United States Patent
Goldman et al.

(10) Patent No.: US 7,319,142 B1
(45) Date of Patent: Jan. 15, 2008

(54) **NUCLEOTIDE AND AMINO ACID SEQUENCES FROM *XENORHABDUS* AND USES THEREOF**

(75) Inventors: Barry S. Goldman, St. Louis, MO (US); Karina Krasomil-Osterfeld, Ellisville, MO (US); Thomas M. Malvar, North Stonington, CT (US); John W. Pitkin, Wildwood, MO (US); Steven C. Slater, Middleton, WI (US); Wei Wu, St. Louis, MO (US); Jiamin Zeng, Ballwin, MO (US)

(73) Assignee: Monsanto Technology LLC, St. Louis, MO (US)

( * ) Notice: Subject to any disclaimer, the term of this patent is extended or adjusted under 35 U.S.C. 154(b) by 0 days.

(21) Appl. No.: 11/216,782

(22) Filed: Aug. 31, 2005

Related U.S. Application Data

(60) Provisional application No. 60/606,098, filed on Aug. 31, 2004.

(51) Int. Cl.
*C07H 21/04* (2006.01)
*C07K 14/00* (2006.01)

(52) U.S. Cl. ................ 536/23.1; 530/350
(58) Field of Classification Search ............... None
See application file for complete search history.

(56) References Cited

U.S. PATENT DOCUMENTS 6,048,838 A * 4/2000 Ensign et al. ............ 514/2

OTHER PUBLICATIONS

☐☐ Khandelwal et al., Insecticidal Activity Associated with the Outer Membrane Vesicles of *Xenorhabdus nematophilus*, Applied and Environmental Microbiology, Apr. 2003, vol. 69, No. 4, pp. 2032-2037.*

* cited by examiner

*Primary Examiner*—Robert B. Mondesi
(74) *Attorney, Agent, or Firm*—Timothy K. Ball; Arnold & Porter LLP

(57) ABSTRACT

The invention provides isolated nucleotide sequences from *Xenorhabdus nematophila* species Xs86068, and, in particular, nucleotide sequences that encode insect inhibitory proteins, the insecticidal proteins, and compositions that comprise one or more of the insecticidal proteins for use in controlling insect infestation.

3 Claims, No Drawings

NUCLEOTIDE AND AMINO ACID SEQUENCES FROM *XENORHABDUS* AND USES THEREOF

CROSS REFERENCE TO RELATED APPLICATIONS

This application claims the benefit of priority to U.S. Provisional Application 60/606,098 filed Aug. 31, 2004.

BACKGROUND OF THE INVENTION

The present invention relates to nucleic acid sequences from *Xenorhabdus nematophila*. The invention also relates to methods of using the disclosed nucleic acid molecules to encode proteins and fragments of proteins and to develop antibodies, for example, for nucleic acid sequence identification and analysis, preparation of constructs, transformation of cells such as bacterial cells and plant cells with the nucleotide compositions disclosed herein to produce *Xenorhabdus* proteins or fragments thereof, in particular novel insect inhibitory, bactericidal, fungicidal and nematocidal proteins.

*Xenorhabdus* is a Gram-negative bacterium, a member of the family of Enterobacteriaceae, and symbiotically associated with nematodes of the genus *Steinernema*. The nematode-bacterial complex can be characterized as an obligate and lethal parasitic relationship, specializing in parasitizing and proliferating in soil insect larvae. Infective, non-feeding stages of these nematodes live in soil and carry in their gut the nematode-genus-specific symbiotic bacteria. It is believed that the nematodes actively search for the appropriate insect host, invade the insect larvae through natural openings or lesions in the cuticle and, once inside the hemolymph, release their symbiotic bacteria. The nematode-bacterial complex secretes a variety of highly efficient extracellular metabolites and proteins exhibiting insecticidal, bactericidal, fungicidal and nematocidal properties to secure the larval mass as a source of nutrition. An array of extracellular enzymes such as lipases, phospholipases, proteases, nucleases as well as several broad spectrum antibiotics, and antifungal and nematocidal compositions are also secreted [Boemare & Akhurst, J. Gen. Microbiol. 134: 751-761, 1988; Li et al., Can. J. Microbiol. 43(8):770-773, 1997; McInerney et al., J. Nat. Prod. 54(3):774-84, 1991; McInerney et al., J. Nat. Prod. 54(3):785-95, 1991; Sundar and Chang, J. Gen. Microbiol. 139 (Pt 12):3139-48, 1993]. It has been discovered that some compounds secreted by *Xenorhabdus* exhibit anti-neoplastic (U.S. Pat. No. 5,827, 872), acaricidal, anti-inflammatory and anti-ulcerogenic properties (U.S. Pat. No. 4,837,222). U.S. Pat. No. 6,048, 838 describes insect inhibitory proteins that exhibit a molecular weight of greater than 100 kDa produced by *Xenorhabdus* sp., which are active against a variety of insect species including the orders, Lepidoptera, Coleoptera, Diptera, and Acarina, when provided in the insect diet.

*Xenorhabdus* strains have been shown to produce an array of extracellular proteins and small molecules or secondary metabolites having specialized functions [Li et al., Can. J. Microbiol. 43(8):770-773, 1997; McInerney et al., J. Nat. Prod. 54(3):774-84, 1991; U.S. Pat. No. 6,048,838]. More commercially interesting are proteins and small molecules having antibiotic properties or proteins that exhibit insect inhibitory activity. A small number of insect inhibitory proteins have previously been identified from these bacteria, symbionts of insect-parasitic nematodes (Morgan et al., Appl. Environ. Microbiol., 67(5):2062-2069, 2001; U.S. Pat. No. 6,048,838). Such proteins and compositions are used as biologically safe and effective pest control agents. Unlike chemical pesticide compositions, these proteins have no effect upon the environment in general, can be targeted to direct their effect primarily upon target insect species, and have no effect on non-target species. Therefore, a different resistance management strategy that takes advantage of insect inhibitory proteins derived from distinct microbial sources other than *B. thuringiensis* would be desirable. Insect inhibitory proteins isolated from *Xenorhabdus* bacteria seem to have all the prerequisites for the delivery of novel genes for transgenic expression of insect pest inhibiting proteins to provide pest resistance to plants, either alone or in combination with *Bacillus thuringiensis* insecticidal proteins.

Therefore, there is a great deal of interest in identifying the genes that encode new insect inhibiting proteins, and proteins involved in the biosynthetic pathways of novel antibiotics produced by *Xenorhabdus* bacteria, as well as other useful proteins. Isolation and sequencing of the entire genome of *Xenorhabdus* would facilitate such an endeavor, because it would allow dissection and analysis of the genome into discrete genes encoding proteins having beneficial properties as described herein.

SUMMARY OF THE INVENTION

In one embodiment, the present invention provides isolated nucleotide sequences from *Xenorhabdus nematophila* bacterium, strain Xs86068. The isolated nucleotide sequences encode at least a group of insect inhibitory proteins that have insecticidal activities against insect pests. The insect inhibitory proteins of the present invention comprises, but are not limited to, the following amino acid sequences: SEQ ID NO:6903, SEQ ID NO:6904, SEQ ID NO:6905, SEQ ID NO:7110, SEQ ID NO:7179, SEQ ID NO:7514, SEQ ID NO:7776, SEQ ID NO:7777, SEQ ID NO:7803, SEQ ID NO:8275, SEQ ID NO:8277, SEQ ID NO:8279, SEQ ID NO:8280, SEQ ID NO:8281, SEQ ID NO:8454, SEQ ID NO:8468, SEQ ID NO:8595, SEQ ID NO:9946, SEQ ID NO:10477, SEQ ID NO:10481, SEQ ID NO:10482, SEQ ID NO:10483, SEQ ID NO:10484, SEQ ID NO:10485, SEQ ID NO:10486, SEQ ID NO:10487, SEQ ID NO:10488, SEQ ID NO:10551, SEQ ID NO:11147, SEQ ID NO:11688, SEQ ID NO:11690, SEQ ID NO:11691, SEQ ID NO:11692, and SEQ ID NO:11693. The insecticidal activities are manifested by inhibiting the growth or development of, or contributing substantially to the death of, an insect from the insect orders Coleoptera [e.g., western corn rootworm (WCR, *Diabrotica virgifera virgifera* LeConte), and cotton boll weevil (BWV, *Anthomonas grandis grandis*), and Hemiptera [e.g., Western Tarnished Plant Bug (WTPB, *Lygus hesperus* Knight)]. The present insect inhibitory proteins also have insecticidal activities against insect pests from other insect orders such as Diptera and Hymenoptera and against sucking and piercing insects or insect larvae.

The isolated nucleotide sequences of the present invention that encode the insect inhibitory proteins comprise, but are not limited to, the following: SEQ ID NO:795, SEQ ID NO:796, SEQ ID NO:797, SEQ ID NO:1002, SEQ ID NO:1071, SEQ ID NO:1406, SEQ ID NO:1668, SEQ ID NO:1669, SEQ ID NO:1695, SEQ ID NO:2167, SEQ ID NO:2169, SEQ ID NO:2171, SEQ ID NO:2172, SEQ ID NO:2173, SEQ ID NO:2346, SEQ ID NO:2360, SEQ ID NO:2487, SEQ ID NO:3838, SEQ ID NO:4369, SEQ ID NO:4373, SEQ ID NO:4374, SEQ ID NO:4375, SEQ ID NO:4376, SEQ ID NO:4377, SEQ ID NO:4378, SEQ ID NO:4379, SEQ ID NO:4380, SEQ ID NO:4443, SEQ ID NO:5039, SEQ ID NO:5580, SEQ ID NO:5582, SEQ ID NO:5583, SEQ ID NO:5584 and SEQ ID NO:5585.

In another embodiment, the present invention provides purified insect inhibitory proteins from *Xenorhabdus nematophila* bacterium, strain Xs86068, which are active against insect pests. The insect inhibitory proteins of the present invention at least comprises, but are not limited to, the following amino acid sequences: SEQ ID NO:6903, SEQ ID NO:6904, SEQ ID NO:6905, SEQ ID NO:7110, SEQ ID NO:7179, SEQ ID NO:7514, SEQ ID NO:7776, SEQ ID NO:7777, SEQ ID NO:7803, SEQ ID NO:8275, SEQ ID NO:8277, SEQ ID NO:8279, SEQ ID NO:8280, SEQ ID NO:8281, SEQ ID NO:8454, SEQ ID NO:8468, SEQ ID NO:8595, SEQ ID NO:9946, SEQ ID NO:10477, SEQ ID NO:10481, SEQ ID NO:10482, SEQ ID NO:10483, SEQ ID NO:10484, SEQ ID NO:10485, SEQ ID NO:10486, SEQ ID NO:10487, SEQ ID NO:10488, SEQ ID NO:10551, SEQ ID NO:11147, SEQ ID NO:11688, SEQ ID NO:11690, SEQ ID NO:11691, SEQ ID NO:11692, and SEQ ID NO:11693.

In still another embodiment, the present invention provides an insecticidal composition that comprises one or more insect inhibitory proteins as specified above having an amino acid sequence selected from the group consisting of SEQ ID NO:6903, SEQ ID NO:6904, SEQ ID NO:6905, SEQ ID NO:7110, SEQ ID NO:7179, SEQ ID NO:7514, SEQ ID NO:7776, SEQ ID NO:7777, SEQ ID NO:7803, SEQ ID NO:8275, SEQ ID NO:8277, SEQ ID NO:8279, SEQ ID NO:8280, SEQ ID NO:8281, SEQ ID NO:8454, SEQ ID NO:8468, SEQ ID NO:8595, SEQ ID NO:9946, SEQ ID NO:10477, SEQ ID NO:10481, SEQ ID NO:10482, SEQ ID NO:10483, SEQ ID NO:10484, SEQ ID NO:10485, SEQ ID NO:10486, SEQ ID NO:10487, SEQ ID NO:10488, SEQ ID NO:10551, SEQ ID NO:11147, SEQ ID NO:11688, SEQ ID NO:11690, SEQ ID NO:11691, SEQ ID NO:11692, and SEQ ID NO:11693. The insecticide composition disclosed herein may comprise one of the following: insecticidal protein suspensions, isolated protein components or bacterial cells that are transformed with one or more nucleotide sequences that encode the insecticidal inhibitory proteins of the invention. The insecticidal composition may be formulated in the form of a dust, a granular material, an oil (vegetable or mineral) suspension, a water suspension, a mixture of oil and water emulsion, or a wettable powder, or in combination with an agriculturally acceptable carrier that may be solid or liquid.

In a further embodiment, the present invention provides an isolated *Xenorhabdus nematophila* bacterium, strain Xs86068. The inventors have demonstrated that this strain exhibits insecticidal activity against commercially important insect species including, e.g., those in the orders Coleoptera (e.g., WCR, BWV), and Hemiptera (e.g., WTPB). The strain may have insecticidal activity against other insects including, e.g., Dipteran and Hymenopteran insects, or a sucking and piercing insect or an insect larva thereof. The insect inhibitory proteins also have insecticidal activities against insect pests from other insect orders. This strain may be used as a source for DNA sequences encoding insecticidal proteins, and when formulated into a composition of matter as a spray, powder or emulsion, for the treatment of plants or animals to inhibit insect infestation. The Xs86068 strain was deposited on Jul. 26, 2004, with the Agriculture Research Culture Collection (NRRL) International Depository Authority at 1815 North University Street, in Peoria, Ill. 61604 U.S.A., according to the Budapest Treaty on the International Recognition of the Deposit of Microorganisms for the Purpose of Patent Procedures and was designated as NRRL B-30757.

The present invention relates to a plant cell, a mammalian cell, a bacterial cell other than a *X. nematophila* Xs86068 cell, an algal cell, an insect cell and a fungal cell transformed with an isolated nucleic acid molecule of the present invention that is selected from the group consisting of SEQ ID NO:795, SEQ ID NO:796, SEQ ID NO:797, SEQ ID NO:1002, SEQ ID NO:1071, SEQ ID NO:1406, SEQ ID NO:1668, SEQ ID NO:1669, SEQ ID NO:1695, SEQ ID NO:2167, SEQ ID NO:2169, SEQ ID NO:2171, SEQ ID NO:2172, SEQ ID NO:2173, SEQ ID NO:2346, SEQ ID NO:2360, SEQ ID NO:2487, SEQ ID NO:3838, SEQ ID NO:4369, SEQ ID NO:4373, SEQ ID NO:4374, SEQ ID NO:4375, SEQ ID NO:4376, SEQ ID NO:4377, SEQ ID NO:4378, SEQ ID NO:4379, SEQ ID NO:4380, SEQ ID NO:4443, SEQ ID NO:5039, SEQ ID NO:5580, SEQ ID NO:5582, SEQ ID NO:5583, SEQ ID NO:5584, and SEQ ID NO:5585. In an event when a bacterial cell is used, the bacterium may be selected from the group consisting of *Bacillus, Agrobacterium, Pseudomonas, Rhizobium, Erwinia, Azotobacter, Azospirillum, Klebsiella, Flavobacterium* and *Alcaligenes*.

Both the isolated nucleotide sequences and the amino acid sequences of the present invention are provided in the Sequence Listing file in electronic format that also includes other nucleotide and amino acid sequences, all of which are set forth in SEQ ID NO:1 through SEQ ID NO:16918, the electronic copy being included on the CD-ROM that accompanies this specification.

Various advantages and features of the present invention will become hereinafter apparent, and the nature of the invention may be more clearly understood, by reference to the following detailed description of the embodiments of the invention and to the appended claims.

BRIEF DESCRIPTION OF THE SEQUENCES

All the nucleotide and amino acid sequences as set forth in SEQ ID NO:1 through SEQ ID NO:16918 and as categorized below are provided in electronic format within the Sequence Listing file, the electronic copy being included on the CD-ROM that accompanies this specification.

SEQ ID NO:1 through SEQ ID NO:6108 are nucleotide sequences isolated from *X. nematophila* strain Xs86068. Each of these nucleotide sequences reside within a larger sequence referred to as a contig sequence, and are cross referenced in the SEQ LISTING file with reference to SEQ ID NO:'s corresponding to a particular contig sequence.

SEQ ID NO:6109 through SEQ ID NO:12216 represent amino acid sequences encoded by the nucleotide sequences as set forth at SEQ ID NO:1 through SEQ ID NO:6108, respectively. SEQ ID NO:6109 represents the amino acid sequence translation of SEQ ID NO:1, SEQ ID NO:6110 represents the amino acid sequence translation of SEQ ID NO:2, and so on and so forth.

SEQ ID NO:12217 through SEQ ID NO:14867 represent predicted promoter nucleotide sequences isolated from *X. nematophila* strain Xs86068.

SEQ ID NO:14868 through SEQ ID NO:16342 represent terminator nucleotide sequences isolated from *X. nematophila* strain Xs86068.

SEQ ID NO:16343 through SEQ ID NO:16424 represent nucleotide sequences isolated from *X. nematophila* strain Xs86068 encoding tRNA's and rRNA's.

SEQ ID NO:16425 through SEQ ID NO:16918 represent the contig sequences.

DETAILED DESCRIPTION OF THE INVENTION

In accordance with the present invention, novel nucleic acid molecules have been isolated from a bacterium *X. nematophila*, strain Xs86068, and their encoded polypeptides or proteins are provided. Isolated nucleic acid molecules comprising regulatory elements that include promoter and terminator sequences are also provided. In a preferred embodiment, the present invention provides isolated nucleic acid molecules that encodes a class of proteins that exhibits insect inhibitory activity, wherein the activity is manifested by inhibiting the growth or development of, or contributing substantially to, or causing the death of an insect, such as a Coleopteran, a Dipteran, a Lepidopteran, a Hemipteran, a Hymenopteran, or a sucking and piercing insect or insect larvae thereof. Therefore, those skilled in the art will find the utility of these insecticidal proteins in protecting plants from insect infestations.

The present invention also provides isolated nucleic acid molecules encoding other types of useful proteins and compositions, e.g., insect inhibitory proteins, microbial inhibitory proteins including bactericidal and fungistatic proteins, nematocidal and protein homologs of chitinases, histones and restriction enzymes, proteases, proteins capable of conferring resistance to heavy metals or other toxic compositions, polyketide synthases, among others.

The present invention relates to methods of obtaining the disclosed nucleic acid molecules and proteins and of using the disclosed nucleic acid molecules, proteins, fragments of proteins, and antibodies, for example, for gene identification and analysis, preparation of constructs, transformation of cells with nucleotide compositions disclosed herein to produce *Xenorhabdus* proteins or fragments thereof, in particular novel insect inhibitory, bactericidal, fungicidal and nematocidal proteins.

Three CD ROM diskettes are provided along with the application as filed including a first CD-ROM diskette containing the Sequence Listing as filed, this diskette being labeled as the CRF (computer readable form), and two additional CD-ROM diskettes each consecutively labeled as Copy 1 and Copy 2. There is a single file on each of these three diskettes. The CRF copy of the Sequence Listing and the Copy 1 and Copy 2 Sequence Listing are the same. Each diskette was produced using an IBM-PC type machine, using an MS-DOS operating system running MS-Windows. The Sequence Listing file was created on Aug. 5, 2005, and the diskettes were produced by writing the file to the diskettes on Aug. 31, 2005. The file on the diskettes was provided the filename "52053B Xeno Seq Listing.txt", the file is 28.005 megabytes in size, and is a text file that lists SEQ ID NO's sequentially from SEQ ID NO:1 through SEQ ID NO:16,918. The Sequence Listing is incorporated by reference into the specification in its entirety.

One aspect of the present invention relates to an isolated nucleic acid molecule having a nucleotide sequence, wherein: (1) the nucleotide sequence hybridizes under stringent conditions to a nucleotide sequence of a second isolated nucleic acid molecule selected from the group consisting of SEQ ID NO:1 through SEQ ID NO:6108 or complements thereof, (2) the nucleotide sequence is a portion of any sequence selected from the group consisting of SEQ ID NO:1 through SEQ ID NO:6108; or (3) the nucleotide sequence is the complement of (1) or (2).

The term "an isolated nucleic acid" refers to a nucleic acid that is no longer accompanied by some of materials with which it is associated in its natural state or to a nucleic acid the structure of which is not identical to that of any of naturally occurring nucleic acid. Examples of an isolated nucleic acid include: (1) DNAs which have the sequence of part of a naturally occurring genomic DNA molecules, but are not flanked by two coding sequences that flank that part of the molecule in the genome of the organism in which it naturally occurs; (2) a nucleic acid incorporated into a vector or into the genomic DNA of a prokaryote or eukaryote in a manner such that the resulting molecule is not identical to any naturally occurring vector or genomic DNA; (3) a separate molecule such as a cDNA, a genomic fragment, a fragment produced by polymerase chain reaction (PCR), or a restriction fragment; (4) recombinant DNAs; and (5) synthetic DNAs. An isolated nucleic acid may also be comprised of one or more segments of cDNA, genomic DNA or synthetic DNA.

Stringent conditions are sequence dependent and will be different under various circumstances. Generally, stringent conditions are selected to be about 5° C. lower than the thermal melting point (Tm) for the specific sequence at a defined ionic strength and pH. The Tm is the temperature (under defined ionic strength and pH) at which 50% of the target sequence hybridizes to a perfectly matched probe. Appropriate stringent conditions are known to those skilled in the art or can be found in *Current Protocols in Molecular Biology*, John Wiley & Sons, N.Y. 6.3.1-6.3.6 (1989). For the purposes of this disclosure, stringent conditions include at least one wash (usually 2) in 0.2×SSC at a temperature of at least about 50° C., usually about 55° C., for 20 minutes, or equivalent conditions.

The hybridization portion of the two hybridizing nucleic acids is usually at least 50 nucleotides in length, more usually at least about 75 nucleotides in length, more particularly at least 100 nucleotides in lengths. The hybridizing portion of the hybridizing nucleic acid is at least 70%, at least 80%, at least 90%, or at least 98% identical to the sequence of a portion of a sequence as set forth in SEQ ID NO:1 to SEQ ID NO:6108.

Another aspect of the present invention relates to an isolated nucleic acid molecule comprising one or more open reading frames as set forth in SEQ ID NO:1 to SEQ ID NO:6108. An "open reading frame" (ORF) is a region of a nucleotide sequence that encodes a polypeptide. This region may represent a portion of a coding sequence or a total coding sequence. Open reading frames in genomic sequences can be screened for the presence of protein homologues utilizing one or a number of different search algorithms that have been developed, one example of which are the suite of programs referred to as BLAST programs. The open reading frames identified in the isolated nucleic acid molecules comprise SEQ ID NO:1 through SEQ ID NO:6108, wherein the open reading frames encode *Xenorhabdus* proteins or polypeptide or fragments thereof which are homologues of known proteins or unknown proteins. It has been discovered that the nucleic acids and amino acids encoded by the nucleic acids derived from *Xenorhabdus* species (bacteria commonly symbiotically associated with insect pathogenic nematodes) are surprisingly useful in providing compositions comprising insect inhibitory proteins, microbial inhibitory proteins including bactericidal, bacteriostatic, fungicidal, and fungistatic proteins, protein homologs of chitinases, histones and restriction enzymes, proteases, proteins capable of conferring resistance to heavy metals or other toxic compositions, proteins and compositions capable of conferring pharmaceutical advantages such as antineoplastic, acaricidal, anti-inflammatory and anti-ulcerogenic properties, polyketide synthases, transposons and mobile genetic elements and their corresponding transposases, excisases, integrases, and invertases, phage and phage particle proteins, other useful proteins homologous to proteins derived from *Xenorhabdus, Photorhabdus, Serratia, Yersinia, Salmonella, E. coli*, and *Erwinia* sp. among others. In addition, antibodies directed to the above-mentioned proteins and fragments thereof have been discovered to be of particular utility in the present invention. The invention also relates to methods of using the disclosed nucleic acid molecules, proteins, fragments of proteins, and antibodies, for example, for nucleotide sequence identification and analysis, preparation of constructs, transformation of cells with nucleotide compositions disclosed herein to produce *Xenorhabdus* proteins or fragments thereof, in particular novel insect inhibitory, bactericidal and fungicidal proteins.

The present invention provides an isolated nucleic acid molecule comprising a nucleotide sequence, wherein: (1) the nucleotide sequence hybridizes under stringent conditions to a nucleotide sequence of a second isolated nucleic acid molecule, wherein the hybridizing portion of the nucleotide sequence of the second isolated nucleic acid molecule encodes a polypeptide or protein having an amino acid sequence selected from the group consisting of SEQ ID NO:6109 to SEQ ID NO:12216; (2) the nucleotide sequence encodes a polypeptide or protein, wherein the amino acid sequence of the polypeptide or protein is substantially identical to any one set forth in SEQ ID NO:6109 to SEQ ID NO:12216; or (3) the nucleotide sequence is the complement of (1) or (2). In one embodiment, the nucleotide sequence is or is a portion of the isolated nucleic acid molecule as disclosed herein, selected from the group consisting of SEQ ID NO:1 to SEQ ID NO:6108. The present invention provides an isolated protein having an amino acid sequence that is substantially identical to a member selected from group consisting of SEQ ID NO:6109 through SEQ ID NO:12216. By "substantially identical" or "substantial identity" as used in reference to two amino acid sequences, it is meant that one amino acid sequence is identical to the other amino acid sequence or has at least 50% sequence identity, at least 70% sequence identity, preferably at least 80%, more preferably at least 90%, and most preferably at least 95% identity when compared to the other amino acid sequence as a reference sequence using the programs described herein, preferably BLAST using standard parameters, as described below. "Sequence identity" is determined by comparing two optimally aligned sequences over a comparison window, wherein the portion of the polynucleotide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity.

Polypeptides that are substantially similar share sequences in which residue positions are not identical and may differ by conservative amino acid changes. Conservative amino acid substitutions refer to the interchangeability of residues having similar side chains. "Conservative amino acid substitutions" refer to substitutions of one or more amino acids in a native amino acid sequence with another amino acid(s) having similar side chains, resulting in a silent change. Conserved substitutes for an amino acid within a native amino acid sequence can be selected from other members of the group to which the naturally occurring amino acid belongs.

Optimal alignment of sequences for comparison can use any means to analyze sequence identity (homology) known in the art, e.g., by FGENESB (Softberry, Inc., Mount Kisco, N.Y.) that is based on Markov chain models of coding regions and translation and termination sites, by the BLAST algorithm (Altschul et al, J. Mol. Biol. 215: 403-410, 1990) that is suitable for determining sequence similarity; by the progressive alignment method of termed "PILEUP" (Morrison, Mol. Biol. Evol. 14:428-441, 1997); or by the local homology algorithm of Smith & Waterman (Adv. Appl. Math. 2: 482, 1981). One skilled in the art will recognize that a value of sequence identity can be appropriately adjusted to determine corresponding sequence identity of two nucleotide sequences encoding the proteins of the present invention by taking into account codon degeneracy, conservative amino acid substitutions, reading frame positioning and the like. Substantial identity of nucleotide sequences for these purposes normally means sequence identity of at least 50%, preferably at least 60%, more preferably at least 70%, more preferably at least 80%, more preferably at least 90%, and most preferably at least 95%. The present invention also includes an isolated nucleic acid comprising a nucleotide sequence encoding a polypeptide having an amino acid sequence set forth in any of SEQ ID NO:6109 to SEQ ID NO:12216 with conservative amino acid substitutions.

In a preferred embodiment of the present invention, the isolated nucleic acid molecule comprising a nucleotide sequence encodes an insect inhibitory protein. The nucleotide sequence encodes all or substantial portion of a polypeptide the amino acid sequence of which is substantially identical to one of the sequences as set forth in SEQ ID NO's: 6903, 6904, 6905, 7110, 7179, 7514, 7776, 7777, 7803, 8275, 8277, 8279, 8280, 8281, 8454, 8468, 8595, 9946, 10477, 10481, 10482, 10483, 10484, 10485, 10486, 10487, 10488, 10551, 11147, 11688, 11690, 11691, 11692 and 11693, wherein the nucleotide sequence is selected from the group consisting of SEQ ID NO's:795, 796, 797, 1002, 1071, 1406, 1668, 1669, 1695, 2167, 2169, 2171, 2172, 2173, 2346, 2360, 2487, 3838, 4369, 4373, 4374, 4375, 4376, 4377, 4378, 4379, 4380, 4443, 5039, 5580, 5582, 5583, 5584 and 5585. The phrase "an insecticidal protein" or "an insect inhibitory protein" refers to any polypeptide or protein or a substantial portion thereof that exhibits insect inhibitory activity, wherein the activity is manifested by inhibiting the growth or development of, or contributing substantially to, or causing the death of a Coleopteran, a Dipteran, a Lepidopteran, a Hemipteran, a Hymenopteran, or a sucking and piercing insect or insect larvae thereof. It also refers to any polypeptide or protein with modified amino acid sequence, such as sequence which has been mutated, truncated, increased and the like and which maintains at least the insect inhibitory activity associated with the native protein. Accordingly, the isolated nucleic acids encoding those polypeptide or protein with such modification are also within the scope of the present invention.

The insect inhibitory proteins of the present invention may share some homology to known insecticidal proteins. For instance, the polypeptide sequence as set forth in SEQ ID NO: 6903 exhibits 71% amino acid sequence homology to an insecticidal toxin complex protein TccB2 from *Photorhabdus luminescens laumondii*. The polypeptide sequence as set forth in SEQ ID NO: 6905 exhibits 61% amino acid sequence homology to an insecticidal toxin complex protein TccA2 from *Photorhabdus luminescens laumondii*. The polypeptide sequence as set forth in SEQ ID NO: 7110 exhibits 57% amino acid sequence homology to an insecticidal toxin complex protein TccC from *Photorhabdus luminescens laumondii*, etc.

In another aspect of the present invention, the isolated nucleic acid molecule encodes all or a portion of a protein homologue to a known protein and may have important utility. For example, the isolated nucleic acid molecule encodes all or a portion of a hemolysin lipase protein homologue wherein the amino acid sequence of the protein homologue is substantially identical to one of the sequences as set forth in SEQ ID NO's: 6531, 6578, 6696, 7505, 7679, 7793, 7939, 8216, 8220, 8222, 8366, 8745, 9199, 9212, 10143, 10306, 10325, 10683, 10919, 10995, 10996, 11246, 11991 and 12000.

The isolated nucleic acid molecule comprising a nucleotide sequence encodes all or a portion of a polyketide synthase homologue, wherein the amino acid sequence of the protein homologue is substantially identical to one of the sequences as set forth in SEQ ID NO's: 7253, 8852, 8857, 8864, 9558, 9560, 11014, 11583, 11587, 12090 and 12112. Polyketides are small bioactive molecules that are a class of small compounds linked by their biosynthetic pathways. The pathways and their products are particularly abundant in soil microorganisms including *Xenorhabdus nematophila*. A large number of major pharmaceutical and agricultural products have been derived from these complex natural products including insecticides, fungicides, antibacterials, anti-inflammatory, cancer-fighting agents, and cholesterol-lowering agents. Examples of polyketides include Rifamycins (Rifampin), Adriamycin (Doxorubicin), Erythromycin, Mevacor (Lovastatin), Ascomycin (Immunomycin), and Spinosad. Polyketides are produced by large proteins called synthases (or synthetases). There are an extraordinary number of polyketides synthases from *Xenorhabdus*. In addition to polyketide synthases *Xenorhabdus* also contains an extraordinary number of related proteins called non-ribosomal peptide synthases (NRP synthase). These proteins also generate small molecules with a variety of biochemical functions. It is possible that any of these genes can be placed into the genome of a plant and produces a substance (polyketide or non-ribosomal peptide) that can protect a plant against damage from insects, fungi, or bacteria. In addition, these genes can be placed in plants to generate polyketides or non-ribosomal peptide for other uses including pharmaceuticals.

The isolated nucleic acid molecule comprising a nucleotide sequence encodes all or a portion of a protease homologue, wherein the amino acid sequence of the protein homologue is substantially identical to one of the sequences as set forth in SEQ ID NO's: 6308, 6309, 6310, 6393, 6537, 6549, 6595, 6774, 6941, 6942, 7199, 7289, 7328, 7503, 7627, 7682, 7683, 7749, 8152, 8300, 8301, 8870, 8957, 9108, 9263, 9265, 9296, 9319, 9343, 9720, 9725, 9748, 9749, 9884, 10246, 10385, 10461, 10588, 10614, 10896, 11020, 11830, 11831 and 11901. Protease plays very important roles in an organism's metabolism and proteins synthesis and several types of proteases have been reported. A processing protease is a protease that cleaves a propeptide to generate a mature biochemically active polypeptide (Enderlin and Ogrydziak, Yeast 10:67-79, 1994). Serine protease is required for intramitochondrial proteolysis and maintenance of respiratory function. Ubiquitin-specific protease (ubiquitin C-terminal hydrolase) of the 26S proteasome complex is involved in vacuole biogenesis and osmoregulation. Inner membrane protease of mitochondria acts in complex with IMP1P but has different substrate specificity for removal of signal peptidase serine protease of the subtilisin family with broad proteolytic specificity (U.S. Pat. No. 6,723,837). Therefore, the nucleotide sequences may find utility for those skilled in the art in generating useful traits in plants or other organisms using available techniques.

The isolated nucleic acid molecule comprising a nucleotide sequence encodes all or a portion of a chitinase homologue, wherein the amino acid sequence of the protein homologue is substantially identical to one of the sequences as set forth in SEQ ID NO's: 6902, 6906, 7325, 8047 and 10542. The genes encoding these protein homologues may be overexpressed in plants as antifungal proteins to control fungal diseases in plants. A chitinase is one of several classes of antifungal proteins identified that include chitinases, defensins, cysteine-rich chitin-binding proteins, β-1,3-glucanases, permatins (including zeamatins), thionins, ribosome-inactivating proteins, and non-specific lipid transfer proteins (U.S. Pat. No. 6,573,361).

The isolated nucleic acid molecule comprising a nucleotide sequence encodes all or a portion of a restriction enzyme homologue, wherein the amino acid sequence of the protein homologue is substantially identical to one of the sequences as set forth in SEQ ID NO's: 8941, 8945, 9353, 11041, 11042, 11113 and 11114. "Restriction enzyme" refers to an enzyme that recognizes a specific palindromic sequence of nucleotides in double stranded DNA and cleaves both strands. Cleavage typically occurs within the restriction site. It is obvious to those skilled in the art about the utility of these nucleotide sequences encoding the restrictions enzyme homologues.

The isolated nucleic acid molecule comprising a nucleotide sequence encodes all or a portion of a histone homologue, wherein the amino acid sequence of the protein homologue is substantially identical to one of the sequences as set forth in SEQ ID NO's: 6182, 7457, 7980, 8272, 8605, 8765, 8778, 8861, 9590, 9802, 10293, 10449, 10469, 10762, 10812, 10926, 11206, 11677 and 12135. Histones were not previously found in bacteria. However, histones are abundant and required for DNA organization in all eukaryotes. Genes with homology to histones and proteins that affect histones, such histone deacetylases may affect histones in insects, disrupting normal cellular processes.

The isolated nucleic acid molecule comprising a nucleotide sequence encodes all or a portion of a ferritin homologue the amino acid sequence of which is substantially identical to one of the sequences as set forth in SEQ ID NO's: 6267, 6268 and 9272. These proteins may be used for overexpression in plants may result in an increase of resistance to abiotic and biotic oxidative stresses. Overexpression of ferritin promotes cellular productivity during limited water conditions to prevent formation of oxygen radicals (US Pat. Appl. Pub. No. 20030233670).

The isolated nucleic acid molecule comprising a nucleotide sequence encodes all or a portion of a drug metabolite transporter protein homologue, the amino acid sequence of which is substantially identical to one of the sequences as set forth in SEQ ID NO's: 6836, 6837, 7447, 8274, 8701, 9071, 9100, 9579, 10205, 10446, 10456, 10604, 10737 and 11018.

The isolated nucleic acid molecule comprising a nucleotide sequence encodes all or a portion of a protein homologue capable of conferring resistance to heavy metals, wherein the amino acid sequence of the protein homologue is substantially identical to one of the sequences as set forth in SEQ ID NO's: 7432, 7741, 8701, 8706, 8828, 8829, 9071, 9181, 9271, 10600 and 11018. Those genes may be introduced into crop plants to provide for resistance to a heavy metal in a poor growing conditions (U.S. Pat. No. 6,426,447). Therefore, those skilled in the art will find the utility of these nucleotide sequences in trait development in plants.

The isolated nucleic acid molecule comprising a nucleotide sequence encodes all or a portion of a RTX (repeats in toxin) homologue, the amino acid sequence of which is substantially identical to one of the sequences as set forth in SEQ ID NO's: 9946, 10551 and 10643. RTX belongs to the cytolytic toxin family. Within the medical sciences, there is growing interest in the potential utility of purified mammalian antibodies in the diagnosis and treatment of disease. For example, tagged antibodies directed against tumor cell surface antigens provide a highly sensitive and specific means for detecting and classifying various cancers. One therapeutic application using antibodies involves the administration of purified tumor-specific antibodies that are chemically coupled to cytotoxic agents. A class of cytotoxins that holds particular promise in the treatment of cancers consists of protein toxins from plants. However, progress in the treatment of cancers using chemically coupled antibodies and cytotoxins has been impeded by the lack of a cost effective means for producing these molecules in a pharmaceutically acceptable grade and in commercially acceptable quantities. Therefore, the nucleotide sequences of the invention encoding the cytotoxin homologs may be overexpressed in plants and large quantities of the cytotoxin proteins may be produced, isolated and purified from the plants. These purified toxins may be used as a therapeutic agent (U.S. Pat. No. 6,140,075).

The isolated nucleic acid molecule comprising a nucleotide sequence encodes all or a portion of a PapA protein homologue, the amino acid sequence of which is substantially identical to the sequence set forth in SEQ ID NO: 7514. PapA is shown to have cytotoxicity to larval hemocyes of an insect and, therefore, may be used as an insecticidal protein (Khandelwal et al., Biochem. Biophy. Res. Commun. 314: 943-949, 2004).

The isolated nucleic acid molecule comprising a nucleotide sequence encodes all or a portion of a pyoverdin protein homologue, the amino acid sequence of which is substantially identical to the sequence set forth in SEQ ID NO: 6598. Pyoverdin is a fluorescent siderophore secreted by *Pseudomonas aeruginosa* group. It's used to help the microbe leech iron out of its surroundings and is produced mostly in iron deficient environments. Pyoverdin competes directly with transferrin for iron and that it is an essential element for in vivo iron gathering and virulence expression in *P. aeruginosa*. It is indicated that it plays essential role in bacterial growth and development (Meyer et al., Infect Immun. 64 (2): 518-523, 1996).

The isolated nucleic acid molecule comprising a nucleotide sequence encodes all or a portion of a Zinc finger protein homologue, the amino acid sequence of which is substantially identical to the sequence as set forth in SEQ ID NO: 8011. A zinc finger is part of a protein that can bind to DNA. Zinc-finger proteins regulate the expression of genes as well as nucleic acid recognition, reverse transcription, signal transduction and virus assembly and have prominent roles in many other cellular processes. Therefore, Zinc finger proteins and their metal binding sites are promising targets for specific drug design to help ameliorate major diseases (Hanas et al., In: Zinc Finger proteins: from atomic contact to cellular function, edited by Iuchi and Kuldell, 2004).

The isolated nucleic acid molecule comprising a nucleotide sequence encodes all or a portion of an enterochelin protein homologue, the amino acid sequence of which is substantially identical to the sequence as set forth in SEQ ID NO: 8528. Enterochelin proteins are iron-binding compound of *E. coli* and *Salmonella* spp. may have utilities in antibacterial arena (Antimicrob Agents Chemother. 18 (1): 63-68, 1980).

The isolated nucleic acid molecule comprising a nucleotide sequence encodes all or a portion of a nonribosomal peptide homologue, the amino acid sequence of which is substantially identical to one of the sequences as set forth in SEQ ID NO's: 6870, 7462, 7463, 8248, 8339, 8492, 8530, 8546, 8547, 8856, 8860, 8863, 9225, 9226, 9227, 9552, 10073, 10506, 10726, 11003, 11004, 11005, 11012, 11013, 11015, 11584, 11585, 11588, 11590, 11591, 11844, 11845, 12085 and 12089.

The isolated nucleic acid molecule comprising a nucleotide sequence encodes all or a portion of a protein homologous to a protein from a *Drosophila* species the amino acid sequence of which is substantially identical to the sequence as set forth in SEQ ID NO: 7909. The gene encoding a protein homologous to a protein from *Drosophila* may affect pathogenesis in insects.

The present invention also relates to a class of isolated nucleic acid molecules comprising promoter sequences or regulatory elements, particularly those found within SEQ ID NO:12217 through SEQ ID NO:14867 or complements thereof. Particularly, the promoter sequence comprises a nucleotide sequence, wherein: (1) the nucleotide sequence hybridized under stringent conditions to a nucleotide sequence of a second isolated nucleic acid molecule selected from the group consisting of SEQ ID NO:12217 through SEQ ID NO:14867 or complements thereof; (2) the nucleotide sequence is a portion of any sequence selected from the group consisting of SEQ ID NO:12217 through SEQ ID NO:14867; or (3) the nucleotide sequence is the complement of (1) or (2). As used herein, the term "promoter" or "promoter sequence" means a nucleotide sequence that is capable of, when located in cis to a structural nucleotide sequence encoding a polypeptide or protein, functioning in a way that directs expression of one or more mRNA molecules that encodes the polypeptide or protein. Such promoter regions are typically found upstream of the trinucleotide, ATG, at the start site of a polypeptide-coding region. Promoter molecules can also include DNA sequences from which transcription of tRNA or rRNA sequences are initiated.

The present invention also relates to an isolated nucleic acid molecule comprising terminator sequences, particularly those found within SEQ ID NO:14868 through SEQ ID NO:16342 or complements thereof and refers to a nucleotide sequence that is required for the termination reaction of the transcription process. Termination involves recognition of the point at which no further bases should be added to a growing RNA chain. To terminate transcription, the formation of phosphodiester bonds must cease and the transcription complex must come apart. When the last base is added to the RNA chain, the RNA-DNA hybrid is disrupted, the DNA reforms into a duplex state, and the RNA polymerase enzyme and RNA molecule are both released from the DNA.

The present invention also relates to an isolated nucleic acid molecule that encodes ribosomal RNA (rRNA), transfer RNA (tRNA) molecules. Particularly, the isolated nucleic acid molecule comprise a nucleotide sequence, wherein: (1) the nucleotide sequence hybridized under stringent conditions to a nucleotide sequence of a second isolated nucleic acid molecule selected from the group consisting of SEQ ID NO:16343 through SEQ ID NO:16424 or complements thereof; (2) the nucleotide sequence is a portion of any sequence selected from the group consisting of SEQ ID NO:16343 through SEQ ID NO:16424; or (3) the nucleotide sequence is the complement of (1) or (2).

The isolated nucleic acid molecules of the present invention also include those comprising a substantial portion of a nucleotide sequence selected from the group consisting of SEQ ID NO:1 through SEQ ID NO:6108 or complements thereof. A "substantial portion" of a nucleotide sequence comprises enough of the sequence to afford specific identification and/or isolation of a nucleic acid fragment comprising the sequence. In general, gene specific oligonucleotide probes comprising 20-30 contiguous nucleotides may be used in sequence-dependent methods of gene identification (e.g., Southern hybridization) and isolation (e.g., in situ hybridization of bacterial colonies or bacteriophage plaques). In addition, short oligonucleotides of 12-15 bases may be used as amplification primers in PCR in order to obtain a particular nucleic acid fragment comprising the primers. The skilled artisan, having the benefit of the sequences as reported herein, may now use all or a substantial portion of the disclosed sequences for purposes known to him or her in this art. Accordingly, the present invention comprises the complete sequences as reported in the accompanying Sequence Listing, as well as substantial portions of those sequences as defined above.

The nucleic acids of the present invention may be used to isolate nucleic acids encoding homologous proteins from the same or other species, such as *Photorhabdus, Serratia, Yersinia, Salmonella, E. coli,* and *Erwinia* sp. Isolation of homologous genes using sequence-dependent protocols is well known in the art. Examples of sequence-dependent protocols include, but are not limited to, methods of nucleic acid hybridization, and methods of DNA and RNA amplification as exemplified by various uses of nucleic acid amplification technologies (e.g., polymerase chain reaction, ligase chain reaction).

For example, genes encoding homologous proteins, either as cDNA's or genomic DNA's, could be isolated directly by using all or a portion of the nucleic acids of the present invention as DNA hybridization probes to screen cDNA or genomic libraries from any desired organism employing methodology well known to those skilled in the art. Methods for forming such libraries are well known in the art (Sambrook et al., Molecular Cloning: A Laboratory Manual; Cold Spring Harbor Laboratory Press, Cold Spring Harbor, 1989). Specific oligonucleotide probes based upon the nucleic acids of the present invention can be designed and synthesized by methods known in the art. Moreover, the entire sequences of the nucleic acids can be used directly to synthesize DNA probes by methods known to the skilled artisan such as random primer DNA labeling, nick translation, or end-labeling techniques, or RNA probes using available in vitro transcription systems. In addition, specific primers can be designed and used to amplify a part or all of the sequences. The resulting amplification products can be labeled directly during amplification reactions or labeled after amplification reactions, and used as probes to isolate full-length cDNA or genomic DNAs under conditions of appropriate stringency. Two short segments of the nucleic acids of the present invention may also be used in polymerase chain reaction protocols, for example, the RACE protocol (Frohman et al., Proc. Natl. Acad. Sci. USA 85:8998, 1988), to amplify longer nucleic acids encoding homologous genes from DNA or RNA from other sources.

Nucleic acids of interest may also be synthesized, either completely or in part, especially where it is desirable to provide plant-preferred sequences, by well-known techniques as described in the technical literature. See, e.g., Carruthers et al. (Cold Spring Harbor Symp. Quant. Biol. 47:411-418, 1982) and Adams et al. (J. Am. Chem. Soc. 105:661, 1983). Thus, all or a portion of the nucleic acids of the present invention may be synthesized using codons preferred by a selected plant host. Plant-preferred codons may be determined, for example, from the codons used in the proteins expressed in a particular plant host species (Brown et al., U.S. Pat. No. 5,689,052). Other modifications of the gene sequences may result in mutants having slightly altered activity.

Availability of the nucleotide sequences encoding *Xenorhabdus* proteins facilitates immunological screening of DNA expression libraries. Synthetic polypeptides representing portions of the amino acid sequences of *Xenorhabdus* proteins may be synthesized. These polypeptides can be used to immunize animals to produce polyclonal or monoclonal antibodies with specificity for polypeptides or proteins comprising the amino acid sequences. These antibodies can be then be used to screen expression libraries to isolate genes of interest (Lerner, Adv. Immunol 36: 1, 1984). It is understood that those skilled in the art are familiar with the standard resource materials that describe specific conditions and procedures for the construction, manipulation and isolation of antibodies (see, for example, Harlow and Lane, In *Antibodies: A Laboratory Manual*, Cold Spring Harbor Press, Cold Spring Harbor, N.Y., 1988).

The present invention relates to a method for obtaining a nucleic acid from a cell other than a *Xenorhabdus* Xs86068 cell comprising a nucleotide sequence encoding a *Xenorhabdus* protein homologue the amino acid sequence of which is at least 70% identical to a member selected from the group consisting of SEQ ID NO:6109 to SEQ ID NO:12216. In a preferred embodiment, the method of the present invention for obtaining a nucleic acid encoding all or a substantial portion of the amino acid sequence of a *Xenorhabdus* protein homologue comprising: (a) probing an expression library with a hybridization probe comprising a nucleotide sequence encoding a polypeptide having an amino acid sequence set forth in any of SEQ ID NO:6109 to SEQ ID NO:12216, or an amino acid sequence set forth in any of SEQ ID NO:6109 to SEQ ID NO:12216 with conservative amino acid substitutions; (b) identifying a DNA clone that hybridizes to the hybridization probe; (c) isolating the DNA clone identified in step (b); and (d) sequencing the DNA fragment that comprises the clone isolated in step (c) wherein the sequenced nucleic acid molecule encodes all or a substantial portion of the amino acid sequence of the *Xenorhabdus* protein homologue.

In another preferred embodiment, the method of the present invention for obtaining a nucleic acid molecule from a cell other than a *Xenorhabdus* Xs86068 cell that encodes a substantial portion of an amino acid sequence of a *Xenorhabdus* protein homologue comprising: (a) synthesizing a first and a second oligonucleotide primers corresponding to a portion of the coding sequence of a second nucleic acid molecule set forth in SEQ ID NO:1 through SEQ ID NO:6108; and (b) amplifying a DNA insert present in a cloning vector using the first and second oligonucleotide primers of step (a) wherein the amplified nucleic acid molecule encodes all or a substantial portion of the amino acid sequence of the *Xenorhabdus* protein homologue.

The present invention, in another aspect, provides a substantially purified protein or polypeptide molecule comprising an amino acid sequence, wherein the amino acid sequence is defined as follows: (1) the amino acid sequence is encoded by a nucleotide sequence that is at least 50% identical to all or a substantial portion of a coding sequence located within SEQ ID NO:1 through SEQ ID NO:6108; or (2) the amino acid sequence is substantially identical to a member selected from the group consisting of SEQ ID NO:6109 to SEQ ID NO:12216. In alternative embodiments, the nucleotide sequence is at least 55% identical, at least 60% identical, at least 65% identical, at least 70% identical, at least 75% identical, at least 80% identical, at least 85% identical, at least 90% identical, at least 95% identical to all or a substantial portion of a coding sequence located within SEQ ID NO:1 through SEQ ID NO:6108. In a further embodiment, the nucleotide sequence is 100% identical to all or a substantial portion of a coding sequence located within SEQ ID NO:1 through SEQ ID NO:6108. In a still further embodiment, the amino acid sequence is at least 60% identical, at least 70% identical, at least 80% identical, at least 90% identical, at least 95% identical to a member selected from the group consisting of SEQ ID NO:6109 to SEQ ID NO:12216.

The term "substantially purified protein or polypeptide molecule" refers to a protein sequence molecule separated from substantially all other molecules normally associated with it in its native state. More preferably a substantially purified protein sequence molecule is the predominant species present in a preparation. A substantially purified molecule may be greater than 60% free, preferably 75% free, more preferably 80% free, more preferably 90% free, and most preferably 95% free from the other molecules (exclusive of solvent) present in the natural mixture.

It is well known in the art that proteins or polypeptides may undergo modifications, including post-translational modifications, such as, but not limited to, disulfide bond formation, glycosylation, phosphorylation, or oligomerization. Thus, as used herein, the term "protein molecule" or "polypeptide molecule" includes any protein molecule that is modified by any biological or non-biological process. The terms "amino acid" and "amino acids" refer to all naturally occurring amino acids. This definition is meant to include norleucine, ornithine, homocysteine, and homoserine.

The polypeptides or proteins of the present invention may be produced via chemical synthesis, or more preferably, by expression in a suitable bacterial or eukaryotic host. Suitable methods for expression of the polypeptides or proteins are described by Sambrook et al. (ibid). The polypeptides or protein molecules of the present invention may also include fusion protein sequence molecules. A protein sequence molecule that comprises one or more additional polypeptide regions not derived from that protein molecule is a "fusion" protein sequence molecule. Such molecules may be derivatized to contain carbohydrate or other moieties (such as keyhole limpet hemocyanin, etc.). Fusion protein sequence molecules of the present invention are preferably produced via recombinant means.

Another aspect of the present invention concerns antibodies, single-chain antigen binding molecules, or other proteins that specifically bind to one or more of the protein sequence molecules of the present invention and their homologues, fusions or fragments. Such antibodies may be used to quantitatively or qualitatively detect the protein sequence molecules of the present invention. As used herein, an antibody or polypeptide is said to "specifically bind" to a protein sequence molecule of the present invention if such binding is not competitively inhibited by the presence of non-related molecules. For example, the antibodies of the present invention bind to protein sequence molecules of the present invention, in a more preferred embodiment, the antibodies of the present invention bind to protein sequence molecules derived from Xenorhabdus that comprise SEQ ID NO:6109 through SEQ ID NO:12216.

Nucleic acid molecules that encode all or part of the protein sequence of the present invention can be expressed, via recombinant means, to yield protein or polypeptides that can in turn be used to elicit antibodies that are capable of binding the expressed protein or polypeptide. Such antibodies may be used in immunoassays for that protein or polypeptide. Such protein or polypeptide-encoding molecules, or their fragments may be "fusion" molecules (i.e., a part of a larger nucleic acid molecule) such that, upon expression, a fusion protein is produced. It may be desirable to derivatize the obtained antibodies, for example, with a ligand group (such as biotin) or a detectable marker group (such as a fluorescent group, a radioisotope or an enzyme). Such antibodies may be used in immunoassays for that protein or may be used to screen DNA expression libraries to isolate clones containing full-length insert of genes (Lerner, Adv. Immunol. 36: 1, 1984).

In one embodiment, the antibodies of the present invention specifically bind to one or more of the insect inhibitory polypeptides or proteins of the present invention comprising SEQ ID NO's: 6903, 6904, 6905, 7110, 7179, 7514, 7776, 7777, 7803, 8275, 8277, 8279, 8280, 8281, 8454, 8468, 8595, 9946, 10477, 10481, 10482, 10483, 10484, 10485, 10486, 10487, 10488, 10551, 11147, 11688, 11690, 11691, 11692 and 11693. Such antibodies may be used to detect the presence of such insect inhibitory polypeptides or proteins in a sample.

The present invention also provides a method for detecting an insect inhibitory polypeptide or protein in a biological sample, wherein the method comprises the steps of: (1) obtaining a biological sample; (2) contacting the sample with an antibody that specifically binds to the polypeptide or protein comprising SEQ ID NO: 6903, 6904, 6905, 7110, 7179, 7514, 7776, 7777, 7803, 8275, 8277, 8279, 8280, 8281, 8454, 8468, 8595, 9946, 10477, 10481, 10482, 10483, 10484, 10485, 10486, 10487, 10488, 10551, 11147, 11688, 11690, 11691, 11692 or 11693, under conditions effective to allow the formation of complexes; and (3) detecting the complexes so formed.

The present invention also relates to a plant recombinant vector or construct comprising a structural nucleotide sequence encoding a Xenorhabdus protein sequence comprising an amino acid sequence that is selected from the group consisting of SEQ ID NO:6108 through SEQ ID NO:12216. In one embodiment, a plant recombinant vector or construct of the present invention comprises a structural nucleotide sequence encoding an insect inhibitory protein sequence of the present invention comprising an amino acid sequence that is selected from the group consisting of SEQ ID NO's: 6903, 6904, 6905, 7110, 7179, 7514, 7776, 7777, 7803, 8275, 8277, 8279, 8280, 8281, 8454, 8468, 8595, 9946, 10477, 10481, 10482, 10483, 10484, 10485, 10486, 10487, 10488, 10551, 11147, 11688, 11690, 11691, 11692 and 11693. The present invention also relates to a transformed plant cell or plant comprising in its genome an exogenous nucleic acid encoding one or more Xenorhabdus proteins or polypeptides of the present invention. The present invention also relates to methods for creating a transgenic plant in which one or more Xenorhabdus proteins or polypeptides of the present invention are overexpressed.

As used herein, "structural nucleotide sequence" refers to a nucleotide sequence that is expressed to produce a polypeptide. The term "genome" as it applies to plant cells encompasses not only chromosomal DNA found within the nucleus, but organelle DNA found within subcellular components of the cell. DNAs of the present invention introduced into plant cells can therefore be either chromosomally integrated or organelle-localized. The term "genome" as it applies to bacteria encompasses both the chromosome and plasmids within a bacterial host cell. Encoding DNAs of the present invention introduced into bacterial host cells can therefore be either chromosomally integrated or plasmid-localized.

Methods that are well known to those skilled in the art may be used to construct the plant recombinant construct or vector of the present invention. These methods include in vitro recombinant DNA techniques, synthetic techniques, and in vivo genetic recombination. Such techniques are described in Sambrook et al. (ibid); and Ausubel et al. (Current Protocols in Mol. Biol., John, Wiley & Sons, New York, N.Y., 1989).

A plant recombinant construct or vector of the present invention contains a structural nucleotide sequence encoding one or more Xenorhabdus proteins or polypeptides of the present invention as set forth in SEQ ID NO:6109 through SEQ ID NO:12216 and operably linked regulatory sequences or control elements.

The term "operably linked", as used in reference to a regulatory sequence and a structural nucleotide sequence, means that the regulatory sequence causes regulated expression of the operably linked structural nucleotide sequence.

"Regulatory sequences" or "control elements" refer to nucleotide sequences located upstream (5' noncoding sequences), within, or downstream (3' non-translated sequences) of a structural nucleotide sequence, and which influence the transcription, RNA processing or stability, or translation of the associated structural nucleotide sequence. Regulatory sequences may include promoters, translation leader sequences, introns, and polyadenylation recognition sequences.

It is understood by those skilled in the art that different promoters may direct the expression of a gene in different tissues or cell types, or at different stages of development, or in response to different environmental conditions. For example, promoters that may be used in the present invention include, but are not limited to, constitutive promoters [e.g., the nopaline synthase (NOS) promoters (Ellis et al., EMBO Journal 6:11-16, 1987); the cauliflower mosaic virus (CaMV) 35S (Fraley et al., U.S. Pat. No. 5,858,742); and actin promoters, such as the *Arabidopsis* actin gene promoter (see, e.g., Huang, Plant Mol. Biol. 33:125-139, 1997)], inducible promoter [e.g., the drought-inducible promoter of maize (Busk, Plant J. 11:1285-1295, 1997; the cold, drought, and high salt inducible promoter from potato (Kirch, Plant Mol. Biol. 33:897-909, 1997; and salicylic acid inducible promoter (Uknes et al., Plant Cell 5:159-169, 1993)] and tissue-specific promoters [e.g., leaf-specific promoters [e.g., Matsuoka, Plant J. 6:311-319, 1994; Shiina, Plant Physiol. 115-477-483, 1997); root-specific promoters (e.g., Samac et al., *Plant Mol. Biol.* 25: 587-596, 1994; Yamamoto, Plant Cell 3:371-382, 1991), tuber-specific promoters (Hannapel, *Plant Physiol.* 101: 703-704, 1993; Bevan et al., *EMBO J.* 8: 1899-1906, 1986), seed-specific promoters (e.g., Sheridan, Genetics 142:1009-1020, 1996; Abler, Plant Mol. Biol. 22:10131-1038, 1993) and pollen-specific promoter (e.g., Guerrero, Mol. Gen. Genet. 224: 161-168, 1990; Wakeley, Plant Mol. Biol. 37:187-192, 1992).

It is recognized that additional promoters that may be utilized are described, for example, in U.S. Pat. Nos. 5,378, 619, 5,391,725, 5,428,147, 5,447,858, 5,608,144, 5,608,144, 5,614,399, 5,633,441, 5,633,435, and 4,633,436. In addition, a tissue specific enhancer may be used (Fromm et al., *The Plant Cell* 1:977-984, 1989). It is further recognized that since in most cases the exact boundaries of regulatory sequences have not been completely defined, DNA fragments of different lengths may have identical promoter activity.

The "translation leader sequence" refers to a DNA sequence located between the promoter sequence of a gene and the coding sequence. The translation leader sequence is present in the fully processed mRNA upstream of the translation start sequence. The translation leader sequence may affect processing of the primary transcript to mRNA, mRNA stability or translation efficiency. Examples of translation leader sequences include maize and petunia heat shock protein leaders (U.S. Pat. No. 5,362,865), plant virus coat protein leaders, and plant rubisco leaders, among others (Turner and Foster, Molecular Biotechnology 3:225, 1995).

The 3' non-translated sequence or 3' transcription termination region means a DNA molecule linked to and located downstream of a structural polynucleotide molecule and includes polynucleotides that provide polyadenylation signal and other regulatory signals capable of affecting transcription, mRNA processing or gene expression. The polyadenylation signal functions in plants to cause the addition of polyadenylate nucleotides to the 3' end of the mRNA precursor. The polyadenylation sequence can be derived from the natural gene, from a variety of plant genes, or from T-DNA genes. An example of a 3' transcription termination region is the nopaline synthase 3' region (nos 3'; Fraley et al., Proc. Natl. Acad. Sci. USA, 80: 4803-4807, 1983). The use of different 3' nontranslated regions is exemplified by Ingelbrecht et al. (Plant Cell 1:671-680, 1989).

A recombinant vector or construct of the present invention will typically comprise a selectable marker that confers a selectable phenotype on plant cells. Selectable markers may also be used to select for plants or plant cells that contain the exogenous nucleic acids encoding polypeptides or proteins of the present invention. The marker may encode biocide resistance, antibiotic resistance (e.g., kanamycin, G418 bleomycin, hygromycin, etc.), or herbicide resistance (e.g., glyphosate, etc.). Examples of selectable markers include, but are not limited to, a neo gene (Potrykus et al., *Mol. Gen. Genet.* 199:183-188, 1985) which codes for kanamycin resistance and can be selected for using kanamycin, G418, etc.; a mutant EPSP synthase gene (Hinchee et al., *Bio/Technology* 6:915-922, 1988) which encodes glyphosate resistance; and a nitrilase gene which confers resistance to bromoxynil (Stalker et al., *J. Biol. Chem.* 263:6310-6314, 1988).

A recombinant vector or construct of the present invention may also include a screenable marker. Screenable markers may be used to monitor expression. Exemplary screenable markers include a β-glucuronidase or uidA gene (GUS) which encodes an enzyme for which various chromogenic substrates are known (Jefferson, *Plant Mol. Biol, Rep.* 5:387-405, 1987; Jefferson et al., *EMBO J.* 6:3901-3907, 1987); an R-locus gene (Dellaporta et al., Stadler Symposium 11:263-282, 1988); a β-lactamase gene (Sutcliffe et al., *Proc. Natl. Acad. Sci.* (*U.S.A.*) 75:3737-3741, 1978); and a luciferase gene (Ow et al., *Science* 234:856-859, 1986). Included within the terms "selectable or screenable marker genes" are also genes that encode a secretable marker whose secretion can be detected as a means of identifying or selecting for transformed cells. Examples include markers that encode a secretable antigen that can be identified by antibody interaction, or even secretable enzymes that can be detected catalytically. Secretable proteins fall into a number of classes, including small, diffusible proteins detectable, e.g., by ELISA, small active enzymes detectable in extracellular solution (e.g., α-amylase, β-lactamase, phosphinothricin transferase), or proteins which are inserted or trapped in the cell wall (such as proteins which include a leader sequence such as that found in the expression unit of extension or tobacco PR-S). Other possible selectable and/or screenable marker genes will be apparent to those of skill in the art.

In preparing the DNA constructs of the present invention, the various components of the construct or fragments thereof will normally be inserted into a convenient cloning vector, e.g., a plasmid that is capable of replication in a bacterial host, e.g., *E. coli*. Numerous vectors exist that have been described in the literature, many of which are commercially available. After each cloning, the cloning vector with the desired insert may be isolated and subjected to further manipulation, such as restriction digestion, insertion of new fragments or nucleotides, ligation, deletion, mutation, resection, etc. so as to tailor the components of the desired sequence. Once the construct has been completed, it may then be transferred to an appropriate vector for further manipulation in accordance with the manner of transformation of the host cell.

The present invention also provide a transgenic plant comprising in its genome an isolated nucleic acid which comprises: (1) a 5' non-coding sequence which functions in the cell to cause the production of a mRNA molecule; which is linked to (2) a structural nucleotide sequence, wherein the structural nucleotide sequence encodes a *Xenorhabdus* protein sequence of the present invention that is substantially identical to a member selected from the group consisting of SEQ ID NO:6109 to SEQ ID NO:12216; which is linked to (3) a 3' non-translated sequence that functions in said cell to cause termination of transcription.

The term "transgenic plant" refers to a plant that contains an exogenous nucleic acid, which can be derived from the same plant species or from a different plant species. Transgenic plants of the present invention preferably have incorporated into their genome or transformed into their chloroplast or plastid genomes a selected polynucleotide (or "transgene"), that comprises at least a structural nucleotide sequence that encodes a polypeptide the amino acid sequence of which is selected from the group consisting of SEQ ID NO:6109 to SEQ ID NO:12216 or, in particular, an insect inhibitory polypeptide the amino acid sequence of which is selected from the group consisting of SEQ ID NO's: 6903, 6904, 6905, 7110, 7179, 7514, 7776, 7777, 7803, 8275, 8277, 8279, 8280, 8281, 8454, 8468, 8595, 9946, 10477, 10481, 10482, 10483, 10484, 10485, 10486, 10487, 10488, 10551, 11147, 11688, 11690, 11691, 11692 and 11693. Transgenic plants are also meant to comprise progeny (decendant, offspring, etc.) of any generation of such a transgenic plant. A seed of any generation of all such transgenic insect-resistant plants wherein said seed comprises a DNA sequence encoding the polypeptide of the present invention is also an important aspect of the invention.

The DNA constructs of the present invention may be introduced into the genome of a desired plant host by a variety of conventional transformation techniques, which are well known to those skilled in the art. Preferred methods of transformation of plant cells or tissues are the *Agrobacterium* mediated transformation method and the biolistics or particle-gun mediated transformation method. Suitable plant transformation vectors for the purpose of *Agrobacterium* mediated transformation include those derived from a Ti plasmid of *Agrobacterium tumefaciens*, as well as those disclosed, e.g., by Herrera-Estrella et al. (Nature 303:209, 1983); Bevan (Nucleic Acids Res. 12: 8711-8721, 1984); Klee et al. (Bio-Technology 3(7): 637-642, 1985); and EPO publication 120,516. In addition to plant transformation vectors derived from the Ti or root-inducing (Ri) plasmids of *Agrobacterium*, alternative methods can be used to insert the DNA constructs of this invention into plant cells. Such methods may involve, but are not limited to, for example, the use of liposomes, electroporation, chemicals that increase free DNA uptake, free DNA delivery via microprojectile bombardment, and transformation using viruses or pollen.

A plasmid expression vector suitable for the introduction of a nucleic acid encoding a polypeptide or protein of the present invention in monocots using electroporation or particle-gun mediated transformation is composed of the following: a promoter that is constitutive or tissue-specific; an intron that provides a splice site to facilitate expression of the gene, such as the Hsp70 intron (PCT Publication WO93/19189); and a 3' polyadenylation sequence such as the nopaline synthase 3' sequence (NOS 3'; Fraley et al., Proc. Natl. Acad. Sci. USA 80: 4803-4807, 1983). This expression cassette may be assembled on high copy replicons suitable for the production of large quantities of DNA.

When adequate numbers of cells (or protoplasts) containing the exogenous nucleic acid encoding a polypeptide or protein of the present invention are obtained, the cells (or protoplasts) are regenerated into whole plants. Choice of methodology for the regeneration step is not critical, with suitable protocols being available for hosts from Leguminosae (alfalfa, soybean, clover, etc.), Umbelliferae (carrot, celery, parsnip), Cruciferae (cabbage, radish, canola/rapeseed, etc.), Cucurbitaceae (melons and cucumber), Gramineae (wheat, barley, rice, maize, etc.), Solanaceae (potato, tobacco, tomato, peppers), various floral crops, such as sunflower, and nut-bearing trees, such as almonds, cashews, walnuts, and pecans. See, for example, Ammirato et al. (Handbook of Plant Cell Culture—Crop Species. Macmillan Publ. Co., 1984); Shimamoto et al (Nature 338:274-276, 1989); Vasil et al. (Bio/Technology 8:429-434, 1990; Bio/Technology 10:667-674, 1992); Hayashimoto (Plant Physiol. 93:857-863, 1990); and Datta et al. (Bio-technology 8:736-740, 1990). Regeneration can also be obtained from plant callus, explants, organs, or parts thereof. Such regeneration techniques are described generally in Klee et al. (Ann. Rev. Plant Phys. 38:467-486, 1987).

A transgenic plant formed using *Agrobacterium* transformation methods typically contains a single exogenous gene on one chromosome. Such transgenic plants can be referred to as being heterozygous for the added exogenous gene. More preferred is a transgenic plant that is homozygous for the added exogenous gene; i.e., a transgenic plant that contains two added exogenous genes, one gene at the same locus on each chromosome of a chromosome pair. A homozygous transgenic plant can be obtained by sexually mating (selfing) an independent segregant transgenic plant that contains a single exogenous gene, germinating some of the seeds produced and analyzing the resulting plants produced for the exogenous gene of interest.

The development or regeneration of transgenic plants containing the exogenous nucleic acid that encodes a polypeptide or protein of interest is well known in the art. Preferably, the regenerated plants are self-pollinated to provide homozygous transgenic plants, as discussed above. Otherwise, pollen obtained from the regenerated plants is crossed to seed-grown plants of agronomically important lines. Conversely, pollen from plants of these important lines is used to pollinate regenerated plants. A transgenic plant of the present invention containing a desired polypeptide or protein of the present invention is cultivated using methods well known to one skilled in the art.

Transgenic plants, that can be generated by practice of the present invention, include but are not limited to Acacia, alfalfa, aneth, apple, apricot, artichoke, arugula, asparagus, avocado, banana, barley, beans, beet, blackberry, blueberry, broccoli, brussels sprouts, cabbage, canola, cantaloupe, carrot, cassava, cauliflower, celery, cherry, cilantro, citrus, clementines, coffee, corn, cotton, cucumber, Douglas fir, eggplant, endive, escarole, eucalyptus, fennel, figs, gourd, grape, grapefruit, honey dew, jicama, kiwifruit, lettuce, leeks, lemon, lime, pine, mango, melon, mushroom, nut, oat, okra, onion, orange, an ornamental plant, papaya, parsley, pea, peach, peanut, pear, pepper, persimmon, pine, pineapple, plantain, plum, pomegranate, poplar, potato, pumpkin, quince, radiata pine, radicchio, radish, raspberry, rice, rye, sorghum, soybean, spinach, squash, strawberry, sugarbeet, sugarcane, sunflower, sweet potato, sweetgum, tangerine, tea, tobacco, tomato, turf, a vine, watermelon, wheat, yams, and zucchini.

The present invention also provides parts of the transgenic plants of present invention. Plant parts, without limitation, include seed, endosperm, ovule and pollen. In a particularly preferred embodiment of the present invention, the plant part is a seed.

The present invention also further provides method for generating a transgenic plant comprising the steps of: a) introducing into the genome of the plant an exogenous nucleic acid, wherein the exogenous nucleic acid comprises in the 5' to 3' direction i) a promoter that functions in the cells of said plant, said promoter operably linked to; ii) a structural nucleic acid sequence encoding a polypeptide or protein of the present invention that is selected from the group consisting of SEQ ID NO:6109 to SEQ ID NO:12216 or, in particular, an insect inhibitory polypeptide that is selected from the group consisting of SEQ ID NO's: 6903, 6904, 6905, 7110, 7179, 7514, 7776, 7777, 7803, 8275, 8277, 8279, 8280, 8281, 8454, 8468, 8595, 9946, 10477, 10481, 10482, 10483, 10484, 10485, 10486, 10487, 10488, 10551, 11147, 11688, 11690, 11691, 11692 and 11693, said structural nucleic acid sequence operably linked to; iii) a 3' non-translated nucleic acid sequence that functions in said cells of said plant to cause transcriptional termination; b) obtaining transformed plant cells containing the nucleic acid sequence of step (a); and c) regenerating from said transformed plant cells a transformed plant in which said polypeptide or protein is overexpressed.

Any of the isolated nucleic acid molecules of the present invention may be introduced into a plant cell in a permanent or transient manner in combination with other genetic elements such as vectors, promoters, enhancers etc. Further any of the nucleic acid molecules encoding a Xenorhabdus protein sequence of the present invention may be introduced into a plant cell in a manner that allows for over expression of the protein sequence encoded by the nucleic acid molecule.

The nucleotide sequences of the present invention may be introduced into a wide variety of prokaryotic and eukaryotic microorganism hosts to express the Xenorhabdus polypeptide or protein of the present invention, particularly the insect inhibitory polypeptides or proteins of the present invention comprising an amino acid sequence that is selected from the group consisting of SEQ ID NO's: 6903, 6904, 6905, 7110, 7179, 7514, 7776, 7777, 7803, 8275, 8277, 8279, 8280, 8281, 8454, 8468, 8595, 9946, 10477, 10481, 10482, 10483, 10484, 10485, 10486, 10487, 10488, 10551, 11147, 11688, 11690, 11691, 11692 and 11693. The term "microorganism" includes prokaryotic and eukaryotic microbial species such as bacteria and fungi. Illustrative prokaryotes, whether Gram-negative, Gram-positive, or otherwise, include Enterobacteriaceae, such as *Escherichia, Erwinia, Shigella, Salmonella*, and *Proteus*; Bacillaceae, Rhizobiceae, such as *Rhizobium*; Spirillaceae, such as photobacterium, *Zymomonas, Serratia, Aeromonas, Vibrio, Desulfovibrio, Spirillum*, Lactobacillaceae; Pseudomonadaceae, such as *Pseudomonas* and *Acetobacter*; Azotobacteraceae, Actinomycetales, and Nitrobacteraceae. Among eukaryotes are fungi, such as Phycomycetes and Ascomycetes, which includes yeast, such as *Saccharomyces* and *Schizosaccharomyces*; and Basidiomycetes yeast, such as *Rhodotorula, Aureobasidium, Sporobolomyces*, and the like.

For the purpose of plant protection against insects, a large number of microorganisms known to inhabit the phylloplane (the surface of the plant leaves) and/or the rhizosphere (the soil surrounding plant roots) of a wide variety of important crops may also be desirable host cells for manipulation, propagation, storage, delivery and/or mutagenesis of the disclosed recombinant constructs. These microorganisms include bacteria, algae, and fungi. Of particular interest are microorganisms, such as bacteria, e.g., genera *Bacillus* (including the species and subspecies); *Pseudomonas, Erwinia, Serratia, Klebsiella, Zanthomonas, Streptomyces, Rhizobium, Rhodopseudomonas, Methylophilius, Agrobacterium, Acetobacter, Lactobacillus, Arthrobacter, Azotobacter, Leuconostoc*, and *Alcaligenes*; fungi, particularly yeast, e.g., genera *Saccharomyces, Cryptococcus, Kluyveromyces, Sporobolomyces, Rhodotorula*, and *Aureobasidium*.

The present invention also relates to a bacterial or a fungal recombinant construct. The recombinant construct may comprise a structural nucleotide sequence encoding a Xenorhabdus protein sequence comprising an amino acid sequence that is selected from the group consisting of SEQ ID NO:6109 to SEQ ID NO:12216. The present invention also relates to methods for obtaining a recombinant bacterial or fungal host cell, comprising introducing into a bacterial or fungal host cell an exogenous nucleic acid molecule that is selected from the group consisting of SEQ ID NO:1 to SEQ ID NO:6108.

The recombinant construct for producing a polypeptide in a bacterium also contains an inducible promoter that is recognized by the host bacterium and is operably linked to the nucleic acid encoding, for example, the nucleic acid molecule encoding the Xenorhabdus protein sequence of interest. Inducible promoters suitable for use with bacterial hosts include the β-lactamase, *E. coli* λ phage $P_L$ and $P_R$, and *E. coli* galactose, arabinose, alkaline phosphatase, tryptophan (trp), and lactose operon promoter systems and variations thereof (Chang et al., *Nature* 275:615, 1978; Goeddel et al., *Nature* 281:544, 1979; Guzman et al., *J.*

Bacteriol. 174:7716-7728, 1992; Goeddel, *Nucleic Acids Res.* 8:4057, 1980; EP 36,776). Hybrid promoters such as the tac promoter (deBoer et al., *Proc. Natl. Acad. Sci.* (*USA*) 80:21-25, 1983) and other known bacterial inducible promoters are suitable (Siebenlist et al., *Cell* 20:269, 1980) may also be used.

The bacterial recombinant construct or vector may be a linear or a closed circular plasmid. The vector system may be a single vector or plasmid or two or more vectors or plasmids that together contain the total DNA to be introduced into the genome of the bacterial host. In addition, the bacterial vector may be an expression vector. Nucleic acid molecules encoding *Xenorhabdus* proteins or polypeptide can, for example, be suitably inserted into a replicable vector for expression in a bacterium under the control of a suitable promoter for that bacterium. Many vectors are available for this purpose, and selection of the appropriate vector will depend mainly on the size of the nucleic acid to be inserted into the vector and the particular host cell to be transformed with the vector. Each vector contains various components depending on its function (amplification of DNA or expression of DNA) and the particular host cell with which it is compatible. The vector components for bacterial transformation generally include, but are not limited to, one or more of the following: a signal sequence, an origin of replication, one or more selectable marker genes, a promoter allowing the expression of an exogenous nucleotide sequence and a structural nucleotide sequence of the present invention.

In general, plasmid vectors containing replicon and control sequences that are derived from species compatible with the host cell are used in connection with bacterial hosts. The vector ordinarily carries a replication site, as well as marking sequences that are capable of providing phenotypic selection in transformed cells. For example, *E. coli* is typically transformed using pBR322, a plasmid derived from an *E. coli* species (see, e.g., Bolivar et al., *Gene* 2:95, 1977). The pBR322 plasmid contains genes for ampicillin and tetracycline resistance and thus provides easy means for identifying transformed cells. The pBR322 plasmid, or other microbial plasmid or phage, also generally contains, or is modified to contain, promoters that can be used by the microbial organism for expression of the selectable marker genes. In addition, nucleic acid molecules encoding *Xenorhabdus* proteins or polypeptides may be expressed not only directly, but also as a fusion with another polypeptide, preferably a signal sequence or other polypeptide having a specific cleavage site at the N-terminus of the mature polypeptide. The suitable vectors containing one or more of the above-listed components may be constructed employing standard recombinant DNA techniques. Isolated plasmids or DNA fragments are cleaved, tailored, and re-ligated in the form desired to generate the plasmids required. Examples of available bacterial expression vectors include, but are not limited to, the multifunctional *E. coli* cloning and expression vectors such as Bluescript™ (Stratagene, La Jolla, Calif.), in which, for example, a *Xenorhabdus* protein sequence of the present invention, may be ligated into the vector in frame with sequences for the amino-terminal Met and the subsequent 7 residues of β-galactosidase so that a hybrid protein is produced; pIN vectors (Van Heeke and Schuster *J. Biol. Chem.* 264:5503-5509, 1989); and the like. pGEX vectors (Promega, Madison, Wis.) may also be used to express foreign polypeptides as fusion proteins with glutathione S-transferase (GST). Bacterial cells used to produce the polypeptide of interest for purposes of this invention are cultured in suitable media in which the promoters for the nucleic acid encoding the heterologous polypeptide can be artificially induced as described generally, e.g., in Sambrook et al., ibid). Examples of suitable media are given in U.S. Pat. Nos. 5,304,472 and 5,342,763.

A yeast recombinant construct can typically include one or more of the following: a promoter sequence, a fusion partner sequence, a leader sequence, a transcription termination sequence and a selectable marker. These elements can be combined into an expression cassette, which may be maintained in a replicon, such as an extrachromosomal element (e.g., plasmids) capable of stable maintenance in a host, such as yeast or bacteria. The replicon may have two replication systems, thus allowing it to be maintained, for example, in yeast for expression and in a procaryotic host for cloning and amplification. Examples of such yeast-bacteria shuttle vectors include YEp24 (Botstein et al., Gene, 8:17-24, 1979), pCl/1 (Brake et al., Proc. Natl. Acad. Sci. USA, 81:4642-4646, 1984), and YRp17 (Stinchcomb et al., J. Mol. Biol., 158:157, 1982).

The nucleotide sequence provided in one of SEQ ID NO:1 through SEQ ID NO:6108 or a fragment thereof, or a complement thereof, or a nucleotide sequence at least about 70% identical, preferably about 80% or about 90% identical, even more preferably about 95%, about 98% or 100% identical to the nucleotide sequence provided in one of SEQ ID NO:1 through SEQ ID NO:6108 or a fragment thereof, or a complement thereof, can be "provided" in a variety of media to facilitate its use. Such a medium can also provide a subset thereof in a form that allows a skilled artisan to examine the sequences.

In one application of this embodiment, a nucleotide sequence of the present invention can be recorded on computer readable media. As used herein, "computer readable media" refers to any medium that can be read and accessed directly by a computer. Such media include, but are not limited to: magnetic storage media, such as floppy discs, hard disc, storage medium, and magnetic tape: optical storage media such as CD-ROM; electrical storage media such as RAM and ROM; and hybrids of these categories such as magnetic/optical storage media. A skilled artisan can readily appreciate how any of the presently known computer readable mediums can be used to create a manufacture comprising computer readable medium having recorded thereon a nucleotide sequence of the present invention.

By providing one or more of nucleotide sequences of the present invention, a skilled artisan can routinely access the sequence information for a variety of purposes. Computer software is publicly available which allows a skilled artisan to access sequence information provided in a computer readable medium. The examples which follow demonstrate how software which implements the BLAST (Altschul et al., *J. Mol. Biol.* 215:403-410, 1990) and BLAZE (Brutlag et al., *Comp. Chem.* 17:203-207, 1993) search algorithms on a Sybase system can be used to identify open reading frames (ORFs) within the genome that contain homology to ORFs or proteins from other organisms. Such ORFs are useful in producing commercially important proteins such as enzymes used in amino acid biosynthesis, metabolism, transcription, translation, RNA processing, nucleic acid and a protein degradation, protein modification, and DNA replication, restriction, modification, recombination, and repair.

Nucleic acid molecules and fragments thereof of the present invention may be employed to obtain other nucleic acid molecules from the same or closely related species. Such nucleic acid molecules include the nucleic acid molecules that encode the complete coding sequence of a protein, and promoters, and flanking sequences of such molecules. In addition, such nucleic acid molecules include nucleic acid molecules that encode for other isozymes or gene family members. Such molecules can be readily obtained by using the above-described nucleic acid molecules or fragments thereof to screen genomic libraries obtained from *Xenorhabdus*. Methods for forming such libraries are well known in the art.

Nucleic acid molecules and fragments thereof of the present invention may also be employed to obtain other nucleic acid molecules such as nucleic acid homologues. Such homologues include the nucleic acid homologues of non-*Xenorhabdus* species including the nucleic acid molecules that encode, in whole or in part, protein homologues of other species or other organisms, sequences of genetic elements such as promoters and transcriptional regulatory elements. Such molecules can be readily obtained by using the above-described nucleic acid molecules or fragments thereof to screen cDNA or genomic libraries. Methods for forming such libraries are well known in the art. Such homologue molecules may differ in their nucleotide sequences from those found in one or more of SEQ ID NO:1 through SEQ ID NO:6108 or complements thereof because complete complementarity is not needed for stable hybridization. The nucleic acid molecules of the present invention therefore also include molecules that, although capable of specifically hybridizing with the nucleic acid molecules, may lack "complete complementarity." In a particular embodiment, methods for obtaining these molecules may be used [Frohman, M. A. et al., *Proc. Natl. Acad. Sci.* (*U.S.A*) 85:8998-9002, 1988; Ohara, O. et al., *Proc. Natl. Acad. Sci.* (*U.S.A.*) 86:5673-5677, 1989].

The nucleic acid molecules of the present invention may be used for physical mapping. Physical mapping, in conjunction with linkage analysis, can enable the isolation of genes. Physical mapping has been reported to identify the markers closest in terms of genetic recombination to a gene target for cloning. Once a DNA marker is linked to a gene of interest, the chromosome walking technique can be used to find the genes via overlapping clones. For chromosome walking, random molecular markers or established molecular linkage maps are used to conduct a search to localize the gene adjacent to one or more markers. A chromosome walk (Bukanov and Berg, *Mo. Microbiol.* 11:509-523, 1994; Birkenbihl and Vielmetter *Nucleic Acids Res.* 17.5057-5069, 1989; Wenzel and Herrmann, *Nucleic Acids Res.* 16:8323-8336, 1988) is then initiated from the closest linked marker. Starting from the selected clones, labeled probes specific for the ends of the insert DNA are synthesized and used as probes in hybridizations against a representative library. Clones hybridizing with one of the probes are picked and serve as templates for the synthesis of new probes; by subsequent analysis, contigs are produced. The degree of overlap of the hybridizing clones used to produce a contig can be determined by comparative restriction analysis. The most frequently used procedures are, fingerprinting (Coulson et al, *Proc. Natl. Acad. Sci.* (*U.S.A.*) 83:7821-7821, 1986; Knott et al., *Nucleic Acids Res.* 16:2601-2612, 1988; Eiglmeier et al., *Mol. Microbiol.* 7:197-206, 1993), restriction fragment mapping (Smith and Birnstiel, Nucleic Acids Res. 3:2387-2398, 1976), or the "landmarking" technique (Charlebois et al. *J. Mol. Biol.* 222:509-524, 1991).

Nucleic acid molecules of the present invention can be used to monitor expression. A microarray-based method for high-throughput monitoring of gene expression may be utilized to measure gene-specific hybridization targets. This 'chip'-based approach involves using microarrays of nucleic acid molecules as gene-specific hybridization targets to quantitatively measure expression of the corresponding genes (Schena et al., *Science* 270:467-470, 1995; Shalon, Ph.D. Thesis, Stanford University, 1996). Every nucleotide in a large sequence can be queried at the same time. Hybridization can be used to efficiently analyze nucleotide sequences.

It is understood that one or more of the molecules of the present invention, preferably one or more of the nucleic acid molecules or protein molecules or fragments thereof of the present invention may be utilized in a microarray-based method. In one embodiment, the microarray of the present invention comprises at least 10 nucleic acid molecules, more preferably at least 100 nucleic acid molecules, and even more preferably at least 1000 nucleic acid molecules, that specifically hybridize under stringent conditions to at least 10, at least 100, at least 1000, nucleic acid molecules, respectively, encoding *Xenorhabdus* proteins or polypeptides or fragments thereof set forth in SEQ ID NO:1 through SEQ ID NO:6108 or fragment thereof or complement. In a further embodiment, the microarray of the present invention comprises at least 2,500 nucleic acid molecules that specifically hybridize under stringent conditions to at least 2,500 nucleic acid molecules that encode a *Xenorhabdus* protein sequence or fragment thereof set forth in SEQ ID NO:6109 through SEQ ID NO: 12216. While it is understood that a single nucleic acid molecule may encode more than one protein homologue or fragment thereof, in a preferred embodiment, at least 50%, preferably at least 70%, more preferably at least 80%, even more preferably at least 90% of the nucleic acid molecules that comprise the microarray contain one protein or fragment thereof.

Nucleic acid molecules of the present invention may be used in site directed mutagenesis. Site-directed mutagenesis may be utilized to modify nucleic acid sequences, particularly as it is a technique that allows one or more of the amino acids encoded by a nucleic acid molecule to be altered (e.g. a threonine to be replaced by a methionine). Three basic methods for site-directed mutagenesis are often employed and these are cassette mutagenesis (Wells et al., *Gene* 34:315-23, 1985), primer extension [Gilliam et al., *Gene* 12:129-137, 1980; Zoller and Smith, *Methods Enzymol.* 100:468-500, 1983; and Dalbadie-McFarland et al., *Proc. Natl. Acad. Sci.* (*U.S.A.*) 79:6409-6413, 1982] and methods based upon PCR (Scharf et al., *Science* 233:1076-1078, 1986); Higuchi et al., *Nucleic Acids Res.* 16:7351-7367, 1988). Site-directed mutagenesis approaches are also described in US Patent Pub. No. 20020151072, European Patent 0 385 962, European Patent 0 359 472, and PCT Patent Application WO 93/07278. Any of the nucleic acid molecules of the present invention may either be modified by site-directed mutagenesis or used as, for example, nucleic acid molecules that are used to target other nucleic acid molecules for modification. It is understood that mutants with more than one altered nucleotide can be constructed using techniques that practitioners skilled in the art are familiar with such as isolating restriction fragments and ligating such fragments into an expression vector (see, for example, Sambrook et al., ibid).

Insect inhibitory protein-encoding nucleic acids of the present invention will find particular uses in the plant protection against insects. For instance, insect-resistant transgenic plants can be generated by introducing the exogenous nucleic acids encoding an insect inhibitory polypeptide or protein or insect inhibitory fragment thereof, the amino acid sequence of which is substantially identical to a sequence set forth in SEQ ID NO's: 6903, 6904, 6905, 7110, 7179, 7514, 7776, 7777, 7803, 8275, 8277, 8279, 8280, 8281, 8454, 8468, 8595, 9946, 10477, 10481, 10482, 10483, 10484, 10485, 10486, 10487, 10488, 10551, 11147, 11688, 11690, 11691, 11692 and 11693. The methods for generating such insect-resistant transgenic plants have been disclosed herein.

Insect inhibitory protein-encoding nucleic acids of the present invention will also find particular uses in engineering a transgenic microorganism (bacteria or fungi) to express the insect inhibitory polypeptides or proteins of the present invention and then to apply them to the insect food source or allow them to reside in soil surrounding plant roots or on the surface of plant leaves. The transgenic microorganisms of the present invention may be used to produce *Xenorhabdus* polypeptides or proteins of interest, particularly insect inhibitory polypeptides or proteins. Insect inhibitory polypeptides or proteins or insect inhibitory fragments thereof may be secreted, for example as in bacterial systems, meaning targeted to either the periplasm as for gram negative bacteria or localized to the extracellular space for gram negative or any other type of bacterium, or localized to the intracellular spaces within the cytoplasm. Such compositions may be administered to insects according to methods well known in the art.

Insecticidal proteins of the present invention can be used together with other insecticidal or pesticidal agents, such as organic chemical compositions, organo-phosphate compositions, nerve agents, diverse insecticidal proteins such as Bt cry, vip, TIC, and EG related insecticidal proteins, as well as with agents designed for dsRNA mediated gene suppression.

The principle object of the present invention is to provide a method for identification of any gene or any protein encoded by any structural gene contained within a *Xenorhabdus* species, particularly those species which are shown to exhibit the production of an insect inhibitory protein or molecule or other similarly active composition, either alone or in combination with proteins or molecules or other similarly active compositions which may be derived from the bacterium in its role as a natural symbiont within an insect pathogenic nematode host. Isolation and identification of a single insect pathogenic nematode species enables the skilled artisan to isolate at least one species of *Xenorhabdus* endosymbiotic bacteria from the haemolymph of an insect larvae or adult which has been invaded by the isolated and identified host nematode. The isolation and purification of an insect pathogenic nematode *Xenorhabdus* symbiont bacterium from an insect cadaver provides the basis for obtaining an amount of genomic DNA from which a genomic library can be constructed to represent the entire genome of the bacterial strain. The library can then be manipulated as described herein to produce linear nucleotide sequences, which can then be compared to each other to identify regions of identity with which an overlapping sequence can be generated to produce islands of linear sequence known as contigs because of the contiguous linear sequence assembled from smaller bits of sequence data. The contigs can be assembled into a genomic map from which genes can be identified, and wherein translation of structural genes lead to further identification of proteins having predicted structure and function based on homologies of such predicted protein sequences as translated from open reading frames contained within the genome map, to proteins of known sequence, and perhaps also of known structure and function identified previously from other bacterial, viral, fungal, or other eukaryotic sources.

The *Xenorhabdus* strain Xs86068 and isolatable protein compositions exhibiting insecticidal activity as disclosed herein will find particular utility as insecticides for topical and/or systemic application to field crops, grasses, fruits and vegetables, and ornamental plants. In a preferred embodiment, the bioinsecticide composition comprises an oil flowable suspension of bacterial cells that expresses a novel protein disclosed herein. In another important embodiment, the bioinsecticide composition comprises a water dispersible granule. This granule comprises bacterial cells that express a novel insecticidal protein disclosed herein. In a third important embodiment, the bioinsecticide composition comprises a wettable powder, dust, pellet, or colloidal concentrate. This powder comprises bacterial cells that express a novel insecticidal protein disclosed herein. Such dry forms of the insecticidal compositions may be formulated to dissolve immediately upon wetting, or alternatively, dissolve in a controlled-release, sustained-release, or other time-dependent manner. In a fourth important embodiment, the bioinsecticide composition comprises an aqueous suspension of bacterial cells such as those described above that express the insecticidal protein. Such aqueous suspensions may be provided as a concentrated stock solution which is diluted prior to application, or alternatively, as a diluted solution.

Exemplary bacterial cells for fulfilling the above methods may comprise *Xenorhabdus* Xs86068 cells. However, bacteria such as *Bacillus, Salmonella, Agrobacterium, Rhizobium, Erwinia, Azotobacter, Azospirillum, Klebsiella, Flavobacterium* and *Alcaligenes*, other *Xenorhabdus* or *Photorhabdus* species, or *Pseudomonas* transformed with a DNA segment disclosed herein and expressing the insecticidal protein are also contemplated to be useful.

Alternatively, the novel *Xenorhabdus* insecticidal proteins of the present invention may be prepared by native or recombinant bacterial expression systems in vitro and isolated for subsequent field application. Such protein may be either in crude cell lysates, suspensions, colloids, etc., or alternatively may be purified, refined, buffered, and/or further processed, before formulating in an active biocidal formulation. Likewise, under certain circumstances, it may be desirable to isolate insecticidal proteins or whole cells from bacterial cultures expressing the insecticidal protein(s) of the present invention and apply solutions, suspensions, or colloidal preparations of such insecticidal proteins or whole cells as the active bioinsecticidal composition.

Regardless of the method of application, the amount of the active component(s) is applied at an insecticidally-effective amount, which will vary depending on such factors as, for example, the specific coleopteran insects to be controlled, or the specific piercing and sucking insect to be controlled, the specific plant or crop to be treated, the environmental conditions, and the method, rate, and quantity of application of the insecticidally-active composition.

The insecticide compositions described herein may be made by formulating either the bacterial cells, insecticidal protein suspensions, or isolated protein components with the desired agriculturally acceptable carrier (U.S. Pat. No. 6,177,615). The compositions may be formulated prior to administration in an appropriate means such as lyophilized, freeze-dried, desiccated, or in an aqueous carrier, medium or suitable diluent, such as saline or other buffer. The formulated compositions may be in the form of a dust or granular material, or a suspension in oil (vegetable or mineral), or water or oil/water emulsions, or as a wettable powder, or in combination with any other carrier material suitable for agricultural application (U.S. Pat. Nos. 5,616,319 and 5,942,658). Suitable agricultural carriers can be solid or liquid and are well known in the art. The insecticidal compositions of this invention are applied to the environment of the target coleopteran or piercing and sucking insect, typically onto the foliage of the plant or crop to be protected, by conventional methods, preferably by spraying (U.S. Pat. No. 6,177,615). The strength and duration of insecticidal application will be set with regard to conditions specific to the particular pest(s), crop(s) to be treated and particular environmental conditions. The proportional ratio of active ingredient to carrier will naturally depend on the chemical nature, solubility, and stability of the insecticidal composition, as well as the particular formulation contemplated.

Other application techniques, e.g., dusting, sprinkling, soaking, soil injection, seed coating, seedling coating, spraying, aerating, misting, atomizing, and the like, are also feasible and may be required under certain circumstances such as e.g., insects that cause root or stalk infestation, or for application to delicate vegetation or ornamental plants. These application procedures are also well known to those of skill in the art.

The insecticidal compositions may be employed in the method of the present invention singly or in combination with other compounds, including and not limited to other insecticidal proteins and pesticides. The method of the invention may also be used in conjunction with other treatments such as surfactants, detergents, polymers or time-release formulations. The insecticidal compositions of the present invention may be formulated for either systemic or topical use.

Having now generally described the invention, the same will be more readily understood through reference to the following examples that are provided by way of illustration, and are not intended to be limiting of the present invention, unless specified.

EXAMPLES

Example 1

This example illustrates the isolation of *Xenorhabdus* bacteria.

*Xenorhabdus nematophila* bacterium, strain Xs86068, was isolated from entomopathogenic nematodes according to the following procedure. Entomopathogenic nematodes were isolated from soil samples and entomopathogenic nematode suspensions were prepared according to the entomopathogenic nematode baiting method as disclosed in the US patent application (application Ser. No. 09/897,516). A variety of fourth instar insect larvae that included Western corn rootworm (WCR, *Diabrotica virgifera virgifera*), corn ear worm (CEW, *Helicoverpa zea*), tobacco bud worm (TBW, *Heliothis virescens*), black cut worm (BCW, *Agrotis epsilon*), beet army worm (BAW, *Spodoptera exigua*), boll weevil (BWV, *Anthomonas grandis grandis*), and *Galleria mellonella* were placed individually in a 24-well plate containing Whatman filters in each well. Approximately ten microliters (μL) of an entomopathogenic nematode suspension were added into each well with one insect. The plates was sealed with Parafilm™ and placed at 25° C. in the dark. After 48 to 72 hours dead insect larvae were removed from the 24-well plate. The insect larvae were surface sterilized [20 milliliter (mL) $H_2O$, 3 mL 4M NaOH and 1 mL 5% NaOCl) for 5 minutes and air-dried. The insect larvae were cut open with sterile instruments on the lateral side without injuring the gut and the hemolymph was streaked on indicator plates (NBTA and NA). The agar plates were incubated at 30° C. in the dark for 48 hours.

Characteristic blue colonies were selected from the indicator plates: phase I *Xenorhabdus* bacteria were able to take up bromthymol blue dye from the NBT agar and form the blue colonies. Bacterial characterization was performed according to methods known to the one skilled in the art (Farmer, *Bergey's Manual of Systematic Bacteriology*, Vol. 1: 510-511, 1984; Akhurst & Boemare, *J. Gen. Microbiol.*, Vol. 133: 1835-1845, 1988; Boemare et al., *Int. J. Syst. Bacteriol.*, Vol. 44: 249-255, 1993).

Single characteristic phase I colonies were picked up by an inoculation loop and suspended into BHI media (Brain Heart Infusion medium (Difco), 32 g/l, 50 mL in a 250 mL baffled flask). The bacteria were grown at 25° C. at 280 rpm on a rotary shaker in the dark. After 24 hours 15% glycerol was added to the bacterial culture, 1.5 mL aliquots for stock cultures were placed into cryovials and stored at −80° C.

The isolated *Xenorhabdus* strain Xs86068 was deposited according to the Budapest Treaty on the International Recognition of the Deposit of Microorganisms for the Purpose of Patent Procedures with the Agriculture Research Culture Collection (NRRL) International Depositary Authority at 1815 North University Street, in Peoria, Ill., ZIP 61604, U.S.A., on Jul. 26, 2004 and designated as NRRL B-30757. It is contemplated for use as a source for DNA sequences encoding insecticidal and other types of useful proteins, and when formulated into a composition of matter as a spray, powder or emulsion, for the treatment of plants or animals to inhibit insect infestation and the like.

Example 2

This example illustrates the construction and characterization of a *Xenorhabdus* genomic library.

Genomic DNA from *Xenorhabdus*, strain Xs86068, was prepared for construction of a genomic library using methods well known in the art. Xs86068 bacterial cells were grown in brain heart infusion broth (Difco) for 42 hours at 25° C. to mid-exponential phase (OD650 approximately 1.0). Cells were poured into ten 1.5 mL-microcentrifuge tubes and spun for 5 minutes at about 10,000 RPM to pellet. The supernatant was removed and the cells were frozen. The frozen pellets were resuspended into 200 µL of TE (10 mM Tris, 1 mM EDTA, pH 8.0). Genomic DNA was prepared from the frozen cell pellets using the Promega Genomic Preparation kit following the instructions of the manufacturer (Promega Corp., Madison, Wis.). Ten DNA samples were prepared from the cells above, and two of the samples were resuspended into 50 µL of TE. Sample purity was tested and confirmed by digestion using the restriction enzymes EcoRI, HindIII, NotI, and SalI. The resuspended samples were used for the preparation of the genomic library.

The genomic library of *Xenorhabdus* strain Xs86068, LIB4695, was prepared according to standard procedures well known to those skilled in the art. Genomic DNA was sheared and then polished with T4 polymerase and T4 polynucleotide kinase. LIB4695 was constructed from fragments 2-5 KB in length. Size fractionated fragments were recovered from an agarose gel. Blunt end ligation was used to clone DNA fractions into the HincII site of the standard cloning vector pUC18. The resulting ligation reactions were transformed into *E. coli* DH10B. The resulting vector fragment contains an intact beta-lactamase coding sequence enabling selection of transformed cells containing genomic DNA insertions on media containing ampicillin. Ninety-six ampicillin resistant transformants were inoculated into 96 well deep well boxes containing TB media and ampicillin to determine the efficiency of the library construction. 95% of colonies arising from the transformation contained an insert, presumably derived from the genomic sequences. Approximately 15,000 colony-forming units per microliter of ligation mix were obtained. About thirty thousand individual recombinant colonies from each library were selected for DNA sequence analysis of inserted genomic DNA.

Example 3

This example serves to illustrate the generation and assembly of *Xenorhabdus* genome sequences and the assembly into contiguous sequences. The two basic methods for the DNA sequencing are the chain termination method of Sanger et al., *Proc. Natl. Acad. Sci. (U.S.A.)* 74:5463-5467, 1977) and the chemical degradation method of Maxam and Gilbert, *Proc. Natl. Acad. Sci. (U.S.A.)* 74:560-564, 1977). PHRED (phragment editor, Phil Green, University of Washington) was used to call the bases from the sequence trace files and to assign quality scores to the bases. After the base calling was completed, sequence preprocessing was performed by removing 5' and 3' vector and linker sequences, according to standard procedures well known in the art. The preprocessed sequences were then assembled into contigs, or groups of overlapping sequences. Contigs were assembled using PHRAP (phragment assembly program, Phil Green, University of Washington) using default assembly parameters.

A total of 494 contigs were obtained and contig sequences were recognized as those sequences whose designations begin with Xb4695.C. All contig sequences were run through the annotation and gene selection processes as described in Example 4 below. The contig sequences were listed in the Sequence Listing file from SEQ ID NO:16425 to SEQ ID NO:16918.

Example 4

This example illustrates the identification and annotations of different genes within the 494 contigs assembled as described in Example 3. FGENESB gene prediction algorithm (Softberry, Inc., Mount Kisco, N.Y.) was used for this purpose. The genes and partial genes embedded in such contigs were identified through a series of bioinformatic analyses following the instructions as described in the program. The *X. nematophila* genome from strain Xs86068, as assembled from LIB4695, consisted of 494 sequence contigs. The sequence contigs were annotated to identify genes and gene regulation elements. As a result, 6108 protein-coding genes (SEQ ID NO:1 through SEQ ID NO:6108), 2651 promoters (SEQ ID NO:12217 through SEQ ID NO:14867), 1475 terminators (SEQ ID NO:14868 through SEQ ID NO:16342) and 82 ribosomal and transfer RNA genes (SEQ ID NO:16343 through SEQ ID NO:16424) were identified.

The *Xenorhabdus* genome was annotated by searching for homology to genes of known functions. These searches were done using homology to whole protein using blast as well as similarity to protein domains using Pfam and Hidden Markov Model algorithms. The annotations were then associated with the genes. The genome annotation was completed with FGENESB, a bacterial gene/operon prediction and annotation pipeline developed by Softberry Inc. (Mount Kisco, N.Y., USA). The annotation database and parameters were updated and customized when processing *X. nematophila* genome. These annotations were assembled into a database that could be queried by searching for key words using wildcard text searches.

The analysis was done by performing keyword searches against the annotated genome sequences in the database. Since *Xenorhabdus* is an insect pathogen, it may contain potent insecticidal molecules that are similar to the toxin complex (tc) toxins previously shown to be associated with *Photorhabdus*. There may be many genes that are associated with virulence and pathogenesis in other eukaryotes. These may include, for example, hemolysins, lipases, and RTX (repeats in toxin) family of cytolytic toxins. Homologs of histone, proteins sequestering iron, polyketides and Non-ribosomal (NRP) peptides, etc., were also searched for homology to genes of known functions. The exemplary key words used to conduct the searches included tc, toxin, RTX, PapA, hemolysin, lipase, chitinase, protease, ferritin, iron, chelin, pyoverdin, resistance, restriction, insect, *Drosophila*, ketide, NRP, polyketides, non-ribosomal, polymer, nema and nematode, etc. A wild card was used with all searches.

The search results have shown that the *Xenorhabdus* strain Xs86068 has proteins that are homologous to many important known proteins or polypeptides. The search for homologs has also led to some new discoveries. Discovery of histone homologs was unexpected as histones were not previously found in bacteria. These genes might make histones that would affect an insect's growth and development by disrupting its normal cellular processes. A PapA homolog was identified in this sequence pool. PapA has been demonstrated to have an insecticidal activity (Khandelwal et al., Biochem. Biophy. Res. Commun. 314: 943-949, 2004). The first step was done to look for any annotation containing the word "resistance" and put them into first class. Often these homologs referred to resistance to metals (e.g. tellurite resistance) or antibiotics (e.g. tetracycline resistance). Resistance homologs may also came about from small phage-like particles called colicins. These proteins may often be evolved from phage tails. Polyketides and non-ribosomal (NRP) peptides were very large proteins, often greater than 1000 amino acid residues. Proteins that affected fungi and insect skeletons included chitinases. Proteins sequestering iron were often a virulence determinant. Homologs identified included ferritin.

In summary, the nucleotide sequences identified in SEQ ID NO:1 through SEQ ID NO:12216 encode many useful *Xenorhabdus* polypeptides or proteins, including but not limited to insect inhibitory polypeptides or proteins as set forth in SEQ ID NO's 6903, 6904, 6905, 7110, 7179, 7776, 7777, 7803, 8275, 8277, 8279, 8280, 8281, 8454, 8468, 8595, 9946, 10477, 10481, 10482, 10483, 10484, 10485, 10486, 10487, 10488, 10551, 11147, 11688, 11690, 11691, 11692 and 11693; a PapA protein as set forth in SEQ ID NO:7514; hemolysin lipase protein homologues set forth in SEQ ID NO's: 6531, 6578, 6696, 7505, 7679, 7793, 7939, 8216, 8220, 8222, 8366, 8745, 9199, 9212, 10143, 10306, 10325, 10683, 10919, 10995, 10996, 11246, 11991 and 12000; polyketide synthases as set forth in SEQ ID NO's: 7253, 8852, 8857, 8864, 9558, 9560, 11014, 11583, 11587, 12090 and 12112; protease homologs as set forth in SEQ ID NO's 6308, 6309, 6310, 6393, 6537, 6549, 6595, 6774, 6941, 6942, 7199, 7289, 7328, 7503, 7627, 7682, 7683, 7749, 8152, 8300, 8301, 8870, 8957, 9108, 9263, 9265, 9296, 9319, 9343, 9720, 9725, 9748, 9749, 9884, 10246, 10385, 10461, 10588, 10614, 10896, 11020, 11830, 11831 and 11901; chitinases as set forth in SEQ ID NO's 6902, 6906, 7325, 8047 and 10542; restriction enzymes as set forth in SEQ ID NO's 8941, 8945, 9353, 11041, 11042, 11113 and 11114; histone homologues as set forth in SEQ ID NO's 6182, 7457, 7980, 8272, 8605, 8765, 8778, 8861, 9590, 9802, 10293, 10449, 10469, 10762, 10812, 10926, 11206, 11677 and 12135; ferritin homologues as set forth in SEQ ID NO's 6267, 6268 and 9272; drug metabolite transporter protein homologues set forth in SEQ ID NO's 6836, 6837, 7447, 8274, 8701, 9071, 9100, 9579, 10205, 10446, 10456, 10604, 10737 and 11018; polypeptides or proteins capable of conferring resistance to heavy metals or other toxic compositions as set forth in SEQ ID NO's 7432, 7741, 8701, 8706, 8828, 8829, 9071, 9181, 9271, 10600 and 11018; RTX (repeats in toxin) homologues as set forth in SEQ ID NO's: 9946, 10551 and 10643; a pyoverdin protein homologue as set forth in SEQ ID NO: 6598; a Zinc finger protein homologue as set forth in SEQ ID NO: 8011; an enterochelin protein homologue as set forth in SEQ ID NO: 8528; nonribosomal peptide homologues as set forth in SEQ ID NO's: 6870, 7462, 7463, 8248, 8339, 8492, 8530, 8546, 8547, 8856, 8860, 8863, 9225, 9226, 9227, 9552, 10073, 10506, 10726, 11003, 11004, 11005, 11012, 11013, 11015, 11584, 11585, 11588, 11590, 11591, 11844, 11845, 12085 and 12089; and a protein homologue to proteins from *Drosophila* species as set forth in SEQ ID NO: 7909. These proteins or polypeptides, offered by way of illustration and not by way of limitation, are just some of the exemplary proteins or peptides from the *Xenorhabdus* strain Xs86068 that are homologous to known proteins or polypeptides.

Example 5

*Xenorhabdus* strain Xs86068 was evaluated for its insecticidal activities using the following procedure. Strain 86068 was evaluated with other two *Xenorhabdus* strains Xs86830 (isolated from *Galleria melonella*) and Xs86832 (isolated from beet armyworm, BAW, *Spodotera exigua*) for comparative purpose. Specifically, three 250 mL baffled flasks each containing 50 mL BHI medium were each inoculated with 1.5 mL bacterial stock culture from each strain, respectively, and incubated at 25° C. and 280 rpm on a rotary shaker in the dark for 48 hours. The culture broth was centrifuged at 2600×g for 30 minutes at 4° C. and decanted from the cell and debris pellet. The broth was then sterile-filtered (0.2 μm) and dialyzed. The culture supernatant was concentrated 5× and was then used for bioassays to evaluate insect inhibitory properties. Five milliliter of the supernatant was applied to each insect larva for bioassay and the larvae were obtained using insect eggs obtained from commercial sources, hatched and reared using conventional methods known in the art.

Insect inhibitory activities of these strains were evaluated against members of the insects in the orders Coleoptera that included Western corn rootworm (WCR, *Diabrotica virgifera virgifera*) and cotton boll weevil (BWV, *Anthomonas grandis grandis*), Lepidoptera that included tobacco budworm (TBW, *Heliothis virescens*), corn earworm (CEW, *Helicoverpa zea*), black cutworm (BCW, *Agrotis epsilon*), and Hemiptera that included Western tarnished plant bug (WTPB, *Lygus hespus*). Insect inhibitory activity against Western corn rootworm larvae was evaluated as follows. *Xenorhabdus* culture supernatant, control medium (BHI) or Tris buffer, pH 7.0, was applied to the surface (about 0.38 cm$^2$) of a modified artificial diet (BIOSERV™; diet product F9757) in 20 μL aliquots. The plates were allowed to air-dry in a drying chamber (16-20° C.; 40-50% RH) and the wells were infested with single non-diapausing neonate WCR hatched from surface disinfested eggs (Pleau, Master of Science Thesis, Saint Louis University, 1999). Plates were sealed, placed in a humidified growth chamber and maintained at 27° C. for the appropriate period (5-7 days). Mortality and stunting (0-3) scores were then assessed and statistically analyzed (SAS institute, user's manual for JMP version 3.2, 1989-1997). Twenty four insects per treatment were used in all studies. Control mortality was generally less than 10%.

Insect inhibitory activity against Lepidopteran larvae was tested as follows. *Xenorhabdus* culture supernatant, control medium (BHI) and Tris buffer, pH 7.0, were applied directly to the surface (about 0.38 cm$^2$) of standard artificial Lepidopteran diet (Southland Products Incorporated, Lake Village, AR; Lepidopteran multi-species diet) in 20 µL aliquots. The diet plates were allowed to air-dry in a drying chamber (16-20° C.; 40-50% RH). The test wells were then infested with insect eggs of TBW, CEW or BCW suspended in agar. In the case of ECB, neonates were hand infested into the wells at one neonate per well. Following infestation, diet plates were sealed, placed in a humidity controlled growth chamber and maintained in the dark at 27° C. for the appropriate period of time. Mortality and stunting measurements were scored at day 5 and statistically analyzed (SAS institute, 1989-1997, User's manual for JMP version 3.2). Generally 24 insects per treatment were used in all studies. Control mortality generally ranged from 0-12.5%.

Insect inhibitory activity against the cotton boll weevil was evaluated as follows. *Xenorhabdus* supernatant, control medium (BHI) or Tris, pH 7.0, were applied in 20 µL aliquots to the surface of 200 µL of artificial diet (Bioserv™ Co., Frenchtown, N.J.; diet product F9247) and allowed to air-dry. Boll weevil eggs were then placed into the wells, the wells sealed and the plates held at 27° C., 60% relative humidity (RH) for 6 days. An activity score, based on confounding of gross production, growth and mortality, was then assessed and analyzed statistically (SAS institute, ibid). Control mortality ranged between 0% and 25%.

Insect inhibitory activity was also tested against *Lygus* bugs (Western Tarnished Plant Bug (WTPB), *Lygus hesperus* Knight) in the order Hemiptera. The insect inhibitory activity against *Lygus* bug was tested as follows. Feeding domes were made using a dome-making machine manufactured by Analytical Research Systems (Gainesville, Fla.). Briefly, the system used a vacuum to form domes from PARAFILM™ sheeting using an aluminum block template shaped in the form of a 96-well microtiter-plate. To each such formed dome was added 40 uL of a 1:10 (v/v) dilution of test solution in diet. The dome-molded PARAFILM™ was then heat sealed with a sheet of Mylar. The resulting PARAFILM™ dome sheet (96-wells) was placed onto a 96-well flat-bottomed microtiter plate containing one *Lygus* nymph per well. The assay was typically scored after 4 days for mortality and stunting, using a scale of 0 (no mortality or stunting) to 3 (complete mortality).

The bioassay results demonstrated that the culture supernatant containing insecticidal proteins from *X. nematophila*, strain Xs86068, exhibited insecticidal activity against some of the insect species tested. Specifically, the culture supernatant exhibited very strong insecticidal activity against WCR, BWV and WTPB. All strains showed very strong stunting effects against BWV and, among them, strain Xs86068 showed the strongest stunting effect. Similarly, all strains showed high mortality rates and, among them, strain Xs86068 showed 100% mortality rate. However, while other two strains demonstrated much lower mortality effects against WTPB, the strain Xs86068 gained the highest mortality rate (90.5%). The overall insecticidal activity of strain Xs86068 against BWV and WCR were comparable to the activities of strains Xs86830 and Xs86832. Strain Xs86068 seemed to be more active against WTPB in comparison to strains Xs86830 and Xs86832. Therefore, the bioassays using the cultural supernatant exhibited insecticidal activities against WCR, BWV and WTPB, but not against TBW, CEW and BCW.

In the other bioassay conducted, similar results were observed. The strain Xs86068 was tested against WCR and WTPB as 1× unprocessed supernatant from a 48 h shaken culture (BHI medium, 25° C.). The culture was used as un-heated, heated (boiled 20 min.), and concentrated 5-fold (3K MWCO). The untreated 1× culture was most active against WCR with 100% mortality rate and the highest stunting effect rated as number 3. Similarly, the untreated 1× culture was most active against WTPB with 90% mortality rate (stunting rate unavailable). Heating process destroyed the insecticidal activity against WCR with 0% mortality rate but only decreased the insecticidal activity against WTPB with 49% mortality. Concentration of the supernatant by 5-fold decreased the insecticidal activity on both the insects with 12% mortality on WCR and 82% mortality on WTPB. Therefore, the insecticidal activity against WCR and WTPB seems to be heat-labile.

The specification above describes exemplary embodiments of the present invention. It will be understood by those skilled in the art that, without departing from the scope and spirit of the present invention and without undue experimentation, the present invention can be performed within a wide range of equivalent parameters. While the present invention has been described in connection with specific embodiments, it will be understood that it is capable of further modifications. Various permutations and combination of the elements provided in all the claims that follow are possible and fall within the scope of this invention.

SEQ ID NO's referred to herein are listed in the sequence listing on CD-ROM which accompanies this specification. All patent publications referred to in this specification are incorporated herein by reference.

SEQUENCE LISTING (16918 sequences)

SEQ ID NO: 1 - DNA, 787 bp, Xenorhabdus bovienii
  unsure (1)..(787): unsure at all n locations
  Coding DNA location: Contig name=SeqID_16425; Position on contig =2..788bp; Strand=-
ttgacgccaaacgagtggctggatctgggcgggttgaacgaactgtcagcagaagaatattntggggcaagcctgtggcagctctacaagagtgttgactctccttataaagcagttttgaaaagtctgctgctggaggcctattcatgggaatatccgaacggaaaattgctgtcaatggagatgaaacagcatttccatgatggttctattgtttccttcggccttgattcttatagcatgatgcttgagcgtgtaacccgttatctcaccgcaacgaacgatttcacgcgtctggatctggcgcgccgttgtttttacctgaaagtttgcgaaaagatgctgggaagccacgaggataaaggctgtacaggatggcgccatcaggtcatgtcgcagctggcgcatgaatggggttgggatgccagcaaattggcaatgctggataaccgtaattcatggaaaatcgggctagtgcgtgatgctcataatgaattactggataccatgatgatgagttatcgcaatttgatccgctttgcccggcgtaacaatttaagtgtgagtgccagcccacaggatattggcgtactgacccgtaaattgtatgcagcatttgaagccttgcccggtaaagtcactctggtgaatccacaaatttcaccggatctgacagaacaggatctgacattcatctatgttccgcctggcggctggtatctttacaatcacgcgcccacgatagaaacgatcatcggccgacctgcaggcanntgcaaggctttgc

SEQ ID NO: 2 - DNA, 205 bp, Xenorhabdus bovienii
  unsure (1)..(205): unsure at all n locations
  Coding DNA location: Contig name=SeqID_16426; Position on contig =3..207bp; Strand=-
ttggaagatagtgacaactggcgctatgtccctgtgcgccgcctgtttaataccgtcgagcgggatgttaagcgcgcgatgagctttgctatgttcgagccaaacaaccagccgacttgggaacgtgtcagggcggcgatcagcaattatcttcatggcctgtgnnnnnnnnnnnnnnnnnnnnnnnnnnnnnnnnnnnnnnnnc

SEQ ID NO: 3 - DNA, 213 bp, Xenorhabdus bovienii
  unsure (1)..(213): unsure at all n locations
  Coding DNA location: Contig name=SeqID_16433; Position on contig =772..984bp; Strand=-
agagaaaactccctttctccctttttctctccctccctnnnnnnncnnnntnttttttcttttctctccccccccnnnnnnnncnnnnnnnnaaaananaannnaannnnaannnaananagggnggggggggggggggggnnnnnnctnnnnnnnnnccctcccctccctccncctnnnntnctnggggttntntgggnnnnnnnnnnnnnn

SEQ ID NO: 4 - DNA, 162 bp, Xenorhabdus bovienii
  unsure (1)..(162): unsure at all n locations
  Coding DNA location: Contig name=SeqID_16448; Position on contig =2..163bp; Strand=+
aaaacagtggcggacctagcaagacttggaaatnnnnnnnngggggttnnggnnggggggggnnnngntgggggggccncnaaaaaaaaaggattaaaaaaaaaaaagctactgagaggaaaagggaaaaaccgggtttaccgggggggtaaaaccctttaa

SEQ ID NO: 5 - DNA, 357 bp, Xenorhabdus bovienii
  unsure (1)..(357): unsure at all n locations
  Coding DNA location: Contig name=SeqID_16449; Position on contig =245..601bp; Strand=-
ttgtgtgggggggggcgctttaaaaaaataaaaaaaaaaaaatgggggcaaaaaggggccccttttttttggggggggggggggaaaaaaaaaagaaaaaaaaaaaaaccccctccttttgtaaaaaaaaaaaagggggttttttttaaaaaaaaaaaagaggggttttttttaaaaggggccctttttttaaaaatttcccaagaaaaccgggggaaaaatttttttgggggggtggggtttttttttggaaacccaaattttgggggtaaggggaaatattttggggggtgtttttggtttgaaaaagggtttgaattgggccaagnacgttttttgttnttaagccgtatttaa

SEQ ID NO: 6 - DNA, 183 bp, Xenorhabdus bovienii
  unsure (1)..(183): unsure at all n locations
  Coding DNA location: Contig name=SeqID_16458; Position on contig =737..919bp; Strand=-
gtgggggggggaancncaaannntaaaataaaaaccngcggggggggggagaaaaannaaaaaattnnnatacaaaccncgcggggggggtgggggaaaanntattttaatccnccccnccttcnttcctgggggggtgagggggcncaagaggggggggcggggttttcgggaaaaaaataa

SEQ ID NO: 7 - DNA, 234 bp, Xenorhabdus bovienii
  Coding DNA location: Contig name=SeqID_16462; Position on contig =413..646bp; Strand=+
atgaatccagaagatattgctttattggggtatcaagcgggagatcgggttgatatcgagacggtatggaatgatggtattgagcgcaaagtgtatggctttaagctggttccttacgccattccacgcgggaatcttgcgggctattacccggaaaccaatccattagtgccgatggatagtatcggcaatggcacgggcacaccaacgtcaaaatctgtgccgtttaaataa

SEQ ID NO: 8 - DNA, 195 bp, Xenorhabdus bovienii
  unsure (1)..(195): unsure at all n locations
  Coding DNA location: Contig name=SeqID_16472; Position on contig =148..342bp; Strand=+
ttgggggggggggaagaaaaaaaaaaaaaaannggttataaaaaaantagtgannnaattttttatttgggggggggaaaaaaaggaggagaaaaatataaaaagnncccacccaaaaaaaaaacctgtccttttncctggtncgagccttttttaagggggcgggaaaaccccaaaaaaaaaaagggcctttaa

SEQ ID NO: 9 - DNA, 454 bp, Xenorhabdus bovienii
  Coding DNA location: Contig name=SeqID_16472; Position on contig =443..896bp; Strand=+
ttgggaacccggggccaaaaaaaaagggaaaggggggccctggggggccaaaaggaaggagggaaaaagagggcaaaaggggggccaaaaaaaaaagagggggggggccccacaccccccctggagagaaaggggggggttcctccgccaaagaagagaccccccccacccccccccgcggggaaaaaaaaggaggggccacaaacaaaaaccccaagaccttatgttaaaaaaaaaaagggggggggggtggttttcataaacgaacaccacacacccgaaaattgggggggggggggggggcgaaaaaaaaaaaaacaacaacgcccgcgggggggggggaaaaaaaacgacccggacaaaaaaaaaaaaaaaaggtggcggcccgggggggcgggaacaacaaacaccagaggaagggggggggggggtgcggtccacgcgaaagacaaga

SEQ ID NO: 10 - DNA, 171 bp, Xenorhabdus bovienii
  unsure (1)..(171): unsure at all n locations
  Coding DNA location: Contig name=SeqID_16476; Position on contig =305..475bp; Strand=-
atgggtggttttttttttttaaaaaatatgggaaaaagggttcccccgaaaaaaaaaaaagatttttgggggttttgtgttttttggaaaaaattaccctgggggggcctcttttttaagggcccaacccggttaaaaattatcccccaaaattttgngaccccgggttaa

SEQ ID NO: 11 - DNA, 195 bp, Xenorhabdus bovienii
  unsure (1)..(195): unsure at all n locations
  Coding DNA location: Contig name=SeqID_16479; Position on contig =21..215bp; Strand=-
atgggccacaaaaggtttcagggcaaaagtgttggatttggtgcccaccaaaaagggggggaaaaaaaaaaggggggttttgnnnccccccccaaaaaaaaaanagggggggnnaaaaacnaaaaannggggnaaaaaanncccccaaaannnccctttnnaannccccannnccnctnncacataagttattaa

SEQ ID NO: 12 - DNA, 312 bp, Xenorhabdus bovienii
  unsure (1)..(312): unsure at all n locations
  Coding DNA location: Contig name=SeqID_16488; Position on contig =932..1243bp; Strand=-
ttnnntnnnnaantannnnncnngaagnnnnnnngnncaaanaagtacnaaantgnnnncaaantnnncggnnnnttannncnngannaaacngtnnncnnaatcagnnntncnnnngaaancnnngnncnntngnncnntaannnnntncnnnnnntnnggnacnnnaancanaaanngatancnngnnnncaagnnaantnngntnntnnnnaaagnncnnntttggnnncnnncnngnaananagttncnngnnctgnnanngtcnnaaaacnganaanntnnanctngnatngcnaagtgaaagntaa

SEQ ID NO: 13 - DNA, 195 bp, Xenorhabdus bovienii
  unsure (1)..(195): unsure at all n locations
  Coding DNA location: Contig name=SeqID_16490; Position on contig =3..197bp; Strand=+
accaanagtcggngttatgacactgaaccaataatctttnntatacagnataaattaaccgacctattctatcaatttactgcccctttaattatcttaatgaacgaatttcaaccttttcgggtttataaatgggggaaacttttaaaagggggaaaagggcgctttggaattaacccttttaaaaacttttaa

SEQ ID NO: 14 - DNA, 579 bp, Xenorhabdus bovienii
  unsure (1)..(579): unsure at all n locations
  Coding DNA location: Contig name=SeqID_16490; Position on contig =199..777bp; Strand=-
ttgtttcgccccccccccccccaaaaaaaaaaagaaagaatacatttttttttttttcgcgcgcggggggggagaaaaaaaaaaaagagtgggggaggttgtttttttttcttttcccacacaaaaaaaaatttttttttcgttggggggggaaaaaaaaaaaaaaaaaaatttttttttttatgggggggggggggggggttttgtttatattccccaccaagaaagggggcaaattatatcccaaaaagagggtggccttttttccccccccccncnaaccccctttgtttttttgtaaaaaaaaaaaaaaaaatattctttttcttttttcgcggcggggaaaaaaaaaataaaaaaacccccgcgcgccccccccgcgaaaaaaaaaaaagagggggggggggggggaaaaaaaaaactttttttttattttggcggccccacccccctattataaaaaaaaaaaattttggggggggggcccccctatttttttcccccccgggggggggggtgggctccccccggggggaaaaaaaccccccggggggattgggaaacaccggttttttttaa

SEQ ID NO: 15 - DNA, 237 bp, Xenorhabdus bovienii
  unsure (1)..(237): unsure at all n locations
  Coding DNA location: Contig name=SeqID_16492; Position on contig =215..451bp; Strand=-
ttnnaaaaattnnaaaatttnnttnnttttnngggncccccctggggngggngggtttnnnaaaaatttnttttntnnnnnnccctngggnnnaaaaaaaaaagggncccgnnggnnaaaaaaaaccccggttgttnggttggggggggtttttttttttgggggggggggtggttttnnnnnnnnnnggggggggggggggggggggggnnnnttttttttttttttnnnnnnnnn

SEQ ID NO: 16 - DNA, 507 bp, Xenorhabdus bovienii
  unsure (1)..(507): unsure at all n locations
  Coding DNA location: Contig name=SeqID_16493; Position on contig =31..537bp; Strand=-
gtgngcccccccccccgcccccccccacacacaaaaaaaaaaataatttgttttttttgtttggggtggagaggggggcccccccgccgcgccccacaccacaaaaagaggagagtgagaggaggggggggggggcggcccgcggcgcgcccgcgcgccccccccacagtactgtatatttttatttttttattgtgtgtgggggggggggggggggggaaaataaagagggggcgtgtgcggagcgcgccccccccccacaaaaaaagaaagagggtgcgcccccccccccccacaccaaagaaggtgaaaagaaaaaagggaagaaaaaaaaaagggaggagaaaaaaaaattttttttttttttataaaaaaaaaaaaaaaannggggggggggggggagggggggggggggnnccccnccccccccacaaaaaaaagtttttgtgtttttnnngnttaaggggggggggnncccccccaaaaannnccccgggaaanncctaa

SEQ ID NO: 17 - DNA, 153 bp, Xenorhabdus bovienii
  unsure (1)..(153): unsure at all n locations
  Coding DNA location: Contig name=SeqID_16493; Position on contig =864..1016bp; Strand=-
atgtggggggggnggggggggggnngngaggaagagagaggagagaatagaggaggaaaggcgggcgagagtcgctcagcgaccgacgccgcccccgcgcgcgacgccagcgaggggtggtgngtgtgtgttttttgttgttgtttaagataa

SEQ ID NO: 18 - DNA, 168 bp, Xenorhabdus bovienii
  unsure (1)..(168): unsure at all n locations
  Coding DNA location: Contig name=SeqID_16494; Position on contig =309..476bp; Strand=-
ttgnanngnattaanccngnannananttnanannnccanngnngnttggnngttnttgnngannncttaacttaangnanngnngnattnnncncnncnccgngnggttannncnnncgnanggntcttnncgnannatttttnncttatatatnacactccnnnnn

SEQ ID NO: 19 - DNA, 504 bp, Xenorhabdus bovienii
  unsure (1)..(504): unsure at all n locations
  Coding DNA location: Contig name=SeqID_16494; Position on contig =827..1330bp; Strand=-
ttttattttttcccccccccccccccctcttttattttttttttatttccccaaccccccccccccccccggaaaaaaacaaaaaaaaaaaaannnnnttttttttttttttttttttttttnngggggggcccccccacccccactttttttttttttttttttttttttgggncccacaacaaaaaaaaaaaggcccccccccccccccccaaaaaaaaaaccctctcccccctcccccccacgttttttttaaaaaaaattgttaaaaaaaaattttttttttttccccccccaacaccctttttttttggggtttttttttttttccccccccccaaaaaaatattttttcccccccctttttttatttttttttttttttctcccaccccaccccctctcaaaaaaattttttttttttttccccctccccccccccccctttttttttttttttttttacccccccccccccaaatttattttttttttttttattaa

SEQ ID NO: 20 - DNA, 204 bp, Xenorhabdus bovienii
  unsure (1)..(204): unsure at all n locations
  Coding DNA location: Contig name=SeqID_16496; Position on contig =23..226bp; Strand=-
ttngnntttnnnnnnnngntnnnnnntannnncccnccnctccntnnntttttnngnnntttttnnnnnncttntngtnttnnnntgnanccncttatccctacttgttttnctagttngngagnattttcntttnttctcctttttttnncttgtttccngtttggcctccaggccttccaatatgcccnnnnnnnnnnnnnn

SEQ ID NO: 21 - DNA, 291 bp, Xenorhabdus bovienii
  unsure (1)..(291): unsure at all n locations
  Coding DNA location: Contig name=SeqID_16511; Position on contig =2..292bp; Strand=+
atggtttccgaaattccgggcctcggtaccccggggaatccctcagaggtctnaatcgtggtcaaacggcatccctttccgcaacggcttgaaaacttaagtggtacccggaccgggcacattcttcgtnctttttcagcccaaaaangaatggttaagggcaaaaaactgngcttacacctgttcanggcacaggngaaaaaactcctgggcgcctttggaaatttgacccaaaccggccgggcagaaaaaaatcagagggcctgtggtttaaacgggccccgggtttaa

SEQ ID NO: 22 - DNA, 249 bp, Xenorhabdus bovienii
  unsure (1)..(249): unsure at all n locations
  Coding DNA location: Contig name=SeqID_16517; Position on contig =303..551bp; Strand=-
ttggggggggggcccccgcgggggggtttacggggggggggggggggggggttcctccgggggggggtttccggggggggggggggggggcaaaaaagggggggggggccccccccgggggggggggggganactccctcctccccacaaanttttttttgggttttgggggggggggcactttcggggggggttttccccccggggggggtcccgggggggggggttttggggccggggggggggtaa

SEQ ID NO: 23 - DNA, 342 bp, Xenorhabdus bovienii
  unsure (1)..(342): unsure at all n locations
  Coding DNA location: Contig name=SeqID_16521; Position on contig =28..369bp; Strand=-
ttggaaagcccggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacctgcaggcatgnccacagtag

SEQ ID NO: 24 - DNA, 153 bp, Xenorhabdus bovienii
  unsure (1)..(153): unsure at all n locations
  Coding DNA location: Contig name=SeqID_16528; Position on contig =3..155bp; Strand=+
aactangggttgcatgacatcgcaggttcngngnaaanactantcgttatttttggcaaaancttcncggcggnagcccatttattngnnnctggggccgctttctgcctagggaacgttaattcggtgggaaaggaaaaacacgctctttga

SEQ ID NO: 25 - DNA, 261 bp, Xenorhabdus bovienii
  unsure (1)..(261): unsure at all n locations
  Coding DNA location: Contig name=SeqID_16530; Position on contig =185..445bp; Strand=+
atggangnaacccnaaanacccannnnaaatccccggcccccggggttttttctccaaaaccccggggttttgggnttatttgggggtttttngcggcccccgggtttnccctncccccgggcccaaaggggggggnanaaaacccccaacccgggtttttggggggnccccccaagggggggngggggttttttttccccccctttgggggggnnnaaaaaaaatttnaaaaaaaaattnnaaccccccccggggtttaa

SEQ ID NO: 26 - DNA, 195 bp, Xenorhabdus bovienii
  unsure (1)..(195): unsure at all n locations
  Coding DNA location: Contig name=SeqID_16539; Position on contig =346..540bp; Strand=-
atggaattgggggggaaaaaaaaaaaagggattaccaaatttaccccggattgggaaaaggnctggnagggggtttttgggggggaaaaaaaacnaggggtnatattnncccagtgtnatcnnccccnaggtggggaaattttttnggtttttttnnatttcnnccccnnnnnanaatttattttannatattag

SEQ ID NO: 27 - DNA, 330 bp, Xenorhabdus bovienii
  unsure (1)..(330): unsure at all n locations
  Coding DNA location: Contig name=SeqID_16545; Position on contig =437..766bp; Strand=-
gtggggggtggngtgttggtttggggtgggggtggtgtgtggtgggcggcggtggggtggtggngggtgggggggggggggggggggggggggtgtgtngtgtgtgtggtgtggggttggtgtgggtgtgtgctgtggggtggtgtggggtttgggggggggggggggggttttttttggggggggtggggggtggggtgtgggtgggtgggggttgtggttgggttgtgggtgggggtggggggggtggtgtgggggtggggggggtcgcggaaaaaaaaaaaaggggggggggtgggggccggtcgcccggttggggtgggtgaataa

SEQ ID NO: 28 - DNA, 120 bp, Xenorhabdus bovienii
  unsure (1)..(120): unsure at all n locations
  Coding DNA location: Contig name=SeqID_16545; Position on contig =777..896bp; Strand=-
atgtgtgtagggtgngggttaggtgtgttggtgtgtgtatttgtgatttgtatgtgggtgtcgggtgggtttatgtgggtggtgtggggtgcgtgtggggtgtgtggtgtgtattgttag

SEQ ID NO: 29 - DNA, 141 bp, Xenorhabdus bovienii
  unsure (1)..(141): unsure at all n locations
  Coding DNA location: Contig name=SeqID_16549; Position on contig =1..141bp; Strand=+
atggtttccgaattncgggcctcggtaccccgggggattccctctgaggtctgggaagaagtgctcgccgggatcatcgtgccgaagtgggccactcggacgtggntaaaaactaaaaagggtgggtttgccgggaggtaa

SEQ ID NO: 30 - DNA, 213 bp, Xenorhabdus bovienii
  Coding DNA location: Contig name=SeqID_16551; Position on contig =200..412bp; Strand=-
ttgcggggggggggggccgccccccaaaaaaaaagagaaaaaaaaaaaaccccccccccctctttttttgtgggggggtgggtggaaaacaaggggggtgccccccccccctttttttttccgcccggggttttaaaattccctgggaaaaaggccctttacccaggtttagggcccaataaagccccttttggtgaaaaaattggtttttaa

SEQ ID NO: 31 - DNA, 465 bp, Xenorhabdus bovienii
  unsure (1)..(465): unsure at all n locations
  Coding DNA location: Contig name=SeqID_16551; Position on contig =543..1007bp; Strand=-
ttttttctttactctcttcccaccaanaagaagagaagaggggggggggtgggtgttttttttgtttttttttttttttttttnnnnaaannnnnaaaaaaaaaacaaaaaaaaaaaacaccacaccccccccccccccccccccctggtttgtttttttttttttttttttttctctcccctcccccccccccgcccgcgcgggggggggggagggggggtaggttnggtnttntnnatatagagggggggcgggccgcccccccccccccccctctttcttttttttttttcaccccccaccaccccctcctcttttttttttgttgtgggggggggggggggggggtcccctcccctcggggggcggggggggggggggggggggtcccctcccccccccccccccccccccccctcccccttttatatattaaaaaaagggggggggggggggggttgtna

SEQ ID NO: 32 - DNA, 378 bp, Xenorhabdus bovienii
  unsure (1)..(378): unsure at all n locations
  Coding DNA location: Contig name=SeqID_16555; Position on contig =341..718bp; Strand=-
atnagngggnggnggggggngngngnntctctgctgctctctgctcctccttctcctaccgggcganagnggncgncgcgcgncgcgggncggcggnggggaangaagagnaangagaaagcanaacaagatngtggctgttgttnttgngtgctttcttgtggangagannngagnnnnncncgnncgngtncggcggcggcgtcgantgntnctanaaaactacaacataaaaattttctctcgcgtgcngggnnagagaaacacacacacacacaccactctactctctcgctggnaggatggagctgnaggactatctngatagggatgctacatgtgcntnatttagtagattgcgngcgtctatctagctag

SEQ ID NO: 33 - DNA, 219 bp, Xenorhabdus bovienii
  unsure (1)..(219): unsure at all n locations
  Coding DNA location: Contig name=SeqID_16563; Position on contig =130..348bp; Strand=-
gtgtgggtggccccgaaaaattctccgaaacacaaaatttatcacaccgggttcccccgggggggcctcccccaaaaccaagggggaaccgggagcggcctttatttcttaccccgttccagaaatacccttattcaaaggncccancgtttggttcagnccaaggggnctattaaggttatcaagcgggtgnaactgnactgnacnctnagaggntan

SEQ ID NO: 34 - DNA, 135 bp, Xenorhabdus bovienii
  unsure (1)..(135): unsure at all n locations
  Coding DNA location: Contig name=SeqID_16576; Position on contig =497..631bp; Strand=-
atgagagaaaagggggcgcctccttttttttatattnttntcgggcgnngggagggggggagggggggggggcgcgccccccaacaaaaaaaaaaatatattcccaaaaaaaaggggggcggggggggagtataa

SEQ ID NO: 35 - DNA, 192 bp, Xenorhabdus bovienii
  unsure (1)..(192): unsure at all n locations
  Coding DNA location: Contig name=SeqID_16576; Position on contig =779..970bp; Strand=-
taaagaatatgtgtnnnnnntgtgnnntgcgtttnnntctttnttgtgcgtgtttctatatgtgnagtcgaacacaaaacacagcgcgtattgcttgtccgtctgtggcctcggttggtcatgagggcgggggtggggggtggtttgtttcgttttgttatgggggaggttgtgggaagaaaagtaatctag

SEQ ID NO: 36 - DNA, 330 bp, Xenorhabdus bovienii
  unsure (1)..(330): unsure at all n locations
  Coding DNA location: Contig name=SeqID_16585; Position on contig =269..598bp; Strand=+
atggggggggggggggaacaaataattttttcccccccccccccggggtgggtggggaaaagtggttttataaaaaaaaaacaatatatttttgtgttgtggggggaaaaaaaaaaaaaaaaatatttgtggggggggggagaaaaaaaaaaaaaaaaaaaaaaaggggggggggggggggggtngnnggggggggaagnnaaaaaaaaaaaacaacaaccccgggggggggggggtgtggggggnnnnnnnttaaaaaaaaaaaaaaaaaaggtgnttttggggggggggagagagagacagaagaaaaatatatttttttttttttaa

SEQ ID NO: 37 - DNA, 252 bp, Xenorhabdus bovienii
  unsure (1)..(252): unsure at all n locations
  Coding DNA location: Contig name=SeqID_16597; Position on contig =3..254bp; Strand=+
attctgctgctgcagtcccgagcgcccatcgagccatcaggatacgcgctgcgcagacacgtgacgncgatcaacacgcagcggtccgccgtcgggcacaaacgcttatgggttccgatttcccccacaatggttaccgggggttttcgggttcggggggaaaaatttaccctgttgggggcgaaaattgcgcccccccaaaaaaaccaaaattgggggggtgtttcccagggggggggggggggttattag

SEQ ID NO: 38 - DNA, 186 bp, Xenorhabdus bovienii
  Coding DNA location: Contig name=SeqID_16601; Position on contig =499..684bp; Strand=-
gtgcggccctacctacaaacgatgggcgtgagaggtggagtgaaacgtggcgcccgcggctgggaccacggaagagagggcgcaagctggggggggggggagggggtggggttgatatatttctccgccgcgggcggaagaaaaaaagaagaccgccccctttatggggcgccggcgggtttttaa

SEQ ID NO: 39 - DNA, 234 bp, Xenorhabdus bovienii
  unsure (1)..(234): unsure at all n locations
  Coding DNA location: Contig name=SeqID_16606; Position on contig =305..538bp; Strand=-
ttnnncccgggcgcgggggtttttttttntttatttttttgggggggggcccccaanaccccccggggnaaaaaaaaatttttagggggggggntttatgggggggtgttttgggggnnagaagggcccttttttttggtttttttgnnntttttggggnaaaaaaaacttggtttttnnnnaanatttagtttaagaaaaaatttttcggggggggctgggtgggtnttttaa

SEQ ID NO: 40 - DNA, 135 bp, Xenorhabdus bovienii
  unsure (1)..(135): unsure at all n locations
  Coding DNA location: Contig name=SeqID_16613; Position on contig =108..242bp; Strand=-
atggccaaggccccctgcccagggagtcccaaagtacctttctttgggtcaaagaaccaaaccccccggactggttttnccccttggccgaacgccatcctggacggatttagttggaaacaagcccgggggtaa

SEQ ID NO: 41 - DNA, 219 bp, Xenorhabdus bovienii
  unsure (1)..(219): unsure at all n locations
  Coding DNA location: Contig name=SeqID_16619; Position on contig =63..281bp; Strand=-
ttggagaaaaaaaagggggcctttttaaaccccctcgttaaaaaagagggcaatattcacaattatgttgctccaaaaacaccggttcgggaaaacctttgtttttctttcctggggatggcccggaatatccagggnatgggggtatctctcgtcattnnaggtggggtcatcgntcntagaggtccccgggtnacgagtccgntatggttaagctag

SEQ ID NO: 42 - DNA, 195 bp, Xenorhabdus bovienii
  Coding DNA location: Contig name=SeqID_16619; Position on contig =516..710bp; Strand=+
gtggttggagagggaaaaaaccacccccccctccccccggcgggggggggggggggggggggggaggaaaaaaaaaaaaaaaaaaaagaggggggggggcggggcgggcgggggggaaaaaaaaaaaaaaaaaaagcgcccccggcgcgggggggggggggggggggggagaaaaaaaaaaaaaaaaaaaaataa

SEQ ID NO: 43 - DNA, 339 bp, Xenorhabdus bovienii
  Coding DNA location: Contig name=SeqID_16632; Position on contig =419..757bp; Strand=+
atggtttattctcaaggcggtgacgctatgtctcaaccccgtatctatggtagcaaatggaacaaggcacggctggccttcctacaacaacatcccttatgtgtcatgtgtcaccagcaagggagagtgaccggcgcgaccgttgttgaccacatcatcccgcataagctgaaaggggcactggattccggtaacaagccggagatagccaaagcacagaagctattctgggataccaagaactggcagcccttatgtgacagtcaccataactccactaagcaacggatggagaagcgcggtaaggtggtcggttgcgatattaacgcctgccattag

SEQ ID NO: 44 - DNA, 168 bp, Xenorhabdus bovienii
  unsure (1)..(168): unsure at all n locations
  Coding DNA location: Contig name=SeqID_16645; Position on contig =105..272bp; Strand=-
ttggttcccggggggggnccccaccaaggaaataaaattttgcnnnnnnnnngnnnnnnannnaaaaacagtgcttatactcttaaccgcaatcaagagcatctgagagttcaaaaagaaagacaaaacaacacaggccaacgccgcacccatagaaacccaaccnnn

SEQ ID NO: 45 - DNA, 534 bp, Xenorhabdus bovienii
  unsure (1)..(534): unsure at all n locations
  Coding DNA location: Contig name=SeqID_16645; Position on contig =420..953bp; Strand=-
atgtcgaccgtacgcanccccggcgggggggggccccnnccctnnnntttnnttttttttttttgggtgtnggggggggggggggggccccccggttcgcccggaaaaaccaaacaaaaaaaaaaaaaaaaaaaaaaaacacagngngtgtgnttttttccgcctcgccgccggtgcgggggtggggcggccggcgcccccccccccctccccccctcgcgcgggggggggggggggttttcctcttccccccccacacaaaaaaaaaaaaaaggaaaggggagggggcccgcccccccccccccaaaaaaaaaaaaaaaaaaagaaaaaagggcggttttttttttttttttttttttgtgtaagagagaagaaaaaaaaaaaaaagaaaaaagaggggggggttttaataaatttcctcccccccccccaaaaaaaaaaaggggggggggggggggggggataaatttanaaaaaaaaaaaccccccccccaaaaaaaaaaagcggggggggaaaaaaatttttttttataa

SEQ ID NO: 46 - DNA, 198 bp, Xenorhabdus bovienii
  unsure (1)..(198): unsure at all n locations
  Coding DNA location: Contig name=SeqID_16653; Position on contig =21..218bp; Strand=-
ttgggcccctttttttttttggggggttttcccaaaaccagggggggggcccctcccccatttgtgaggaaattttttgccccccccctgggggggcctgaaggggaaatcaattgggnnnnnnnnnnnnctnccaggcttgcagcgaaaatcaacaattcggtaggtataattcgatacgaaatactagtcttctaa

SEQ ID NO: 47 - DNA, 138 bp, Xenorhabdus bovienii
  Coding DNA location: Contig name=SeqID_16656; Position on contig =615..752bp; Strand=+
atgcatatcttacaagtatttatattggctcaattccaagcaacctttgcacttacattttgcaagctagttcaatcacgtacttctatacttgctttggtttgtgttggcatcaatcaccaaaaagggggagattga

SEQ ID NO: 48 - DNA, 192 bp, Xenorhabdus bovienii
  unsure (1)..(192): unsure at all n locations
  Coding DNA location: Contig name=SeqID_16680; Position on contig =41..232bp; Strand=-
ttggtttncagggntttaccaggtttncagggggagggccananatttgggaccccttggcaggggcatggtgaaggggtgcgtttctctgcgctgtccggtgtttttgtggttgatggttcctttcttgggcctggtggttttgctttgttactggtggcggctgggggttggtgttttcaannnnnnnnn

SEQ ID NO: 49 - DNA, 177 bp, Xenorhabdus bovienii
  unsure (1)..(177): unsure at all n locations
  Coding DNA location: Contig name=SeqID_16680; Position on contig =159..335bp; Strand=-
ttganatttcccggttttccgggggggttggggggccggganatccccnccccaatgggagttggcgccccgggananacnccccgggagggatttggcgcttttggtttncagggntttaccaggtttncagggggagggccananatttgggaccccttggcaggggcatggtga

SEQ ID NO: 50 - DNA, 534 bp, Xenorhabdus bovienii
  unsure (1)..(534): unsure at all n locations
  Coding DNA location: Contig name=SeqID_16680; Position on contig =437..970bp; Strand=+
ttgggcaaaaagggggaaaaaaaaaaaaaggggccgagaaaaagcccgcgccccaaaaagagaaaatatttccaacacaaaaaggagngcgcccttttttgggcgccccccccccccccgggaaaaaattttaaaaaaaacaaaaaaaaaaaaaaagagggcgccccccgccgccccaaaaggccaaaaagaagagaaaaaaaaaaaaaaattttttgtggaaagaaaacaaaaagagaaccccccccctctttntttttctctccacaccaaaaaaaaaaaaaaggggcggggggcaaaaaaaaccaaaaagggggggggggaaaaaaaaaaaaaaaaaaaaagaaaagagggggggcgggggccccccaaaaaaaaaaaaatatatttttatatacccccgccccccgccccccaaaaaacaaaaaaaaaaccctccccaaaaaaaaaaaaaaggagggggggggcggggggccaaaacaaaagggcgagaaaaaaaaaaaaaaaaaaaaaaaccaccccccccccgcctaa

SEQ ID NO: 51 - DNA, 219 bp, Xenorhabdus bovienii
  unsure (1)..(219): unsure at all n locations
  Coding DNA location: Contig name=SeqID_16694; Position on contig =139..357bp; Strand=-
ttnntttggggggncccccaanaactctcgattaaatccnnncccctagtnnnattcggnnanaaagnantccccgtnnnccccggggggggggggnnttttctcccccccggaggggggggnnnnccccccccccaggggggggggggttttttaaaaaaaaaaaacaaaaaaggaggggggnnnnnnggnnncccccccccccnnnnnnnnnnnnnn

SEQ ID NO: 52 - DNA, 534 bp, Xenorhabdus bovienii
  unsure (1)..(534): unsure at all n locations
  Coding DNA location: Contig name=SeqID_16694; Position on contig =402..935bp; Strand=-
ggggggtgtggggcccccccccctctcttcggggggggggggggaaaatatttattattttttttagcgacagaggcggcacggtttttttttttttttttgtggtgggggggttgttttattttttttancggggggggggacccccccccggggggggtgtttttttttttcccgggggggggggggggtttttttttttcccccccccctatttttttanaanaaccccgcgcccccccccccgggggggtgggggggtttttttggggggaaataaatttttnnccccccggggggggcccctctttttttgtggaggggggaaaattattttcccccccggggggggggcttcctttttccccccaaaaattttggggggagggggggaaaatttttttgggggggggccccccggggttttttncccccaaaccccnaaaccccctcctnncccctttgggttnnccgggggggggnnttttttnnnaggggggttttnaaaaaanaannaaagaggggnaattttna

SEQ ID NO: 53 - DNA, 324 bp, Xenorhabdus bovienii
  unsure (1)..(324): unsure at all n locations
  Coding DNA location: Contig name=SeqID_16696; Position on contig =749..1072bp; Strand=-
ttgggtttggntgnttgngggnnnnggngggnnggnncgcgggggggggggnnngnnggggggggaaaannnnnnanngaaaagaaananaaaanagggagaaaaaaaaaaagannnnnaaannnnnnnanannnacaacnnacccaccaacaccccaccaccccccccnnnnnnnngnnnngnnnggnnnngnnnnnnnnnnnntntttttttttttttttttttttttttttngnnnnnnngnngttntggggggnnggggggggnnggnnnnnnanaaaagaaaaaaaaaaanaaanannccnnnnnnnnnnnaaaaatga

SEQ ID NO: 54 - DNA, 159 bp, Xenorhabdus bovienii
  unsure (1)..(159): unsure at all n locations
  Coding DNA location: Contig name=SeqID_16704; Position on contig =14..172bp; Strand=-
ttgggcggggggaggtggggtgtcttctttggttctgggggggggggggggcaggcggggggggggggggtggcggtttgtggcggagaggggcttcngggggtcccggagggcgggggtccgcatttgatgagtgcnnnnnaaagaaannnnnnnnnn

SEQ ID NO: 55 - DNA, 480 bp, Xenorhabdus bovienii
  unsure (1)..(480): unsure at all n locations
  Coding DNA location: Contig name=SeqID_16704; Position on contig =200..679bp; Strand=-
ttgtgggggggcggggggggtgtttgttgtattattattaaaaaaaaaagtgggnnnnaannnggtgggggtgtgttgtttttttttttcttttgngttttttttttttttgtttggggnncctcttttttttttttttttttttttaagaggggggtggggggggggggggaaaaaaggtttttggggggggtggggggtgttttattatttttttgggggggggggcgggggggggtgtggttgtttttttttttaaggggcgggggggggggttttttttttttttttggggggggggggtttttttttccccccccctgggggggtgggggggtgaacaggggggggggttttttttttcccctttttattattccgttgttttttgagggggttttttttattnntnnnnnnccnaaaaaagagggtaatttcgnnnngggcggggnnnggnggccgcggnnngatcaattttga

SEQ ID NO: 56 - DNA, 138 bp, Xenorhabdus bovienii
  unsure (1)..(138): unsure at all n locations
  Coding DNA location: Contig name=SeqID_16715; Position on contig =847..984bp; Strand=-
atnattgtggaggggggggggcgccctctctttctcttcntntttntnnnggggggggaaaaaaaaaaagaaagagggcccccccccaaaccagaggaaggaggtgggggggggggggggaatannaaatatatataa

SEQ ID NO: 57 - DNA, 183 bp, Xenorhabdus bovienii
  Coding DNA location: Contig name=SeqID_16722; Position on contig =454..636bp; Strand=-
atgagcgaaaaggcgttcgcgcagtatgttgcagacacgcatacgccagagatccaggccgccagaggacgtaaatcaaagcgtggcgcgatcccaagctcagagagaacgctcaagccgtgggaatcactaggaattagtcgccgctggtattaccacaaaaagaaaaatggtttgctttga

SEQ ID NO: 58 - DNA, 174 bp, Xenorhabdus bovienii
  unsure (1)..(174): unsure at all n locations
  Coding DNA location: Contig name=SeqID_16731; Position on contig =379..552bp; Strand=-
atgtatttttttttaaaagagggggggggggngnnggggggcctccgctccccccgcgaagaaaaaaaggaacagaccccccctnncctccggcctncctctgcctccgctccagcagatgagatnttattactccttctctctctctgctctctgatgggggggggggtttga

SEQ ID NO: 59 - DNA, 147 bp, Xenorhabdus bovienii
  unsure (1)..(147): unsure at all n locations
  Coding DNA location: Contig name=SeqID_16733; Position on contig =222..368bp; Strand=-
gtggnncgggnggggggnnnnnnnnnnnnaaacannaganaannaanngnngggnngggtaaatatngngtagnngngggggggagggnaaaancnnggggnngggngggggggactgtaagagttagatggatacaaaaatnntag

SEQ ID NO: 60 - DNA, 225 bp, Xenorhabdus bovienii
  unsure (1)..(225): unsure at all n locations
  Coding DNA location: Contig name=SeqID_16740; Position on contig =669..893bp; Strand=-
ttgtggggggggggggtgaaaacaaanaaaaaaaaaagagggggggggggggggggaaaaaaaaaaaaaaaacccgcccgggggggggggaaaaaccccccaaaaccccccaaaaaagggcgggggggacacaaaaaaaaaaacnccccgggagaaaaaaaggggcccccctttttgggggaaaaaaggggaaaaatcccccaaaccccgggggggaaaaaataa

SEQ ID NO: 61 - DNA, 273 bp, Xenorhabdus bovienii
  unsure (1)..(273): unsure at all n locations
  Coding DNA location: Contig name=SeqID_16741; Position on contig =406..678bp; Strand=+
atgggggggaaaaaaaaaaaaaatctgcgggggggggttttttttaaaaaaaaaaaaaaaaaaaaattttttttttgggggggggggggggaaaatttaaaaaaaaaaaaaaaaaggggccgcggccaaaaaaaaaaaaaaaaaaagggaaggggggggggggggggtggggtaaaaggggaaaaaaaaaaaaaaaaaaaaaaatatatnnnttttttnaaaaaaaaaaaaaaaaaccccaaaanngggggggggggggggggggggggntaa

SEQ ID NO: 62 - DNA, 525 bp, Xenorhabdus bovienii
  unsure (1)..(525): unsure at all n locations
  Coding DNA location: Contig name=SeqID_16744; Position on contig =29..553bp; Strand=-
ntggtttttttttttttttttttattaaaaagannnnggnngggggggggngggggggggggggggcgcccgggccccgcccccccccccccccaaaannanannataaanaattgtaaaggggggggggnggggggggggtntttggtgatattttctctctcccccccccccgggggggggggggggaaaaaaaaaagggggggggggggggggggccccccccggggggggggtatgggggggggggttttttttaaaaaaagaggccccccccccccggggggggggggggggtccccccccccccggggcggggggggcccccgggggaatccccccccttttttttccgggataaaacccccagggggggggtggcgaccgcgcggggccgcggggtccggcaggccgcggctgggccctccgcggggagcctgggggggcccgcgggctgcggtgcgggcggtcgtggaggcccccgcggggcgcgggggccggtgggtggggaaggtgnnnnnnnnn

SEQ ID NO: 63 - DNA, 192 bp, Xenorhabdus bovienii
  unsure (1)..(192): unsure at all n locations
  Coding DNA location: Contig name=SeqID_16744; Position on contig =607..798bp; Strand=-
gtntntnnntnttnnttnnggtnnttttttttntttnnttttntttttttnnntnnnnnnaanaaaaaannaaaaaaaaagaaagannnnnntntntnnnnttttttnntnnntnnnnnnnnccnnttnnnnntnnnntnnnnnnnnntntnngtnggggggggggggggggggggnngngnnngnnnnnnn

SEQ ID NO: 64 - DNA, 292 bp, Xenorhabdus bovienii
  Coding DNA location: Contig name=SeqID_16745; Position on contig =216..507bp; Strand=+
atgcttcgccatcactccgagcaactctctattccttggggagaaatgagcatcaaagaaaaggacttcatccttggaggagagagtaaaagctcaaaagcaaaaggaccggatttcgtctttggtataatcttaactcatttacttttgaccaaaggggaagaaattactaaggagggctctaatgattccgtttttggcgattcatgccaaaaagggggagaaatgagcccaaagcaaaaggaccgcaccaccaccaccaaattcaaaaacttagtgctttccaaaagtc

SEQ ID NO: 65 - DNA, 279 bp, Xenorhabdus bovienii
  unsure (1)..(279): unsure at all n locations
  Coding DNA location: Contig name=SeqID_16746; Position on contig =445..723bp; Strand=+
gtggggggggggggggggagagagaaaaaaaaaaaaaaaaaaaaaaaaaaaaagaccctcttctttggggggggggggggggtttattataataanancctctntggggggggggggggagagacccccccccctttttttattttttccgcccaggtgtgttttttccacaaaggagagggggtgttttctcttccctcccggggggggaatttttttggggaggggggggaggtgggaaaaaaaatatgggccaaaatagggcgggggtgggtgtaa

SEQ ID NO: 66 - DNA, 147 bp, Xenorhabdus bovienii
  Coding DNA location: Contig name=SeqID_16746; Position on contig =693..839bp; Strand=+
atgggccaaaatagggcgggggtgggtgtaagggggtttttttttaaaaaaggttttgggagggacggcccccctttggatttccagggagacaagggggttaacattcagggcagggcttttttttcggaggccaccctcttttaa

SEQ ID NO: 67 - DNA, 147 bp, Xenorhabdus bovienii
  Coding DNA location: Contig name=SeqID_16750; Position on contig =498..644bp; Strand=+
atgtttacagttatgcgtgcctatcactatcagtctatccaaaagacacacgacttccgtgaacgtcaactgaaaaacacgtcgctgcaggcgaatatgggattatggactgttgtgaattgggatatatattggcactccagctag

SEQ ID NO: 68 - DNA, 171 bp, Xenorhabdus bovienii
  Coding DNA location: Contig name=SeqID_16750; Position on contig =820..990bp; Strand=-
agcttgctgcctgcaggtccactttactcgattttgtgtgatgcatctttcttcgacgccaagggtgcgtttgatagtgcccaaattgcctgtgccaatgcatgggccggcctaactttggcgtctattttggctgaccaagaattagccaactttggcatgccaaaataa

SEQ ID NO: 69 - DNA, 229 bp, Xenorhabdus bovienii
  Coding DNA location: Contig name=SeqID_16761; Position on contig =3..231bp; Strand=-
atggctagtactttattgactgacagtaaaatccgaggcttgaaacccaaaaactcagcctattatacatggcaagcagcagcaacacgaggaactggaaggttaggagttaaaacatatccatcgggaagaaaggtctttgtctatcgttactttaagaatggaaaagaaaagttcataaacctaggtgatttccctgctctttctttggcagaggcattatccaaat

SEQ ID NO: 70 - DNA, 180 bp, Xenorhabdus bovienii
  Coding DNA location: Contig name=SeqID_16761; Position on contig =506..685bp; Strand=-
atggcgataagatacattaagcgtgaagagatgcaacgactcacaggaaaaagcaaaacaaccctttggagaatgtacgcaaaaagaaatgagtttcctaaaccagataagactgctggtggaacatttctaggatggcctgaagaggtctatgaggcttgggtgagagagaagaagtag

SEQ ID NO: 71 - DNA, 192 bp, Xenorhabdus bovienii
  Coding DNA location: Contig name=SeqID_16762; Position on contig =404..595bp; Strand=-
gtgacttcgcccccactgcgtggcaacgcattttgtgcttggtttttggtttccgccaaaccgacctattttggaaatttacttcgtcgaagatggctacatgatcgcgatagttgccagtattttgctgtttttagactttctgtggcagatatggcagtcttcgataaagaattactgcaggctgcatag

SEQ ID NO: 72 - DNA, 259 bp, Xenorhabdus bovienii
  Coding DNA location: Contig name=SeqID_16762; Position on contig =537..795bp; Strand=+
ttggcggaaaccaaaaaccaagcacaaaatgcgttgccacgcagtgggggcgaagtcaccggtgatatcacgatttctactgacagtgagatagcttggcgcaaaaatacagatatggccgcaattggttttaaaaacaccggagatggtgataccgattcttatatgtggtttaaaaccgcagataatggtaacgagtatttcaaatggcagcatagcctctctgggggaggaaccaatgagtggatgagcctgaaat

SEQ ID NO: 73 - DNA, 201 bp, Xenorhabdus bovienii
  Coding DNA location: Contig name=SeqID_16764; Position on contig =431..631bp; Strand=-
atggtccatattaaaaataaagaccgggggtttattttgttaaaaccctccgcaccaataacctcgcgggaactctggggaagaattttgggaattgggggcgcgtttttccctctccggggggcacaccccaaattaaaactccgcgtgttttatacacaaaaaaaaaaaaaaccctggggggagagaggtctcccataa

SEQ ID NO: 74 - DNA, 420 bp, Xenorhabdus bovienii
  Coding DNA location: Contig name=SeqID_16767; Position on contig =319..738bp; Strand=+
atggaactttctcgttatgcttgtctgtttgggctaaatgaagagctgaaacaatttattagcgatgacattgccatcaaaatggtgtcggaagattgggaacgccgccaatattatcgtttgcgtgaagtgacctttcgcgatgaacagaaaatcttaaaagaagatcgtgacgagtaccatgttaaagcattaggtattgttgccattgagaaaatggcgggtgagcatgaccgtgtgattggcgcagtactgatttttcccgatggcgaacacacgtggtatggcgggcgtttatgtgtagagcctctataccgacgtcaccataccattggtaaagcgttaatcaatgcaacggtatcgaccgccaagaacttgggatgctgtacttttttaacccaccgggccaagtcaaaatga

SEQ ID NO: 75 - DNA, 156 bp, Xenorhabdus bovienii
  Coding DNA location: Contig name=SeqID_16771; Position on contig =467..622bp; Strand=-
ttgggggggggggaggaaaaacaacaacccaccccggggggcgggggggggggggggggggggtttttcttttttctcggcgcgggggggggggggggattatttttattatataaaaaaaacacccctctcttctttttatttattataaaataa

SEQ ID NO: 76 - DNA, 213 bp, Xenorhabdus bovienii
  Coding DNA location: Contig name=SeqID_16776; Position on contig =238..450bp; Strand=+
gtgtgtgttgtatggggtttaaaagaaaaaacaatgaacaagcaagagaaaagttgcctgaatattgcaaaattcattcggggacagacgctgttattgctggaaaaaatcaatgaactggatttggatgatgaagcggaggcgtgtgagaagttgcatgatgatgccgaggctctctatcatcaattagtgtcgagatacggtgaggaatga

SEQ ID NO: 77 - DNA, 528 bp, Xenorhabdus bovienii
  Coding DNA location: Contig name=SeqID_16776; Position on contig =347..874bp; Strand=-
gtggtgcaggccttctaccgcgatttgatgacgctgctggagcacgagcaggcaccgttggcgctggcacaacgctgtagtggcgtgccgcagtcgatgccactgttcagtgccctgcttaattaccgtcatagccaaaccagcgaggcagacgcggttaacacgatttggaccggtatacgcgtggtcgccgttgaggaacagagcaactatccgctcaccctgtcggtggatgatctgggcgccggtttccacctgactgctcaggccgtagtcgggatcgatccggctcgcgtaaccgcctatctggttactgccatcagcggtctggtcgatgccctggctcgcgacccgatggcatactcccgaaaggcctcggctagccttttttcttcggaatctgttaatttatgtcttttcatgctcattcctcaccgtatctcgacactaattgatgatagagagcctcggcatcatcatgcaacttctcacacgcctccgcttcatcatccaaatccagttcattga

SEQ ID NO: 78 - DNA, 252 bp, Xenorhabdus bovienii
  Coding DNA location: Contig name=SeqID_16777; Position on contig =61..312bp; Strand=-
gtggaggctgcgaccggggccgccctggagccaaccccggagaccgcagcgattgcgacggctgcccccacatctgctgcggccggcgaagacctgcccccaaaggtggccgaaggcgcccctgatgcccccgcagcagctgcgccgagcattgaagatcccgcagcggaggcgatggaaacaatggcggaagtggcggcggagccaacggcggaggctcccgcagcgtcagggccttcgcaggtggcgtag

SEQ ID NO: 79 - DNA, 450 bp, Xenorhabdus bovienii
  Coding DNA location: Contig name=SeqID_16777; Position on contig =406..855bp; Strand=-
atgcgtgcggaggctgaacggacgcgcgctcagcttaaggatacatatcgcgagctgggcgcgcggaccggcgacttcgaggtgccggaccgagagcccgggctttgttgtctgcaatgggtgcaggaggagctgcaggaactccccgttgttgtggggggctttatgtcgtacgcctccctggtcacctgcgagggggcgatgaacgcactctcccgcgaagggtgccggcacttcgaggtcttcgaccaggcagatgaagactttaagcgagatgtctatacggtcgaagaccccgttgtgaaggaatccgtcggggccctctatgaccggatgtggggtccgcacggccgtgaggtggtcagggagcgggccgagatcgcgagggctcaggtaatgttgttgttggtttggcgtttgctgcatgtggggtgtgcttgtgtttgctga

SEQ ID NO: 80 - DNA, 621 bp, Xenorhabdus bovienii
  Coding DNA location: Contig name=SeqID_16784; Position on contig =290..910bp; Strand=-
ttggcagccaccaccaatagtggtgtgttggcaagttcatatgttgacgatgacaaagtagtggactattacggtgttcttcaaaacattgtagagttgattttcgatggccccaaggaacttaaagtcgtgtttttcgagtgcgactggtttgatgctcatagtgggactcgtgtcgacaagtatggtaatgtcgaggtgaagcatagctctaggattccgagcagtatgagcgatgttgtccttgcaaatcaggcaaaacaagtgtactacctgccatatcctcacccaagccttagggcttggtgggttgcaatcaaagtcaacccacaagtcgtcgctccagagagtgctgactacgtgagtacgagcagggacaacgatgatgctgtttttcaaccagaagcggcgtcgaatcaagacatagctcaccgattccatgtgaccaatggagaaggactagaaaatctctgttgcaattcaagcgacttaattgaagaacctaggtcaaagcgcaaacgacctgtcgtcgttagaagatcagtaaggatccaacgaaatcaagagcgtatgaataaacaacgagccgaagaagcatcatcggatgcggatgacttttga

SEQ ID NO: 81 - DNA, 186 bp, Xenorhabdus bovienii
  Coding DNA location: Contig name=SeqID_16784; Position on contig =1325..1510bp; Strand=-
gtgtttgctccttcagtgcgactccatgtcgaaaatgaatcgccccaaagcacccttcaaatttttgcgaatccgggtaaagcagttggaaaagggagtgtacgtcacatgaagggatcagatttgaacacgctaatgctatatatgtatagcaatattgacagcacacaggaggcgttcgagtaa

SEQ ID NO: 82 - DNA, 348 bp, Xenorhabdus bovienii
  Coding DNA location: Contig name=SeqID_16788; Position on contig =483..830bp; Strand=+
ttgtaccctaccggttatcccgagagcaagattaggagaattcactctaggaagtctcactctggcccaaatcatgcttttatgtataagggtgagacatctagttctaggcaaccaatccgtgctaagttgcctaagaagagaactcctaatgcatcaaatgatcatgacatttcattcaaaacttttgatgcatcatatgttttaactaacaaatccggcaaggtagttgccaagtttgttgggggcaaacacaagggctccaagacttatgtttgggtacccaaagttcttgtttctaatgccaaaggacccaaaaccgtttgggtacctaaagtcaagaactaa

SEQ ID NO: 83 - DNA, 186 bp, Xenorhabdus bovienii
  Coding DNA location: Contig name=SeqID_16790; Position on contig =35..220bp; Strand=-
atgcaagttattctgcttgataaagtagcgaacctgggtagcctgggtgaccaagttaacgttaaagcgggttatgcccgtaacttcttagttccacagggcaaagccgttcctgcgactaagaaaaacatcgaattcttcgaagctcgccgtgttgaactgaagccaaattggctgacgttctga

SEQ ID NO: 84 - DNA, 228 bp, Xenorhabdus bovienii
  Coding DNA location: Contig name=SeqID_16790; Position on contig =259..486bp; Strand=-
atggcacgttatttccgtcgtcgcaaattctgccgttttacagcggaaggcgttcaagagattgattataaagacatcgttacgctgaaaaactatgttaccgaaagcggtaaaattgtaccaagccgcattaccggcactcgtgcaaaataccagcgtcagctcgctcgtgctatcaagcgtgcgcgctacctgtctttgttgccttacactgatcgtcatcagtaa

SEQ ID NO: 85 - DNA, 138 bp, Xenorhabdus bovienii
  Coding DNA location: Contig name=SeqID_16790; Position on contig =814..951bp; Strand=-
atggttatgcgcgttaagcacgcagtaactgaaccatcaccaatggttaaagctaaagacgaacgtcgtagccgtgacctggtcttagaagaagacatggctgatgatgctgatgaagctggggactctgaagagtaa

SEQ ID NO: 86 - DNA, 1024 bp, Xenorhabdus bovienii
  unsure (1)..(1024): unsure at all n locations
  Coding DNA location: Contig name=SeqID_16791; Position on contig =3..1026bp; Strand=-
accaagggggagagggaaggggagaagaaggaaaaggaagctttcctctcccaaaccgcatcggagtgcggnggaattaaggagatgagggaagtggtcttattacgagacngaccactcnatcaccttttacctnccggctccgatgcaccctccataacttcgaagcgccatgagcgtaagagttttagtaagatccccttccattatcctcgtacctgtagacatactccattactttccgttccattaggcaacccgccaacctttgacggtgaagattatgctaggtggagtgatttaatgaaatttcatctaacctcactccacaaaagtatatggaatattgttgagtttggtgtacaggtaccatccgtaggggatgaagactacgactcggacgaggtggcccaaattcaccactttaactcccaagccactattatactcctcgcctctctaagtcgagaggagtataataaggtgcaagggttaaaaagtgcaaaggaaatttgggacgtactcaagaccgcgcacgagggagacgaggtgacaaagatcaccaagcgggaaacgatcgagggggagctcggtcgcttcatgcttcaccaaggggaggatccacaagctatgtacaaccgcttgaagaccttggtgaaccaagtgcgcaacctcgggagcgaaaaatgggatgaccatgagatggtcaaggttattcttagatccctcgtattccttaaccctacacaagttcaattaattcgaggtgatcctagatataagctaatgtctcccgaggaagtcataggaaaatttgtgagctttgagctaatgattaaaggctcaaagaaaatcatcgagcaaggcacctcctccacacccgaagcacaaccggtcacattcaaggcgacggaggagaagaaggaagagtctacatcaagtagacaaccaatcgacgcctccaagctcgacaatgaggaaatggcgctcgtcatcaagagcttccgccaatccctcaaacaaa

SEQ ID NO: 87 - DNA, 396 bp, Xenorhabdus bovienii
  unsure (1)..(396): unsure at all n locations
  Coding DNA location: Contig name=SeqID_16792; Position on contig =33..428bp; Strand=-
atgagtaattatgaagaatggcaatcgcaagagttttcacatttaatgacggataaaggtgataaactttgtcatattaaaggaaatgaactttgtcatattacagagagtgacgtttgctgtgttgtgcattactatattgtggatgaaaaaggttatttgattaataacggtgtgcgtcaaaccagattaggaaaaatttcgccgaaattagtacaagccacggaagcattacggatcgagtggctgaaaaaaaatgatgaagttaatgattatgaacaacgccaagaagagcggcgcgagcgctatcttgaaagggcggagaaggcacgtaaagaaagagaggccgtccattctcaagctaaagatatgtcgagtattattccgttgnnnnnn

SEQ ID NO: 88 - DNA, 477 bp, Xenorhabdus bovienii
  Coding DNA location: Contig name=SeqID_16793; Position on contig =618..1094bp; Strand=+
ttgtccatccatgagcataaattcacatttaagcacttgtgttggcactcaatcaccaaaatacttagaaatggcccaagggcacatttccctttcataagcccggtcatttcattgcaaaatgtcctatatctagtgacagtgacaggggcgacgacaagaaggggagaagaaaggagaagaagaaatacaacaagaagaggggcggcgatgcccatgtttgtcgggagtgggactccgacgaaagctctagcgactcctccgacgccgaggacgccgccaacatcgccgtcaccaagggacttctcttccccaacgtcggccacaagtgcctcatggcaaaggacggcaaaaggaagaaggttaaatcaaaatcctccactaaatatgaatcttctagtgatgataatagtgatgaggaagataatttgtgtaccctttttgccaaccttaacatggaacaaaaggaaaaactaa

SEQ ID NO: 89 - DNA, 126 bp, Xenorhabdus bovienii
  unsure (1)..(126): unsure at all n locations
  Coding DNA location: Contig name=SeqID_16793; Position on contig =1116..1241bp; Strand=+
atgaaaaaagatgatctcttggactctcaagaggacttcctaatcanagaaaataaaaagcatgttaaggttaagaatgcttatgctctagaggtagaaaatgtgagaaaatatctagtgagctaa

SEQ ID NO: 90 - DNA, 540 bp, Xenorhabdus bovienii
  Coding DNA location: Contig name=SeqID_16797; Position on contig =3..542bp; Strand=+
agcttgctgcctgcggtccgtaatatggaaactccccttgagcttcagaggttaattgctaatcaagaattgatgaaagtctgtaataaggttatcaaaaaatatcatcatacagatgaacgaaaaaaagcattgatggaagtgggactaaaagaagacttggcagataaattactaaaagatgatcgcttcggaggcattggctatgcccattttactttaagtaataatagcgcaaccatcagaaggatctcaggtcggattgaagaaataaaaaaattgaaagaattatctgtagaaataaaagaagaatttgaatgttttactttccaaattgacaaggaagataatcgcgtaaaattcatttttccaaatgacaaaaggccggatgaaaaaataaagcagttgctaaataataaagcgtttaaatggagtcctacccgtaagtcttttgtgagacaagcaacggcaaatggaattttggcgggaaaataccttaaactggatattattaaatacctagattctattaaaagctag

SEQ ID NO: 91 - DNA, 240 bp, Xenorhabdus bovienii
  Coding DNA location: Contig name=SeqID_16797; Position on contig =758..997bp; Strand=+
atgaacacatttacccccgctcaatttgatgatatttcaacgtatatcaaagataacagtatatataccccagttcgaattttccctgtatggacaatgataaacggttgtgaagctgtaaggggggataaccaggatgaagttattatttttcaaaataaagtacccgtagcaatgtatattttagatgatgatgaagcaactgtggggatttatcaattgaaggaaaaaaataggtaa

SEQ ID NO: 92 - DNA, 219 bp, Xenorhabdus bovienii
  Coding DNA location: Contig name=SeqID_16800; Position on contig =2..220bp; Strand=+
agaacacaaagagggggcgatctgcccttcattgaagatacaccaaggaaaaaaaacaatggggacttcactgaaccaaacaaagaaaaaggttttttggccgcgaagaaaccctccgttggttttttgaaagcccacaaaaaaagggcgcattttttggcggggggaacaaaggaaaaaaggctggttaaaccccccctcgggttaaaaaaaccgtga

SEQ ID NO: 93 - DNA, 618 bp, Xenorhabdus bovienii
  Coding DNA location: Contig name=SeqID_16802; Position on contig =193..810bp; Strand=-
gtgccgagcctggaaacatacccgctcgttgtcgaccccatcatcggcaacgtcaggctcaccaaggtcctcatggacggaggcagcaacctcaacatcatctatgtcgagaccctcgggctcctgcggatcgatctgtcctcggtccggatgggcgccacgcctttccatgggatcatccccgggaagcgcgtccgacccctcggacaactcgatctacccgtctgctttgggacgccctccaactttcgaagggagaccctcacattcgaagtggtcgggtttcgaggaacctaccacgcagtgctggggaggccatgctacgccaagttcatggccgtccccaactacacctacctcaagctcaagatgccgggccccaacggggtcatcaccgtcgggcccacgtaccgacacgcttacgaatgcgacgtggagtgtgtggagtacgccgaggccctcatcgccgacctggagagcctctctagggaggcgccagacgtgaagcgccacgccggcaacttcgagccagcggagacggttaagtccgtccctctcgacccctgcaacgacgcctccaagcagatccggattggctccgagctcgaccccaaatag

SEQ ID NO: 94 - DNA, 555 bp, Xenorhabdus bovienii
  Coding DNA location: Contig name=SeqID_16802; Position on contig =829..1383bp; Strand=-
atggacatcgccaccaagttcgcctctggccaggaggcggttgaggccatcttctggaaggacaagcagccccagggccgcccactggaagatgttcccaaggcgtcaactcagcgcggcaccaagaagaagggcaagaagaagtcgcaagcgaaacgcgacgccgccgacgcggaccttgtcgccgccgccgagtacaggaaccctcggaaacctcctggaggtgccaacctcttcgacaagatgctcaaggagccgtgcccctatcatcaggggcccgtcaagcacacccttgaggactgtgccatgcttcgacgccacttttacaaggccgggccacccacggagggtggcaaggctctcaacgacgctaagaaggaagatcacaaggcaggagagttacccgaggtccgcgactgcttcatgatctacggtgggcaagtggcaaacgcctcggctcggcaccacaagcaagagcgtcgggaggtctactcggtaaaggtggcggtgccagtctacctagactggtccgacaagcccatcaccttcgactag

SEQ ID NO: 95 - DNA, 444 bp, Xenorhabdus bovienii
  Coding DNA location: Contig name=SeqID_16805; Position on contig =101..544bp; Strand=+
gtggctgaggaggactgttttacatctcgtatggtttgtcagtggagagtttttccttacgggcgaaatatcggtgttgttgtgtgggcagtgatggacaaggatcgccaaggggcggcacaaaaacgccaggcgactgtcaggctgcatgaagctaggccgaagcggcagcggggggctgcgaaggctgcggcccccggcggaggcaggtcgccgctggcggcgaaggcgggcgcctctgcacctagcaaggcgccggaggcgacggcgggcgccggaggctccaaaccgacgaaggtggtgccaccggccagcggagtggcggaggcttcgaaggcggcccgagcgctgccgttgtcgggcaaacgtgttgccgacttcggcaccgatattactgtggacgactatcttggtggtaagtcgctggcctattattgttattaa

SEQ ID NO: 96 - DNA, 498 bp, Xenorhabdus bovienii
  Coding DNA location: Contig name=SeqID_16805; Position on contig =567..1064bp; Strand=-
ctcctctccgccgccagttggcgccggaggtcagccttttccttctccagggcggccaccctgtccgacagcttacggcacttgctgtcggaggccgatttctcacggacagcgtcagcatgttgtgtccgaagtctctcgacttcggcagacacaactgccgtgagggcccccgacgcagtacggctggcgaagtcagcaacctgcagggcacacgtaaggcctttgctccaaaaaaagaggtgggggagagagtataactcagcggacctgactcagcgcctccgtcgcctgactcagcgcctccgtcactcccttcagccggcgggtcgctgcgcccgcctcgtccctgaccaacgcgagggccgacacctcgcctccggcgccaagcgtctcgcccctcgccttcggcactatggcggccgtcgcgatcgccgcgccaggcgcaactatagcgagctggccctcgtccggccctgcaacgcgtcaacaaattaa

SEQ ID NO: 97 - DNA, 1542 bp, Xenorhabdus bovienii
  Coding DNA location: Contig name=SeqID_16806; Position on contig =343..1884bp; Strand=+
atgtcggggggactaagaaacgaaagtgcttctaagcttgaaaaatttgaggttgcctcgacttcatcttttgttgcagatgttgatcctagggcaatagatcttgccatgagaatcgccgaaaggatgttcctcaaaatgaaggaagataaggcgaagaacaaaattgaagaagaaaatgatcgatggagaccaaacgatgaatccacctcttcacaaggttcgtctttcaaatccacttctcatatgtgctttattgctaatgggagtgacagtgaaagcgaaagtgaggatgaggaggagcaagaaagtgatagtgaagatgaggacgatcttcaacaattcttcgctcaactaagcaagaaacatcggatgagcttgctcaaactcatgaaaagagcagaagaacaaaaagaaatgcttcataagcaagaagacttcctcatcagaaaaatcgaagacttagagaagttgaccaaagagcatgagaagctaaagtgctctcatgatgatttggtccaaaggtatgaagacatttcaattgagcaaattaaagttgttaatcattcatcatatattgctcaattagaaaacaaaaatgctatgttcaagaacacgatagaaaggctaaatattgaaaatctagctttgcaagaaaaacatgatatgcttgtgtgctctcataataaatttatggattcacatatcatgttagaaatggctcatgaggttgtgttaactaattttaaatcataccaacctcacatatgcacatgtactcaagtagaaactatattatcatgtgctaacaaatgttgctctcaagaaagccaatcttccattgagctagaaatttcaggaattagtgatatttctatcacacaagaaaataaagagttcaaggaagaagttggaaggctaagaaggagcttaactattttgaagggaaagtgtcatgctcaaccttctcaagataaccgtgataatatgatgaaaaagcttgagaaggggacaaccgtagcatgcacaaaaccccttcaaaagaatatcaagctttccaagaaggacatgagcaagactcaaggtgagaaaattaatgctcatattatttgctctaacaatgtacctatgtgcttcaacaaagaaagatcaaagagaagcgataggaggtgctatggatgcaaggagaagggtcatgaaattggttcatgcccccacatgaagaaccaaaaccttgcacgatcaagaaagatgaccatcaaaaaggatgaaagcaaagggcaaatgcattgcaaggacaagcaccacatttgttacaattgccgtgaaaagggtcatctattcaaggtttgtccaaagggtaaaaatcctaagcttaacttaacaatacattcagatatgcttaggagacccaaatttgactcttgtgctagaaaggtgatgacttcaccacattctaggactaaggctatttgggtgcctaagtccttattggctaaccttggtggacccatccaaaaatgggtaccaaagtgtaattaa

SEQ ID NO: 98 - DNA, 387 bp, Xenorhabdus bovienii
  Coding DNA location: Contig name=SeqID_16807; Position on contig =982..1368bp; Strand=-
gtgtcatggaactctaagaaacaaacctccattgccctatccaccgctgaggccgagtacgttgtcgcaggacagtgttgcgcgcaactgctttggatgaggcaaacccttcgggactttggctacaatctgagcaaagtcccactcctatgtgataatgagagtgctatccgcatggcggaaaatcctgttgagcacagccgcacaaagcacattgacatccggcatcactttctgagagaccaccagcaaaagggagatatcgaagtgtttcatgttagcaccgagaaccagctagccgatatctttaccaagcctctagatgagaagaccttttgcaggctgcatagtgagctaaatgtcttagattcgcggaacttggattga

SEQ ID NO: 99 - DNA, 210 bp, Xenorhabdus bovienii
  Coding DNA location: Contig name=SeqID_16808; Position on contig =141..350bp; Strand=-
atggtgagagaacgaagaacaccaacaaacacaatgagcaagaacacaagagacacaagatttatcccgaggttcggtcacaccaccaaggtgccctacttcctcgttgaggcgcccacaaagagccgggtctctttcaaccctaatcctccctttgccgaccacaaaggtcaagctcacacactaatctttgctcaaacgagcgggtaa

SEQ ID NO: 100 - DNA, 840 bp, Xenorhabdus bovienii
  Coding DNA location: Contig name=SeqID_16808; Position on contig =534..1373bp; Strand=+
ttgcctattcaccccccctctaggcaactttcagatatcgatgatgttgatgatgatggctattcatatgatgatcttgttagaatgttaggtgaggccgatgactacatgcacaaagaaaaagaaaattttaagaccttgaaggaattgtataaaaacctccaagtgtcttttgaggagctcaagacctctcacaatgacctcaaagaaaattgtgagaagcttgcggatgctcaaaaatcatctattgtgcatgaagttgaggtggtcactaaggatgttggagtcacttgtgacttacttgatagtcttacaagtgaaccactacctactaactctatttgtgataaatgcaaaatttctctcaatgataacattgctcttgatgaatcaaaaattattgttgagaatggagtgttagtagatagaataaatactctaactcatgacctagaaaaggcatatggtggtaagactaaattggatttcatattgggaagtcaacgatgctctcttaaccgtgaaggtcttggatatgttcccaagaaaggaaagaatgcttttgtaaagcaaaagacattgtttgtgaaagaatgtgacaaagtgtgtcacaagtgtcacaaaaagggacacgttaagaaaaattgtcccaagttcaaaaatgtatcctccacttgttttgagcattgttatgttctttctcataatgcaaaaggtgttcatactaaatttgttggtacttcaattgttggaaacaaaaagaaagctatttgggtaccaaagaccttggtcactaacatccaaggacccaagcaagtttgggtacctaaaagagattga

SEQ ID NO: 101 - DNA, 342 bp, Xenorhabdus bovienii
  unsure (1)..(342): unsure at all n locations
  Coding DNA location: Contig name=SeqID_16808; Position on contig =1417..1758bp; Strand=+
gtgttggatagtggatgtactcaacacatgaccggggatatgaaaatgtttacccaaatgagtgaggaagattgctcaaattatgatagtatcacatttggagataatcgtaaaggaaaggttaaaggtttgggtaaaattgctatctcaaatgatcattctatatcaaatgtgctattggttgagtctttgaattttaatttactttccgtagctcaattatgtgatttaggattttgttgcaatttcacggttgaagatgttattatctctagtgttgatggtagcaatcttaagtttaaaggttttagacatgaaaatctttatcttnnnnnnnnnnnn

SEQ ID NO: 102 - DNA, 219 bp, Xenorhabdus bovienii
  Coding DNA location: Contig name=SeqID_16809; Position on contig =405..623bp; Strand=+
atggtggtctgcatgtggctggttcgtgggaatgatggaagaggagatgggaaatggggaacaggtagcagatggatgggtaagggagatgtggatgtagtctgggaatatggcgtggaggtgggaattatggttgcggctgctatggtggaggatgttgcggcgcccgggatgccagtcggtagtgtgggaacaccgccgtacccgggtatgccgtag

SEQ ID NO: 103 - DNA, 183 bp, Xenorhabdus bovienii
  Coding DNA location: Contig name=SeqID_16810; Position on contig =89..271bp; Strand=+
atggcaaagggagatgctaaggtaaaaatcatcaccgatgtaaatgatataaaagatgatgatgatattgaaagtgcattcatcccttttgtgagttttggtgatttggataacaacacatttaaaggtctaacgagtttgctaagtgttgaacaggaaattcagtatgatgaacatacttga

SEQ ID NO: 104 - DNA, 198 bp, Xenorhabdus bovienii
  Coding DNA location: Contig name=SeqID_16810; Position on contig =1465..1662bp; Strand=+
ttgcagtctgacttgcagtctgccagtctgactggtagactgtctgtcagcctgccccaggcggttgaaccggtcttaggggcggttcaaccggtcttggtcaactttgaccagtctgtggtcagtctgcgcgtcagtctgccagtcagactggcagacaggctgccaggtctgccaggggcggttcaaccgccctag

SEQ ID NO: 105 - DNA, 270 bp, Xenorhabdus bovienii
  Coding DNA location: Contig name=SeqID_16812; Position on contig =79..348bp; Strand=+
atgtatgttataccccgctatcttcagggctcaggctatcagttccatgaacgtaacccccgaccccgagccacacaagcaaaacaacaggcatttcagatagcactgtcagttcgcagcagagttggccagctgcacgagaccgtccacgatttccagcttgctgccaagctgcaccttctgctcccccgggtcaccgcaggggcagggccagtacaagctgggctccccgaaccccaagttgttgtagctcggcagagcctgagctag

SEQ ID NO: 106 - DNA, 321 bp, Xenorhabdus bovienii
  Coding DNA location: Contig name=SeqID_16813; Position on contig =405..725bp; Strand=+
atgggtacgtcaaacgatcatttaaaattctttagacttcgaattgatgaagatatcatagaaaaaattaatcgtgaagcgcaaatcaaagatggaatgaagcaggatcttatctctgatgttgctgattggtttgctacacaacgtagcaaaggtgagatcccccctcgttatttcgcaagtcgaacgtgtgctgaatacgaaggtatatgggtaagaaaagaaacagccaagcgaattgaagagcttgcaaaaactgatggaacaaatgcttcaagagttctttatacagcacttgcaagatatgtagaaaaaaagtga

SEQ ID NO: 107 - DNA, 270 bp, Xenorhabdus bovienii
  Coding DNA location: Contig name=SeqID_16815; Position on contig =35..304bp; Strand=-
gtggcgttcttcaccaacatcatccatcgttttggggtcccaaactccatcatcaccgacaacggcacccagttcaccggcagaaagttcctggacttctgcgaggatcaccacatccgggtggactgggccgccgtggctcaccccatgacgaatgggcaagtagagcgtgccaacagcatgattctacaaggactcaaacctcgggtctacaacgacctcaacaaagttcggcaagcgatggatgaaggaactcccctcggggtctga

SEQ ID NO: 108 - DNA, 612 bp, Xenorhabdus bovienii
  Coding DNA location: Contig name=SeqID_16815; Position on contig =971..1582bp; Strand=-
atgggcgaaccaatctcgttcgcccctcggaagcccatcaagtcccaggtcttggcggacttcgtggctgaatggatcgacacccagctcccaacagttccgatccaaccggaactctggaccatgttcttcgacgggtcgctgatgaagacaggagccggcgcaggcctactcttcatctcgcccctcgggaagcacctacgctacgtgatacgcctccatttcccggcgtccaacaatgtggctgagtacgaggctctagtcaacgggttgcggatcgccatcgagctaggggtccaacgcctcgacgctcgcggtgactcgcagctcgtcatcgaccaagtcatgaagaactcccactgccacgacccgaagatggaggcctactgcgatgaggttcggcgcctggaagacaagttctacgggctcgagctcaaccacatcgcccggcgctacaacgagactgcggacgagctggctaaaatagcctcggggcgaacaacggttcccccggacgtcttctcccgagacctgcatcaaccctccatcaagatcgacgacacgcccgagcccgaggcaccctcggctcagtccgaggcaccctcggcttag

SEQ ID NO: 109 - DNA, 126 bp, Xenorhabdus bovienii
  Coding DNA location: Contig name=SeqID_16816; Position on contig =1..126bp; Strand=+
actgtgattacagcacctcgtaaaagcacatttttgaaaagtgaaaaaaagaaaagtggaacagttatcgaacataaagatactgattctatttttattcgtttggagcgtgaaaatgcaaattaa

SEQ ID NO: 110 - DNA, 876 bp, Xenorhabdus bovienii
  Coding DNA location: Contig name=SeqID_16816; Position on contig =116..991bp; Strand=+
atgcaaattaacaaaatgtttaaacctgctttattaagtctatttattctctctggttttgtgcatgcacaacccgcacctggtatagctgtattgaaggcaactggtacaccggagttaaaaaaggttcaagaaactcaagcaggttcaattgctgaagttaaagccgcgcaagacgaatttaaacaaaccttttctcaaatgaatttcactaattttgctgaatcaccagtgaaaggaatctatgaattacataccggtggcaacgttatttatttcacacctaaatcggaagatcgggaaggtgtaattatttttggtgaaatgtgggattcaaacggtgtaagcctgacaaatgaaagcaagctaaaagctatcaaaggggaatggaaaaaacttccagttaaaagcgcaatttcaattgggaataaaaatgcgccttcctattatgaaataactgatcctgattgtccttactgccattcctatcatggatggataaaagattactccaaaaccaaccctgtacaacgcaaccttatctttatgttgaatccagggcatccagaagcaccggctaaaatcgaacacatcatttgttctaaagataaagaacaggcaattaacgatatgttcgaacaaaaacctgtgactttagaaaagtgccctgaagcaaaaggcattattcaacaacatcaggacattgttaaatcattaggcgtaaacggtacaccatcattcgtatttgatgttaatgaagaacctgaactcatcgttgggtttaataaaaacaaagtcatggaggcaataattcaagcaacagagaaagtaaaagccagcgaattaacaaaaccagacgccaccaaaaagcagtaa

SEQ ID NO: 111 - DNA, 246 bp, Xenorhabdus bovienii
  unsure (1)..(246): unsure at all n locations
  Coding DNA location: Contig name=SeqID_16816; Position on contig =1043..1288bp; Strand=+
atgattttaacgctaagcactcatgttcatgagaacacgcagtctatttttatgaaaatgaaaacctggtacttgagccttagcaccatacagcgcttatgtatgggtttattactaactcttattcctgttgctgcaatggcttggacagaacccgcagctggtgattttggctatcaaatctatgacgttggtatcaataaaattgccaaaggcccaatcgggtttgcaggtggcgnnnnnnnn

SEQ ID NO: 112 - DNA, 1185 bp, Xenorhabdus bovienii
  Coding DNA location: Contig name=SeqID_16817; Position on contig =825..2009bp; Strand=+
atgtctaaagaaaagtttgaacgtaaaaaaccgcacgttaacgttggtactatcggccacgttgaccacggtaaaactaccctgactgcagcaatcactactgttctggcgaaaacttacggcggtagtgctcgtgcattcgatcagatcgataacgcaccagaagaaaaagcgcgtggtatcaccatttctacttctcacgtagaatacgataccccaactcgccactatgcgcacgttgactgcccaggccacgccgactatgttaaaaacatgatcacgggtgctgctcagatggatggcgcagttctggttgttgctgcaactgatggcccaatgccacagactcgtgagcacatcctgctgggccgtcaggtaggcgttccatacatcatcgtgttcctgaacaaatgtgacatggttgatgatgaagagctgctggaactggttgaaatggaagtccgtgagctgctgtctcagtacgatttcccaggcgatgatacgccaatcatccgtggttctgcgctgaaagcgctggaaggcgaagcagagtgggaagcgaaaatcattgaactggcagaagcactggattcctacattccagaaccagagcgtgacattgacaagccattcctgctgccaatcgaagacgtattctccatctctggccgtggtactgtagtgactggtcgtgttgagcgtggtatcgttaaagtgggtgacgaagttgcaatcgttggtatcacagatacggtgaaaacaacttgtactggcgttgaaatgttccgcaaactgctggacgaaggccgtgctggtgagaacgtaggtgttctgctgcgtggtactaagcgtgacgaaatccaacgtggtcaggtactggctaaaccaggttcaatccagccgcacactcaattcgaatcagaagtttatattctgagcaaagatgaaggtggccgtcatactccattcttcaaaggttaccgtcctcagttctatttccgtacaactgacgtaaccggtactatcgaactgccagaaggcgttgagatggtaatgccaggtgacaacatcaacatgatcgttaccctgattgctccaatcgcaatggacgaaggtctgcgtttcgccatccgtgaaggtggccgtactgtaggtgctggtgttgttgctaaagtgattgcttaa

SEQ ID NO: 113 - DNA, 498 bp, Xenorhabdus bovienii
  Coding DNA location: Contig name=SeqID_16818; Position on contig =386..883bp; Strand=+
atgggagaagaattgcgtgactgggttggatgggtgaaatcacgattccgcaaccttcttctcaaggtcatttcatcttttctttgggcatgcatgcttttcttttccacatttctgggttgtgttgatgttgatgttgatcttgaactctccaatgatgttctgcagctggagagtcttggtgtttactgtgaccctgatccctcagaacaagttgatcataccatcactgatccaaatgttgtattcttctggggtctcatctatagaaggaatattcaaatatgtataagttctctcaaagaagatttcatgaaaagtgtctgcaataacatctatggaaaggaaaaatgtgcccattcagacatcacaatgtccattgttgggcctccccagctgccaaaaagtgtctttgatctctcagtttactctgaaaagctgccacaacatatgatggggcaccaactaatgaagcagaactacaatgcagtcagttag

SEQ ID NO: 114 - DNA, 198 bp, Xenorhabdus bovienii
  unsure (1)..(198): unsure at all n locations
  Coding DNA location: Contig name=SeqID_16819; Position on contig =57..254bp; Strand=-
atggatgtctgtcacattgttgcagtggttttggtggtctccgcaagaaacttgcaggtcgctttaaatccaagcgccctcgtggaaatgatgatgactatacaccaaccactgattcagaggcccaatcctcagctgggggcactgaatccatggatgctgaagattttcctcatgttcatcccgattatcnnnnnn

SEQ ID NO: 115 - DNA, 1395 bp, Xenorhabdus bovienii
  Coding DNA location: Contig name=SeqID_16819; Position on contig =1204..2598bp; Strand=-
gtgtttcgcaacaagcacaatgaatatggtgtggtagtaagaaacaaggcaagattagttgcacaaggatatactcaaattgaaggattggattttggggagacattcgctcccgtagcaagattagaagcaatccggattctacttgcttatgcttgtgcacataatatcaagctctaccaaatggatgtaaagagtgccttcctaaatggtaagattagtgaactagtgtatgttgaacaacctcccggttttgaggaccccaaaagacctaaccatgtgttcaagctttctaaagctctctatgggcttaagcaagctccacgcgcttggtatgaaaggcttagggatttcttgctttccaaagacttcaaaattgggaaggttgacactaccctattcactaaaagaattggcaaagacttatttgtttgtcaaatctacgttgatgatattatttttgaatctactaatgaattattttgtgaggagttcggaagaatgatgtcaaaagaatttgaaatgtctatgataggagaattgagcttctttcttggccttcaaatcaaacaattgaaagatggaatttttataagtcaatcaaaatatttgaaggacatgcttaagaagtttggtttagaaaatgctaagcctatcaagactccaatggcaacaaatggtcatctagacttagatgaaggaggtactatggttgatcaaaaactttatcgttcaataattggtagtttgctttatattaccgcatctaggcccaatgttatgtttagtgtatgcatgtgtgctcgatttcaagcttcacctagagagattcacttgaaggccgctaaaagaattctaagatatttgaagtatactcccaatattggtctatggtatcccaaaggtgctcactttgaattaattggatattcggattcggactatgcggggtgcaaagttgatagaaaaagcacctccggttgttgtcaatttcttggtagatctcttgtttcatggtcttctaagaaacaaaattcggttgctctatctaccgccgaggcggaatatatatcggccggaaattgttgtgctcaactattatggatgaaacaaaccttattggattatggaattattttcaagaatgtgcctctcatgtgtgataatgagagtgcggtaaaattggctaccaatccggtccaacactcaagaaccaagcatattgatatacggcatcacttcttaagggatcatgttggcaagggagatatctctatttattccattggcacggatgatcaattagcagacatttttacaaagcctttggatgaaacaagattttgttctctaagaagtgaaatgaatgtgatcgatctctcaaatgtggcttga

SEQ ID NO: 116 - DNA, 1032 bp, Xenorhabdus bovienii
  unsure (1)..(1032): unsure at all n locations
  Coding DNA location: Contig name=SeqID_16819; Position on contig =2767..3798bp; Strand=-
atgattttattggggcccctatcttttgtaagtattggtggtattcttaatgtcttgggattgtggatgcctattcaagatttacttgggtttattttctacgagacaaatccaaatgtgtttgaaacattcaagtcatttgctatattggctcaaaatcaatttgatttcgacatcaaaaaggttagaagtgataatgggtcggaattcaaaaatgcaagaattgatcaatattgtgatgacaagggtatcaaacatgaattctcttccaaatataccccggaacaaaacggtattgttgaaagaaagaatagaactcttattgatatggcaaggtctatgttagcggaatatagtatatcggattcttattgggccgaggcaataaataccgcttgtcattcatcaaatagactatattgtcacaagctattgaagaaaactccatatgaattgctcattggtagaaagccaaatatctcatattttagggtattcggttgcaaatgttatattttgagaaaggggagccggctctctaaatttgagaagaaatgtgatgagggttttcttcttggatattcatcaaatagtaaggcttatagagtcttcaacaaaactcatggtattattgaggaagcatatgatgttgaattcgatgaaacaagtgggtctcaagatgagagtgataatctcgatgatgttgggggaactcaattgataaatgcaatgaaaacaatgtccattggtgaaataaaaccaaaggaagatgatgatgaaaatagtgtggttgccattccttcatccacaactataaatgaggaagatcaccaaagccaacaactcaatganaccatggatactcatgatcaaggtactttcagaccttcggttcctcctaatgcttcaacaagcaattatcaaacggtatcnngaannnntcattnnnntntganngatnaccnnntngatnnnnttgnnnntnntnttnntaagggtnnccnannnnnntntnnnatnnnttngnnntnn

SEQ ID NO: 117 - DNA, 282 bp, Xenorhabdus bovienii
  Coding DNA location: Contig name=SeqID_16820; Position on contig =553..834bp; Strand=+
atgaagttggatgatttactctccgccatgacacctgaaatttatcagagattggttcaggctgttgaattaggcaagtggcaggatggtgtaccgctaacgccggaacagaaagagcacagtttacagatggtgatgctttggcaagccaagcataatcacgatcctgaacacatgacgattggtacggatggccaaattaccataaaaagcaaacaagagttgaaggccatgttccagtcagaaatggtcgtgaaactaaaaccacagccagaagaatga

SEQ ID NO: 118 - DNA, 621 bp, Xenorhabdus bovienii
  unsure (1)..(621): unsure at all n locations
  Coding DNA location: Contig name=SeqID_16820; Position on contig =913..1533bp; Strand=-
nnnnntatcgacctgcaaaatgatttctgttcgggaggagcactggcagtcaaagagagtgaagaggtcatcacaatagcgaataaggccatcagcctctgccagaaaaacaatatcactgttatcgcaagtcaggactggcatcccgccaatcatatgagttttgcagttaatgccagtcagcctgttggagaatctgggctgctcaatggcattcctcaaatatggtggcccgttcattgtgtacaagggcaattcggcgcagattttcatcctgcgttgaatcaatccgctatccaagaaattttccgtaagggtgaaaatccgcagatagacagctacagtgccttctttgataatgaccataagaacgcaacccgactgcatgggtggctagcggatcaaaatattcaacgactgattgtgttgggtattgctacggattactgcgtaaaatttacagtactggatgcactggaacaaggctatgaaacctacgtgattactgatggttgtcgtggggtcaatcttcaggatgatgacagcctgaaggcatttaaggaaatggcaactaaaggcgctaaactaatcccactgcatgaaataacaacactttcttaa

SEQ ID NO: 119 - DNA, 525 bp, Xenorhabdus bovienii
  Coding DNA location: Contig name=SeqID_16821; Position on contig =116..640bp; Strand=+
ttggttttaacagcgctaacttattatgaagtgagcaattcagcggacaaagcaaaagtagttattactcctttcgccagtgtggattctggtgatttttgggtgactggaagaacggcatcagagagttatgttaatcgcatggctaaactggtcgctgcgtattacgggacggtttcgcccacaactgtaaaaaactctaatgcctctcttctggctatggttcaccccactagaagtgaagcgatgaggaaaaaattcaacgaacgagaaaagaaggttactcagtttacaactgtctcattcattacagaattaaaccctgaaaaaccaatccaagttactactaatcctgaagttgaatataaagaacatggttctttgcctgtttatcgtctggagatccctgttaccaaaagaaaaataattggtgagacttctcctaatcctgaaacagcaaaatacaccgtagattacaccatcgaatcaaatcaattctggctgcttgatataacgggcttataa

SEQ ID NO: 120 - DNA, 789 bp, Xenorhabdus bovienii
  Coding DNA location: Contig name=SeqID_16821; Position on contig =642..1430bp; Strand=+
atgaataaactactcctaatttgcgctctcagtcttacctctgctgtggcgacggcaaaagtaactaatattagtacccaaagggtacttcctgaagtatctaccactgttacattgagcaaccgtgatgttaatcggattgtttgtgaatctggcgaagcagttaaaccagttttcagtaaagaaaaaccaatgaaagtagaaattggtgctgatagaaaaactttttttgttaagttcttatttttacagagtgctgggggcaaccaatactactcagagcctaccgaattatatttaacctgcggtaacgctacttttgagttgattatcaatcctcagcatgaatctgccagaaaggttttattgggttctggtacagccaataccattaaagagaatcaaaagttattctcagctctatctctggaagaaacagcaacacaactatcaattagcgttatgaaagatgctaacgattccggccttgggcttcctccaacatttgaacaacaagcaataaatggccgttgggagaaagcatttcctgatcgtcgtggtgtggctattcccatcgaacttaaaaaagatagagaagttaatgttgaaggaacaggtttaaaagcgactcaatttaccattagagcattacgcaatgttcaactatcagaaatgatgtttttgaatacccgctacggaaagaacatattcgccataacattagagtctttgtctttaagttcagggcaaatgacgtcactggtcattattgaaagggaaggtctatga

SEQ ID NO: 121 - DNA, 1236 bp, Xenorhabdus bovienii
  Coding DNA location: Contig name=SeqID_16821; Position on contig =1430..2665bp; Strand=+
atgaatatcgaagacaataaaacaacccttttggataaggctaaatcctggtactactctaaatcttcagctgatagaaagaagatcgtcaaatatggcactattaccagttttattattattatttttggtttctattacgcttcaggtaaggccgaaatcgtaaacaagccaacatctaaaacttcagtggttgcggatacagctgaagataaattattgaaagacgatgttgtcgctcaattgcaaggcgatataaaggacagtaatgcaaaaatcactgatgatgtggccaaaaaaattcaggacatgattaacaagggtgaatttaaactagcacctacaccgccagttaacttagcagaggcagatatatctccagttaaagagagaaatgaacttggctcgactactggaaatccggttgaattttcatatccacaacctttaagtgaatcatcaccagtttcttcagacaatggtacaccggtagacgggactacaccgcccgatactggccccatttgggttggtgatatcgcgatagataacagtacatttacccagcctccggcagaggtgaataccgaaaaaaagaaccagatccagttgccggttggatttatgaaagcccaccttttagtaggcgttaatgcgttaaccggtgaatttggcgcagaaaatccccaaacagtaatgtttagggttcaagcaccggcccaattgcctaacttcattaaaatgaatctctcaggttgtttctcagtggctaacgtcactggtaatttatcgatggaacgtatcattgcacttccaatcagcatgcattgtattaccagagacaagcgattcatcgttgaaggggcaattaaggggtttgtctctgatcgtgatggtaaacgtgatatgtctgctcgtgtcgtttccagagcggggccgttacttgcttctaccatatttgcgaagagcattgagggctttgctaacgtagttggttcacagggcgtcacacagaacgtatccgctttaggttccgtgaataccattaaaaacgcagatttagctaagacagctgcctcacaaggtttagccggtggcttaagtgaagttgggaaatatttattagacctcgccaagcaaacagcacctgccctggaaacaggttccggtaaagatgtcattttgtttattcaagaaaccgcaacgcttgaaattaaagaagttcggattaaatag

SEQ ID NO: 122 - DNA, 378 bp, Xenorhabdus bovienii
  unsure (1)..(378): unsure at all n locations
  Coding DNA location: Contig name=SeqID_16821; Position on contig =2689..3066bp; Strand=+
atgaaatttattaaactcacaattattcttcctgtattgattttatctggttgcggtattcttccttatcacaatgattttgcctgtaaattagaagatggttatggaaaatgcatttcctcagctgacgcatatgatgaggcggttactggtattaataaaggcaaggaaattacagacagcggagtaaaggatgacccaaaggcatctgccgctaaagcggctaccagcgctaatagctctgtggcctacgataaatatcgtgaccgtgtttatcagcaattaacacaattaattgcacaaccacaaacaccggttgtaaaaccagctaaagtcgtcagaactttaattatgtcttattcccctagcatggannnn

SEQ ID NO: 123 - DNA, 273 bp, Xenorhabdus bovienii
  Coding DNA location: Contig name=SeqID_16822; Position on contig =1034..1306bp; Strand=-
ttgggagagattataggctctgacagcaaaaatgcttatttatccatcaatagcaagcgtgtcgattttgccattattgaccagaaaggcgaaccattcgctgtagttgaatatcagggttctgggcattatcaaggtaatgccgcagtccgtgatacaataaagaaagaagcctgtaataaagcaggtatcaggtatttcgagatcccagctaaatacagtgaagacgatgtaaataacatcggactgtaccttaataccctgagtaactga

SEQ ID NO: 124 - DNA, 273 bp, Xenorhabdus bovienii
  Coding DNA location: Contig name=SeqID_16822; Position on contig =1739..2011bp; Strand=-
atgagcaatgaaaaatatgtttgtcccaactgtggtgagcaagtttatttctgggttgaacaattaattgagcatagacgtgtaattaatacgaaaactggacgaatgaaaacgcaagttaaaaaaatcaactttggcaatagaacaactaattcaggtgttagttgtagtaaatgttattggttttcatcattcgatggagagcagcttccaaagcattttgaagacatttcaggtgtagatcaatttattgaaagtatagaaaatagttaa

SEQ ID NO: 125 - DNA, 282 bp, Xenorhabdus bovienii
  Coding DNA location: Contig name=SeqID_16822; Position on contig =2098..2379bp; Strand=-
atgcggttaattgaaaattatgtacccccttcgacggatgatctagcggatctaaaaggtaagttacgttttacaggtcaacaaatggcagaactggcaggggtatctggtagtaaccagtggcgtaaatatactggtggggaaaaaccacgggaattaaatcaacatattcttttttttatagcagcccaattgacattggatcagaaagaattattatccattttggataaaatgagaaaattagggtcagaattcgaagaaaatttaatacagccctaa

SEQ ID NO: 126 - DNA, 270 bp, Xenorhabdus bovienii
  Coding DNA location: Contig name=SeqID_16822; Position on contig =2420..2689bp; Strand=-
atgtcagccataactatgaatacacataatgctattaaatctctgaaagaatcggggatgagtgaagcacaagcggaaaaaattgtcgagattattgctgacttacaaaatgtcagtgcagcgacaaaagatgatttaaagcaagctgagaacaatttaaaagctgatttaacatcaattaaaaatgatatggattggttgaaaaaattaattattacggttgggatcgctgttgtcatcgcagccataaaatacatttttgtaggctaa

SEQ ID NO: 127 - DNA, 309 bp, Xenorhabdus bovienii
  Coding DNA location: Contig name=SeqID_16822; Position on contig =2931..3239bp; Strand=-
atgcaacgaaataacaaaactactgatgatctcttcccattacgtgatagcgaaattgttattgtatgcgaactcaatgaaggcaaagggtttcatttctgccgtaatgctttgctaagtggcagtaacaataacctatggtggcctctagctgaagatgaaaaactactctctgcaattgaacgagttatggttataaatcatgtagctaggaatgtgacccgtattacaccggttcgccgtggtgaaaaattcgttgattatgaggtgatctataataaggaaaataatcaaatagtgaaaaaataa

SEQ ID NO: 128 - DNA, 279 bp, Xenorhabdus bovienii
  Coding DNA location: Contig name=SeqID_16822; Position on contig =3308..3586bp; Strand=-
atgccaagtaattcagctaatccaacgaaaacaaaaaataaagcgattgaactcattgaaaagtcgattgatgccttaaatttaaatagtaaccgtattgttagtaatgaacgagctaatttggtaaatcagctagaatcagagggtttcccaatattgtctgaaattgttgaaggttttgaacttgatagatatagagaaaaccatcagcaccagatttatggttgtcttctcaggaaatatatttctttatttgaagaaatggaatttggtaattaa

SEQ ID NO: 129 - DNA, 291 bp, Xenorhabdus bovienii
  Coding DNA location: Contig name=SeqID_16822; Position on contig =3670..3960bp; Strand=-
caatgtgactcctggaagtattatgacttatcctgcggcggtggttatatggctccgattacagacaaaaacttcactatacatgtacatggtaacggctttagcgggatgttaagtgccgatgctgcggggatcgctgtaaccctgtttgctcttaattattttatttggcaagcctacgaggctggcgatcatgaattaaatcactggttgattgagcgtcaggaatggctgaaatattatgcaaatcagcactctgaatcagagaaaattttaggggctgttcgttaa

SEQ ID NO: 130 - DNA, 624 bp, Xenorhabdus bovienii
  Coding DNA location: Contig name=SeqID_16823; Position on contig =53..676bp; Strand=+
atgaaggtgatctacggagcattgccgaaaactaaaggcaggatcctgctggatggaaaacccctgactattcgcaatccacaggatgggctggctaacggcattgtctatatttcggaagaccgtaagcgtgatggcttagtgttgggaatgtcggtcaaagaaaatatgtccctcacagcgttacgttatttcagtcaaaaaccctatcgtttgaatcattccgcagaacaaaaagccgtaactgacttcatcaaattattcaatatcaaaactccctcaatggaacaatcgattggcttgctttctggcggtaaccagcaaaaagtggcgattgcccgtggtctgatgactcgcccgaaggtattgattttggatgagccaacccgaggagtggatgtcggtgcgaagaaagagatctatcagttgatcaatcagttcaaaaaagaaggtttgagcatcattttggtctcgtctgagatgccggaagtcatgggaatgagtgatcgtattctggtgatgcatgaaggtggcataagtggtgagttcagtgcggataacgcctctcaggaagcgctgatggtcgctgctgtcggcaaacaatacggtgcagttgaaaggtaa

SEQ ID NO: 131 - DNA, 675 bp, Xenorhabdus bovienii
  unsure (1)..(675): unsure at all n locations
  Coding DNA location: Contig name=SeqID_16823; Position on contig =695..1369bp; Strand=+
atgaattctaacacagcaccaacctccagacgtttgctcacgaaagcctggttgatggagcagaagtcactgattgcactattgattctgattgttgtcgtttccttcctcagccccaattttttcacactgaataacttatttaatatcctccagcaaacttctgtcaacgctatcatggcggtgggaatgacgttggtgatcctgacttctggcattgatttatccgtcggatctctactggcactgacgggagcggtggctgcatctatggtcggtacggatgtcaacgcgctggtggcagttgttgcagcactggcattgggggcagcgattggcgcatgtaccggtgttattgttgcgaagggcaaagtccaggcgtttattgccacattagtgatgatgctgttattgcgtggtgttacccgtgtttataccgatggcagtcccatcaataccggattcagtgataatgccgagctatttggctggtttggtattggccgtccattaggagtgccggcgccagtctggatcatgttgctggtttttgctgctgcctggtacattctgcatcacactcgccttggccgttacatctacgctttaggcggaaatgaatctgcaacacgtttatcaggtattaacgttgataaaataaaaataannnnnnnn

SEQ ID NO: 132 - DNA, 120 bp, Xenorhabdus bovienii
  Coding DNA location: Contig name=SeqID_16824; Position on contig =380..499bp; Strand=-
atgacacaactcaccatgcacgctgccacctcagctccctcctctccacacatgtctcatgtcactttcgactttggctttttcactatgacacaactcgccatgcatgttgccacgtga

SEQ ID NO: 133 - DNA, 759 bp, Xenorhabdus bovienii
  Coding DNA location: Contig name=SeqID_16825; Position on contig =63..821bp; Strand=+
atgtccattatgatcaccctaaaaaacattacggtcgaatttggtagccgcaaggtattaaacaatatcactttcagtctcagacaaggcaagatcctgacgttaatcggcccaaatggtgcgggcaaatcaacactggttcgcgttgttctgggcttgattcaaccaacttctggaactatcgaacacagtcatccactgaaaatcggttacgtcccacagaaactcagccttgatcctaccctgcccttaacggttaaacgtttcatgatgctaaggccaaatgttaaatcagcagacatcatgcccgtattaaagcgtgtcaatgctgaacatttattacagcaacccatgcaaaaactgtcaggaggggaaacccagcgggttttactcgccagagccttgctcaatcatcctcaacttctggtgcttgatgaaccaacacaaggtgtagatgtgaacggccaactggcgctttacgatttgatcaatcaaatcagaacagaacttaattgcgccgtgcttatggtatcccatgacttgcacttggtgatggcgaaaacagatgaggttttatgccttaaccaacacatttgctgttctggcacacctgaggtggtatcaatgcatccagaattcatcgcaatgtttggtcgtcatggtgcagaacagctggcagtctaccgccatcaccacaaccatcaacatgatctgagaggaaaaattattttgaaaaacggtggggagccacgtcgatga

SEQ ID NO: 134 - DNA, 786 bp, Xenorhabdus bovienii
  Coding DNA location: Contig name=SeqID_16825; Position on contig =818..1603bp; Strand=+
atgattgagttattactcccaggctggctggctggcattttattggtcatcgccgcagggccgctcggctcttttgttgtttggcggagaatgtcttattttggtgacactctggcacacgcttcattgctcggcgtggcattcggttttttattagacgttaatccgttttatgccgttattgctgttacattgatattggcaatgattttagtctggctggaaaaacgcccacaattagcggtcgatactctgctgggcattatggcgcatagtgcgctatctctgggcttggtagtcgtcagctttatgaccaatatccgagtcgatatgatggcgtatttatttggtgatctgctgtctgtcacttatgaagatctctggctgattgcagcgggtgttgccattgttactgggttgctgacatggcaatggcgtgctttgctgtcgatgacggtcagtcaggatttagcatttgttgatggcatcaaaatccagcgcttacgtgtgcttttaatgctggttacagctttgaccattggattggcgatgaaatttgtcggggcattgatcatcacttctctattaattatcccggcggccactgcccgtcgattctcccgtacgccagagcacatggcagtttttgctattactgttggtatgcttgctgtcacgggaggattaactttatcggcattttataatacccccgccggaccttctgttgtgctctgctcggcagcattgtttgcattaagtttgacgtgtaaggcgaaaaactga

SEQ ID NO: 135 - DNA, 1008 bp, Xenorhabdus bovienii
  Coding DNA location: Contig name=SeqID_16825; Position on contig =1884..2891bp; Strand=-
atgattgaagctgaccgtctgatttcagcagaagttttgcaagatgatgaagtcattgatcgcgctatcaggccaaaattactgtctgaatatgttgggcaacctcacgtttgtgaacagatggaaatttttattcaagctgcccggcaacgaggagatgcactggatcatttgctgatttttggccctccaggattgggtaaaaccacgttggctaatatcgtagcgaatgaaatgggcgtcaatctccgcacaacatcagggcctgttctggaaaaggccggtgatcttgctgccatgttaaccaatcttgaaccccatgatgttctattcattgatgaaatccatcgcttgtctccggttgtggaagagatcctttatcctgcgatggaagattaccaactggatctcatgattggtgaaggtccagctgctcgttcaataaaaattgatctgcctccatttacgttagttggtgcaacgactcgcgcggggtctctaacctccccattacgcgaccgatttggcatcgtacagcgccttgaattttataacgtagatgatttacagaacatagtttcccgtagtgcccgctatatggggttgggcatttcagaagagggagcaaggcaaattgccatgcgttcccgtggtacacctcgtattaccaatcgtctgctgcgtcgtgtgcgagatttctctcaggtaaaaggggatggttctattaatggcgacattgccgtccaagctctcaatatgctgaatgttgactcggcaggttttgattatcttgaccgtaagctattaattgcgattattgataaattcatgggtggccctgtcggggtggataacttggcagccgcgattggtgaagagcgggaaactattgaagatgttctggaaccatttctgatccagcaaggttttatccagcggactcctcgaggaagaattgctaccaatcatgcttatcggcattttggactgagtaaagaagtggagtag

SEQ ID NO: 136 - DNA, 204 bp, Xenorhabdus bovienii
  Coding DNA location: Contig name=SeqID_16825; Position on contig =2908..3111bp; Strand=-
ctgttcaaccaaagcaacgatattaatttacctgcggtggctaaacaagccaactctaatgcggatattgaagcagaagccgcttccgcattggtttcactgggatataaactgcaggaagccagccggatggtaagtaaggtggctaaaccgggcgcagattgcgaaacgcttattcgagaagcgctgcgtgcggctctgtag

SEQ ID NO: 137 - DNA, 1263 bp, Xenorhabdus bovienii
  Coding DNA location: Contig name=SeqID_16827; Position on contig =427..1689bp; Strand=+
atgaagctaaatgcgcgactaatcgagactgcaaaatccaaggataaaacctataaacttgccgatggtggtgggttatatctggaggtcacttcacgcggttctaaatactggcgtatgaaatatcgccgtccaacagacaaaaaggaagaccgactggcttttggtgtctatccggcggtgtctttggctgacgcccgaaccaaacgagatgaagccaagaaattacttgcgcaaggaattgaccccaagatagagaaaaaagggggactacctaagtcggcaggagcatattcctttgaacgggttgcccgtgaatggcacgccagtaataaacgctggagcgaagatcacagcaaccgaattctacgcagtcttgagcaatacattttccctcatattggcaggcttgatatttccattttaagaacaagccacctattagcgccaatcaaagccgttgatgcagaaaccaagcatgatatagcccggcggttacagcaacgtgtgactgccatcatgcgttatgccgtccagaacgacattcttgaatccagtcccgccaatgatatggctggcgctctcactacagtgaaatccaatcaccatcccgcattaccccatgaacgtttacctgagtttttgacccgtcttgcccgttatcgtgggcgtttaattacccggatcgctttagaactaactttacttacgtttgtccgttccagtgagctgagatttgcccgttgggaagaagtcgatcttgaaagagccacctggaagatacctgcaacaaggaaacccatcgagggggttaaattttcaggacgtggcatgaagatgaaaactgagcacattgtgccattgtgtcgtcaggctgtgtctctcatagaaaccttgcgtgggctgagtggcgattgtgacgtgatgttccctaatgatcatgaccccaaaaaagtcatgagtgaaagcacagtcaataatgccttgcgtgttatgggttatgacaccaaaacagaagtttgtgggcatgggtttagaacaatggcacggggtgcgatgggtgaatctgcattgtggaacgatgatgcgatagagcgtcagttaagccatatagaaagaaaaaacgttagggctgcatatattcatacttctaaacatttggacgaacggcggctaatggttcagtggtgggctgattatttggatgcgaacagagaaaagcacataacaccgtatgattttgcgaagaaacgtcggaaatag

SEQ ID NO: 138 - DNA, 315 bp, Xenorhabdus bovienii
  Coding DNA location: Contig name=SeqID_16827; Position on contig =1869..2183bp; Strand=+
atgaataatgtgtttttagcggatccgcttagtgaattaaaaagcaaagcaaaagattttatttctatagaagatactctaaatattatttgcgagatgctggattgctccttagtgactgccgctgagattatcttattgaaattaccagatgatagagattggaataatagtccagttaatcctcctttttttggggaaaaattaggaatagctacgttttcatactgtgataatagacctctgattcgagagttactaaaaaacatcattgaaaatgatccatttagctttgaagacagcatccctttttag

SEQ ID NO: 139 - DNA, 729 bp, Xenorhabdus bovienii
  Coding DNA location: Contig name=SeqID_16827; Position on contig =2196..2924bp; Strand=+
atgacagagcgtaaattagctagcgaatataggaagtttggttttgtgaaatcccaacttgaggatgttttaggtttctctctagggggagagcgttctttgcctgattatcttaaaccatataaaacaagaataggcatacaactagatgaagctgcaaatatttttgctgggtgtagacctagtgaacatataaattctggtccattggttgatattattcgtggttatagagcctctctttgggatgcatatgataatgatatattgtcaggcaacaatatcatcatggattataactataatgaagaatatagagtcgatgttactttagttaaagatcaagttactaaatgggctagagagcataacctagattggccttttgaattacctgaaagtgaaatagataatgaaagtagttcggttgatttactctcaaaaattgaaagtttagaattagaaaataaatctttaaaaacaaaaatcaatgaattaaaagaaattataccgctactattgtctgcatatagagatgatgacccattatcaatagctattaaattaagaaatgaagtgtgggtagactacaacgaagattcaagatcaacaataccaacccaagagtgggtggtagcaaaactcatagatgaatataaagagtttgaaatgacaaaggctcaagctcaagcaattgaaaaggttgcttgccctattaagcgtaaatag

SEQ ID NO: 140 - DNA, 216 bp, Xenorhabdus bovienii
  Coding DNA location: Contig name=SeqID_16827; Position on contig =3215..3430bp; Strand=+
atgccagcaatcataataactaaagaaaacctcatccgcttacccgaagtccaacgcagaactggctacggtaaagcatggatctacaaactcattgcaggcaataaatttccgaagcaagtcaaaattggcactcgttcaatcgctttcgttgagtcagaaattgatgactggatatcacaacgtattgctgaatcacgcggcgaggtaatgtaa

SEQ ID NO: 141 - DNA, 921 bp, Xenorhabdus bovienii
  Coding DNA location: Contig name=SeqID_16827; Position on contig =3513..4433bp; Strand=+
atggaaaaaattactgccttgattggcaacggtcaaacttaccctaaattcagccagagtgatatttcaattatccgtaaggcggttatttcgggtaactggacggtaattaacaaaggtatttgcacactcaccgatttgggattacgtcataacggtcaggggttagtttggctcaattctggtgtatcggttcatgatgcagaaagtgatacagggctgacaggcaaggataagcaatcccatgagtaccattcagaggtgcgctcagttaaccatttgaatagtggtaactattatggatttgtccagctaaaggatattgatagttacgcattgaatatcattacttcaatcagttctgaatatcacacccgtaaaaatggcacacctttagcgacgttcgcgttactgattgaccagaagcaacggaaacaggccgtggataactggattttataccgcaatccaaaccagccagataagtacaccattctcaataagcatcatgaactggcgaagtgttatcaggctaaaggctggatgcgtgagccgttggaatatctaagcaagttaatccgtaatgatgctgagttcagcaagcttatgcgtcggttgggttatgttcccgttcgcacaagaaaactaaccggaaaacgtgagagattttggttatacagaaaaacaggaaatgataagggggttgggacaaaaaaaataaataaaatcaatagggttactccatttgtccagtatgcaaaacgaccagtgagagccttcgagcatattgctgtagatggtcagtggctctatgtctatgccgatcacattcgctttctaacaaagaaacgtcaccgcgttgagggtgttcgggttcagggttatacggcaaaagaaatagagctgcgagaggtggtgtga

SEQ ID NO: 142 - DNA, 312 bp, Xenorhabdus bovienii
  Coding DNA location: Contig name=SeqID_16827; Position on contig =5077..5388bp; Strand=-
atgccaacaccaaacaaaaatgcaaagtcacagttaactaccgtccgtgtaccgcatgatgtaatggagggaatggaagcagtaaaacaaggtaatgaaagcaatgctggatttattattactgcgatgcgtgtagaaatagctcgccgccaaagtgagggcaactgtaaagatccactactctcgtcccttgatgcccttgcccgcgtcgaagaaatcggtacaaaagtcaatgaagaaataagattacttatcagtgttgcacaggaagaactccagcgacgcaaaaccaaagcatcatctgaacagtaa

SEQ ID NO: 143 - DNA, 189 bp, Xenorhabdus bovienii
  Coding DNA location: Contig name=SeqID_16827; Position on contig =5579..5767bp; Strand=+
atggatacaccacagcataaccaaactcgccttaaatttacattcctaattgcatcgggcaatcaacgtctggtggatattcaccctgtacgcctcattactgttctggcggactgtgaaggtgaagcccgtttactggcaggcaaatcctctctggtatttgtttcccgtcagggggtgtccgcatga

SEQ ID NO: 144 - DNA, 249 bp, Xenorhabdus bovienii
  Coding DNA location: Contig name=SeqID_16827; Position on contig =5764..6012bp; Strand=+
atgagcaagcctatcactattcatcaagccgctgaaaaggcgcagcaactcgaatttattaatcagcttattgagtcataccctcatcaaatacagggcagtgaaatatccgttatgccttcactgatggcgaagctatccggcgatattgctgtatttctgattgaagtaatcgcaggtgaggaagctattgataacacttcccactgtagcgatatgtctactgttcagggggtgaaccatgcctaa

SEQ ID NO: 145 - DNA, 171 bp, Xenorhabdus bovienii
  Coding DNA location: Contig name=SeqID_16827; Position on contig =6005..6175bp; Strand=+
atgcctaaccctgcccctcatgactattacacccatcagaacggggaaaccgttcaggtgttgtcggtcgcctttaatcgcgtgacgtttgtccgtgatggttatcacaccccgtgcatcatgccagtaagccgtttcactaaagaatacacctacgcagggagagcctga

SEQ ID NO: 146 - DNA, 306 bp, Xenorhabdus bovienii
  Coding DNA location: Contig name=SeqID_16827; Position on contig =6178..6483bp; Strand=+
atgtctgatatctataaccacttagtacgcaacaactttaacgcgatgagcactgaggaaattaaagatctgcgtaagcattcagagggtgcacacagtgcagtgatggcggcaatgtcagcgatgggtgagttggctttctggtctgctgataatgaaaactatgcaaattgtcaggcaagggaagatttacgccgcgtgggtgaagcactgatgtatttgccgaggattgccgaagcgctgaacgacacagcacagcatgcggattttgaaattcatcaccgtgaggggttccccaaatggtaa

SEQ ID NO: 147 - DNA, 943 bp, Xenorhabdus bovienii
  unsure (1)..(943): unsure at all n locations
  Coding DNA location: Contig name=SeqID_16827; Position on contig =6477..7419bp; Strand=+
atggtaaatcatattgatatccgttcagtgaaaatggcggcgaaggatcactggcaaggattgctggctgcctgtggggtggatgttccgacaaagggtaagcatggcgcttgccccctctgcggcggcactgaccgttttcacttcattgacgatcacggtcacggtgactggcattgtcgccagtgtgatgagccgagttttggggatggattggatttgttggtaagagctaaggggatcaccattattgaggcggctaaagtcgttgctgatgcactggcgttacctttgccagaacccaagccagccagaaaggaggctcccaaatcaggggctcccctgatagccgaaagaattaaaaagctggcggctcaaaccacggtcgggcaatcggaatatctgactaacaaggggctgcaatgcccccatcagaagctattgaaagacggttctttgttactggtcatgcaagcgttggacggagccgtgacaggtgcccagacgatcaagccgaacggtgaaaagcgccttgtctcaggctcacagaaaaagggcagttttatccccttatccgggataaccggaacgccggacacgatcatcattgccgatgggtatgcaaccgcgttaacggtcagccagttacatgatggcgtggtactggctgcgattgatgaagggaatctattcgctgttgcagaacaagtcagggaacggtggccagatgcgaaaatcattcttgctgctgacaacgatatgaagtccggtcataagaatgtggggaaagtttcagcagaaaaagcggctaaatctgtcaggggctgggtcacattgncgcccacggaagagaaagccgactgggacgattaccgccagcgtcatggtattgaggcagcaaagcaggcattcagtaatgggttgtatcaggtgggggagaaag

SEQ ID NO: 148 - DNA, 255 bp, Xenorhabdus bovienii
  Coding DNA location: Contig name=SeqID_16828; Position on contig =68..322bp; Strand=-
atgaacgataaaatccgtactctgcaaggtcgtgttattagcgataaaatggaaaagtccattgttgttgctattgaacgtgtggtgaaacaccctctgtatggtaaattcatcaaacgtacgactaaactgcacgtacatgacgagagcaatgaatgtggaattggcgatgtggtggaaatccgcgaaacccgtccactgtctaagactaaatcttggactttagttcgcgtcgttgagaaagcggttctataa

SEQ ID NO: 149 - DNA, 192 bp, Xenorhabdus bovienii
  Coding DNA location: Contig name=SeqID_16828; Position on contig =322..513bp; Strand=-
atgaaagcacaagagctgcgcgataaaagcgttgaagagctgaacactgagctgctgaacctgttacgtgagcaatttaatctccgtatgcaggcggcaagtggccagctgcaacagtctcacctgttgaaacaagtgcgtcgtaatattgcacgcgttaagactttactgactgagaaggcgggtgcgtaa

SEQ ID NO: 150 - DNA, 411 bp, Xenorhabdus bovienii
  Coding DNA location: Contig name=SeqID_16828; Position on contig =513..923bp; Strand=-
atgttacaaccaaagcgtacgaaattccgtaaagtgcataaaggccgcaaccgtggtctggctgtaggtacggatgtcagcttcggcactttcggtctgaaagctgtgggtcgtggtcgtctgactgctcgtcagatcgaagcggcacgtcgtgctatgacccgtgcaattaagcgtcaaggtaaaatctggatccgtgtattcccagacaaacctatcaccgaaaagccactcgaagtgcgtatgggtaaaggtaaaggtaacgtagagtattgggttgccttgatccagcccggtaaagtcctgtatgaaatggacggtgtgcctgaagagctggctcgtgaagcattcaagctggcagcagcgaaactgcctatcaaaaccacctttgtaactaagacggtgatgtaa

SEQ ID NO: 151 - DNA, 702 bp, Xenorhabdus bovienii
  Coding DNA location: Contig name=SeqID_16828; Position on contig =936..1637bp; Strand=-
atgggtcagaaagtacatcctaatggtattcgtctggggattgtcaaaccttggaactctacctggtatgcgaataccaaagaattcgctgacaacctggacagcgattttaaagtgcgccagtacttgaacaaagaactggttaaagcatctatttcacgtatcgttatcgaacgtcctgcgaaaagcatccgtgtgacaattcacactgctcgtccaggtatcgttatcggtaggaaaggtgaagacgttgaaaaactgcgtaagactgtagcggagatcgctggcgttcctgcgcagattaatattgccgaagtgcgtaagcctgaactggacgcaaaattagttgctgacagcattagttcacaattggagcgtcgtgtgatgttccgtcgtgcgatgaaacgtgctgtacaaaacgctatgcgtctgggcgctaaaggtatcaaagtggaagtcagtggtcgtttaggcggtgctgagattgcacgtactgaatggtatcgtgaaggtcgtgtacctctgcacactctgcgtgcagacatcgattataacacttcagaagcgcacaccacttatggtgtaatcggcgttaaggtatggatcttcaaaggtgagatcttgggtggtatggctgcagttgaacaggcggaaaaaccggctgctcaacctaaaaagcagcagcgtaaaggccgcaagtaa

SEQ ID NO: 152 - DNA, 333 bp, Xenorhabdus bovienii
  Coding DNA location: Contig name=SeqID_16828; Position on contig =1655..1987bp; Strand=-
atggaaactatcgctaaacatcgccacgctcgttcttctgctcagaaggttcgcctcgtggctgacctgatccgcggtaagaaagtgtcgcaagctctggaaactctgctctataccaacaagaaagctgctggtttagtgaagaaagtacttgagtctgctattgctaacgcagaacacaacgatggcgctgacatcgatgatctgaaagtcacgaaaattttcgtagacgaaggcccaaccatgaagcgtattatgcctcgtgccaaaggccgtgcagatcgtatcctgaagcgcaccagccacattactgtggttgtgtccgatcgctga

SEQ ID NO: 153 - DNA, 279 bp, Xenorhabdus bovienii
  Coding DNA location: Contig name=SeqID_16828; Position on contig =2002..2280bp; Strand=-
atgccacgttctctcaagaaaggtccatttattgacctgcacttgctgaagaaggtagagaaagcggtggaaagcggagacaaaaagcctattaagacttggtcccgtcgttcaacgatctttcctaacatgatcggtttgaccatcgctgtccataatggtcgtcagcatgttccagtttttgtttccgacgaaatggttggtcacaaactgggtgaattcgcgccgacccgtacttatcgcggccatgcggccgataaaaaggctaaaaagcgctaa

SEQ ID NO: 154 - DNA, 822 bp, Xenorhabdus bovienii
  Coding DNA location: Contig name=SeqID_16828; Position on contig =2298..3119bp; Strand=-
atggcaattgttaaatgtaaacctacgtctccgggccgtcgccacgttgttaaagtggttaaccctgagctgcataagggcaaaccttatgctccgttgttggaaaaaaacaacaaaactggtggtcgtaacaacaatggtcgcattaccactcgtcacattggtggtggccataaacagcattatcgtctggttgactttaaacgcaacaaagatggtatccctgctgttgttgaacgtctggaatatgatccaaaccgttcagcgaacatcgcactagttctgtataaagacggtgagcgtcgttacatccttgcacctaaaggtctgaaagcaggtgatcaaatccagtctggtgctgattcagcaatcaaggccggtaatgctctgccaatgcgcaatatcccggttggttctactgttcacaacatagaaatgaaaccaggtaaaggtggccagctggctcgttcagcaggtacttacgctcagatcgttgcacgtgacggttcctatgtaaccttgcgtctgcgttctggtgaaatgcgtaaagtgttgtctgactgccgcgctactttaggtgaagttggtaacgcagaacacatgttacgcgttctgggtaaagctggtgcaagccgctggcgtggtatccgtcctaccgttcgtggtacggcgatgaacccagtagaccatccacatggtggtggtgaaggtcgcaactttggtaaacaccctgtaactccatggggcatccagaccaaaggtaagaagacccgtagtaacaaacgtactgatcaatacatcgtacgtcgccgttctaaataa

SEQ ID NO: 155 - DNA, 303 bp, Xenorhabdus bovienii
  Coding DNA location: Contig name=SeqID_16828; Position on contig =3139..3441bp; Strand=-
atgatccgtgaagaacgtctgctgaaaatactgcgcgcgccgcacgtatctgaaaaagcttctacagcgatggaaaaaagcaataccatcgttctcaaagttgcgaaagacgcgactaaagcagagatcaaagctgccgtacagaaactcttcgaagttgaagttgaaggtgtaaacactttgctagttaaaggtaaagttaaacgccacggtcagcgtattggtcgtcgtagcgactggaaaaaagcttacgtcaccctgaaagaaggccagaatttggacttcgtcggcggcgctgagtaa

SEQ ID NO: 156 - DNA, 606 bp, Xenorhabdus bovienii
  Coding DNA location: Contig name=SeqID_16828; Position on contig =3438..4043bp; Strand=-
atggaattggtaatgaaagacgcgcaaagcgcgctgactgtttccgaaactaccttcgggcgtgacttcaatgaagcgcttgtgcatcaagtagttgttgcgtacgcagctggtgctcgtcaaggtactcgtgctcagaaaactcgtgctgaagtttctggttcaggtaaaaaaccatggcgtcagaaaggtactggtcgtgcacgtgcaggttctattaagagtccaatctggcgctctggtggtgtaacttttgcagcgaaaccacaggaccacagtcaaaaagttaataaaaagatgtaccgcggtgctctaaaaagcatcttgtctgaactggtacgtcaagaacgtctgatcgttgtcgagaagttctctgttgaagcacctaaaactaagctgctggtacagaaactgaaagaaatggctctgcaagacgtgctgattgtcactggcgaagttgatgagaacctgttcttagcagctcgtaacctgtataaggttgacgttcgtgatgcagcaggtatcgacccagtaagcctgatcgccttcgacaaagtggttatgactgctgatgctgtaaagcaagttgaggagatgctggcatga

SEQ ID NO: 157 - DNA, 633 bp, Xenorhabdus bovienii
  Coding DNA location: Contig name=SeqID_16828; Position on contig =4060..4692bp; Strand=-
atgattggtttagtcggtaaaaaagtgggcatgactcgcatcttcactgaagatggcgtttctatccctgtaagtgttatcgaaatcgaagataaccgcataactcaggttaaagaccaagagagtgacggttatcgtgcaattcaggtaacgactggtagcaaaaaagctaaccgcgttaataaacctgaagcaggtcatttcgctaaagctggcgttgaagctggccgtaccctgcgtgaattccgtctgtcagcagacgacgaagagtacacagtgggtcaaagcattagcgttgaaattttcgctgacgttaaaaaagtcgacgttactggtacatctaaaggtaaaggtttcgcgggtactgttaaacgctggaacttccgtactcaagatgctacccatggtaactccttgtctcaccgtgttccgggttctatcggtcagaaccagactccgggcaaggtattcaaaggtaagaaaatggcaggccaaatgggtaatgaacgtgtaactgttcagagcctagatgtagtacgtgttgacgctgagcgtaacctgctgctggtcaaaggtgctgttccaggtgcaactggcagtgacctgatcgtaaaaccggctgtcaaggcgtaa

SEQ ID NO: 158 - DNA, 312 bp, Xenorhabdus bovienii
  Coding DNA location: Contig name=SeqID_16828; Position on contig =4725..5036bp; Strand=-
atgcagaaccaaagaatccgtatccgcctgaaagcatttgatcaccgtttaatcgatcaatcaactgcggaaatcgtagagaccgctaagcgcactggtgcgcaagttcgtggtccgatcccgctgccgactcgtaaggagcgttttatcgttctgatttctccgcatgttaacaaagatgcgcgtgatcagtacgagattcgcactcacaaacgtctggttgacatcgttgagccaaccgagaaaaccgttgatgctctgatgcgtctggatctggctgctggtgtagacgtgcagatcagcctgggttaa

SEQ ID NO: 159 - DNA, 162 bp, Xenorhabdus bovienii
  Coding DNA location: Contig name=SeqID_16828; Position on contig =5326..5487bp; Strand=-
ttggcatatgccgattcagcctatgattatgtaagccgagacttgatgattgaggttctttctgacgaagagaatcacatagactggttggaaacccaactggacttgctcaatcgaatgggaatacaaaattatattcaatctcaacttattgaagaataa

SEQ ID NO: 160 - DNA, 216 bp, Xenorhabdus bovienii
  Coding DNA location: Contig name=SeqID_16828; Position on contig =5462..5677bp; Strand=-
gaagttgaatatcgtgaatctattgaggagatgaaacacgctgataagtatattgagcgtatcttgtttctggaaggtttgccaaacctacaggatttgggcaaactcaatatcggtgaggatatagaagaaatgctgcaatctgatctagcactagagatacgcggtgctaaggatctgagagaggcaattggcatatgccgattcagcctatga

SEQ ID NO: 161 - DNA, 186 bp, Xenorhabdus bovienii
  Coding DNA location: Contig name=SeqID_16829; Position on contig =1..186bp; Strand=+
agtcaaagagcggggatgtcgcaggaagcttttgccgataaatgcggattggatcgtacttatatcagcggcattgagcgtggagtcagaaatcctactttagaaattatttatgtcattgctaatggcttacagattgaactgaatgaattgtttaatcttgaaacaagattacctccgaattaa

SEQ ID NO: 162 - DNA, 951 bp, Xenorhabdus bovienii
  Coding DNA location: Contig name=SeqID_16829; Position on contig =569..1519bp; Strand=-
atgctccccaagaaaattatccttgattgcgatcccgggcatgatgatgccattgcgttactgcttgctcatggaaatcctgacattgaactactggcggtgactacggttgttggcaaccaaaccttgaataaagtcacccgcaatgccctttcaattgcccgcatcgccaatattcacaatgttccttttgccgcagggtgtcatagaccattggtcagagatatccaaactgcaccagcaattcatggtgaaaccggtctggatggcgtcgttttgcctgaacctgcattaaggctggatgcccgtcacgctgttgatttgattatcgacatcattatggaaaatccccccaagagcattaccttggttccaacggcaggtttgacaaatattgcccttgccgcccgtaagtctccacatattgttgaacgcgtaaaagaagtcgtgttgatgggaggtggctaccatactggtaactggagcgctgtcgctgaattcaacatcatgatcgatcctgaagcggcacatattatttttaatgaaaaatggcccctgacgatggtggggctggatctgacgcatcaagctcaggcaacgcctgatgtcattgacgctatctccaagatcaaaacccgtcctgcccaattcgttttagatgcgttgcagttttatggggagaggtatcgggaatcgcagggttttgactatcctccggtgcatgatccctgtgcagtcgcttatgtgatcgatcctaccgtgatgacaacacaaaaagtccccgtgaatatcgagttgaccggaaccttaacaacgggcatgaccgtcgctgatttccgtttcccgccaccaaaagattgccatacacaagttgccgtaaaattggatcaagccaaattctggcaattggtgattaatgccctgaaaaatattggcgaaacagcgtcctga

SEQ ID NO: 163 - DNA, 1320 bp, Xenorhabdus bovienii
  Coding DNA location: Contig name=SeqID_16829; Position on contig =1903..3222bp; Strand=+
atgctcacggggtataacatgaataataatcttgattcattaacatactatgctgcaaccaaaaaatatgatcttcgctttcccacactgacagaagacttggatgttgatgttgttatcattggtggcgggttttccggtgtgaatacggcactggagctggctgaaaaaggcatcaccaatattgctattctggaaggtcggacgttgggatatggcggaacggggcgcaatggcggtcaagttatggcgggtattggtcatgatttggataggattaaacgtcatgtcggtgagaaaggtctagagactatttttaaaattagcaacatgggtgcaggaattattcgtgaccggattgctaagtacgatatcaaggcggatttttgtaagggttacggctatctgggttataacgcccggcaggagaaaactttgcggggctggctgaaagagtttcaggcagcgtgtcccgatgaagagattgaactttatgtcggtgctgatgttaaaaaagtcattggttcagatctttatacctgtgcgctgaagcatatgggtgggggacacgttcattcactcaatctgttgctgggggaagctaaggctgcaacggagcagggtgtcagaatttttgaaaacagccaggtggtgaatgtagaatatggcccacgggtcacagttcgcacagcaatggggacggtacgggcaagtaagatactgtgggcgtgcaatgctttcctgaatggtcttgaaccgactatctacaaaaaaacgatcaatacttacgctttccagctaatgacggaagaactgtcagacgatctgattgaaaagatcagcccgattcgtggggcatacagtgatattagtcctgtcatcaactactaccgagttaccaaagagaaccgagtgctgtttggcagtgctacacaatatcttgagtatatcccttctgatttaaaagcatggaaccgcaaacgtatgctggatgtcttcccctacctgaaagatgtgaaaattgaattggcatggggcgggccactatcttgtagcgtcaacttgttcccacaaattggctctttgcccgaacatgacaatgtgttttatgtacagggttattcaggatttggtgtaacgccgagtcacattgtctgcaaaatcttggcagaaggaatgagtgaaggctctgaacgttactcactgatgagttcgattcctcatctcaatgttgtgggcaaagacaaattaaggagcctgctcctttctgtcggcaaaacttggcaccaagcttcaggctattggaaaggccgtcgctag

SEQ ID NO: 164 - DNA, 369 bp, Xenorhabdus bovienii
  Coding DNA location: Contig name=SeqID_16829; Position on contig =3293..3661bp; Strand=+
atgataaagccattattgttagatcaagcacttcctgaattaatgcctattggcagtgtcactcatcttggttctattgtgttggagggggatccccaggcaagtggcgcaatgacccacggagagcctacggataatctgacttgcggtatttttgcctgcaccaggggtaaatttaaaatgatctatccctttgatgaaatggcgacggttcatgaaggctcggtgaaactgaccgatgtcaaaacgggggctacggttgagtaccataagggcgactcttggtttgcggcgaaaggcactgaaatgatgtgggaaatcaccactgaacgctttgttaaacattacatggcttgtgtgaacgcttaa

SEQ ID NO: 165 - DNA, 1494 bp, Xenorhabdus bovienii
  Coding DNA location: Contig name=SeqID_16829; Position on contig =3690..5183bp; Strand=+
atgagtgaaataaccttgctaaagcccgttacggattttctgcaacgtcctcatggtcattatatcaacgggttatccattcctggtcagggaaacaacaccttttctgtcgttaatcctgcttctgatgaagtgatcgctaaagttaatcgaggagaggaagccgaaataaatttggcaatggaagcagcctcgaaggcttttcatggttcatgggcgcagacatcgcctatggagcggggtaagtgcctgaaccggctggccgatttattgcaaaaacacggtgaagaattagcccagctggaaagtttatgttcaggtaaaccgatccagcttgctcgaatgttagacgtgggcgcttctgctgattacctgcgttattttgctggttggtcgagcaaaattagtggtgagacattgaatgtttcattgccatcactcaaaggggaaaaatacacggcctttacccgacgtgaaccaattggcgtggtggttggcattattccgtggaatttttccattatgattgccatctggaaactgggggcggcactggcctgtggttgtactttagtactgaaacccagtgagtatacccctttgactatgcttcgtgtggcagaattggcgaaagaagccgggatacccgatggcgtgatcaatgttgtcaatggttctggcgctagagttgggtcagccctgctcgctcatcccaaatgtgccaaagtcacttttactggctcagtcccgaccggcactattatcggtaagtcggcgatagagtatggcttgactcgtgcgacgctggaattgggaggcaagaatgcggctgctttcctgtctgatatgtcagttgaaaagattgttgagggtgtgttggaagccggttatttgaatcaggggcaaatctgtgcggcagcggaacgtttctatatcccatctgttcacatggatgcggtcttaaaattactttctgaacgtttgtcagcgatgaaaatcggctctcctcttgatgaatcaaccgaaatggggcctttggcaaacaaagagcattacgaaaaaatcctgtccctgtttgaaaaagcgcgtcaggatggcagtgagatcgtatatggtggccatgcgctggaaggcgaaggtttttttgtcgcaccaacgattatccgagccaagagtgctgaagacacattaatgcaagaagaaaccttcgggccgataggaacgttcctcagctatgatgatgaagaagaattaattgtcatgatgaacgcgacgccatttggtctgtctgccagtttatggacgaatgatctcagtaaggcgatgcgtatgatcccccgcattcaagtgggtactttgtggattaatatgcatacatttctggatccagcggtgccttttggtggcgtgaagtcgtcgggcattggccgggagtttggtagtgcatttattgagcattacaccgaactgaaatcggttatggttcgttattaa

SEQ ID NO: 166 - DNA, 267 bp, Xenorhabdus bovienii
  Coding DNA location: Contig name=SeqID_16829; Position on contig =5302..5568bp; Strand=+
atgatcagtgcaaagcggggtttaaaactggctttttggcagagtatcaccggattatgggggagtttgttattcagtctgatggcgtcaatactggtaataaccggggcagggatcgagcaatttaagataagtattctggctgctatgctgttgacacttgtgctgctgctgcatcgcgatgcacgccatttcctcttaattcctgcgggtattgctgtaatgtgcagcttattcgcgggcttgcgctatgcggagtatttttga

SEQ ID NO: 167 - DNA, 2310 bp, Xenorhabdus bovienii
  Coding DNA location: Contig name=SeqID_16830; Position on contig =2..2311bp; Strand=+
attattaaaatacattaccctaaaggtactgttgcgcaatggattctttaccctgaccacaatatagacgacatacttgatgagtacgccgcctgtcgcgttcaaggtgatcctatcaacgatatgaatgttaaaaataccagccaatatttgcgaaacggtgctgagaacggcatccatcctcagatgaatggtattcctgttcgtaattttcgcgtattctatacactcaagtgtgaagagatgattagggaggatttgctctcttcaattgagcaaatctttgataccgctggcatggcccctcgcagaattggggccaccgaacttattcgttggatgagtgagtttttctgtgggaaaaaatttgctggtgaatataacccagaacgaccgttagctaagcagatgatgtctaatgaccctgcttacgagcgttcgtttgacaacggaggacatcatgaagccttacaaaacttttctgtaacgcctaatattcttggtcatcgctatggtacatgtttatttcccaacgttattccacagaaagacaataatccactccgtaccaacgaactgttcggcgggtacaaaggtgttattgatgatcggggccagattaaatatccattcctttacacgctcaccattatctacgatgaactgcaaaccgagattgcaaataaagcatctcaaaccatgtttcagcgagttggtgcagggttagtatttgcgctaaaggaacgtattaatgaattctctgaaatgcaacaaactctcgccaaaggcggggattttgcctatttcatcccgcaactttgggtttttggtaaaactaaaaaggacgttcgagccgccgtttctgaagctaaagatttatggggaaaccataaatttgaattaatgccagaaacaaatatgtccaaagttatgtacctaaccgcactaccttttggtttttataatattgatagcaatctgaaaaacatggatcgttttttttatgctgattatgaaaacatagcgcgtttcttaccggttcagggtgattttaggggcggaggtaagccagtacaaacctatattggaagaaaaggccaaatcattggtctggatatgtttgataaacgagttaactcacataatttctacgtggtggctgaaactggtggtggtaaatcatttttacttaatgacctgcttgattcctacgcatcgtgcggggctaaaatacgaataacagatctcggggcttcttataaaaagttaacccatataagaaaaggtcgatatatagacttcgcgctagataatccaatgtgtatgaatccttcaggttttatagccaaagatgcagaggatcttgaacaaaatattgcggcggcggttctcatttattcatcatgtgcctattcatttaccggtcagactgtaacagaggtggaagcaaacttactcgatcaggcttgccatgctagccatagaaaaggtaatcaagaaagtggtgttgatgatgttatcgcttatttgagaagtggcgaatggaaaaaggggcaagaaatttctcctgttgctgctcaagaaattgaaaatcaggctcaacgattatccttcctgttaaataatttcggaagtaatgggcaatttaaaaaattcttcgtcggaaagtctgaatttagtatttctcaagatgaatttgtttgtgtcgatttggaaaaattaaaaagtcagaaacagttattctttcccatgatcatgcaagtcatgaatgcaatgacacaagatttatatctttctgatcgcagccagaaaagctttattctttttgaagaaattgcctcgatggttaaacagcaaggcaatatctctatggatggcctagcttcaatggttgaagaaggttatcgcagagcgcgtaaatatctcggtgcgtttggtattgttcttcaatcacctctcgatctcttactactaaaagggttaggccaagtggcgcaagctaacgccccgttcaaatattaccttgaatctaaaatgtacgctgaagctgtttcaaaaggcgtcctacctggtattaaaggcggcttccctcttacactccttgaatctgttaaaaacgcccgtccccgctatggtgaagtcttcattgatagtcctctaggaatgggcgtagcgcgcctttgcgtagataaatggcgctattggattaatacctctgacggtgatgacgtggctcaatacaacactcttatccagcgtggattccaacctgtggatgctttacgccagttatccggcgtgaccctgtaa

SEQ ID NO: 168 - DNA, 1989 bp, Xenorhabdus bovienii
  Coding DNA location: Contig name=SeqID_16830; Position on contig =2374..4362bp; Strand=+
gtgcatgcacaaaaacaagaaagtatcagtaaagcctcacaagacaaagttgattcaatagccaatgacattagtgatgtagtcaaaggtaaaaccagttcagcttcaagtatcaacaattccctattgagtccgatgaacggacaagaccagatgacaacctttgatgggaagcagtcatttgatggtaaggccgtctgtaaaggtacgtctgagtttatgaaaatgctggttcaaccaggagctggcggtgatgtaaccattctgaatgttatgcaagataccaatatggacggcaagctagatataacaatggctcctaattggaacgtatcagcggtgtgttccaatgggtttatgacttgtaccgatcccaataacaccactacctgtacctcctggacgtggatagcagacagtaaaagctaccagttagggcgcaagcgagtagccctaactgatctaggcggttgttactgtatcaataataaatgcggtagtaatctagcatggacgaatatgggccaaattctccgtaaccttggcggtggggcatctcaagctctggcagctgtaaatccttggtacaccctttctgatgtcaaagttgacggcgttgtcgcttcattcgttggtggtgacgcgggttcatgcaatgttggtgattccaccggcttctttaacagccccgatggttctcagctcctgacataccagaataacgaaacgaaaatgaaggacgatgcgactaattcaactcaaagttctgatgcgtataaagccatcgtcagtggtagtttaaacccaaatgaaagctctgaaacccgacgttgtgaggtgcgccgtaatgttggtatcgatgagctaactttagatgaaatcatcaagtttgatggtggtgaaggacaggtaactcaatgtggaaccgattgccttcagttggtactcggaaaactaggcgacgactactggcaaggcagctgtagctattatgaggttaagagtaatttcatcttaaaagatccttcccgaatcaaatccgcaaccttaatcaatgctgtatttgatgattggatgcaagtatgggtaggtgacaaagttgcatggaatggcccttatggtaactggctggatgctggccctgttcctggtgcatgtgagttatcgacgagctggaacgttaaccctaatgtggacttcgcggagtacataaaaaaccctggccctctacaattcaaaattcgtgttgaggttagtggcgaaggtgaaggttatgctttattgcgcgttaaaacggatatgagctgtaagttaggagccgaatccatttcgaatacttgtactgcttatgaaaacgactcgacctgtaagctggtagaggaagaaattgacggtattaagtcattcatcggcggcataaataccggtcttaagcctttatcacaaacacacaaggtaaatggcaatttctgtagcattgaagttaagcgggattggttcactaaaaaaagagtctatcgttgcaacacaaagaatgactacgatacatctaaaattattgagcgtaaggggtatatcgaggacaacgttaaaccggatcactataaagacaaaatgttttcagagaatggaaaagtcacattaggagaaggtgatttattctggcctaaattacctacagtcaatgaatgcgtaaatgtctgcaaaacgagaaaagagaaaacgacccctgatatgtcagtctctggtcaagttgataaaaataaagccacaggtcaaaaagtatacaattattattatcacgaatgtggaacggataataaatgtgtaacagactccgatgaagaagtggttaaagcctgccagtgtattaatgagttcgctgaagcggcggctattatgcagacaatgagagaggccggacaagatatgatatgcagttccggtgaggtaaagaaccctaatggaaccccactggaatcaaattga

SEQ ID NO: 169 - DNA, 1623 bp, Xenorhabdus bovienii
  Coding DNA location: Contig name=SeqID_16830; Position on contig =4337..5959bp; Strand=+
atggaaccccactggaatcaaattgaggttaacatgataaaaatattattaatcgtattttctctattattttccagcggttcacttgcagcttcaaatcttatttgtggtattgaccaaaataataatggttacttaggcgatgaaggtgaaacagcgacttgcatcggtaatgatcctggactttgtcctattgggaaaatagcttgtaatgcagtaaacaatgagcaaacaagtgatcctatctacagctgccctgtgggaacaacgttaaagaataatgtatgtatcggtgataatgagcctcactgggaagaatatcacgctttagactttctaatgtgcacaagctgtgcaggtaagaccttatacgacgagatctacataaattgggcaccagattataaatacttggggtgggacaagcctccttattactattacggccctagatattatactggtagatatgaagccggagaactaaatacaggcatggagttttatatatataaaacaaacattaacaacggtacaattgatgataatgacaaaattaaagtccgcattggtaattatagagaaagatccggtaaaaactgtatagggctagattgtcaaggtacatggactattttcgtccaaataggtgatgcaacagctacaagcccatctattacatgcgtggatacttacacatggaatacagtagaaaacaaatgtaaaaaagtaatagtggaccaagtttgtcctataaatggtggcggcgcttgtatacctgatggcagtggttattcatgctcacctaataaatgtgttaataccaatattaatatacctgttgatgaaggtgatattaacggcggcatgctagttaatgatggaaagaaaactgaagacggcatttgtcttgatcaattatatatattttccggtcggggccaacgttgcttaccttctggtatgtcaacgggatacaagaactgctgtgcaaacaaaggcagtgcattacaagataacgccggttccttagcttcaatggctagcagcgtttcaactattagcaaagtgtatgacgtggcagagaaagggtatcaagcctataacgctgccattaccgcaggaaaaacaataagccaggcttcaacgcttgccggttctgctatgcaggggcagatgcttatagcttttgacccaacatccctagctatcagtgtggcgatccattttgcaatgaaatacttcatgcaagcttgcgatcaggaatcaatggaaaccgccatgtttgctagtagtggttactgccactatgtcggtgaatattgtaagaagaaagtccctttgctgggctgtgtgcagaaagctaatgcctattgctgctttaacagcaaactggctcgaatcatccacgaacaaggtagaccgcagctcagcacgattggagatttcggcacagctaaggcacctcaatgccgtggttttacccccgatgaattccaatctattgatttctctaaaatcgatttatcagaatacatagaggatatgactaaaaatacaacagaacagattaaaggtcagattagtgacacaatcaaagacttctacgaaaaaacaaactga

SEQ ID NO: 170 - DNA, 228 bp, Xenorhabdus bovienii
  Coding DNA location: Contig name=SeqID_16830; Position on contig =5984..6211bp; Strand=+
atgaaccttaaagatttttatcatcaaattaaaccagatatgagtattaccaactctcacatcatttctaatgtgatagatgaaatatcagttattaatactaaatttgataccaactccaatgacctaatcaacatggcagaggcccactcatcaacctatagaaacctttcagttgagcaaacacggatggtgaacaccatatttaacacacctttatttctataa

SEQ ID NO: 171 - DNA, 1584 bp, Xenorhabdus bovienii
  Coding DNA location: Contig name=SeqID_16830; Position on contig =6368..7951bp; Strand=+
atgaaaacatcactctcagcatcggcattcttagttgccatgctgctatcttcacatgttgaagcctcacaagatgttgtaggtcaactttataacattagtgaacccgatgctttgaagcagattcaagagcgtgttgctaacgttgattggcaaaaagaactcaacaaagatcgtgaaaagtggggggcattcaaaggtgttccactaccaaccactctggaagataaaacccgtaaaattgtaccgttctattctgcgccttttgaagtgaaaggtgaggatggacgtttactatttccgaaaggctacacttttaacccactggtacatgttcggctcccgcaacgtttaatcgttgtagagaaaggacaagaagactggcttaaatccatagcaacggaatctgacatgatcatttatgcaagtggtgatgttattgaagttagccagcgtatcggtagaaatgctttcatcctcgataagaacttacaacaacgcctagatatcaaagttgttccctccatcattcaacaagaaggagagcatttaatcattcaagagttttctaaacaacatgtggaaaatgctaaaaataaagctctgtttgattttaatggtaaaaaactggcgtggtcagtagtcggttcagtgatggatttcttagttccccccgcacacgcaacctgcaaatcatcatttataaacccaattacagatattagctggagttgcattttcccaatgcggatagctggggtacaggttgttggcggtgaagagaatccctctaataaccaaaaccctgtttgtatctgtaaaggggctgctcttccgatgatcggccttaaaacttccttttgggaacctaagcggataatcgataccgtcagtgacccttattgcatgatgcccctggggacgcaactaagtaaaccagtgcctggcactctcgccggtggctacaacgaaactaatactagtaagcgggtattccaacaagcacattactttattttccccgcatggaaaattttgaatatgttctatgacattccctgcctggatgacgaaggttttgatgttgccatgatgacggagatcttaccgcaatggaacaatgaagcactcagtttgattattaatcctgaagcccttctttttgctaatccagtggcgacaattgcttgctctgccgatgcggtagctggcacttatggcatgccccttaacgccttgttctggtgtatgggaagttgggggaacgtctatcctctgtctggttcaatcacaagtaccgactttgttgaagctaatgctggtatagcggctcgatcaattttcactatgggccggttaggtttgttgtggaatacatcagatgatggctgttatcgcgaactggctcctatctggaaaaaagaccgcttcaagttgcagcttatgaggccaacccgcgctagtgcatgcatccctatagggcgtgagggtttgttatggactggcggcaagcatgacccacttaaagacaactttatgtggatgatgtttgaaaagaaagattgctgcatcagggcttactaa

SEQ ID NO: 172 - DNA, 720 bp, Xenorhabdus bovienii
  Coding DNA location: Contig name=SeqID_16830; Position on contig =7951..8670bp; Strand=+
atgaaaaaactatttatcactatatcgttagcgctaacgacaaattttgtgcatgcacaagaagttgctatctcacctgagatgatgaaagcggcacaatccgcagttgatcatcgggttagcaataaagaaatgaacagttttgccgaaaacatagttggctattccaaatcatcagaatttaagcaacaacagaaagacctacaacagcaggttttcaagacagctggtttagatcccgataaacagcagcaagatgaacgtcctgaactggttaaagaccaactggttctttttgtatcaagcagtatgcctatccataccctacgaaactatgcgcgggatttgtctaaagtaggaggtgtaatggtattacggggcgcggttggggggattagtcgtattgccgacaccatgaagctgagccgcgagatcctagctgttaaccagacctgcgatacaacatcatgcaaaatgtggtcaacccagattctaattgaccccgttctatttaagcaatatgacattaaagttgttcccgcgttgatcttccagccagatatgaacattaatagctattgtgatggtttggaattaatgaaaaagtctgaaaccgttatttatggtgatgcctctattgcaaaaatgcttgaagccatgaaccgaattactccaaataaaaagtacgagtcacttatcaaagtaattagggggctataa

SEQ ID NO: 173 - DNA, 432 bp, Xenorhabdus bovienii
  Coding DNA location: Contig name=SeqID_16830; Position on contig =8703..9134bp; Strand=+
atgattattatttcaatcatgtttattatttactctgcattccaatatataaatatcccactaaccagtagtgtgttaccccatgtgttgattaaaacaggtgatcgcccaacgcaaacggacgactacgttatttttactttggaacatccttatttacctcacgctaaagaccaacttaccaagcggattggttgtatagaaagacaaaaacttgagcgaattaatcagcatttctattgcgacagtaagcttattgtcattgctttagaacatgatattcagggggcttctcttcccgttttctctttcactggcactataccagccggaaaagcttttttagttggtgatactcctaatagtttcgatagtcgctattggggattttttgatattcaaaagacagaaaaactcatccctattatctga

SEQ ID NO: 174 - DNA, 399 bp, Xenorhabdus bovienii
  Coding DNA location: Contig name=SeqID_16830; Position on contig =9166..9564bp; Strand=+
atgaaattcatcgataaatctattgctaaaacattgttagtcatagcctgtttttcttttgttttagcaatcactggatgcgcaacggtttttactgagaaatctgttgctgtcaccatccacagcaatcctgaaggtgcaaacgttttcagaaatggtgagatgttggggcaaacaccactgacggttgagactaccccacgaagctctgtcttttccatcactaaagagggatacgaaggcgaagtgctaatgcttgaaactggcgtcaaccgcacaacgcatggtaacgccgcagtattcccactgttccctattactgacgcagttgattcagtcaccggtaactatcagaaaatcgaacagaccactgcaacagtcactttaaagaaaaagtaa

SEQ ID NO: 175 - DNA, 588 bp, Xenorhabdus bovienii
  Coding DNA location: Contig name=SeqID_16830; Position on contig =9574..10161bp; Strand=+
atgattaactcacttatcacttcagttttcagtctatttgttagctttggctctgtatctgcgcatgcctctttgcctaatcagctttcattatcggagtcgcttattaaaacgccgaaacgtgaccttttttggtatgacttaccgacgaaaacagaaaaaaaatctgatgaaaaatatccgcgcccagctattccctctgctgaagcactatttcaaatgcatcctaaagaactgaaagcattactggatgacaccttagattacgccgttttcaaactgtctcctgaagccacaatggactattacaaagtcctcgatgttgctcgtcgaaaatcatctgcttttaccaaccttaccggtttcgtgatgctggataagccagaattgaacgccgcccaagattacccaattaccaatcctggtaacgcagagaaaaaacgccgtactgacaatgatgtgacaaaaaattgcaagcggcccgtgatgaatacgctttgttattcttcacacaacctgcatgtggtttctgtgtccagcagtctcaaatacttgagaacttccaacgggaatcgggctggattataa

SEQ ID NO: 176 - DNA, 1389 bp, Xenorhabdus bovienii
  Coding DNA location: Contig name=SeqID_16830; Position on contig =10428..11816bp; Strand=+
atgataaatcttaagaaaatagtaatccttaccctgaccagcctatatatcacagctgcaaatgctgataattgggctgataaatggtttgataatgcggtctatgacacacccagctcatttgagtcacagaaacgcggctattacactatggggggattctcagcccgtaataactcatcaactgattatcctataacaatctccccgcccaaacttagcgttggttgcggtggtattgatgcatttttgggggggttctcattcctcgatcctgattatctggtagagaaagcacaacgtgctatgcaagcagctccgtatgttgcctttgatatggctcttaagacaatgtgtaaagagtgtgcggacacgctaggtaagattgagcagatcactaatttcctaaacggtattcagatgaatgaatgtgctctggcaaaacctattgcgaccgctgcaatcactcaggatgccgaagccttaaaaggtctttggactgagatgaccggcacgaaaagtttagatgaagctagtgatagactttggactgaatcgacatcaaaaattaaggctaatgataataagccaactcaagacctgaagagcatgattgaaggctgtccggttgagttcaaagatctaatgcaacatggctctatcgtcgaacgggccgcgcagaaagtgggccttggcaactacgccgacactattcgtgggtatctcggtgacgtctggattgagtctaaaaccgccgaccgtattccggtagcagtctcgataccaagttgtccccaaaatcagaagtacagcctcgatgatatgttaacaggacgctcttttgtcaaaacgattaataagcaatgcgttccttccagcagtaaaccagtaagagatattgtttatgcgaaaatgcaaaaagttctgaataaaatgaaagcagggcaagagctggggacggatgagattaaatttattaactcaaccaatattcctgtttattcaattcttaaacaagcaattaccagtaaacaagatgatgtagtgttaaatgtcttggctgaattagttggtctgaattattcgtattatattttctctgatttatatcggaatacccaaagtgcattcgatgctgttaacgaaatgatgtcatcacctttatctgatccgaataatgcgaagaagccttgccgtatggatttgttcgcgccggcactgacaaagtttggtgatcttattcaacaggcccgagatagtagcgtcaaagttgaagccacctataacagccggttgcaaagctacatgctgaattcaggctttatcgaaacattccgtgagcaagaaatgcgagatcagcggcaacgcgctggggagttagcaaaatga

SEQ ID NO: 177 - DNA, 1078 bp, Xenorhabdus bovienii
  Coding DNA location: Contig name=SeqID_16830; Position on contig =11813..12890bp; Strand=+
atgaagccttctcttttgctactcttaatccttattccaagtgttagttttgcatctttggatatggaatacgtggtacaaggcggtttttctactgtagttaatgcctttacacgtattaaattcatgtttaatgaccgtcaatattcatcattgatggctgcaatggtggtgtttgggatcgtttctggccttatgtaccgtgctgcaaaaggtggtgtagaactgctagaaaccggcaaggccagtatggggttaggttggttggcttacaccctgattggtacaatgatatggtttggtttgatggtgccgaaaggcaccatccatatttatgatcagactcgtaaccagtaccaaccagtaagcggtatccccgattttattactttcgtcgcaggtgggactaacctgatttatcaggcttttactgacatggcgaataccaataccgctactaccacccgcttcagtggggaaggaatgccaatcaaggtgctaatggcgcttatgacgcgcaacggcgcatcatttgatccctatatcagcaaatcaataaccgaaatgtggaagcaatgttcaccaattgctgaaaccagagggtttgatgctaataacctaaagaccggtagcaccacgtttaatatcgtttcgactttaagtgctctgcgtaatcctgctgtctttactacctggtactcagctgctaaccctggtggttcaacagtaagttgcaccactgcctacagtaaccttcagagcgctatgggttcccctactgcctacgactcacgtttaaaagatatctgctctaaattgggctacaactctgcaaatgcggcttcatacgtcgattgtaagggccggatggaggacacgttacaaacagtatacggaagtacaaccgttactcttaacgctgcaatcgggggcattatggtatctcaagcaatcagtgatgccttagtacaacaaaaccctgaagttgccggaacaatgcttgctaatcgctcaatggttaattcggctttatcggatgcttcaacaaatccagaatggctaacaactataatggcgg

SEQ ID NO: 178 - DNA, 2574 bp, Xenorhabdus bovienii
  Coding DNA location: Contig name=SeqID_16831; Position on contig =29..2602bp; Strand=-
atgcgtctggatcgtcttactaataaattccagcttgctctcgctgaggcccaatcccttgcattagggcgtgataatcaattcatcgaaccgacccacttgatgagcgcattgcttaatcaagaggggggctctgttcgtcccttactgacatcggcaggggttgatacgagtagcattaacaatcaacttaaccaagccttggatcgattaccgaaagtagagggtaatggtggtgatgtacaggtatccaatgagttgggacgttatttaaacctgtgtgacaaacttgcgcaaaaagcaggtgacaattttatttcttctgaactctttattttggcggcaatagaagaacgtggaacattaagtgacatacttaaagctgtgggaacaaccaaagataaaatcgctaaggcaatagaacagatgcgtggtggtgagaaagtgagtgatcaaggcgctgaagatcagcgtcaggcactaaaaaaatacacaatcgatctaactgaacgcgccgaacagggcaaattagatcccgtgattgggcgcgatgaagaaattcgccggacaattcaggtattacagcgtagaactaaaaataaccctgttcttattggtgaaccgggtgttgggaaaaccgccatagttgaaggtctggcgcagcgtattattaatggtgaagtcccggaggggctgaaaaacaaacgcgttctgtcccttgatatgggagcgctagtggcgggtgcgaaataccgtggtgaatttgaagaacgtttgaaaggtgttttgagcgatctcgccaagcaggaaggctcagtcattctgttcattgatgaattgcatacggtggtaggagcaggtaaggctgatggcgcaatggatgccggtaatatgcttaaacccgccctggctcgcggtgaactacactgtgttggtgcgacgacacaggatgaatatcgtcaatacattgaaaaagatgctgctttggaacgtcgtttccagaaggtgtatgttgcggagccaaccgttgaagataccattgctatcctgcgtgggcttaaagaacgctatgaattgcatcaccatgtacaaattactgatccagcaatcgttgctgctgcgacattgtcccatcgctatatttcagatcgtatgttgccagacaaagccatcgatctgattgatgaagcaggagcaagtttgcgtatgcaaatggattctaaaccagaagcactggatcgtttggagcgtcgggttattcagttaaagctggagcagcaggcactgaaaaaagaatcggacgatggcagtaaaaaacgactcgaaatgttgaatatggagctggtggagaaagaacgcgaatattctgagctggaagaagagtggaaagccgaaaaagcagagctgactggcactcagaacattaaagcagaattagagaatatgcgccttgaattagaaaaagcccgtcgtagtggtgatctagcgaagatgtctgaaatccagtacggaaaaattccagaattggaaaaacgtttggcaacggcaacaacggtagaaagccatcatatgaaactgctgcgtaacaaagtgaccgatgccgaaattgccgaaattcttgctcgctggacgggaattcctgtatccagaatgttggagagtgaaaaagataaacttctgcgcatggagcatgaattacataaacgtgtcatcgggcaaaatgaggctgttgatgccgtatctaatgcaattcgtcgtagccgtgcgggattatccgatccaaatcgtccgattggttcttttatgtttttggggccgacgggagtaggtaaaaccgaattgggtaaagcgttggccaatttcctattcgacagtgatgatgcgatggtgcgcctagacatgtcggaatttatggaaaaacatactgtttcaagactggtgggggctcctcctggatatgttggatatgaagagggggggtatctgacagaagcggtgcgtcgccgcccttattcagtgattttactggatgaggtagaaaaagctcatcctgatgtcttcaacattctgttacaggtattggatgatggtcgcctgacggatggacaggggaaaacggttgattttcgcaatactgttataattatgacctctaacctaggttcagatatgattcaggaacgttttggcgcactggattatgcgggaatgaaagatatagtgatggaagtagttggtcatcatttcaggcctgaatttattaaccgtgttgatgaagtagtcgtgttccacccattaggaaaagaacatctgacatccattgcgaatatccaattacaacgtttatactatcgtttggaagagcgtggctatcaggtcacgatgacatcgacggcattggagaaattgagtgacgctggttttgatcctgtatatggtgctcggccattaaaacgagccatccagcaagagatcgaaaaccctttggcccagcagatcctttcaggcaaactgattcccggaaaattggttactttagatctggaaaacgaccacatagttgcaaaacaatga

SEQ ID NO: 179 - DNA, 732 bp, Xenorhabdus bovienii
  Coding DNA location: Contig name=SeqID_16831; Position on contig =2732..3463bp; Strand=-
atgaccccgctgatttttcctgattggccacagcttgataatgttggcgcttgcagtacaacccgcttgggtggagtaagcctaccgccttatgacagtttgaatctgggtaaccatgttggtgatgattcggaatgtgtggagcggaacaggaaactgctggttgaatatgctcagttgccacaacaacctgtctggttggagcagatacacggaactcgtgtcatcaatctggatggccagccagcgaaagataatcaggctgatgctgtttacacgaatatgcccgggcaggtttgtgctgtcatgacagctgattgcctgcctgttcttttctgcgccattgcgggagatgaaattgcagcggcgcatgcgggatggcgtgggttatgtacaggggttctagaaaataccgtgtctcgatttagcacaaaacctgaaatgatccgcgcatggttagggccagccattggccctgaaaaatttgaggtgggtcgtgaagttatggacgcgtttgttgtaaccaatcctgagctagaacaagcctttacgccttatggtaataaatttttggcaaatatctatttactggctaaattaaagttgcagtctattggtataaatgaagtatttggagggactgcttgtactgccactgaggaaagaaattttttctcctatcgccgtgatggtaacactggacgtatggcaactttaatctggctgagataa

SEQ ID NO: 180 - DNA, 978 bp, Xenorhabdus bovienii
  Coding DNA location: Contig name=SeqID_16831; Position on contig =3468..4445bp; Strand=-
atggcacaacaaatacgacttaatgcaacagtcgctgaaacacagctcggtcaacgtttagatcaggctttggctgaattgttctctgattattcaagatcccgtataaaagaatggattttggataataaagttcaggttaatggtaaattgatcaataagccaaaagaaaaagtactgggcggtgaagaaatttccattgatgccatcattgaagaagatgcgcgttgggagccacaagatatcgagttgaatattgtctatgaagataatgatattctagtgattaacaaaccgcgtgatttggttgtacatcctggagcaggtaaccctgatggtacagtactgaatgctttgttataccgctatcctgcaattgcagatgtccctcgcgctggtattgtacaccgtctcgataaaaacacgaccgggctgatggttatcgcaaaaaccgttccagcacaaacccgtctggtggaatccctgcaattgcgtgaaattacccgtgaatatgaagcgatcgccttgggatgcatgacagctgggggaatggtagaagaacctatatcccgccatccgacaaaacggacacacatggcagtgcatcctatggggaaatcggcagttacccattatcgggttatggaacatttccgggcacatactcgtctgcgcctgcgactggaaactggcaggacacatcagatccgtgtccatatggcacatatcaagcaccctctggttggtgatcctttatacggtggccgtcctcgtccgttaaaaggcgcttcagacgaatttcgtgaagtgatgcgcaactttgatcgtcaggcattacatgccaccatgctacgactttaccatcctatttctggtattgagatggaatggcatgcagaattaccggatgatatggttaaactggttgatgtgatgaaagcggatattgaaactttcaaagatgagatggactggtag

SEQ ID NO: 181 - DNA, 735 bp, Xenorhabdus bovienii
  Coding DNA location: Contig name=SeqID_16831; Position on contig =4581..5315bp; Strand=+
gtgatgattcgcatgaaatatctggtggcagcagccacattgagtatggttttatctggatgctccaacaataaggatgctgttcctgatatcccgcaatctcaaatttactcagccgggcaaaaacacctgcaagaaggtaactataaaggggctatcaaacaattggaatcccttgataaccgttatccttttggaccgtactcccaacagactcagcttgatttgatctatgcctattacaaatcagcagaattcccaatggctctcgcatccattgaccgtttcatgcgtctgaacccaacccatccgaatatcgactatgtaatatatttgcgtgctctgatatcccaagccttggatgacagtaccctgcaaagctttttcggcatagatcgttcagatcgagatcctgaacatgcccgtgcctcattccgtgatttcaacctgctagtcagccgctatcctaacagtcagtatacatccgatgctgccaagcgtttagtcttcctcaaagaacgtttggccaaatatgaacttgcggttgtgaaatattacactaaacgcagcgcttatgtggccgttgtcagtcgagttgaacaaatgttacgggattatcctgatactcaagcgactcgagaagcacttccttacatggaagcttcctataagaaattgggtctgatggctgaagcagataaagtggcaaaattaattgcggccaacccagtataa

SEQ ID NO: 182 - DNA, 333 bp, Xenorhabdus bovienii
  Coding DNA location: Contig name=SeqID_16831; Position on contig =5682..6014bp; Strand=+
atgttagtgaacatcaccagcaaacaaatggaaattacccccgcaattcgtagccatgtagaagaccgtctaaacaagttgaacaaatggcaagtcaacctaattaatccacatatcgtactcacaaaagaaccacaggggttcttggttgatgccacaataggtataccaaacaacacattagttgctagtgcaaaacatgaggatatgtacgctgccatcaacgaactactgacaaaattagagcgtcaactcaataaagtgcagcataagggagaagcacgccgtgcagatcacagtgttaaagactccaactttgacgtagaagtttaa

SEQ ID NO: 183 - DNA, 1155 bp, Xenorhabdus bovienii
  Coding DNA location: Contig name=SeqID_16831; Position on contig =6320..7474bp; Strand=+
atggaacgaaaattagttaatatacgagaagaaatcagcagtattgatgcaaatttgctggatctgcttgggaaacgccgacaattagcctgtgatattgcgcagactaaacttctcgaacatcgccctgtccgagataaagaccgtgagcgggaactacttaatgtgttaattaataaaggcaaaactcatggtctagatggattctatattactcgcctgtttcagatgatcattgaagattcagtattaacccagcaagcgttgcttcaacagcatctgaaccagacaccttacgactctgcacgtattacttttctagggccaaaaggttcctattcccatattgcagcccgtcaattttcggcgcgccatttcaatcagttagttgaatgcagttgtcataaattcccagatattttttcgctggttgagattggtcaagcagattatggcatcctgcctctcgaaaataccagctctggagcaataaatgatgtttatgatttattgcaacagacgccactattccttgttggggagataaccctgccaataaatcactgtttattgattggtaccgagactgatacgtcaaaaataaaaacagtttatagccattctcaacctttccagcaatgcaaccaatacctcaatcaatttcctcattggaagattgtctattgcgaaagtactgctgctgccatgcagaaagtagcagagctcaactcgtcagaagtggcagcgttaggtagtgaagcagggggggcactctatggattacgggttttggaaaacaatttggcaaatcagcaaaataatagtactcgctttattgttgttgccaaaaaacccattgatgtgtcaaatcaggttcctgccaaaaccacgtttatcatgtcaacagggcagcaggctggtgctctggtcgatacgcttattatcttgaaaaaacacgatattataatgagtaagttggaatcacgtcccataaacggcaaaccgtgggaagaaatgttttatattgatgtagaagccaatcttcgctccatgaaaatgcaacaggcacttaaagaattgtcagaaatcacccggtttttgaaagttttgggatgttatccctcagaaaatgtgatttctatcgacccctgctaa

SEQ ID NO: 184 - DNA, 1122 bp, Xenorhabdus bovienii
  Coding DNA location: Contig name=SeqID_16831; Position on contig =7532..8653bp; Strand=-
atggcagcaaaattatcacaattgcgggaacaaattgatggtgtagataaagcattattggtgttactggcgaagcgaatgtatttagtggcagaagttggagaaattaagagccaactgggtttgccaatttacgtaccagaaagggaagcgtccatgctggcttcccgccgccaagaagcggaagtgatgggaattcctccagacctaattgaagatattttgcggcgcattatgagagagtcctacgtaagtgagaacgataaaggattcaaaaaactcagtacccatctaatgccaatagttattattggtggctcagggaaaatggggaaactgtttagtcgcttgttaactttatctggctacgaagttcgggttcttgagtcgggagattgggataaggccgaacatatactggcagatgcaggaatggtaattgtcagtgtgccgattcatcagacagaagaggttatccgccgtttacctcctttgccggaacagtgtgttttggttgatttggcctctattaaacaaaggccgttaaaggcgatgcttgatgtgcatcaagggccggttttagggttgcatcctatgtttggacccgatgtgggcagttttgccaaacaggttgtcgtgtattgtgatgggcgtcagcccgaagcataccaatggtttttggaacaaatatcagtatggggtgcgcgattacatcaaattagcgcagagcagcacgacaaaaatatgagcttcattcaagcgctgcgtcattttactactttttcttatggtcggcatcttgcaaaagaggatatcgatttacagcaactgatatcactatcctcaccaatctatcgattggaattggctatggttggtcgattatttgcccaagaccctcagttatatgctgatatcattatgtccagtcctgaaaatattgagctgatccgccgttatcaccagagttttggacaggcgattgaaatactggagagtcaggataagtcggcttttattgcgagttttaaccaagtgaatgaatggtttggtgatgaagccactcgatttatgaaagagagtcagtctcttttgcagcaggctagtgatagccggatatag

SEQ ID NO: 185 - DNA, 1095 bp, Xenorhabdus bovienii
  Coding DNA location: Contig name=SeqID_16831; Position on contig =8660..9754bp; Strand=-
atgatcatgcaaaaagatgcacttaataacgttcatattcttggtgaacagatttttatcacacctgaggagctgaaacagaaatacccattgagtcgcaacgatctgcatgccatcacaaatgcccgtaataccatcgctgatattattcagcaccgtgatcctcgtttgttagtggtgtgtggcccctgctcaattcatgatgtggactctgccctcgattatgcccgtcgcctgaaagtactttctactgaattaagtgattgcctgtatattgttatgcgtgtctattttgaaaaaccccgtacgacggttggttggaaaggcttaatcagtgatccccatatggatggttcgtttgatatagatgctgggctgcatattgcccgcggtttattaatgaatttagttaaaatgggattgccactggccaatgaagcactagatcttaataatcctcaatacttgggagacctattcagttggtcagcaatcggggcgagaacgacagaatcacaaactcaccgcgaaatggcatcggggttgtctgtctccgttggattcaaaaatgggactgatggtaatttgaatactgcaattaacgccatgaaagcggctgccatgccacattgcttcatgggaataaatcagtcagggcaagtctgtctgctacaaacccaaggtaacccaaatgggcatgttatcctgcgtggtggtggcgaaccgaattatagttctgagcatgttgctgactgcgaaagccaaatgatcaaggcaggtttaacgccatcgttaatgattgattgcagtcatggtaattccaataaagattttcgtcgccagagcatcgtagtggattccgttgctgaacagattatgtctggaaatcgatctatcattggtattatgttggaaagcaacattcacgaaggaaatcagccctcagaacagcctcgttctgagatgcaatatggtgtttcagtgactgacgcctgtattaactggcaaaccacggagcaaatattaagaaaattacaccaacaaattgccccacgttttgcaaaacgtaacatgatgatggaaaaagcaggataa

SEQ ID NO: 186 - DNA, 252 bp, Xenorhabdus bovienii
  Coding DNA location: Contig name=SeqID_16831; Position on contig =10259..10510bp; Strand=+
ttgatagacgcgcgttatgctgacatagaattgggactgatcaatgatattaggctttttatactggcatatgtttttgggcttaaactaggtaagctgcctgtagatgtgatgctcaacattcttgtggtaatcggttgtgcatctacttggcaaactgcagatggattatcgatgttccgctcccaaagccaccacttttttattaacgctatttattcttgtctccactttatttttggctctggttaa

SEQ ID NO: 187 - DNA, 354 bp, Xenorhabdus bovienii
  Coding DNA location: Contig name=SeqID_16831; Position on contig =10863..11216bp; Strand=-
atgagcaacattattaaacaaattgaacaagagcagatgaagcaagacgtaccttcattccgtccgggtgacaccgtagaagttaaggtatgggtcgttgaaggttctaaaaagcgtctgcagacattcgagggcgtggttattgcaattcgtaaccgcggtctgcattctgcattcactgttcgtaagatttctaatggcgaaggagttgagcgtgtattccagactcactctcctgttgtagacagcatcagtgttaaacgtcgtggtgccgttcgtaaagctaaactgtattacctgcgtgagcgttctggtaaggcggctcgtattaaagagcgtcttaacgctagataa

SEQ ID NO: 188 - DNA, 753 bp, Xenorhabdus bovienii
  Coding DNA location: Contig name=SeqID_16831; Position on contig =11281..12033bp; Strand=-
atgtggattggggttattagcctgtttcctgaaatgttccgcgcaataaccgattacggggtaactggtcgggctgtaaaaaatggcctgctgagtattgaatgctggagtcctagggattttacctacgacaggcatcgtaccgttgatgatcgtccttatggcggtggtccaggcatgctaatgatggtgcaaccattacgggaagctatctatgcagctaaagcagaggcaggcgttgatgcaaaggtgatttatctttcaccacaggggcgcaaactcgatcaacagggagtttgtgagctggcagcacatgaggaattgattcttgtttgtggccgttatgaaggtattgatgagcgtgtcatccaaaccgaaattgacgaagaatggtctatcggggactacgttctcagcgggggagaacttcctgcaatgacgatgattgactctatatctcggtttattccgggagtattggggcgtcaggcatcggcagaagaagactcgtttgctgatggcttattggattgtccacattatacccgccctgaggtgttggatgggatggaagttccccctgttttattatcgggaaaccatgccgaaattaatcgctggcgaatgaaacaatcgcttggccgaacttggttaagaaggcccgaacttctagaaagcctagctctgactgacgagcagaggatgttgctgtctgaattccaacaggaatatcaggatcaagcaacgaattaa

SEQ ID NO: 189 - DNA, 549 bp, Xenorhabdus bovienii
  Coding DNA location: Contig name=SeqID_16831; Position on contig =12071..12619bp; Strand=-
atgagcaagcaaactggcctggagccacctgttgatccaatagtattggggaaattgggctccgcatatggcattcgtggttggctcagagtgttttcttccaccgagcgtaccgaagacatttttgaatatcaaccgtggtttattcaacgttcaggccagtggcaacacgttgagctggaaacgtggaaataccacaatcaggatttgatcatcaaaatcaaagagattgatgatcgggatgctgcgaatttattcaccaactgtgaagtggtggtggattctacccaattaccagagctggaaaccgatgattattactggagagaccttatgggctgtcaggtaataaatattgcaggttataaccttgggactatcaacgacatgatggaaacaggttctaacgatgtgatggtagtaaaagcaaacctgaaagatgcattcggtatcaaggaacggttagttccgtttcttgatgggcaggttatcaagaaagtcgatctcgctactaaaactattgaagtagattgggatcctagtttttaa

SEQ ID NO: 190 - DNA, 258 bp, Xenorhabdus bovienii
  Coding DNA location: Contig name=SeqID_16831; Position on contig =12638..12895bp; Strand=-
atggtaacaattcgtttagctcgtggcggcgcaaaaaagcgtccgttttatcaagtagtcgtgactgatagccgtaatgcgcgtgatggtcgtttcattgagcgcgttggtttcttcaaccctatcgcatcagggaaagcagaagctctgcgtttagatctggaccgtatcgaacattgggttggtttgggtgcatctgtgtctgatcgtgtttctgcactgatcaaagatgctaaaaaatcagctgaagcagcttaa

SEQ ID NO: 191 - DNA, 501 bp, Xenorhabdus bovienii
  Coding DNA location: Contig name=SeqID_16831; Position on contig =13034..13534bp; Strand=-
gatcgcattgcatcccgtattctgggtatgggagatgtgctttcattgattgaggaaattgaaagcaaagttgaccgaacccaagcagagaaacttgcatcaaaactgaaaaaaggcgatggttttgatttaaatgacttccttgatcagctcaagcaaatgcgcaatatgggtggtatgaccagtatgttgagtaaaatgccgggcatgtcgcagatccctgatgccgtcaaatcccaaatggatgacaaggttctggtgaaaatggaagccattatcaattcaatgacccgtaaagagcgtgagaaaccggagattatcaaaggctcccgcaaacgtcggattgcgtcagggtctggtactcaggtgcaggatgttaaccgtttgctgaaacagtttgatgaaatgcaacgtatgatgaaaaagatgaagaaaggtggtctagccaaaatgatgaaaggcatgaaaggcatgctgccacctggctttatggggcaataa

SEQ ID NO: 192 - DNA, 478 bp, Xenorhabdus bovienii
  Coding DNA location: Contig name=SeqID_16832; Position on contig =2..479bp; Strand=-
atgtggggaaaattaacactggatgcaatcccactacatgaacccattattgtagtgactctgattgcaatccttctcgggggactggcggttgtcggtaccttaacttatttccgtaaatggaaatggctctggagcgaatggttaaccagcgttgaccataaaaaaatcggtatcatgtatatcgtcgttgccatggtcatgatggttcgcggtttcgctgacgccatcatgatgcgtggacagcaagctctggcttccgcaggtgaagccggcttcctgcccccgcaccattatgatcaagtctttaccgcccacggcgttatcatgatcttcttcatggcaatgccgttcgttgtcggtctgatgaacatcgtagttcccctgcaaatcggggcgcgtgacgttgctttcccattcctgaactcactgagcttctggttatttgttgtcggtgtcgtactgatcaacctctccc

SEQ ID NO: 193 - DNA, 966 bp, Xenorhabdus bovienii
  Coding DNA location: Contig name=SeqID_16832; Position on contig =484..1449bp; Strand=-
atgagacttatgaaatacaaaaaaactattgggttgtcgtcattactcgcagccactttaatactaagtggttgtgatatggtattgatgaatcccaaaggggcgatcggcgttgagcaaaaaacgctgatactgacagcgtttggcctgatgctgatcgttgttattccggctatcgtaatggcaatcatttttgctctacgttaccgggaagccaataaatccgctacttaccgtccaaactgggcacactcaaataaaattgagcttgtcgtttggactgtgcctattctgattatcatcgtcttggcaaccattacatggaaaacgactcaggaactcgatccatataagccattggactatgaagaaaaaccggtaacgattgaagttatttcccttgactggaaatggctatttatctacccagaacaaggcattgcgacagtaaacgaaattgcattccctaccaatgttcccgtgaacttcaaaatcacgtcagactctgtgatgaactcctttttcatcccacagttaggcggtcagatttatgcgatggcaggcatgcagacaaaactgcacttgattgctaatacaccggatacatataaagggttctcagcaagctatagcggcgaaggcttctctggcatgaaatttactgcaacagcgacacctgatcgtgaaagttttgaacagtgggtgcagaaagttaaggcatcacctaaaaccctggatactgtgcaggcgtttaatgacttagctgaaaaaagccaaaataaccctgttgaatacttctcaagagtgaaaccaaagctgttccaagaaacgatcaccaaattcatgggtgacatgaaacatggtggtatgtttggtacagcaagtcacggcaaaacagaacatggtgaagctgcggatcataatatgaatatgagtcagccggctcatgcaggtgttgaggaataa

SEQ ID NO: 194 - DNA, 768 bp, Xenorhabdus bovienii
  Coding DNA location: Contig name=SeqID_16832; Position on contig =1800..2567bp; Strand=-
atgaaaagacatattttgacactcaccgcagttgctactgccttggtttctgcatcagccagcgcggaatatcagtggggttttgccaatgtcagcatgaactaccttgactggaccaaacacaccactcaaaaaacagggcagacctcacataaagatgactttgcttatttggaactagaaggtggagctgggttcagttggggcgagctatatggtttccttgatttagaaaatccatttaacagcaaaactgcacaacccggtgataaccagcgctacaccttcaaaaccacaggtcgtttctatctcggtgatacgggtttcaacctttatggtcatgtttatggcacctattcactaccaggtaaagccaacggtggcaatttccatgaagtaaatactctctatggattgggctataacaccacgcttgctggtgtttggttcaaaccttttgtcgcacttcactatgttgaccaaactttctactcaggtaataacggttatgtcataggctgggttgcagggtacgatttccaactctggcaagaaaaattcagtattacgaactggaatgaaattgagttgaaccgtaatcagcgctacggcaatggtggccgagagggtatcaatggtgctgtcggattatggtggactccacatccttcctttactactgggattcaatatcgctatgcggataacaaattaggcgaagatttcttgcaggatggtattgtttatagtgtaaaatataacttctaa

SEQ ID NO: 195 - DNA, 1503 bp, Xenorhabdus bovienii
  Coding DNA location: Contig name=SeqID_16832; Position on contig =2833..4335bp; Strand=-
atgactaatcattatctcaataagctgtccagattacgcaattattacatccttcttttactaggttttgcctctggtctacccctagcactcacgggaggaacattacaggcatggatgacagttgaaaatctggatatcaaaaccatcggttttttcactttggttggtcaagcctatgtctttaaattcctctgggctccggcaatggacagatattcgccctcatttttagggcggcggcggggatggatgctggtgactcagctcctgcttatcgtcagtattgccacaatggctttcctcaagccatctgaacatttatggtggctcgcagcattagccgtctctgtcgcatttttttccgcttcccaagatattatctttgatgcctataaaaccgacttactttcacaggaagaacgcggttcaggtgctgcaatttccgttctaggatatcggatagccatgttggtttccggtggtttggcgttgtggctgaccacttatattggctggcagaatatgtatttgataatggcaggcatgatgctcattggtgtttatgccacactcaatgccaaagaaccaaagattaatacagcgccaccaaaaacattacatcaggcagtattcgaacccttatctgatttctttagccgaaacaatgcctggattattctgctattaattgtactgtataagcttgctgatgcgtttgcgctctctctcagtacaacgttccttatacgtggtgttggctttactgctgctgaagtcggtatgatcaataaaacactcggcttggctgctaccattgtaggtgctctatatggcggctatttgatgcataaatggagcctgtttcgcgccctgatgatatttggcattctccagaccgtttcaaatttgggttattggatacttgccgtcactcccaaagacatctacgtgatggggggcgctgtttttctggaaaatatctgtggtggcatgggaacagcagcgtttgtcgccctgttaatgaccttatgcaataaatcattttcagcgacacaatttgccctgctttctgcattagcagcaattggacgggtttatgtcggcccggttgcgggatggttcgctgaatctcacggctggtccatgttttatctattctccattgtcatcggattaccgggtctgtggcttttgtttatctgccgcaagacactggcttatactgaaaaaaacgatagtttcatttcccgtacattattcaagggctattatcggattgctttcattatcatgctgctcgccgctttcatatttataatttggttaatttgtagctgcctgataattatcatcagtagtatggctcattttatcgtccttgatgaacttcaaaaagcaatctcacccgtattctcattcagtatcgcaatgggtactgtaggacttctattgggaggagcgctggattatttagctttgaggaaaaccaaattcgcttag

SEQ ID NO: 196 - DNA, 588 bp, Xenorhabdus bovienii
  Coding DNA location: Contig name=SeqID_16832; Position on contig =4408..4995bp; Strand=-
atgctaaaaaaaatatttacttcattgcttgcacttttctttttagctggcttatctggctgtgcaaactccggcaatacattggcaattcaaccaaaaattaccctgccacccgtagatccgacaatgaaagcgatcacaatcagtattagtggggtcgatcatcgtcaatctcaagcactggcccaagttaatcgcgatgccagactggttaccctgacaccttcccgtgatttacggtttttactccaagaagcactggaaaagcaaatggtagctcgcggctatatgattggttctcctgccaatgccaacttgcaagtcgttgtgaatcagctttatgccaatgttaaggaagggagtctacgccacgatatttctacaaaagcagaagtctccattattgtttatgcccaagatggcagccagcagatcaaaaactatcgcactagctacaatgttcaagggccattaagtgcaacaaatgcgaaaattgcagatgccgtaaacacggttttatctgacgtgatcgcagacatggcccaagattcgtcagtcagcaccttcatcaaacaaaacgttcactaa

SEQ ID NO: 197 - DNA, 324 bp, Xenorhabdus bovienii
  Coding DNA location: Contig name=SeqID_16832; Position on contig =5238..5561bp; Strand=+
atggttcgtcaggaaatagaaataaagttacaggcggcatttaagccttctcatctggaagtgatcgatgaaagttatcgtcataatgtgccagcaggttctgaaagccattttaaaataattgtgatcagtaatgaatttgtcgatcagcgagtgcttagccgccatcgctcagtatatagtgtcttagctaaagagttggaagaaggcgtacatgctttagcgcttcatacttatacagaaaaagagtgggcagaattgggagacactgttctagcttcgcctgcatgccggggaggaagtacgacgacgtcaggtttgtga

SEQ ID NO: 198 - DNA, 180 bp, Xenorhabdus bovienii
  Coding DNA location: Contig name=SeqID_16832; Position on contig =5716..5895bp; Strand=-
atgcctgaaaaactggctgattacaacactcatcaagaaccggggcggtcgtatttaaaaaccgagaatccctgtgatcagaagcgtcccgaaaccattctaaaaattcagacgcagcattatagcgacgcagacagtatgagtcgagaattgcagacaaaagcaggcaatattcgttga

SEQ ID NO: 199 - DNA, 1305 bp, Xenorhabdus bovienii
  Coding DNA location: Contig name=SeqID_16832; Position on contig =5946..7250bp; Strand=+
atgcaagtttctgttgaaaccactcaaggccttgggcgtcgtgtatcaatcaccgttcctgctgccgacattgaaaaagcaattagcagtgaattggttaatgtagcgaaaaaagtccgtatcgacggtttccgtaaaggcaaagtgcctatgaatatcgtcaaacagcgttatggcgcttccgttctgcaggatgttcttggtgatctgatgcaacgcaatttcgtcaatgcgatcattgagaataaaattaatccagcaggcgcgccaagctataaaccagagcagtttaaagatggtgaagacttcatttatgctgttgagtttgaagtttatccagagattgaactgaaaggtctggaagagatcgaagttgaaaaaccggttgttgaagttaaagatgcagacgttgacgcgatgctggaaactttgcgtaaacagcaggcagattggaaagaaactgatgaagcagcggctgcggaagatcgcgtaactgttgacttcactggttctgttgatggcgaagagttcgaaggcggcaaatcaactgatttcgttctggcaatgggccagggccgtatgatccctggttttgaagagggcgtcgttggccacaaagcgggtgaagaatttaccctcgatgtgactttcccagaagattatcatgcagaaaacctgaaagggaaagctgcgacgtttgctatcaacctgaagaaagttgaacagcgtgaactgccagaactgaccgaagagtttatcaagcgttttggtattgctgacggcactgttgatggtttgcgtgctgaagtgcgcaaaaatatggaacgtgagctgaagaacgcggttcgtagccatatcaagactcaggttcttgatggtctggttaatgcgaacgaagttgaagttccagcagcggttatcgatggcgaaattgatgtgttgcgccgtcaggctgctcagcgtttcggcggcaatgaaaaacaagctctggaactgccacgtgaactgttcgaagagcaggcaaaacgccgcgttgttgttggtttgctgttaggtgaagtcattagcagcaatgagctgaaagttgacgaagatcgcgttaatgtgttgatcgaagagatggcttctgcttatgaagatccaaaagaagtgatcgaatactacagcaaaaataaagaaatgctgaacaacgtccgcaacattgctctggaagagcaggctgttgaatttgttctgaataaagcaaaagtttctgaaaaagaagccggctttaatgatcttatgaaccaaaatcaactggcataa

SEQ ID NO: 200 - DNA, 624 bp, Xenorhabdus bovienii
  Coding DNA location: Contig name=SeqID_16832; Position on contig =7509..8132bp; Strand=+
atgtcatacagtggcaagcaagatcaatatgcacctaacatgtctttggtgccgatggtggttgaacaaactgcacgtggagaacgtgcattcgatatttattcccgtttattaaaagatcgaattatttttctgactgggccagttgaagatcatatggcgaacttaattgtcgcccaaatgttattcctggaagcagaaaacccagaaaaagatattaacttatatatcaactctccgggtggggttattacagcgggtatgtctatttatgacacgatgcaatttatcaagccggatgtgagtactatctgtatggggcaagcctgttcaatgggtgcattcctgttgacagcgggagcaaaaggtaagcgtttctgtctgccaaattctagggtcatgattcaccagccattaggtggtttccaagggcaggcgacagatattgaaattcatgcgcaggagatactcaaggttaaagctcgcatgaacgagttgatggcgaaacatactggcaaaccacttgagaagatcgtcgaagatacagaacgcgaccgtttcttatcagctgcagaatccgtagaatacggtttggttgatagtatatttacccagcgcaactaa

SEQ ID NO: 201 - DNA, 1272 bp, Xenorhabdus bovienii
  Coding DNA location: Contig name=SeqID_16832; Position on contig =8276..9547bp; Strand=+
atgacagataagcgcaaagacggttcaggaaagctgctgtattgctctttctgcgggaaaagccaacatgaagttcggaaattaatagctggcccgtcagtgtatatctgcgacgaatgtgtcgatttatgtaacgatatcattcgcgaagaaattaaagaactagtaccacaccgtgagcgtagcgctttgcctacccctcatgaaattcgtcaacatctggatgattatgttatcggtcaggaaacggcgaagaaagtgttagcagtcgctgtttataaccattacaagagactgcgtaatggtgacactaataacggtgtggaattaggaaagagtaatattctgctgattggcccaacaggtagtggtaaaaccctacttgctgagacactcgctcgttatttagatgtgccttttactatggccgatgctacgacactgactgaagcgggttatgtcggtgaagatgtagaaaatattatccagaaactgctgcaaaagtgtgactacgatgtgcagaaagcgcagcgtgggattgtgtatattgatgaaatagataagatttctcgcaaatctgataatccgtcaattactcgtgatgtctcgggagagggcgttcagcaggcacttttgaagctgattgaaggtacagtggcagcggttccacctcaaggtggccgtaaacatccacagcaggaatttcttcaggttgatacctctaagatcttgtttatctgtggtggtgcatttgcaggattggacaaagttattagccagcgtttgaatgtcagctcgggtatcggttttagtgctacagttaaaggcgagtcggagaaagcaacagaaggcgaattgcttgctcaggctgaaccggaagatttgatcaaatttgggttaattcctgaattcattggccgtctgccagttgtggcaacattgactgaactgagtgaagaagcactgattcagatcctgcaagagccgaaaaacgcgttgaccaaacagtatcaggctctgtttaatctggaaggtgctgaacttgagttcagaaaagaagcattgacagcgattgcgaagaaggctatggcgcgtaagactggtgcacgtggtcttcgttcaatcgtagaaggtgttttgctggatacgatgtatgacctgccatcaatggaacatgtagaaaaagttgtcgttgatgaagcggttgttgaagagaaatcagcgccattattgatatatagcaagccggatgcccaagtttctggtgagtga

SEQ ID NO: 202 - DNA, 1717 bp, Xenorhabdus bovienii
  Coding DNA location: Contig name=SeqID_16832; Position on contig =9757..11473bp; Strand=+
atgaaccctgagcgttccgaacgcatagaaatccctgtattgcctttgcgcgatgtagtggtttacccacatatggtgatccctctgtttgttgggcgtgagaagtcgattcattgcctggaagcagcaatggatcatgacaaacaggtcatgttggtcgcgcaaaaagaagcatccactgatgagccgggagtcaatgatcttttctccgtaggtacagtggcttctgtgttacagatgttgaaactgccagacggcacagtgaaagttctcgttgagggtttgcagcgtgcccgtattacaacattgacggataatggtgagtacttctatgcgcaggttgaatatcttgaatcccctgtcgttgatgaacgtgagcaggaagttctggtaagaaccgccattaatcagtttgaaggttatgtcaaactaaacaagaagatcccgccggaagtattgacatcattacacagcattgaagatttagcaaaactggcagataccattgctgcccatatgcctttaaaaattaacgataaacagactgttttagaaatgtctgatgttgttgagcgtattgaatatctgatcgcaatgatggaatcagaaatcgatctgttacaggtagaaaaacgtatccgcaatcgcgtcaaaaaacagatggaaaaaagccagcgcgagtactacctgaacgagcaaatgaaagcgattcagaaagaattaggtgagatggatgatgcacctgatgaatatgaaacgttgagacgtaagatcgaagacgctaaaatgccgaaagaggcacgcgaaaaggccgaagccgagctgcagaaattaaaaatgatgtctccaatgtcagcggaagcgacggtggtacgtagctacattgactggatggtacaagttccttgggttgctcgcagcaaggtgaaaaaagatttggtcaaggcgcaggaagtgctggatatagatcattatggtctggaacgcgtcaaagagcgtatccttgagtatctggcagtacaaagccgtgtcagcaaaatcaaagggccgattctgtgcttggtagggcctcctggcgtaggtaaaacctcactgggccgttctattgcgcgtgcaactggccgtaaatatgttcgcatggcgctgggtggcgtacgtgatgaagcagaaatccgtggtcatcgccgtacttatattggttccatgccgggtaaactggttcagaagatgtccaaaattggggtcaaaaatccactgttcctgttggatgaaattgacaaaatgtcatctgacatgcgcggcgatccggcttctgcattgctggaggttcttgatcctgaacaaaacgtggcatttaatgatcactaccttgaagtggattacgatctgtctgatgttatgtttgtggcaacgtccaattcgatgaacattccggcgccactgcttgatcgtatggaggttattcgtctgtcgggttataccgaagacgaaaaactgaacatcgccaagcggcatctactgccaaagcagattgagcgcaatgctttgaaaaaaggtgaattggccattgatgacggtgcgattctcggtattatccgttactacacccgtgaagctggtgtacgtaatctggaacgtgaaatttccaaactgtgccgtaaagctgttaagacattgttgatggataagcagcttaagcacatcgaaatcaatgcgg

SEQ ID NO: 203 - DNA, 783 bp, Xenorhabdus bovienii
  Coding DNA location: Contig name=SeqID_16833; Position on contig =27..809bp; Strand=+
ttgatatttggtattgcttctggtgccggcttttggggcatagcgattggcctgttgctcggtcatgtacttgataaggtcgggatgcgcaatcaaagactttctgacaaaggtccatcccggcaggcgctgttttttcgcagcacctttcagatattggggcatttgaccaaagcaaaaggccgggtgacagaaacggatatccagctcgccagccagttgatggataggatgcagctgcatggtgatgcaagggttgccgcacagcaggcgtttcgtgagggtaagcagccccggtttcctctgcgtgaaacacttcggcaattgcgacgtgcctgttttgggcgcttcgatctgattcggatgtttttggaaattcagttacaggctgcgttttcagatggcgaactgcatcctaatgaaagaatagtgttgtttgtcattgctgaagaactgggtatttcccgcgctcaatttgagcagttcctcgccatgatggaaggtggccgccattttggtgggcaataccagcagcatggacgttatcaggatcatgggcagccgcgggcaacactggcagatgcctgcaaggtgctgggtgttaaggaacatgacgatgcgacaaccattaagcgggcttatcgaaaactgatgagtgagcaccatcccgataaactggtggcaaaaggtttaccgccagaaatgatggatattgccaaacagaaagcgcagtccatccaatccgcttatgatttaattaaaaaagaaaaaggttttaaataa

SEQ ID NO: 204 - DNA, 654 bp, Xenorhabdus bovienii
  Coding DNA location: Contig name=SeqID_16833; Position on contig =816..1469bp; Strand=-
atgctggaatcttataatcccccgactgatccctggttacatgtgctttatcaagacgagcacattatggttgtcaataaacccagtgagttgctttctgtaccgggcaaagcagaggaccataaggacagtatcatgacgcggatacaggccgagtttccaacggctgaatctgttcatcgactggatatggcaaccagtggtgtcatggtcgttgcactgaccaaagcggctgaacgtgagctaaaacgtcagtttcgcgaacgtgagccgaaaaaagtctatatcgcccgggtatggggaaaattagaacgggaaaaaggtctggtagatttaccactgatctgcgactggccgaaccgcccgaagcaaaaggtctgttttgaaaccggaaaatcggcacagacagagtatcaagtgctggaatatgaagctcaggcaactcgcgtcaggcttgctcccatcactgggcgatcccatcagctacgtgtacatatgctggcgcttggtaatcccattctgggggacaggttctatgctcatcagcaggcaagagaactggcacctcgcctgcaattacatgcacaagagttgtcgattactcatccggcctacggcactccgatgcattttgaatgcaaggccgatttttga

SEQ ID NO: 205 - DNA, 2910 bp, Xenorhabdus bovienii
  Coding DNA location: Contig name=SeqID_16833; Position on contig =1604..4513bp; Strand=-
atgccatttacccttggtcaacgctggataagcgatacagaaagcgaacttggattaggaacagtcgtagcgcttgatacgcgcatggtgacgttacttttccctgccagcggagaaaaccgcctttacgcacgcaatgattcacccattacccgcgttatgtttaatgcgggcgataccctgaccagtcatgaaggctggaaactcaaggtcgatgaagttcagcaagataatggcctgttaatctatatcggtactcgtctggatactgaagaggaaaatatcaccctacgagaagtttttctggatagtaagctgacgtttaataagccccaggatcgtctgtttgccggtcagattgaccgaatggatcgctttgcgctgcgttttcgcgcccgtaaacatcaaagtgagcagtttcgtctagctgaaagtgggctgcgtggcattcgcgccagcttaatccctcaccagctgcatattgccaatgaagtcggcaaacgccacgctccccgtgtgttgctggccgatgaagtcggattgggtaaaaccatcgaagctggcatggttattcaccagcaactcatggccggtcgtactgaacgagtgctggtcatcgtgccggaaagcctccagcaccaatggctggtggaaatgctacgccgtttcaacctgcgcttttccctgtttgatgatggtcgttattccgaagccctgcacgatagcgataatccatttgaaacagaacaattgattatctgttctctggattttgttcgccgtaataagcagcgttttgaacatctgctggaagcaagttgggatttaatggtcgtcgatgaggctcatcatctggaatggagcgaaaaagcaccaagtcgcgaatatcaggtcattgaagagttagccgagcagatcccatccgtactgctgctgacagcaacgcctgagcaattaggacaggaaagccattttgcccgtctgcgtctgctcgatcccaatcgtttccacgattatcaggtgtttattgatgaacagcagaagtaccgtccggtcgctgatgccgtcaccctgctgctctctggcgaaacgctgaacaatgaccagcagaacctgattgtcgaactgattagcgagcaggatattgaacctctgctgaaagcggcaaacagtcatcaggatgaagagagtgaaaaagcgcgccgtgaactggtcgcgatgttaatggatcgccacggcactagccgcctgctgttccgtaatacccgaggcggcgtcaaaggttttccacaccgtgaactgcacgaaatcaagctgccattacccgctcaatatcagacggcaatcaaagtgtctgaaatcatgggcgccaaaaaatccgtagaagcgcgcgctaaggatatgctctacccggagcggatctatcaggagtttgaaggcgaaaatgcgacatggtggaacttcgatccccgtgtggaatggttgcttggtttcctgctggcaaaccgcgatgaaaaagtgctggtgatctgtgccaaggcagaaactgccctgcaactggagcaggtgctacgcgaacgtgaaggtatccgcagtgccgtgttccacgaagggttatctctgctggaacgcgaccgtgccgcggcttacttcgcttccgaagatgaaggagcgcaagtgctgctctgttctgaaattggttctgaagggcgtaacttccagtttgctaaccagcttgtcatgtttgatctgcctttcaacccagatttgctggaacaacgcatcggtcgtctggatcgtatcggccaaagccggaatatcaagatcagcataccttatctggaaaataccgcgcaatcgattctcctgcgctggtatcacgagggtttgaatgcctttgaacagacctgcccaaccggtcgtcccatctatgacaaatattatgaaactctggtgaatttccttgccaagccaaacgaacaggctggcttcacgccattcattacagagtgccgtgagcatcatgagcaactcaggcagcagctggagcaaggccgtgaccgtctgctggaaatgaattccaatggtggcgagcagggacaaaagctggcagaaaccatcgccgcacaggataacgatacggatctggtgagttttgctctgaatttgttcgatatcattggcattaatcaggaagatcgcagcgacaatattattaccctgaatccatccgatcatatgctggtgccggatttccctggcttaccggtagatggttgctcaattacgtttgatcgtgaaaaagccctgtcccgcgaggatacccaattcctgagctgggaacacccgatcatccgtaacggcttagatctgattttgtctggagataccggaagctgtgccgtttccattctgaaaaacaaagcactgccagtcggaacgctgttggttgagttaatttacgttgttgaagcccaagcgccaaaacatctgcaattaacccgcttcctgccaccaacaccagtgcgcctcttaatggatctgaaaggaaccaatctggcacctcaagtggagtttgaaagtttcaaccgccagctaaatgccatcaatcgccataatgccagtaaactggtcagcgcggtgcaaaaagaagttcacgctattttgcagcaatctgaaccgctggtagaacagcaagcccgtgaagtgattgagaaagcgaagaaagaggcagataacgtgttgtctgctgagttgtcacggctggaagcgctgaaagcggttaatccaaatatccgtgatgatgagctggaagcggttgagtctgaacataagcatctgctgctcaatcttgatcaggcaaattggcgtctggatgccattcgcttggtggtggtctctcatcaataa

SEQ ID NO: 206 - DNA, 2346 bp, Xenorhabdus bovienii
  Coding DNA location: Contig name=SeqID_16833; Position on contig =4732..7077bp; Strand=-
atgcaaacaaagcatgttgaacaaggttttatactcacccgccactggaaagatacgccatccggtattgagttagtatattggctagcgacggatcagggtgcacgccgcatcactatttctcaccaaaaagcggtggcttttattccccagcatgatttgcagaaggcaaagcggattatcggccaagaacagcgttgtgaattcaaacctgtgccgttgaaagatttcaatcgccaacctgttactgccttatattgcctgcaatatcgtcaattgcaacagctggaaaaagcgctgaaagagcaggatattccgctctacgaaaccgatatccgcccacctgaccgatttatgatggagcgttttattaccgcgcccgtctggttcaatcagaagccggatggcagctatcaaatgaaaccgaatcccacctatcgccctaaactgaaatgggtttcactggatattgaaaccagccagcatggggagctgtattccatcggattagcgggttgcggtgagcaaacggtgtttatgctggggccagaaaatgggggcaggcaagatagggatttcaagctagagtacgtcgccagccgtccgcagatgctggaaaagctaaacgaatggatagcattttacgatcccgatgccattattggctggagtctgatccagtttgatttaaaagtattacagaaacatgctgaacgctataacgtaccgctgaaactcggtcgtcatcatggtttgctggaatggcgggagcacggtttcaagccggggcattttttcgcctcggctgaaggccgcctgattattgatggcattgatgcgctgaaaaccgcaacgtggaattttccttcgttcagtcttgaatctgtcgcacaggcgttattgggggaaggaaaagccattgatagcccctatgatcggatggatgaaatcaatcgccgctttcaggaggataaacccgccctcgcccactataatttgcaggactgtattctggtcaaccgtatttttgataagacggatttgatgacgttcctgctggagcgcgctacggtgacagggctggcagtggatcgcagcgggggatcagtggctgcgttcacgcacctttatctgccgagaatgcaccgcatcggctatgtcgctcccgttcatgcaactgactccggtgatagccccggcggttttgtgatggattcgtttccggggctgtatgattcagtgctggttttggattacaagagcctctatccttctattattcgcacttttctgattgatcccgtgggcatggtagaaggcctcgcccagcccgatagtgaacatgccatacccggttttcggcaagcgtttttctctcgcactcaacattgtttacctgatatcgtcacgcaaatctggcatgaacgtgacaaagccaaaaagcaacaaaacgccccgctctcccaagcgctgaaaattatcatgaatgcgttttatggcgtactgggtgcgtcaggctgccacttttttgatccccgcctgacttcctctattaccctgcgcgggcaccaaatcatgcaccagacccgtgagttgattgagtcacaagggtatcaggtgatttatggcgatacggactcaacttttatctggctgaagcaccctcattctgaagcagaagccggtcaaataggtcattcgctggcgcaatttgtcaatcaatggtggcaaagccatcttaaaacgcagttcaatcttgaaagtactttggaactggaatttgaaacccattatcgccgttttctcatgccaaccgtgagaggcactgaacaaggcagtaaaaaacgctatgccggattgagtggcgataaaatgattttcaaagggctggaaacaataagaacggattggacaccgcttgcgcagattttccagaatgaactgtacacccttatttttcaccagaagccttaccaagattatatccgtgattacgttgccaacacgctggcaggaaaattcgatgaccgtctcatttaccgcaaacagctacgtcgcaaactgtctgattatcagcgtaatgtaccgcctcatgtccgggcagcacgtctggcggatgagtataaccagctgaacaatcgtccattgcaataccaaaatggcggttggatcagctacctcatcacgcaatcagggcctgagcctctggaagaccagactacgctgccggattacgaacactacattaataaacaactgatgccgattgcagacgccatcctgccatttcttcaagataactttatgaccctgctgacagggcagatgagaatatctttcgaataa

SEQ ID NO: 207 - DNA, 1413 bp, Xenorhabdus bovienii
  Coding DNA location: Contig name=SeqID_16833; Position on contig =7217..8629bp; Strand=+
atgaagaatgaattgagtaaaaaacaatctgagttactcgcgagttttaataaagaagaattacttgaaatcatccatgcattaatcagaaataatgagctggctcaaaccacattagtcagtggatatttgctggagtctgaagatattctgaaactcattgaaaaagagtataaaaaacgcagcaagagcaaacgatttttcgattattatgaaacggatatcttcttcggtgaactgcatagctatatggcaacgctttttgacacgattatccctttaaagccagcagaatcagaagtgttactgtcaaatatgttacaagattttgaacgcctgagtgaaactaaagacacctcgagtggtggctggcaggattattactactaccttgttgaatcttggattaaggcgttatctctgcaaaaagatattgataaggttacggtagcaaataagcttttcaatattttccaaggtgaatattatttctctgtgtccctgttggctgaatataaatctactttgggtcttgatattcttcgccagctaagagatatcttttatcagcacaaaaatgatgatgaagcactggagttgagttcttccattaaagatattgaattcttcaagacgtatctcgataaggagaaagagtttttatatccaagatattatctggattacgctgaattgctgattgaagatgtcaggtctgatgaagctattgtgttgttggaaaatctcagagaaaaaaacaacaaactgccagttgaactcaatgatgataagataatggaattattgattaaggccaatattgaagagggtaagaaagaagaagccaggcaactttgtattgacgctttcaaggagtactataaccatagattttatgaattatatgaaaatactcttgataaagatgaaaaagggagtgctataaaattatttttggatatagccaatcaatatgaagaaaaccgtttcttttatttactattcctaatagaagtggaaaaattcgatgtgatcaatgattacgttttgaatttaggaaaagataatataataaaaattaccgattctattattcccagtacggcgagaaaagtatcaagtttactgtataaaagtggttttcctctttctgcgacgctcgtaagacgtgcgcttgttgaagatgtgcttggtcgtggagcaagtaagtattataaatatgccgtttctgatcttaagaaaagcttggattatggagaaaagatacaaagtacggacgatattgcttctaatcaaacatatttaaccgccctctacgcaaagcataagaaaaaagcctcattctggtctttggcggaagaaaaaattaagggtgtttcaatggataaagatggcgcttattatggaaaatga

SEQ ID NO: 208 - DNA, 1374 bp, Xenorhabdus bovienii
  Coding DNA location: Contig name=SeqID_16834; Position on contig =994..2367bp; Strand=-
gtgcagaaatacttaaatgaagcgcgtagtttgctcgctctggggatcccaatcatcatcgcacaattttcacaaactgcgatgggtttcgtcgatacagtcatggctggtaaagcgggtgctgtcgaaatgtctgcagttgccgtcggtacgtcaatctggttaccaactattttatttggtcagggtttactgatggccctaacgccgattgtggcacacatgaacggttctggtcagagaaaaaatgtggcagttcagatccaacaaggcttctggctggcaacttttctctctattttagttatagctgtattgtataactgccgattcattatagaagcgcaacacaatgttgatcctgtgttggcacaaaaagcaataaactttatccatgccattatgtggggtgcccctggctatctgttctatcagaccttacgcggtcagtgtgaaggattgtcgaaaaccaagcctgcaatgattattggcattatgggattactggttaacattcctgtcaattatattttcatttacggtaaatttggcgcaccagaattaggcggtgtgggctgtggtgttgcaacggccacggtctattgggtcatgttcctgttactgcttgcgtatgtaaaacacacgccttcacagaaggacatccatacgttcgacaattttactggccctaattggcgtacacaaaaacgtattgtgttacttggcttacctatcgcactggccctgttctttgaagtcacactttttgctgttgtttctctgttggtatctcctctcggagtcgctgccgttgctggacatcagatcgcactcaatttcagttccatgatgtttatgtttcccctgtcatttgggatcgcagcaaccatccgcgtaggctataaccttggaaaaaaatcgactgaaggtgccaaaatttcagcttacacaagccttgctgtcggtttgatgatagcctgtatgaccgcggcctttacaactttgttccgcgaaccgatcgcacttatgtataacgataactatgaagttgtcactcttgcatcccatctgatgctgtttgcagccatttatcagatttctgattcagttcaagttattggttccggtgtattacgagggtataaagatacgcgttccgtcttctttatcacctttattgcttattggatcttaggactacctagtggttacattctggcgctaacccattatgtcactgaaccaatggggccacagggtttctggattgggtttattatcggcttaaccgccgccgcagtcatggtgggtctccgaattttgtggttacaaaagcaaccaacccactttgttctggaacgctctactcattaa

SEQ ID NO: 209 - DNA, 645 bp, Xenorhabdus bovienii
  Coding DNA location: Contig name=SeqID_16834; Position on contig =2606..3250bp; Strand=+
atgtttacaggcatcattcagggaaaagcgccgatagttgcgattgatgaaaaagcgcattttcgaactcatattgttaaatttccggctgaattattacccggaattgaaacgggagcctccgtttcccacaatggttgttgcctgacagtgaccaatatcgatagcgatctgattagttttgatttgatgaaagagacgctgcgcttgactaatctcggtgatcttaacgtaggtgatttagttaacctggaaagagctgcaaaatttggtgatgaaattggtgggcatctgatgtccggtcatgttattacgatagctgaaattgccaagattttcacttcagaaaataaccatgaaatttggtttcgcattcacgataagcaattgatgaaatatattctgcataaaggatttattggcattgatgggattagcctgacgattggggatgtcgtgaataaccgattctgtgttcacctgatacccgaaacactggaacgtacgacactgggtaaaaagcgccttgggcagaaagtgaatattgagattgacacacagacacaggcaatcgtagataccgtcgaacgggttatggcgcagaaagaacaggaaaaagtattgtcacaaacggaagaacaataa

SEQ ID NO: 210 - DNA, 1152 bp, Xenorhabdus bovienii
  Coding DNA location: Contig name=SeqID_16834; Position on contig =3329..4480bp; Strand=-
atgagttcatcttgcattgaagataaaaaaataattaccgatccgtggcatagaatcgccaatgagttgcttcaagaagctgatattgagatcaacggcaaacgccctttcgatatacatgtcaaaaatccaaatttttataaaagagtgttaaaagaaggctcccttgggctgggtgaaagctatatggatggctggtgggattgtgaacatctggatgtattctttcataaaatactgcgagctggtctggagtatcgcattcccaaaaatgccaaggatattctgaaagtcattaccgctcgcatatttaacttacaatcacccaaaagagcctgggttgtaggagaagaacactatgatttaggtaacgatctttttactcgcatgctcgacccctacatgcagtactcatgtggttactggaaagattcaaatacactagaagaagcccaaaccagtaaactccgcctgatttgcgaaaaactgcaattgtcttcaggcatgacactattggatatcggatgtggatggggtggtctggctgcctatgctgcaaaaaactatggtgcatccgtcactggcgttactatttccgcagagcaacagaaatatgctcaagaacgctgtgaagatctggatgtgaaaatcatccttgaagattatcgcgatttgaacctccaatttgataggattgtttctgtcggcatgtttgaacacgttggtcctaaaaactatgccaattatttcaatatcgtgcgcaaaaacctgaaggctgatggcctgtttctgctgcatactatcggctctaatcgtgataaactgaacgtcgattcatggataaataagtatatttttcccaatggttgcctaccttcggtcgcaaagatcgccaaagccagcactggaaaatttgtcatggaagactggcacaactttggagcggattatgaccgtacgttgatagcatggtatgaacacttcaccgcaagctggagcgagatagaacataactacagcccacgctttaaacggatgttcagttattacttgaatgcctgcgcaggtgcattccgtgccagagacattcaactgtggcaaattatgtttagtccacggggaattgaaaacggcctgagagttcctcggtaa

SEQ ID NO: 211 - DNA, 1182 bp, Xenorhabdus bovienii
  Coding DNA location: Contig name=SeqID_16834; Position on contig =4800..5981bp; Strand=-
atgacaacaaataacaattccatttcattcatgttttatctcgctggcctgagtatgctcggctatttggctattgatatgtatctacctgcttttggagtaatgaaaacagagttaaatacatcagaaagtgctatcagtgcgagtctcagcatttttcttggcggttttgcctttgctcagttgttatgggggcaactgtctgaccgattgggaagaaaacctgttcttattatcggcttatccctgttttccattagctgtctaggtatgctttggataactgactccactcaactgcttgtattgagattttttcaagcggttggagtctgctctgcagcagtttgctggcaggctttagttgtcgatcggtatgatcctgaacgtactaaacgtgtttttgccatgataatgcctctggttgccctttcccctgcactcgctcctttggtcggtgcatggctattgtcacacgttggctggaaaatcattttccttgtcttgatggctgtaacacttttactgctgatacccacatttttcctgaccaataaacacaaaactatcgataccgactctgataaaaagggagtttctttctttaccttattgaaatcccccatcttcagtggaaatgtattaatttatgctgcttgcagtgctggtttttttgcttggctaactggctcaccaacaattctggccgatatgggttatgatcctacagatatcggcttgagttatattcctcagactctggcatttatggtcggtggatatggttgccgtattcttttggaaaaaatcaaaagtgaaacggtatttccattcttactggcaggttatgccgtcagtatggtgatcatttatttaatttcccaattctatgaaccttcatttatggctattctcatccctttctgcattatggcagcaatgaatggtgcttcttatcctattgctgtagcaaatgccctctctgtttaccctaaaaacagcgggaaggcggctgcattgcagaatgccctgcaattaggtctctgttttgtcgcaagcctgatagtctctgtattcatgaaaaaccctcttctatctaccacaacagtgatggtttctactgttgttttgatggcaatagggtattggttgcaaaagcaaaaatatgacaagaaagattaa

SEQ ID NO: 212 - DNA, 909 bp, Xenorhabdus bovienii
  Coding DNA location: Contig name=SeqID_16834; Position on contig =6105..7013bp; Strand=+
atgtggtctgaatactcgctggaagttgttgatgctgtagccagaacaggaagtttcagtgcagctgcatcagaacttcatcgtgtcccctctgctatcagctatacggtaaaacaactcgaagaatggttggctgtacctttatttgagcgtcgtcaccgtgatgtagaattaacggaagcggggggtatttttgttaaagaagctcgttctgttatcaaaaaaatgcatcacactcgccatcaatgtcagcaggtggctaatggttggcgagggcagttcagtattgccgttgatcaagttgtaaaacctgaacgaacgctccaacttattctggatttttaccgacattttccagatattgagttgcttatctatcctgaagtttttaatggtgtgtgggatgcattggtagatgggcgggttgatgtcgctattggtgccacacgcgcttctccggtcggagaacgatatagtttcagggacatggggtttatgccgtggttatgcgttgccagccctgcacatgaactggtttcgatagcagaaaaattgaatgacgaccagatgcgcgcttattccagtttgtgcctggaagatacttctcgcagcctgcccaagcgtgatacgtgggctttggataatcaacggcgattgattgtgcctgattgggatattgggttggcttgcctgatggatggtctgtgtgtaggaatggtgcccaagcatcgtgcattaccacttatccgcagcggaaaattgatcgcacttgagcttgaacaaccattgcctgatagcccatgttgcttggcatggtcgcaaaaaagccattcaccagcattaagctggttgcttgattatctcggagatagtgaaacacttaatgctgaatggctgcaggaggactga

SEQ ID NO: 213 - DNA, 1026 bp, Xenorhabdus bovienii
  Coding DNA location: Contig name=SeqID_16834; Position on contig =7017..8042bp; Strand=-
atggcaacgattaaagatgtggctaaacgcgctggtgtttcgaccacaaccgtatcccatgttatcaataaaacccgtttcgtcgccgaagatacaaaaatcgcagtttgggctgccattaaagaactaaactattctcccagtgccgttgcccgtagtttgaaggttaaccacaccaaatccatcggattactggcaacttcaagcgaggcaccttattttgccgaaataatagaatccgttgaaaatagttgctatagcaaaggctatacgttgattttatgtaattctcacaacaatctcgacaagcagaaagcttatctcgcaatgctcgctcaaaaacgtgtggatggtttactggtaatgtgttcagaatatcctgaacaacttttgggtatgctggaagattatcgcaatattcccatggtggtcatggactggggcgaatctagaggagatttcaccgatgcgattatcgataacgccttccatggtggttatttggccggtcgctatcttattgaacgcggtcaccgtgatattgcttccattcctgggccactagcaagaaataccggtggcgggcgtcatcaaggttttctcaaggcactgaaagaggcaaatattgccattcggaatgagtggattgtgcagggcgatttcgaacctgaatctggctatcaagctatgtataagatcctgaaccagaaaaatcgccccacagctgttttctgtggtggcgatgtgatggcaatgggggcaatctgtgcagccgatgagctaggcttacgtgtccctcaggatatttccatcattggttatgacaatattcgtaacgcacgctacttcacgccagcgctgacaaccatccaccagcctaaagaacgtctggggcagatggccttctcggcgttactggacaggatcatcaataagcgtgaagatgcacaaactatcgaagtccacccgcgtcttgttgagcgtcgatctgttgcagatgggcctttcatcgattatcgccgttga

SEQ ID NO: 214 - DNA, 579 bp, Xenorhabdus bovienii
  Coding DNA location: Contig name=SeqID_16834; Position on contig =8517..9095bp; Strand=-
atgtcttttgaattaccagcattaccttatgccaaaaatgccctggaaccacacatttcagcagaaactctggaatatcattacggcaaacatcataacgcctacgttgtgaacctgaacaatctgattaaagataccgaatttgccggaaaatcactggaagaaatcatcaagacatccgaaggcggcatcttcaataacgcagcacaagtctggaatcacactttctactggaatagcctgtcaccaaacggtggtggtgaaccaactggaaaagtggcagacgctattaacagtgctttcggctcttttgctgaattcaagcagcagtttactgatgctgccctgaaaaattttggttctggttggacatggctagtcaagaaagctgacggcagcgtggctatcgtcaatacttccaatgccgcaactccactgactagtgaagataaacctgtactgacagttgatgtttgggaacacgcatattacatcgattatcgtaatgcgcgccctcaatatctggagcatttctgggctctggtcaactggaaatttgttgaagaaaatctggcttaa

SEQ ID NO: 215 - DNA, 384 bp, Xenorhabdus bovienii
  Coding DNA location: Contig name=SeqID_16834; Position on contig =9462..9845bp; Strand=+
atgagtattgagaaaaacgaacgcccggttgaagaaacaacgactattggaaaaatagaacgccagatcaaagaaaatccaatcttgctgtacatgaaaggttctccaaagctaccaaactgtggtttttctgctcaagcggttcaggcgctgtctgcctgtggtgaacgttttgcttacgtagatattctgcaaaatcctgatatccgtgcagaattacctaaatatgtaaactggccgacatttcctcagctttgggttgatggtgagctggtaggtggctgtgatattatcattgaaatgtatcagagtggtgaattacaagcgttgatcaaagatactgctgacaagtaccgtgaacaggcagactgcgatagcgaataa

SEQ ID NO: 216 - DNA, 651 bp, Xenorhabdus bovienii
  Coding DNA location: Contig name=SeqID_16834; Position on contig =9911..10561bp; Strand=-
atgtctaataaaaaagatcaaaacatgctaagtggacgttttcgtggctactatcctgttgtcattgatgtagaaaccggtggttttaatgcacagacagatgctttacttgaaatcgcagcaattactttaaagatggatgaagagggttggctggtgccagctgacacactgcattttcatattgacccctttgaaggcgctaaccttgacccagcggcgctggcattcacagggattgatccgaccaatccattgcggggagcagtcagtgaatacacggcattacatgccattttcaaaatgatccgcaaaggtatgaaagacagtaattgcaaccgcgcgattatagtcgcccataatgccagttttgatcacaactttgtcatggcagcagcagagcgttctagtttgaaacgtaatccatttcaccctttcgccacttttgataccgcagccctgagtggtttggtgctcggccaaacaatcctggccaaagcctgtattacagcagaaataccatttgacagtaatcaggctcatagcgctctgtatgatacagaccggactgccttgctgttctgtgaactcgttaaccgctggaaacgactaggcggctggccattaccttccccagataacgaatcctga

SEQ ID NO: 217 - DNA, 408 bp, Xenorhabdus bovienii
  Coding DNA location: Contig name=SeqID_16834; Position on contig =10686..11093bp; Strand=-
atgcgtttactccatactatgatccgtgttggcaacatgcagcgctcaattgatttctatactcaagtgatgggtatgcgtctacttcgcaccagtgaaaatccagagtataaatattccctcgcttttgtcggttataccgatgaaagccaaggtgcagtcattgagttaacctataattgggatgttgaaagctacgaaatgggaaccgcatttgggcatattgccttgggtgttgacgatgtcgctgcaacttgtgagagcatcaaactctctggtggaaatgtgactcgcgaggctggacctgtcaaaggcggaacaacggtcattgcgtttgttgaagatcccgatggctataaaatcgaattaatcgaaaaccaaagcggcagcagtgcattaggaaattaa

SEQ ID NO: 218 - DNA, 963 bp, Xenorhabdus bovienii
  Coding DNA location: Contig name=SeqID_16834; Position on contig =11850..12812bp; Strand=+
atgtctgataacatcgtagtcggtattgatatcgccaaacacaaatttgatgtcgccgtttgggcaggcgaaaatcattacaaaaggaagcattttccaaatgaccttaagggattcgacgccttcattaattggcttaaacccgcctcaaattaccatttttgcatggaagcaacaggaatttatggggatccgctcgcactttatctttcggataaggggcttcttatcagtgttgtcaatccggtacaaatccatgcctttggtaaagcggaattactccgcaataaaaccgataaaattgacgccaaactgatagcacgttattgcgccagtcagcatcctccggcatggcagcccgcgccgctttgtgaacgccaattactggctttagtccgccatcgcaataagctgaatgaaatgcttttgacggaagagaatcgcctctccgtggtggatgaagttgtttgtgattctcatgcaaagataatcaccctgctaaagcaagaactcaaagacaccgaattgaaactaaaaaagcacattgatgactcgccttcgctgaagaaaaataaggggttactggaaagtattcccggtattggcgaacggttgagcgcaacactgctggcttatattggtgatggttcacggtttcatcatagtgggcaagtggtggcttacgctgggcttaatcctaaattacatgaatcaggacaactaaaagggcgggctcatctctcgaagcagggaagtgccgagctgcgaaaagcactttatatgcctgcgctggcagcgatcagttgcaataaagtagtgaaaaagcagtgggaacagctgacagcacgccataaaggggggaaagttggtgtttgtgcagtgatgcgtaaactcttacgattagcctatggcgtgatgaaatcaggcacattatttaacgcagaaataccgcttgcagtttaa

SEQ ID NO: 219 - DNA, 432 bp, Xenorhabdus bovienii
  Coding DNA location: Contig name=SeqID_16834; Position on contig =13524..13955bp; Strand=+
ttgacattgggatcagacctagcacgtttagttcgtgtttggcgcgctttaattgatcatcgtttgaaaccgttgaaattaactcaaacacattgggttactctatacaatattagtcagttaccaccagagcagtcacagatacaacttgcgaaagctattggtatcgaacaaccctctttggtgaggactctggatcaattagaagaaaagcaactgattacacgtcacacatgtgctaatgacaggcgtgcgaaaagaatcaaattaaccgaggaatcggaaacttttatcagagaagttgacagtgttattggctctacaaggaaagatatcttggagggaattactcatgatgagttaattctgcttgcttctgtaataaaaaaaatcgaaaagaatattagccaattgcataaacaggtaatataa

SEQ ID NO: 220 - DNA, 474 bp, Xenorhabdus bovienii
  Coding DNA location: Contig name=SeqID_16834; Position on contig =14042..14515bp; Strand=-
atgttcaaacgtttcctggttggtgcagttgtagtaacaacattgtctggttgcgcagacatgggagcactttctagtgatacctactctattgatcaagccaaacaagttcaaaacgtaacctacggcactattctatctgtacgtcctgtgtatattaaaggtgctcaggctggtaacccaaacatgctgggtttgattggtggtgctgttttaggagggttattgggtaacacggtcggtgatggtacaggccaaagacttgctacggccgcaggtgctattgctggtggggtggctggccaggggattgaaggggccatcaataaaacgaaaggtgtcgaattagatattcgcacggatagcggaagaaatatcgtcgtagtacagaaactggatcaagtcgtattcagcaaaggacaacgtgtcaagatagctgacggtggaaattcgactacagtatcaccactctga

SEQ ID NO: 221 - DNA, 1113 bp, Xenorhabdus bovienii
  Coding DNA location: Contig name=SeqID_16834; Position on contig =14866..15978bp; Strand=+
atgaagtcaggacgttatatcggtgtcatgtctggtactagcatggatggagttgatgttgttctggcggcgattagcgataaagttgttgcacaacaagtgagttattctcacccatttccacaagagcttaagcagaaattgctttccatctgtcaaggtcaacagacgacattatctatggtcggccagtttgactatgaacttggaacactttttgccgaagcagtaaaaggtctgatggacaaagctgggctaaccgcaagcgacattacagcagttggctgccatgggcagacagtatggcatgaaccagacggtgaaaaaccctttactatgcaaatcggtgataataatcgtgtcgctgcattgaccaatattactactgtaggcgatttcaggcggcgtgatatggcttatggtggtcagggcgcacctttagtacctgcatttcatatggcggttctcgggcatccaacagaaagacgcattattctgaatattggcgggatcgcaaatatctccgcacttctgccagattctgctgttaaaggatatgatactgggccagggaatatgctgatggatgcctggatatggcggcataagcagttaccttatgataaggatgctcagtgggcaaatgaaggaacagtcaatcaacgcttgctccagaaaatgatttatgatccttattttgcacgtattgcaccgaagagtacggggcgtgagtacttcaatatggcatggttggaaaaacagttggcagattttcccgacgtctcatctgtagatattcaggcaacgctggctgaactaaccgcggtaagtattgcacagcaggtagtgttgagtggtgggtgtgaacgcttgcttgtctgcggaggtggggcacgaaatccacgtgtaatgagccgcttatctgctttattgccaattactgaagttgctacgactgacaaatatgggttgagtggtgacgatatggaagcactggcatttgcttggctggcattccgcactatgtctgggttatctggtaacttgccgtcagtaacgggtgcggacagggaaacgattttaggggcaatttatcctgttgccagcagataa

SEQ ID NO: 222 - DNA, 343 bp, Xenorhabdus bovienii
  Coding DNA location: Contig name=SeqID_16834; Position on contig =16020..16362bp; Strand=+
atgtcagaacataatgaaacgggtatcgcagacctgcgccgcgaatatatacgtggtggattgaggcggaaggatcttactaaagaaccgattgaactttttgaactttggttgaaacaggcttgtgaagccaaactcattgaccctacggcaatgtgcattgctacagttgatgaacacggtcagccttaccaacgcattgttttattaaaacattttgatgcccgtagcttggttttttataccaaccttggtagccgcaaggcgaagcatctgacccagaataaccgaatcagcctccattttccgtggtatcagcttgagcggcaggtcagtttccttg

SEQ ID NO: 223 - DNA, 456 bp, Xenorhabdus bovienii
  Coding DNA location: Contig name=SeqID_16835; Position on contig =20..475bp; Strand=+
atgctagatgtggcgttgcattcacaagaagggccggtgccattagccgacatttctgagcgtcagggaatctccctttcctatcttgagcaattgttttcccgcctgcgtaaaaatggtttggtttctagtgtccgtggtccaggtggcggctatctactaggcagagatgccggtaatattttcgttgccgaagtgatttctgctgttgatgaatctgttgatgcaactcgctgtcagggcagggaaggctgtcaaggcggtgatcgttgtctgactcatacgctatggcgtgatctcagcgatcgcatcacgagtttcctcagcagcattagtttagaagaattagttaaaaatcaagaagtcttagacgttgctgatcgtcaagacagcgataagcgccgtacacctaacggcaggcctcaagagacgattaacgttaacctgcgtgcgtaa

SEQ ID NO: 224 - DNA, 1215 bp, Xenorhabdus bovienii
  Coding DNA location: Contig name=SeqID_16835; Position on contig =526..1740bp; Strand=+
atgaaattacccatttatttggactattcagcaaccacaccggttgatcagcgtgttgctgaaaagatgatgaaccatctgactatggacggggttttcggcaacccggcttcccgttcacaccgttttggctggcaggctgaagaagcggttgatattgcgcgtaatcaaattgcagatttggttggagctgacccgcgtgaaatcgtgttgacttcaggtgcaacagaatcagataacctcgcgatcaaaggtgctgcaaaattttatcagaaaaaaggcaagcacattattacctgcaaaactgagcacaaggccgttttagatacttgtcgccagttagagcgtgaaggttttgaagtgacttatcttgcgccgatgagcaatggcatgcttgatctgaaagaactggaagccgccatgcgcgacgatactattctggtttccatcatgcatgtgaacaacgaaatcggtgtcattcaggatattgtgaccattggtgatatttgccgcagccgtggcatcatgttccacgttgatgcaacccaaagcgttggtaaattacctatcgatctcagcaaactgaaagttgacctgatgtctttctctgctcacaaattatatgggccaatgggcatcggagcactgtatgttcgccgtaaaccacgcgcccgtattgaagctcagcagcatggtggtggtcatgagcgcggtatgcgttccggtacattgcctgttcatcagatcgtgggtatgggtgaagcttaccgcatcgcaaaagaagtgctggaaacagaatcagagcgtctgcacggtttgcgcctgcgtttgtggaacggtattaaagatattgaagaagtttacctgaacggtgatttggaactgggtgcaccacacattctgaatgtcagcttcaactatgttgaaggtgaatcattgatgatgtcgttgaaagatttggctgtttcttctggctcggcatgtacttccgcgagtctggaaccttcttatgtcctgcgtgcgctgggcatgaatgatgagctggcacacagttctattcgtttctctttggggcgttttaccacagaagaagaaatagactatgcaatcaaattgattcacaacgcgattggtcacctgcgcgatctttctccattatgggaaatgttcaagcaaggtgtggatatcagtaccatcgagtggtctcatcattaa

SEQ ID NO: 225 - DNA, 387 bp, Xenorhabdus bovienii
  Coding DNA location: Contig name=SeqID_16835; Position on contig =1765..2151bp; Strand=+
atggcttacagcgataaagtaattgatcactacgagaacccacgtaatgttggttcatttgacagtgaagatccttcagttggcagtggcatggttggtgcacctgcttgtggtgacgttatgagactgcaaatcaaggtcaataacgagggtatcatcgaagacgcacgttttaaaacctatggttgtggctctgcgattgcgtccagttctctggtaacagaatggatgaaaggaaaatcgctggaacaggctggggctatcaaaaatacagcgattgccgatgagctggaattgccacccgtgaagattcactgctctattttggcagaagatgctatcaaagcagcgattgcggattacaaaagcaagcgcgaagctaaataa

SEQ ID NO: 226 - DNA, 324 bp, Xenorhabdus bovienii
  Coding DNA location: Contig name=SeqID_16835; Position on contig =2231..2554bp; Strand=+
atgtcaatttccctgacagaaagtgcagcccagcgtattttggcttttcttgacaatcgtgggaaaggtgtggggttgcgtttgggagtgagaacatccggctgctctggtatggcatatatacttgaattcgctgataccgttaacgaagaagatcaagtttttgaagacaagggcgtgaaagtcatcgttgatggtaaaagcatcgtttaccttgatggtactgagttggatttttctaaagaaggtctgaacgaaggcttcaaattcaataaccccaatgtttccagcgagtgcggttgtggggaaagttttcacgtttaa

SEQ ID NO: 227 - DNA, 522 bp, Xenorhabdus bovienii
  Coding DNA location: Contig name=SeqID_16835; Position on contig =2613..3134bp; Strand=+
atggactattttactttatttgggctgcctgtacgctacgcgattgaccgtgaacaattgtcaatccgttatcgggaattgcagcgtcagtttcaccctgatcgttttgctaaccagccagaacgtgaaaaagcgcaggctcttcagcaagcgtccatcattaatgatgctctttatactctgatacatcccttgaaacgtgcagaatatatgctgtctcagcaagggttcaatttgtccggcgagcagcataccatgcaggataccgcgttcctgatgcaacagttggagttgcgcgaagagcttgatgccattgagcatagcgcggagccagaaatcgcattggccgatttttcatctcgcttgagtaaaatgatcaaaacacgcagtgagcagatggaacagcagcttgatgctgcacaatggccaattgcagccgataccgtccgtaaattacgctttctggataaattgcaacagcaggttgaacaactggaagagcggttgctggatgatttttag

SEQ ID NO: 228 - DNA, 1848 bp, Xenorhabdus bovienii
  Coding DNA location: Contig name=SeqID_16835; Position on contig =3191..5038bp; Strand=+
atggctttattacaaatcagtgaacctggtttatctgccgaaccacatcagcgtcgtctggccgtggggattgatcttggtacaacacactctctggttgcgacagttcgcagtggtcaggtagaaaccttggcagacagtgaaaaccgtcacttacttccttctgttgtacaatatcgcaaagatgaaactcaggtcggctggcaggcgcgtcagcaagcggcatccgatcctgttaataccgttatctccgtcaaacgtatgatgggacgctctttggctgacatccagcagcgttacccaaatctgccgtaccagcttcaggcaagtgaaaacgggctgccgttgattaatactgtggcaggcctggtggatcctattcaggtttcttctgaaatattgaaatcgttggcccaacgggcagaagaaaccttggatggcaaacttgatggtgttgttatcaccgttccggcctattttgatgatgcgcagcgacagggaacaaaggatgctgcgcgtttagcgggtctgcacgtcctgcgccttttaaatgaaccgactgctgctgccattgcttatggtcttgattctggtcaggaaggtattattgctgtttacgaccttggtggcggaacattcgacgtttctgttctccgcctgagccgtggtgtatttgaagttctggcaaccggtggtgataccgcactgggcggtgacgattttgacctgttgctggcaaattggatccgtgaacaggccgggatcagcgatagtgaccacgggttacagcgtcaactgttggatgtcgcgacgcaggccaaaattgctttaagtgatgcagatacggctgagatcagcattgcaggctggcagggcaatattactcgtgccgaatttaatgagttgatcatatctctggtcaaacgcacattgctggcctgtcgtcgagccctgaaagatgcgagtgtcacaacgggtgaagttttgcaggtagtgatggtcggcggttcaacgcgcgtaccattggtacgcagcatggtgggcgaatttttcgaccgtgaaccactgacctctatcgatcctgacagagtcgttgctgttggggcggcgattcaggctgatattctggtaggtaataagcctgatagcgaaatgctacttctggatgttatcccgttatcactcggtctggagaccatgggtgggctgatcgaaaaagtcattccacgtaacaccaccattcctgttgcaagagcgcaggagtttaccacattcaaagacggccaaggagcgatgagcatccatgtggttcagggagaaagagaattagtgaatgattgccgttcactggctcgtttcacgctgcgtggtattcctccattaccggctggtggtgcgcatattcgtgtgacctttcaggtcgatgcggatggtttgctgagtgtcagcgccctggaaaaatccacgggtgttgaagcttccattcaggttaaaccttcctatggcctgtccgattcggaaatcgcccgaatgctcagagactcaatgaccaatgcgcaggaagatattcaggcgcgtaaactggctgaacaaaaagtagaagcggcgcgggtgctggaaagtttaaccagcgcactggaaaaagatgccgacttgctgagtcaggaagaacaggctgccattgatgctgccgtagaagtattaatcgagagcgcacagggaacctcttctgatgcgattgaaagtgcaattaaacaattggacaaacaaacgcaggaatttgcagcgcgtcgcatggacacatcaatccgccgggctttggcgggtcattctgtggatgaaatttaa

SEQ ID NO: 229 - DNA, 336 bp, Xenorhabdus bovienii
  Coding DNA location: Contig name=SeqID_16835; Position on contig =5041..5376bp; Strand=+
atgcctaaaattgtatttttacctcataacgaactttgccctgaaggtgcagtattggaagccaaagaaggcgaatcgattctggatgttgcactgcgcaatggtatcgaaattgaacatgcctgtgaaaaatcctgtgcgtgtaccacttgtcactgcattgtcagagagggctttgactcactaaaggaaagcactgagttggaagatgatatgctggacaaggcatgggggctggagccagaaagccgtttgagttgtcaggccaaagtcgctgatgaggatttgattgttgaaatccctaaatactccattaaccacgcgcgcgagcactga

SEQ ID NO: 230 - DNA, 195 bp, Xenorhabdus bovienii
  Coding DNA location: Contig name=SeqID_16835; Position on contig =5391..5585bp; Strand=+
atgaaatgggctgacagtcgtgacattggcgaagcactgtatgataaatttccggatgtagaccccaaaacggtgcgtttcaccgatttgcaccagtgggtttgtgaactggatggttttgatgacgatccgcagaaatccaacgaaaaaatcctagaagctatattgctggtttggttggatgaatttgagtag

SEQ ID NO: 231 - DNA, 1296 bp, Xenorhabdus bovienii
  Coding DNA location: Contig name=SeqID_16835; Position on contig =5743..7038bp; Strand=+
atgacaaagcaaatcatgccgataacactgtcttatgagccagctaacgcttgctggggtgaaaaagcgctaattagttcaagtgagcagggaattatcatccatttggaaggtaatggtaaatctggagcgatccaacgtgctggacgtaaaattaatgggcagggtatccacaacgtcgctttgacaggtgaaggttgggatctggaaaaaagctgggcattctggcaaggatttcgtggctcaaaggggctgcgtaccattgaatggccacaattacctgcggcagacaaacaagagctggataatagaatcaaattcgttgattgggtgcgagataccatcaacatgccggcagaagaattagggccagagcaacttactcagcgagcgattgacttactgaatggtgtagcgggtgatgccattagttatcgcatcataaaaggcaacgatctgcgtgagcagggttatgttggggtgcataccgttggccgtggttcttcccgtgatccggtttttctggcgttggatttcaatccgacaaaagagaaaaacgcacccgtatttgcctgtctggtgggtaaaggtatcaccttcgattcagggggttacagcctgaaaccgtctaattccatggattccatgaaatcagacatgggcggctctgcaacattgacgggcgcattggcactggcgatcagccggggcttagagcagcgggtcaaattattcctgtgtattgcggacaatatggtgagcagtaacgccttcaagttgggtgacatcattcgttatcgcaatggtaaaaccgttgaggtaatgaatactgacgcggaagggcgtttggtactggctgatggcttgattgatgccagtgcggaaaaagcaccacttatcattgatgcagcaaccttaaccggtgcggcgaaaatggcggtaggtaacgattaccactctgtattcagttttgatgatcaattggcagcagacttgctggcagcggctgatgctgaaaatgaattgttctggcgtctgccattggctgaattccatcgtagccaactgccatccaattttgctgacctgaataatattgcttcgccttctcataccgcaggcgcaagtacagcagcggctttcttgtctcattttgtggaaaactacaaaaaaggctgggtacatattgactgttcagcaacttaccgcaaatcggctgttgagcagtgggcggcgggtgcaacagggtatggtgtgcgcacaattgctaatctattgctggctaaagcaaaataa

SEQ ID NO: 232 - DNA, 432 bp, Xenorhabdus bovienii
  Coding DNA location: Contig name=SeqID_16835; Position on contig =7162..7593bp; Strand=+
atgagcttgtcaaatgggtccgttgccaccgaaatggaggtttccagtggaagtcgcattaccctcagccagccagaggaacaaccaagccagcttattgacgccttgagtggtttatttaagcagcacaaacctgtgcggcgggcttttctggtcatggctcacgataaaagtctggatgagaaacccaatctattaattgggttggaattgagtgacgcaccgacagacaatgagatcaatgcgctcattcaagaggcaggggaagtggcctgtgaataccttacggaagatgaatcggtagatttttgcctgctcaatgaaaacgaaaggggcattagtcattatctgattcagcatactcagcctttctaccagcgaaaattaggaagctggctgcgcgataccattcctgttgttaatcgggaataa

SEQ ID NO: 233 - DNA, 5004 bp, Xenorhabdus bovienii
  Coding DNA location: Contig name=SeqID_16835; Position on contig =7789..12792bp; Strand=+
atgcttgccacgttatttacgctattcgtgctgcctggatgcgatcaatccgaaaatcctgcgaaagaaaacacagaagaacgacaggcatcattgtctaagagtagtgatactgccaatagtcatgcaaaatcggcagcgacatcgcccgagaataaacaagccacggcaaaaaaacaggaacaccaatcgtcagcacagcgctatgcgggtaaagacgtcacgatcctggatgcatcagatctacaattggatggtgccagtgcgatggttgtgacattttccgttcctttagaacctaatcaagatttttcacagaaattacatctggttgatgtgaaatcggggaaattagagggtgcatgggaactgtccaataaccagatggagcttagactccgtcatttaccgcctgcccgtgaattgcagctaaccgtggacgaaggcgtgaagggcataaatgaacgccaattggcaacagcatatgagaaaaaattcaagactgctccaattacaccaactgttggttttgctagcaaagggctgcttttgccaagcaaagcagcagaaggcctgcctgttctggcgctcaatgttgatcgtgtagatgtaaactttttccgtataaaagatgaggctctgccgttattcattgctgattggcaatatagcaacaacatgaattactggaattccaacgaattattgaaaaataccgagttagtctacactggccgcttcgatcttaatcctactgctaatactcgtgaaaaattattgctgccattaagtgacatcaaagagctgcaaagagagggtgtttatctggcagtcatgcagcaggcaggaaaatatacttatagtaatccgagcactctatttaccctgagtgacattggtgtttcgatgcacagctatctgaatagggtagatgtattcactcagtcattggagaaaggttccagtctgaaaggtgttgaaattcgtctgctggatgcaaaggggcaacttctgtcaaaagccacgacagatagtgatggacatgccacactggaaaaaaatgctaaggcaaaattattgctggcgatccagggtgggctaaccagcatgatagacctgacatctcctgcgcttgatctgtctgaatttgatatcggcggcccacagggttatagcaagcaattctttgtatttggcccaagggatctttaccgtcccggagaaatgttgattgtcaatggcttactgcgtgatgcggatggccgtccgcttaagccacaacccgtcaaagttgatatattgaaagcggataatcaggtcgttcgtagttttgtctggcaacctgaaaatgaactgtaccaataccgttacccgattccccgcgaggctgaaacggggatatggtcactgcgattcgatttaggtgataacaccccgcgttattacaaattccacgtcgaagatttcatgcctgaacgcatggcactggaaattaaaggtgcatctaataatcagtcagttctgaagaatgaaaacgttaatttcgctataacaggtcgttacctatatggcgcgcctgctgctgataatcgcctgcaagggcaactgtttctgcgtcctgcccgtgatgcagtggcaaaattaccgggatatgaatttggctcttcaaaagaagagggtttgagccgaacattggacgaatttgatttcacgctgaatgccgaaggaaaagctaatctttcagtcagtgaggatgaatggaaacaggtgacatctcccgtgaaagttatcgttcaggccagtctgcttgaatccggtggacgtccggtgacgcgccgtgctgaacaggcggtgtggccagccgaaaaactggctggtgtacgcccacttttcaataagaaatctatttacaactaccgaacagggcgtgatgaaaaccgctataacgtcgatgaagattcattggcagagtttgaagtggtttatgcggatgccagcggtaaaaaatatgccacgaacgatttaagaacccgtctgatatatgagcgccgggattattattggcgttggtcagacagtactggctgggattcagggtatgaccagaaagatttagtcatggctgataacactattcaaattgcggaaaatggcacagccaaagtcagtttccctgttgaatggggttcttatcgcattgaagtagtgaatccacaaaatcagctcgttaccagcctgaatttctgggcaggttattcatggcaggataataccggaggtacaggtgccattcgtccggatcaggtcaagatgtcattagataaacccgcgtataaaccgggtgataaagtgaaattgcacatggttgcaccacaggaaggtaaaggttacttgctggtggaatccagtgatggcccactgtggtggcaggaaattgatgtaccggaaaaaggtttggatattgatgtatcaatcaatcaggaatgggctcgtcatgatttgtatctgaccgcagttatcgtgcgtccgggggataaatcccgtcaggctacgccgaaacgggcgattggggtattacatttgccgcttatggatgaagggcgcaaactgaatctgaccttgaatgcccctgataagatgcgtccaaatcaggatctcaccgttaaaatcaaagcgacttctcagcaggggcaaaaactgcctaaacaagtttatgtcctgctttctgccgtagattctggcgttctgagcattactgactttaaaacccctgacccttatgacgctttctttgggcgtaagcgttacagtgttgatcagtatgatgtttatggccatctgattgaagccgaagggcgtaaggcgaatttgcgttttgggggagatggtgatgaaaatgcactcgatagaggcggtaaaaagccgctgacggaagtaaaaatcatcgcagaacaggctaaaccgattactctggatgctaatggggaaggggaaattaccttacctattcctgatttcaacggtgagctcagactgatggctcaggcgtggggtggtgaggaatttggtcacagtgaacgcaaaatcatcgtggctgctcccgttattactcagatgtcattgcctcgcttcatggcaggtggcgatcaatcccaattggcgctggatcttaccaatctgactgaacagcagcaggttcttaccgtgaatttcgaggcgaaggggctgatcaaattacaagacccgataagcaaaaaaatcattctggagacaggaaagcgaactaccattcaaattccggtcaaggctgattatggatttggacaaggagaagttttcctgaccatcgatggattgaacttgcccgatgaaaagctgaaacagtaccaaaatagctggaaaattggcgttcgtccggcgcacccggccaagaccattcagtttgcagatgtgattcaccaagggcaaaactggcaattaccgcagacagccactgctggtctggtactagataccctagaagggcaattattgctgaccagtcggccgccactgcaaatcgcccgttatatccgcgaattgtatgcttatccctatggctgtttggagcaaacagtcagcgggctttatccatcactctattccaatgaagctgagttgaaaaaactgggcatcgatacgcaaactgatgaaaaacgtcgatctgccattgatgcaggtattacccatctgctgagtatgcagcgtcatgatggtgctttctctctatggaaccgtaatggcgatgaagagttttggttgaccgcctatgcgacagatttcctgttccgcgcaactcaacaaggttacagcgttcctgctgatgccctgaagtcggccaatagtcgcctgctacgctatttacaggataaaagtgtcattactgatcgttacagtggttcccgcatcgaaacacaattttctgtgcaggcctatgcgggtttggtcttggcaagtcagcaaaaagcgccgttgagcggtctgagacagctttatgaacgccatcaacaggcaggaaatggtttatctctggttcagttgggcattgcactgaaaatgatgggggataatacccgtagtaatgaggctgttcgtttaggggttaataaggcacgccaatctggctatggattaggtgattatggcagtacaattcgtgataacgcattgattgtttctctactgacggagaacaaaatgttgcagaaagagcgtgatgaaaagctgctcgacttatccaatgaattgtcaactcgccattacttctcgacacaggaaagtaattcgctttatctggcggggcgttactttattgacgcttctgaacaatcttggaaggctgcgattaatcagcaaatgccaccccttaaccgtgatagtgcattgactgaaacattgacagcaaaacagatcctagaaggcatcgatatcagcaatcgtggtgacagcacattgtattcgcgtctgaatatggtgggatatccattggccaccccggaaccttcctcaaatgttttgaaaattaagcgtacttaccttgacttggagggtcactatttccctaccgagcgtatgagaagtggtgaaatggtggttgtgaaacttgaggttgatgcgacacagtcagtgccggatgcattagttgtggatctgctgccggcagggttggaaattgagaatcagaatctggcaagtagcagtgctagcttgagcgaaagtgctacggggttgcaggatattgtcgaaggcatgcaacaggcgaatatccgtcacatggaataccgcgatgatcgttttgtcgctgctgttgccgtccagcctcaccagaccgtgacactgttgtatcttgctcgtgcggttgcgccgggtgtctatcaggtgcccgcaccacaggtcgaatccatgtatgttcctcactggcgtgccgtgggtgaaacaaacgaaaaactggaagttgtccgctaa

SEQ ID NO: 234 - DNA, 2337 bp, Xenorhabdus bovienii
  Coding DNA location: Contig name=SeqID_16835; Position on contig =12850..15186bp; Strand=+
atgagaagattgtcttcccgcatttacctgattgcgttggttattttattcacactccttgcggcagtgtggctggcagataaaatctggccgctgccattgcataatgtcaaaatggcgcgtgttgtggtgggagaagatggctcgccactgtggcgttttgccgacaatgaggggatctggcgttatcctgtcactttggagcaggtttctcctgaatatattcaggcattgctgacctacgaagatcgctggttttacaaacatccgggcatcaatcctgtttctttgctgagggcggcatggcaggacatccgcgcaggaaaaattgtgtcggggggcagcacaatctccatgcaagtggctcgattgattgatccacatccgcgcaccttcaccggaaaattcaggcagatttggcgcacgttgcaacttgagtggcattactcaaaagatcaaattttggagatgtatctgaaccgtgcgccattcggtggtacgttgcagggtgttggagcagcaagctgggcgtatctgggcaagccgccgtcagaactttcgccgggtgaatcggcattattggcggtattaccacaagctcccagtcgcttaaggccagatcgctacccagaacgtgcgcaggctgctcgagacaaagtattacagcgtctgaagcaatacaatgtctggccagcggaaaacgtcgctgatatcaaagaagaaaatgtatggctggctcctcgtcaggttcctcaccttgcgcctttactggcaaggcgagtggcaaacggaaacccgcaggaagtgatccagacaaccattgatacaggcttacagcgccaactggaggatatggttctcaattggaaataccaactggcggacaaaacatcgattggggtgttggttgttgatcatacggatatggccgttaaggcctatattggttcggtagatcttcaggatgacagtcgttttgggcatgtggatatgataagcgcatggcgttcacctggctccacgctcaaaccttttttatatgccatggcgctggatgatggattgattcacggggaatccttattgcaggatgttccccgccgttttaatgattaccgtccgggaaattttgacagtggttttaatgggcctgtcagtgccagtgaagcgctaacgcggtcgttgaatttgccagcggtacaacttctcgaatcttatggtgctaagcggttcaccgctaatttgcgtaatgtgggaatggtactgcgttttccgcttggcagtgagccgaacttatcgcttattttgggaggaacggcggctcggatggatgaactggtatctgtttacagcgcttttgcccgtcaggggaaagtttcgccgttgcgttttacaccacagcagagaattcgtgacagacaattattctcagcaggggcagcttggattgtcaggaggatcatggcaggtgaaggacgaccaaaacctgatgatagcctgtctgccgaagtccctttggcgtggaaaacaggtacgagttacggttatcgcgatgcatgggcgattggcctgaatgcccgttataccataggcgtgtgggtcggcaggccagatggcacgcccgtagtagggcaatttggttatgctacggcgatccccattatgaaccagatcaacgggctgttaatggaaaatttacgctatagctcacagcgtattcctgtcgatccgcgaccgataagtgtcagtcaagcgaccatttgctggccgagcgggacaatgctgactaaagaaataatagctaaagatatcagcaattgccgtcagcgtcgcttaagctggattttggataatacaatcccgccaacgctgtctgccattgggcaggaagggacttcgggtattaacgaacggatatggatagataaaaatggtctacgcgttgcttctgattgtcctgatgcccggcctgaaaccgtagctttgtggccgattactctggaagcatggctaccggcaaaagaacgtcggtcgaatcggttgccaccgattaatccccaatgccctcctctgaaaacggatgaggctcccttactcattgtgggagttcgcgaaggggatattctgaaacgccttccgggcaaaaatacgctggacttacggataacaacgcaggggggtaacggtcagcaatggtggtttttgaatggtgaacaagtttctgtgacaaaaaataaccagtcgtgggtaaaaaccttatcacaaccagggaaataccagcttagtgttttagatttgagtgggcagatcagcgcaatcaattttgtttttaagtga

SEQ ID NO: 235 - DNA, 1224 bp, Xenorhabdus bovienii
  Coding DNA location: Contig name=SeqID_16836; Position on contig =90..1313bp; Strand=-
atgagtaatcataatgcacagaagcaaatcggtaatattgatctggtcaaacagcttaatggcgccgtggtctatcggctgatagaccaacatgggccaatatcccgcatccagattgcagaagaaagccagcttgctcccgccagcgtaaccaagattactcgtcagttactggaacggggcttgataaaagaagtcgagcagcaggcttccaccggagggcggcgcgcgatctcaatcatcaccgaaactcaccacttccataccatcggagttaggcttggccgccatgacgccacggtggcgctatttaatatgagcggtaagacgctagtggaacagcactattcagttccagagaatacgcaacaggaagtcgaaaaccggattatctccgccattgaagatttcatcgagaaaaatcagcggcggctccgtgaactgatcgcgatttcagtcattctgcccggtctggttgatcccgatgaaggtgtcattcgctatatgcctcacatcaaggtggataactggccactggtcaaaagcctcaacaatcatttcaatatctcttgctttgttggtcatgatattcgcagccttgcactggctgaacattacttcggggcaacccgcaattgtgaagactcacttctggtacgtattcatcgtggcacgggagcaggagtcatcatcaataagaatattctgcgcaacaaacgtggcaatctgggtgaaataggccacatccagatcgagccacttggcgaacgctgccattgcggtaattttggctgtctggaaacgatcgtatccaattcagcgatagaaaccagagttcaacatcaattacgacagggttttccaagccagctagccttgaataattgcaatatccatgcgatctgcctcgcagccaatgaaggtgatccactggcagtagaagttatcagacaagtagggcactatcttggcaaagggatctcgattgcgattaatttatttaatccccagaaaatcgtcattgccggtgatattaccgaagcagagcaggttttactcccggcaattcaaagttgcatcaatacgcaggtgttaaaagcattccgtgaagatcttccggtggtagtttctgagctaaatcattgttctgcgattggtgcattcgccttgacgaaacgtgcgatgcttaacggtgtactactgcaacatcttcttggcggataa

SEQ ID NO: 236 - DNA, 1164 bp, Xenorhabdus bovienii
  Coding DNA location: Contig name=SeqID_16836; Position on contig =1326..2489bp; Strand=-
atgtacgctttaacaaactgcatcatctatacagggtatgagcgacttgaaaaacatgccgtgatcatcgcagatgggttgattcagcaagtttgtccagaaaatgaattaccgaaatccatcgaaaagcatgatttgcacggtgcaaacctctctccagggtttattgacctgcaagtcaatggctgtgggggagttcaatttaatgagcgactggaaaatcttacagaaaatacgctgaatatcatgcagaaaaccaatcagcgctacggttgtaccagtttcctgccgacgttgatcactagtcccgatgaattgatgataacggcaatcgaagtgatgcgttcctatctgacaaagcatcctaatcaggcgctggggctgcatctggaaggaccttatattaatcccataaaaaaagggactcacaatccagcctatatacgcaagccaacctccgaaatggtcaactatctgtgtattaatgccgatgtgatcactaaaatcacactcgctcctgaaatagtggaaagtaagtatattcatcagttgaccgaagccggcattattgtttctgctggccattccaacgcaacctatgaagaggctcgccacggcttccagcagggtatctctttttccacccacttatataacgccatgcccgccatttccggccgccagccagggctaatcagtgccatctatgattcttccgaggtctatgccggcattatctgtgacggaacgcatgtttcatggccgaatatccgcaactccaagcgattaaaaaccgacaaattaatcttagtgacggatgccatcgtccctgctggccttgacccgaaaaccaatacactagaacaatttacctttgccaataaaacaatatactatcgaaatggcttatgtgttgatgagaatggcacactgagcggttcatcaatcacgatgattgagagcgtcaagaatagtgttgaatatgttggtattgctttggatgaaacattgcggatggtgacgctttatccagcccgagcaatcggtgttgataaacgcctcggtacgattgaacccggtaaggtcgcgaatctgactgcatttactcatgatttcaacatctgcaaaaccatcgttaatggaaatgaaatcgaactatcgtga

SEQ ID NO: 237 - DNA, 807 bp, Xenorhabdus bovienii
  Coding DNA location: Contig name=SeqID_16836; Position on contig =2510..3316bp; Strand=-
atgaggctgatccccctaactaatgcaagcgatgtcggacgatggtctgctcactatattgttagtaaaatcaatgcattcaatccaaccgcagagcatcctttcgtgcttggcctacccactggcagtactccactgaccacctatagagaacttattgctctgtatcaggcgggaaaagtcagtttcaggcacgtagtgacatttaatatggatgagtacgtcggtattcctgaagatcatccccagagctaccatacgttcatgcagcaaaatttctttgaccacattgatattccaaaagaaaatatcaatttactcaacggcaatgcagcagacattgacgctgaatgcctgcgttatgaaaataagatcaaggcttatgggaaaattcatctgttcatgggaggagttggtaatgatggtcatattgcctttaatgaacccgcttcctccctttcttcacgcactcgtatcaaaacgttgaccattgaaacacgaaccgcaaactcccgttttttcaataatgatgtggaacaggttccgaaatatgcattaacggtcggtgtaggaactttgatggatgccgaagaagtcatgattctggcaacaggaatgaacaaagcactggccctgcaagctgcaatagaaggcaatatcaaccatatgtggacagtaagctgcctacaaatgcaccctaaatcgattattgtctgtgatgaacccgcaacaatggaattgaaagtgaagacagtgaaatattttcgccagttagaggcggatattttcagtgaattcgctagttag

SEQ ID NO: 238 - DNA, 2028 bp, Xenorhabdus bovienii
  Coding DNA location: Contig name=SeqID_16836; Position on contig =3649..5676bp; Strand=+
atgaacattctaagctacttacaacgtattggtcgggcattgatggtgcccgttgcgacattgccggcagcggcaatattggtagggatagggtactggatcgatccgacgggttggggcgctgataatgcgctggcagcactgcttatcacatccggcaatgccatccttaacaatatggggatgttgttcgcaattgggttagcctatggcatgtcgaaggataaagatggcgctgctgcactggcaggtttaatcgggtttattgtcgtcataaacctgtgtgctcccgcgtctatcgcaatgattaaaagtatgccgattgatgaagtaccaaaagcattcgggaagatcaataaccagtttgtcgggattttggttggggtactttctgctgaactgtacaaccgctacagtagcgtcgagttaccacaggcgctgtcattctttagtggtcgccgtttagtacctatcttaaattctttcctgatgattttggtatcttttatcctgatgttcatttggccggtagtttatgactggctggtggcatttggtgaaagcatcatgaatcttgggtcatcaggggcgggtctttatgcattctttaaccgtctgttgatacccgttggtctgcatcatgcacttaactcagtattctggtttgatgttgccggcatcaatgatattcctaacttcctcggtggtcagaaatcgattgaggctggtacggccattacgggtatcaccgggcgttatcaggcaggtttcttccccattatgatgtttggattaccgggagccgcattggcgatttaccactgcgcacgtcctgaaaacaaagctaaagttgctggtatcatgatggcaggcgctattgcggctttcttcacgggggtgactgagccacttgaattctctttcatgtttgtcgcacctgtgctttatgttttgcacgccattttaacggggatttctgtttatatcgcggccacaatggagtggattgcaggtttcggttttagtgccggattcgtcgacatgttgctctcctcgcgcaacccgctggcggttaagtggtacatgctgatcccacaaggtttggtattcttctgcctttactatgttgtattccgtttcaccatcaaaaaattcaacctgatgacaccggggcgtgaattatcagccacggatgaaaccgatggttatgatgttgatacggcaaaacaaggaaagaatgtagtaaataacattcaggaagaagcacgtcagtacattgccgcagtagggggatctgataatttgacagggattgattcctgtatcagccgtttacgtttatcagtcaaagactcaggattggtcaataatagactgaccagacatcttggtgcctcgggaattatccgtctgaataaacagaacgcccaaatcatagttggaacccgcgcagagttgattgccagtgccatgaaagaagtattggcaaaaggcccggtagcggcaatcacagaaactcaatactctgagtctgatgttcagacaaaggaagatagccagcaaacaggcattccaatcttgactttaatcgctcctgttacaggggaattggtcaaactggaagatgtccctgatgaagccttttccagcaagttggtaggggatggtattgcgattaagccgacgtcggacactgttttagctcccattgacggtacggtcgtgaaaattttcgatactaatcatgcagtatgtattgcggcagataatggtgttgaagtcattgttcatataggtattgataccgtcactcttaatggcagagggtttgagcgtctgattgaagaaggtgtgaaagttaaagcgggtgagccgctattgaagctggatcttgattacttgaacacccatgctaaatcgatgatcagtcctgtgattatcagcaatattgatgattattttggcattagaatgattgcgaaagatgctgttgttgctaaagaatcagatttatttcaggtgatataa

SEQ ID NO: 239 - DNA, 852 bp, Xenorhabdus bovienii
  Coding DNA location: Contig name=SeqID_16836; Position on contig =6345..7196bp; Strand=+
atgtctgaatttctttctgaagaaaaaatggggcagtatttaaaaagctgggatgataacggttatatagttatagaatcagcggttagtagagagcaaacccagaaaacagtcgatgctatattctattttttggaaatggataaaaatgatcccgttaatttttataacaccgatatccgttctcgctcaggaattgatgaaatggggcgtattcctttttatcatcatcagaccttgtgggataatcggcaaagtcaaataatttactctgtatatgaaagaatttttggtataaaagaactattggtgagtattgatagggtcaatatgaatccccctgttaatgatgattggaaatacgaaggttttattcattgggatattgatgtttcaaaacgcccgttagagagtaaaatacaaggcctattgagcctaactgacgatgatggcaattctggtggatttcaatgtgtaccggggtttcataaagtaatctatgaatggctgtcgaaacaaccggaaggatataatagccgattccctgatacgacaggaatgaaaattgtatctatcccattgaaagccggggattatgttatctttcatggcgcgctgcctcatggaaataaacctaatatttcggataatccaagattagctcaatatttttgttgttttccacggactgatcttactgagcagcaaatcgcagaacgaattgctgcttataaacaaggattaccgactacatctataacgggtaaacttttcccggttaaaaaagttaatcaacaaggtacatccagcataaatttaacagagctgggtgaattattgttggggagttag

SEQ ID NO: 240 - DNA, 747 bp, Xenorhabdus bovienii
  Coding DNA location: Contig name=SeqID_16836; Position on contig =7232..7978bp; Strand=+
atgcatcacggagtgaataatattgatgtttcaattattcttcctaggtataatgaaagttatttagttatagaaaaaaccatacagcgcattaagaatattcaagaggtattgaaagtacaggtcattataattaatgattcaaataaaaataatttccatgatatagatattatcaaggtaaaaaaacagtaccctgatgttgaggttgtctctaactgtggtaactatggaaaaggatatagtataaggcgaggcgttgatttagcaaaaggaagatatattttttatactgatattgattttccaataaaggagagtgatttttttagtgcttatcaaaaaattgaaacttctaatgttgatttaattattggggagcgattctcaaagaataaatcaaaagcgaatttatatagaaaaataaccagtaagttttttttgaaaattgttaatttactattaaactgtaaagtttctgattctcagtgcccatttaagatgttaaggtctgatgtagcaaaggaagtattttctaagcaaaagattaaggggtatgcatttgatgctgaaattatttaccttacaaatagactctctaagaaactatatcaattccctgttatttgggaggatacaagagagaactggagttttatgaggacgtttattaattatagtattatgattttaggaattttctctattaaaatttattggattatcaatgatcctaaaattatctga

SEQ ID NO: 241 - DNA, 666 bp, Xenorhabdus bovienii
  Coding DNA location: Contig name=SeqID_16836; Position on contig =8120..8785bp; Strand=+
atgaagtctggaggagtaatggagatttttaacataaaagccattttatttgatatggatggcactttagttcaatcactttcagaagttgaagttgtttggtctaaatggtgcgaaatgcacaacatatctatcaaagatgtattagatatttgccatggtgttcgctccaaggatgttattttatccattgctccatatttgaatgtggaagaacaaattaagttattagatgatttagaaattaaatattctgctactgccaaggcgttaccgggggcaaaagaatttctgctgtctttaggcacttgtccgtggtctgtcgtcacttctgccagccaacgagttgcatatcataggatggcgatttgtggtcttaagataccagacttcataattggttctgatgatgtgctgaatggcaagccctatcctgatccctatcttatggcagcagaacgtttgaatattgcggctgaagattgtttagtttttgaagatgctcatgctggggtgcaaagcgcattagcagcagagtgtaaggtcatacagattggtggaaaagaaaaaatgtttgattcagttataggtctaattaatgactggaatgaaattaagattgctgagatgggaattaattctttcagagtcagtatgaacttataa

SEQ ID NO: 242 - DNA, 1125 bp, Xenorhabdus bovienii
  Coding DNA location: Contig name=SeqID_16836; Position on contig =8874..9998bp; Strand=+
atgaataatgttatttctactagagttgttttcttggcagcaggtatgggaattgctgcgtgggctcctcttatacccttggtaaaggctgatttaaatattgatgcaggagagttaggttttttattactttttcttggtttcggttcaattgtttcgatgccgattacaggatttcttaccactttatttggttgtcgtaaggttattatatcttcaggaatttttgctattgtttctttaccgattttaatattggcgcctaatgtcactcaactgggttttatgctttttatatttggtgcatccattggtacagtggatgttgcaatgaatattcaggcggttgaggtcgaaaaaaatacaaatagaaatttaatgtcaggatttcatggattttttagtttaggggggatctttggtgctgctggtgtatctatattactttatttgaatttctcagcgcttgcagcatgcttaattatatcctttatattgtctgtgttatttttgttttctttttctggactcattagtcgtcataaaaatcatggggatagcgatagtaaaaaaattgtttttcctcggggaatcattattgtagcgagtttgctttgttttttaatgggaattattgaaggttctgtaattgactggagtggagtatttttagttagtgagcgtaatattgatatttcattcagtggatttgggtatgctgcctttgcagcagcgatgacaataggacgattcatgggagatcgggttatatcaaaaataggaagggggaaagtattttttgctggtacactcagtatcttcattggatttcttatcgttgttaatgtaggaactctcaatctatctatgattgggtttttctttattgggttgggatcatcaaatattgttccaatcttatgttcaatatctggaactcaaaaagtcatgttgcctagccatgctgtcgcttctattgtcacatttgggtattttggaattatgattgggccagctttaatagggtttattgcccagagttctggtctggagacagcattttatatattagctattggtgcattaattatggtagcaaatacaaaattgataaagaaacattga

SEQ ID NO: 243 - DNA, 1230 bp, Xenorhabdus bovienii
  Coding DNA location: Contig name=SeqID_16836; Position on contig =10078..11307bp; Strand=+
atgaatttcccacaatggccaagttttacagaaaaaacactgaaagatattcaagaacccctgttatctggtcaagtaaattactggactggaaaaaaaggcatggaatttgaaaataaatttgcgcattggattggcgcagaaatggcaatttcatgtaattccgggacttctgccgtaaatattgctgttggcgcattaaatattggccccggcgatgaagttatcgtgccttcttacactttcattgcaacctcctttgctgttttacaatgcggtgccattcctgttttttgtgatacgacagaagagcacaccattgatcccacgaagatagaagcactgattacaccgcgcacgaaagcaattattgttgtgcatctttatggtgtcgtatctgatatggatccaatcatggagattgcccgccagcataacctcaaagtgatcgaagatagcgcacaatgtctcggcggaaaatataaaggaaaatcggctggcacaattggggatatcggtacgtttagcttctgccagtcaaaacattttactacagggggagagggcggcatggtcgtgaccaacaatactgaaataggttgggaatgccgggcttatcgtgatcatgggtttgatgtgagaagaaaatttgaccttctcgctttagaagaagtttcgtggcatgtgcataatcgaatcggttacaattaccgtatgactgaaattcaatcgattatcggtctgaacgagttagagcgatttgatgattggaatatgaacaatcgcaagcgatatgcgaagatctacgatgaaaaatttgcggatatcgacttgatccacggcctgccattgaataatgaagacagatgcaatgcgtactggttatatcccattgtttttgatcttgccaaactggattgtacggctgaaatcatcctgagtgatttgaaaaagatagggattccggcatttaaaatccagtggcctgaagcctatggcgaaaaagtattcagagagctacgtgggtttggttcagctaatttcccttttcattcgaaagaatacacatcacctgaatctgttaattaccgtgatgtcgtctgtgaaactgcacgttctttattgccgagaacaatcagcctgtatctgcaccctacttgggatgaagagcatattgtttattgtgcggatcaactgatcgccgtattgaacagtcatcgtgtgagttga

SEQ ID NO: 244 - DNA, 1668 bp, Xenorhabdus bovienii
  Coding DNA location: Contig name=SeqID_16836; Position on contig =11545..13212bp; Strand=+
atgagtgaggcagatgcccgcccgaccaactttattcgtcagattattgacgaagatctggcaaccggtaaacatacatccgtacatacccgtttcccgcctgaacctaacggctatctgcatatcggccatgcgaagtcgatctgcctgaatttcggcatcgcgcaagactatcaggggcaatgcaacctgcgttttgacgatacaaacccggttaaggaagatatcgaatatgttgaatccattaaaacggacgtacagtggctgggtttccagtggagtgacaatattcgctactcttctgactatttcgatacgctgcatcaatacgccattgaattgatcaataaagatttggcctatgtggatgaactcagccctgaacagatccgcgaataccgtggaacgctgaaagagccgggcaaaaacagtccttaccgtgatcgcagtgtggaagaaaacctggctctgtttgaaaaaatgcgtgccggtgaatttgctgaaggtaaagcgtgtctgcgtgccaaaattgatatggcatctccattcatcgtgatgcgtgatccggtgatttatcgcatcaaatttgccgagcatcaccagtccggcaataaatggtgcatctacccgatgtacgattttacccactgtatttccgatgcgctggaagggatcacccattcaatatgtacattggagttccaggataaccgtcgcctgtatgactgggtattggataacattacgattgcctgtcatccgcgtcagtacgagttttctcgcctgaatctggaatacacggtgatgtccaagcgtaaactcaaccaattggtgaccgaaaatattgtcaatggttgggatgatccacgtatgccaaccatttccggcctgcgccgccgtggttataccgctgcggctatccgtgaattctgccgccgtattggtgttaccaaacaggataacaacgtcgaaatagccgcattggaatcttgtatccgggatgatttgaacgaaaattcaccacgggcgatggcggttcttgatccggttaaactggtgattgagaatatgccggaaggtgaagtgatcctgacgatgccgaaccatcctaacaagccagaaatgggcagccgcgaagtcccattcagccgtgaggtttatattgaccgtgccgatttccgcgaagaagctaaccgtcagtacaaacgtctggtgctcggcaaagaagtgcgcctgcgtaatgcttatgtgattaaggcagagcgtgttgaaaaagatgcggaaggcaatatcactaccatttactgccactatgatgagcagacactgaacaaagatccggctgacggccgcaaggtcaaaggtgtgattcactgggtgagtgcggtacatgccgtgccagcggaattctatttgtatgaccgtttgttcagtgtgccaaacccaggggcggaagatgatttcctatccactatcaattcagaatcgttggtcgtgcgtaaaggttttgtcgagccagggctggtgaatgcacagccagaaagaacttatcagttcgaacgtgaaggttatttctgtgctgatagcggcctctccagtgcagaacatctggtatttaaccgcacagttggcttgcgtgatacttggacaaagatctctcaggaataa

SEQ ID NO: 245 - DNA, 2682 bp, Xenorhabdus bovienii
  Coding DNA location: Contig name=SeqID_16836; Position on contig =13582..16263bp; Strand=+
atgaaaagcgttaaattgcgtaccttggcagcactcatcacgacagttggattaatgggctgtgttcatgcagaaatgacgtcacagcagatagtggattcgcttagtcaattaaaagtgaatttcaaaattaaggataatcaagcaggagcacatggaactgattgtgccattttaggcgcggacggagcttcctgtaatcgggttcatatcacattagctaatggcaatcaggcgatcgactcttctgactgggcgatctattttcacaatattcgccagatcctgaaagtcgatcatgagcaatacaaaatcacgcatatcacgggtgacttacataagctggagccgacggaaaaattcacaggtatcaaggccaatgaaaaaatcttgttaccgatctttggagaatactggcagatttacagtacagattttatgccacgctggtatgccacttccggcgatgcgatgcctaaaatactggcgaataccgatacggaagatctgagtgcgtttttatctgattttacaggtgatcagtggaaacgtactacgtcagataacaatatccagatgactccggaaactcgttttgtaaaaaaccagcagatggtaaaaatcagcgaggataaactgcgtggacaggttattccgacgcccaaaatgctgactatccattcacaagatgtgaacctatcccgtggtgtgaaactggagttgggtgggttgagcaacgcatcaatcgacgttattcgagaacgctttgcctctcacaatatcaagctaacggataatggttatcggattgcggcacagatcaacgcaaacaaatttacgggcaactggcgagtacaaggagcttattcgctgaatatcacaactcaaggaacgcaaatcgtcgcttttgatcaatccggtgtgttttatggcctgcaatcattgttatctctgctccctgccaatggtgatcctaccattgccacactaacggcaaaagacgcgcctaggttcgaatatcgaggcatatttttggatgttgggcgtaacttccacagtaaggaagctgtcctgcgtctgctcgatcaaatgtccagttataaactgaacaaattccatttccacttgagcgatgatgagggctggcgtctggaaatccccggtctgccggagctgactgaagtcgggagcaaacgctgccatgatctgagtgaaactcaatgtttgttgccgcaattaggatcagggcctgatagcaataatatgggaagtggctattttagtcgtcaggattacattgatatcttgaaatatgccaaagcgcgccagatagaagtgatccccgagattgatacccctgctcacgctcgtgcagcggtcgtgtcgatggaagctcgttacaaaaatctgatggcgcaggggaaagagcaggaagccaatgaatatcgcctgcttgacccgactgataccacgaatgcgacatcagtacagctttacgatcgccgcagttatttaaatccgtgcatggattcctccaagcggtttgttgacaaaattatcagcgaaatcgctttaatgcacaaagaagcggaattgccgttgaagacatggcattttggtggtgatgaagcgaaaaacattcgtctgggggcggggtatcaggacaaagatggtccaatcgaaccgggcaaggggattatcaacaagaaaatagaagacaaaccatgggcaaaatctcaggcttgccagaaaatgatagcgcagggcattgttaaagatgttaatgaacttgacagccattttgctattgaagtcagcaagatcgtcaatactcatggtattgatacaatgcaggcatggcaggatggcttgaaacatgtgaagtcggcaaaagatttcgccaccaagcatgtggcagtgaatttctgggatacactttattggggaggctatgactccgccaatgattgggcgaataagggctatcgagtggtcgtttccagccctgattatgtctaccttgatatgccgtatgaagttagtccgaaagagcgcggctactattgggcaactcgcttcaatgatgaagcaaaaattttcagttttgcaccgaacaatatgccacaaaacgctgaaacatcggtggatcgcgatggcaaccacttcaatacccagagcaacaaacattggccgggggcttatgggctgtcagggcaatcatggagcgaaactatgcgcactgatgatcagatggaatacatgatttacccgcgcttgttgccgttggcggaacgtgcatggcaccaggcgagttgggaacagaattatcagcagggcagagaatacaagggtggggtaacacattatgttgataccaatgcgctcaacaatgactggatagattttgccaatttgatgggacaacatgaactggcgaaattggataaagctaacattgcgtatcggttgccagtacctgggggaaggattgtatccgggacgttggaagctaatatcgccttgccggggctagggattcagtattcgctggatggcggtaaaacatgggagatttacgatgacaggcagcgcccacatgtcagcagtaatgtgaaagtgcgctctgtcagtactgatggcaagcgttttagccgagatgaagaagtaaaaatcacgctctga

SEQ ID NO: 246 - DNA, 450 bp, Xenorhabdus bovienii
  Coding DNA location: Contig name=SeqID_16836; Position on contig =16384..16833bp; Strand=-
atgaccgacaacaataaagcattgaaaaatgctggacttaaagtaacacttccacgcctgaaaattctggaagtgctacaggatccagaatgccatcatgtcagtgcggaagatctctacaaaaaactgattgatatcggtgaagagattggcctcgccactgtctatcgcgtgttgaaccagttcgatgatgccggcattgtcacacgccacaattttgaaggcggtaagtcggtttttgaactcactcaacagcatcaccatgaccatctgatttgccttgactgcggtaaagtcattgagttcagtgatgagtttattgaagagcgccagaaagatatcgctgaacgttacgggatcaagctgtcaaaccatagtctctacttgtatggtcactgtactgctggtgattgccgcaaagatagcacgatgcatgatgaaaactcatga

SEQ ID NO: 247 - DNA, 315 bp, Xenorhabdus bovienii
  Coding DNA location: Contig name=SeqID_16837; Position on contig =1..315bp; Strand=+
aaaaaaaatgataagttaatatctgtagatgttgagggagttaaatctatttttgatgataaaaaattccctatatatacgttatttcacagctatatagtaggggtagaagttcttatatttagaaaagaattttttggtgaagaatcatcctcaatatatcatggaaaaacagatagaataataaaaatatgccaaaaaatgtccatatctattgaaaataatatctcttatttttcgaataaatcaatatatatttttaaaaaatcaaaagaattgataaataaacttactgatgaagagataataaaatga

SEQ ID NO: 248 - DNA, 798 bp, Xenorhabdus bovienii
  Coding DNA location: Contig name=SeqID_16837; Position on contig =312..1109bp; Strand=+
atgacgtataagaatttcgttttatttaatgatattaaagaaataattaactccaaagaatacaattcagatataacatgcaacaataacattattaactatatacataaaaataaaatcactaaaaatatcaaagatgaaatatattataaagtatctttgaatggtgatatatatataattgaatttaatgaagaagatactatagatgaagctgtcattttacttgaagggatttttggttatcctcttacttataagaatagaaacaataaaaaatatgaggtcataaaaaacagtaaaaatccaaaatggttttttgaatcaaattattcacaaccagtacatacagatgaaggtcatgaaaaaaaacaaccaagtatacttgcactctattgtaaaacaatatcaaaaatcggaggaaataatatattggttgatacaaaatccatttataattttttattaaataaatatggttataaagtagaaatattattcaacaataaatgcattaacttaattaacaaaaatgaaaacttaacaaaaagcatactctcaacaataaaagaaaatattggaatatcattttctccattgatcaataattttaaatgcactcaagaagtttatgctatgctgaaagatataaataaattcatacatgataaggaaaatcagtatcgatttaagttaaaaaaaaatcagtgtgttattttcagtaattatctctacttgcattccaggactgagtttccaaaagactcaaatagaacattatataggatttggttttag

SEQ ID NO: 249 - DNA, 114 bp, Xenorhabdus bovienii
  Coding DNA location: Contig name=SeqID_16837; Position on contig =1449..1562bp; Strand=-
atgcaagaaaatgaagtaactaaaaataacactgatgtaatatggtctatgctacttttatcgttagataataatccaataaaaaagaaaatagatagcggaacagcactgtaa

SEQ ID NO: 250 - DNA, 582 bp, Xenorhabdus bovienii
  Coding DNA location: Contig name=SeqID_16837; Position on contig =1660..2241bp; Strand=+
atggcttatactgccattatcttattggtggctttgaatttgtttatcagaactaacgataatataagtcaccgaataacagaaaaatcttttttgccttcatttcttttatccccttactttataaatttattatactttataaaaaacaaaaaaatattcaccataaatttaattatctcagtgatactctcctatctggtttgctatattgcttatcagcaaacacccgatagaataatctatataacaataatatatctcagttttacactttatatattcaccctatttttctacaatatcattcacatagaaattaaacacctatcttatcttgttaatttctcatcaaaaagaaaatttattttcattaattacactctgtgtcttttattatttataatatgtggcctgtattatattataatgaccaaatcaactgcgatattaattttttattattcaggaatttactctttaacagcactaataaatttatcaagatcgcaatatacaaaattaatcaccctgtgtgttattgttttattttcttgtttaggaggatatatttatgcttaa

SEQ ID NO: 251 - DNA, 249 bp, Xenorhabdus bovienii
  Coding DNA location: Contig name=SeqID_16837; Position on contig =2614..2862bp; Strand=+
atgtcactgggaaccaaaaagaaactattactgacatcagcattaatgactgatgtcgatgtttacattttagatgaacccaccaatggccttgatgtgacatcaattagttttctaaaagaaaaattcaattctcttgctgaccagaaaattatcattttcagttcacatgacgaaaatttcttaaaagatctcaacatacatgattataaaatacatgaaaaccgtatttccaaaacgggaagttag

SEQ ID NO: 252 - DNA, 2136 bp, Xenorhabdus bovienii
  Coding DNA location: Contig name=SeqID_16837; Position on contig =2897..5032bp; Strand=-
atggcactttccagttcaataaaaaatcagattagccaatggtataaggcattatccatccatattgatggcttcattccacgcgagcctcagcgtcagatgattgcagaggttgcaaagacactggcagatgaagagggacgacatttggtgatagaagccccgaccggggtcggtaaaacgctgtcttacctgatcccaggtattgccgtcagtcgggcggaaaaaaagccgctagtggtcagtacagccaatgttgctttgcaagatcagatttacagcaaagatttgccgttgttacgcaagctcatccctgacctgaaattcaccggggcttttggccgtgcgcggtatgtttgcccccgcaatttggaagctatctgtgctgcggagggggagcagattgatctgatgcttttggtcgaagacaaaactgaaatcgccaatagtgaagagcgggaactgtgccgtaggctgcgcagtgattacaccacttttgcctgggatggtctgcgtgaccatcatcaactggcgttatcggattcgctgtgggcaaagatcagcaccgataaaatgaattgtttggcgagaaattgccagttttaccatcgttgcccatttttccttgcccgtcgggaaattgaaaatgcggatgttgttgttgccaatcattctctggtcatagctgcactggaaaatgaatccgttttgccggacgcgaaaaacctgttgctgattttggatgaagggcatcatattcctgatgttgcaagggattcgctggaagttgaaggcgaaatcacgttatttcaacttaatgggcagttggatacctttgttcgccatgtagagcaatacttgcttcaatttcgcccggccaaaccgccagctttggcaaatatcacccgtttgcaggcgcattgtgaaaaaattcgtgaatgttttaaggagctggcggatatcacacaggtattattgcccgaacgccgtgaagcagcagaatatttatttgaactgggaaaattacctgaaaatttgctgttatgctgccagcaattattcaaacttactgatgggttgcgtggcctgtctgaagcgattttaaatgatcttaccgatcaaacagccaaacaagatattgtcaggttgcatcatgctattctgcaaaccagccgaacatcgggttactttgagaatatggtgaaactgtggcgtttagcatcacaggaagaatcttcccatgcaccaatatcgaaatggctcactcgccgttatgagaaaaaccaatcgcatctttattttcactgtgcaggcattcgagtcagcgagcaattaacgcagttgttatggcgtaatattccccatgttgtggtgacatcagcgacattacgttctctaaatagcttctctcgtattcaggagctgactgggctgcatgaaaattatgatgatcgctttatcaccttgtcatctcctttcgaacatgtacgccagggacgtattattattccccagatgacgcaggaacccactattcaaaatgaaatgcagcatcttgaagaaatggcgcgttattttcgttcgcaggtactgatgggagcctatcggggaatgttggtgctatttagtagccagcgtgcaatggaaggttttctcactttcgtgaaagaattgcggcttatgttattggtgcaaggtgatcagccgcgctatcgattggtggaaactcattgcagacgtattgatgaagggcagcccagcgtgttgattggattgcagtcattcgcggaaggactggacttgaaaggtgattatctttcacaagtacatatccataaaatagcttttcctcctgtgaccaatccggtcatcattacggaaagtgaatggctgaaatccctaaagcgatacccttttgaagtacaaagtttgccgagtgcgtctttcagccttattcagcaagtgggaagattgatccgcagtcatgaatgttatggtgaggtggtgatttatgaccggcgcctactgagcaaaagttatggttcccgtctgttgaatgctttaccggtatttcctattgagcaaccggatgtgccgtcagaagatgaattactgcaaatgaaaaaaggtcaataa

SEQ ID NO: 253 - DNA, 156 bp, Xenorhabdus bovienii
  Coding DNA location: Contig name=SeqID_16837; Position on contig =5314..5469bp; Strand=+
atgaaaaaaatcctgcttattatcatcgtgttattttccctcggctctattggcggtgtctttttggcagggctgaatatgtacactcgctcaacaactccggtagaagagccacagcagtcacagcaggaaaacgccccgatagggcaacaataa

SEQ ID NO: 254 - DNA, 840 bp, Xenorhabdus bovienii
  Coding DNA location: Contig name=SeqID_16837; Position on contig =5530..6369bp; Strand=+
atgaaaaatgaatattttgttagtccgcaatggttaaacgaccatctccatgatgagaatgtcgtcattgttgacgccagcgcccccatgcctacccaaactatcgattatcaccagttatggctagataaccatattccgggtgcccagttttttaacctggataaaatcgccaatctccagactaacctgccacatatgctgccagaaccggagattttccgtcaggccgttagcgcgatggggatcagtgaaaaccatctggtgataatttacgatcaggggaatatgttctctgccccacgagcatggtggactttcaagatctttggcactcgcaatatccgtatccttgaagggggtttacagggctggcagcaagtgggttattcaacggaatcaggtgaagttacccgtcagccccaaattttcaatagccaattcacccctgaaaaagtctgttctcaggaacagatccttgatgctctccataataaagcgccaatacagtttattgatgccagagccgaagaccgttttcaagctaaagtaccagaacctcgccccggtttgagaatggggcatatccccggctcaaaaaatgtcccgtggacagcattgattgataatggaagttataagtcaccagacgaaattgcagctatattcaaaaagcaaggcgttgatttaaaacagccaatgatgactagctgtggttctggaatgacagccgcagttttagtattagggctggatatgattggtcacaaagaagtgggattatacgatggctcttgggcagaatggggtgccgatgattctcttccgttagaaaaatag

SEQ ID NO: 255 - DNA, 249 bp, Xenorhabdus bovienii
  Coding DNA location: Contig name=SeqID_16837; Position on contig =6448..6696bp; Strand=-
atgggtatcctgtcatgggttatctttggcttaattgctggaattattgcgaagtgggttatgccgggggataacagcagcggtatcatcatgacggtgattttaggaattattggtgcagtcgttggcggatatatcagtacattcttcggcatgggaaaagttgatggatttaatctgggaagttttgccattgcagtcgtgggtgcgatagttgtcctatttgtataccataaaatttctaattaa

SEQ ID NO: 256 - DNA, 942 bp, Xenorhabdus bovienii
  Coding DNA location: Contig name=SeqID_16837; Position on contig =7073..8014bp; Strand=-
atgcgcgttttactggccccgatggaaggtgttctggatcatctggtcagggaactgttgagtgaggtcaacgattatgacctctgtatcacggaatttctacgtgtggtggacagtctgctgccggtgaaatccttttaccggttgtgtcctgaactggagcaccagagccggacaccatcaggaacacccgtcagggtgcagcttctggggcaatatccagaatggctggccgaaaatgctgtcagggcagttgaattgggctcatggggcgttgatttaaactgcggctgcccttctaaaaccgtaaatggtagcggtgggggggccacattattgaaagatcctgaactcatctaccgtggtgccaaagcgatgcgggacgcggtacctgaagagttaccggttacggtaaaagtgcgtctgggatgggataccggtgatcataagtttgaaattgcggatgccgttcagcaggcgggtgcgaccgaactggtggtgcatgggcgtactaaagaagatggctataaagcagaacgcatagactggcaggcgattggtgaaatccggcgtcgcctcgccattccagtgattgctaacggtgaaatctgggattggcacagtgctcaggagtgcatgaaggtgacgggatgtgatgcggtgatgataggccgtggcgcactgaatgtgccaaacttgagtcgtgttattaaatataacgaaccaagactgccgtggaatggtgtgcttcagttattgcaaaaatatacttatctggaaaagcggggtaatacaggcatgtatcacgttgcccgcatcaagcagtggcttggctatctacgtaaagagtatgatgaagccgatgagttatttatgcagattagagcattgaaaacgtctgctgctatctcaaatattatctcttcagctgcagaagcatga

SEQ ID NO: 257 - DNA, 1359 bp, Xenorhabdus bovienii
  Coding DNA location: Contig name=SeqID_16837; Position on contig =8035..9393bp; Strand=-
atgaattttgagtcactcggcttgaaggctgatattttacgtgccgttgaagaacaaggttacgtggaacccacccctattcagcagcaagccatacctgttgtgttgtccggtaaagatcttttggctagtgcccagacgggaacggggaaaacggcagggtttactttgccaattttgcaattactgagtgaatctccggctcaggcaaaaggtcgtcgtccggtcagggcgctgattttgacaccgacccgtgagctggcggctcaagtgggtgaaaatgtatgcaattacagtaaatatctcagattgcgttcactggttgtatttggtggtgtcagcattaatccacaaatgatgaaattacgtggtggtgtcgatattctcgtggcaactccggggcgtctgttggatttagaacaccagaatgcggtggacttatcccatgttgaaatccttattttggatgaagccgaccgcatgttggacatgggctttattcatgacattcgtcgggtattgagcaaattgcccgcaaaacgccagaatttactgttttcggcgaccttttccgatgatatcaagagccttgccaataaactgctgcgtgatccggtgagcatagaagttgcccgtcgtaattcggcttctgaacaaatcgatcaagctgttcattttgtggataaaaaacgtaagggagaattgctctctcatatgataggcaaccagaactggcagcaagtattggtctttacccgcaccaaacatggtgcaaaccgtctggcggaacagctcagtcaagatggtgtcactgctgccgcgattcatggtaataaaagccagggtgccagaacccgtgcgctggccgatttcaagtcaggccggatacgcgcgctggtggcgacagatattgctgcccgtggattggatatcgatcagctgccccacgtcgttaactttgaattgcctaatgttgcggaagattacgtacatcgtattggtcgtactggccgtgcggaagcgacaggacaggcaatatcgctggtttgtgtcgatgagcacaaactcctgcacgatattgaacgactgctgaagcgtgaaattccacgtattgcgatttcgggttatgaccctgatccttccattaaagctgagcccattctgaacggaagtaattcccgtggcagtcagcgtggcaacggcagacaaagcccttccaatcagggtagtactaagccgagccgttccagccagaaccgttctagccaaggcagtgccaaacaaaacagtgatcgtccgcgtagtaaaggtgcaccatcgcgacagggctggccgcgtacttcatccaaagcaaactag

SEQ ID NO: 258 - DNA, 678 bp, Xenorhabdus bovienii
  Coding DNA location: Contig name=SeqID_16837; Position on contig =9769..10446bp; Strand=+
atggcagctaaaacgactcaaacatcgcgaggcgaacaggccaaacagcaacttattgaatcagcgatagaaattttcgggaagtccggtctggaaggagcgaccacccgtaatattgcccagcacgcaaaacagaatatcgccgctatttcttattatttcggctctaaagaagggctataccttgctgtcgcacaatttattgccgataagctaaaatcggaattttccccactcgttgaagcaattgaccgtttttttgtcgaaacttctcagccttatccacaagcgcagatactggcatttatccatgaaggaatgacgaggtataactgtctgattttcgaaacaagcagcatcaatctcagccgaatcatgtcacatgagcagttgacgcccacagcggcttacagcgttatccatgagcaggggcttgccccggtttattcccgtctgaataaactcatcgccaattatatcggcgcggatgaatgccagatttcaacacagatccacacacatgccctgttgggggaaattctttctttccgtctggcacgagaagcgttactacgccaaacgggttgggacaatcttggcaccaaagaatacgaattaatcaatcaagtgttatctcaacacatcactttattgcttaacgggttacggcagaagtaa

SEQ ID NO: 259 - DNA, 993 bp, Xenorhabdus bovienii
  Coding DNA location: Contig name=SeqID_16837; Position on contig =10504..11496bp; Strand=+
atgaacagtaaaaagtttgctcttttcctattagcgatcatcgttgttatcggagctattgtcggaattgattattatcaggaacaaaatgacaaggaattaatgctgtatggcaatgttgatgtcagaaccgtcaatcttggctttcgagtcgcgggtaagctggcagccttgcaagtagatgaaggcgatgcaatcactgcgggtcaggcactcggccaactcgacaatgcccccttcatcaatgccctgaaccaggcgaaagcaacccgtgacgccgccaaagcaactcttgccaaaaccgaagccggttatcgcactgaagaaattgctcaagtacgtgccgagaccacgcaaaaagaatccgcattccgcttcgctgatagcttcctgaaacgtcaacaggggttatggcaacgtaaaatgatttccgataacgagctggacaatgccaaaaccggccaacatcagacgctggcggcctatcaagcggcaaaagataagttacgtcagtttgaggcgggttatcgtaaagaggaaattgccgccgccaaagcgcaactggcacaagcagaagctgccgtggcacaggcagagcttaattcacaggatacgcaactgacttcaccgtcagcgggtgtcattcttacccgagccatcgaacccggcacgatgctggcagccggaaacaccgtctttacactctcgctgaccaaacctgtctggatcagagcgtatattgatgaacccaatctgaatcaagcgatagcagggcgcgaaatccaaatttataccgatgggcggaaaaatcagccctatcacggcaaaatcggctttgtttctccaacggctgaattcacgcccaaaaatgtcgaaacacctgacttaagaaccgatttggtctatcggctgcgcattattgtcaacgatcccgatgaagggctaaaacagggaatgcctgtcactctgcgttttactaattcaaataagtaa

SEQ ID NO: 260 - DNA, 1737 bp, Xenorhabdus bovienii
  Coding DNA location: Contig name=SeqID_16837; Position on contig =11506..13242bp; Strand=+
atgaccagttcggcttacacgataatactgaacggcgtagagaaaacgtttccagggttggaaattcctgccgtatcgcacttgaatgcagaaattcaagggggatcagtcaccggtcttgtcgggccggacggtgctggaaaaaccacgctgattcggatgctggcagggctattgaagcccaataacggcaatattaaaatcatggggcttgatcccatcaaagacagcgttgaagtgcgttctgaactgggctatatgccgcagaagttcggtctgtatgaagatttaaccgtgctggaaaatctcaatttatacgcagagctgcggggtgtgcttcgcgaagagcgcaaggccacttttcaaaaactactgactttcacagatttaacccatttcaccgggcggctggcgggaaaattgtccggaggcatgaaacagaaactggggcttgcctgtacgctattgggaagcccgaaagttttgctgcttgatgagccgggagtgggtgttgatcccattgcccgtcaggaattatggcagatggtgcacgaactcgcttccgacggaatgttgattctgtggagcacgtcttatttagatgaagcagagctgtgccgtgatgttttactgctgaaccgtggtgaattgctctatcgcggtcagccgcagaaattgacccagaatattgtcggacgatcttttctactcgatgtcaaacaaggttcccgccgtaaaatcctgcaacatgcgcttacgctgccacaagtgacggatggagtgattcagggaagatctgtgcgtctgatcttaaaagctggtgtagaccaaagcgatctactccagcaaatagggctgcctgatgccaagctatttgacgccgaacctcgcttcgaagatgcctttatcgatctactgggtggcggcccttcccatcgctctgcactggcagaaatcatgccgcagataccgaccaatccgacggaaaccgttatagaagcccgtagcctgaccaaaaaatttggtgattttgcagcaactgatcatgtggattttcaggtgaagcgcggggaaatttttggcttgctcgggcctaatggtgctggaaaatcgacaaccttcaagatgatgtgtgggctgatcatccccacttcgggcaatgcgctggttctggatatggatttaaaaaccagttcaggcaaagctcgccagcgtctcggttatatggcacagaaattttccctctatggcaatctgaccgttgcacagaatcttaagttcttctccggtgtttacgggctgaaaggccgccatcagcgggagaaaatggctgatatggtcaatgcctttaatctcgaaccgatcttgcatcaaaccaccgacagccttccgctcggctttaaacagcgtcttgcccttgcctgcgccttgatgcacgaacccgatattctgtttttggatgagccaacgtcgggcgtcgatccactgactcgccgcgagttttggctacatatcaacggaatggtagataaaggtgttaccgtgatggtgaccacccactttatggatgaggcagagtattgtgatcgtatcgggctggtatttcggggaaaattgatcgccgcagggacacctgatgagctgaaacagttggtcactactcctgagcgtcccaatccttcaatggaagagacctttatcgatcttgtggtgaattatgataaggagccgcaatga

SEQ ID NO: 261 - DNA, 1176 bp, Xenorhabdus bovienii
  Coding DNA location: Contig name=SeqID_16837; Position on contig =13239..14414bp; Strand=+
atgagtcatcctgaacgcattcgccctgaatatcagggatcccataaagctgtcagtttttcatggcgtcggttaaaagcactgtgcattaaggagagcaaacaaattgtccgcgatcccagcagtgccttgattgcggtagttatcccgttgatgctgctgtttatctttggttatggcattaaccttgattccggcaaactgcacctcggcattctgatggaacagcaaagtgaagatgcccgtgaactcgttcatgcatttacaggctcgccctatatcgatgccactgtcagcgacaatcgccaactcttgatcaataaaatgcagatgggtggggttcgcggtatcatcgtgataccggtaaattttgatgttcagctcgcccgtattgatggttatgcccctatacaagtgatcaccgatggcagtgaacccaataccgccaattttgttcaaggctatgcgaaaggcgtctggcaaatctggttacagcaacgggggcaaaatcgcgcggtttcaacggctccactcattgacatccaaatccgttactggtttaaccccgcagccatcagccagcattttctcatccccggcgccatttcaattattatgacggtggtaggagcgatcctcacttctcttgtggtcgcccgcgaatgggaacggggaacaatggaagcactgctgtcaacccaagtcacccgaactgaattactgctcgccaaattattaccctatcaagtgctgggttctttcgtcatggtgctttgcatggtattcaccgtgtttgtactgggcattccctatcgcggctcactctggctattggcactgatttccagcctctatctcgctaccgccttgggtatgggcttgctgatttctactgtgacacgcaatcaattcaatgcagcaatgattgccctgaatgccgcttttttgcctgccattatgttatccggctttgtttttgaaatagacagtatgcccgctttcattcaggcaacgacttatgtcatccctgcccgctattttgtcagcagcttacaaacgctatttctggcgggtaacatcggcactgtgctgatcacgaatttgcttctgctgattgccagcgccatcgtttttattggcttgaccgcatggaaaacccgtcggcatctggattaa

SEQ ID NO: 262 - DNA, 1107 bp, Xenorhabdus bovienii
  Coding DNA location: Contig name=SeqID_16837; Position on contig =14427..15533bp; Strand=+
atgttttacagcctgtatacgctagtcataaaagagttgcagtctctcctgagaaatccccagacacgagccactctgattgtgccggttctctttcagatgaccctgtttccttgggcggccacgctggaggtcaagaatgccacgattgccatttataatgaggacaaggggcaggcttccattgaattaacccagcgtctggcaaaatcgaaagcatttcctgacattattttgctgaccagttcacaggaaatccgcccgacgttagataaccgcaaggcactgctattggtgcgctttccccaaaatttcagtgccaatattgccagccagacaccgacttcaattcaggttttactggatggacgcaactcaaacagcgcacaaatttccgctaattatatccagcagattgtgatgaattatcagaaggaattattaggcaattcggccagtctcaacaatagcgacttgatcattcgtaattggtataacgccaatctggattataaatggtttgtggtgccatcactggttgccatgattacgacaattggcgttttgatcgtgaccgcactttccgttgcccgtgaaagagaacagggaacactggatcaattgctggttgctccgttggcgacatggcagattttcctcggtaaggcgatccccgcattggttgtggcaaccactcaggcaagtattgttttacttatcgggacattgttttaccaaattccttttgccggttccttgctgctattttatggctgcactctggtttatggtctatcgcttgttggttttggcttacttatctccgctgtctgttcaacgcagcagcaggctttcatcggcgtgtttgtgtttatgatgccagctattctgctgtctggttatatttctcccgtcgaaaatatgcccgtttggttacaggatattacgtgggttaatcctattcggcattttactgatatcactaagcaaatttatttgaaaggtgcggatttttcggtgatttggcacagcttatggccgttattagttattaccgtgacaactggcgggatcgcttatcggttattccgtagtaaaattgcttga

SEQ ID NO: 263 - DNA, 711 bp, Xenorhabdus bovienii
  Coding DNA location: Contig name=SeqID_16837; Position on contig =15803..16513bp; Strand=-
atggaccgatatcaacgttctagtggttcgattgtccagaaagctggctctggtgtacaaacttatatggcacaagtctacggctggatgacttgtggtctgctgttaactgcgtttgttgcaggatatgtagcgaatagccctgaaatcttaaacgcaatctttagtagctctatcgtattttatggcctgatcattgcacagcttgcattggtatttgtgctgtctggcttggttcacaaaatgagcggtgcactggcgacagggctgtttatgctgtattccatgctaacgggactgacgctttccagtatttttgtgatttacacgagtggttcaattgccagcacttttgttatttcagcggcgatgtttggggcactgagtgtctatggttacaccactaagcgcagcctgagtggtttaggcagcttcctgtttatggggctgattggtatcgttctggcttctctgataaacctctggctgaaaagcccggcactgatgtgggcaatcacctatattggtgttttagtcttcgcgggtctgactgcttatgacacccagaaactgaaagaaatgggtgcggagctggatgttaacgataaagagaacctgcgcagatattccattactggcgcattgactctgtatctggacttcatcaacctgttcctgatgttgttacgtattctcggtgatcgtcgttaa

SEQ ID NO: 264 - DNA, 453 bp, Xenorhabdus bovienii
  Coding DNA location: Contig name=SeqID_16837; Position on contig =16708..17160bp; Strand=-
atggaaaacacacgagtgtgtgtccaaagggagatattcaacgttggtgatgaataccaatggctctcgcagtgcgatgatgatggcgcagtcgttacctttatgggcaaagtgcgtaatcataatctgggggatagcgtcaaggcactgacactggagcattatccgggtatgacggaaaaaatgttgcaggctatcattgacgaagctcgtcagcgctggccgctgcaacgaatcagtgtcattcatcgcatcggtgcattgtatccgggtgaggagattgtgttcgttggtgtcaccagcgctcaccgcagcatggcttttgctgcggctgaatttattatggattatttgaaaaccagagcaccattctggaaaaaggagtctctggtggaaggagagcgctgggtagcaacgcgagagagtgatcaggaagcggctgggcgctggtaa

SEQ ID NO: 265 - DNA, 246 bp, Xenorhabdus bovienii
  Coding DNA location: Contig name=SeqID_16837; Position on contig =17163..17408bp; Strand=-
atgataaaagtcctattttttgcacaggttcgtgaactggtaggggctgattcactcgaactgcctcatgaatacccaacggttgcggatcttcgtcactctctgattgagaaaggagaacgatgggcgctggcactggaggagggcaaattacttgccgcagtgaaccaatcttttgtacatgctgaacaccctttgaaggatggtgatgaagtggcttttttcccgccagttacggggggatga

SEQ ID NO: 266 - DNA, 480 bp, Xenorhabdus bovienii
  Coding DNA location: Contig name=SeqID_16837; Position on contig =17405..17884bp; Strand=-
atgtcccaactgacccatatcaatactgcgggtgaagcccatatggtggatatttctgccaaagcggaaaccgtgcgagaggcacgggcagaagcctttgttgaaatgcaggcggaaacgctggccatgattgttgctggtgatcaccataaaggcgatgtttttgcgactgcccgtattgcggggattcaggcagcgaagcgaacttgggaattgatcccactgtgccatccgctgctgctgagtaaagttgaagtacaactagaagcacaagccgaacatcatcgtgtcagaatcgaatcctgctgccgcctgacggggaaaaccggcgtggaaatggaagccttgaccgctgcttctgtggcggctttgacgatttacgacatgtgtaaggctgtgcaaaaagatatggtgattgggccggtacgtttgctggaaaaaagcggcggcaaatcaggaaattttaaggtgggatcatga

SEQ ID NO: 267 - DNA, 981 bp, Xenorhabdus bovienii
  Coding DNA location: Contig name=SeqID_16837; Position on contig =17919..18899bp; Strand=-
gtggaacaactcgtagatgcatttgcccgcaaattttattacttgagattatcgattaccgatgtgtgtaattttcgctgcacatattgcctgcctgatggctatcaccctcatgggcaccaatcgttcctgttcctgccagaaattcgccgcgtcagccgtgcatttgctgaactggggacggaaaaaattcgcctgacgggcggagaacccactatgcgtcgtgatttctgcgatatcatcgcgacagtgcatgaaaacccacagatcaaaaaaatcgccattacgaccaatggctaccgaatggagcgcgatgttgcccgctggaaagaggcggggctgacggcgatcaacgtcagtgtggatagccttgatccccgccaattccacgccattaccggacaggataaatttttccagattatgcgtggcattgacgcggcttttgacgcagggttcagtggagtgaaagtcaacgccgtattgatgaaaaacgtcaatgatactagcctgcccgtttttctggagtggattaaacatcgttcgatccaattgcgttttattgaattgatggaaacgggggaaggcagtgaattgttccgccgtcgccatctttccggtgaagtgatccgtcgccatctgctgcaagagggctggcagcaacagcaacgcgcccgcagtgacgggccggctcaggtctttagtcatcccgattatcagggcgaaattggccttatcatgccgtatgaaaaaaacttctgccaaagctgcaaccgcctgcgggtttctgcgattggcaatcttcacctgtgcctgtttggtgagcagggaattccattgcgtgatttattgtccgatgacacgttacttgatgatctaaaattgcgcattcaaggtgggttgcgccataagcgtgagactcactttttacatcagggggatagtggcattacccctaatctttctttcattggcggttaa

SEQ ID NO: 268 - DNA, 909 bp, Xenorhabdus bovienii
  Coding DNA location: Contig name=SeqID_16837; Position on contig =19337..20245bp; Strand=+
atgcgaaaccgcacattagatgatttagatcgtgtggtcgccctcggtggcggtcacggacttgggcgcgtcatgtcttccctttcatctctcggtgcccgtctgagcggtattgtcacaacgactgacaatgggggatcaaccggaagaatacggcgtgctgaaggtgggatcgcctggggtgatacccgcaattgtctgaatcaactgatcactgaaccgacggtcgcttccgccatgtttgaatatcgattcagtggtaatggcgagctggccggccataatctgggcaatttgatgttaaaggcgctggatcacctgagtgtccgcccccttgaggccattaacctgctccgcagtctgctaaaagtcaatgcacatcttatcccgatgtccgaacaccctgtcgatttaatggctgtcgatgatcaaggcaatatggtgtatggggaggtcaatgttgatcaactcaattgtgtaccacaggagttaatgctctatccccatgtcaacacgaccaaggaagcgctggaagccatcgagcgggcagacttgattttgatcggacccggtagttttttcaccagtctgatgccgttgttattgctggaagatttaactcaatctctgcgccgtagcaatgccagtatgatttatattggcaacttggggaaagaactcagccatgctgccgcaggtctgtcgttgagcgataagcttgaaatgatggaaagtaaaattggccgcaagatgattgatgcgattattgttggcccttgtactgatatcagctctttaagtgaccggattgtggctcaacaaattttagaggctcaggatattccctatcgccatgatcgtgaattattacgacaggctatcgaaaataccctgcaaaaattgggctga

SEQ ID NO: 269 - DNA, 2028 bp, Xenorhabdus bovienii
  Coding DNA location: Contig name=SeqID_16837; Position on contig =20302..22329bp; Strand=-
atgagcaaagaaacgagcaaagtattcaagttacattctgatttcgaaccgggaggggatcagccagaggctatccggaaattacaggaagggctggaagatggtcttgcccaccagacgcttttgggggtgacgggatcaggcaaaactttcacgatagctaatgttattgcaaatctgaatcggccaacgatgatccttgctcccaataaaacgctggcggctcaactttatagcgaaatgaaagaattcttccctgaaaactcggtggaatactttgtttcctattatgactactaccaaccagaagcttatgtacccagctcagatacctttatcgaaaaagacgcttctgtgaacgagcatatcgaacaaatgcgtttgtcggcaacaaaagccctgctcgaacgtcgggatgtggtggtggttgcctcggtttctgcgatttatggtctgggtgaccccgatagctacctgaaaatgatgcttcatctgaccgatggcatgctcattgatcagcgcgccatcttgcatcgtctggcagagctgcaatatacccgcaatgatcaggcattccagcgcgggaccttccgggtgcgtggcgaagtgattgatatcttccccgcagaatctaatgaacatgcgctgcgtgttgaactgtttgatgatgaagtggagcggctttccctgtttgatccactgaccggtcagattcagtacaacgtgccgcgttataccgtctatcccaagactcactatgtcacaccgcgtgagcgtattactcaggcgatggaagacattaaagttgaattggaacagcgacgcaaaatgcttctggcgacggataaactgctggaagaacagcgtatcacccagagaacacaatttgacctcgaaatgatgaacgaactgggttactgctctggcattgaaaactactcccgttatctctctggccgtgccgaaggtgagccaccgccaacgttgtttgattaccttgcagcggatggtttactggtggtagatgaatctcacgtcactatcccgcagattggcggcatgtatcgtggcgatcgttcccgaaaggaaacgctggtggattatggttttcgcctgccatcagcattggataaccgcccattgaggtttgaggagtttgaagcactggcgccccagacgatttatgtttctgcaacccctggccgttatgaattggaaaaatcaggtaacgaactggttgagcaggtggtgcgcccgacgggtcttattgatcctgaaattgaagttcgtcctgtagccacgcaagttgatgatctgctatctgaaattcgtatccgtgccgagaaaaacgagcgagtactggtgacgacgctgacaaaacggatggcagaagatttgactgaatatttggaagagcacggcgagcgagtgcgttatctccattctgatatcgataccgtggaacgggtggaaattatccgtgatcttcgcctgggcgagtttgatgtactggtgggcattaacttactgcgcgaaggcttggacatgccggaggtttctctggtggcaattctggatgcggataaagaaggtttcctgcgctcagagcgttccctgatccagactattggtcgagcggcgcgtcacttgcacggcaaggcgattttatacggtgacaggatcaccgattctatggcaaaagccattgatgaaactgagcgccgtcgtgccaaacaacaggcatttaacgaggaacacggcatcgtaccgaaagggctgaataaaaaaatcggtgatctcctgaaaattggtcaaccagcgcatggtaaaggaaaagccaaaggaagaggtaaagcttctcccgacactgatgattaccgtaaattgtcggcaaaagagctggaaaacaaaattcgtgaactggaagaaaaaatgtaccagtatgcgcgggatctggaatttgaacaggcggcgaatattcgtgatcaggtacaggcattgcgggcacagtttattgctaactcgtaa

SEQ ID NO: 270 - DNA, 684 bp, Xenorhabdus bovienii
  Coding DNA location: Contig name=SeqID_16838; Position on contig =239..922bp; Strand=-
gtgacaaataaatattttcttaccggaaccgacactgaagtcggtaaaactatcgtcagttgcgcgttgctgcaagcggcaaataagcaaggatatcaaaccgcaggttacaaacccgtggcatcgggcagtgagatcacctcagaaggaatacgcaatggagatgcactggccttacagcgcaacagttccgtatccttggcttatcaagaagtcaacccactggtatttgttgaaccgacatctccccatattgtgagtgctgaacttaaccagccgattgagtttgaggtgatatcacagggtttggaaagattgacggcaaaatctgattgggttttggttgaaggtgcaggcggttggtatacacctttgtcggaaaataccacttttgctgattgggtgattcaggaagaactgcctgtgattttgacggtgggagtcaaactgggctgtattaaccatgcggtattgacggcaaaagcgattcaacattctggattgaggttagccggctggattgccaatgaaattgaacccgccggtaaacgtcagacagcgtatttggagacgttggaacggatgattcccgcacctttactaggggttatccctcacttgagcgaattgagtgataacaataatatcggcgaatatataaatattgatttattggttaactaa

SEQ ID NO: 271 - DNA, 774 bp, Xenorhabdus bovienii
  Coding DNA location: Contig name=SeqID_16838; Position on contig =912..1685bp; Strand=-
atggatctggctgttaaggccgttgacaagcaggcgattgcaggcgcttttgggcgcgccgcttctcgttacgatacggctgctaaattgcaacagcaaacaggtgaatacctgatggaactggcgcaggcagaaaatctcggtgtccgggtattggatgcaggctgtggaacaggttttttcagtgcgcactggaagcagcggggcaagcaggtcatcgcactggatctggcttctggtatgttaaatcatgcgcaggagcagcaagttgccgattactacctgcaaggggatattgagcacttggggctggcggataatagcgtagatatctgtttcagcaacttggccgtgcagtggtgtaatgaactgccatgtgcattgcaggaatttcatcgggttacccgtcccggtggcctcattttattctccacacttgcgcaaggttcgctgtatgagttggaagcggcgtggagacaggttgacacttatcggcatatcaaccaatttctgcctttacaagcaatcactgacgcgtgccaagcctatcgacacaagataataagccgacaatattgccaatattacccgcaactgctgcctttgttgaactcgctgaaaggaataggggctacgcaccttcatcatggtcgccagcatggactcatgaccagaaaacgcctgaacactctggctgaagcgtatccacggaataatgaggattacccattaagctatcagattgcttttggagttatttactgtgacaaataa

SEQ ID NO: 272 - DNA, 1152 bp, Xenorhabdus bovienii
  Coding DNA location: Contig name=SeqID_16838; Position on contig =1669..2820bp; Strand=-
atgaactggtcagacacgatttcccgacgattgactgaacgtcggggaacatctctatggcgtagcagacaagtccatctgggatcagatgggcgtttattacacacttcagacggtcaatacctgaatttttccagcaacgactatcttgggctgagtcagcatccccagattattgctgcctggcagcagggagctgaacagtacggcgtaggcagtggggggtcggggcacgttacaggttacaccgcagttcaccacacattggaacagcaattagcggaatggttgggttattcccgcgccttactatttatttctggctatgcggccaatcaaggtgtgatagcggctttgatggaaaaagacgaccggattattgctgatcgcctgagccatgcctcgctgatagaagccgccatgcactctcccgcacagtttcgacgttttctgcataacgatccaaattccctgaagcagcatctggtaaaagattgtgcgggcaaaacgctggtagtgacggaaggtatttttagcatggatggggattgtgcgccgcttgcatcccttgcacagcagacaaaatccacgggcagttggttgatggtagatgatgcccacggtatcgggatccacggtgaacaagggcggggtagttgctgggcgcagaatgtcaaaccggaaattttgattgtcacctttggtaaggcgttcggattgagtggggcggcggtactgtgtgatgaacaaaccgcagaatacctgatccagtattccagacacttaatttacagcacctccatgccacccgcacaggcggtagcactgtctgaagcggtacggcaaatcaaggaaggcgatgaattgcgtcagcgattacaaaacaacatcagatattttcgccgcgaagctcatcatttgccttttaccctgatggattcagagacggccattcagcctttgatcattggtgacaatgaacgctgcattgctctatcccatgtgctcagacagcagaaagtgtgggtaaaatcgattctcccgccaacggttccactggaaagtgcccgcttgcgtatcatactgacggcgagccatacacaacaggatattgagatattactggaggcgttgcatggatctggctgttaa

SEQ ID NO: 273 - DNA, 1041 bp, Xenorhabdus bovienii
  Coding DNA location: Contig name=SeqID_16838; Position on contig =2820..3860bp; Strand=-
gtgaatgagcgtcagcaatggactatcaaacaggctcaggctttgtttgatcaaccttttttcgaattgttatttcaggcacagcaggtacaccgtgaacattttgatccgcagcaagtacaggtcagcacgcttctttcaataaaaaccggtgcctgtccagaagactgcaaatattgtccgcaaagctcccgttacaaaacaggcttggaaaaagagcgtttgatggaagttgagcaagtcatcgaatctgcgcgtaaggccaaaaatgccggttcaacccgtttctgcatgggagcagcatggaagaaccctcacgagcgtgatatgccgtatctggagaccatggtcaaggaagttaaagaattaggtatggaaacttgcatgactctgggaatgttgaatcaaactcaggcacaacgtctggcagaggctggtttagactactataaccataacctggacacctctccggaattttacggcaatatcatcaccactcgcagctatcaggatagattggatacgttgggaaatgtcagggatgcgggcatcaaagtctgttctggtggcatcgtcggtctgggagaacaaatccgtgaccgtgcggcactgctggtgcaactggcgaatttgccgaagccgccggaaagtgtgcccattaatatgctggtgaaagtaaagggaaccccgttggaaaacaacgatgatgttgatcctttcgactttattcgcaccattgctgtggctcggatcatgatgccagcatcccatgttcgtttatccgcaggacgtgaacagatgaatgagcagacgcaagcgatgtgctttatggcgggtgctaactccattttttacggctgcaaattactgaccacgccgaacccgaatgaagacaaagatctgcaactgttccacaggctgggcatcaatcctcaacagactcaaacagcatttggtgacaatcaacaacagcagaacctgactgaagccatcatcaataatgttgattacgaacaattctataatgcggcagtataa

SEQ ID NO: 274 - DNA, 1269 bp, Xenorhabdus bovienii
  Coding DNA location: Contig name=SeqID_16838; Position on contig =3958..5226bp; Strand=+
atgaatccttcagatcttgaatttgacctacgccatatctggcacccgtatacatcaatgactcatccactccccacttatcctgtaatttcagccgcaggggttgagctggaactgtcagatggccgcagactgatcgatggtatgtcttcatggtgggcggcgatccacggttataatcatcctgtgctcaatgaggcagcaaagtcgcagattgacaggatgtctcatgtgatgtttggcggtatcacccaccctcccgcgattgaattatgtcagcaattagtcgcgatgacgccggccgcactggagtgtgtttttctagcggattcaggatctgtcgctgtagaggttgccttgaaaatggcgctacaatactggcaagccaaaggagaaaaacgccacagattcctgaccctgcgtcatggttatcatggcgatactttcggtgccatgtctgtctgtgatcccgacaattcgatgcataacctgtataaaggttatctccctaaccatctgtttgctgatgcaccacaatctcggtttgagggtgaatggcaacctgaggatatcacttcgttccgacagttattgctccaacaccacaatgaaatcgcggccgtaattctggaaccgattgtgcagggtgcaggtgggatgcgcatttatcatcctgaatatctgcgtcaggttcgtaagctgtgtgatgaataccagatcttgctgattgccgatgagatcgccacgggatttgggcggactggcaaactattcgcctgcgagcatgcacagatcgagccggatattttgtgtctgggcaaggcgttgacaggcggttatatgacattatcggccacattaaccactcgtcatgtggctgaaactatcagtcaaggtgaagctggctgttttatgcacggcccgacgtttatgggaaatcctctggcttgtgccgttgccagcgccaatctgaaattgctctctgataatcagtggcagcagcgcactcaatccattgagagccagttgaaagcagaattgctcccgttgaaatcacacactaccgtcgaagatgttcgagtattgggtgctattggtgtcgtagagatgaaacagcccgttgatatggcttcgctacagcgccgctttgtacagcatggtgtttggatcaggccatttggccggttaatttatttaatgccaccttacattacccggtctgagcaattatctaaactgacaaatgcaattaatgatgtaataatttaa

SEQ ID NO: 275 - DNA, 573 bp, Xenorhabdus bovienii
  Coding DNA location: Contig name=SeqID_16838; Position on contig =5449..6021bp; Strand=+
atgagcgacgaaaaatcaattatgccttctaacgaagaaatgcaagctacattttcattatctaaggagatgcatgaaaaggaaatatcacaccattcaactgttgcaagagaaatacctgagctagcccatttgtttgtaaaaaatcccaacgtgatttcatcaacgggttatggtgctggtctgatagaatatattagtggaagttttaatcttaatacattccaacaatatggaagttatccttttatccaaatatcatcccattcggctataattgggtatgcgccaaatgttggccagcgggttaaatttaatggatatgttaatgctgggcacactattccaattattaattggaataatttttattttgcagggacagtacataatattagatctattataaacgtacaacttactattcaactttacattaaccaacagaatattttcatccgtcttttcgatgggaatatttatttgggcgatttaatttctgtatatagacctaattcaattattcctgttcctatagtaatatcaggcgttggttcatttagtttaatctaa

SEQ ID NO: 276 - DNA, 987 bp, Xenorhabdus bovienii
  Coding DNA location: Contig name=SeqID_16838; Position on contig =6150..7136bp; Strand=-
atgaaacaggtggtttatacagccagccctaatagtagtcagattcacgtatggtcgctgaatattgcgggggagctctcacttctccagacagtgaatgtgccgggcgaagtacagccgatggtagttaaccctgatggcaaacacttatatgtgggaattcgccctcagttcagtatcgtcacttatgcaatcgggtcagatggacagctcgaacagcaggctattgcgccgttgccgggtagccctacgcatatttctacggatagagcgggacgttttttgtattctgcttcctatggtttcaacaaactcagtgttcaccctattgatgaaaacggcactgccaaagcgccggttcagatcgtagaaggcctgcaagcgcctcattctgccaatattgatcgggaaaatcgccagttactggttccatgcctgaaagaagatcacatccgcatttttaatctggatgagcagggttatttgacagaaaatagggcggatgaaatcagtacggtagcaggagctggcccgcgtcatatggcttttcatcctgaaaaatcggcgatttattgcatcaatgaactggatgcgactgtcgatgttctgcgtaaatgggacaaatatcgcattgtgcaatctgttgattcattgacggctaatttttccagtgtctgctggtctgcggatatccacatgacaccggatggtcgtcacctttatacctgtgagcgctcagagagcctgatcagccatttccgcgtttcagaagatggctattacctgacattagtcggaaattatccgacagaaagtcagcctcgtggttttgcgattgatcacagcggcagcttcctgattgcctcagggcagaaatcagatcatatttcagtgtcacgtattgataaatattctggaaaattaacgcaattagcgcgttatccagtgggcaaaggcccgatgtgggttacagtgctggcattgtaa

SEQ ID NO: 277 - DNA, 816 bp, Xenorhabdus bovienii
  Coding DNA location: Contig name=SeqID_16838; Position on contig =7285..8100bp; Strand=+
atgtcatatcgcgttatcgcgctggatctcgacggcacagtgcttgatccacaaaaacgtattttgccagaatcactagctgccctgaatgaagcccgtcaagctggtgttaaggttttgattgtcactggccgccatcatgtcgctatccatccgttctatcaagcactacaactcgatactccggctatttgctgcaatgggacttattcatatgattaccatgcaaagaaagttctggattccaatcccctttccacccaagaagccgttcaggtgctttcttatctgcaaggaacggaaattcagcatctgatgtatgtcgatgatgccattttatatcaatttcatgacactgtttcacgcacgcttgcatggtctgattctctgcctgaacatcagcgccccaatctccagcagaccaatagctttcaagatgccatctatgatgtgaattttatttggaaatttgccaccagctccccgaatgtggtgaaactgcgtgaaatcagtgaacagattgaggagaaagtcggtcttgagtgcgaatggtcgtgggttgatcaagtggatattaccaaaaaaggcaatagtaaggggatgcgcttgaagcaatgggttgagtcacaaggcatatccatgaaagaagtgattgctttcggtgataattttaatgatatcagcatgctggaaacagctggtttgggcgttgctatggaaaatgcggctgatgcagtcaaagagcgtgccgatattgttacgcgggataatacccagcctggcatcgctgaagtgattcgaaaatacgtgctttaa

SEQ ID NO: 278 - DNA, 1152 bp, Xenorhabdus bovienii
  Coding DNA location: Contig name=SeqID_16838; Position on contig =8166..9317bp; Strand=-
atgtgtgattgctatcgtgctggcattggtttcattgatgctttccgagtggctgacccgttggggcagaaaacgtctgggggcagcatgctagagctggattttgaacaacgtctgggtaacctgcacatgcaggtcgataccactctgccaacagaaagcattacggctatatttgggctttccggcgcgggtaaaacgtctctgatcaatgttattgccgggttgagcaggccacagagaggccggattgtcctgaatggccgcattttggtggatatagagcagaaaatcttcctgccgccggaaaaacgccgaatgggttatgtttttcaggatgctcgcctttttccccattatcgcgttaagggcaacctgcaatacggtatgtcgccagacatgaaaccacagtttgacaacatcattggcttactgggcattgaacacttactgtcacgttttcccatgaccttatccggcggggaaaagcagcgggtagcgattggacgggcattactgaccgcgcctgaaatcttgctgatggatgagccgctggcttcgctggatttaccccgcaagcgtgaattactgccgtatctcgaaaaactgtccgccgatgtcaaaatcccgatcctgtatgtcagccacaatttggatgaaattctgcgattggcggataacgtgatcgtaatggacaaggggaaaatcagagcgacaggcacattggaagaagtctggtcaaacagcatattacgcccgtggctgcaaaaagagagccttagcagcatactgacagtctctgtcatggagcatcatcagcgttatcatatgacagcggtggcgataggagataaagctctctggttgcccaaaatcgatgtggctccggggacagacctgcgtattcgcattgatgcatcggacgtttctctcgttttggaaccaccgaaagccagcagtattcgtaataccctacaggttaaagtcattgaattttttgaatatgatggtcaggttgatgtcaagttagcactgcgtgaacatttcctgtgggcgagaattaccgcttgggcgcgggaagaacttaacctgcggtcaggtcaatggttgtatgcgcaaataaagagtgtttcgctgaatcagactttttaa

SEQ ID NO: 279 - DNA, 699 bp, Xenorhabdus bovienii
  Coding DNA location: Contig name=SeqID_16838; Position on contig =9224..9922bp; Strand=-
ttggagatgttaagtgaatatgaatggcaggcgattttactgagcttaaaaatctcaggtatctcggtgttattcagtttgccattagggatattgatggcatgggttctggctcgctgccagtttttcgggaaatccctgctggatagcattatccatctgccgctggtattaccgccagtggttgtaggatatctgctgctcctcagcatggggcgccgtggtgtcatcggtgaatttctttatgattggtttggcgtcagtttcgcgtttagttggacgggagcggcgttggcttcggcagttgtggcttttcccttgatggtcagagcgatcaggctggcgctggaaagcattgatcgtcgtctggaacaggccgcgcgtacattgggagccagttcgcttagggtctttttcaccattaccctgccactttcattgccgggtgtgattgttggtgctgttctggcttttgcccgttctctgggggagtttggtgcaacaattacgtttgtatcgaatattccgggggaaacccgcaccattccccttgccatgtacacattgattgaaacgcccggcgcagaaacggcagcggcgcgtttatgtgtgattgctatcgtgctggcattggtttcattgatgctttccgagtggctgacccgttggggcagaaaacgtctgggggcagcatgctag

SEQ ID NO: 280 - DNA, 771 bp, Xenorhabdus bovienii
  Coding DNA location: Contig name=SeqID_16838; Position on contig =9934..10704bp; Strand=-
atgaaaaagagcatgtaccaattgctgacaggggctgtggtttcttttgcgctggttgggaatagctggagtgcagaaaaagtgaccgtctttgcggcggcgtcattgaccaatgcacttaacgatattgccgctcagtacaaaaaagaacaacagggagacattgttgcctcttatgcttcatcgtcaacactggcacgtcaggttgagcagggcgcccccgctgatatctttatttctgctgatcagcagtggatggactatgccgcaggcaaaaaactgattgctgaaaatactcgtcatactttattaggtaatcaacttgtcttgattgcacccaaagagagcaagctggataaaatcgacatcgatcgaaaaacaaaatggaaatctctgctggcagatgggcgtctggctgtgggtgatcccgatcatgttcctgttggcatttatgccaaagagtcgctgcaatctctgggagcatgggaggcggtcaatccactgatggcacgtactaacaatgtacgtagtggtatggcgctggtagagcgggcagaagtaccgttgggaattgtctatggttctgatgcagttgccagcaaaaaagtgaaagttgtcggtatattcccatcagagagtcataaaccagtggaatatcccattgcaattattaaaggtcatgaaaatcaggccgtccgtgatttttatgattatctcaaaacccctgaagccgcagtcattttcaaacgctatggtttcagtccactgtag

SEQ ID NO: 281 - DNA, 141 bp, Xenorhabdus bovienii
  Coding DNA location: Contig name=SeqID_16838; Position on contig =10964..11104bp; Strand=-
atgtttgagttgattggaagtatggcgtttgcgttgatcatggttcccgttgtgatggcactgattttggggctgatttacgggcttggcgaagtgttcaacgttatttccaaaacaggaaataccgaacggcagccttga

SEQ ID NO: 282 - DNA, 189 bp, Xenorhabdus bovienii
  Coding DNA location: Contig name=SeqID_16838; Position on contig =11119..11307bp; Strand=+
atgagtgaccataatttagccaaaaaattaactgtgcaacactcggcgttatttttccttaatggaaaaacggtgcttcatgacacaggcggtgatctcgctattctagacaataaaaaagtaacagtaaccgacgaaacgtgcgattcttacggttatcctgtaaaaaactctcaaatatttgcctga

SEQ ID NO: 283 - DNA, 792 bp, Xenorhabdus bovienii
  Coding DNA location: Contig name=SeqID_16838; Position on contig =11319..12110bp; Strand=+
atgcaagccgaaatattgttaacactcaaattacagcaacgccttttcgctgatcctcggcgaatcgaattgcttaagcagattaaaataacaggttctatcagtcagggagcaaaacaggccgggatcagctataaaagcgcctgggatgccatcaatgaaatgaatcatctcgcagatgaggtattggtagaacgtgccactggtggcaaaggtggagggggtgcgcaacttacgcactatggtgaacgcctgttacaactttatgatctgctggaaagaattcaacaaaaggcattcgatgcgctgaaagaggattctctgcctttggatagcctgctcgcggctatttcccgtttttcgttacaatccagcgcccggaaccaatttttcggtacgatagtcgaacgtgatcatgaaaatatccagcaacatgtccgtatcttactggctgatggcaaaacatcgatctctgccgcgctgactgagcaaagcgcaaaccggctgaagttggtaaaagggaaagaagtgctggtgttaattaaggcaccgtggataaccttaagcaaggagcctgtaacagcgacgccattcgataatgccttatccggccaggtcagtctgattgaaacaggaacagaacacagtgaagttatcctgacgcttgatgggggtgaatcactctgcgttacgctaaccaatcaggaaatggagcgttcaggtcttcagcctaatgatttcgtcaccgcactctttaatgccgataaagtgattattgcaaccctgtgttaa

SEQ ID NO: 284 - DNA, 1485 bp, Xenorhabdus bovienii
  Coding DNA location: Contig name=SeqID_16838; Position on contig =12295..13779bp; Strand=+
atgtctgagttgcaaataacacaaggtagtttccgtttaagtgacacccgtaccctgcggctaccgtcactgaaaattatttctggcgaaagttgggcgtttgtcggcgcaaatggcagtgggaaatcttctctggctcgtgccctgtcggatgaattaattcaactttcaggtgaacgttattgttcatttaatacacctgtacgcctctctttcgaacaacttcaacaactgattaatgaagagtggcaacgcaacaatacagatttactcagtgaaggagaggaagatactggacgtactgccgcagagatgattcagctccaccataaagataatgaattatgccttgaactggcagcatattttggtatcaaagatttgctttcacgtcggttcaaatatctctcaactggcgaagttcgcaaagtgttactttgtcaagcattaatggctaatcccgacctgctcatccttgatcagccttttgacgggctggatacttatgctcagaatcaattatcccaattattcggatcgctggcagcaaaaggcatcacattggttttaatactgacccgattccatgaaattcctgattttgtcgaacagatcggtgtactggctgattgccacctggcactggcaggaaagaaggagagtattctgtcagaatctctcgtggcacagttagcccacagcgaagcactgaaagacattcggcttcctgaaacagacgaataccgtgcagatgaacaattccccgaagatcaaccactagtgtcgatgtgcaatgttgttgttcagtacaatgacaaaccgatactgcatggtctgagctggcaaataaatccagatgaacactggcaaatcatcggtgaaaatggtgcaggaaaatccaccctcctcaacctgattacgggcgatcatccccaaggttacaacaatgagctaatcttattcggccgacggagaggcagtggcgaaaccatctgggatattaaacgccacattggttatgtcagtaacagcattcaccttgagtatcgtgtcagtacctgcgttcgaaatgtcattctctctgggttcttcgattccattgggttatatcaggccgtttcagatcggcagcagcaactggctgatgagtggctggccttgttgggattctctgaagcaatcgcaaacaacccatttcacagcctatcatggggacagcagaggctcgttctgattgcccgtgccctggtgaaacaccccgccttattgattctcgatgaaccgttgcagggacttgatccccttaaccgtcagttagtcctgcgtttcattgatatcatgattgccaagggggatacacaacttctgtttgtttcccatcatcaggaagatgcgccagaatgcattactcaccgcctgaaatttattcctgatggcaatatttatcggtatgaaaccgaagatatctcccaacagtctttgtag

SEQ ID NO: 285 - DNA, 828 bp, Xenorhabdus bovienii
  Coding DNA location: Contig name=SeqID_16838; Position on contig =14013..14840bp; Strand=+
atgtcttgggcgttacttgccgtttcattggcgcttttggatactcgtcgcattattgcattttccatcgcatttctagctttaatcattgggatcagcactaacgtgctcacctttcccgcaattgctgcgcttattgtgattgctggtttaggtacagcacacgtttacctcaaaaaacatcctacatccagaattatcactgaggtgttactgctcatctctgtggttttactgttcatgcattacattccgggatttaataacttgaaatacctagataaggtgcaggttggcccgcttagtgcacctttttcaatgtatttcaactttgacaaggcactgattcctttcattctattattctgcatgccaagcctgttcactcgaaagcccgtggtagaagccttcccgcatgtatgggcagcattgatagttgcgatacctgcgctattgggccttgccacagagttagggggattagccgttgagctgcatttacctagttggttccctgctttcgtcgttgccaatattttctttgtttcattggcagaagaagccctgttccgtggttacctccagcaaaagctgagtcagtggataaatccctatttggcactcgttatcacttcgctgatttttggcgccgcacattttgccggtggcagtttgttgatgattttcgcaacactggcaggattaatttatggtctggcatggatgtggagtggtcgtttatgggttgcggtcgctttccacgtttcactcaatctgggtcatctcctgtttttcacctatccggtaaaatcattactcatacagtag

SEQ ID NO: 286 - DNA, 753 bp, Xenorhabdus bovienii
  Coding DNA location: Contig name=SeqID_16838; Position on contig =14969..15721bp; Strand=+
atggctgtaactaaactggttcttgtaaggcacggagagagcgagtggaacaaagagaaccgttttactggctggactgatgttgaattgtctgacaaaggccgtactgaagcacaacaggcgggccaattactgaaacaagaaggtttcgtttttgatttcgcttacacttctgttttaaaacgtgctattcacactttgtggaacattctggaccaagtcgatcagcaatggctgccggttgaaaaaaactggaaactgaatgaacgccactacggcgcactacaaggcctggacaaagctgaaacagccgctaagtacggggatgatcaagttaaattgtggcgccgtggcttcgcgatcacgcctccagatttgactaaagatgatgaacgttaccctggccatgatcctcgttacgcgaacttaaaaccagaagaacttcctgccacagaaagccttgcagccacgattgagcgtgttgttccttattgggaagacgttatcaaacctcgtgttgcaaacggtgaaaaaattatcatcgccgctcatggaaactctctgcgtgctttagtgaaatatttggatggtatgagtgaagaagaaattcttgagctgaatatcccaactgctgtgccactggtttatgagtttgatgaaaacatgcaacctatcaaacactattatctgggcaatgccgacgagatcgcagcaaaagcagccgctgtagcaaaccaaggtaaagcgaaataa

SEQ ID NO: 287 - DNA, 1053 bp, Xenorhabdus bovienii
  Coding DNA location: Contig name=SeqID_16838; Position on contig =15791..16843bp; Strand=-
atgaattaccagaatgacgatataaggataagaaaaataacggaattattgccaccagttgcattactcgaaaaatttcctgcaacaaaaaatactgctactaccgttcgtgaagcccgtgaagctattcataacgttttaactggtgaagatgatcgtctcttggtagtgattggcccgtgttcaattcatgacccaaaggcagcattggaatatgcagaacgcctgaataagttacgtgaagaattgaaagctgatttggaaattgtgatgcgggtttattttgaaaaaccccgtaccacgataggttggaaagggttaattaatgacccgaacatggattgtagctttgatattaatgatgggttacgtactgcccgtaagcttctgatcgatattaacgacatggggctgcctgctgcgggtgagttccttgatatgataacccctcagtatcttgctgatctcatgagctggggcgcgataggggcacgtacaacggaatctcaggttcaccgtgaactggcatcagggctttcttgtccggttggctttaaaaatggaactgacggcacaataaaagttgccattgatgctatcaacgcggccagctcacctcactgttttctttctgtgactaaatggggacactctgcgattgtcagcaccacgggtaatcaggattgccatattattctgcgtggtggcaaagagccgaattacagtgcggagcatgtcaatgtcgttaaagaggaattgatgaaagctggtttagctcctcgtgtgatgattgatttcagccatgcaaacagttcgaagcagttcaaaaggcaaatggacgttaatgatgatgtttgtgatcagattgcaaggggagaaaacgcgattattggcgtcatggtcgaaagccatctcgttgagggaagccaaaatctcgatagtgataagcctttagtttatggacaaagtgtgacagatgcctgcattggctgggatgacacagaaacgttactgcgtcagttatctcagtctgtcaaagcccggagggggtaa

SEQ ID NO: 288 - DNA, 705 bp, Xenorhabdus bovienii
  Coding DNA location: Contig name=SeqID_16838; Position on contig =17119..17823bp; Strand=-
atggtttttttcagtattaatagcatattggtacatattccattaggtgcaggcggctatgatctttcgtacattgaagctgttggtacgatagctggtttattatgtatctggcttgccagtcaggagaaaatcattaattacctgtttggattgattaatgtttctctctttgccgttatcttcttccaaattcaactttacgccagtcttctcctgcaaatctttttcttcgcggccaatatctacggctggtatgcctggagtcgtgtcaatgaacagaaacagacggaacttaagatccgctggctcaaccccaaacaaacaattatcgtcgccgcagtttccatatttgcaatcttgataatgatgttcaatatcgaccaaatctttggctatatggcaaaaattgcagttcttgtcttacagggaatgggcttcaatattacgatgccagccttagagccagatgcatttccattctgggattcggtgatgacagtattatcgatagtggcaatggtactgatgactcgtaaacacgtggaaaactggctggtatgggtgatcgtcaatgtgatcagcgtagtgatttattttcaccaaggtgttctggcgatgtccttgcaatacattatattgacgggtattgcactgaacggtgcccgcctgtggatcaaggctgctaaacccaatggctcataa

SEQ ID NO: 289 - DNA, 177 bp, Xenorhabdus bovienii
  Coding DNA location: Contig name=SeqID_16838; Position on contig =18067..18243bp; Strand=-
atgttgcgcccttctgagaaatcagtaatatatgccgccgttggcagggaatgctgtcaagcagatttagatgggtcgttagctcagtcggtagagcagttgacttttaatcaattggtcgcaggttcgaatcctgcacgacccaccattttaaacttccgttcaaatactccttag

SEQ ID NO: 290 - DNA, 768 bp, Xenorhabdus bovienii
  Coding DNA location: Contig name=SeqID_16838; Position on contig =18329..19096bp; Strand=-
atgaacagtaacttcagacgttatgtgttgggtctgtcgttattggttggcgtagcggctccttgggccgctaccgcccaagcgccaatcagtaatgtcggctcaggctccaccgatgagcgcctctcccaattagagcgtgtttccgatgctcacagtcaattgttaactcaacttcaacaacagcttgctgactctcaacgtgatattgatacactccgtggtcagatccaggaaaatcagtatcaattaaatcaagttattgagcgccagaaagatatttaccaacagttggataaaatcactaatccatcatcaggtacagaaggcgataatacagctacgccatcggcaaaaaccgatggtaatccacctgctgctccggcaagtacggggagtgaaaaaggtgattacgatgctgcggttgctttggcgatcaataccaaagaatatgataaagcaatctctgcgtttcaaaaatttgttaaagcctatcctaagtcgaaatatctatcgaataccaactattggttagggcagttgaattacaacaaaggcaagaaagacgacgcggctttttatttcgctactgtcgtgaaagattatcctaaatcacagaaaagtagcgattctctgtacaaagtgggattaatcatgcaggaaaagggacagaaggctaaagcgaaagcagtttatcagcaggttgttaaacaatatcccggcactaattcggctaaaatggccgagaaaaagattgcggggatgtaa

SEQ ID NO: 291 - DNA, 504 bp, Xenorhabdus bovienii
  Coding DNA location: Contig name=SeqID_16838; Position on contig =19106..19609bp; Strand=-
atgcaactgaacaaagtgctaaaagggctgatgttagctttaccaatcatggccgtagcagcgtgtagtactaacaaaaatggcaacaatgatcagtctggtgtaggcactgttgataattctgctaaagcaggtctgtctgctgaagaattagcacgtcagcagatgcaagagctgcaaaacaacaatatcgtatacttcggtttcgataagtatgacatcaacagcgatttcgctcagatgctggatgcacacgcggcattcctgcgcagcaacccatctatcaaagtgaccattgaaggccatgcagacgaacgcggtacgcctgagtacaacatcgctctgggtgagcgtcgtgctaacgcagtgaaaatgtacctgcaaggcaaaggtgtttctgctgatcaactggctatcgtttcttacggtaaagaaaaaccagctgtacttggccatgacgaagcagcatacgctaaaaaccgtcgtgctgtaatcgtatactaa

SEQ ID NO: 292 - DNA, 798 bp, Xenorhabdus bovienii
  Coding DNA location: Contig name=SeqID_16838; Position on contig =19657..20454bp; Strand=-
ttggcttatgtcgtcaagaaagcgagtgtgggtaaatacccatatgaactgcgtgtttctgattatgatggttataaccagtttaccgtccaccgctcacctgaaccattaatgtcgccagcatggttgccagatggttctcaacttgcttatgttacgtttgaaagtggtcgctctgcgctagttattcaaacactggcaacgacagcagtgcgtcaggttgcctcgttccctcgtcataacggagcgcctgcattttctccagatgggactaaacttgcatttgcactatctaaaacaggtagtttgaatctttacatgatggatttggcttctggtcagatccatcaggtaactgatggccgcagtaacaatactgagccaagctggatgccggataaccagacactggtctatacctcagatcaaggtggccgtccgcagttgtacaaaattgatattaatggcggtgctccacagcgcctgacttgggaaggttctcagaaccaagatgctgatgttagttctgacggtagttttatcgtgatggttagctcagcaagtggcagtcagcatatcgccaaacaagatctggcaacgggatctgtccaaattttgacagatacgtttctagatgaaacgccgagtatcgcacctaacggcactatggtgatttatagctccactcaagggttggggactgtattgcagctagtttcgaccgacgggcgtttcaaagcgcgtcttccggctaccgatggacaggttaaattccctgcctggtcgccgtatctgtga

SEQ ID NO: 293 - DNA, 555 bp, Xenorhabdus bovienii
  Coding DNA location: Contig name=SeqID_16839; Position on contig =176..730bp; Strand=+
atgtctactgttttacgccaatacttaaatctctgcccacaggttggtcaaagagtcatgttagattcttcttctattgtgattggagatgtcagattagcaaatgatgtgagtatttggccccttgtggttatccgtggtgatgtaaattatgtttcaattggtgcacgtacaaatattcaggatggttccgttttgcatgttactcataaatcacctgataatcccgccggcttcccactgataataggagaagaggtcactgttgggcataaagcgatgctgcatggctgtaggattggaaaccgagtgctggttggcataggttctattctacttgatggcgcgattattgaagatgatgttgttattggggcgggaactcttgtccctccaggaaaaaaattagaaagcggatatctgtatataggcagccccgccaaacaagtgagaaaactcaaacctgaagaactggaagggctactttattccgctaataactacacctactggaaagataattatttagcagacacgtcagagggcaaggagtaa

SEQ ID NO: 294 - DNA, 270 bp, Xenorhabdus bovienii
  Coding DNA location: Contig name=SeqID_16839; Position on contig =697..966bp; Strand=-
atgaatcaagctattcaatttcctgatcgtgaagaatggaatgaggtggaaagcaaagtgattttcccagctatggtcgatgggttattggtgcaatgtatgattagttccgatgagttagccgaacgttatggtaaagatcatcacccactcgacctatttcaccgacatcgctgggatctggaagagaaatttgaagccgctatcttgagtgggcatggtgatcaatttgggcgttactccttgccctctgacgtgtctgctaaataa

SEQ ID NO: 295 - DNA, 819 bp, Xenorhabdus bovienii
  Coding DNA location: Contig name=SeqID_16839; Position on contig =963..1781bp; Strand=-
atggataaatttgcggtttttggtaaccctattgcacacagtaaatctccttacattcatcgattatttgctgatcagacggggattgatcatcaatatgggcgggtgcttgctccgatagaacattttgaacaaactttggatcgcttttttgagcagggcggtttaggagcgaatattactgtaccttttaaagaaagggcttatcagcgctcagatgaattgactgagcgagcaagaattagtggtgcggttaacacattaaaattgatcgagggtaatcgtctccttggtgataatactgatgggatcgggttactggcagatttacagcggctaggtttcattactaagggtcggcatattctgattattggggctggtggtgcagcaaaaggagtgttatctcttttattagaactaggatgtgccgtcactatcacgaaccgtacattcgagcgtgcgcagataattgcagataaattttcccgattgggtgatattcagccaattgaaatggaatcccttctttccccagatttcgatatcatcatcaatgcgactgcttctggtattgatggacaaattcctgaggtatcaccgctgatttttcgcaatgatactgcttgttacgatatgtattaccaacacggattaactccattccttgattttgcccggcaaaatggtatttcacgtttggctgatggattaggaatgttggtggggcaagctgcgaatgcttttgaattgtggcacggagtattccctgaaatagaatcagttttaaccgctttaaggcgagagttacacgcatga

SEQ ID NO: 296 - DNA, 570 bp, Xenorhabdus bovienii
  Coding DNA location: Contig name=SeqID_16839; Position on contig =1788..2357bp; Strand=-
atgagtaacaaagtttcacctgcatttgatgtgattataactgcgttaaaagaagaaaaagtgattgcttatccgacagaggccgtttttggtttgggttgtgatcctgacagcgaaaaagccgtgaacgaattattatcgctgaaaaatcgaccgtgggaaaaagggctaattctcattgctgatagctatgaaaggttatgcctttatattgatgatgagcaacttagtgatatacagaaagaaacggtattttcattttggcctggtccagtgacatgggtaataccagcaaaaacgacgacaccaaagtggttaacggggcaattttcaacattggcggttcgggtcacagagcatcctctggttaaacaattatgctctctttatgggaaaccccttgtatcgacgagtgcaaatttaagtggactagagccatgtcggagtgcggaagaagttcgtcagcaatttggaaaccgagtccctgttttggaaggagaagtggggggacgtaaaaatccatcagaaatcagagatgctttaacaggtaaattatatcgacaaggatag

SEQ ID NO: 297 - DNA, 768 bp, Xenorhabdus bovienii
  Coding DNA location: Contig name=SeqID_16839; Position on contig =2968..3735bp; Strand=-
gtgttatcccaaaagcaggtggcaatggtgggtagtaggttagcaagcttttatggtgagaaatgggggaaaatctttgctggtgaattagcgaaaaatggagtggtgataaccagtgggttggcaattggtattgatgggatttgccatcaggcagcgcttagtgcaggcggaaaaaccattgctgtacttggcagtgggcttgaaaaaatttatccctataggcatgactctctggcgcggcttattgaagaaaatggtgcattggtttctgagtttttccctgaaatgccacctaaagctaaaaattttccaaggcgcaatcggatcattagcggcttgagtctcgctcttcttattgtggaagcttatgaaaagagtggttcgttgattacagcgcgttgtgcgcttgaacaggggcgagatatttttgcattacctggtgcattaggcactccttcaagtgagggcaatcattggctgataaagcagggggcttatttggcagtgaatccaacggatataatggaacatattaatggcgcgtttcgatggttgaatatagaaaaagaagaacgcgtgcaagttgaccaaatagagttgccatttgccgatgtgctggttaacgtaagtcatgaagttactccagttgatgtgattgctcaacgctcttgtcttcctgtcacagaagtcatgaccagacttttggagctggaactcatgggaaaagtcgccgttgttgctggtggctatattcgggtaaattga

SEQ ID NO: 298 - DNA, 513 bp, Xenorhabdus bovienii
  Coding DNA location: Contig name=SeqID_16839; Position on contig =4178..4690bp; Strand=+
atgtcagttttacaagtattacattacccagacgagcggcttcgcacaattgcaaagccagttgaaaaagttgatgcagaaattcagagcatcattgatgatatgttcgaaacaatgtatgaagaagaaggtatcggtttagctgcaacacaagtcgatattcatcagcgaattattgtcattgatgtctctgagaatcgtgatcaacgccttgttctcatcaaccccgaattgatgaatgaagttggtgcaacagggattgaggaaggatgtttatctgtccctgaacaacgcgcatttgtaccacgttttgagcaagtaaaaattaaagctttagattatcacggacagccatttgagctggaagctgacgacctgctagcaatctgtattcaacatgaaatggatcatctagtaggtaaactctttatcgattatctgtcgccattgaaacgtcagcgtattcgccagaaagttgaaaaaattgaccgtctgagagctaaagacaaataa

SEQ ID NO: 299 - DNA, 948 bp, Xenorhabdus bovienii
  Coding DNA location: Contig name=SeqID_16839; Position on contig =4715..5662bp; Strand=+
gtgtctgattctttacgtattatttttgccggaaaccctgatttcgctgctcaccatttggctgctttattaaaatctcaacatcaagttgtcggagttctcacccgaccagacaaaccggcaggaagaggtaaaaaactgacaccaagtcctgtaaaagcattggctgaagaacatagtatttctgttttccagccaaaaaccttacgcacagaagaaagccagcaatggatcatggatcggcaggcagatattatgatcgttgttgcgtatggcctgattctacctcaaaccgttctggacataccacgtttaggatgcctgaatgtccatggttctttgttaccacgctggcgtggcgccgctccgattcagcgtgcaatctgggcgggagatccagaaactggcgtaacaattatgcaaatggatgctggtcttgatactggcaacatgctactaaaagcggcttctccaattacaaatcaagataccagcgccagcctgtatgaaaaacttgcaaatattggatctgaagcattactcaacacattaaatctgctaatgttgggaaattgccaaccaagcattcaagatgatactttggcaacttatgctgaaaaactcagtaaagatgaagccaaaatggactggcatttacctgccattcagcttgagcgatgtgtccgctcattcaacccatggccaatgagcttctttctcattgatgagtaccccattaaggtatggaacgctgaagccatcgctgagcaagctactcagtcccccggaaccatcattaaggcagataagaaaggtattcaaatcgcaaccgctgatggaatattaaatatcacacaattacaaccatcaggtaagaaatcaatgtcagccgccgatttcttaaactcaaaacgtgattggtttacaccaggtaacaaaatcaaatga

SEQ ID NO: 300 - DNA, 1320 bp, Xenorhabdus bovienii
  Coding DNA location: Contig name=SeqID_16839; Position on contig =5712..7031bp; Strand=+
atgctgacgacagtcagcttttttgaccatatcatgaaaaatacatataacctgcgaagtatcgctgcaaaagcgatccatcaagtactggaacaagggcaatcactcagcactgttattcctgaactccaacaaagaatttctgacaaagataaagctcttctccaagaactctgttttggcgtaatgagggtattacctcagctagaatggttcattagtcagttgatggcaaagccattgaaaggcaagcaacgtatttttcactatctaatcatggttggaatctatcagcttacttatactcgtatacctgcacatgctgcacttgccgaaaccgtcaatggcgcaatcagtttaaaacgtcagcaattaaaaggcttaattaatggcgttctccgccaatttcagcgccaacaacaagcattagtcgagcaagttaatagtgtcaacagccatttacatcccaaatggctgttagatcatattcaaaaaacctatccacaggattggcaaaagattattgacgtaaataatcaaaaaccgcccatgtggttgcgagttaatcagcgctatcatagtgcgaatcaatattttactctgttgcaagaagctaatatagaagcagaactagatgaaaatcatcctagtgctattcgtttgctaaatccttgccctgttaacgttctgcccggatttgatcaaggatgggtgactattcaagatcgctctgctcaagggtgtgctgaattattaacgccatgtgacggagaatctatactggatctatgtgctgctcccggaggaaaaaccacccatatccttgagatagcgccaaaatcaaaagtacttgccgtcgatattgatgaacagagaattaagcgggtgaaagaaaatttacagcgccttaatttgcatgccgtcgtcaaaacaggtgatgggcgccttccacatgagtgggcaacaggggaacagttcgatcgcattcttcttgatgcaccatgttcagcaacaggtgtcattcgtcgtcaccctgacataaaatggttgcgccgaaatgaagatattgaccaattggttacgctacaatctgaaatccttgatgctatttggccatatttaaagaaaaatggcactctggtttatgcaacctgctccattttacctcatgaaaatagccaacaaataaaagcattcttaggacgccatacagatgctgaattatcagatacaggcacacttgaaaaaccagggatacaaattattcctgaaacaacaggtggtgatggcttcttttatgcccgactaactaagtattga

SEQ ID NO: 301 - DNA, 1377 bp, Xenorhabdus bovienii
  Coding DNA location: Contig name=SeqID_16839; Position on contig =7129..8505bp; Strand=+
atgaaaataattattctgggtgctggtcaggttggtggaacattagctgaaaatttggttgatgaaaataatgatattactgtcgttgataccgataccgatcgcttacgccagttacaggacaaattcgatctacgggttgtaaatggccatggctcccaccccagagtattgagggaagcaggtgcagaagatgccgatatgttggtagccgtcacaaattcagatgaaaccaacatgattgcatgccagatcgcttactccttatttaatacccccaataaagtcgctcggatacgttcatcagaatatatctatgaatcagagaaactatttcaacccaatgatatccctattgattacctgatatctcctgagcaattggttattgattacatctataaattgattcaataccccggagcattacaagttgtcaattttgcggaaggccgtgtcagtatcgtcgcggtcaaagcctattatgggggttcactagtgggtaatgcattatcctcgcttcgagagcatatgccacatatcgatagcaaagttgctgcaatatttcgtcaagaccgcccgatcaggccacaaggctccacaattattgaagcgggagatgaagtattctttgttgccgcatcacaacatatcagagcggtgatgagtgaattacaacgccttgaaaaaccatataaacgtctcatgattgttggaggtgggaacgtcggtgcaggtttagcgttgcgacttgagaaggattacagcgtcaagctgattgaacataatcaagaaagagctacagagctagcagagctcttgcacgatactatcgttttctacggtgatgcctctgatcaagagcttctgtcagaggaacatattgaacaagtcgatgttttcattgcattaactaacgatgacgaagccaacattatgtcagccatgcttgcaaaacgaatgggagccaaaaaagcgatggttcttattcaacgcagtgcatatgttgatttagtacaaggtggtgttattgatatcgccatctcacctcagcaagctaccatttctgcattacttggccatgtccgtaaagcagatatcgtcagtgtatcttcattaagaaggggggtagccgaagctattgaagccatagctcatggtgacgagcatacttccaaagtagttggacgcaagattggtgatattagactaccaccaggcacgacaattggcgcaattgtccgcggtgaagaggtaatcattgccaatgattacagcattatccaacaaggcgaccatgtaatcatgtttattaccgataaaaaatttgttcctgaagtggaaaaactattccagccgagcccttttttcctgtaa

SEQ ID NO: 302 - DNA, 201 bp, Xenorhabdus bovienii
  Coding DNA location: Contig name=SeqID_16839; Position on contig =8552..8752bp; Strand=-
atgacgacataccgccataaaaaaggcgtcatcaaagataatgctatagaggcactgttacacgaccctttatttaggcagcgagtagaaacaaacaaaaagggtaaaggaagttatagtcgtaaagaaaaacatggcaaaagtagtggttgggaggccaatgataataattttttcaagttgttatcattggccttctaa

SEQ ID NO: 303 - DNA, 414 bp, Xenorhabdus bovienii
  Coding DNA location: Contig name=SeqID_16839; Position on contig =8828..9241bp; Strand=-
atgtatcgtattggtcagttggctaaattagcgagtgtcacgcctgatactattcgtttttatgaaaaacagggattgatggctcatgaggaaagaacagaaggcggttatagactttataccgaacaggatttacaacgattacgttttattcgttatgcaaaacaatcgggttttacactggaaacgattgtagagttactgtctattcgtgttgatcctgagcatcatacatgtcaagaatcgaaacaaattgttgattccagattacaggaggtcgaagataaattattggaaatgcaaaaaatgcgtaattctttaaaaatgttgagtgatgcatgttgtggtagtgcgcataccagcacatattgttccatattggaaattttggaagaaggagcaactaataaataa

SEQ ID NO: 304 - DNA, 393 bp, Xenorhabdus bovienii
  Coding DNA location: Contig name=SeqID_16839; Position on contig =9420..9812bp; Strand=-
atgcgccatcgtaagagtggtcgtcaattgaaccgcaacagcagccatcgccaagctatgttccgcaacatggcaggttctttggttcgtcatgagatcatcaagacgactctgcctaaagcgaaagaactgcgtcgcgtcgttgagccgctgattactcttgccaagaccgacagcgtagctaatcgtcgtctggcattcgcccgtactcgtgataacgaaatcgtggcaaaactgtttaatgaactgggtccgcgttttgcgagccgcgcaggtggttacactcgtatcctgaagtgtggcttccgtgctggtgacaatgctccgatggcatacatcgagcttgttgaccgcgccgttgagtctcagacagaagcagcatctgcagagtaa

SEQ ID NO: 305 - DNA, 990 bp, Xenorhabdus bovienii
  Coding DNA location: Contig name=SeqID_16839; Position on contig =9853..10842bp; Strand=-
atgcagggttctgtgacagagtttctaaaaccgcgcctggtagatatcgagcaagtcagttcgacgcacgccaaggtgacccttgagccattagagcgtggctttggccatactcttggcaacgcactgcgccgtattctgctttcgtctatgccgggttgtgcggtgactgaggttgagattgatggtgtactgcatgagtacagcaccaaagaaggcgtacaggaagatatcctggagattctcctcaatctgaaagggctagcggtgaaagttcagggtaaagatgaagttatccttaccttgaataaatctggcattggccctgtgactgcagccgacatcatccatgatggtgatgttgaaatcgtcaagccgcagcacgtaatctgccatctgactgacggaagtgcttccattagcatgcgtattaaagttcagcgcggtcgtggttatgtgccggcttctgcccgaattcattcggaagaagatgagcgccctatcggtcgtttgttagtagatgcttgctatagcccagtagagcgtattgcctacaatgttgaagcagctcgtgtagaacagcgtactgacttggataagctggttatcgaaatggagactaacggcacaatcgatcctgaagaggcgattcgccgtgcagctaccattctggccgaacaactggaagctttcgttgatttacgtgatgtacgtcaaccagaagttaaagaagagaagccagagtttgatccgatcctgctgcgccctgttgacgatctggaattgactgtccgctctgctaactgccttaaggcagaagctatccactacatcggtgatctggtacagcgtaccgaggttgagttacttaagacacctaatctgggtaaaaaatctcttactgagattaaagacgtactggcttcgcgtggactttctctgggcatgcgtctggaaaactggccaccagcaagtatttctgatgaataa

SEQ ID NO: 306 - DNA, 621 bp, Xenorhabdus bovienii
  Coding DNA location: Contig name=SeqID_16839; Position on contig =10868..11488bp; Strand=-
atggcaagatatttgggtcctaagctcaagctgagccgtcgcgagggtacagaccttttcctgaagtctggcgtgcgcgcgattgacaccaagtgtaaattagaacaggcaccaggccagcacggcgcacgtaaaccgcgtctgtctgactatggtgtacagttacgtgaaaaacaaaaagttcgtcgtacttacggtgttctggaacgtcaattccgtaactactataaagaagcaactcgtctgaaaggcaacacaggtgaaaacctgttgactttgctggaaggtcgcttagataacgtcgtttatcgtatgggcttcggcgcgactcgtgctgaatcacgtcagatggtaagccataaggctatcatggtaaatggttgcgttgtcaatatcgcttcttatcaggtatccccgaatgacgtagtcagcgttcgtgaaaaagcgaagaagcaggctcgtattaaggcagctttagagctggctgagcagcgtgagaaaccaacttggttggaagttgatgctgcgaagatggaaggtgtgttcaaacgtatccctgaacgtactgatctatccgctgacattaacgaacacctgatcgtcgagctttactctaagtaa

SEQ ID NO: 307 - DNA, 390 bp, Xenorhabdus bovienii
  Coding DNA location: Contig name=SeqID_16839; Position on contig =11533..11922bp; Strand=-
atggcaaaagcacctattcgtgcacgtaagcgtgtaagaaaacaagtctctgacggtgtggctcatatccatgcttctttcaacaacacaatcgttactattactgatcgtcagggtaatgctttgggttgggcaactgcaggtggttccggtttccgtggttctcgtaaatctactccgtttgcggctcaggttgcagcagagcgctgtgctgaagcagtaaaagaatacggaattaagaacctggaagttatggttaaaggacctggtcctggccgtgagtcaactattcgcgcattaaacgcggctggtttccgcatcactaatattactgatgtgactccgatccctcataacggttgtcgcccaccgaaaaaacgtcgcgtttaa

SEQ ID NO: 308 - DNA, 357 bp, Xenorhabdus bovienii
  Coding DNA location: Contig name=SeqID_16839; Position on contig =11938..12294bp; Strand=-
gtggcccgtatagcaggcattaacattcctgatcagaaacataccgtaatcgcgttaacctcgatttacggcatcggtaaaacccgctcacagcaaatctgtgaagcagcgtgtattgctgaaaatgttaagatcagtgagctgtctgaagagcaaattgacaagctgcgtgacgaagttgccaaatacgttgtagaaggtgatctgcgtcgtgaagtgaccctgagtatcaaacgtctgatggaccttggttgctatcgtggtttgcgtcatcgtcgtggtctgccagttcgcggtcagcgtactaagaccaatgcacgtacccgtaagggtccgcgtaagccgatcaagaaataa

SEQ ID NO: 309 - DNA, 1332 bp, Xenorhabdus bovienii
  Coding DNA location: Contig name=SeqID_16839; Position on contig =12593..13924bp; Strand=-
atggctaaacaaccaggattagattttcaaagtgccaaaggcggattaagcgagttaaaacgcagacttttgtttgttattggagctctgattgttttccgtattggctcttttattccaatccctggtattgatgccactgtgcttgccaaattgctcgaacagcaaagaggcaccattattgaaatgtttaacatgttctctggtggtgctttaagccgtgcttctatcttcgcactgggtataatgccgtatatttctgcatctatcattatccagttgctaactgtggttaatccccgtttagcagagattaagaaggaaggggaagctggtcgtcgtaagatcagtcaatacacccgttatggcacgttagtgctggcaatatttcagtcaatcggtattgctactgggttgccgaatatgcctggaatgcaaggtttagttattaaccctggctttgcgttctatttcacggctgttgtaagtctggtcacgggaaccatgttcttgatgtggttgggtgagcagattactgagcgaggtatcggtaacggtatttcaatcataatctttgctggtatcgttgcaggtttaccacctgcaattggtcacaccatcgagcaagctcggcaaggcgacctgcacttcctcctgttgctgttggttgcagtattagtgtttgccgtaactttcttcgttgttttcatggagcgtggtcaacgccgtatcgttgttaactatgctaaacgtcaacaaggtcgaagagtttatgcggcacaaagtacacatttaccgttgaaagtgaatatggctggggttatccctgcaatttttgcttctagtattattttgttccctggtaccatagcctcttggtttggtggtggaacaggctggaattggttgacaactatttctatgtatttgcagccaggtcaaccgctttatgtgttattgtacgcatctgcaatcatcttcttctgtttcttctacacggctttggtatttaatccaagagaaacagcagataacctgaagaagtccggtgcatttgtaccaggaattcgtccgggagagcaaacggctaagtacatcgataaagtaatgactcgcctgaccttagttggtgcgttatacattacctttatctgcttaatcccggagttcatgcgtgacgcaatgaaagttccattctattttggtggtacttccttactgattgtagttgtcgtcatcatggactttatggctcaagtgcaaactctgatgatgtcgagtcaatatgagtctgcattgaagaaggcaaacctaaaagggtataaccgctaa

SEQ ID NO: 310 - DNA, 435 bp, Xenorhabdus bovienii
  Coding DNA location: Contig name=SeqID_16839; Position on contig =13932..14366bp; Strand=-
atgcgcttaaatactctgtctccggctgaaggtgctaagcacgcatctaaacgtgtaggtcgtggtattggttctggcctaggtaaaaccggcggtcgtggccacaaaggtcagaaatctcgttctggcggtggtgttcgtcgtggttttgaaggcggccaaatgcctttataccgtcgtctgccaaaatttggttttacttcacgtaaagcaatgatcactgcagaaattcgtctgtctgattttgcccatgttgaaggcgatgttatcgatctgaatgcactgaaagctgctaacattgttggccctcaaattgaattcgcaaaagttatgctttctggcgaagtcaatcgcgcagtaattgtgcgtggcttacgtgttacgaaaggcgcccgtgctgcaattgaagccgctggcggtaaaattgaggaataa

SEQ ID NO: 311 - DNA, 180 bp, Xenorhabdus bovienii
  Coding DNA location: Contig name=SeqID_16839; Position on contig =14370..14549bp; Strand=-
atggctaagactattaaaattactcaggttcgcagttcaattggtcgtttgcctaagcataaggcaactctgactggtttaggtctgcgtcgcattggtcatactgttgaacgcgaagatacaccagcggttcgtggtatggtcaacttggtttcctatatggttaaagttgaggagtaa

SEQ ID NO: 312 - DNA, 501 bp, Xenorhabdus bovienii
  Coding DNA location: Contig name=SeqID_16839; Position on contig =14555..15055bp; Strand=-
atggctcacatcgaaaaacaagctggcgaactgcaggaaaagctgatcgcggtaaaccgcgtatctaaaaccgtcaaaggtggccgtattttcagctttacagcactgactgtagttggtgatggtaacggtcgcgttggttttggctacggcaaagcacgcgaagttccggcagcgatccagaaagcgatggaaaaagcacgtcgcaatatgaaaaacgtcgcacttaacagcggcaccctgcaccacccagtgaaaggtggacacaccggttctcgcgtgttcatgcagcctgctcacgaaggtacaggtatcatcgccggtggtgcgatgcgtgctgttctggaagtggctggagttcgtaacgtactggctaaaacctacggttccactaacccgatcaacgtggttcgtgcaactctggacgctttagacagcatgaagtctccagaaatggtcgcagctaagcgtggcaaatccgtcgaagaaattcaggggtaa

SEQ ID NO: 313 - DNA, 354 bp, Xenorhabdus bovienii
  Coding DNA location: Contig name=SeqID_16839; Position on contig =15070..15423bp; Strand=-
atggataagaaagcagctcgtatccgtcgtgcgacccgcgcacgccgcaagctccaggaactgggtgcaactcgcctggtggtacaccgtacccctcgccatatttatgcgcaggttatcgcaccaaatggttctgaaactctggtggccgcttctactacagaaaaagctattagtgaacaactgaaatttactggaaacaaagaagccgcagcagtagttggtaaaattgttgctgaacgtgctctggaaaaaggtatcaaaaatgtatcctttgaccgttctggtttccaatatcatggtagagtccaggcactggcagatgctgcccgtgaagctggccttcagttctaa

SEQ ID NO: 314 - DNA, 534 bp, Xenorhabdus bovienii
  Coding DNA location: Contig name=SeqID_16839; Position on contig =15433..15966bp; Strand=-
atgtctcgtgttgcaaaagcacccgtcgtcattcctgccggcgtagaggttaaactcaacggtcaggttatttcgattaagggtaaaaacggcgaactaagtcgtaaaatccacaatgcagttgaagttaaacatgcggatggccaactgactttcgctccacgcgaaggttttgctgatgcttgggcacaggcaggtacaactcgctctttgctgaatgcaatggttatcggtgttaacgaaggcttcaccaagaagcttcagctggtgggtgtaggttaccgtgcagcagttaaaggcaatgctgttagtttgtctttaggcttctcgcatccggttgagcatcaactgccagcaggcataactgcggaatgcccgtcacaaactgaaatcgtactgaaaggtgctgataagcaggtgattggtcaggttgcggcagatctgcgtgcctatcgtcgtcctgagccatataaaggcaagggtgttcgttacgccgatgaagtcgtgcgtaccaaagaggctaagaagaagtaa

SEQ ID NO: 315 - DNA, 393 bp, Xenorhabdus bovienii
  Coding DNA location: Contig name=SeqID_16839; Position on contig =15981..16373bp; Strand=-
atgagcatgcaagatccgatcgcggatatgctgacccgtatccgtaacggtcaggccgcgaataaagttgcggtcaccatgccttcctccaagctgaaagtggcaattgccaacgtgctgaaggaagaaggttacattgaagattttaaaatcgaaggcgacactaagccagaactggaagtcactctgaaatacttccaaggtaaggctgttgtagaaagcattcagcgtgtaagccgcccaagtctgcgcatctataagaaaaaagatgagctgccaaaagttatggctggtttgggtatcgctgttgtttctacctctaaaggtgtaatgactgatcgtgcagctcgccaagctggtctgggtggcgagattctctgctacgtagcttaa

SEQ ID NO: 316 - DNA, 306 bp, Xenorhabdus bovienii
  Coding DNA location: Contig name=SeqID_16839; Position on contig =16407..16712bp; Strand=-
atggctaagcaatcaatgaaagcacgtgatgtaaaacgtgcgaaattagctgagaaattcttcgcaaaacgcgttgaactgaaagcgatcatctctgatgtaaacgcatctgacgaagaccgttggaatgctgttctcaagctgcaaacactgccacgtgattccagcccttgtcgtcagcgtaaccgctgccgtcagactgggcgtccgcatgcatttttgcggaagtttgggttgagccgtattaaagtccgtgaagccgctatgcgcggtgaaatcccgggccttaaaaaggctagctggtaa

SEQ ID NO: 317 - DNA, 540 bp, Xenorhabdus bovienii
  Coding DNA location: Contig name=SeqID_16839; Position on contig =16725..17264bp; Strand=-
atggcgaaactgcatgattactacaaagacgaggtagtccagaaactgatgagtcagttcggttaccattctgtcatgcaagtccctcgggtcgagaagatcaccctgaacatgggtgttggtgaagctatcgctgacaaaaaactgctggacaatgcagcagctgacttgacagcaatctctggtcagaaaccattgatcaccaaagcacgcaaatcagttgcaggcttcaaaatccgtcagggctatccaatcggctgtaaagtaaccctgcgtggcgaacgtatgtgggagttctttgagcgcctgatttctattgctgtaccacgtattcgtgacttccgtggtttgtccgctaaatcatttgatggtcgtggtaactacagcatgggtgttcgtgagcaaatcatcttccctgaaatcgactacgataaagtggatcgtgtacgtggtttggatattactatcaccactactgcgaaatctgatgatgaaggccgcgcactgttggctgcgtttaacttcccgttccgcaagtaa

SEQ ID NO: 318 - DNA, 315 bp, Xenorhabdus bovienii
  Coding DNA location: Contig name=SeqID_16839; Position on contig =17278..17592bp; Strand=-
atggcagcgaaaatccgtcgtgatgacgaaattatcgtgctgactggcaaagataaaggtaagcgcggtaaagtaaaacaggttctttcttctggtaaaattatcgttgaaggtatcaatctggttaagaaacatcagaagccggttccggcactgaatcaaccaggtggcatcgttgaaaaagaagcagctatcaatgtttctaacgttgcaatctttaatgcagtaaccagcaaggctgaccgtgtaggttttagattcgaagacggcaaaaaagttcgtttcttcaaatctaatgacgaaactatcaagtaa

SEQ ID NO: 319 - DNA, 903 bp, Xenorhabdus bovienii
  Coding DNA location: Contig name=SeqID_16840; Position on contig =613..1515bp; Strand=-
atgactagttttgcactggattattttgccgaccatctgccccgaaaaccctatcacacggatgatttactctctgggttgcgtatcaataacgccgatgtggccaagctcgcccgttacatccaacacaatcccccccatgccgctttctggtttgtgtttgatgttgatcgcgttggcgcggcgatagactggacggacagcaacgcgcctgcccccaacatcacggtaaagaaccagacgaacgggcatgcccatctgctttatgggctacaaacagccgtcagaactgcccccgatgccagtatcaaagccctgaaatatgccgcatcggtagaacgtggcttgtgtgtgaaactccgtgccgacgtgaattacagcggactgatttgcaaaaacccccttaacctgcactggcaggtgaccacatggcgtcaggcagtctacacgctggacgagctggccgattatgtcgatttgaacgtcccagaagcccgcgtaaacgattttaactacgggctggggcgtaactgtcagttattcgaaaaaacgcgtaaatgggcttacagggcgattcggcaggggtatcccgattttgcccagtggcaactggccgtcattcagcgtgtggaaatgtacaacgttcagctgaccaacccgctatcgctgccggaatgcgcctgtatcgggcgcagtattgccaagtggacacaccagcgtatgagcgaaaaggcgttcgcgcagtatgttgcagacacgcatacgccagagatccaggccgccagaggacgtaaatcaaagcgtggcgcgatcccaagctcagagagaacgctcaagccgtgggaatcactaggaattagtcgccgctggtattaccacaaaaagaaaaatggtttgctttga

SEQ ID NO: 320 - DNA, 1227 bp, Xenorhabdus bovienii
  Coding DNA location: Contig name=SeqID_16840; Position on contig =2165..3391bp; Strand=-
atgcttaaactaatccatagtcagtcgtctctgttctttgtttcatacgttataaatgccttaatcaattgggcattcaaatttatagcacctttggcgctatatgcggaaacacaatccctgcagatgatgactattagttatggattactatttacaccaaacattatcgccccacctttcatcaatttaatcgatggcaagcttgctagaaaaacaagcttgctaatcctgaattttttgggattagcatcatgtgcattcagtttcttctattttagaaaagggtttaatagtactgcatttctgactattttatttatgctctcaactgttctaacgctgtttcaaacactcatccatagcgtaattaaagatgttttccacgacaaagatgcaattgctattactagtcgcagaattgcctttgtcgatagtttattccctgctgttggtcctctcattggtgcagtaatgctgagcgctttcaattataatcatgtgtttttgattattgccatagtttatacactatcattccttcttattaagatattaaaaatcgatgaacgaaattcagaaataaaagacagtttcgtcgttagaactaccaaaggttttcaattaataaaaaactcttctttcattaatttcttactaacgagattcttcctttctaatatagcattgcatgggtttcaatcagtgctaacattttatttgattgataaattccatttggcagatataagggttggattcttcttcgccatttcagcgttaggactcttggttggtgtccgaattggacgttttatctatgctcaagatatcaacaaatggtatgtcatctctgcaacagggattatctgcgccgttagcctgattattattccattaaccaacaacatcgttatagctagtctggcatggtgtgctgtgatgcttctcagctctattaaccttattgttttttacacagaacgtcagactaactttcaccagaacgatacaacctgtgtaatctccgcctcttatgtaattatctattcagccattccacttggttccgcagtctcgtttttcctttccaagtactttaatgccagtgaaaccatgtttattctaggtacatacatgctgttgatcggcttctatttcctttatgtttccatcaggaaccaaaagactctaaaaatagaaaaaacatcaaactcacaaaattaa

SEQ ID NO: 321 - DNA, 975 bp, Xenorhabdus bovienii
  Coding DNA location: Contig name=SeqID_16840; Position on contig =3379..4353bp; Strand=-
atgtcgcaaattagtgctatcatagaaaccaataaaaattattttaatagcgaaattctcacttcacttaaatatctttctgaaaacttcaagattcctgttaaaaataatgtttccgttaattataactggcaagtatatgccaattatttcctttgcgtggacgctatcaaggaaggtgacagtaacagcgccgaagattatctgcgctcagctctgaatagtcttaccactgattcttcgacacgctccattgtggatcatggtcgtccagaagtaacagtaattacgcctgaaaatatagactctgaactatccagaacactaaagggtatctatgacaagccggacaatgatgtcaacgatgatggcgtttatgctttcggccccttccctggcaatacaagtcaggaattcgcaagaatcaaacatgcttttgatttattgcaatccgtttctcctgagtattacagttttgtaacctccttggttaagcatatagtccttgtcggccagactgaacgcggtggaataaaatctggctctacgttgaaaacgcttggctgcatcattatatcacctaacacaaaagaggaattcagtccggttggtcagtacattgaagatttggtacacgaagcctcccatactcgactcttcctggaacaaacaaaggatcagctggttaacaaccccgtagtaaacctctacgcagccccctttcgcaaagataagcgtccaatgtcaggaatttaccatgcaaattatgtgcttgggaatatcgtggcttacttcagcaaggctgttaaagtaactcctgatgataaagaaatacacaacgacctgttcttggctcgcgcacttgctcgatacaacgaaacgtatttagttgtccagcaacatggtgatctaaccgaacgcggccgacagatttttgatgaaatgaaaattcaggtagataaatgcttaaactaa

SEQ ID NO: 322 - DNA, 246 bp, Xenorhabdus bovienii
  Coding DNA location: Contig name=SeqID_16840; Position on contig =5076..5321bp; Strand=+
atggcacaagttgtcgtgaaaaaatggggtaacagcccttctgtacgtcttccggtcgctattatgcaagctgcttcacttaatgttgatgatacggttgatattgctgtcgaagatggtcgaattatcattattccggtcaaggcgaaagaatattctctcgatgcgctattagctgggattacccccgaaaatattcatgaaaaaatggattttggttctccagtaggtaaggaattgatctaa

SEQ ID NO: 323 - DNA, 333 bp, Xenorhabdus bovienii
  Coding DNA location: Contig name=SeqID_16840; Position on contig =5321..5653bp; Strand=+
atggtttctcgttttgtgcctgattctggcgatattatttggattgactttgatcctgtggctggacacgagcaaggaggtcatcgccccgcagtagtgctgagtccatttgcctataataataaagtgggattactgctctgtgttccttgtacaacgaaggcgaaagattatccttttgaagttgaattatcaggaagccgtgacagtgttgccttagctgatcaggtgacatgtgttgattggcgagccagaaaagtaacaaagaaaggtcatgttaattcttcagagctggaggatataaaggctaaagcaaaggcgcttatcggataa

SEQ ID NO: 324 - DNA, 741 bp, Xenorhabdus bovienii
  Coding DNA location: Contig name=SeqID_16840; Position on contig =6052..6792bp; Strand=-
atgacaatgggtggcgataattttatccgctcctataaagagcgcatggcaaaaaaacaggataacgagcaggctatcctgcggttcctgaaagatgaaatctattcaacggcggaaatcctgagcagggtactgaattatacggcgaccagtacggtgtacacgacgttaaaccgaatgtgtgccaaagggttactgagcaccgaaaaagtggatttaggcggttacagaccttttaacgtgtatggcattacccagcacggggctgtcatggtcttggatgaccatgatgacccgtttaagctgaaagcgtttgaaccgtcaaaaatcaccctcagcacactggcacaccgatttgatgtacagcggttaagccttgcggccagacatcacgggtatcaatggaaaccgaccagcaatctcaagctggaaaaagggcagaaataccctgacggactaatgcgcaaggacgggaacatctgggcggtggaagtggaacgggtggcgaaatccccgaaacgctaccgcgacatcgtcgaaatttatctgaaccaaattacccaaaatggctgggctggtgtggtgtacttgttccccgaaccgcagttacgggacagggttaaacggatattttacgccgttgatgctgccatgattggcgggcgtctacagtccttatcgcctgaaatgacagaccgtttttttgactttaaaacttatgaggaatttgccagcgagtga

SEQ ID NO: 325 - DNA, 1980 bp, Xenorhabdus bovienii
  Coding DNA location: Contig name=SeqID_16840; Position on contig =6773..8752bp; Strand=-
atgtctttatcatcggcgttgtattctgttctgaaagcgtatccgttcgcgttttctgtcattgaagcggactggctggctgttgctgtttgcgggtttgtttttagttttgttttttttactttgagccggacattgcatgcttatagtctgctgggtgtgagcagtgaggcgattcgaaaagcgcaattgcacaacaaaacgggtgatgggaaaaccatcccgttagtgtggcgtcagaaagcgaatctggataatccgtccaaacgtatttatgcaagacgctggattgcacggctatttatgtcattggtgagcgcgttgtttggtttaactgccttagcttatctcctgttagtttttgcctgctttatcatcaatgacaaagtcacgtttgagttattgttgagtgaaaaccgtttttatccggcgttctggctggcgggttctctggtggcaggggggattgtatcgagtctggtttactttatttttatccgtgacgttatggcgagaaaagatgcagacattaaccgcgttatcattgaaaagcggaataagcacaaagggcgaacgggcgaactttctgacgcccgttcactgcaatttgcgtctgtgcctgattttaatccggttgattattttaatacggcggcggccaaggatgccgtattcctcggactggacgagaaacgccaccctatctacatcccgcgcaagatatgggtgaaatccaatgttcagataatgggatcagtcggcagtggtaaaggtgtgctggcctgttgtgctctggcgcagtgtaccggaatgtttaatgacacggtcatcgtttttgatccgaagaacgatgaatttgccccgcacgttctcaaagggcagtctgataaatttttactgctggatttacgccagggtaaacctgcacaactgaatattttccgtgacctgtcctcttatcagctcaatgaattactggtctcgggcttcagtctcggacggcggggcgataatgcggatttttaccgtgacaatgaccgccaggctgtccgtttgttgtcgtcccagtttgaacacggtacagatgtcacagccctgcttgaagcggcgcaacgtttgccacaaaaggtcagggagtccgccagtggttttatgacgctgttacaggaattgtgctcgttgtccgttttacagacccatgaggggattgatttaaaggattttatccttaatggcggttgtctgtatgttgtcggctctctgcgtgatgaatcggtgatcatgctgcaaaaaatgttgtttgtgcgttgcttacagattatcgaggagcgcgaccgttttcatgaaactacgcacgtgaatatttttctcgatgaggttaagtacctgctttcaaaatccagtctggaagccctcggcacagtacgtgacaagaactgtaatattctgctgacacaccagtctctcggcgactttggtcagtgtggtgccgatatgaagccggaagtagtccaagcgacggtgatagacaacacgccgattaaatggatctaccgcatgaaagattacaaagtggcggagtgggcaagcaagcaaacggggcaaatactggtcgacagtgaacggcgcaacgtgaccacagagaccggcaatgttgaactgatgagcaccgaaaccaccgtatttaaagaaaaacgtgaactcatcgacaccaacactatccagcacctgcccgatggcgcggccgtgatgattggtgtcgggctggcgcggattgcgtatagcaaaccgattaaagccgcgcgacgggagattgcattaaccgaataccccaccctcaagcagcctgattttcatttttcagcttcatccttccctgaatatgccggagaaataccgcaacgtgaagaggctgttaccgagtctgtggcacagacacactttaaccgagagagtcgtgatgacaatgggtggcgataa

SEQ ID NO: 326 - DNA, 561 bp, Xenorhabdus bovienii
  Coding DNA location: Contig name=SeqID_16841; Position on contig =149..709bp; Strand=-
atgattatcaaaaaagaaaaagcagaacagattatcgcaaaacacaagaagttgattgcatggaaaccagcaagagttgttgccgcattgataaaaatagggatgtcagaagcggaagcgacagcaatggtcaaaacaaacacaccagcacgaaaggagcataaaccacataagccccacaacagccacgcaaagcctgtgaatctggaagcactgagcactcactacatcgtggtcggtgattacgatttgctgggcctgagacatcaggatgcactgattgtcgccatccgaaacggcaaagggaaaagctcatggaatgatggggcaatggcggtaatcctgttcggattagtcaaggcatacccgatcatcactacagccgaggtgaacaaattcctcaaccgtggcgcatttattgacagcattccattgttcattgacggggagatgatcgacggtgaaacgatgccgtcagcggataacgagagcgtgaaagacgtttttcgtgtggttaagcaactgaaaaaaatcactgagcggcgcattgactttcaataa

SEQ ID NO: 327 - DNA, 207 bp, Xenorhabdus bovienii
  Coding DNA location: Contig name=SeqID_16841; Position on contig =1939..2145bp; Strand=+
atggagagtgtaattgatacatgttctaatttagatattgaattagagccagctaaaaatgcaatcgaaaaatcaagatcactattgagcacaatgattgatgtctgtggagataatgacgacgcaaatttacttcttattgcgatagatttagcctttgatgctggcaaagaaatagcacgagtcagaggagtagaatactcatga

SEQ ID NO: 328 - DNA, 411 bp, Xenorhabdus bovienii
  Coding DNA location: Contig name=SeqID_16841; Position on contig =2142..2552bp; Strand=+
atgaaaatacttaaacccatcgaaaccgccactaatcaagagatcgttattgagccacgtgaagtctatgtcgttcgcggttctggcaagacttatctgagtgagaaaggcgcactgaataaactggcttacgttcgggcacaagagcagttcaacgccgacgaaaggccaagcaacttccctgccgaagaagtcattcaggaagacggcacttctgcattacgccgtggaaagatgcgacctgaatttatggaacgacatgctcaggtattggaagaactgaaagtcgctgttagacgagaaagggaaaagatagccctacggaaaaagtattcaaaagcaatgaataaaattaactcattacatgaaacaatatctgagttagaaatacaaatagccgaattagaataa

SEQ ID NO: 329 - DNA, 345 bp, Xenorhabdus bovienii
  Coding DNA location: Contig name=SeqID_16841; Position on contig =2630..2974bp; Strand=+
atgacacaatcaattttgcttgaaagaaagcgaaaggcatttatacatgccaaattggatgcattacaaaagaagcacggctctcactctgtatttgtaaaagaatctggcgttaattgccgactggatttagacgaggaaatattaactctcgctttaattaagttctttgaggatgaactggacgaacaccaacataaattacatgaacttataaacacatatgacagcttttacaacaagttcggaaatttaaccgcagaaggcaatgagtttatgaatgaaatattaaaactcattgcaaagaaaacagaacccataaatggagataacaatgaaaaatga

SEQ ID NO: 330 - DNA, 279 bp, Xenorhabdus bovienii
  Coding DNA location: Contig name=SeqID_16841; Position on contig =2964..3242bp; Strand=+
atgaaaaatgaaacctatttatattttgctgaaacagccatccagaaagagaaagaagagaagtatgaccttgcagctttatattggggaaaagccaaatatttagccgctgatcttaagcatcgattatgggcgcaatataaccaagagaataacgaagaaagacacttattacataatagctataaacaggcggcaaatgatgactacatacgaacaagcaaagcaattagcacggattttagaactccaaggcttctttcgccgtgcggccaataa

SEQ ID NO: 331 - DNA, 189 bp, Xenorhabdus bovienii
  Coding DNA location: Contig name=SeqID_16841; Position on contig =3166..3354bp; Strand=+
atgactacatacgaacaagcaaagcaattagcacggattttagaactccaaggcttctttcgccgtgcggccaataaatggggtgaggctctttcattaacccaagagcacaaacaagaacaagaatgcaccaagaataacctgcgctgtgttcgacaagcaagaataactattcgggaggggttgtaa

SEQ ID NO: 332 - DNA, 219 bp, Xenorhabdus bovienii
  Coding DNA location: Contig name=SeqID_16841; Position on contig =3354..3572bp; Strand=+
atggtaaaaaagaaaagaagtaaaacacaacaaggcttcatgggaatgactatcccccaaggaatgcaattaggaaaagacgaagaacgtgattatttaaattcaaaaaaatatatcgccaatttctcaatagaaggcgaattcctaaaagtaccacttaatagagctatgcgacgccatgcaaagaaaatgaagattgaacttaaggaagcagaataa

SEQ ID NO: 333 - DNA, 789 bp, Xenorhabdus bovienii
  Coding DNA location: Contig name=SeqID_16841; Position on contig =3572..4360bp; Strand=+
atgagcaagaaaaacgaattagtaactatcgattcaaacaagctgccagtaatcgaatggcaaggcgttcgtgtcgttaccactgaaacgctggcgactggatacggaacggaaccaacaaacatccgttccaatattgctaatcatcgcagccgctttattgagggtgttcatgtattcactcttaaaggtgataactttcaatcatttaagaaccaaggcaataatattgacttggttaataaacatgcaaatcaaatcacccttttcacagagaaaggtgcggctcgcatgtcgaagattcttgataccgatgaggcatggtctttctttgaaaagatggagtcagcttactttcaccagaaaaaatccgcaaccaatccccctgccttgcccggtgattacattgcagctctggaagcattgctgacaactgaaaaagaaaaggtcgtcattactcaagaacgtgatgaagctcgccgtaccaaatcacagatcagtcgcagtcgtgaggctcaggcactcggcaaactcagcgctgccacccgcaaatgcagagagttggaagaacgtctgggcgaaagcacaaaacacgcaacagttacggctgtgcagaacgccacagaaaaagaatacaactacgccccactccgtaaatggtgccgtgaaaacaacatcgaagttgtgaaggttcccgatacccgatatggacatgttaagtcatggcctgccgaagcatggctggctatacacggtgttgatctcaagaaattatttggcaagaagtga

SEQ ID NO: 334 - DNA, 249 bp, Xenorhabdus bovienii
  Coding DNA location: Contig name=SeqID_16841; Position on contig =4371..4619bp; Strand=+
atggaaagaacaagatatgttgtgacctatttaggtgattacccctgcggacatcgccacccactaagcatttctatggtggctcgtgatgctgctgacgctttcactaaagcacaagaaacactcgcattcactgatgatcgcctgacatcaactaatcacaccctcttctctgtcatgcctgagagattcaacgaaagcatgcttgctgacatgcacctgtgcccaaacgcggaggtgaagtcatga

SEQ ID NO: 335 - DNA, 531 bp, Xenorhabdus bovienii
  Coding DNA location: Contig name=SeqID_16841; Position on contig =4616..5146bp; Strand=+
atgatcatcaactccaatttattacgtgccgcattggtttgtgtggctaaaaatgacccgcgttattacctttgcggggtgcacatcacccccaaatatctggaatcaacaaacggtcatgtggctttacggttggagcatggcgtgaacacacgccgtaaagctatcgttcagttttacgggaagatccccaagaaagcagaaaccacagaactgcatttcaccaaagaaccttatgccgtacaccgagatgttaatggggcgcgagtgggatttaccgtcttatcaatactggatggacgctttcctgacctaagccgcatcatcccaaagaaagtggaaaatgttattcctcactttcaggctgagttcttggcttacccctacaaaatgtttgaagccgattcagctttcatcaccgtttccctgtatccatccagcatgacagacgcctgcttaatgaagtttggcgacaacatcaatcagcgttatggcaatcctctgtttgtcgtcatgccattccgggtgtaa

SEQ ID NO: 336 - DNA, 228 bp, Xenorhabdus bovienii
  Coding DNA location: Contig name=SeqID_16841; Position on contig =5157..5384bp; Strand=+
atgagaattgaatatctcgacaagggcaatacggcacaaatagtcattgccagcttcatcaccgaacgcagcaaacacaatcgttgtgttgatgctgccctgttagccacacctgttcgggcttcttcttccggtgtgtttttcagaagaacggttatcacaggcaaagccaatcacatgatacgtgcttacaagaccatttgtaaggaggctgacagtgacagatag

SEQ ID NO: 337 - DNA, 1161 bp, Xenorhabdus bovienii
  Coding DNA location: Contig name=SeqID_16841; Position on contig =5401..6561bp; Strand=-
atgataaccgtagaaactgccatgcaagcaaccacgcttagtcacgcctttggacacctcactgatccgcgtgtcaaccgcactaaacagtatgccctcatcgatattttaaccatttcgatttgtgccgtgatctgcggttgcgaaggtttcaatgcgattgaagaatacggtaaatccaaggaagattggtttcggcagtttctggatcttcccaatggcatccccagtcacgacacctttaacgatgtgataaatcggcttgatccccaagaatttggggacgcttttacccaatgggtgggcagcttagccaaaatctccgatgacattattgcgttggatggcaaaacattgcggggaacgctcgacaaagccaatggcgcaccggctctccatctggtcagcgcctggtcagtcgcgaatcaactctgctttggtcaggtgaaagtctcggacaaatcgaatgaaatcactgcgatccccaaattgttggcgctactggatattggcggttcgaccatcacgattgacgcgatgggctgccagtacaaaatcgctgaccagattgtcgagaaccaagccgattatgtgctggcgttaaaaagcaaccagggtgagtttcatgatgatatcaaactctttttagaaacccagctggcgaacgattttacgggaatatctcacgccaaaacccagtgcacggagggcgatcatggccgtattgaagagcgtcggttgtggctggttaacgatatcggttggttgcgggctcggcaccctcagtggcatacgctgggcggcattgcggttgtggagtcctggcgtgaagagcagggaaaatcagcgagttatgaaagacgttactttatcaccagtcaccgtgataagtcggcggactttatcgcgtgcgcgatacgcagttattggcacattgaaacgaagctgcactggcagttagacgtcagttttggtgaagacggccagcgtctgagaagtggtcatgccgctgaaaacatggcattaatgaataaaatagcccttaacctactgaaaaatgagaaaaccgttaaggtgggtgtgaaaaccaagcgccagaaagctggatgggataatggttatatgctgaaggttctaacgggagggtttacgtcagtataa

SEQ ID NO: 338 - DNA, 204 bp, Xenorhabdus bovienii
  Coding DNA location: Contig name=SeqID_16841; Position on contig =6690..6893bp; Strand=+
atggcagacattgacgatgtgcttgttaaggcaacattccacatcgacgacggcacggatcaaacacagcggctcattcatatcatgaggcgtaaccaacatcttcatgagggcatctgccctcctctgccacccgcaccaaaagtggcagaagtgaagttaacaccggtgaagaaagcgcgtaataagcaaggtaaagaataa

SEQ ID NO: 339 - DNA, 570 bp, Xenorhabdus bovienii
  Coding DNA location: Contig name=SeqID_16841; Position on contig =6985..7554bp; Strand=+
atgctggcaaactgtattcgcaagggaatagttgaatcggtcaatggcatgtattccctgacagagcaaacagcacctaataatatgaatgttaaagaaatagcctctaatcaggcagcaccaacaaaagttgaggtattgagagggttactctctgaacgtggagaaatgtcttcaactgaacttgcgaaagaagcaggcttcccagtgaacaatatcggcgggttactgggaaaagatatagaaaaaggtgtgataggcatgcataagagggatgggcgtcgtttctattattgggttgcgtctgtttgtcttcctgttcgtcatgttgagctgattaagccggagattgaagtgggagtttcagaaccacaaccaatgaagccagtgattgagtccagtgactttatcacggttccgagtagttctgcactgaaaagagagttgcaacaactcgatcagcgtctggacgtacttcaatccgaacggcagcaaaaggccagcattctagaccttatttatgaactggaagacctattgtctgtgaaggcggtgagccatgatcaataa

SEQ ID NO: 340 - DNA, 318 bp, Xenorhabdus bovienii
  Coding DNA location: Contig name=SeqID_16841; Position on contig =7544..7861bp; Strand=+
atgatcaataactccttccacctgactcaaatcatcgcctcggtttggggcgatccttctgacatcaccgatgcaatctggcaagcaggataccgtaaaccagaacggggagaaaaggaaatcgccgagcttattattgacgttatggacggggtgcctgatcaggtgccctactctgaaaggccgaagaatctgaacgatattctcacaacggatctgaacaacattatttttgatgcgacatggagtgagacagcaacaccagcaacggtggctaagatgattttggagaacgggtatcagaaaggagatgagtga

SEQ ID NO: 341 - DNA, 258 bp, Xenorhabdus bovienii
  Coding DNA location: Contig name=SeqID_16841; Position on contig =8000..8257bp; Strand=-
atggcttctcactttgattcttatacctattggtccatccataatttgcgcagaacgatgcgtactggcgtttctgagttgactgtgcctcatatagctgaaattatggtaggccataaactgccgggaatatggcaggtgtacgataagcacacctacctgaatgagcagagagaggcatacgaacgctggtgggataagctgactaaaattgtttcccgccctcccaatcaaaaatatcctgccgtagaaaattaa

SEQ ID NO: 342 - DNA, 570 bp, Xenorhabdus bovienii
  Coding DNA location: Contig name=SeqID_16841; Position on contig =8350..8919bp; Strand=-
atgcaggatgtaaaagttaatgctgatgcaattctgcgcactttcgagattcatgttttcccaaaattcggtgaactaccccacgatgaggtaaaacttcctatttggctgactttaatcgaaggcgtcacaagacaatcaccagcaatcggtaagcggatattgacatattccaaaactgcgcatcgatgggctgttcggcgaggaatgactaataacactcctctatctgatgtgatatcaagtgatttaggaggtcaggacataaatacggatgttgatacgaatgtgggggatagaacactaagcgaagaagagcgggtgattcttttccgtcttatcaatgctcccaaatacaatctacgcaatgcactgatagtaaagttgtatttattattcggatgccgtattgctgagttattgaaagctaaagttaatgattttgattatgaaaaaaatatctggattatccctcccgcaaaccataaaacaggaagaagaactaagaaacctattattaggccgattattccaaaagccaaagaattaattgaacaggcaaaaaattaa

SEQ ID NO: 343 - DNA, 237 bp, Xenorhabdus bovienii
  Coding DNA location: Contig name=SeqID_16841; Position on contig =9016..9252bp; Strand=-
atggcaattactgattcatggctgcgttctaccaatggcaaaccccaagaaaaaatgattaccaaatcagacagagatggcttatctgttcgtgttaccccgaaaggtaaagtgatttttcagtttcggtatcgctggggaggaaaaagggataggatcgatatcggaacttacccagcaaccagtctaaaagatgctcgtgacgctgtaacctcttaccgtggggaactagaataa

SEQ ID NO: 344 - DNA, 375 bp, Xenorhabdus bovienii
  Coding DNA location: Contig name=SeqID_16841; Position on contig =9358..9732bp; Strand=-
atgagacaccattttgtctcttatggattggtaacaggtatgaatggattgggttatttgcttatcgcgatcatttctgaagtgatcgcaacaacgatgctaaaggcatcggatgggtttagtcgcttgatgccttctattgtcgttgtgataggctattgcttctcgttttgggcattatcgcaggttgtaaaagtgcttccgttgggaattgcttatgctatttggtcggggcttggcattgtgttggtctcggtggcagctatatttttataccagcaaaaactggatttgcctgcaataataggaatgttgctgattatcatgggtgttttggtaataaacctgttttctaatagtggagctaatcactga

SEQ ID NO: 345 - DNA, 915 bp, Xenorhabdus bovienii
  Coding DNA location: Contig name=SeqID_16841; Position on contig =9995..10909bp; Strand=+
atgaatagccagaaaaatcaatataatttcaataaattacaaaaacgcctgcgtcgtgacgcgggtcaggccattgtagacttcaaaatgatcgaagaaggcgatcgtattatggtctgcctttctggtggaaaagatagctatacgcttctatccattttgcagaacctgcaaaaaagtgcaccagttaatttctctctggtggcggtgaatctggatcaaaaacagccaggattccctgaacatatcctgccagcctatctggaagaactgggcattgagtataagattgtcgaagagaacacttacggtattgtaaaagagaagatcccagaagggaaaaccacttgttcgctctgctctcgcctgcgtcgtggtattttgtaccgcacggcaactgagctaggggcgaccaaaatcgctctgggccatcaccgtgatgatatcttgcagaccgtatttttgaatatgttctatggcggtaaattaaaaggcatgcctcccaaattgatcagcgatgatggcaaacatattgttatccgtccactcgcttactgccgggagaaggacattgagcgttatgccgaagccagagcgttcccgatcattccttgtaatctatgcggctcgcaacctaacttacagcgtcaggtcattaaggacatgctacgtgactgggacaagcgttatccaggacgaatcgaaactatgtttcgtgccgtgcaaaatgtggttccatctcatctcagcgatcttaatctgttcgatttcaagagtattactcatggcagtgaagtgattgatggtggggatttggcctttgatcgtgaagagctgccctcgcagccggccgttgaatcagatgagcaacttgattttcaagcggatcgtctggatgtggtcgaaataaaatag

SEQ ID NO: 346 - DNA, 984 bp, Xenorhabdus bovienii
  Coding DNA location: Contig name=SeqID_16841; Position on contig =11187..12170bp; Strand=-
gtggaaacgatttatggctcagtttttaaagattccgacgctgtgtattcctgccagttgaatggtaagggaggtatcatggcatttggggaagacgaagccgcaacagcagagcagccattctggcagcaccttgattataaaaatcaggccagccagcgatggatcatgagtacggctttgctgccgacctcagtgaaagaagggttgtcaggtgaaagtatccgaccaaaagtgcttcgcactggcgaaggcaccatgatcaccttgcggacagttaatcgcaatgaaaatgcacgtcctgatcacttggtctcgttccgcatttatatcaatgacagaatgattatttccagtcgtcaccggaaagttcgttgtatcgatcaagccatggatgatttacataatggcgttggtgccaagagtacggggcattggctggttgaaatagcaggggccattaccgatgaaatgaacgattttattgaagaactgcatgatagcctaatagggtttgaggacgatattctggagcagaaagtccccggacgcggagaattagtgttattacgtaaacaattaatcgtcttgcgtcggtatatggcaccgcagcgtgacgtatttctgcgtttggccagtgaacggctaccttggatgaatgatgaggatcgtcgtctgatgcaggagatagctgatcgtctcgggcgggggctggatgatcttgatggcagcatagcgaggacagcagtccttgcagatgaaatatcgtccatgatggcggatgcgatgaaccgccgcatttatatgatgtctttgctgacgatggtattcctgccaacgacctttttgacaggtttgtttggcgttaaccttggtggaatacctggcaatgagtatcggtttggattcggcatattttgtttcttgctgtccatactgataactattttcgcttggtggttgagacgaaccaaatggttataa

SEQ ID NO: 347 - DNA, 1617 bp, Xenorhabdus bovienii
  Coding DNA location: Contig name=SeqID_16841; Position on contig =12183..13799bp; Strand=-
atgcataattttaagttgcttccctctgtattgctgatgactggactttctttttctgtttctgccgctaatgtacctactggaactcaacttgacgcccgtcaggaactggttcgtcaattgaaagatgaacctgcatcattggatcctattaaatcctttggcttgacagaagcacaagtgctgcgtgacctgcttgaaggcttggtgaatcaggatgcttatggagagcctatctctggtgttgctattgattggaagacaacagacaaccagacgtgggtatttacattacggcagaatgcacgctggtctaacggtgacaaggtcacggcatctgatttcgtttatagttggcggaggttggttaatcctgctaatgcatcctctttttcttggtttgcggctttatcaggcattcagaatgcacaagaaattattgatggcaaattaccatcagaaaaactgggagtggaagcgattgatccatatacattaaaagttagcctagatcgtccagttccttattttcccaatatgacaaccaattttagcctttatcccgttcataaacagagtgttgaaaaatatggtaatgattggacaagagtcggtcatttggttggtaatggcgcatttatgcttacgggacgtgttgtaaatgaaaaaattgttctgacaccaaacccttattattgggatcataaaaataccgtattgaaaaaagttacttttttacctatcaatcaggaatcccatgcgaccaagcgttatctggcagaggatttggatattactgaatctttccctaaaaatatgtatcagaaactattgcgggatattccaggagaagtattcacgccggatcaattaggtacgtattactacgcattcaatacacagcgggcacccaccaatgatattcgcgttaggcgagcgctttccatgacgatagataggaaactgattgcaggaaaaatcttgggaacgggagaaaaacctgcatggcgctttacacctgatgtcactgctggattccagccagaaaaaagccggcaggaaattttaacccaacaggaattggataatcaggcgaggacattattgaaagaagccggatatggcttcggtaatccattaaaactttctctgctttataacaacttagaaaataaccagcggatcgctattgcaataagttcagagtggaaaaagaaactgggtgttgaggtgaaattagtcaatcaggaatggaaaacctatgttgataatcgtaataccggtaattttgatgtcgtcagagcatcttggactggggactacaatgagccatcaagttttttatctcttttgacctcaacgcatagtggcaatctcgctaaattccacaattctgcctatgacacattgataaaagaagctagtcaggaaactgatgaaatgacgagaaactgtgattataatcaggcagaaaaaataattaccgaacaagcgccaattgctcctatttatcaatataccaatggccgtttgatcaaatcgtggctaaaaggatacccgatcaccaatcctgaagacgtggcctatagtcatagtatgtacatcatcaagcactaa

SEQ ID NO: 348 - DNA, 504 bp, Xenorhabdus bovienii
  Coding DNA location: Contig name=SeqID_16841; Position on contig =13966..14469bp; Strand=+
atgacacaaacagtcaagtttcaaggtagcgatatcaccattaatggagattttccacaggtaggccaaacagcaaaagaattctcactggtagccaaagatctcgccgatgtgacactgagccaatacgcagggaaacgaaaggtactcaatattttcccaagtattgatacaggtgtttgtgccacatccgtccgtaaattcaatcaagttgccagcgaactgaataatactgtcgtactttgcatttcagcagacttaccttttgcacaatcccgcttctgtggtgctgaaggtttgtcaaatgtggtgatgctttctacattgcgtggtggtaaatttcacgaagattacggtgttgcgataagccaaggtccattagttgggttaactgcacgtgccgttgttgtcttggatgaaaataaccagattatttatagccagctagttgatgaaatcaccaatgaacctgactatgacaacgcattatcagtactaaaataa

SEQ ID NO: 349 - DNA, 147 bp, Xenorhabdus bovienii
  Coding DNA location: Contig name=SeqID_16841; Position on contig =14537..14683bp; Strand=+
atgaaaggtttaaaaccaccgtctttagacggtgactttgactttaattctttgacctatgcgcgtttacgaggtgcgtggttcgacgactttcagtcgtcggcaccgaagtgcgctaacccacctacttcagtaggtggtagttaa

SEQ ID NO: 350 - DNA, 1002 bp, Xenorhabdus bovienii
  Coding DNA location: Contig name=SeqID_16841; Position on contig =15180..16181bp; Strand=+
atgcagaatactcataataactactccagtggcgagttttctctatctcatgcacttcctatagggtattgtttcaacgaatttgaaattgaagaagtcattagcgaagggggattcagtattgtatatcgtgcatgggatcaccgactgaaacgcactattgctattaaagaatatatgccttctattctcgttgtacgtcgtcaggatctaaagctaaatctacgcagagcaagtctcaaaaagagattccagatcgggctacataattttatgcatgaagcccatttgatgacctgttttaatcacccctgcctgccacgctttctgcgtttctggcaacaaaatagtactgcttatattgcaactccattttacagtgggatgacattaaaaaaattacaaacgaaacgcccaaagatcatcaatcaaaattggatttataatatgttgtttcctttgcttgatgctatcgatacgctccaccaagcaggatatctgcactgtgatatttctctggataatattctgattcaagatgatcagttacccatattacttgatttaggctctgccagaaaagcaacggaacgtttgtcagatgaaaaggaagtgaccataagtcctgggtttacggctgttgagcaatacaccgccaacgaagaagggcaacaaggtccttggacagatatttactctctaggagcggtattgcataccttgattgtcggaacccctcctccagtcagtatcgtgcgaaatattgaagataactatcagccattgagtaagctttgtcctgcgggatattcttcatcatttttacatgtaattgaccgtactttgaaaataaaactatcagaacgcccattgtctataacagaactaatgacgcagataaaagcgtctactataaagacatgtcgagtccctgtattatcttatacccgaccaaacacctttacggcttacgttcctcccgtaagttcaaacagcgaataa

SEQ ID NO: 351 - DNA, 1584 bp, Xenorhabdus bovienii
  Coding DNA location: Contig name=SeqID_16841; Position on contig =16281..17864bp; Strand=-
atgcgattggaagttacttgtcaggatcgaattgggttgactcgcgagctacttgatttactggttttacgaaatattgacctgaaaggaattgagatttctcctgcacgtcgtatttaccttaattttactcaaattgatttcaacacctttcgcttattgatggcggaaattcgccgtattaacggggtaatagatgtcaggacggttgcttttatgccgtcagaaaaagagcacagggcaatgtggacattgctggagtctgttcctgagcccattttttctattgatatgaaaggaaacattgatctggttaatccggcatctttagtattatttggtctcaacagagagagaattggtcaaaaaaatattggccacctcatcagtaattacaatttcctccgctggcttgagagtgaacatcatcaacctcattcggcaaatttagtcatcaaaggtcaagattactgcatggatattattcccatgcaattaacggatgaaaatcagtctgttaaatgtgtgggggctgtgattatgcttcgttcgaccacgcgtgttgctcttgccccatcgagtaaaaagtttactgtgagtgatgacagtgcttttgacaaaattgtcgctgtcggcccgaaaatggttcatgtcgttgagcagatacgtaaaatagcgatgctggatgcacctttattgctgattggtgatacaggaacaggaaaagatgaatttgccaaagcttgtcacctgcggagttcaagaagaaaacagccttttctaggattgaattgtgcttccatgccggatgatgttgcagaaagcgagctgttcggttatgccgcaggggcttacccgaatgcactggaaggtaagaaaggtttttttgagcaggctaatggtggcacggttctgttggatgaaattggtgaaatgtcgccacaaatgcagatcaagttactgcgttttctaaatgatgggacgtttcgtcgtgttggtgaagataatgaagtcaaagttgatgtcaggattatctgcgctactcaaaaaaacttggtcgagttggtgcagaaaggggaatttagggaggatctctattaccggcttaatgtattgactattacattgcctcctttgcgggaacgtcaggcggatatcatgccgttggcggatttttttgttatccgctttgctgaagaacaggggttggaaaagcctaaactcgctcatgaactggaacactttttgtgtagttatcattggccgggaaacgtcagacaattgcgcaatgctatttatcgggcactcactcagtttgaaggtcaccagttacaccctcaggatattcagttacctgaattagagacagaggttgcattcagtgacgatattttggcaggctctttggatgagattagtaaacgttttgaacgttctgtactcattcgcctttaccgtcattatccaagcacccgaaaactggctaaacggctaggagtttctcacacagccatcgcgaataaattacgtgaatatagtttaagcgggaaaaaacagatggccgaacatgaagatgatgagtaa

SEQ ID NO: 352 - DNA, 1089 bp, Xenorhabdus bovienii
  Coding DNA location: Contig name=SeqID_16841; Position on contig =17995..19083bp; Strand=-
atgactgatcccttgaaaccgagaattgatttcgacgatcgtttacaaacacagtcggaaccctcattgaaatctcagaaagaattcaatggacaggaaaatgagttctgtccagtcgcgcctgaacgggaagcagaagagcaagaaagcgagtttgaaggcgcagtcaatgccgctctgaaaccaaagcgtagtttttggcgaaaagttttttccggtgcggttctgttgttgggtattagtgtggttgcgcagtttattcaatggatataccaatcatggcagcaacacgattggatttcgctgggtgtggccgccgcaggcagtatgattgtttttgcaggcataggtactgtaataagcgaatggcggcgtctttatcgtttgcgtcaacgaacggaagagcgcgatatagcgaagtcattattgcaaagtcacggtataggtaaagggcgtcaattttgcgagaacttggcggagcaggctgggatcgggcagcaacatccggcattgcaacgttggcaggctgcggtacataagactcacaatgaccgtgaaatcgtcatgttgtacagcaaacttgttcagcccgttttggatgttcaggctaaaaaggagatcagccgctcggctgcggaatcagctttaatgattgctgtcagtccgctggctatcgtggatatggcctttattgcatggcgaaacattcgccttattaatcgcattgcggcactatatgggatcgaattgggctacttcagccgtattcgcctgttccgattagtcttgctgaatatagcttttgcgggtgcatcggagctggtcagggaagttggtatggattggctgtcacaggacattgctgcccggctttcggcgcgtgccgctcaaggtattggtgctgggttgctgacggcacgcttgggtatcaaggcaatggaactgtgtcgtcctttaccgtggattgatagtgataagccaaaactgggggatttccgccaccagttgatgactcagcttaaaagcacgttaccgacgaagatgaaaagtgcagtaaaaagaacagagaacagcacagtaatcaaatag

SEQ ID NO: 353 - DNA, 1398 bp, Xenorhabdus bovienii
  Coding DNA location: Contig name=SeqID_16841; Position on contig =19080..20477bp; Strand=-
atgaaacggttgcaaaacgaattgaaatcccttgttaatcgtggagtagaccgtcatttgcggctggcggtgacaggattaagccgcagtggaaaaacggcatttattacttctttggtgaaccagcttcttcatgtccacaacggggctagattgccgttgttttctgctgtgcgggatggacgtttacttggtgtgaagcgggtgcctcaacgggattttggtgttccccgttttgcttatgatgaaaatattgcagcattgcacgacacaccaccttattggccaataccaacacagggcgtgagtgaaatccgtctggctctgcgttatcgctctgaagattccctgcttcgttatcttaaagaaacttccaccctgtatctggaaatcgttgattatccgggagaatggctactggatttaccgatgctggaacagaattatctggcatggtcacgacagatgaacggtatgctgaaaggggaaagggcagattgggctaaaccatggctcgaattatgccaacagtgcgatcctctagcacctgccgatgaaaatttgcttgccagaatcgcacaggcttatacggattatctgcatcaatgcaaaacgcaggggttgcattttattcagccgggtcgtttcatattaccgggtgatctggcaggggcaccggcgctacaattttttccgtggccggatattaacggaattggggagccacaactgtccaaggcggataaacataccaatattggtatgttgcgggaacgatttgcctattactgcgatcacattgtaaaaggtttttataaagagcactttctccgttttgatcgacaaattgttctggttgattgtttgcagccattaaacagcggtccacaggcttttaacgacatgcgtctggctctggcacagctcatgcagagttttcattacggtaagcgaaccttatttcgccgcttattttcaccttgcattgataaattgatgtttgcagcaagcaagtctgatcacgtgaccgctgatcaacacgttaacctcatatctctcttacagcaattagttcaggaagcgtggcagaatgcggcctttgaagggatcagcatggattgtgttggtttagcatctgttcaggctactgaaagtggtatcgtgcttcacgatggtgaaaaaatccccgctatcaagggaaatcggttgtcagatgataaattactgacgtttttcccgggagaggtgccacagcgtttaccgaacagtgatttctggcaaaaacaagggtttaattttgaatcttttcggccaaaacaagtaaatgtagatacaccgttaccccacatccgcatggacagtgcgatggagtttttattgggagataaactaacatga

SEQ ID NO: 354 - DNA, 363 bp, Xenorhabdus bovienii
  Coding DNA location: Contig name=SeqID_16841; Position on contig =20631..20993bp; Strand=-
atgtcgaatacttaccgccggaaactttaccgtcttccagagcaggggatggtgaaaggagtttgtgctgggctggcgagttattttaatgtaccggttccgctcatgcgtaccatcacggtattatcgttgttctttggattatttggcttcacggtattgacctatattatcttgacctttgttatggatcccgcgccagcgggatatcaggcagagggcgtaaataaggggccatcgggacaaaagatactggatgaagttgattaccaactgagagcaagtgaagcgcgcctgcgtcagatggaacgctatatcacctctgatacctacagtgtgcgcagccgttttcgtcagctttaa

SEQ ID NO: 355 - DNA, 222 bp, Xenorhabdus bovienii
  Coding DNA location: Contig name=SeqID_16841; Position on contig =20993..21214bp; Strand=-
atgggctatatatttcttggaatcccactgatcctcttcgtgctttttgttttacccatctggttgtggttgcactatagtaaccagagtcggggtcagttagggagcaatgaaattcagcgtttggggcaattggcagagaatgcacggcatatgcaggagcgaattaaaacgctggaagagatacttgatgcagagcatccaaactggagacaatcataa

SEQ ID NO: 356 - DNA, 672 bp, Xenorhabdus bovienii
  Coding DNA location: Contig name=SeqID_16841; Position on contig =21247..21918bp; Strand=-
atgggtattttttctcgttttgctgatatcgttaacgccaatatctcttccctgctggataaagcagaagatccacagaaaatgatccgcctgatgattcaggaaatggaagatacgctggtggaaattcgttcaacatcggcccgcacattggcagagaaaaaacagcttttgcgtcgtatcggtattggtgagaatcaaatagaaggctggcaagaaaaagccgaactggcgttaagtaaagaaaaagaagatctggctcgcgccgctttgattgaaaaacagaaaatcagcaatttgattgacgcgttgaaaaacgaactgtctattctggatgaaacccttggacgtattaaaggggaagtgactgaattggaaaacaaactgacagaagcgcgtgtaagacaacaatcactgaccctgcgccatcaggcagccgcatcttcccgtgaagtacgccgccaactggacagcggtaaaattgatgaagctatggcacgtttcgaacagtttgagcgtcgaattgatcatatggaggcagaagcggaagctattgggctgggcaaacagaaatcactggagcagcaatttacagaattaaaagcggatgacgaaattagtgcacaattggcagccttgaaagctaaaatgagtgtcaaagattcacaatga

SEQ ID NO: 357 - DNA, 1020 bp, Xenorhabdus bovienii
  Coding DNA location: Contig name=SeqID_16841; Position on contig =22128..23147bp; Strand=+
atgcatcaatttattgataacctattaggcgaagcaaactgttttattgaaattctggagcaagtctctgcacttgcaaaattaaataaacccgttttggtgctaggggaacgaggaacaggcaaggaattgattgcacgccgtttgcactacctttctccacgctggcaaggctcttttatctccctcaactgtgccgcacttaatgaaaatttgctggattctgagctgtttggccatgaagcaggggcatttacgggtgcacgttccaaacatcaaggacgttttgagcgtgccgatggtggaacgctgtttcttgacgaactggctaccgcacctatgcaggtacaagaaaagctactgcgggtaattgaatacggttaccttgagcgggtgggaggtaatcagtcgctacaggtggatgtacgattggtctgtgcaaccaacgaagatctacctgccatggctgcccgtggaaaattcagggctgacttgctcgacaggctggcatttgatgttgtccaaatcccgccactgcgccaaaggcagcaagatatcatgttactggcacaacactttgccattcagatgtgccgagagttgaacctgtcgttcttccccggatttaccgatgaagccaagcaacagttacttacttatcactggcccggcaatattcgtgaattgaagaatgtgatagaacgctctatttatcgacacagagataatgaaaaagaattagataccatcattatcaatccctttgcatcatcacaaatattttcttcacaaatgtctattcctgcgtgtaatcataatgaagggacgccttattcccttcccagcttaccttttgatttaagacagtggcaaaatgacagcgaaaaacagttgattatacaggcattggaaaaaagccagttcagccagaaaaaagcggctgggaaactcaacctgacctaccatcaactacgtggattaatcaaaaaacaccatatcaacattcatgtcatggattaa

SEQ ID NO: 358 - DNA, 1716 bp, Xenorhabdus bovienii
  Coding DNA location: Contig name=SeqID_16841; Position on contig =23426..25141bp; Strand=+
atgcgctatttgatttactggatcatattattgttttcagcatccacactggctgctgacaatgctattccagaaacgactaaagctactcacgaagcgattcctgccgacacattgaataatttatcctatgtgtcggctgccttgcggcagaatggttttatttattgcgttaacggcaatctgagtacttttaaccctcagatggctatcagcggcctgactgtggatactctggctgcccagatttatgatcgtctcttaggtgttgaccctctgacctatcgtttgataccagaactggcttcccgctgggaagtgcgggacaacggggcaacataccgcttttacctgcgccataatgtcgctttccaatcaacggactggtttacgccaacccgtaccatgaatgccgatgatgttgttttcagcttccgtcgcttattcgacaaaacgcactattaccattatgtcaacggtgggcattacccctattttgatagtttgcaatttggtgattctgtattgagtattcaaaaaatcgataaatatacagtcgaatttcgccttaatgcacctgatgcgtcgtttctctggcacttggcaactcactatgccccaatattgtctgaggagtatgggcagaaactgcataagataaatcgacaggaacaaattgattggaagcccgtcggaacagggccattcatgctggaagattatcgggcagaacaatttattcgacttatccgtcatgataaatattggaaaggcaagccacacatggaacaggttgttatagatgccggtgccggcggcacaggcagaatttctaaactgctgacgggggaatgtgatgtattggcctatcctcccgccaatcagttcagtgtgctgcatgataatccaaacctgcaccagacattacgctcaggtatgaatatcgcctatcttgcgttcaataccagcaaaccaccgctggacaagctagcagttcgtcaagccattgcgtatgccatcaataatcagcgactgatgaaatccatctattatggcacagctgaaacagctgcctcaattttaccacgcgcatcatgggcttatgataatagtgcggaaatcaccgaatacaatcccgaaaaatcacgaaaaatgctaactgagctgggattaaatggattagaactgacattgtgggtgccaacggcttcacaatcttataatccgagcccattgaaaatggcagaactgattcaggcagatttggcacaggttggtattaagatgtctatccgtcctgtcgaaggccgtgctcaggaaaaccaactgatggataaaacccatgacatgactctagcaggctggtctactgacagtaacgatcctgacagttttttccgaccactattgagttgtgcagccatcgcttcccaaaccaacctgagccgctggtgcgactcaacctttgatgatgcactccatcaagccttattaaatcagcagcttgcatcacgtattgaaaactatcatattgcccagcaaatccttgcccagcaattacctgtactaccattagcttatccaacacgattacagatatttcgttataacattaaaggattagtattgagcccgtttggcaatagctcctttgctggagtctaccgcgtacaggaaacgaccacgcctactgggaataaaaaggaaagcaaatga

SEQ ID NO: 359 - DNA, 966 bp, Xenorhabdus bovienii
  Coding DNA location: Contig name=SeqID_16841; Position on contig =25138..26103bp; Strand=+
atgattatttatattctgcgtcgtttgctgcttctgcttgtgacgctgttttttctttcattaatcagtttcagcctgatgtatttcacacctcatggacctttgagcggtgcatcactgactgacgcctatgtgttctatttccacagcctgttacagtgggattttggcatttccagcattaacggcgaacgcattattgaacaattgtacggcgtttttcctgcaaccatggagctttgtattctctctttttctatggcgttattaatcggcattcctttggggatcattgctggcgtctggcgcaacaaaaaggcagatataatcatcagtacatttgctctattgggtttttccattcctgttttctggctggccctgctactcactctcctcttttcactgtatttgggatggctgccagtctcaggacggtttgatttactgtatcggatggagcaagtgacaggttccgcactggttgatgcctggctgtccaaggagccttatcgcaatgagatgatcgtgaatgtcattttgcacatgattttacccgtcatcacactggccgttgcacccatgaccgaagtcattcgtttaatgcgcaacagtgcagaggaagtctcggcatcaaactatatcaaatcggccgccactcgcggactatcacgattgacgattattcggcgccatttgttgcataatgccctgccccccattattcctaaactgggattacaattttcaaccatgctcacgctggcaatggtaacagagcaggtattcaactggccgggtttgggacactggctcatcatcgccattcgccagcaggattattcagccatctcggctggcgtgatggtgatcggagctttggttatttcagtgaatgtgctgactgatattattggcgcgatagctaatcccctgaagcataaggaatggtatgcccttagataa

SEQ ID NO: 360 - DNA, 888 bp, Xenorhabdus bovienii
  Coding DNA location: Contig name=SeqID_16841; Position on contig =26090..26977bp; Strand=+
atgcccttagataatttctaccgtgaaaagaaaatgccttctccactgaaagtcatctggcgttttttctatgctgatatactggcaatgacgggcttttatggggtactgattttaattgcattaagtcttttgggtgggcaaattgccccatatcaacttgatcagcaatttatgtaccagcttatgcccccgtcatggtcacaccacgggaatgtcgcctttttccttggaaccgatgatctcgggcgagatattttcagtcgtttgctgattggtacgtcttccacatttggagcggcattaattgtgactgccgcagcggcaattgctggattagctatcggtagccttgctgctatgacccatgggctgaagtctgctgtcttgaaccatattcttgagacgttactttcaattccctcactgttactggctatcattgtcgtggcttttgtaggagccagtctgcaacatgcaatgattgctatctggctggcattactgccaaggatagtacgcacaatttatactgctgtacacgatgagctggataaagagtatattatcgcagcacgtctggatggtgcttcaaattatcgtattttgcgctatgccgtctttcctaatattacggcggcgatagtcagtgaattaacccgcactctctctatcgctatccttgatattgctgcgttaggctttctcgatctaggtgctcaattaccctcacctgaatggggagccatgctgggaaattcattggaactcatttattctgccccttggaccgtcatgttacccggtgctgccattacgctcagtgtcttactggttaatttactcggtgacggcctgcaccgcgccattaatgcaggagtcgaataa

SEQ ID NO: 361 - DNA, 993 bp, Xenorhabdus bovienii
  Coding DNA location: Contig name=SeqID_16841; Position on contig =26977..27969bp; Strand=+
atgcctctactcgatatccgaaatctcaccattgaattcatgacgtcagaaggccccgttaaagtggttgaccgtatgagtatttcactgacagaaggtgaaatactcggattagctggcgagtcaggatctggtaaaagtttgattgccaaggctatctgtggtgtcacgaaagacaacctcagcgtcaccgcagaccgttttcgtttcaacgacattgacttattgcgcctgacgttaagacaacgtcggaaagtaatcggacacaacatttcgatgatttttcaagaaccgcagtcatgccttgatccatcagaaagtattggcaaacagctcattcagtccatcccgggctggacctataagggccgctggtggcagcgattcaattggcgaaaacggcgtgccatcgaactgctgcatcgggttgggattaaagatcactatgccatcatgcactgttatccttatgagttaacggatggagaatgtcagaaagtgatgattgccattgcactcgccaaccagccacgactgctgattgcggatgaacccaccaacgcaatggagccaacaacacaagcccagatattccgcttactatcgagcctaaaccagaacaacaacatgacaatcttgctgattagccatgatctgcaaatgatgagcaaactggtcaagcgcattaatgtactgtattgcggtcaaacagtggaaagtgccacacccgatgaattgctagtgacacctcatcatccttatactcaggcacttattcgctcaattcctgattttggcaatccattgcctcataaaggccgtttgaatactctatcaggggctattccatcactggagcatttaccgataggatgccgcttaggacctcgttgtccctatgcccagaaaacctgtattgaaaccccacgtttacggggagttaaaaatcatgtcttcgcctgtcatttccccttgaacatggaggaacagtaa

SEQ ID NO: 362 - DNA, 810 bp, Xenorhabdus bovienii
  Coding DNA location: Contig name=SeqID_16841; Position on contig =27970..28779bp; Strand=+
ttggttgaaacattactggaagttaaaaatctgactaaaacattccgctaccgaaccggactgtttcgccatcaccaccttgatgctgtaaagcccgtgagctttactttgcagcccaaaaaaacgctggcaatcattggtgcgaatggctccggtaaatccacgctggcaagaatgctgtcaggtgttatcgaaccaacttcgggcgatatcctgattaataaccataaactggcctatggggattacagctatcgcagccaacgtatccgcatgattttccaagaccccagtacatcattgaatccccgtcagcgtattggacagattctagatgtgccgttgctcttgaatacggaactttcttcttctgagcgagagaagcaaatcaaccagacattacgtcaagttggtttgctgccagatcatgcctactattatccgcacatgctcgcttcaggtcagaagcagcgcgtggcattggcacgggcgctgatattgcaaccgcaaattattgttgcagatgaagcattggcttctcttgatatgtccatgcgttcccaaatcattaacctgatgttggagctgcaagagaagcacggcattgcctatatctatgtcacccaacacctcggcatgatgaaacacatcagtgatcaggtactggtaatgcatcagggagaagtggtagaacgtggcaatacagcggaagtactggcctcaccattacacgatattacacgtaaactgatatccagccattttggcgaaccactgtccgccgaagcatggcggcaggatatcacctaa

SEQ ID NO: 363 - DNA, 789 bp, Xenorhabdus bovienii
  Coding DNA location: Contig name=SeqID_16841; Position on contig =28967..29755bp; Strand=+
atgggtttcatgaccggcaagcgcattctcattactggcgtcgccagcaaactgtctatcgcttatggaattgccaaggcaatgcacgatcagggagctgagctggcttttacctaccagaatgacaagttgaaacttcgtgtcgaagaattcgctgcatcattggattcgaacatcattctgccatgtgatgtggctgaagatgaaagtattgacgcattattcgctgaactaggtaaagtatggcctaagtttgacggcttcgttcactctattggttatgctcctgctgagcagcttgatggtgattatgttaatgccgtcaaccgtgaaggtttcaaaattgcacatgatatcagcgcatacagcttcgtcgctatggcgaaatcatgccgtaacatgttgaatcctaactcagccctgctcactctgagctatctgggtgcagaacgtgcaatccctaattacaacgtaatgggtctggcaaaagcttctctggaagctaatgtacgttatatggcgaatgcaatgggtgctgaaggtgttcgtgttaacggtatttccgcaggcccaattcgtacactggcggcatctggcatcaaggatttccgcaaaatgctggcacactgcgaagcggtaacacctattcgccgtactgtaacaacagaagatgtaggtaatgcagccgcattcctgtgttctgatctagctggcggtgtgacaggcgaaattctgcacgtcgatggcggtttcagtatcgctgccatgaatgagttggaattgaaataa

SEQ ID NO: 364 - DNA, 330 bp, Xenorhabdus bovienii
  Coding DNA location: Contig name=SeqID_16841; Position on contig =30016..30345bp; Strand=+
atgaaactgtactatgcaccgggagcttgttcactctctcctcacattattctccgcgaaactgggctagatttcagcctcataaaggtaaatttaaaagataaaacaacagaaaatggaactgattttttcaaagtcaatcccaagggacaagttccagcactggttctcgacaatgatgtcattctcacggaagggtctgcaattgtgcaatatattgcggatcaaaaaccagacagaaatctaatcgcgccagcgggtactttggaacgctaccaacaaatcgaatggctgagttatgtcgccagcgaaatacatcaaagcttctga

SEQ ID NO: 365 - DNA, 264 bp, Xenorhabdus bovienii
  Coding DNA location: Contig name=SeqID_16841; Position on contig =30361..30624bp; Strand=+
atggaggcaccagagagctatcgttcgattacccgacagaaattactgcaaaaatttacttatcttgatggtattttgtcaaaacgctcgtatattgcgggcgatcattttacagtcatagatgcttatctcttcacaacctgtggctggacacctgatataacactggatttgtctgaactcagccatttgagtgcctatctgcaaaatatcagacagcgcttacatgttcaagatgctttaaaagcagaagggttaatttaa

SEQ ID NO: 366 - DNA, 879 bp, Xenorhabdus bovienii
  Coding DNA location: Contig name=SeqID_16841; Position on contig =30705..31583bp; Strand=-
atgaaaaatgttctttcaattcagtctcatgttgtttttggtcatgctggaaacagtgctgctgtttttccaatgcgtcgaatgggagtgaacgtatggccattgaatacggttcaattttccaaccatacccaatatcctcaatggcgtggttgtgttatgccgccagagcatttggctgaaattgcccagggaattggtgagattgataaattagtttcctgcaatgctgtactgagtggttacattggttctgcggaacagggaaaccatattcttgatattgtaaaacaggttaagcaagccaatcccgaagcatggtatttctgtgatcccgtgatgggacatccagaaaaagggtgtattgtcgctcctggggttgctgaattcctctgtgaaaaagcattacccatcagcgatatcattgctcctaatttactggagcttgaaacgttgagcatgcggaaaatcgaaaatgtagaacaagctatatccgcagcccgcgcattatgcgaaaaaggcccagatattgttttagtcaaacacctcagtcgtgcaggctaccgagcagatcgctttgaaatgcttttggtgactaaagaacatagttggcatattagtcgtccattgattaatacgggtgaacgtcaacctgtgggtgttggtgatttaacgagtggtttgttgctcgtcaatttactgaaaagtacatcattaaccgatgaagcattacaagtggcgctggaacatgttgcatcagcagtctacgaagtgatgctggagactcaagagagaggggaatatgagctacagatcattgccgctcaagataagatggtcactccaacacatcaattcagagctgtgcaaattggctga

SEQ ID NO: 367 - DNA, 1287 bp, Xenorhabdus bovienii
  Coding DNA location: Contig name=SeqID_16841; Position on contig =31716..33002bp; Strand=-
atggagccattgatgtttagcaataacctgataaaacaactgcaagatcggggccttgttgcccaggtaacggatgaagaagcgttagcagagaggctggcgcaaggtccggtttctctctattgcggcttcgatcctaccgctgacagcttgcatttggggcatctggttcccttgctgtgtttaaaacgattccaactgaccgggcataagcctatcgcgttggtaggtggtgcgacaggtttgattggtgatccaagttttaaggcaactgaacgcaaattaaatacagaagagaccgttaaagagtgggttgaaaaaattcgtaaacaggtttcaccattcctcgatttcgattgtggtgaaaaccgtgcggaaattgccaataactatgaatggtttggggaaatggatgtgcttactttcctgcgtgatatcggaaagcatttctccgttaatcagatgatcaacagagaagcggtaaagcagcgtctacatcgtgatgatgttggtatttcgtacactgagttttcttataacctgttgcaatcgtatgactttgctaacctgaatggaaaatatggtgttgaattgcagattggcggttcagaccaatggggcaacattacttcaggtatcgacttaacgcgccgcttgcaccagaaacaagttttcggtttgacagtgccactgatcactaaatctgatggtactaaattcggtaagacagaaggtggtgctgtttggttagatccaaagaaaaccagcccgtataaattctaccaattttggattagtaccgcggatgcagacgcttatcgcttcctgaagttctttacttttatgagcattgaagagattaatgctttggaagaagaagataagaacagcggtaaggctccgcgcgctcagtatgtattggcagagcaagtgacggatatggtacatggtgaagccggtcttgctgcggcgaagcgcattactgatagcctgttctctggcattgttgcagacttgactgaagaagatcttgctcaattggcgcaagatggtatgccagcgattgaactggaaaaagacgctgatttgcaacaagctctggtcactgctgggctagtaccttcccgtggtcaagctcgtaccatgatcggttctaatgcggtttccatcaatggtgaaaaacaatccgatgctgaatatacgttcgcggccagcgatcgtttgtttgagcgttatactttgttacgtcgtggtaaaaagcattattgccttatcaactggaaataa

SEQ ID NO: 368 - DNA, 304 bp, Xenorhabdus bovienii
  Coding DNA location: Contig name=SeqID_16842; Position on contig =2..305bp; Strand=-
atggaatatgaatttacgcaggatattgcgggtcacgttacaacttctttttcgatggatcatgaagcgattggtcattggttgaatgaagaagttaaaggtgatttgagtgtattggataaaataacttcagcactggcgggcatcaaaggcagtgagcgccaatggcaattgatcggtcatgaatacacattattgatgagtgagggagaaatcatgattagggctaaccaactccagttcgatacagaaatggtggaagaggggatgagttactatgataacgagagtctggctttttgtg

SEQ ID NO: 369 - DNA, 2598 bp, Xenorhabdus bovienii
  Coding DNA location: Contig name=SeqID_16842; Position on contig =454..3051bp; Strand=-
gtgctagaagaataccgcaagcacgtagccgagcgtgcagctcaaggcatcgtccctaagccattagacgcagctcaagcagcagcgctggtcgaattactgaagaacccacctaaaggtgaagaagatttcctgttagatctactgaccaaccgtgttcctcctggtgttgatgaggccgcttatgtgaaggccggtttccttgccgctattgccaaaagtgagacagcctcaccccttgttacgcgggaaaaagccatcgaattattgggaactatgcagggcgggtacaatatccacgctttgattgatgccctcgatgacgaaaaactagctccaatctcagtgaaagcgctttctcatactttgctgatgttcgatagcttttatgatgtggaagaaaaagcaaaagctggcaattctcatgctaaacaaattatccagtcatgggcagatgctaagtggttcttggagcgtcctgaactggcagaaaaaattaccattaccgtttttaaggtcactggtgaaactaataccgatgatctatcccctgcacaagatgcgtggtcacgtccagatatccctctgcatgctctggcaatgctcaagaatgctcgtgaaggcattgagcctgatcaagccggtgccgttggcccaatcaagcaaatcgaagaactgaacaaaaaaggccatcctttggcctatgtcggtgatgttgtgggtacgggttcttcccgtaaatctgcaactaattccgtcctgtggttcatgggtgaagatattccatttgtgcctaacaagcgcggtggtggcgtagtattgggcggaaaaattgcaccaattttcttcaataccatggaagatgcaggcgcgttgccaattgaggtggatgtttccaatctcaatatgggagatgtcattgacatttacccttataaaggcgaaatccgtcaccatgacaccaatgaattgctggcaacctttgggctgaaaactgatgtacttctcgatgaagtgcgcgctggtggccgtattccgttgattatcggccgtggcttgacgacgaaagcccgtgaatcactggaattgccacacagtgacgtattccgtcaggcaaaagcaattgagaaaagtgaacgcggtttctcactggcgcagaaaatggtgggtcgtgcctgtggtacgacgggaattcgtccaggcgaatattgtgagcctaagatgacttcggtggggtctcaggacaccaccgggccaatgacacgggatgaattgaaagatttggcctgtcttggcttctctgcggatctggtcatgcagtcattctgtcatactgcggcttatccaaaacctgtagatgtgactacacaccacacgttgcctgatttcatcatgaaccgtggtggggtatcgctgcgtccgggcgatgggattatccattcatggctgaaccgcatgttattgccggatacggtgggtacaggtggtgactcccatacccgcttcccaattggtatctctttcccagcaggatctgggctggttgcatttgctgctgcaacaggcgtaatgccgctggatatgcctgaatctgtattggtgcgttttaaaggtaaaatgcaacccggcattaccctgcgcgatctggttcatgccattccttattatgccattcagcaaggtctgctgactgttgagaagaaaggtaagaaaaatattttctctggccgcattcttgaaattgaaggcctgccagaactgaaagttgaacaagcctttgaattggcggatgcgtctgcggaacgttctgcagcgggttgtaccatcaagctggataaagcgcctatcactgaatacctgcaatctaatatcgtattgctgaaatggatgattgcggaaggttatggggatcgccgaacactggaacgccgtatcatcggtatggaaaattggctgaaagatcctcaattgctggaagccgatgcggatgctgaatactctgctgttattgaaatcgatctggcagaaatcaaagagcctattttatgtgcgccgaatgatcctgatgatgcgcgtctgttatcagcagttgctaacagcaaaattgatgaagtctttatcggttcctgtatgaccaatatcggtcacttccgtgctgcgggcaaattgctggatcaacataaaggccagttaccgactcgcctgtgggttgctccaccaaccaaaatggatgccgcccaactgacggaagaaggttactacagcatctttggcaagagtggggcgcgtgtcgaaatcccgggttgttcattatgcatggggaatcaggcgcgtgttgcggatggagcaacggtggtatccacttccacccgtaacttccctaaccgtctgggcgctggggcgaatgtttatctggcctctgcggagctggctgcggtggcttcattgctgggccgcctgccaatgccggaagagtatctgcaattcatggacaaagtcgatgaaaccgcagcagatacttatcgctacctcaattttgatcaattgaaccagtacaccgaaaaagcggatgaagtgatcttccaaacggctgtataa

SEQ ID NO: 370 - DNA, 1428 bp, Xenorhabdus bovienii
  Coding DNA location: Contig name=SeqID_16842; Position on contig =3555..4982bp; Strand=-
atgagtactgaaattaaagcccaggtagtggtgcttggagcaggccctgctgggtattctgctgctttccgttgtgcagacttaggtttggatactgttctggtggagcgctactctactctcggtggtgtttgccttaacgtcggttgtatcccatctaaagcgctgcttcatgttgcaaaagtgattgaagaagcaaaagcactggcacaacacggtattgtgtttggtgagccacaaactgatatcgacaaaatccgtctctggaaagaaaaagtgatttcccagctgacaggtggtctgggcggtatggctaagggccgtaaagttaatgttgttaacggcattggtaaatttacaggcgctaacactttggtagtagaaagcgagaaaggcgcaacaacgattaattttgataatgccattatcgctgcgggttcacgcccaattcaactgccattcattccacatgatgatcctcgcgtatgggattctaccgatgcactggaactgaaaactgttccggaacgtctgctggttatgggcggcggtattatcggtctggaaatgggaacggtttaccatgcactgggctctcagattgacgtggtagaaatgttcgatcaggttattcctgctgcggacaaagatattgttaaagtgttcactaaacgcatcagcaagaaattcaacctgatgctggaaaccaaagtgaccgcagtagaagctaaagaagatggcatctacgtaacgatggaaggcaagaaagcgccagcagaaccacagcgttatgatgcagttctggttgctatcggccgtgtacctaatggtaagtcgctcgacgcgggtcaagcgggtgttgaagttgatgagcgtggctttatccatgtggataagcaaatgcgtactaacgtgcctcatatctttgctatcggtgatatcgttggtcagccaatgctggcacacaaaggtgttcacgaaggtcacgttgcggctgaagttatctctggtaagaaacattacttcgatccaaaagtgattccatccattgcctacactgaaccagaagtggcttgggttggtctgactgagaaagaagcgaaagagaaaggcatcagctacgaaaccgccactttcccatgggcggcgtcaggccgtgcaatcgcatctgactgttcagatggtatgaccaaactgattttcgacaaagaaagcaaccgtattatcggtggtgctattgtcggcactaacggtggtgagctgttgggtgaaatcggtctggctattgaaatgggttgtgatgcggaagatatcgctctgactattcacgctcacccaacactgtatgaatcaatcggtatggctgcggaaatgtatgaaggcagcattactgatttgccaaatccgaaggcaaagaaaaagaaataa

SEQ ID NO: 371 - DNA, 1863 bp, Xenorhabdus bovienii
  Coding DNA location: Contig name=SeqID_16842; Position on contig =5201..7063bp; Strand=-
atgtctattgaaattaacgtacctgatatcggtgctgatgaagttgaagttaccgagattctggtgaaagcgggtgacaccgtagaagcagagcagtcactgatcactgttgaaggtgacaaggcttccatggaagtcccatcaccacaggccggtgtggttaaagaaatcaaagttgcagttggtgacaaaattgaaaccggcaaactgatcatgatttttgagtccgcaaagggtgcagcagaagctgcacctgtgcaacagaaagcagcagctctggcggcggcacctgtggcggctgaaagcaaagaagtcaacgtacctgacatcggtggtgatgaagttgaagttaccgaaatcatggtaaaagtcggtgacaccatcactgaagagcagtccctgatcaccgtagaaggcgacaaggcttctatggaagttcctgctccattcgcaggtactgtgaaagaaatcaagattgcggctggcgataaagtcaaaacgggttctctgatcatggtattcgaagttgcaggttctggtacagcgccagcggcaactccagctccagtagcagcggctcctgcggcgtcagcagcaaaagaagtcaacgtacctgacatcggtggtgatgaagttgacgttaccgaaatcatggtaaaagttggtgacaccatcactgaagagcagtccctgatcaccgttgaaggtgacaaggcttccatggaagtccctgcaccattcgcgggtactgtgaaagaaatcaagattgccgttggcgataaagtcaaaacgggttctctgatcatggtattcgaagtggcgggcgcagctcctgccgtagcactggcagcggcaccatctcttgcggttgaatcggtgaaagcagctccagcggctagccagccagcagaaggcaagaacgaattcgcagaaaatgacgcttacgttcatgcgactcccgtcattcgtcgtctggcgcgtgaatttggtgtgaatctggcgaaagtgaaaagcacaggtcgcaaaggtcgtatcctgcgcgaagacattcaggcttacgtaaaaaatgcgattaaacgcgcagaagcagcgcctactgctgctgcgggtggtggcatgccaggtatgctgccttggccgaaaattgatttcagcaagttcggtgaaatcgaagaagttgaaatgagccgcatccagaaaatctccggtgctaacctgagtcgtaactgggtcatgatccctcatgttaacctgttcgatgaagcggatatcactgaagttgaggcgttccgtgcacagcagaataaagaagctgagaagaaacagctgggcgtgaagatcactccgctggtattcgtgatgaaagcggcggcgaaagcgctggaagccatgcctcgctttaacagttctatctctgaagatggccagaagttgatcctgaaaaaatacatcaacatcggtatcgcggttgatacgcctaatggcctggttgttcctgtgttcaaagatgtcaacaagaaaggcatcatcgaactgtcaagagaactggctgaagtatccaagaaagcgcgtgctggtaagctgacggcttccgacatgcaggggggttgcttcaccatctccagcctgggtggtattggcactaccggctttgcgcctatcgtgaatgcaccagaagtggcaatcatggggctgtctcgttcttctatgaaacccgtctggaatggcaaggaattcgttcctcgtctgattctgcctatgtctctgtctttcgaccaccgagtgattgatggagcagatggtgcacgtttcatcacttatattaatgaagtgatgagcgatatccgccgtctggcgatgtaa

SEQ ID NO: 372 - DNA, 2664 bp, Xenorhabdus bovienii
  Coding DNA location: Contig name=SeqID_16842; Position on contig =7077..9740bp; Strand=-
atgtcagatattttgaaaaatgacgtggatccgatcgaaactcgcgattggttacaggcgatcgaatcggtcatccgtgaagagggtgttgagcgtgctcagttcctgattgatcaggttttgaacggggcccgcaaaggtggagttagcgttgcagcaggtgttgcaagtcgtgattacatcaacactattcctgttgaggatgagcctgcttaccctggcaatctggatttggagcgtcgtatccgctctgctattcgctggaatgcggtgatgaccgttctgcgtgcatccaagaaagatctagatctgggcggccacatggcttcattccagtcttctgctactttttacgacgtttgctttaaccatttcttccgcgctcgcaatgaaaatgatggcggcgacttggtttacttccagggccatatttctccgggcgtttatgcacgtgctttcctggaaggccgtttgactgaagagcagatgaacaatttccgtcaggaaattggtggtaatggcctgtcttcttatccgcatccaaaattgatgcctgatttctggcagttccctacggtttcaatgggtctgggcccaatttctgctatttatcaggctaaattccttaaatatttggaacaccgtggtctgaagaatacgtctcaacaaaccgtttatgctttcttgggcgacggtgaaatggatgaaccagaatccaaaggtgcgatcactatcgcaactcgtgaaaaactggacaaccttgtcttcgttatcaactgtaacttacagcgtcttgatggcccagtgactggtaacggcaaaatcgttaacgaactggaaggtatcttcgcaggtgctggctggaaagtgctgaaagttctgtggggcgagcgttgggacgaactgctgcgtaaagacactagcggtaaactggttcaactgatgaatgagactctggatggtgactaccagacattcaagtccaaagatggcacttatgtgcgtgagcacttcttcggccgttacccagaaaccgcagcattggtcaaagatatgactgatgatgaaatctgggctctgaaccgcggtggtcatgatcctaagaaagtctatgctgcactgaatcaagcgcagaatactacgggtcaaccaacggtaattctggctcagaccatcaagggttatggtatgggtgataccgctgaaggtaaaaacattgcccatcaggttaagaaaatgaatatggaaggtgtccgtcacttccgtgatcgtttcaatgtgcctgtgtctgatgaacaaattgaaaaactgccatacgtcacttttgataaagactctgaagagtccaaatatctgcatgagcatcgtaatgcgctgggtggttacctgccaagccgtcgtgtaaacttcgatgaaaaactggaaattcctgcactggaagacttcagctcactgctggaagaacaatccaaagaaatttctactactatcgccttcgttcgtgcactgaacgttatgctgaagaataagtcgatcaaagatcgtctggttccaattatcgctgatgaagcacgtactttcggtatggaaggtctgttccgtcaaatcggtatctacagcccgaatggtcagcaatatactccgcaagaccgtgagcaggttgcatactataaagaagacgccaaaggccagatcctgcaggaaggtatcaacgagctaggtgccgcctcatcttggctggctgctgcaacttcatacagcaccaacaacctgccaatgattccgttctacatttactattctatgttcggattccagcgtatcggtgatctgtgctgggcggctggcgaccaacaggctcgtggcttcctggtaggcggtacttctggccgtacgactctgaacggtgaaggtttgcagcacgaagatggccatagccacattcagtctctgactattcctaactgtatctcttacgatccagcattcgcttatgaagtggctgttatcatgcatgacggtttagagcgcatgtatggtgagaaacaagaaaatatctactactatatcactacactgaacgaaaactaccacatgccagcaatgcctgcgggtgcagaggaaggtatccgtaaaggtatctataagctggaagcttttgacagtgcgaaaggtaaagttcagttgctgggttctggttctatcctgcgtcatgttcgtgaagcagctaagatcctgtctgacgagtatggtattggttctgatgtatacagcgtaacgtccttcactgaactggcgcgtgatggtcaggattgtgagcgttggaatatgctgcacccatcagaggaaccacgtgttccttatattgcgcagatcatgaatgaagcaccagcagtagcgtctactgactacatgaagctgttcgcagagcaggttcgtaacttcgtccctgcaagcgaattccgcgtattaggtactgacggtttcggtcgttctgacagccgtgaaaacctgcgtcatcactttgaagttgatgcttcttacgtggttgttgctgctctgggtgaattggctaaacgcggcgaagttgatgtgaaagtcgttgaagaagctattaaaaaatataacatcaacccagaaaaagttaacccacgtctggcataa

SEQ ID NO: 373 - DNA, 813 bp, Xenorhabdus bovienii
  Coding DNA location: Contig name=SeqID_16842; Position on contig =9985..10797bp; Strand=-
atgactagtccgaagcaacatttactcattgaatggcttacagcagatatggcctatagcaagattcgccaaccaaagttatcagatgtgattgagcagcgtcttgaacatctcattctcgaaggctcgttacgcccgggagaaaagctgctgcctgagcgtgagctggcaaagcagtttgaggtatcacgcccttcactacgcgaagctattcaaaaattggaagccaagggctttcttttccgtcgtcagggcgggggaactttcgtgcagagtaatctctggcaaagtttcagcgacccactcgcccggcttattgcagataatcaagaatctcaatttgatctccttgaggcgcgccatgcgctggaaggtatcgcggcatattatgcggctcttaggggaaccgatgaagatttcgagcgcatcgaaaaaagccactttgccattcaggaagcccagcaaagcggtgatgttaaagcggaatcagatgctgtcctgcaatatcagcttgttgtcactgaagctgcccataacgtggtattgctacatttgctgcgctgtatgatccccatactggaacaaaatatccgacgcaacttcgaattcatctatacccgcaaggaaatgttagccgctgtcagtaaccacagggcagagatttttcgtgcgatcatggcgagagaaccggaaaaagcccgtgaggcttcgcatcgccatttggcctttattgaagaagttttattggatctgactcgtgagcatactcgtcgtgagcgctcactacgccggctccagcaacatcaggaataa

SEQ ID NO: 374 - DNA, 855 bp, Xenorhabdus bovienii
  Coding DNA location: Contig name=SeqID_16842; Position on contig =12211..13065bp; Strand=-
atgactctctttattctattgttagtactggcatgggaacgtgtttttaagatgggcgaccattggcagttggaacgctatttgtcccctttgtttgccataatgaaattattttcattatggagcagtttgggtatgaccctgctggtcgcattactgacctggaaacttattgatgttttgagtgatgtggtttttggtgtaccgggaattctgctgtatattatgatcagcttgttgtgtattggtgcagggtctctgcgttatgactatcgagaatatcttcgagctgtacgtcttgatgatctggatcagcaaaataatcatcttgcccgtttgacgatgatacagggaactttacctgataccacaaaagatgagcggctgcgtgagatacagaatgcattgatctggataaatttccgttattatcttgcaccgattttctggttggtagtgatgggaaaattaggccctgcaatcttaattgggtacggtttcttgaggggttatcaaggatggttggcacaacacggaacggctgtgcaacgtgcacaaactggggttgatagtttgctacactgtctagattgggttcctgcacgtctggcggggatcgcttatgctttattagggcatggggaaaaagcattgccagcttgggttgcatccctcagtgatcttcggacatcgcaatataaggtggtaagtcaattggctcagtttgccttaagtaaggaacctcatcttaatccaatagaaactcctgttgcggctgttaggttagcgaaaaaggcgacattgactattgtgattattgttgcattgttgacgatctatggagcattagcttaa

SEQ ID NO: 375 - DNA, 552 bp, Xenorhabdus bovienii
  Coding DNA location: Contig name=SeqID_16842; Position on contig =13062..13613bp; Strand=-
atgaagctgcatgaagggtggattgatggtgcaaggaaggtaatctctccatattatgatctgcgtccagaaggtgaaatcccatcattactagtcattcataacatcagtttacctcccggcaagtttggcgggccttatatcgatcagctatttatgggaacgctgaattcagatgaagatccgttctttaatgagataaagggattatgtgtttctgctcattgcttaatccgccgcgatggagaaattgtgcaatatgtcccttttgataaaagagcttggcatgctggcgtatcctgctactgtgaccatgagaaatgtaatgacttctcgataggtattgagttggaagggacggattatgagccatttagtgaaatccagtacctcagattggcggaagttacccaactgcttatctgtcactttcctgatatccgcaataatattacggggcacagtgatatcgctccgggtaggaaaaccgacccagggccttatttttattgggaacattatcggcaactattgaaggagcgagttgaatga

SEQ ID NO: 376 - DNA, 423 bp, Xenorhabdus bovienii
  Coding DNA location: Contig name=SeqID_16842; Position on contig =13909..14331bp; Strand=+
atgaaccaacaagggtttacattaatggaattgatggttgttatggcaattgtgtctatccttggcgcaattgctattcccagttatcagggatatatccaaaaagcagcattaaccgatatgctacaaactattgtgccttataaatctggcgttgaactttgtcgttttgaaacagaaaactacaaagactgtaatactggccatgcatcaatcccatcaggtcataatagccgctatatcagcaccgttacggtaaaagacggagaaataatcatcgtcgggcaacaaaatctcaatgggctcactaccaccttaaaaccaacccaagataccaaaaccggcgttatctactggcgtaccatttgtgatactaaaaatgaatctttaaaattgaaatgtcaggaaacttttaaattttaa

SEQ ID NO: 377 - DNA, 1479 bp, Xenorhabdus bovienii
  Coding DNA location: Contig name=SeqID_16842; Position on contig =14516..15994bp; Strand=+
atgactattgcctgtagcaaatcacccaatgaagatttcattgctgcattacggtttatttctggctcaatcattaatgtagatatttggccaaaagcaaaaatcgaatctatgctgacacaaggaaattcattggtatcttgtacagaaaatcactgtgctgaaaatgatgatgaggaacattatcgtatcgaaaaactggatgttccctattccaatcacagtgaaatacaaacaaacgatgcccattctgaagatatggacacgccagttattcaattaattaatcaaacgatatcaacctcaatacaaaaaagagcctcagatattcattttgagccttctcaacgtggctatcggatacgtattcgggttgatgggatcctgcatgctgtatcatcaccttctccccaaatgaataccggcattccagcccgcttgaagatcatggcaaaactcaatattgctgaaaaacgccagccgcaggatggacaatttgactggaatgatagcaaaaacagttatgcgatacgtatatcaacattgccaactctacatggagaaaagattgtcctgcgcgttttaaataccatacaccagctatcgctggagcaacttggcctgccagagcctcaattgcaacttttaaaacagaaaatccacttaccgcaaggtatgatcctagtgacaggcccgacaggaagcggaaaaaccgtcacactgtatagctgtctgcaatatttaaatcaggcgaagaagaatatctgtagcgtcgaagatccggtagaaattcccttaaatggcatcaaccagacacccgtaaacaacaaaattggcctcgattttgccaaagttctcagagcattattacggcaagatcccgatatcattatggtcggtgaaatccgtgacaatgaaactgccgagatatcgatgaaagcagcgcaaacaggtcatctggtcttatcgacactgcataccaactcgacaattgatacgttatcccgcctgcaaaatttggggatttcaggctataccacagcatcgtgcgtgaaattgattattgcacagcggctagtacgtacactctgcccccattgccgccagcaagataaagagcacactgtcatcaatgtcgacagtggcgctatttctataaagcaacctattcccatagaacaagccgtttcgataaaacaacccgattccgtaaaacaatctatttctataagacaatggcttgcggttggctgtgaacactgtttttctggctattatggcaggacagccatctacgagtttcttgagatcaagccaaccctccagcaggccctgtcagaacactcgattgacaaccttccacagttgctcgctgcacaacagcattcaactcttttttccgcagggctggtcttggtggaaaaaggcataacgacactggaagagatttatcagattacaggccaggaaacagcatga

SEQ ID NO: 378 - DNA, 1200 bp, Xenorhabdus bovienii
  Coding DNA location: Contig name=SeqID_16842; Position on contig =15991..17190bp; Strand=+
atgaaaatggaatatatttatcaatggcaagcggtcaataaaaaaggaaacattgtaaaaggagaaagcatcggccagagcagacaaagcgtatttcaacatctgagccaccttgatttgcaaccttataccattaaatgcaaaaaactcattcattacagcgaaaaggaaatcgcttatcgcttacatttcattcatcaattaagcacattactggcatcaggtatccccctattaaaggggcttactctcttattacaggaatgcaaacaaatgctttggcgatgtgtattaacagatattattcaaaaaatcagtcaaggtgagtcattttccacgacactgggacactatccccggttattttcgcccctgttccgccagcttatcgcggtaggcgaagaaaccggccaacttgaaacctgctgtcaattgattattaaccgattggaacaacaaaatatattacgtaagaaaatccagaaggcttaccgttatcccttgatcgtagcctttgtaactattcttgtcattttactgatgctgatttttgttctaccggaattcaagcaagtttattcttcgtttgatgcctcactgcctctcttaacgcagtgggttttatccgcctctgatttcctgattaatcacggtgtattgcttctggcaatagcctctctattgataatcagttacctatggctgcgccatcaatttcccacactgcaaacaagggaaaagatgttccttctgaaactccctctttttaaacaactcacgatttatcaacaaaccaaccagatatttcatattctgtttatgacacaaaaagcaggtctaacactaacgacagggctggaatgtgctctgaacgcgactcaccaccctgtattcatggcaggggtaaaaaatctgtacaggcaaattcagcaaggcatacccatgagtgatgctttaaaaaaagaaatgtactttccaccattatgtcagcagtttgtcatgataggtgaagaatcaggagaattagaattatttttggggaatctagcggcatggtatcaagaacaatcaatcagccttgctgatagtctagttcaattacttgagcccgtactaatgctgataatggcagtgattgttggtttattattgctggctatgtatctgcctgtttttcagttaggtacaatactaacgtaa

SEQ ID NO: 379 - DNA, 624 bp, Xenorhabdus bovienii
  Coding DNA location: Contig name=SeqID_16842; Position on contig =17324..17947bp; Strand=+
atgagttatattattgcactcacaggtggaattggtagcggtaaaacgactatctctaatgtattttcatcccttggtgtcccacttattgatgcagatattatcgccagagaagttgttgctccgggctcccccgcattgcagacaatcgcagagcactttggtgctgacatattgctgccggatggcagtctaaatcgcgtccttctgcgccaaaaaatttttgcagttccaacagaaaaacagtggatcaatgcacttctccacccgttgatacacacagaaacccaacagcaactaagccaagtcactgccccttatgccatttgggtcgttcctctgttaattgaaaataatttaatgcatttggcagatcgtattttagttgttgatgttccccctgaagtacagatcagccgaacaatgacacgtgacggagtgagtcgtgagcaagtcgagaacattctggctgcgcaggccaaccgtcatgaaaggctggaaaaagcggacgatgtcatattcaaccatcacaatgagcaggatatcatctcccgtgtggtcgaattacaccaacagtatttgaaacaagcagaatcagtcagacaggaaaatcgtaatgagtga

SEQ ID NO: 380 - DNA, 759 bp, Xenorhabdus bovienii
  Coding DNA location: Contig name=SeqID_16842; Position on contig =17940..18698bp; Strand=+
atgagtgatgcaacctctactattatctttgaacacccacttaatgaaaaaatgcgttcatggttgaggattgattcttcactgcaacaactggaaaaacagcggcatctagattcatcggcgagttgcctcgcgtttttccgcacgattgccgaattaatcgaaatactggaacgcggtgaagttcgctctgaattattgaaagagctggatcgccaacaggcaaaactaaagcaatggctcggttcgcccgacgttgacacggctatgatccacatactgatagagcaactcaaggaacggagcatcgccttgaataaggccccacgtctcagccagcacattaaagaagatcgtatcatcagcattgtgcgtcaacggcttagtatcccaggaggatgttgcagttttgacttgcccactttacacctgtggctgcatttaccacagtctgtcagagataaaaccgtcaactcttggctggacggtctgcgcccattacagcaagcactggaaagcattctggggctaatacgccaatctgccatattttccccaaaaatcagccataacggtttctatcagggaaatgctgatgaatctgacttattgagattaaagttagatgtcgtactggatgcgctggtctatccgcaaatatccggtcacaaaacccgttttgccatccgctttctgccgatggatagcgaacacggtgttgtacctgcgcatttgtcatttgaattagcctgctgttaa

SEQ ID NO: 381 - DNA, 198 bp, Xenorhabdus bovienii
  Coding DNA location: Contig name=SeqID_16842; Position on contig =18732..18929bp; Strand=+
atgtctgaagtattaaccgtcgcatgcccgacttgcgctaaaacggtaatatggggagaaatcaacccatatcgcccattttgcagtaaacgttgccaactaatcgacttaggcgaatgggccagtgaagaaaagaaaatcgccagccaggacgacagttcagaaaacgatagctggagcgaagaaccagatcggtaa

SEQ ID NO: 382 - DNA, 405 bp, Xenorhabdus bovienii
  Coding DNA location: Contig name=SeqID_16842; Position on contig =18986..19390bp; Strand=-
atggaaaaaaaacatctgcatattgcggccggcatcattaaaaataccaatgatgagatttttatcacccagcgtcatgctgactcacatatgggcggcttttgggaatttccgggaggaaaacttgaacagggagaaattccggagcaggcactcattcgggaattgaaggaagaagtggggatcacggtaacccattgtgaattggtggaaaccatcactcatgaattttctgacagaaacatcacactctatttttaccttgtggatcaatggaaaaatgagccatttggtaaagaggggcaaccttcccgttgggttttgcaaaccgaattgatcgctgatgagtttccgccggcaaaccgcagcatagtggctttgctgaacaaaagcggatctcattaa

SEQ ID NO: 383 - DNA, 1644 bp, Xenorhabdus bovienii
  Coding DNA location: Contig name=SeqID_16842; Position on contig =19647..21290bp; Strand=+
atgcaatatgcaggtcaaccattgatcgaagcaaagcaaatcgcctatcaattttctggtgaaatcattcctctgttttctggtattgatatgtttttgaacgcggaacaacacgctttggtaggtcgtaacggtattggtaaatcttggctagcatcaatattggctcggcaaataccaccgacagaaggcagtgtgaaccatttctgcgatgttagatatctgtcacaaggtctaacatccttttcaggtaatgcggctgagatgttaggactaactgagatcatgaatgccaatgaacgcattctagcgggcgtcggtgatatgacagattttgatgtcatggaaaatcattgggattggcaatttcaaattgaatccctattggcagaaggagaattgcgctctgaagtattaaaccagccttttagttctctcagtggtggagaacagactcgtctcagactgctggcactaaaacatcagggagcggagtttatgattttggatgaacccagcaatcaccttgatcgacaagggcgtctctggctggctcaatggctgacaactttcagtggcggtattttactgattactcatgacccacaattattacaacatgtgtcagttgtctacgaactcagtgggttagggctatgccgcagcacaggtggatgggaaacgtggttagaaagtaaggaacagctacggttaagtgtacagcgcgaggttgatcagactcgtaaaaacctcaaacaagccttgcttgataagcaaaaagatcgagaaaaagcaagtaaaagacaaagccaaggtaaacaacgacgggaaaatgctaatcaaagtaaaatcattcttgatcgggaattagggcgctcagaagccacgctgtcacgacaggctaagcaacatgaggaacgattacagcgaagcgcttctctggccacagatgccagaacaaaactggaaatcatcgctcctcagtcaatcgtagttgctgcgccgcaaatagcgactgctccattactttatctgcaaaatgtcattttgccttttggctcaagctctcccatcagtttaacaatgaatcatagggatcgcctcgctatcacgggaaaaaatggcagtggaaaatctaccttgctaaaagtgatggcaggtttattccctgccaaacaaggcacttgccgaataacaccttcctatcgtctgatggaccaacacttttcatttcttgataaaaaccaatccgcactgcagaactttcagttacagtcacccggttggcctgaagatcgctatcgtacccggctggcacaactgcgcattcgtggtgaagaagtcttgaaaccggtaggctatctgagtggaggagagcaactcaaggtcgctcttgcctgcttgttttgtgggccttatgctcccgccctcctgctgctggatgaacctgacaatcatttggacattgaatcacgcgaactactccaaaaagcgctgcatggttatactggtgcgatggtgctgatttcccacgatgctcagtttattgcaaatattggcaatatgaaggaattactattgggtggcagcgaggattctcttcataaaaaaacctcaaatcattctctgagaaatgaattttga

SEQ ID NO: 384 - DNA, 2709 bp, Xenorhabdus bovienii
  Coding DNA location: Contig name=SeqID_16842; Position on contig =21349..24057bp; Strand=-
atgctgattaaattactcactaagatttttggtagccgtaatgaccgtaccttacgccgtttgcgtaaatcggttgagattatcaaccgtatggagcctgatcttgagaagctctccgatgaagaactaaaagcaaaaacagaacaattccgtgcacgcctgaaagcaggtgaatcactggagaaaattttgcctgaagcctttgctaccgtacgcgaagccagtaagcgtgtatttggcatgcgtcactttgatgtgcagttgctgggtgggatggtactgaacgaacgctgtattgcggagatgcgtacaggtgaaggtaaaactctgacggcaacactgccagcttacctcaatgccttgagtggacgtggtgtccatgtcgtgaccgtgaacgactatctggcacagcgtgacgctgaaaacaaccggccgttgtttgaatacctcggtctgaccgtcggtattaacctgccaaacatgccagcccctgcaaaacgagaagcctatgccgcagatattacttacggcaccaacaatgaatacggtttcgactacctgcgagacaacatggcgtttagcccagaagagcgagtgcaacgcaaactgcactatgcgctggtggatgaggtggattcgatcctgatcgatgaagcccgtaccccattgattatttctggaccagcggaagacagttctgaactttacatcaaagtggacaaactgattcctaaactgatccgccaagaaaaagaggattcagaggcattccagggagaaggtcacttctcggtggatgaaaaaacacgtcaggttaacctcactgagcgtggtctggttctggttgaagaactgctggttggtgccaaattgatggatgaaggcgaatcactgtattcaccgaccaacatcatgctgatgcaccatgtaacagcagcgctgcgtgcccacgttttgtttactcgcgatgtagattacatcgtcaaagatggtgaagtcatcattgtcgatgagcacacagggcgtaccatgcagggacgtcgctggtctgatgggctgcatcaggcggttgaggcaaaagaaggtgttgaaattcagaatgaaaaccagacactggcctctattacattccagaactacttccggatatatgaaaaactggcgggtatgacgggaaccgccgatacagaagcctttgaattcagttctatttataaactggatactatcgttgttccgacaaaccgcccgatgatccgtaaagatttgccggatctggtctacatgaccgaagcggaaaaaatcgatgcgatcattgaagacattaaagagcgcaccaataatggtcagcctatactggtagggacaatttcgattgagaaatcggaagtcattgccaaagcattaaccaaagcaggcattgaacataacgtcctgaatgccaaattccatgcaatggaagcggatattatcgcacaggccggacaggctggcacggttactatcgcgactaacatggctggacgtggtacggatattgtgttgggcggaagctggcagtctgaaatcgccaaactggaagaaccaacccaagagaaaatcgagcaaatcaaagctgcatggcaagaacgtcatgatgaagtacttgcagcgggcggtttgcatatcattggtacagagcgtcatgaatcacgccgtatcgataaccagttacgtggccgtgcgggacgtcagggggatgcaggttcttcgcgcttctatctctcaatggaagactccttgatgcgtatttttgcttccgatcgtgtcactggcatgatgcgtaaacttggcatgcagccgggtgaagcgattgaacacccatgggtcaccaaagcgattgccaatgcccagcgtaaggtagaaagccgtaacttcgatattcgtaagcaactgctggaatatgatgatgttgctaacgatcagcgccgtgcgatttatgcccaacgcaacgatctgcttgatgtgagtgatgtcagcgaaaccattgccagcattcgtgaagatgtcttcaaggtaactattgatgcctatattccgccacaatctctggaagaaatgtgggatatagaaggtttgcatgaacgtctggtaaacgactttgatctggatatgccgatcaaagagtggctggacaaagaacctgaattgcacgaagaaacgctgcgcgaacgtattcttgaaaaggcgattgaagtttacaaacagaaagaagaaatcgtcagtacagaaatgatgcgtaactttgaaaaaggcatcatgttgcaaaccttggatacgctgtggaaagagcacttggctgcgatggactacctgcgccaaggtattcacctgcgtggctatgcacagaaagatccaaagcaggaatataaacgcgaatctttcgccatgtttgctaatatgctggaatcgctgaaatatgaagtgatcagcacattgagtaaagttcaggtcagaataccggaagaagtggaagcgcttgaacatcagcgccgtgaagaagcggaacgtttggcaaagaaacagcatttgagccatgaagttgagcaaggcgctttgatgtcagaaacagaagcacagatggcgagtggcgcacgtaaagtgggacgcaacgatccttgcccatgtggctcaggcaaaaaatttaagcattgccacggcagtttataa

SEQ ID NO: 385 - DNA, 186 bp, Xenorhabdus bovienii
  Coding DNA location: Contig name=SeqID_16842; Position on contig =24164..24349bp; Strand=-
atgcaacagcttatgctggatacgttgcatgctatgctgatacaagcaccgtcacaatttgaatccatccttgatattgaaattacggcgactattcttcctgattcccacacaccggcactctgggtagctaaaactcagggaattcgcgcggggccaacagctaaccatttatctttgctttaa

SEQ ID NO: 386 - DNA, 537 bp, Xenorhabdus bovienii
  Coding DNA location: Contig name=SeqID_16842; Position on contig =24738..25274bp; Strand=+
atgcgagatagccgaccacaatcactggatacgctgtttgaagacgaggcagctgtcggtaaaagccctcttcaaatcattcaacaacatgctattgcacttttgaaactcaaccgtgccattctcagtttattgcccgcacaactacatccatggtgcagggtcgccaattatcgcaaacatattctggtactggaagcaggaaatgccagttggatgaccagacttcgctatgaagtgcccgttttgctttcgacactgagaagcgaaattctaccatctttatcctctatcgacatcaggattaatccatcattaatggtcaaacgtagtaataatgcgcaagacttcgcaagatcgtcaacaacagcacctaataatgataatcagaatttaccaaagcgccaattgagccatgaaagcgcagaaacattaatgatattggctgaacgcagccctgaaaaattgaaaaggaaattagagagattggctgcgctggccggagagggtaccagtacagccaaaaagaagcgctag

SEQ ID NO: 387 - DNA, 918 bp, Xenorhabdus bovienii
  Coding DNA location: Contig name=SeqID_16842; Position on contig =25367..26284bp; Strand=-
atgatcaaacaaaggacattaaaacggactgttcaagcgaccggcgttggtttgcacaccggtaaaaaagtcacgctgacaatgcgtccagcgccggctaataccggggtcatctatcgtcgtactgatttgaatccaccggtagattttccggcgaatgctaaatccgtgcgtgataccatgctctgtacttgtctggtaaatgaacacaatgtgcgaatttcaaccgttgagcacttgaacgcggcgttagcaggtctgggtatcgataacattgttattgacgtcgatgcaccagaaatcccgattatggatggtagtgccagcccgttcgtttttctgctgttagatgcaggcattgaagagctgaatgtcgcgaagaaattcgtacgcatgaaagacgcagttcgcgtagaagatggtgataaatgggctgaattagcgccatatcacggttttagtctggactttaccattgacttcaaccacccggctattgattccagctcacaacgttatagtttggatttctctgcggattcgtttgtccgccagattagccgtgcacgtacttttggatttatgcgcgatattgagtacttgcaatcccaaggcctgtgcctcggtggcagtttcgattgcgccattgtggtagatgactaccgcgtactcaatgaagatggtctgcgttttgaagatgagttcgtccgtcataaaatgctggatgccatcggtgatctgttcatgtgcggctataacatcattggcgcgtttactgcgttcaaatcaggccatgcattgaataacaagctgctgcaagcagtcttggcgcatgaaagtgcttgggaatttgtcacgtttgaagatgaagctgaaatgccgctggctttccgtgctccatcgacagtgatggcatag

SEQ ID NO: 388 - DNA, 129 bp, Xenorhabdus bovienii
  Coding DNA location: Contig name=SeqID_16843; Position on contig =2..130bp; Strand=+
gtcagcctttttataaagatagctcgatatagatataaaagaaaaagtggcatctgccaagacaccactttctattatcgcatgtggatgcgaatcaaactcaatctactgagtcgattacatgcttaa

SEQ ID NO: 389 - DNA, 1209 bp, Xenorhabdus bovienii
  Coding DNA location: Contig name=SeqID_16843; Position on contig =119..1327bp; Strand=-
atgtctggagttctttttatgtctcatatttttcattttatccttgctctagttgttattggcggtctggcgatttttgcgagtaataaccgaaaagacatacgggttcgctatatcattcagttgcttgttattgaactcgttctggcgtggtttttcctgaattctgatgttgggctagggtttgtcaaagggtttgataacctttttgtccacttgttgtcttatgcagcggaaggaacccgctttatcttcggcggtatgatagaagcgaaactggccttctttttcttgaatgtcctttgcccgattattttcatttctgctctgattggtatcctgcaacatattaaagtgctgccaattatcattcgtgtgattggtactgtgttgtccaaagtgaatggcatgggcaaactggagtctttcaatgcggttagctcattgattctggggcagtcagaaaacttcgtcgcttataaagatgtgctgggtaaaatgtctgagcgtcgcatgtacacgatggcggcgacggcaatgtctacggtctctatgtctatcgtaggcgcttacatgacgatgctggatgcaaaatacgtagttgctgcactggtacttaacatgttcagtacctttatcgttctgtcactgatcaacccttactctgtcgagagcgaaggggatatccaaatgaataacctgcacgaagggcaaagtttctttgaaatgctgggcgaatatattctggcgggtttcaagatagctttaatcgtaacggccatgctgattggttttatcgcattgattgcggctatcaatgcgatttttgacatgatatttggtatctccttccaagaatgtctgggatatgtattctatccattggcatggatcatcggtattcctagcgatgaagcctttaaagtaggcagcattatggcaactaaactcgtttccaatgaattcgtcgcaatgcagggtctgcaagatattgcagcacaattgagcgaacgttcaaaaggtattctgtcggtattcttggtttcctttgcaaacttctcctcaattgggattgtggctggagctattaaaggcctgaatgagaaacaagggaatactgttgcacgttttggtctgaaattgctgttcggttcaacgctggtaagcttcttatctgcggcaattacagggttggtgttaagcatgtaa

SEQ ID NO: 390 - DNA, 2019 bp, Xenorhabdus bovienii
  Coding DNA location: Contig name=SeqID_16843; Position on contig =1494..3512bp; Strand=-
atggaaaatattatcgaaaaaatcaacaaactaagagcaacattgcgtcatcacgagtatttgtatcatgttatggatgcgccagagatccctgatgcagaatatgatcgcttaatgcgagaattgaaagtactggaagagcaacatccagagttgattacggcggactctccaacccagcgtgttggtgcggcaccattaacggcatttgaacaggttcgtcatgagatcccgatgctgtctttggacaatgtttttgatgaagaaagttatctggcatttgacaagcgtgttcgcgatcgcctgaaagatagtcgggatttggtgttttgctgtgaattgaaactcgatggactggcggttagcttactgtacgaagatggtgaattggtacaggctgcgactcgtggtgatggcacgacgggggaaaacatcaccgccaatgttcgtactattcatgccattcctctgcgcctaaaggggaataatattccagctcgtgttgaaattcgtggtgaagttttcataaagcagggcgggtttgaaaaactcaatgacgaagtgcgtcgtaagggcaacaaagtattcgctaatccacgtaatgcagccgcaggatcactgcgccagcttgatcctcgtatcacgggcaagcggccattgaccttttgttgctatggcgtaggtgttctggaaggcggagaattgccgacgagccattacgaacgcctgatgcagttcaaacaatggggtttgccagtcagtgacaaagtggaattatgccaaggaactcagcaagtcatcgatttctaccataacattgagcagcagcgcccgatattgggttttgatattgatggcgttgttatcaaagtggactcccttgaattacaggaaacgctgggttttgttgccaaagcgccccgttgggcaacggctttcaagtttgctgctcaggaacagatgaccatcgtgcgtgacgttgaatttcaagtgggacgtactggcgctatcacacctgttgcacgtttggagccggtgcaagttgcaggggtaatagtcagtaatgccacactgcacaatgcggatgagattgaacgtttggggctgcgtattggggataccgtggttattcgtcgtgcgggtgacgtgatcccaaaagttgttagtgttgtacaggataaaaggccagccgaaagtcaggaagtgatttttcctgaatactgcccagtttgtcgctcggatattgagcgagtcgaaggggagtctgtggcgcgttgtactggtgggttgttttgcggtgcgcagcgtaaagaagcgctcaaacatttcgtttcccgtcgagccatggatgttgatggtatgggagaaaagatcattgagcagcttgtcgataaagaatatgtcaaaacacctgccgatcttttccgtctgaccgctggaaaattaacgggtcttgagcgaatggggcctaagtctgctcagaatgtgattgatgccttagagaaatccaagaaaactacattcgctcgttttatctattctctgggaattcgtgaagtcggggaagcgaccgcagttaatttggtttcatattttgccacattagaaaaactgcgagcagcagatactgaagcattaatcgcggtgcaggatgtggggggcgtagttgctagccacgtcgtgaatttctttaacgaactgcataatcagactgtgattgatgacctcattgacaatatcggaattcactgggaatcagttgaaacgctgcagtcagacacagttggtaacccatttgctggtaagattgtggttttgacaggctcgctaagccgtttatcccgggatgaggctaaagataagctgacagcgctgggcgcgaaagtgacaggcagtgtttccaagaaaacggatttagtcattgctggcgaagctgcgggttctaaattagtcaaagccacggaattgggaatagaagtcattgatgaagaagaaatgcttcgtctgttaggtgaataa

SEQ ID NO: 391 - DNA, 930 bp, Xenorhabdus bovienii
  Coding DNA location: Contig name=SeqID_16843; Position on contig =3574..4503bp; Strand=-
atgatgcaggatttgcgtctgatattaatcgttgttggtgcgatagccataatagctttgctattacatgggttgtggaccagccgcaaagagcgttcgtcactctttcgtgatcgcccagttaaacgtcataaacaggagcgtcaggaagagctcgacgataatgatggcgatgaactgtttgataattcgtcaaaatcgcatgttcaagagtcagtcaagcctcgtaatgaacatcgcgaagagcctgttattaaacgctctgcacctgagttatcagcggtagcgcttgatgaggtttttgatcctttgctttcaaatcagcaacctggagcaccaggggcaaaagtaaaaaccgttgaggaatatcaggaagagccacagcttagcttatttgagtctactgagcagagtgctgaggcagcagaatcggttgtcaatacggcagttgtggaagaacagctgaacgtattggaaaatgaaactgtgggcgaagttgagcaagtcaaaaaagaaacagtgctggtattacatgtctctgcccatcatggtcaggagcttgatggcgaagcactgcttcaaagcattttgcaatctggcttccggtttggtgatatgaatatctttcatcgtcatttgaacccggcgggcagtggagcggtgctgttcagtctggctaatatggtaaaaccaggctcgttcaatccagaactcatggacgatttcagcacccctggaatttccatgtttatgcttgtgccatcatatggtgatgctaatcagaactttaaactgatgttgcaggcagcacagcggattgcttctgatgtgggtggcgttgtgttggatggtgagcgaaaaatgctcacgccacaaatgatcgaacactataaggcgcgtattcgcaatacgctcaatgcctgcgaataa

SEQ ID NO: 392 - DNA, 306 bp, Xenorhabdus bovienii
  Coding DNA location: Contig name=SeqID_16843; Position on contig =4401..4706bp; Strand=+
gtgacgaacgctctttgcggctggtccacaacccatgtaatagcaaagctattatggctatcgcaccaacaacgattaatatcagacgcaaatcctgcatcattgctatctctgttgtttaaattaattgccaccacggcggaatattctttagataagagtatttgtcaaatagcacaagtgcaagtctctacatacttttcttaccataaaggagatataccctgttttttcggatattttttacacacaaaactactggtcagtagaaaatcctgcctatatcataccgtctcaatcatctag

SEQ ID NO: 393 - DNA, 777 bp, Xenorhabdus bovienii
  Coding DNA location: Contig name=SeqID_16843; Position on contig =4723..5499bp; Strand=+
atgacgaattcgacaaaactgccaaaacatttgagcgggtttcattatattgcacaaggttggcatctgataacccgccccggcatcaagagattcgttttattacccttactggccaatatcttattgctgggtggttcattctggtggttgtaccataaactggatggctggatactatgggcgctcgataaaataccagattggatgcaatggctgagttatttactgtggccactggctgtcgtctcgattttgctgatttttacctattttttcagcatgctggctaattttattgcctcaccattcaatggattactggccgaaaaattggaagctgaattaactggcattccagcgccgaacactggcatggtcgatttgataaaagatacgccccgtattttaaaacgcgaggtagtaaagatcctctactatattccgcgtgcgctcgtactgctgttgctatatttcattccaggtattggtcaaaccgtcgctcctgtcctctggtttattttcagtgcctggatgttggctatccaatactgcgattatccgtttgataatcacaaagtcagtttttctactatgtgcagtaccctgcgacaaaacaaaattgacaatcttcaatttggtgcagccgttagtgtattgactatgatcccggtagtaaacctgttcattatgcccgttgcagtctgtggagcaacagccatgtgggttgaccgctatcgtgctcaacacgctttacaccataacccatcccattaa

SEQ ID NO: 394 - DNA, 954 bp, Xenorhabdus bovienii
  Coding DNA location: Contig name=SeqID_16843; Position on contig =5787..6740bp; Strand=+
atgagcaaaatttatgaagacaattcgttgactattggtcacactccactcgtacgtttaaaacattttggtaatggccgcattctggcaaagatagaatcccgcaatccaagtttcagcgtgaaatgccgaatcggtgccaacatgatttgggacgctgaaaaacgtggcatcctgaccaaagataaagaacttattgaaccaaccagtggcaacaccggtattgctcttgcttacgttgcggctgcccgtggctataagctgacccttactatgcctgaaaccatgagtcttgagcgccgcaagctgctgaaagcgctgggagccagtctggtgctgaccgaaggcgcgaaaggcatgaaaggtgccattgataaagctgacgaaatccgtgatagcgatccagaccgttatattctcctacaacaattcagtaatccggcgaaccctgaaattcatgaaaaaaccacaggcccagaaatctgggaagctaccgatggcgatatcggtgctttcgttgcaggcgtagggactggaggcacaatcacaggggttgctcgttacctgaaaaatacacaagccgcacaagtcactatcgttgctgtagagccagaagattctcctgtgatcagccagaaacttgctggtgaagaacttaagcctggcccacacaagatacagggaattggggctggtttcatccctgataacttggatttaacattagttgaccgtgtgtttaaagtcagtaatgaagaagccattaaaacagcgagagaactcgctgaaaaagaaggaattcttgctggaatttcctcaggagccgctgtcgctgccgccgtcaggttatctcaggaagacgaatataaagataaaaatatcgtggttattttgccttcttcggctgaacgttatctcagtaccgccctgtttgccgacttagccaatgattaa

SEQ ID NO: 395 - DNA, 171 bp, Xenorhabdus bovienii
  Coding DNA location: Contig name=SeqID_16843; Position on contig =6841..7011bp; Strand=-
gtgtatttaggcattatcaaaaaattaacacactcgatgcattcaattgttggttttatgttaatacacactatccgagtatttgttgaattggatggtgcttttcattctggctcagcgattaatttcgtgcatcaaaataattactggttaaatactaaagctacttga

SEQ ID NO: 396 - DNA, 144 bp, Xenorhabdus bovienii
  Coding DNA location: Contig name=SeqID_16843; Position on contig =6941..7084bp; Strand=+
gtgtgtattaacataaaaccaacaattgaatgcatcgagtgtgttaattttttgataatgcctaaatacaccttatttcattatcaatttaacggttgtacaagccaaagcgggttcagctacactagctttagaattttctag

SEQ ID NO: 397 - DNA, 258 bp, Xenorhabdus bovienii
  Coding DNA location: Contig name=SeqID_16843; Position on contig =7123..7380bp; Strand=+
atgttccagcaagaagtcactattactgcaccaaatggcctccatactcgccctgctgcgcagttcgtcaaagaagcaaaaggtttctcttctgacatcactcttacttctggtggcaaatctgccagtgcgaaaagcctgtttaagctgcaaacgctgggactgactcaaggtactgctgtaacaatttccgctgacggcgaagatgaacagcatgctgttgaacatttagttaagctgatgggtgaattggaataa

SEQ ID NO: 398 - DNA, 177 bp, Xenorhabdus bovienii
  Coding DNA location: Contig name=SeqID_16843; Position on contig =7408..7584bp; Strand=-
atggggtcttctttcagcaataatgccttgccgaaagcaatgcctggtgatactaagatgcctgaaatcatactatatgaccttactgcgggtgattaccttccattaagccttcaagggggaggctctaaatatccccagattttatttatctggggatggaactcggtgaaatga

SEQ ID NO: 399 - DNA, 1728 bp, Xenorhabdus bovienii
  Coding DNA location: Contig name=SeqID_16843; Position on contig =7514..9241bp; Strand=+
atgatttcaggcatcttagtatcaccaggcattgctttcggcaaggcattattgctgaaagaagaccccatcattatcaatcagaaaaaaattactacagaacaaaccgaacaagaaatttcccgttttaaacagggtcgagacaaatcttccgtacagttagaaataattagaaaaacagccgaaaaaaatctgggtgcagaaaaggctgagatcttcgaaggccatatcatgttgctggaagacgaagagctggaacaggaaattgttaccctgattaagaaaaatctggcaacagcagatgccgctgtttattccgttattgaagatcaggctaaggcactggaagaactagacgatgaatatttgaaagaacgtgcggctgatgttcgcgatattggtaaacgcctgctgaaaaatattctgggtatgccgattatcgatttaggcactattgaagaagaagctattctcattgccaatgacttaactccatcggaaaccgcccaactcaatctggacaaagtgctgggtttcatcactgatttgggtggccgaacatcccatacctcgattatggctcgctctctggaattacccgcaatcgtcggtactaccaacgcaacaactcaaatcaaaaatggcagttacctgattctggatgcggttaataaccagatttatgtgaacccgtctaatgccgaaatcgatcaactgaaaaaggcaaaaaacgagtatctgtcagaaaaaacagaactggcaaaactgaaagatttacctgctattacactggatggccatcaagttgaagtttgtgccaatatcggtacagttcgtgatgtcatgggtgcagagcgcaacggcgccgaaggtgtaggcctataccgcaccgaattcctgtttatggatcgcgatacgctgcctactgaagacgagcagtttgaggcatataaagcggttgcagaagccgttggcaaccaagccatcattatccgtactatggatatcggcggtgataaagatttgccttacatgaacctgccaaaagaagagaacccattccttggctggcgtgcaattcggatttgccttgatcgtaaagaaatcttacattctcaattgcgtgctatcctgcgagcctctgcatttggtaaactccgcgttatgttcccaatgattatttcagttgaggaaattagggagctaaaagcagaactggcgttgctcaaaaaccagttacgtgatgaaaacaaagcatttgatgaatctattgaagtcggcatcatggtggaaacacccgctgctgcaaccattgctcatcatcttgcaaaagaagttgacttttttagtattgggacaaacgatctaactcagtatactcttgcggtagaccgtggtaatgagctgatttctcatctttataacccaatgtcaccagcggtgttaagcctcatcaaacaggttattgatgcctcacacgcagaaggtaaatggacgggcatgtgtggagagctagcgggtgatgaacgcgctacgctgttgcttttaggcatgggattggatgagttcagcatgagcgcgatatcaatcccgggcatcaagaaaatcattcgtaatactaattacgatgatgcgaaagcgctggcagagcaagccttatctcagccgactgcacaggaattgatggatttggttgacacctttaccagagaaaaaacactctgctag

SEQ ID NO: 400 - DNA, 510 bp, Xenorhabdus bovienii
  Coding DNA location: Contig name=SeqID_16843; Position on contig =9290..9799bp; Strand=+
atgggtctgcttgataaactgaaatctctggtttcagatgataaaaaaaacagcggcagtattgagattatcgccccattgtcaggtgaaatagtcaatatcgaagatgttccagatgttgtttttgccgaaaaaatcgttggggatggtatcgcgattaaacctgccggcaacaaaattgtcgctcctgttgatggcaccattggtaaaatcttcgaaactaaccatgctttttctatcgaatctgatagcggggttgaactgttcgttcattttggtattgataccgttgagctgaaaggtgcaggctttaaacgcattgccgaagaaggacaacgagtacagaaaggcgatctggttttagagtttgatctggcatttctggaagaaagggctaaatcaacattaactcctgttgttatttctaacatggacgaaattaaagaattgtctaaagtgagtggatctgtagttgtaggtgaatctgtcatcatgcgtatcaaaaaataa

SEQ ID NO: 401 - DNA, 213 bp, Xenorhabdus bovienii
  Coding DNA location: Contig name=SeqID_16843; Position on contig =9768..9980bp; Strand=+
gtgaatctgtcatcatgcgtatcaaaaaataacagaaaaatcatcgggaacacgttttccgctcttttcctgtttgcagatcctgcttatttgcggatggttgatgaatcgccactgttttatcaggtattttaccgattaagcctaataatacaggggcgatttttttgtggtttgctgctcagtcaaaaaacgacgtttaatgccaaataa

SEQ ID NO: 402 - DNA, 873 bp, Xenorhabdus bovienii
  Coding DNA location: Contig name=SeqID_16843; Position on contig =10005..10877bp; Strand=-
ttggaagattttataggcaatactccgctggttaaattacaacgactcactgaaagtgttgatgcggaaatttgggtaaaactggaaggtaacaatcctgctggttccgtgaaagacagggctgcattttcaatgatccagcaggctgaattacggggagaaattgcgccgggagatgtgctcatagaagcaacgagtggcaatactggcattgcactggctatgattgcggtagttaaaaattataaattgaaattattaatgcctgaaaatatgagtcttgaacggcaggcatcaatgcgggcttacggtgcagaattgattttggtcagtaaagaattaggcatggaaggtgcacgggacttagcgcagaaaatggaacaagagggagaagggaaggttcttgaccaatttaataatatggataatgcactggcgcactttaatacaactggcccggaaatctggcagcaaacgcaggggcgcataacgcattttgtttccagtatgggaacgacggggacaattacaggagtgagccgctacctgaaatctcaatcagataaagtgcacactacgggattgcagcctgcagaaaatagccagatccccggtattcgccgttggtctcccgcttatatgcccggtatttacaaaaaagagttggtggaccagcttttggatatcacgcaaatggaagccgaaacgacaatgcggctattggcgcagaaagaaggcattttttgtggtgtcagttctggcggtgctgtttcaggggcactgcgcattgcggctaaaaatccaggggcggtcattgtagcgattgtctgtgatcgtggtgacaggtatttatctactggggtatttaattaa

SEQ ID NO: 403 - DNA, 1089 bp, Xenorhabdus bovienii
  Coding DNA location: Contig name=SeqID_16843; Position on contig =11020..12108bp; Strand=-
atgagtattgaaatcagtaaaatcaacaagtcttttggccgagtccagatactgagtgagatttcattaggtattgaatctggtgaaatggttgcactacttggcccgtccggttctggtaaaacgactctcctgaggattatcgcggggcttgagcagcaaagtgcagggcagttgaagtttaatggtcaggatgtcagtcgagtgcatgcgaaagatcggcgagttggctttgtattccagcattacgccctatttcgccatatgaacgtttttgataacgtcgcttttggtttgactgtgcttccacgtcgtcaacgcctgagtggtgaggcgctccgcagtaaggtgatggcattgcttgatatggttcagttatcccaccttgctgatcgttacccgtcacaactgtctggtgggcagaaacagcgtgtggcattagcaagagcattggcagtggaaccgcagatcctgttgctggatgagccgtttggtgctttggatgcacaggtacgcatggagttgcgccgctggttacggcaacttcatgaagaactgaaatttaccagtgtattcgttacccatgatcaggaagaagcgatggaggtagcggatagagtggtggtgatgaatcaagggtgtattgagcaagttggtacgccgcaacaggtgtggcgagagccagaaagccgttttgtgcttgaattcatgggagaggtcaatcaattacacggtgaaatcaaaggttcccaattatggattgggggaaaaatttttccattgaatgtgacaccattacatcaggggaatgttgacgtgtttttccgcccatgggaaatgactcttagtacccaacaaactgcatcttgtcctttacctgttcaaattgtggaaatcagtccgcgtggccatttttctttgttgtctgtcttgccggtggggtggggaaaagacctcttatcggttatctggcagggtaattcacccgttccagttaggggaaatcagtattttatggggggtactggagctagactgtatgcaggtgacttgtcattaaaagtgctcagactcgctgaatcagcttga

SEQ ID NO: 404 - DNA, 840 bp, Xenorhabdus bovienii
  Coding DNA location: Contig name=SeqID_16843; Position on contig =12129..12968bp; Strand=-
atgactgaattctctgaatacacagtggcacagcgctcttctatcaactggggaaaatgggtactgattggtacgggcatactcgtttctactctgatgctggtaatcccgataatgtggatttttttgaccgctttttcgaaagggttcgatctcgttaaacagaatctttttgatcccgatatgctgcatgctatctggctgacggtgatgattgcgcttatcacagtccctatcaatctgatttttggtgtgatgaccgcttggctagtcactcgattccagtttcccggcaggcagttattgctgacactgatcgatattccgtttgctgtttcgcctgttgtggcagggctgctttatctgctgttttacggtgtcaatggttggatggggagctggctgggttcttatgacattcaattaatgttttcatggccgggtatggtactggtgacggtatttgtgacatgcccatttgttgtccgtgagttggtgccggtgatgttaagtcagggtagtcaggaagatgaggctgcaatattgctgggcgcttctggttggaagatgttctggcgtgtgacattaccgaatattcgctgggcattgctatatggcatcgttttgaccaatgctcgggcgattggggaatttggcgcagtttctgtggtatcaggggcgattcggggtgaaacctatacgctgcctttgcaggttgagctgctgtaccaggattacaacaccgtgggtgcatttacggctgcggctttattggcagtgatggcgattatcactctgatggtcaaaagtgctgttcagtggcgcttaagccaccagtaa

SEQ ID NO: 405 - DNA, 837 bp, Xenorhabdus bovienii
  Coding DNA location: Contig name=SeqID_16843; Position on contig =12968..13804bp; Strand=-
atgatgttagtggcatccggtaaacgcgtactgcccggatttgggctgagtttgggcagtagcctgttttatacctgtctgatcttgttattgccattaagcgctctggccgtacagctttcgagtatgacatgggctcaatattggcaggtgattgtaaatccgcaggttgttgccgcttatcaggttacattgctggccgctgctgcggccagtttgttcaacatggttttcgggatgttgatggcgtggatactgactcgttatcactttcctggtcgcagtttgcttgacgggttgatggatttgccatttgctttgccgactgccgtggcaggcttaactctggccaccctgttctctgcaacagggtggtatggcgcttggctgagcaattttaacatcaaggtagtgaatacttggctgggaattgcagttgcgatggcatttacaagcctaccgtttgtcgtccgcacagtgcagcccgttcttgaagaacttggcaccgaatatgaggaagcggcgcagacattgggcgctagccgctggcagactttccggcgagttatcctgcctgaagtttcacccgcattgatggccggaaccgtactctctttcactcgcagcttgggggagtttggggcagtcatttttattgcaggcaatattgcatggcaaacagaagtggtttccctgatgattttcgtccgtctgcaagaatttgattatccggctgctagcgcgattgcttcggtgatccttgcggcatcgttgttactgctgtttagcgtcaatatattgcagagtcggtttggtaaacggatcggggggcattga

SEQ ID NO: 406 - DNA, 1038 bp, Xenorhabdus bovienii
  Coding DNA location: Contig name=SeqID_16843; Position on contig =13801..14838bp; Strand=-
atgaaaacagtggcaataaacaataaattattgagcgggttggttgccgtagcacttttgggtcttatcagcgcctatagtgccaacgcttatgctgtcggattattgaatagttcttacgatatttcgcgagagttattttctaccttgaaccctcaatttgaaaaacaatggaatgcacagcatccacaggataaattaattattaagcaatcccatgcaggttcatccaaacaggcattgagtattctacaggggttacgggctgatgtcgtgacgtacaatcaggttacggatgttcagatcctgcatgatcgcggcaatcttattcctgctgactggcagcagcgcctgccaagtaacagttcaccttactattccactatggcttttctggttcgcaaagataatcccaaacagatccatacttgggatgatttggtgcgtcatgatgtgaagttgatttttccaaacccgaaaacgtcgggtaatgggcgttatacctatctggcggcatggggcgctttccaacagcaaaatgagcagaacccggtgaaagttggccaactgatgcggcgtcttttgcaaaacgtagcggtatttgatactggggggcggggtgcaacgacttcatttattgaacggagtctgggcgatgttttgattagttttgaatctgaagtcaataacattcgtaaacagtatggtgcagataattatgaaatcattgtgcctccggtagatattttggctgagtttcctgtgacttgggttgataaaaatgttcgcaaaaatggaactgaagccgtggccaaagcttatttgaattacctttatagccccgcagcgcagcagatcattgtgagcttcaattatcgtgtaaatgataaaaacgtcatggaagcacagaaacctcgttttcctgaaaccagactgtttcgtctggaagaacaattcggtagctggccgcaggtgatgaaaacacacttcaacacgggcggtatgttggatcagttattggcggaaggacataaatga

SEQ ID NO: 407 - DNA, 117 bp, Xenorhabdus bovienii
  Coding DNA location: Contig name=SeqID_16843; Position on contig =14879..14995bp; Strand=-
ttgataacccctacatttcctatagcttatcgcgtttcatcatttctcataaaaactcggtatataaaacaggggatagtaaactaccctgttataaatattctggatacagtatga

SEQ ID NO: 408 - DNA, 621 bp, Xenorhabdus bovienii
  Coding DNA location: Contig name=SeqID_16843; Position on contig =15065..15685bp; Strand=-
atgggtaaattttttgtatttaatttattgtcgaaacagcgagttgtagccgttagtagtttattgggaggttcgctgttattaagtgcctgtgctggaatatcagaattttcatggtcttcgttatcacctttggagtggtttggcagtaccttacgcgtctccgaacaaggtgttggggaagttaataaacagacagacatggttcaatctgcgattgaacaaggcttgaaaggcaaataccgcctgcgcagtgggatggaaactcaaaatggcaaattcgtcagcatcattcagggaatggaggggaatcaggtaaaaatcgaattatctggtttggctaaggggaaggttgatcgtattgatgtgttggatgacggggcgaaaaccgtgtggggaacaaaaataggcacgcctttctccgagctgtatgacaaagcgtttggtgtgtgtcatcgttcctgtgatttcactacgcagccaaccgtgatttgtattgcaccgcaaagccagcatatcagctacgtgtttaccggaacgtgggatggcccagaagggttaatgccttctgatgatgtcctgaaaaattggaaaatttcgcggattatttggaaatcttga

SEQ ID NO: 409 - DNA, 135 bp, Xenorhabdus bovienii
  Coding DNA location: Contig name=SeqID_16843; Position on contig =15705..15839bp; Strand=-
atgttatcgatcattgtgtcaacctatcgtcaatgttgtatcgttcttgtttttttggcatttttgttgatgaaatgtttcatattcacaaatgaatgtttttttaagagtgtggtttacataacccgtcaatag

SEQ ID NO: 410 - DNA, 414 bp, Xenorhabdus bovienii
  Coding DNA location: Contig name=SeqID_16843; Position on contig =15874..16287bp; Strand=+
atgatgaatgaaaaggtgattattgcggtatttattatctctttaagcgtatctgtcatggcgagagcctcagatcaaaaattggttttgccttctaatattcatgacaagttgaatcacactacaaatcaggaaaaaatcacgatatctcaggaaaataaatctcatattcaatctccttgtcgctttattatatcagaagggaaaccagaatctcccatccatgatcattatcaactatatcgagataacgaaggaaaaattcaagttagaattatctctagtatcggagataatatccccattacgtcaaagaaattatttactttgcaaaataaatatcagaggtgcttgagccattttataataaagataattaatttagtactgtataattcaataacggccgaataa

SEQ ID NO: 411 - DNA, 423 bp, Xenorhabdus bovienii
  Coding DNA location: Contig name=SeqID_16843; Position on contig =16314..16736bp; Strand=-
atggaaattcgggtatttcggcaagatgattttgaggccgtcaccacactttgggaacgctgtgatttgattaatcccggtgatgatccagaagtagatattgagcgtaagttaacccatgatgctgatttatttctagttgctgaagttgcgggagaagtggttggtacagttatgggcggctatgatgggcatcgtggacatgcttattatctaagcgttcaccctgaattcaggggcaggggaattgctaatgctctgatatcccgtttggaaaaaaaattattggcgagaggttgtccgagtattttgattctggtttcagaagaaaatgatgcaacgatttgtatgtgtgaaaaaatggaatatgattatttggggcaagaaaatactattttttgtaagcgtctgattattgattaa

SEQ ID NO: 412 - DNA, 108 bp, Xenorhabdus bovienii
  Coding DNA location: Contig name=SeqID_16843; Position on contig =16978..17085bp; Strand=+
ttgttccagtgcttattgacgttttcctactattgcagcacactacgtataaacatttgtataaatatattgggtgaacatggctgccgaactaaacaagctcagtga

SEQ ID NO: 413 - DNA, 1218 bp, Xenorhabdus bovienii
  Coding DNA location: Contig name=SeqID_16843; Position on contig =17057..18274bp; Strand=+
atggctgccgaactaaacaagctcagtgacaaaaaacttaaaaccctacacggaaagaaaaggaacaagattgaattttttgccgatggtgctggattaagtgcaaaagcatctaaagctggtggtattagttgggtttttacctaccgacttgatggtaaaaagttaaaccgccttaccattgggcgctatcctgatatgcccctcaaacaagctcgtgaaacacgggacaaatgccgtaactggttggcctctggtaaagatccaaagctgcaatttaatttaacgatgcaggaatcattaaaaccagtcactgtaaaagacgctatcgaatattggatagaacactatggcagagaaaaccgagtaaatattgatagcctcattcgtcaattaggaaagcatatttatccccacattggggaaatggcattatctgactgcgaaataatatattggctgcaatgctttgataaaatgaaaaaagaagctccggtggcttctggtggcatacttcaattgtgcaagcaagccctgaaattttgccgggtaagaaggtatgcaattagccatgtattggatgatttaacaattcaggatataggaaaaaaacagaataaaggccagcggtatttagaagataatgaacttggtcaattatggaaatccatcaatgaagatatttacctaccttattatattaatttattgaaaattttggttgtatttggttgtcgaacacgagagatcaggttatctaaatgttcagaatggaatttagattccatgctgtggactgttccaaaggaaaatagcaagacaggtgaaagaattattcgcccgatacctgaatgtatgaaactattcttagaaaatcttatttatcaaaaccataaaaatgattacctattaggtgcatttaaaagcactgaaacagtatcagagtatggaacaaagatatggaaaaaattaggtcatgtggaaaaatggtctttgcatgacttaagacgaactttttccacaaaattaaatgatatgaaagtagctccacatattgtagatcagcttttaggccatattttaccgggcgtcatggctatatataataagagccaatacctaccagagaagctagacgccttaaacatgtggtgtgagcgactggatgtattgtcgggtaattatgagaatgtcgttgtattaaaaatagctcaataa

SEQ ID NO: 414 - DNA, 285 bp, Xenorhabdus bovienii
  Coding DNA location: Contig name=SeqID_16843; Position on contig =18402..18686bp; Strand=+
atgactattcaatacagcattcctacacctgaagaacgccgcaatatcctttccgagtatggcgaaccttatgatcgccttatacgtgaaaaagaacgccagcacattacctctatttccagaacgtcagcatggaaactggaaaatgaaggccgtttccctgcccgtaagccattaggtcgcaattcctgtgcttggttgctcagtgatttgctgcattgggtacgtaatccgccaacagtagaaaacgtaaataacccgtatagccgtaaacgtaccaattaa

SEQ ID NO: 415 - DNA, 93 bp, Xenorhabdus bovienii
  Coding DNA location: Contig name=SeqID_16843; Position on contig =18698..18790bp; Strand=+
atggaaaaattaactgccttaattggttgcgatctaactcactctaaaatcagcttaatttttgggaatcagtggattaatggtaagtactag

SEQ ID NO: 416 - DNA, 588 bp, Xenorhabdus bovienii
  Coding DNA location: Contig name=SeqID_16843; Position on contig =18777..19364bp; Strand=+
atggtaagtactagctatagaggttctttaagattaaacagccatcaatttgagagacaaccctctttaagagggttaattgattattcttgctcagatgatgctttggatttgcgctggcggcgtttaatttcacctgtcatagccaaaattatgaattgtgcggtactttcaccctcttctttaagtttttccattgagtcaacaagttcatgcggtacacgtgcttctaatttttttgactttgcatttattgctttcgttgccatatctgtatccattagtagttggtggctgacagtatacacaaaaaattttcatgaaaaaggattgacgtggctgacacttaaaaataacatagtggctgacaccttgagtcattcaaggaacaaaaacagcgacgccccgaagtgcggtaacactctcgaggcgtctaaccaaaacattatcggagctaatgctatggctgacatacagtctaaccaaactcgcctaaaatttacattcctaattgcatccggcactcagcggctggctggtatgccctcactgatcttcgtatcacgtcaggagacacaccatgagtaa

SEQ ID NO: 417 - DNA, 408 bp, Xenorhabdus bovienii
  Coding DNA location: Contig name=SeqID_16843; Position on contig =19357..19764bp; Strand=+
atgagtaataaacctatctcattaaaacaggcgctatatcgcgcaagtctgggtgtttcactcttcacatttattaccaaaaaagccaaagatgaatgcgaaatcaacttaaataatctgattgcactggcgggcgatattcatcaggaggttcaccgagctttgttgaaacattctccacagcctcttgtgaataaattattaaattgcgttgtgtataggaaatccgacccattagatcaggcctcgtttcgggcgggtttatgcatctctttatatgagatcattcttgaacagtctagccagcactgttccgaagaattacatgatttgctttcactggcctgtgatatcaatcaggaagtttactattcgctttatgcggctgttaatggcgaggacgagtga

SEQ ID NO: 418 - DNA, 2391 bp, Xenorhabdus bovienii
  Coding DNA location: Contig name=SeqID_16843; Position on contig =19767..22157bp; Strand=+
atgagtcagggaaatagccgtccgttagatgttattcgtgcagtgaagcaatccgccgccaatcactggcaacttttgttgcccgcctgtggtattgacgttccgttaaagggtaagcatggtgcttgtccgatatgcggcggcactgaccgctttcattttatagatgataaccataacggcgactggcattgccgccaatgcgatgagccgaatcatggtgacgggttggatttagtagcgagaaacaaagggattacggtctttgcagcggctaagctggtggctgatgtgctggcaatgcctttgcccgaacccaaaaccgtcaaagaacaaccgcgagcagctaagctgattgctgaacgcattgtggcactggtcgccaccgctgttacgggtgaatctcaatatctagtgaaaaaggggctgcaatgccccaatcaacggttattgaaagatggttcgttattgctggtggttcagacgctggacggcacaattaccggagcacaaaccattaagccgaacggtgaaaagcgccttgttgcaggtactcaaaaaaaaggcagttttatccccgtctccaaaattaccagaacaccggacacaatcatcattaccgagggttacgccacagccttaactgttcgccaattgcataagggagtggtactggcagccattgatgaaagcaatttatcggtggtagccggactggtgagagagcggtggccagacaccagaataatcattgctgctgataatgactggcacgggcaaggcgaacgagacaaaaacggcaggctaaaaaagaacgttggcaaaatggcggcagagaaaaccgctatagcgattaacagctgggtaacgctaccgccaacggaattaaaagccgactgggatgattatcgccaacatcacggcattgagacagcaaagcaggcatttaataacgggttatatcaggttggggagaaaagactaatggaagcagaagcagtggtgatccaagaagcaaagcccaaaaaggccaataacaatctggcacaaatggcagccagtcagcgcggggcgctggtagttgaacgctacggcaggatagcagtcaatcctgaaagtgatatggtttaccattttaacagtacgacatggcagaccgtgtcggataatgagctgcgccgcgcaatggtggcaatctttgaccagcacgaaaccccttacaacccgaatgggatcaataacgctatctgtgccatgaaattacaggtgccggttatcggcgaacagcggcaggatttaatcgggtttcgtaatggcgtgtatgaattatcgacacaacaatttaccccgcaccagccggaacactggctaatgaaccataacggcatcacattcaccccgcctgctatcggtgaaaacctgccggatcacgcccctgatttttaccgctggttatcccatacggcggggagcaatgaaaacaaaatggcacgaatcaaagccgccctgtttatgatcctggcaaaccgttatgactggcagctatttattgaggtcacaggtgaaggtggcagcggtaaaagtatctttacctatattgcgaccttgttagcgggagaacacaataccgccagtggcaatatgagggcactggatgaggcgagaggccgctatcagtttgtcgggaaaagcctgatcacgctgcccgatcaggttaaatatgttggcgagggggcaggcattaaggccattacaggcggtgacctgattgaagttgacgggaaatatgagaaacagttctcaacaattattaaagcggtcgtactggctaccaataatgagccgatgagcttcacagaacgcaatggtgggattgcccggcggcgggtgatatttccgtttaatattccggtcaaagaatccgagaaagactcgcaattaccggagaaaatcagccgagagctgcctgtgattatccggcatttattaacggagtttgccgaccagaataaggctaaaaagctgctacaggcgcaacgtgattctaacgaagcgttaacggtgaaaagcaattcagatccgttgtatcgcttttgcggttatctagtgtctgtcaatgatgcaactggaatgaagatgggcaataagaacatcagcccacgcgcaccgagattgtacctgtatcacgcttatctttcttttatggaagcacacggctttgagcgaccactcacactgaccaagttcggcgaatcacttcccaaaattatgctggaatatcgcaaggagtatcggaaagtgcgaaccaataaaggttactcttataatgttgaattatcgggagaagccgaagagtggctgccgtccgtgcctgagttacgaaacagttaa

SEQ ID NO: 419 - DNA, 108 bp, Xenorhabdus bovienii
  Coding DNA location: Contig name=SeqID_16843; Position on contig =22299..22406bp; Strand=+
atgggtgaacaggagatacagtcaatgaatatcatattaattgcggcaaacccagatgtggcaaggcgtccagtgaatcatgcagagggtgcacagcggagaaggtga

SEQ ID NO: 420 - DNA, 276 bp, Xenorhabdus bovienii
  Coding DNA location: Contig name=SeqID_16843; Position on contig =22574..22849bp; Strand=+
atggctaaagttgatgtggtttgtcgttattgtcacaaagcagaggaggtcaaagggcatggaaaaggaagcagtgggcacccgcgttatcactgttatgcctgccgtaaaaccttccaactgaattacacctatcaagcctgcaaacccggagtgaaagaacaaatcactgatatggcgataaataacggcgggatcagagacactgcacgtgttttgaacgtcgggatcaataccgtgcttcgcacgttaaaaaacatgaacccagacaagtaa

SEQ ID NO: 421 - DNA, 252 bp, Xenorhabdus bovienii
  Coding DNA location: Contig name=SeqID_16843; Position on contig =22898..23149bp; Strand=+
atgagcaggggtcatttgtcggcaacaagaagaatcaacgcgggctctggtatgcgtgggaaccaaaccagaagcaaatcatcgcacatgtatttggcgatcgcagtaaaaaaacgctggaaaaactgttggcgcttctggcatcgtttgaaatccagtattattgtactgataattatgctgtttatgattgccttcctgagagaactcacctcagaggaaagaaatttacccaacgcatcgaaagaatga

SEQ ID NO: 422 - DNA, 255 bp, Xenorhabdus bovienii
  Coding DNA location: Contig name=SeqID_16843; Position on contig =23026..23280bp; Strand=+
ttggcgcttctggcatcgtttgaaatccagtattattgtactgataattatgctgtttatgattgccttcctgagagaactcacctcagaggaaagaaatttacccaacgcatcgaaagaatgaatctgaccctgcgtactcgaataaaaaggctgaatcggaaaacgatctgctactctaaatcagaaatcctgcatgacaaaatcatcggaacgttcattgagcgtgaatactatcttgcaaggataatctaa

SEQ ID NO: 423 - DNA, 480 bp, Xenorhabdus bovienii
  Coding DNA location: Contig name=SeqID_16843; Position on contig =23522..24001bp; Strand=+
atggctaacattatttacatgaccttaaacggcaaaaagcaagggctgatatcagcaggttgttcaacctatgattcaataggtaataaataccaagaagaaaataaagataaaatattggtttattctgtagatcacgatatcagtagagaacagaatgtaaatcatcaacctataataataacaaagccaatagataaatcatctccattattaggcgttgcaatatcaagtaatgagcatttagattgcctgcttgacatatataggaatagctcaacaggaggattagaaaagttttactctatcaaattaacaaatgcaactataaaaaatatctcaagccactaccccaactcactaagccacaatgatatgcaaccatatgaaagtataacaatttcatatgatagcataacgtggacacatcacatcgctggtacatcaggctacagcataagagaagagaatgtattttaa

SEQ ID NO: 424 - DNA, 423 bp, Xenorhabdus bovienii
  Coding DNA location: Contig name=SeqID_16843; Position on contig =23998..24420bp; Strand=-
atgctgggattgcggttgagtaatttcatacgtatatgtatagttatatttattttagctattggcgttattcttttttttgcatcattagcgaatgttaatttatcatatacaaaaagaaattttatttattattactcatttacctttgatgagattaagagtgtacctttaatttcaaatgattatattatatattatgactcccctgatggtaataataccatgactaacgaaattatattttcaaatgtaaaattgagtcgtctggcagaattaataaaatacactgaaaacatgggttttataaaatactatgataagtattggaaagatgaacgctggcgtaaagataataccattataagtataaaacaaaatgatactgagcgtaccattttgtttttagtggagaaaaattaa

SEQ ID NO: 425 - DNA, 687 bp, Xenorhabdus bovienii
  Coding DNA location: Contig name=SeqID_16843; Position on contig =24398..25084bp; Strand=-
atgactaaaagatctgatataaaagatggacgattggtttatacagaaaaattagggtggttagatttagggcatgctaacggtgatgatgcaaggaagttaatgctctctcttgctttgggggatgaaactactaataaatcgcattttattgttaggtatgttcaatatatgggcagggggcgtagcctaggaacatctataaaaacaagatggagagttagaagaggtttatctttacatgataaaaaaagagttgctcttactattatgatgtatacaactcattcatttgaatcatatcaagattcctttccttttactttaatttcagatagtggctatagtggtgaagatttgatttctaacttattcggtttttatcaagctatcaacggtattaattatttacctcaagtaggggtagtaagtaaagaaaaagcatataaacgatgggattactacggggatataggaaaatataaaaataaatcttttaagccattattattccctgaccctgaaaagtatccaaataatacaattccttataatgttcccttgcctagttttttaaatacaataacgcctataagcgatataaaaactggtcatgacgtaattcttattgaagatgcaagctggattaatataggtaaagaatatgctgggattgcggttgagtaa

SEQ ID NO: 426 - DNA, 393 bp, Xenorhabdus bovienii
  Coding DNA location: Contig name=SeqID_16843; Position on contig =25512..25904bp; Strand=+
atgaaaaagatactgattatttttatttttttactttatggttgtgggaatccaacgccaaaagttttaccaaaatcagaagttcttcctgatgctgtgataaacgaaccatatcaagcatcaattaccatcacaggaggcgcattaaatgaaagaagcgtttgggtaaaaatttatcctattgactcaggactaacatggaatccaaaagaaagttctttccaatgggaaggaaaagaagaaataagaaaagattatcatcatataaatataacaggcatcccaaagaagacagagctgataaaaattgaagtggtagggtttactttgggtacaatgtacccagggaaagatttcgataaaacctatactataaaagtaaaaaacaaatag

SEQ ID NO: 427 - DNA, 96 bp, Xenorhabdus bovienii
  Coding DNA location: Contig name=SeqID_16843; Position on contig =25941..26036bp; Strand=+
atgctcgctcaacataacaaggattctttcttattatttttcatggtgttaaaaattattttttgcaaaaataaattaactacaaagacaccatga

SEQ ID NO: 428 - DNA, 1155 bp, Xenorhabdus bovienii
  Coding DNA location: Contig name=SeqID_16843; Position on contig =26033..27187bp; Strand=+
atgaaaaaactactcgaattacgccagcaaaaagccgatttaacccatcaaatgcgttcccttctcaccaaagctggagatgaaaaacgctcactaaccaatgatgaagccaaacagtttgacgaactgcgcaaccagtccgattccctgaatgcggaaattgcccgttatgaaacccttgccgatgatgagcgcagtcaggcaggtaaaacccaaccaacccgcgataacctcagcaatgacgaactccgccattatattctgaccggagaaacccgcaccttgtctacgggcgttccctcagagggtggctataccgttatccccgaactgaataagcagatcatgcagcaacttacctgtgagtcagtcatgctccaaatctgtaccatcaagaccacacgcagtaacgaatataagcagcttgtttcggttggtggtgcagcagtggcacacggggaagaaggtaagtcacgcggcgagacaaccactccgaaaatggaagaagtcagtattaagttgttccctgtctacgcttatcccaagaccacccaagagattatcgattttagcgatgtggatatcttaggctggctgacctcagagattgctgataccttcgtcgataccgaagaaacggatcttgtcagcggtgacggcagcaaaaaagccaaaggttttctggcttatccccgcgatacgaaaagcgacaaggtgcgtgattttggtacgctgcaaaaactggaagttaccacgcttgaggccgatagcctgattgatcttaagttcctgcttaagaataaataccgcaagaatgcggtgtgggtgatgaactccacgactgccgctaaggtgcaaaagctgaaaaacggtaatggggattatatctggcgggaacgtttacaagcgggtgatcccgatatgttgctgggcttacctgtccattatcttgaatttatgcccgatggcgtgatcggtctgggcgacttcaaacgcggttatttcattgttgaccatgaaacaggcacccgtacccgtcccgacaatatcaccgagccgggattttataaggtacacaccgataaatatctgggcggtggtctggtggactccaacgcaatcaagatccttgaagtgaaaaccacttcgaaataa

SEQ ID NO: 429 - DNA, 549 bp, Xenorhabdus bovienii
  Coding DNA location: Contig name=SeqID_16843; Position on contig =27226..27774bp; Strand=+
atgaataacgattttgaaattcgcaccgcgtctctgtctgctgctgataaaaagctggtgggctatgtgattaagtggaacagcagatcccacgttttatgggatgaatttattgaacagtttgccccaaatgcttttagcgccagtttaacttcgggtgttgatgtcagggcactgtatgaacatgaccacatgaacctgttaggccgtaccacgtccggtacgttacagcttgccgaagataccaccggattaagcttcgagttaacgccgcctgatacgcaactggggcgcgatgtgctgactttggttgagcgcggtgatatctccggtatgagctttggattcagggcactaaaagatcagtgggatgtcggtcaaacaccctatatcagaaccgtcttggaagccgaactgcgggaaatcactgtcaccagcttacccgcctaccctgaaagcggggtggagattgccagacgttccctgaatgccgttaagcctaatcatgttgatttgcgtcattactggctgcaactgtccgaggtgtga

SEQ ID NO: 430 - DNA, 1218 bp, Xenorhabdus bovienii
  Coding DNA location: Contig name=SeqID_16843; Position on contig =27777..28994bp; Strand=+
atgtggccttttaagcgaaaagacacggaaacccgcagcctgagcatggatgagtttctttctctggcgggcgtgtctaacaccaaatcgggcgagcatgtttcaccgtctacagcggaaggcttacccgcagtaatgaatgcggtcactgtcattagtgaagcggtggccaccatgccttgttacctttatcgggttcagcaccagaacggcaaagaatcccgcgaatggctcagtaatcaccccgtagattatttgctgaatgagtgcccgaatgactgccagaccccgtttcagtttaagcgaaccctgatgcgtcattgcttactcaatggtaatgcttatgcggtaatcgtctgggggcgggagggtcagccacaatcgttgcacccttacccaccgtcagcggttgtaccgcaacggttatccgatcatcggtttgcctacaccatcaccgaaccttatagcggcaaggtgaaaaccttcctacaggaagaaatcctgcatttacgctatgccaccgaagacggttttcttgggcgctcgcctgtcaccatctgccgagagacattgggcttggggctggcacaacaacgccacggagccagcatcatgaaagacggcatgatggcggcaggggtaattaaatccgctgagtggctggatggtacaaaaggcgctaaggcactggaagcgctcgaacgttataaaggcgctcgcaatgcgggtaaaactcctattcttgaaggcgggatggaataccagcaattaggcatgagtaaccaagatgccgagtggttggcttcccgtcgcttcacgattgatgatatcgcccggatgttcaacgtcagcccgatctttctgcaagagtattcgaacagtacctacagtaactttagtgaagcgtcccgcgcctttctgaccattaccatgcgcccgtggcttgccaactttgagcaacaaatcaaatcggctttgctggtggcgtcaccaaaaagcggcatccgctaccaagtcgaatttgataccgccgaccagctgcgagccaatccgcgcgaacgcttccagagctatgaaaccgcgattaagtcaggggtgatgtgtccgaatgaagcccgtgaacgtgagggactctctccccgtgaagggggtgatgaatttagtcaggcatggaagcaaacggtagaaatcaagaaacaaccggagggcaaggaatga

SEQ ID NO: 431 - DNA, 378 bp, Xenorhabdus bovienii
  Coding DNA location: Contig name=SeqID_16843; Position on contig =28946..29323bp; Strand=+
atggaagcaaacggtagaaatcaagaaacaaccggagggcaaggaatgagggcaggcagattgaggcatcgggtgattatccagaaatccgagcagtcacgcgccccgtcagggcaggttattgacaagtgggtggatgtcgcccccgtctgggcggaagtgagggcgattagcgggcgtgagcgtttggcatccggtgccgtgttctctgaggccactgtgcgtatctggatgcgttaccgtgatgacgtgaccaccgccaatatcattctctataacggggctaacaccagaggaaccgcttttgacattgtggcggttatccctgatgcgaaatacacccgcttagagttgctgtgtaaaggcggtgttttctaa

SEQ ID NO: 432 - DNA, 297 bp, Xenorhabdus bovienii
  Coding DNA location: Contig name=SeqID_16843; Position on contig =29323..29619bp; Strand=+
atggctgaaatccctttaaatgaaatcaaacagcattgccggctcgatgaacgcgacacgcttgatgatgccttgttaatgggctatgccgaagccgcgctggaagtctgccagcaacatattggcaagcggtttgataacggattggcctttacccctgctatcaaggtgggctgtctgctttatattggcttgctgtatgaaaatcgggagatggtgacagaagcagaacttaaagaagtcccttttaccatcaagtcattgtggtctgtctatcgtgatgtgggagtgtattag

SEQ ID NO: 433 - DNA, 435 bp, Xenorhabdus bovienii
  Coding DNA location: Contig name=SeqID_16843; Position on contig =29620..30054bp; Strand=+
atgccgtggcaacctttaaggcgctgtagttatccgaattgccgtgaacgggtgaagtcaggccactgtgaacaacaccaacgggaagcccgacggcagcaggacaaacaacggggaacccgaacccaacgaggctacagtaaccgatggggacgctaccgactgcaatacctgaaagccaatccgttgtgtgtccactgcctacagcaagatatctatgcctctgcaacgattgtggatcacattatcccgatacagggtgaagctgatgtgttgttctggcctgaatccaatcatcaatcgttatgcccgccctgccataaccgcaagaccgtacagacagatcctatcaccaaagcgaagcgcaaacagggtatctatcaggaacgggaaacagaagcggcaaagcatcgcggttggttagtcgcagaataa

SEQ ID NO: 434 - DNA, 450 bp, Xenorhabdus bovienii
  Coding DNA location: Contig name=SeqID_16843; Position on contig =30089..30538bp; Strand=+
atgacaaacgcgcttctcagcggaaccgaccccctcctcaaatttttacgcacggcactttttttgaaaataaactcacaaggaagacagaaaattatggcaagggcacccaaacccccgacttatcttaatgacattgccgccagtcagtggaaatccaaggcaaaaatcttaggcgaacgggaagatctgaccgccgccgactggaacaacttagaactgtactgcgtcaactatgccatttaccggaaagcggtggcagaccttgatattcggggttttagtatcgtaaacagtcagggcagtgaaagccgtaatccctcattgagcgccaaggctgatgccgaaaaaatcatgataaaaatgtcgtcgttgcttggctttgatccggtttcacggcgtaaaaatccgatagaaacggaggaagaagacgagttagaccgcttatga

SEQ ID NO: 435 - DNA, 1662 bp, Xenorhabdus bovienii
  Coding DNA location: Contig name=SeqID_16843; Position on contig =30535..32196bp; Strand=+
atgaatgcatgggagcagtatgcttttgatatccaaaacggtaaaatttcggcctgtaaccgactaaaacaagcggtgaaacgctactataacgacctgaataacccgctttatacgtttgattctgaggtcgtggcgcgttttattgctttttcctgtctctgtccgcacgtcaaaggccatttacgcggtaagccgattgtactggagccgtggcagcagttcgcctttgctaatctgttcggtttcaaggtaaaagcaaccggacgcagaaagtaccgtagcgcttatattcaggttccgcgcaaaaatgcgaaatccaccgttgccgcgatactggctaactggttcttggtgatggagcaggagcagcaagatatttacaccgccgccgtgagccgtgatcaggcgcgtatcgtgtttgatgatgcccgccagatgagtttactttccaagccgctcaaaaagcggctatctatccagcaacataaagtgacctacccgaaaaccaatagcttgttaaagccactggcagccaaagcctctaccattgaaggaacaaaccccagccttgccattgtcgatgagtaccatttgcaccctgataacgcggtgtattctgcccttgaattaggtatgggcgcacgtcccgaaggtgtcctgtttgccattaccacggcgggcagtaacgtgatatccgcctgtaaacagcattatgattattgctgtcagatactgaatggcgaagagcaaaacgcatcgttattcgccctgatctacgaactggacgacgagaacgagattgatgatgaaacactttggatcaaggctaaccccaatctgaatgtatccgtggacagtgccgccttgcatgacaccatccagaaagcgcgtggcattccctcgcaatggacagagatgctaaccaaacggttcaatatctggtgtcagggtgaaacaccgtggatgggtgaaggcgcatggaaagcctgccagacagactatgatgaaaacaacctgaaagggctggagtgttacgccggactggatttatcctcaacaggggatatcaccagcgtgtgttacacgttccctgtggataatgaattgttattactgacccgccattatttaccggaagcccagttacagaatccggccaacaagaaccgggcggtttatcgtcaatgggcacaagcaggctggatacgtaccacacaaggcgattgcattgattatgaccgtattcgtgacgacattctcaaagatagccagcactttgatatcaagctggtgggttttgatacatggaacgccacgcacctaagaacacaattacagggagcagggctggacgttgaacccttcccgcaaacctatatgcgctttagccccgttgccaaatctgccgaggtgttcgttaaccgcaaagttattcgtcacaatggcgatccggtgctcgcgtgggcaatgtccaatgtggtgatggaaacggacgccaacgctaatatcaaaccgaacaaaaagaaatcggcaaacaagatagatccggcgattgcgttcctgatgagctttggcacatggcagagtgagcatgaagagtttgctttcggtctgagtgatgagcaaaaacagcgattggctacctttgatgggatttag

SEQ ID NO: 436 - DNA, 183 bp, Xenorhabdus bovienii
  Coding DNA location: Contig name=SeqID_16843; Position on contig =32238..32420bp; Strand=-
ttggcctctataaaaaacgcttttattctgtggagaaagctccttaacgacacgaaggaaatctcctatacatgtgatttctgtcatattctcatttatctccttattattccgtgcattgttgaatctttattacatcaaacagtaacagtaattagaagaaaccgtatcaacaaatattaa

SEQ ID NO: 437 - DNA, 1179 bp, Xenorhabdus bovienii
  Coding DNA location: Contig name=SeqID_16843; Position on contig =32334..33512bp; Strand=+
atgacagaaatcacatgtataggagatttccttcgtgtcgttaaggagctttctccacagaataaaagcgttttttatagaggccaaagaaattcagaatatggtattaattcaagtataagtcgattgttaaaaagtgttaagttaaatcctatttcgattaaaagatataatactattacaagggtgttttatgatgatgaaatttccaaatatcatttggcaagtgaattatattccactttcagggagaagcatatagtttatcctgatgtgaatatcattaacggctatagtatgaatgatattgatcttcatgtaactgctcagcattacggattatcaactagagtcattgattggacttatagtcctttaattgcattatattttgcaacagagaaaagaaaaaataatggaattaaatacgaggatgatagtaaagatgcatcagtgttcatgatttggaatgaagaatctaataaactagatgtatgttctagcgataatttcttaaaaagaatagaagcagagaaaaaaatccataaaaaaatatctaaggattgtgaaagtttttatttaactcaccgttataaaatttataatatgcacgatgaattagaaagatatgttgatgagttatataataaattaatagattatacgaatcatttagagtttggtgaaacaataaggttaaattcaacagatcatttaattgatcttgtcgagtgccgcgataatttaaatgctaatgaatttattgagaaaatattttattttgcagttcgattttttaatcaatcatataattattccaggccgaacgctaccatagacatttttaatgattataacactatcatagagccgctgccaattaatcaaagggtaaaaaatcaacaaggagttctaatgttttgtaaaaaagttgaggacgatgtttatccttcaagcaaattcaatgaaaaaaatacaataaatcatatcgatgatgagtcattatcggaagtttccaaaaatgctggattattgaaaataatcataccaaagagtagtatcaagagtataagaaaagagctggaactgtatggtttctcgaaagactttgtatatcctgaaataatgtcttttactgaatatatgcaagagaagatcatatcgaagcatagcatttga

SEQ ID NO: 438 - DNA, 276 bp, Xenorhabdus bovienii
  Coding DNA location: Contig name=SeqID_16843; Position on contig =33835..34110bp; Strand=+
atggaaagggtagcaggaatgaataacgttagaaatgactggcatcaggccgacattattgctgcattacgtaaacgtggtacaaccttagccgcagtctcccgtgaagccggtctcagttcatcaacattagcaaatactctcagtcggccgtggccgaaaggtgaatggattattgctaactatcttgaaatacatccttctgaaatttggcctagccgatattttgatatgtacggtcagcttattgcgcgtaaggctcgagacaaatcataa

SEQ ID NO: 439 - DNA, 132 bp, Xenorhabdus bovienii
  Coding DNA location: Contig name=SeqID_16843; Position on contig =34128..34259bp; Strand=+
ttgaaaatcaccgggaagatagccgtaacggggtatcttctcactagcagtaacactcatcattgtcacctcaatagctcccgacgaagtgcgctgcaacctctcataagttcagaacgtttagcgtactga

SEQ ID NO: 440 - DNA, 909 bp, Xenorhabdus bovienii
  Coding DNA location: Contig name=SeqID_16843; Position on contig =34442..35350bp; Strand=+
atgaatatacctaatatatcccaagttaaggattttttcctctcattacaggatgaaatctgcaaacaacttgagcgacttgatggtcactccaattttatggaagagtgctggcagagggaagaaggcggtggtggtcgcagtcgcgtattaaaggcaggcaacgtttttgaacaggctggcgtgaatttctcccatatcactggggcttcacttcctcaatcagcaagcgcccaccgccctgaattagcgggtcgtagctatcaagcaatgggcgtttcccttgttatccacccactcaatccctatattccgaccagtcatgccaatgttcgcttttttattgcggaaaaagaaggtgaagcaccagtgtggtggtttggcggcggttttgatctcactccttattatggcttcaacgaagatgccattcattggcatactgtcgccaaaacattatgccaaccttttggcgataatgtttatcctgattataagaaatggtgtgatgattatttctttataaaacaccgtaatgaaccacgcggaattggtggattattttatgacgatttaaatacccctgattttgaaacttgctttaactttacgcaagccgtcggtaatggttttttggccgcatatttgcctattatagaaagaaggaaaaatataaactggggagaacgtgaaagagaattccaattatatcgccgtggccgttacgttgaatttaatttagtttgggacagaggaacattatttggcctgcaaagcggtggacgcactgaatcaatattaatgtccatgccgccattagtacgctgggaatataatcattctcctgagccaaactctccagaagctgaactttatacctcctttctaataaaaaaagattgggtatga

SEQ ID NO: 441 - DNA, 1068 bp, Xenorhabdus bovienii
  Coding DNA location: Contig name=SeqID_16843; Position on contig =35552..36619bp; Strand=+
atgaaaaataatgaaatcaacagatatagcttaatccctccatttgttttagaacatatctctaatgattgtgatgagcgctctaatcaatatgtattaaaaacattagatcatgttcatcacttaatgaatatctctattggagaagatctcttacaacaggaaaatgaagtagaatttgatgatgaattaaatcgaactatctacgatgcagaacatgaagagatatttccaggtgataaggtagcgcgacgcgaaggtatgcctgagagtgaggatattgctgtcaatgaagcctatgagtatctcggtaagacccatgaattctacaaaaaagtttttggccgtaattcactcgataacaaaggaatcaagctagtcgcaactgtacattatggtcaaaactacatgaatgcattttggtctagaaaacagatggtttttggcgatggcgataaaagtggaaaatatttcaatcgcttcacttctgccattgatgttatagctcatgaattaacgcatggcgtgattgagagtgaagcaagacttttttatgcttatcaatctggcgcgttaaatgaatccatttcagatgtgtttggcattatggtaaaacagtatttcgataaacaaaaagccagtgaatccgattggcttatcggaaaagggctacttggatctaattttaatccagacaataaaccggatgttgccttacgtacatttgtaaatccgggaacggctttttccggggataaacaagttggtcatatggatcaatataaagagctaccgtttacaaaggacaatggtggggttcatatatattctggtattcctaacagagccttttatctactggcagtggaactaggtggttattcatgggaacgggcgggtaaaatctggtatgaaactttactcgacgaacgtttatcttcagatgccaattttgatgattttgcagaattaaccattaaaaacgctgaaaaattgtttaataaagaagtttcagatatcgtgaataattgctggagcaaagttggagttatcattccaacaaaataa

SEQ ID NO: 442 - DNA, 135 bp, Xenorhabdus bovienii
  Coding DNA location: Contig name=SeqID_16843; Position on contig =36603..36737bp; Strand=-
atgaatataagaaagggctattttcagccctttcttgtttattataggattatcttaatcttactctgtttaagaataattgatattgtattaatgattatattgatgttggtgttaattattttgttggaatga

SEQ ID NO: 443 - DNA, 93 bp, Xenorhabdus bovienii
  Coding DNA location: Contig name=SeqID_16843; Position on contig =36852..36944bp; Strand=-
atgatattgtacttgtctattttactattacgcataatattagccagtttgtatgttgttatgtgtatctgctttagggtacttagatattag

SEQ ID NO: 444 - DNA, 198 bp, Xenorhabdus bovienii
  Coding DNA location: Contig name=SeqID_16843; Position on contig =36910..37107bp; Strand=+
atgcgtaatagtaaaatagacaagtacaatatcattcctccctgtctactggaatatattgccaataattgtgatgaaaatgacaaggaatgtgcgctaaggacgttagaacatgttaatagtctaatgaaaaattcagctaaagaagaaaaggtttcacagccggaaaataatttatcagttgataaaaaaagataa

SEQ ID NO: 445 - DNA, 1491 bp, Xenorhabdus bovienii
  Coding DNA location: Contig name=SeqID_16843; Position on contig =37335..38825bp; Strand=-
atgatacctgttgttgcgctggttgggcgcccgaatgtcggaaaatccaccttatttaaccgtttaacccgaacccgagatgcgctggtagcggatttccctggtttgacccgtgatcgtaaatatggacgggcagaagttgaagggcaggaattcatcatcattgataccggtggtatcgatggtacggaagatggcgtagaaacgcatatggctgcgcaatctctgatggcaattgaagaagcggatatagtcctgtttatggtcgatgccagatcaggaatgatgccagccgatcacgggattgcaaaacatctgcgtagccgtgaaaaagccacctttttggtagcgaataaaaccgatggtattgataccgatactgctatccctgaattctactcactggggttgggggatatatattccatcgccgcttcccacggccgtggtgtgacacaactgattgagcatgtgttgttgccattctccgaaaaagagaaaacggaagaagttgaattaacggaagaagaagccaatgcagcttattgggctgagatagagcagtctgaattggaagctgctgaaggggaagagaaggaggcagcttttgatcctaccactttaccgctgaaattggcgattgttggtcgtccaaacgtgggtaaatccacattgaccaaccgtattctgggcgaagagcgagtcgttgtttatgacatgccgggaaccacccgagacagtatttatattccaatggagcgtgatggccgcgaatatatcctgattgatacagcgggggttcgtaaacgtggcaaagtaaccgaaacggttgagaaattctctgttatcaaaacgcttaaggccattgaagatgctaatgttgttttgctgatagttgatgcccgtgaagggatttctgatcaggatctctctctgctcggttttattctcaatagtgggcgctctctggttattgcggtcaacaagtgggatggcatgagccaggaagacagagatcacgttaaggatatgctggatttgcgtctcggctttgtcgattttgcccgtgttcactttatttctgcactgcatggcagtggggttggcaacttatttgactcgattctggaagcttacgaaagtgctacccatcgcgttagtacttccatgctgactcgtatcatgcatatggcagaagaagatcatcagccgccgatgatacgtggacgcagggtcaaaatgaaatatgcccacgcagggggatataacccacctatcgtggtgatccacggcaatcaggtgacaaatttgcctgattcttataaacgttacttgatgaactacttccgccgctctttaaaagtcatgggaacacctattcgcattcagtttaaagaagggtctaacccttatgcagataagaaaaataccttgacggctacacagcttcgtaagcgtaaacgtttaatggcgcatttgaaaaagcgctaa

SEQ ID NO: 446 - DNA, 126 bp, Xenorhabdus bovienii
  Coding DNA location: Contig name=SeqID_16843; Position on contig =38767..38892bp; Strand=-
gtggagcttcgagtggatcactttcagcaggatatcgatttacatctagttatgaggcatcaaaaaaatgatacctgttgttgcgctggttgggcgcccgaatgtcggaaaatccaccttatttaa

SEQ ID NO: 447 - DNA, 1173 bp, Xenorhabdus bovienii
  Coding DNA location: Contig name=SeqID_16843; Position on contig =38983..40155bp; Strand=-
atgcaactgcgaaaaacactcttggttgggctggttgcttctgttctgttggctggttgttcaagcgaacaggatacgctagcaatgtcaccgctgccgaaggttgaaaatcaattcaatccccgtgtaatttgggataaatcagttggaagcggtgttgggcaatattattctcacttgtcacctgtttggcagggttcaacggtttatgttgctgatcgcaccggtgtcgttaaagcatttgaagtagatacgggtaaagagctgtgggccacagacctgtcggaaaaagcaggttttctgtcatcccgcttgcctgcattgctttctggtggtttgaccgtatcaggtgagcgcctgtatgtcggtacagaacaggcaaaagtcatcgcactggataccactaacggtaaagttgaatgggaatcaaacgttgcgggtgaagcgttatcacgtcccgtggtgagtgatggccttgtgttaatccacacgggtaacggtctgttgcaggcattgaatgaaaccaatggttccgcagtctggtcagtcaatatggatacaccttcattgtcagtccgtggtgaatctgctccagccgtagcctatggtgctgcgattgtcggtggtgataatggccgtattagtgcggttctgatgtcacaaggacaattgatttggcagcagcgtattgctcagatgacaggttcaactgaaatcggccgcctgaatgatattgatatgactccggtcatttctaataatattatttatgcaattgcttataatggcaatttggtggcaatggatatgcgttccggccagcttatctggaaacgcgatatcggttctgtgaatgagatggttgtgacgaatgaccatattttcattgttgaccaaaacgaccgtattctgtccctgcgtaaaagtgacggggtaacactgtggacgcaaagcgatttattgcaccgtaacctgacagcaccggaaatgtacaatggctatctggttgttggtgatgctgaaggttatctgcattggttgaatatggctgatggtaaatttgtggctcagcataaagttgatggttctggcttgttgagtcgcccggttgttgccggagataagctgatggtacaggcgaaggacggtaaggtttacctgtatacccgctaa

SEQ ID NO: 448 - DNA, 621 bp, Xenorhabdus bovienii
  Coding DNA location: Contig name=SeqID_16843; Position on contig =40170..40790bp; Strand=-
gtggaagtctataccactgaaactgaacaaattgatgtgataaagcgtttttttgccaacaatggtaaatatcttgctgttggcttggtgctgggcattggggcgctggctggctggcattactggcagtctcatcagacaaaccagttgcagggtactgcggcgacgtttgagaaattgaataaatcattggaatcgggctcgaaagaaagcgttgttgccacagaaaaattcgctaatgaaacgaataatatctatggtgtcatggctgatgtggatttggcaaagcgtgctgttgaacagaatgatttggctcaggcagaaaagcgcttgctggccgccgctggcaaagccaaagacgaggatatgcaggctttatccaatattcgcctggctcgagttcaattcgcagaagataaaacggatgctgcactgaaaacgctggaacaggtcaaggggaaaggttggctggtagccgttgagaacattcgtggtgatattctgacgaaaaaagggaatattgcgggtgcgcgtgcagcctattccagggggctggaagccgatggcccacagcctttgaaaagtagtattcaaattaaacttaataatttatccagctaa

SEQ ID NO: 449 - DNA, 309 bp, Xenorhabdus bovienii
  Coding DNA location: Contig name=SeqID_16843; Position on contig =40802..41110bp; Strand=-
ttgcagatctggcctgttgcggatgtttatctctcctcctttggtgaaggtagccagcaggcggcattgattctggcggagcagatccgtgatgaattgcctgaattacgcttgatgaccaatcatggtggtggcaacttcaagaaacagttggggcgtgcagataagcatggtgccaaagttgccctgatccttggagaagatgaaattcgtgcaggtaatatcactgtgaaagatttacgtaatggtgaacaagagacgttgtcacaacaagcgattgcagcacgtttgagcgaactgttaggctaa

SEQ ID NO: 450 - DNA, 1017 bp, Xenorhabdus bovienii
  Coding DNA location: Contig name=SeqID_16843; Position on contig =41064..42080bp; Strand=-
atggcaaaaaatatcccagctattcgtggcatgaacgattgccttcctgctgaaacggtcatctggcaacgtgttgagtctacggttaagcgtgtgttggcaggctatggtttcagtgaaatcaggacgccgattgtagagcagaccccgttatttaaacgcgcaattggtgaagttaccgatgtggtcgaaaaagaaatgtacacatttgacgaccgcaatggggaaagcctgaccctgcgcccagaaaataccgcaggttgtgtccgcgctggtattcagcatggtctgctgtacaatcaggaacagcgcttgtggtacattgggccaatgttccgctacgaacgcccacaaaaaggccgctcccgtcaattccatcagttgggtgctgaagtttttggcctgcaagggccggatattgacgctgaaatgattttaatgacggctcgctggtggcgtgaactgggcatcgctgaacacgttagacttgaattaaattccattggttcactggacgcccgtgcgaattaccgtgaagctttggtggcgttccttgaacagcataaagagaagctggacgaagactgtcagcgccgtatgtataccaacccgctgcgtgtactggattccaaaaatcctgaaattcaggctcttcttaacgatgcgccggcactgtttgactatcttgataccgaatcaaaagaacattttgatgggttgtgccggattctggatagcgcaggtatcaagtatcacctcaaccagcgtctggttcgtggccttgattattacaatcgtactgtctttgaatgggtaacttctgcattgggtgcacagggaacagtctgtgcgggcggtcgttacgatggcctggttgagcaattaggtgggaaatctacaccagcagtaggctttgcaatgggaatggagcgtatggttctgttagttcaggaagtcaatcctgagttcgttgcagatctggcctgttgcggatgtttatctctcctcctttggtga

SEQ ID NO: 451 - DNA, 1122 bp, Xenorhabdus bovienii
  Coding DNA location: Contig name=SeqID_16843; Position on contig =42201..43322bp; Strand=-
atgcataatgaatcaccgataaaaagacgtaaatccacacgtatttatgtcggtaatgtgcccattggcgatggcgcacctattgcggtgcaatcaatgacgaacacacggacaaatgacgtagaagcgacagtcaggcagattaaatcgctggagcgtgtaggtgttgatatcgtccgtgtttctgttccaaccatggacgctgcggaagcgttcaaatccatcaaacagcaggtcaatattcctctcgttgctgatattcatttcgattaccgtatcgcattgaaagttgcagaatatggcgttgactgcctgcgtattaaccccggaaatattggcaatgaagaacgcatccgtcaggttgtggattgcgctcgtcactacaatattcccattcgtattggggtcaatggtggatcgttggaaaaggatatacaagaaaagtacggagaaccaacaccagaagccttggttgagtcggcaatgcggcatgttgatatacttgatagcttgaactttcatcaattcaaggtgagcgtcaaggcgtcagatgtctttctggctgtcggtgcttaccgtttgctggcacagaaaatcgatcaaccattgcatttgggtattaccgaagcggggggcgctcgcgcaggtgcggtgaaatcctcaattggtctgggtcttctgttgtctgaagggattggtgatacattacgtatttcactggcggctgatccggtagaagaagttaaagtcggttttgatatccttaaggcactacgcattcgctcgcggggcatcaatttcattgcctgcccgacttgctcccgtcaggaatttgacgttatcggcaccgtgaatgcgcttgaacagcgccttgaggacttgattacgccgatggatgtttccattattggctgtgtcgtgaatggtcccggggaagcagaagtttcaacaatcggcgtgactggtgcaaaaaataaaagcggtttttatgaagatggcatccgtcagaaagagcgttttgacaataataatttgattgatcaacttgaagcgaagatccgtgccaaggccacgatccttgatgccagtaaccggattaatgtcaatcagcttgatgaataa

SEQ ID NO: 452 - DNA, 165 bp, Xenorhabdus bovienii
  Coding DNA location: Contig name=SeqID_16843; Position on contig =43244..43408bp; Strand=+
gtgcgccatcgccaatgggcacattaccgacataaatacgtgtggatttacgtctttttatcggtgattcattatgcatttttacattactcccctacatccctgtattttgtttataaaaattacaactatgctgtggtgaataatacacacaggcgaacttga

SEQ ID NO: 453 - DNA, 972 bp, Xenorhabdus bovienii
  Coding DNA location: Contig name=SeqID_16843; Position on contig =43458..44429bp; Strand=-
atgaagactgaaacttacccagaagaagctaatctgacaacgggtcagattctgcgccaggctcgtgaaaaacttgagctttctcagcaaactgtggcagatcgtttgtgtctcaaactgtccactgttcgtgatattgaagaagataatacgcagtcaaatattgccctgacattcttacgtggatatattcgggcttatgcgaaacttgtccgagtccctgaatccgatattttaagcacattaaataaacaaatgcccgctaaggctgggaaagtttccccgatgcaaagcttttcgtcaggaaaaaagcggaaaaaacgtgatggttggttgatgaaaataacgtggggcgtgctcattgtgctgctgggaatgactgggtggtggtggtggcagaattacaccgcgcagcaaaaagacttagcttcaatgacaacacaatctgatgcttataacgcccaggcgcaaggcgatgaaagtgacttgggcacttcaacaacagatctaggtcaactatctgaccatgctaaagatgataactcagtcgcggccgctcaggaagaaacctctccagcgttagcaaatccggcagcaaacagcaatgcatcatcgccgggcaatcaatcggttgtaaattcagtaccagcgacaactaatacagcaccaaattctgctgtgaatacgtcatcggctgatgtgaataatatcagtgcggttaacagtgatgaactggtgatgaattttaaggcaagatgctggttacagatcacggatgccaatggtaagactttgttcatgggcacaaaagataaaggcagcagtctgaaactttcaggtgccttgccttataagctgaaaattggcgcacctgcggcggttgatatccagtttcagggaaaaaccgtggacatgactcgttttgtcaaggtgaaccgtattgcccaactgaaactgccagaaaataattaa

SEQ ID NO: 454 - DNA, 207 bp, Xenorhabdus bovienii
  Coding DNA location: Contig name=SeqID_16843; Position on contig =44429..44635bp; Strand=-
atgctgcttttctctgtgaacaaaagcgggatgaagaggctaaaaaattggtcacgggaaacaacacaagtcactacacttgtgataaatgattttctgcgttcgacgcagtatgaaatgatttcgctgcacaaattaagttggatgttctatcaaattaatttgcgtaaatactttaacctgaacagtaccagtgcccttagctaa

SEQ ID NO: 455 - DNA, 411 bp, Xenorhabdus bovienii
  Coding DNA location: Contig name=SeqID_16843; Position on contig =44544..44954bp; Strand=-
atgatacggaaatcaataatttggtctatagtttgttttggcctgatcacgggttgtgcggaacgttccccgcatcacggtcatcaggtcgtcgcaatagatactcgattacagctagggaaagcctatttagcggagcgaaatttatcggctgccaaatatcattttcaaaaggttttgctggcgaaacctcgccacccagaagcgcatttgggtatggcgctgtatgaatattatgcaggtcaacccaaagctgccgatcagcattatagaatggccatgcagtatgcggcaggaaatgatactgtaatacgtcattatgctgcttttctctgtgaacaaaagcgggatgaagaggctaaaaaattggtcacgggaaacaacacaagtcactacacttgtgataaatga

SEQ ID NO: 456 - DNA, 1179 bp, Xenorhabdus bovienii
  Coding DNA location: Contig name=SeqID_16843; Position on contig =45027..46205bp; Strand=-
atgtcccaacttaacgaaaccgtacaaccttcaactgccgctgtatctgtcactcctgaaaagaaaaacggcaaaatcaatctgcttgatcttaaccgtaaacaaatgcgtcaattttttctcgatatgggagaaaaaccgtttcgtgccgatcaggttatgaaatggatgtaccactattgctatgacgactttgagcagatgaccgatatcaataaagtgctcaggacgaaattgcagcaggtggcagaaatcaaggcacctgaagtggcagaagaacagcgttctgcagatggcaccattaaatgggcaattactgttggtgatcaacaggttgaaacggtttatatcccagaggatgagcgcgcgacattgtgtgtttcatctcaggtcggatgtgctttagagtgtaaattttgttctactgcccagcagggatttaaccgtaatctgcgggtttctgaaattattggtcaagtctggcgtgccgctaaaatcattggctcgctgaaatccagtggtcgccgcccaatcaccaatgtcgttatgatggggatgggagagccattgcttaacttaaacaatgtcgtgccggccatggaaatcatgatggatgatttcggctttgggttgtcgaaacgccgcgtgacgttgtcaacatctggcgtagtgcctgcattggacaaactgggcgatatgattgatgttgcactggcaatttccctgcatgcacctaccgatgatgttcgtgacgaaatcgtaccgattaaccgcaagtacaatatcgaagaatttctggcgggagtgcgtcgctatttggcaaaatccaatgccaatcaagggcgggttacggtggaatatgtgatgcttgatcacgtcaatgacagcgtggaacaggcacatcaattggcggaatgcctgaaagatacaccaagcaaaatcaacttgatcccatggaacccgttcccgggggcaccttatgggcgtagctccaacagccggattgaccgtttttcgaaagtcctgatgggatacggttttacgactattgtgcgtaaaacacgaggggatgatattgatgccgcatgtgggcagcttgctggtgatgttattgatagaacaaaacggacactgaaaaaacgtctggcaggtgaaccaattcaggtaaaaccagtctaa

SEQ ID NO: 457 - DNA, 138 bp, Xenorhabdus bovienii
  Coding DNA location: Contig name=SeqID_16843; Position on contig =46179..46316bp; Strand=+
ttgtacggtttcgttaagttgggacatttttacatcgcctcgttgttacactttcggctctgtgctgatttaatttcagcactaagttttgattcggtgactatcaattcaataaccactatatgcagtgataattga

SEQ ID NO: 458 - DNA, 429 bp, Xenorhabdus bovienii
  Coding DNA location: Contig name=SeqID_16843; Position on contig =46413..46841bp; Strand=-
atgacgattgaacgtactttttccattattaagcctaatgctgtgaagaaagatgctatcggttccatctatgcccgttttgaaagtgcagggtttaaaatcattgcagccaaaatgctgcatttaacacgcgagcaggcggaaggtttttacgctgagcacaaaggccgtcctttctttgatggtctggtagaatttatgacttctggcccaatcgtggtacaggctctggaaggtgaaaatgcggttcagcgtcatcgtgacctgatgggcgctaccaatccggacaatgcactggcaggtactctgcgtgcggattacgcagatagctttactgaaaatgcggttcacggttcagactccattgaatctgcaaaccgtgagattgcttattttttcagtgatgatgaaatcttcccccgccactga

SEQ ID NO: 459 - DNA, 180 bp, Xenorhabdus bovienii
  Coding DNA location: Contig name=SeqID_16843; Position on contig =47097..47276bp; Strand=-
atgcgtaacagagactgttttgtaattggaactgcattaaaacgccgaatcaatgatcttgatcagaatgcctatttgggatttcatcgcctgaataggcattattttatagaattaatcgggcaggatggtacgaattggcagaaagtaagtgatctccaatgttctggattggtgtaa

SEQ ID NO: 460 - DNA, 327 bp, Xenorhabdus bovienii
  Coding DNA location: Contig name=SeqID_16843; Position on contig =47252..47578bp; Strand=-
atgaaaattttttcatattttttattgctggggctattttatattcctgtttcttttgcagatacatcagcaaaaggtgttgataataaaatggagaataaacaatcaggtaatcaaggagcgttgagaaaatgtacacacctattgcctgaaggacataaatataccattagtattattggtacatctgataagacaacaaaagaggtcaataagcagttcaaaggggagtttaaactctctagtggaagtaaaaagccactggataagaaaagaaatgaagagattaaaccttttattcaatgcgtaacagagactgttttgtaa

SEQ ID NO: 461 - DNA, 207 bp, Xenorhabdus bovienii
  Coding DNA location: Contig name=SeqID_16843; Position on contig =47629..47835bp; Strand=-
gtggcaatttatatcactctagatgtgctcatggcaaaacgaaaggttaaatctaaagaattagcacaggccattggtattactgaacaaaacctttctttgctgaaaacgggaaaaattaaaggggttcgattctctactcttgatgccatctgccaatatttagattgtcagcctggggatatattggaattcaaagatgattaa

SEQ ID NO: 462 - DNA, 453 bp, Xenorhabdus bovienii
  Coding DNA location: Contig name=SeqID_16843; Position on contig =47844..48296bp; Strand=-
ggagccaagttaatattagagaaatatgggttaggattttcgttgacaaatagaatattattgcattttagtgagaatactcttagctcgtggaaactgaccagtggaatatttatatcgacaatcccattattgtttttgggagggagtctctgggcttttcatcagttattcggcaattatcggaaaggtgattatttttccaagaatacggtgaaatatttggaatatgcaggttggggggtcatcatctgggctatgttagatattctttttgaacctttattaactgtttggctcactatgggagcgccagcgggtcagcgctttttctcattgagtctaagccctagccatcttgttgctatttttatttcggtttgcctggctgtcatttcgcgtattctttaccaagcatgtgatatatatgacgaaaataagagcattatatag

SEQ ID NO: 463 - DNA, 574 bp, Xenorhabdus bovienii
  Coding DNA location: Contig name=SeqID_16844; Position on contig =3..576bp; Strand=-
atgatctgttcaacagaaaaaattattagcgccctaataaatttttgggaaattagtaatgagccatggggtgctaaagataacaactcaaaatttatatatgctaataataaatacaatgaattactttcactgcccaaaggatacgacgtaggaggatattacgatggtgaacttccttcaacaacatcagattttcaagatgaatttcaaaaacatgatagaaaagtagaatcattattagacagagttacgtctatcgaaattcaccctttcaaaggtctcgattatctgcaaccatggtattttgacaaattcccattaatagacgaatcaggtgaatgcagggggactattttccatggaagaccggtagacactataacacttgaaaagctaaaaaaaataaatatccaaacatccttaattttcacccctccatcagaaatattcagtaaaagggaatgggaaattatattttacataatgcaaggttattcgactaaagacatagcggaaagactgtttgtgtctcatagaacagtttcaaaccacatccagaacgtgtaccaaa

SEQ ID NO: 464 - DNA, 441 bp, Xenorhabdus bovienii
  Coding DNA location: Contig name=SeqID_16844; Position on contig =976..1416bp; Strand=+
atgacaacagaaaccatcgatcattcaaccttgcaccgtctggttgaagccggcgctgtccgcgcagcacacgttattgggacttccggcggctgggcgttaacggttaaatatggtctgactgaacgccttttggctgcacaacgcagcaggcaggtacggttgtttaaaaaattggaaacactggtcggttacctgaaagacatcggtattgcgcaattcgatgttgatgcgtccaactattccccagaaaaccagccccggcaaactcgaccagatcggtcggcagcactgaaacgcgcacatgaggcagtttcttatgatgattggttcagggaacaggtacaaacatccatcgacgatccgcgaccggcagtttcgcatgaggaggccaaacatcactttgccgcccggaaagacgctctgcgtaaggagtcgtga

SEQ ID NO: 465 - DNA, 282 bp, Xenorhabdus bovienii
  Coding DNA location: Contig name=SeqID_16844; Position on contig =1416..1697bp; Strand=+
atgcgtctggaatggaaacccatggctctgactgaccgggaaaatattatggactatatcgcccgtgataacccagcggctgcgattgccttggatgatgagtttgaggcggcggcagagcgggcgtgtactgagcctgagatgtataaacccggtcggctgaaaggcacgagagaagtcgtggtcaaaccccgttacatactgatatatcaggtagagggggaggtactggaggttttacgtatacttcatgccgctcaacaatggccacctactgagtga

SEQ ID NO: 466 - DNA, 156 bp, Xenorhabdus bovienii
  Coding DNA location: Contig name=SeqID_16844; Position on contig =1694..1849bp; Strand=+
gtgacggaattttcggcggttccgacgtacaatcccttgatggacgaaaaagatattcaagcctacctaagcgcagctaaaaatgaaaatgatcctgaatacttattaacagcattaaataatgccaagaaggctcaagaatcacataatcaataa

SEQ ID NO: 467 - DNA, 846 bp, Xenorhabdus bovienii
  Coding DNA location: Contig name=SeqID_16844; Position on contig =1950..2795bp; Strand=-
atgacatcgaaagttggtttaggatgggtttcttccaatacacctcaagatgttattgattctattaaaaataaagaatatgaaaaaaacacaaagaatataaatacatttttatctgagactgattttaaacaactatctgttttcctttttcagaaatacagcacattaaaaacaagtgacgtacatagaatattatcgaaaaaggaagatatgataaaaatatcagagctaactgaatttataccgaaaagtaattggcaacgttatttttaccaagatttcaaaactgatgctgatgttcacaagaatagagatgatgctcaagagaaaatagaggattcttggaatcgtttatcagacttaaggaataaagttgctcacaatagatttatctcctttgaagaaatgagaatgattaaatctaagagtgaagaaattaataatgttattgatgatgcattgaataaacttgattctgtcgaggtaacaaaagctcaaattaatgaaattaaacaagaacttaatgacacaatcaaagaggaggcaacccccttagctaataagaagatgacagaaacgcctacggaagttggtgctatttacaaggttgatcagcatcctgtggctagggctgaatcctgcatcaggaaattaactaaacatatgtatatggagcttgcaaagcctttcaaagatgaactaagaaaacatagagccaagcttaacactgcattagaaagctacaaaagagaccctaataatcagcttaatttaaatctgttagagctagagttcgatcgagctgatgaatatctttcgactgttcggaagtttacccaataa

SEQ ID NO: 468 - DNA, 447 bp, Xenorhabdus bovienii
  Coding DNA location: Contig name=SeqID_16844; Position on contig =3048..3494bp; Strand=-
atgagcagtgggatttatacatcagagtatcttttgattctctctgaagatattgaaataattgaatcagaagaagatttagttaagtcgttggaattaaacaaaaaatatacattcaaaaaaatcgagaacaacacaattatcattcataaagatatggagttcgatctttttataaaaaaaataaaagctaaaaaccagagcgatagaaattttctaattacgttaagtaataaatcggcaataacaaattatgttgataaatcgattgttaacagcatgaatcaagaattcataaaaattattagtagtagttttaaccattctcgattagataaacttagggatgatttatcaggggttttccgccggaaccgccggaaattccgatgccatgaatctgacgtttttttatacatgtttcgcattattaggatgtacgattaa

SEQ ID NO: 469 - DNA, 690 bp, Xenorhabdus bovienii
  Coding DNA location: Contig name=SeqID_16844; Position on contig =4727..5416bp; Strand=+
atgagtcatcttgttgcttacaaatccaatgcactgatagaagcgagttataagctaacattgcaggagcaaagagttttattgatgtgtataggaaagctcaatccgcaagatgaagtaccagagaaaacttttaaattaactgctaatgagttttatctcgctttccctgacatgggaagagaaaacgcagaacggcgcttacaagaagcaatagatcgtctatgggatagaactatattaattactagaaaagatgaaaaacgtgaaataagatgggttcaagaaaaagctaaatattttagcggagagggtacaagtgaaatagttttcgcagactctattatgccttaccttacccagttaaaaggacaatttacaaagatagctatcaaaaatgtagctgctttgaaaagaacatacagcatccgaatttatgaattacttcaacaatttaaacaaactggcgatagagttatttttttagaagatttccgttctatgttgggactagaagataaatacaaaacatttaagtcattaaatcaactggtattaataccagccataaaagaactgaacgaaaagagtgatttaattgtttctgtagatacagtaaagaaagggcgtactgtaatagcccttcactttagattcaaagaagacaaacaaataaaaatggcgatttaa

SEQ ID NO: 470 - DNA, 480 bp, Xenorhabdus bovienii
  Coding DNA location: Contig name=SeqID_16844; Position on contig =5559..6038bp; Strand=+
atgtcatatatgatttatttaactttaaacggcaagaagcaaggtttaatctccgcagggtgttcaacgcttgattctatagggaatcggtatcaaaaagggcacgaagatcaaatacaggtactcagcctgaatcatgcaatttcacgccagcagaacgtgagtcaccagccagtacagttcatcaaaccaattgacaagtcatcaccactactagcaatggcaatagactccaatgaatcactgaatggcggttttattttttatagaacaagccaagcagggcaattagaattattctatgaagtaaaaattacggaagctactatcacagatatttcctgtgtatacccacattctataaatgatcatgatatgatgccatatgaaaaagttacattaaactataaatctatatcatggaatcatataacggcaggtacatctgcctatagtatatgggaagacagagttttctaa

SEQ ID NO: 471 - DNA, 903 bp, Xenorhabdus bovienii
  Coding DNA location: Contig name=SeqID_16844; Position on contig =6497..7399bp; Strand=-
atggggtgtcaaatgagtagaaatgaatttgaaagagcatttatggatggttctattggttttgaaaatggaacattagtacctttaagtgatagcaaattaataagagaaaaaagatattctgaacttcaaaatgaacttcaaaaaaatttaaatgacaatgaagatctttatgtttttttaacgtttgaagaagctatatattttgtaacaaatatatgtgggccaaaccctaattcatcatggaaagaagctggttatttatgtatggatattgttacatcatttacaggtaatattattgatgctaaaggtttttataaattgtcaaaagaactcagtagtaattttggagttaaagttactgagtttgttgatagatacggtaatagaagcataaagttaaccggatcaacaggtgttagaaaatttttaaccgctgctaaatataaagtgaataattggaaaataatagatatgggtataggaacacaagggatgaaaaatggcctcatcgatggaactaggaaagttgtttttgtcgcagcgggttatcgattattagaacttgcgtttagagatgagtatgatatttataatttctatggaaatataaccatggatgcggcaaaaacagccgctggattattggctggagttgtagttacagctgctgctggaatgtttttagctgcgggtacttatgcacttgctgtagctgccacggcaattgtggctagtattttggttgggtctctattatattatattgataataaatatgggttaagtaaagcgctgatagaccatttgcgtaaaatggatgaattggaagctaagtatccgagaccatgtgtgcaaccatttggtttcccttgtcaggaaataaaattaaaatggtaa

SEQ ID NO: 472 - DNA, 231 bp, Xenorhabdus bovienii
  Coding DNA location: Contig name=SeqID_16844; Position on contig =7631..7861bp; Strand=-
atggtcgctgattcggcgtggtttttggaactaacacggcaaacccataaacgccgatttgttgctactggcggtgcattgaaagatgttttgaaactggaacaggaatcagaccaggatatgattattggtgatgatgtttcagagggtgacgatgatggttctcgtcttgcttttggttgggattcattgcctaaaaaatataagcgaataccagaaagagataaatag

SEQ ID NO: 473 - DNA, 546 bp, Xenorhabdus bovienii
  Coding DNA location: Contig name=SeqID_16844; Position on contig =8378..8923bp; Strand=+
atgcaagcccgctatattttaaatgcgggccgctacacctatcactacaagattgaagaagccgcctttgaaacaacagatcatctttataaccaaatcaaaggcggtagtgtctcatttaaagagaaaacgtataaaaaagtaggtcggagtcggaaaaagatagcctcttatactctgcaggccaatgatgaaaaaaaggcttggtttgatgcggtgaatgcaaaaacagcccgtttacgtcaagaggctgactttcccattcgcccctcattcaaaatcgaaatgctggattggtgccgctgtgtctctatcgtggcaccgattgagatccgcaatgttgaagagcttcacaaactggttgatttggttcgccgtctcctgcaaagggaaacaacgttagacaaggagttccttgattatacgtacggcaaggcacaatggattgcagaaggcctgacggaaagtcaaaccaactctatagggttcctccggtccccctatttaaacgctaaaagccctgactgtacaaatcagggcttttag

SEQ ID NO: 474 - DNA, 252 bp, Xenorhabdus bovienii
  Coding DNA location: Contig name=SeqID_16844; Position on contig =9159..9410bp; Strand=+
atggccttactttcgttgcgttttttttacaatatttctttaacgaaacgcaacatcaataaactaaaaaatcagggcattatatcatcgcgttatcgtacacaccctgcgattgtagatactgactacatagccttaaagcattatcgagcgagtttgttacttatactcaactgcgattaccccatacaaaaacacttcgtagcctttatcgcaaaaacactgaacaacttattaaaaacacgtgcttaa

SEQ ID NO: 475 - DNA, 141 bp, Xenorhabdus bovienii
  Coding DNA location: Contig name=SeqID_16844; Position on contig =9881..10021bp; Strand=+
atgtcgcattttacatgcagcgcatctaaaataggttccctggtattggataatttatatttgtatattgcacaatggctttattatgattatttttatgtagaaaataattttaattatgtattattctggctgttgtga

SEQ ID NO: 476 - DNA, 387 bp, Xenorhabdus bovienii
  Coding DNA location: Contig name=SeqID_16844; Position on contig =10064..10450bp; Strand=+
atgattgatttcgcaaaattttctacagacggtgccaccaaagatgactcagtcggcatttctataaaacgtattatagaaaaagatggactgaatgcttatgcaacatttataagtgcgggaaagaaagtgggatgtcatagtcatagccaaggagatgaatggtatattatactttccggtgatggtgaaatatggacaggggatgtggtagataatgaaattattaatataaaaaaagaaaaattttcaaaaggctgtattttttgtattcatcaaaatacagcacatcaactggcatctcataacgatgttgaactgatatttttatgcccgaaatctcatttgtctcatgatagagtgggttttgaggatatctgtaaataa

SEQ ID NO: 477 - DNA, 690 bp, Xenorhabdus bovienii
  Coding DNA location: Contig name=SeqID_16844; Position on contig =10451..11140bp; Strand=-
atgatctgttcaacagaaaaaattattagcgccctaataaatttttgggaaattagtaatgagccatggggtgctaaagataacaactcaaaatttatatatgctaataataaatacaatgaattactttcactgcccaaaggatacgacgtaggaggatattacgatggtgaacttccttcaacaacatcagattttcaagatgaatttcaaaaacatgatagaaaagtagaatcattattagacagagttacgtctatcgaaattcaccctttcaaaggtctcgattatctgcaaccatggtattttgacaaattcccattaatagacgaatcaggtgaatgcagggggactattttccatggaagaccggtagacactataacacttgaaaagctaaaaaaaataaatatccaaacatccttaattttcacccctccatcagaaatattcagtaaaagggaatgggaaattatattttacataatgcaaggttattcgactaaagacatagcggaaagactgtttgtgtctcatagaacagtttcaaaccacatccagaacgtgtaccaaaaaaccgaaacaaattgcagaaagagcctcgttgattactgttatgagcataatatagctaactatgtccctgaaaattttttcagggaaccgaagtccattcactttaatgaatag

SEQ ID NO: 478 - DNA, 255 bp, Xenorhabdus bovienii
  Coding DNA location: Contig name=SeqID_16845; Position on contig =2..256bp; Strand=+
atgattaagtgtcctctgtgtggtcagtcagcgcatactcgtagcagcttcgagcactcaagccagacaaaggagcgttataaccaatgtcagaacatcaactgtggagcaacgttcgtcagtcatgaaacgtttgtgcgttttattgctaagccaggtgacgtcgagaatgtcacgccacatccaagggcgaaaacgaagagacaacctcgtcagaaagctgctgcgccatgtcagaaagctgacgtacaataa

SEQ ID NO: 479 - DNA, 312 bp, Xenorhabdus bovienii
  Coding DNA location: Contig name=SeqID_16845; Position on contig =174..485bp; Strand=-
atgagatgcaaaggatcttacaggcagagtcccaaaaataaccctgtcatagactttgacgcctgcttctctgacaagcaggcgttacatgaggattgtcatttcactcgccgttctctggcctcaatgccgtttaaggttctctattcgagaacaaaacacagtccattatccataaaaaagccaccattacggtggcaaaaactggaacaatgtcctttttcattatttattgtacgtcagctttctgacatggcgcagcagctttctgacgaggttgtctcttcgttttcgcccttggatgtggcgtga

SEQ ID NO: 480 - DNA, 219 bp, Xenorhabdus bovienii
  Coding DNA location: Contig name=SeqID_16845; Position on contig =445..663bp; Strand=-
atgtttccagaatatcgtgatttagtgtccagtctgaaagaatctaatccccgtttccaatccctgtttgaaaaacataaccgacttaaccacgagatatcacatcttgaaggcccaaatggaaccggctatagcgataaagttgtgcgcctgaaaaaagaaaaactacacatcaaggatgagatgcaaaggatcttacaggcagagtcccaaaaataa

SEQ ID NO: 481 - DNA, 99 bp, Xenorhabdus bovienii
  Coding DNA location: Contig name=SeqID_16845; Position on contig =826..924bp; Strand=-
ttgatatatttaacaacggaattgaatcataacatgtacaacgataggaataagttatgcttttttggcaagggactgatttttaccactattatttaa

SEQ ID NO: 482 - DNA, 483 bp, Xenorhabdus bovienii
  Coding DNA location: Contig name=SeqID_16845; Position on contig =935..1417bp; Strand=+
atgaaaaagtatctacttcctttagccgctatgatggtttcggtttctacttttgctcaggctgataagaaacttgaagatgtcgctccttatcctaaagcttcagagggaatggtacgcaatgtcattgaccttgcaccagaagaggatgaaggcgattacatggttgaactgatgattggcaaggatataaaagtagactgtaatcatcactggtttggtgggcaacttgaaacaaaaaccttggaggggtggggatacgattattatgtattgaataatgtcaccggcccagcgtcaacccacatgggttgttcaggacaaaaagaaaccgtgagctttgttcaagtgcagttaggcaaagatgcgcttatacgctataacagcaaattacctatcgtggtatatacgccaaaatcaatgacagtcaaatatcgtatttggcaggcattggatgatgtcgataatgcagtaatcaaataa

SEQ ID NO: 483 - DNA, 147 bp, Xenorhabdus bovienii
  Coding DNA location: Contig name=SeqID_16845; Position on contig =1435..1581bp; Strand=-
atgaaaggtttaaaaccacggtctttagacggtgactttgactttaattctttgacctatgcgcgtttacgaggtgcgtggttcgacgactttcagtcgtcggcaccgaagtgcgctaacccacctacttcagtaggtggtagttaa

SEQ ID NO: 484 - DNA, 108 bp, Xenorhabdus bovienii
  Coding DNA location: Contig name=SeqID_16845; Position on contig =1782..1889bp; Strand=-
ttgaacattctacgattcctcaatgatatttgcatgaatgcaaaagaatccaaacaaagtttagttagtatttttaaatatatgcaaggaaccgcaggcagaaaataa

SEQ ID NO: 485 - DNA, 720 bp, Xenorhabdus bovienii
  Coding DNA location: Contig name=SeqID_16845; Position on contig =1855..2574bp; Strand=+
atgcaaatatcattgaggaatcgtagaatgttcaaaaaattatcggcagagtttttgggtactttttggttggtgtttggcggatgtggcagtgctgttttagcggctgcattcccacagttggggattggttttgtgggggtatctctggcttttggtttaacggtcgtgacgatggcctatgccgtagggcatatttcaggagggcactttaatccggctgtcacattggggttatttgttgggggacgtattgcagcaaaagaagttattccttatatcattgctcaagtgattgggggaattgctgctgcagccgtactttatcttattgccagcggtaaaagtggttttgatgcaacggcaagtggtttcgcatccaatggttatggtgaacattctcccggcggtttttcattacaggctgccattatcattgagttggtattaaccgcatttttcctgattgtgatcctcggtacaaccgataaaaatgcatcagtagggtttgcgccactggccattggtttggcattaacacttatccatttaatcagtatccctgtgacaaatacgtcggttaacccggcaagaagtacggcagttgctgtttttcaaggcacatgggcgttggatcaactttggctgttctggctgatcccattaattggtggtgctatcggtggcttgatataccgtacgttattacagaaagattga

SEQ ID NO: 486 - DNA, 330 bp, Xenorhabdus bovienii
  Coding DNA location: Contig name=SeqID_16845; Position on contig =2478..2807bp; Strand=+
atgggcgttggatcaactttggctgttctggctgatcccattaattggtggtgctatcggtggcttgatataccgtacgttattacagaaagattgatatcttgtcattttgaacagccatgcgattgcgtggctttttttatcatatttatggtaaatttttctacggttgacgcttttttaaaaggaaaaatgatggagcaaaatataacgtgggaacaaggtgaatactgggtcaccacggataaaacgaaacctcttcggtgggtgggctttatgaaaaattcggttttgagcctgtcagggtgcaggattttgtttggacgttag

SEQ ID NO: 487 - DNA, 243 bp, Xenorhabdus bovienii
  Coding DNA location: Contig name=SeqID_16845; Position on contig =2778..3020bp; Strand=-
gtgatatctcaacttttgattctgcaagaagtcaatacggatccgataaaaatcttcattaacagtcaaggtggacacgttgaagccggcgatacactacatgacatgatcaaatttattaaaccggaggtcataatgattggcactggttgggttgccagtgccggcatcaccattattgccgtttcatttactcagacgctttcgttttctctaacgtccaaacaaaatcctgcaccctga

SEQ ID NO: 488 - DNA, 105 bp, Xenorhabdus bovienii
  Coding DNA location: Contig name=SeqID_16845; Position on contig =3060..3164bp; Strand=+
atggaacgtgatttaaggggtttattctttagagtggggattattgcgttattttcttctgttaattcaggatattcgctatgcatcatttctattctcatgtaa

SEQ ID NO: 489 - DNA, 93 bp, Xenorhabdus bovienii
  Coding DNA location: Contig name=SeqID_16845; Position on contig =3140..3232bp; Strand=+
atgcatcatttctattctcatgtaataaacaatattaatggtataaataatatagctcttaaaaacgtttttatgttgaaaaaatgtatttaa

SEQ ID NO: 490 - DNA, 1008 bp, Xenorhabdus bovienii
  Coding DNA location: Contig name=SeqID_16845; Position on contig =3787..4794bp; Strand=+
atggaacatcttgacgtagaaaaggtgtcgagcaaaattttacatgaattgttgcaatatagacgccgtttctcagaatctgaacatacgattgaatatgaagaacagaaagtctctgaagttcagctaccacgcattcgtgcgtttgttgaacagggcaaagctgttgaatgtattcttcctgcgtttccgacaaaatcgccaaacccccgcaaagtactgggtacgatgcctgatatggcagaaaaattatcactgatttttctgaattctctgtgtcagcgcattcaactttattatccaccaggtgcaaatattgttatttgttctgatgggcatgtattcagtgatcttatccatgtcgacgatgaaaccattacccattatcaattggaaattgaaaagttgctgcatgaactgggtgcaaccaatctttcagtttttaatctcggcaatgttgaatcactaacccaatataccagcaattatgatcaactgcgtgaattgctggtgaatggctatgcttcttcggtagaagaaattaaggccacgcttaaagagagtgaagaagggcttcagctctatcgggcgatcactcgttttctctatgaagatagtctgttgccgggatatgacggctcgaaaacagccttgcagaaagatgcgcgtcagcgagcggctggcgttatccagcgtagttgggcgtggggaaatctgctggctgaacagtttccactggctattcgcctttctatccatccgcagcccgttgacagtattaaaatcggtattcatatgatgcctacccgggatgattggcttactccgtggcatggtgtcgcagccaatattaacggtcaatttgtgctgatgaaaagtgatgaagtgaaaaagatgcaggggaaattggtcgagatccgtggtgtccccagccattacatgattgaagccgtatctcagcaaaatcagcaggcagcaccattggctgtcgcttcgcaggaacagtaa

SEQ ID NO: 491 - DNA, 900 bp, Xenorhabdus bovienii
  Coding DNA location: Contig name=SeqID_16845; Position on contig =4848..5747bp; Strand=+
atgaatatagatgaactggattgtcgtattgaaccgaacatgccttttgggcttctgattacgcccaatacctctgagcaggacatcactgcgctgtctgttgataccctgcgcgagctggcacgtacccacaagctggttgtattacgtggcttttcttctggttttacggatccggaaaagttgacggaatacactagccgttggggagaaataatgatgtggccgtttggcgccatattggatgtcatggagcgccctgatccttcagaccatgttttggacagcacccatgtgccattacattgggatggcatgtataagccgacaattccggagtttcagatatttcactgcgtctctgcacctgaggcaagtcaaggagggcggaccacgtttgttgatactgagcaattgattgttgatgccagtgatgatgagcgtcatgagtggaaaaacaccatgataacttaccgtacaagcagagtgacgcattatggtggagaggtggtttcaccgctgatttgtcttcatccagatggtaaaaaatgggtgatgcgttacaacgaacccatgacaggaaaagacgataaatatgctgaccatcatttgttgacgatccatgggttgtcaattgaacagcaaaaagaatttgaaagaaatctgcatggcagattgtatgacccgcgttatttctatgctcatcaatggcagtccggtgatttagtcattagtgataattttactttgctgcatggtagggaagcgtttattactcattctccccgacatctccagcgggtacatgttcatggaacaccagtttgtgagaatctcagtttccggactatttccaattcagattctggtgtagctgaagttgagttgaaggaggtttga

SEQ ID NO: 492 - DNA, 1281 bp, Xenorhabdus bovienii
  Coding DNA location: Contig name=SeqID_16845; Position on contig =5751..7031bp; Strand=+
atggctcgtattgttttggctgcgattgcaactccaggtcatgtttttcccatttgttccattgccaagcatttgatagggcaggggcacgaagcgacaatattcactggctctatttttcggcagcaggcggaagcgttaggagcaagtttcgtcgcctttgatcagcaggtcgatgttgattaccgtaatctggaagagaaatttcctgagagagggcagcatcctcccggaaatcatcagatgacacatgcccttaagcaattttttgctggccctatacccgtgctgtatcgtcagttggaacagttagttgaaggtgctgatttgctgattgtggacaatacgttctatgcggtactgccactgttacagaaacctgcccatgatcgtattcctgttattgcgattggggtgacaccgttgtcatggtcgactcgggataccatcttctggggaccgcgtattcctcctgaattgttgcctgctgatttgatgcgtgagcaattggtggatgaggaaacgggtcagttgattggacaggtacgggatgcattcaacacagcactgttggaagtggcatctcctcctctgacacaagatcacaatgatgtcgttctgagtcgagccgaccgtttcctgcaattggcaaccaaatcgtttgaatttcctcgtgatgatttaccggaaacggtggattttatcggtgcgctgggtgtcgaagtgcaggatgataaaacccagttggagtggtcagatgaaaacctgccgcttgtcttagtcacacagggaacgctggcgaatgttgatctcagccaattgctgttacctaccttgcgtgcattggcgacgctgccagtgcgtgtgctggcaattacggcgggaaggccagtcgaaacgttgggtgaagagatccctgacaatgccagagtggtggaataccttaactttgaacactggcttcctcgttcagcaattttcattaccaatggtgggtatggttctcttaatgcggccattcgtcacggtgtgccgctggtggttgctggtacgggagatggtaagttggaggctgtcgcccgtgttatctggtcacgatgcggtattagtctgaatacggatacaccgagtgaaaaacagttatatcaagcggtgactcggatactttcttctcctgaatggcattatcagtcacagagaatcaaggcagattatgatgctcataatgccttggaatcgatcactcgtcatgttaatgagttgattgctgaatcagcttga

SEQ ID NO: 493 - DNA, 138 bp, Xenorhabdus bovienii
  Coding DNA location: Contig name=SeqID_16845; Position on contig =7064..7201bp; Strand=+
atggatttcgagttgcagcgcgacggaatcctcggaagcatagctaactatgtgaccggggtgagtgagcgtagccaacaaagcggcaacttgaaagacggaggctatttaaaccgtcacgaacatctccatgtctaa

SEQ ID NO: 494 - DNA, 582 bp, Xenorhabdus bovienii
  Coding DNA location: Contig name=SeqID_16845; Position on contig =7272..7853bp; Strand=-
atgttaaaaaagatgctaattggcctgaccgcaggcgctttattaatgagtacaggctctgcaatagccgctaactataaaatcgatacgattggccaacacgcctttattgaatttcgtatccaacatttgggtatgagctggctttacggtagcttcagaaaatttgacggagattttgctttcgatccgcaaaacccagcaacagacaaagttaatgtcgttattaagacgagtagcgtagacaccaaccatgccgagcgcgataaacacctgcgcaagcctaattttttaaacacggaaaaatatccagaagccaaatttacttcaactgagatcagccaaaagggagagaaatacacagttatcggtgatctaacattaaatggtgtcaccaaacccgtgacgctgaatgccaaattaatgggagaaggtaaagatccgtgggggggataccgtacgggttttgaagctaatggtaaaattaaactgaaggattttgatattaaggctaatttagggccaaaatctcaggaagttgaattggttatttccgttgaaggtgtacgggaaaaggcctga

SEQ ID NO: 495 - DNA, 552 bp, Xenorhabdus bovienii
  Coding DNA location: Contig name=SeqID_16845; Position on contig =7880..8431bp; Strand=-
atgcttttaaaaaatacttccacgcgctttggtcatgtttctgttttaatccactggttagttgcactcgctgtttacggtatgtttgcacttggattatggatggtgacattaagctattacgatacttggtatcatcaggcaccagaactccataaaagtattgggagtttaattttttttgtcatggttattcgtattatctggcggtttatttctccgccaccaaaacctctgaccagttacagtcatttgacgcgaatcagttccaaactggttcatttcacgctctatctggctctgtttggcattttaggcagcggatatcttatttctacggctgacgggcaacctatcagtgtttttggatggtttgatatccctgccacgctgtcagaacagggcgtacaagcagataccgctggcattatccacctttatctcgcttgggttgttgtagtgctctccctgctgcacacacttgctgcattgaagcatcattttattgaccgcgatagtaccttaaaaagaatatttggcttcaaaccctga

SEQ ID NO: 496 - DNA, 114 bp, Xenorhabdus bovienii
  Coding DNA location: Contig name=SeqID_16845; Position on contig =8477..8590bp; Strand=+
atgagaaagtttaggtatcatagtagattaaaatgctatttgatttttacaaattttcgacaaataatttgtttaagaatgtcagattttatcaataatagaatcatattatga

SEQ ID NO: 497 - DNA, 132 bp, Xenorhabdus bovienii
  Coding DNA location: Contig name=SeqID_16845; Position on contig =8924..9055bp; Strand=-
ttggctatccacaatgtgtacatcgtatttcccgctatagtgatcaaagagtgtgactacgcaaaaacattacaatctcttgccctaagagtaaacaatggcatacagggaaacgctttttatttttcttaa

SEQ ID NO: 498 - DNA, 630 bp, Xenorhabdus bovienii
  Coding DNA location: Contig name=SeqID_16845; Position on contig =9033..9662bp; Strand=+
atgtacacattgtggatagccaataaaaattattcttcttggtcactgcgtccgtggattttgctgaaggcgctggagatcacatttaacgagcagctcagttattttgaagatgataaaagtagttatgaaaaattcaaaacattctcacccactgggcttgttccttgtctggtagagggtgaaattaccgtttgggattcattggctattgttgaataccttgcagaaaaccacactcaggtttggccacaagatcgcatcgccaaagcgtgggcaagaagtgcttcggcagaaatgcattctggttttgccacattgcgccaaacttgcgcgatgaattgttcaaaacagtttgaatttagggaaatttcccttgaattacagtgtgatattgaccgccttgatgctctttggtcagacgggttaacgaaatttggcggcgaatggctggctggaaatacattcactgcggttgatgcgtttttcgctccagtggctttccgtgctcagacctatgggctgaaattttctgctattagtcaggcatgggttgatcgtatgcttaagcatccggcaatggtggaatgggctgaggcggcagcaaaagagcctgaaatagagcattaa

SEQ ID NO: 499 - DNA, 111 bp, Xenorhabdus bovienii
  Coding DNA location: Contig name=SeqID_16845; Position on contig =9761..9871bp; Strand=-
atgcacctgtactacctactacattttcccagctacttttacccatttccgctccgtatcaatacggagcttttttttgtccatattaggtggttaataaaattaaaataa

SEQ ID NO: 500 - DNA, 111 bp, Xenorhabdus bovienii
  Coding DNA location: Contig name=SeqID_16845; Position on contig =9972..10082bp; Strand=+
ttgagagaatacctggtatggcccattaacaatgaatttttatcaaacaagtcataccaaatatcagtttttgtcattgagtcataccctatatttttttattggctgtga

SEQ ID NO: 501 - DNA, 1911 bp, Xenorhabdus bovienii
  Coding DNA location: Contig name=SeqID_16845; Position on contig =10060..11970bp; Strand=-
atgtcattccaaaatttttatcagcattcgattgataatcccgatgccttttgggcagaccaggctcggcgaatacattggcaacatccttttgcacaggtattggatcacagtaacccaccttttgcccgctggttcagcggtgggcaaaccaatctatgctacaacgcgctggatcgctggctggaaatccaacccgatgccaaggcgttgattgccatttcaaccgaaaccaatagcgaaaaagttttcacctataaagaattacatcaggaagtcaaccgagccgctgccatgatgctctcgctgggggtaaaaaaaggcgatcgcgtggtggtttacatgccaatggtggcagaagcgctgttcgtcctgctcgcctgcgcccgtatcggagcgattcattcggtcgtgtttgggggctttgcttcccacagtctcgccacacgactggataacgcagagccggtgttggtcgtctctgcagatgcgggatcacgcgggggcaaaattattccttataaacccctgctggacgaagctattgagctagcgaaacacacaccacgccatgttttgatggtgaaccgcggtttggccacaataaattggctggaaggacgggatatcgatttcgacagcctgcggcaaacgcactttgatgcagacattcctgtcacatggatggaatccaatgaaacctcctgtgtgctatatacatcgggcacaacggggacgcccaaaggcgtacagcgtgatgtcggtggctatgcagtagcactggcgacctcgatggatgccatttttggcggcaaagcaggcggcgttttcttttgcacatcggatatcggctgggtggttggccactcttacattgtctatgctccacttatcgcaggcatggcaaccatcatgtatgaagggctgccgatccgccctgatgcgagtatctggtggcagatcgtggaaaaatatcgcgtcacccgaatgttttctgcgccaaccgcaatccgtgttctgaaaaaatatcccacagattgtattgcaaaatacgatatttcatcacttgaggcattatatttagcaggtgagccgcttgatgaacataccgcccgctgggttgcggaaaccatcaacgttccggtcattgataattattggcagaccgaaaccggctggccgattatggcgattgcgcgtgggttggatgaccggccgagtcgttttggcagccccggttttccaatgtacggcttcaacgtcaaactgatcaacgaactaactggtcaggaatgtggcgataacgaaaaaggaatgttggtagccaaaggccccctgcctcccggttgtattcagaccatctatggcgatgatactcgttttgtaaatacttactggaagcattttgcccagcagatttattctacgttcgactggggcatccgtgacagcgacggttactattttattctggggcgttcggacgatgtgattaatatctcagggcatcgcttaggcacacgggaaatcgaagagtgcatcgccagccatgaagacgtggcagaagtagccgtgattggcatcaaagatgaagtaaaaggacaagccgctgttgcctttgcggtactcaaggaagggcgggaaatccagagtgctgaccctttcgcagcgctggaaaaagcactgatggagctggtcgataaacagctcggcagtgtcgggcgcccggcgcgggtctattttgttgcccagcttcccaaaacccgctcagggaaaatgctgcgacgcaccatgcaggcgatttgtgaaggacgggagccgaacgacattgcgttaattgagaaccctgcctcgctggaggtgatccgagatgccgtttctcatcaggtcacagccaataaaaaaatatag

SEQ ID NO: 502 - DNA, 1452 bp, Xenorhabdus bovienii
  Coding DNA location: Contig name=SeqID_16845; Position on contig =12038..13489bp; Strand=-
atgtctacctctgttgtcaacaaccgccctgattacgatcaagtgattgtggatattgtggattatgtcatggactacaccataacatccccagttgcctacgaaacagcccattactgttttctggataccctgggctgtgggctggaagcactggaatatcccgcctgcaaaaaattattggggccggttgtaccgggtaccgtggttccgaacggtgcgcgtgtaccgggaactcagttccaactcgatcctgttcaggccgcctttaatattggcaccctgatccgttggctggatttcaacgatacttggctggcggcagaatgggggcatccatcggacaaccttgggggcattcttgccatcgcagactggctgtcccgaacggcggtcgctaatggaaaacagcccctgaccattaaagatgtgctgaccggcatgatcaaagcgcatgaaattcaaggctgtctggcattggaaaatgcgttcaataaagtcggtctggatcatgtggtgttggttaaagtcgcttcgacagcggttgttgcccagatgttaggtttagcgcgtgaagaaatactgagtgccgtttcgctcgcttgggtagacgggcaatccctgagaacctatcgccatacccctaacacgggttcccgcaaatcctgggctgccggtgatgccacttcccgtgccgtgcgactggcgctgatggcgcaaaaaggcgagatgggatatccctcagtattaacggcaaaaacgtggggattttatgatgtcctgttcaatgggcaaccgttcaaatttcaacgtccttatggcgcgtatgtgatggaaaacgtgctgttcaaaatcgctttcccggccgaattccactcacaaacggccgtagaagcggccatgactctgcaccagcaattgaaaatggcaggtaagcaggtcgaagacattgcccaaatcactatccgtacccacgaagcctgtatccggattattgataaacagggcccgttgaataatccggcagacagagatcactgcatacaatacatggttgccattccattattgtttggccgtctgacagcggccgattatgagaataatgtggccgccgatccacgcattgatgctttgcgggaaaaaataagatgtgtcgaagatcccgattttacccgtgattaccatgaccctgagaaacgttcgattgccaacgctctgaccatcacatttaacgatgacagccagcttgacgaagtgaaagtcgagttcccaattggacatgcgcgccgccgcaaagacggcatcccattgctactgaaaaaattcagtaccaacctagcgcggcaatttcctgaaactcagcaacgaaaaatcctgtcggtttcccttgaccgcaccttattggaaaacatgcccgtaaacgaatatctcgatttatacgttatctaa

SEQ ID NO: 503 - DNA, 1176 bp, Xenorhabdus bovienii
  Coding DNA location: Contig name=SeqID_16845; Position on contig =13551..14726bp; Strand=-
atgagtaaacagaatacgatgactggatctcctgaagctgcaacatttaaaccgaaaaaatccgttgccctgtccggcatgattgccggtaatacagcgctctgtaccgttggaaaaaacggcagcgatttacattaccgcggctatgatattctcgatttagccgcctattgtgagttcgaagaaattgcttatctgctcgtccatgaaaaactcccttcccgcgcagaactggccgcttacaaaaccaaactgaaagcttttcgtggtctgccaagcagcgtcaaatcagcactggaaactttgcctgcggtcgctcatccgatggatgtgatgcgcacgggcgtttctgtctttggttgtaccttgccggaaaaagaagatcataaccttaccggcgcccgcgatattgcagatcgtttgctggcatccctcggctctatcctgctttattggtatcactacagccataacggacgcaggattgacgttgagaccgatgatgattccatcggcgggcatttcctgcatctcttgcatggccaaaaaccgcgtgattcatgggaaaaggcaatgcatagctctctgatcctgtatgccgaacatgaattcaatgcttcgacatttaccagccgagtgattgccggcacaggatcagatacatactccgctattatcggtggaattggcgccctgcgcgggtcaaaacatggcggtgccaatgaagtttcattcgaaatccagcagcgttatgactctcccgacaaagccgaagccgatatccttacccggctggaaagaaaagaagtcattattggctttggtcatccggtttataccgtctccgacccccgccataaggtgattaaagagatttccctgcatctttcaaaggaagccggcacaactcagatgtttgacattgcagatcgcattgaatctgtgatgcgggataacaaaaaaatgttcccgaaccttgattggttctcggcggtatcttatcacatgatgggggttcctaccgccatgtttacccccctgtttgtgattgcccgtactgctggctgggcggctcacattattgaacaacgcattgataacaaaattattcgcccttcagccaactataccggccctgagaacctgccgtttacaccgattgaccaacgcaagtag

SEQ ID NO: 504 - DNA, 903 bp, Xenorhabdus bovienii
  Coding DNA location: Contig name=SeqID_16845; Position on contig =14732..15634bp; Strand=-
atggagttatatatggcattttcttctgctggtctggcttttcgccgggcaatagaggccgaatctccgttacaggtggtcggaactatcaatgcaaaccatgccttgctggcaaaacgagcgggctacaaagccatttatctttcgggtggcggcgtttcagcaggctcgttaggtctgccggatctgggcatctcaacgctggatgatgtgctgaccgatattcgccgcattaccgatgtatgcgatttgccgctactggtggatgccgatatcggctttggttcttcggcattcaatgtcgcccgcaccgttcgttctattattaaggcgggtgctgcgggtatccatattgaagatcaggtgggtgccaaacgttgtgggcatcgtccaaataaagaaattgtctccaaagaggagatggttgatcgtatcaaagctgccgttgatgcccgcaccgatgagcattttgtgattatggcgcgcacagatgcgctggcagtggaagggttagaagccgctctcgacagagccgaggcttatattgcagctggtgcagatatgctgtttcctgaggcgataacagagctgaaaatgtatcaggtatttgccgcaagaacgcaggttcccatactggccaatatcaccgagtttggtgccacccctctctttacgaccgaagaattaggtagtgtagacgtcgctatcgcgctttacccgctttctgcatttcgggcgatgaatagagccgcagagcaggtctacaccacactccgccgtgacggcacacagaaaaatgtgatcgatctgatgcaaacccgtaatgaactttatgaaagcattaattattacgattttgaacagaaattggatgccctgttttcccagaaaaaccagaggtga

SEQ ID NO: 505 - DNA, 1713 bp, Xenorhabdus bovienii
  Coding DNA location: Contig name=SeqID_16845; Position on contig =15873..17585bp; Strand=+
atgaaacattatggtgaaattatcaaaaatcgaaaagagcaagaaaggggggaacaaatggcgtcaggacatacaggggagtgtgataacaacaaaccggttatctggacagtatcggtttcccggcttttcgatctttttcgtgatatcacgccggaatttgatcatcaggctgatatcacaccgattaatcttggttttgaacaggcggttcaacatattcgtaaacgtctggaaacggagcactgtgataccgtgatttgcgctggctcgaatggtgcctatttgaaaagtcgtttatccgtgccggtgattatcgccaaatccagtggttttgatttcatgcaggcactggcgcgcgcgaggcaaatcagcgcccggattggcgtcatcacttatcagaatactctgccagcattggaagaatttcagcagcgtttcaacttgcggattgaacagcgcagctatgtgacggaagaagatgccaggacgcaggtcaatgcgctgaaagccgtaggtatcaaggtcattgtgggcgctgggctgattaccgagctggcttatgaagccgagctggtgggggtgtttctctattctgccgatacgatccggcaggcatttcatgatgcgttggaaatggccagaatgaccaaactcaatctggtgtcgagttcgccttatcctacggaggataagttacgcattcgtcatacgctcaacgatattagaggtgattccgctgcggtggagcatgtacgtaacacgattatgctgtatgcccgttcgacggccacggtgttgattcaaggggaaagtggtacgggaaaagagctggtggcgcaggccattcatcatgaatacagcctgcgttatgggcagtctgtgggtaaacatccgcgtccctttgttgcagtcaactgtggtgctattaccgagtcattactggaggcagagctgtttggctatgaagaaggcgctttcacgggctctcgtcgaggggggagagcgggtttgtttgaaatcgcgcacagaggaacgctgtttctggatgaaatcggcgaaatgccattgccactgcaaacgcggttattgagggtgctggaggaaaaatccgtcgtcagggtcgggggatatcgtccgattgccgttgatgttcggatcatttgtgctacccattgtgatttggatacatgggtgcgagaagggagttttcgggcagacctcttctaccgcttgagtgtgctgagaattaatgtgccagcattacgtgaaagagggagtgatattgggctgctggccgtggagtatctgcggcgggcatttgcggcgcttaacttgcctgtttcatcgtcaagaatacgggaactttctgcttgtcatgcagcgctgcaatcttaccattggccgggtaatgtgcgggaactgcgtaatttgatggagaggattgcactctacttaagtgcccatcccgaacagacattgacacctgctttgatcttatcgctttcacctgagcggcagattgatatcggttcggtgaagagcaacgcgaaaacttccgagattgaacctccttcttcaatggcggtttcttcctctatccatgatattgtggcgagatttgcgggtaatcgacaggcggcggcagaatatctgggaattagccgcacgacgttatggcggaggttaaagcaagagccggggaaagattaa

SEQ ID NO: 506 - DNA, 168 bp, Xenorhabdus bovienii
  Coding DNA location: Contig name=SeqID_16845; Position on contig =17559..17726bp; Strand=-
atggctggtttttggctcacaaaaagtccggagaagcaggttggataccacaggaatatgttgcattttaaaaatgtcatattggtgatagttatcacaatattagtcaataaggagcctattccaataaggtttttccatttaatctttccccggctcttgctttaa

SEQ ID NO: 507 - DNA, 108 bp, Xenorhabdus bovienii
  Coding DNA location: Contig name=SeqID_16845; Position on contig =17676..17783bp; Strand=+
gtggtatccaacctgcttctccggactttttgtgagccaaaaaccagccatttagcgatttctcctccacattttaaccaatttattcgctggaatgataatgagtaa

SEQ ID NO: 508 - DNA, 147 bp, Xenorhabdus bovienii; identical to SEQ ID NO: 349
  Coding DNA location: Contig name=SeqID_16845; Position on contig =17810..17956bp; Strand=+

SEQ ID NO: 509 - DNA, 150 bp, Xenorhabdus bovienii
  Coding DNA location: Contig name=SeqID_16845; Position on contig =17939..18088bp; Strand=-
atgtttacgtttatttcgtggggattgtgcagtgtgagcccgacgcagaaacgcgatccaaattatccacagatggtctgtaggttaatgagtgaatggtgctatgtgcgtctggttacgtttcgtagggacttaactaccacctactga

SEQ ID NO: 510 - DNA, 111 bp, Xenorhabdus bovienii
  Coding DNA location: Contig name=SeqID_16845; Position on contig =18150..18260bp; Strand=-
ttgaaccaaaaactgaaatttcctgaaaatattttcacacttttcaatttgcggtttctctcacgccgcctgtgctggcgcgctctggcggttccctttgtcggattttaa

SEQ ID NO: 511 - DNA, 144 bp, Xenorhabdus bovienii
  Coding DNA location: Contig name=SeqID_16845; Position on contig =18319..18462bp; Strand=+
gtgagaagtaagatcacgaagaaaggccgcattccatcatggaaatcagatagaaagcggctttgcagaataagcagaactgaaattattttctcttcttacatcaaggcaaaggagaaaattaaagtgcgcttaattcactaa

SEQ ID NO: 512 - DNA, 297 bp, Xenorhabdus bovienii
  Coding DNA location: Contig name=SeqID_16845; Position on contig =18440..18736bp; Strand=-
atggacaaaaaactttttgatgatctggttgaaagcatgaatcagatggtagcgattgaaaaaggagagctttccgttcctgctgaaaatattcatcgccatcgtctgcctgatgtaaaaaacctacgcgaaaccttcgggttaaagcaaagtgagtttgccgaagctgttggcgtttctgcttccctaattcaaagctgggagcaacatcgccgtattccttctggctcatcacttaagctgcttaaaatgcttgaacgtaatcccacactgattagtgaattaagcgcactttaa

SEQ ID NO: 513 - DNA, 201 bp, Xenorhabdus bovienii
  Coding DNA location: Contig name=SeqID_16845; Position on contig =18751..18951bp; Strand=+
atgaacattgccgcgtatctacgcggcgttgattattgcaatttatttttccatatgaaaggtttaaaaccaccgtctttagacggtgactttgactttaattctttgacctatgcgcgtttacgaggtgcgtggttcgacgactttcagtcgtcggcaccgaagtgcgctaacccacctacttcagtaggtggtagttaa

SEQ ID NO: 514 - DNA, 117 bp, Xenorhabdus bovienii
  Coding DNA location: Contig name=SeqID_16845; Position on contig =18976..19092bp; Strand=-
atgggaaaaagtggcggagtaagaatcatctactacaccatcacgaaaactggaaggttctatcttcttttgatttaccctaagaataaaaaagatgatttagccccaaaagaataa

SEQ ID NO: 515 - DNA, 159 bp, Xenorhabdus bovienii
  Coding DNA location: Contig name=SeqID_16845; Position on contig =19105..19263bp; Strand=-
atggaatacctactttttatcgaaacccccgtgtttagtagagatcgggcagatttgttaactgatgatgaattcagacgactacaggagcacttactaaagaatcatgaacaaggtagtaccattagcgctactggaggatgtaaaaagattcgctag

SEQ ID NO: 516 - DNA, 198 bp, Xenorhabdus bovienii
  Coding DNA location: Contig name=SeqID_16845; Position on contig =19306..19503bp; Strand=-
atggcagccttaaagctaccattaaaaaataggcataaaaaatccaacactaacggggttggttctgaccgcttacttaaggtttctaggcctcatttaggaaatgataatgaattgctttcggaaggtcaactacatttttccatacacatgaaaatttcgtactatgtacgattttacttttacaatcgtacatag

SEQ ID NO: 517 - DNA, 498 bp, Xenorhabdus bovienii
  Coding DNA location: Contig name=SeqID_16845; Position on contig =19482..19979bp; Strand=+
atggtagctttaaggctgccatctctccgaatcaatgtcgggagggcggcgaatacaacacccgaaaggggaataagtccgcagctcttactgctgtttctagcctcccgacaccacttaattgtggattttcctagaaagaaaagtaaggagtcagaaatggctaatctatcagtaaccccattcatgttcgaaaatcagcaagtacgtacattgactaaaaatggtaacccttggtttgttgctcaagatgtatgtgatgccttgaaaatcaaaaatagccgggatgccatcgcaaagcttgatgatgaaaagggtgtcgctttaaccgacacccttggtggggaacaaaaaataaacattatcaacgaatcaggaatgtactttctgacaatccgttgtcgtgatgctgtgaagataggaactctttcccaccgtttccgtaagtgggttactagtgtagttctacctacaatagaaagactggtaactatataa

SEQ ID NO: 518 - DNA, 264 bp, Xenorhabdus bovienii
  Coding DNA location: Contig name=SeqID_16845; Position on contig =20000..20263bp; Strand=+
ttggatcagttcatcatttgtccatgttgtgaacggcctgccagtattgtggggattaaatattaccatagagaaaaatcagagattgttgccttatgcaataattctcagtgcccaagcctgccatttaaagtagatctttcattcagtcactatttgcaagttaaggatgaaagcaggaatgtgagagatgtaaggcgattaataaatgggatgatttccactcagaagctaaaactggtgaatgccttaacatctaggtag

SEQ ID NO: 519 - DNA, 147 bp, Xenorhabdus bovienii
  Coding DNA location: Contig name=SeqID_16845; Position on contig =20249..20395bp; Strand=-
atgtttttggtagtaggtttagtagtaaaagaccaacaaccaaaacataaatatgttatttattatatagttaacaaactagatcaaattccgccagcccacccattttatttttatgggcacgaatggacactacctagatgttaa

SEQ ID NO: 520 - DNA, 240 bp, Xenorhabdus bovienii
  Coding DNA location: Contig name=SeqID_16845; Position on contig =20489..20728bp; Strand=+
atgtatttatataatataaatatattatatttattatatagttatacttattttaaaattatgtactcagtaaaaactagggacaagggtgggacagcacctaatatatgcgtcccgaccttcgataaagccttcctcggaaatgcgcaacgtcttttgccagcggcaaacagccgtggagctgccgacagatttgtctgtagagctaagtgtggatctccacttaggccaaagcagtaa

SEQ ID NO: 521 - DNA, 216 bp, Xenorhabdus bovienii
  Coding DNA location: Contig name=SeqID_16845; Position on contig =20736..20951bp; Strand=-
atgaactatgggctagtaataaagcgagccgcctccattcaaaatttttcacataacactacacaaaactacagaaaaatattaactaagcctaaaccacatcaaactactagacacgtaagccaagatattaagctagacgaaaaatccataatggatggagtagccaggcagaaaagaaacgtacttataggaatttttcactccctgccctaa

SEQ ID NO: 522 - DNA, 417 bp, Xenorhabdus bovienii
  Coding DNA location: Contig name=SeqID_16845; Position on contig =21121..21537bp; Strand=-
atgcacatccctttcttttatagcttccccataaactcttgccaaggtgcttcggtattcttcggcatggctgcacagcaatttttcccagatgtcgatattaaaattgttcttgggggcgatcgaaaaggtgaagacttccactattggctagaaattgacaaaaaagtctatgacctgacagtagaccaatttatatcttggatggataagcaatataattgccccgacaaacctatctacgcagaaaagaagcaccctctggcaaaatactttttctacaaaaagcgtttttctccattagaagcatattcaattttttgcgatcgacatgcaaatgaaagggatgttgtcgctgtttatgacttcttgaaagcagaacttaaaaaactaggatggaataatccgaggaggtga

SEQ ID NO: 523 - DNA, 123 bp, Xenorhabdus bovienii
  Coding DNA location: Contig name=SeqID_16845; Position on contig =21515..21637bp; Strand=-
ttgcatgtctctgtacatggttttttatccgcctcaaatgtactagttaacaagtacataatatcatcgctggtggataaggggaaatgtggccaagagtatgcacatccctttcttttatag

SEQ ID NO: 524 - DNA, 360 bp, Xenorhabdus bovienii
  Coding DNA location: Contig name=SeqID_16845; Position on contig =21620..21979bp; Strand=+
atgtacagagacatgcaaaaaatactatcgcattggggcgggtgggtagtgcaaggccgagttaacattggctggaagtcggtatccgccgggtttgaaaacgcggtgacttataccagcaataacaagctgtcgtgcagtgacgatgacgggatggtcattgatggctgtgttgccaagctacgtaacgtcggtatgtctcaggaatgtgactttattgaagaccattacgttaaaggcatatccaaacgtgcaattggtcgcagttccaagctcagtgagagcgaggtcagaaagcgaatgctggtggccgaaagttttattcttgggtgcctggaggttctaaataagaattcataa

SEQ ID NO: 525 - DNA, 498 bp, Xenorhabdus bovienii
  Coding DNA location: Contig name=SeqID_16845; Position on contig =21974..22471bp; Strand=-
gtggatattgaccttaacccaaaaatcggggcagattggtgtttcaagggacaacaaaagcgtgttgtgacccccggaaagaaccagaaacactatcttgcgggctgcctcaacgcgaaaacgaaagaaataacttatgtcgggggcttaagaaagaactcggatttatttattaagttgttagatacacttaataatcaatatgttaatgcaaagacgatcaccttgattttagataactatggcattcataaaagtcagaaagtcatcgcggggctggcaaaaaatcctaaatttaatctcttgtttttaccggtctattccccttggttgaataaaattgaacgcctgtggcaatccctgcatgaaaccgtgacacaaaaccattgctgccaatttatggggcagttacttgaacatgtaaaagccttcatggaaatcacttcattacaacagcaaaaacctgggagggtaaaaatgggtgtatcatcattatga

SEQ ID NO: 526 - DNA, 1122 bp, Xenorhabdus bovienii
  Coding DNA location: Contig name=SeqID_16845; Position on contig =22508..23629bp; Strand=-
atgaaagaattagtggatgtcttttctgattttccagacccacgttgtcagggaaaggtcaaacaccgttttattgatatcttagtgatcgctgtatgcgctgccattgctggggctaacgcctggactgatattgaacagtacggtcaactcaaaaaggattggctgagttcatttcttccgctcaaagggggtattccgtcacatgatactttccggcgctgtttcagtttattaaacccgagcctctttgaacatcatttttatcaatgggtttctcgtgacctctcttcagaaaaacgggctatcattgcgattgatggtaaaagtttacgtcattcgtttgataagaaaattgaccaaagcgcattacatatggtgagtgcattcacggttgagaaagggcttagcttatgtcaatgtgccgtagacggaaaatcaaacgaaattaaggccattccggcattattatcgatgctttcattgaaaggccatctcgtgacgatggatgcgataggttgccaacgcacgattgctcagcaactacgcgagagtgaagccgattatattttgtcgcttaaaggcaatcaggggaaaaccttttcggaagcggttaactattttcaacaacaacagataacccaaaaaccttaccttaaacttgaccatgatgaattcgatgatagccacggacgtaccgtcagacggcgcggatgggttctgccactgacatcagaagcaaaacacttaaggtcttggccagatattcaagctctcctggtaacagaaacgatacgacaagaacactattctgacacggtgacttctgactttcgttattatttaagcagttgttatgattctcccgcctttcagttaggtgcaatacgaaaacattgggctatcgaaaatagtttacactgggtactggatgtcactttccgagaagatgattcacggatgagagagcgggtcgccacaagaatatttgcccaattacgtaaaatggcactcaatattgttaaacgagatatcaatagtaaattgagtttgagtgcgcgaagaaaatcagcgggatgggataacggttatatggaagcactgttatttaatcaattttag

SEQ ID NO: 527 - DNA, 1212 bp, Xenorhabdus bovienii
  Coding DNA location: Contig name=SeqID_16845; Position on contig =23655..24866bp; Strand=-
atgcctaaaaagataacgccgctttcccctacaacggtatccaatgccaaagccaagcttgatagcaaaacgggtaagcccaaagatacgatctatcgtgacggggacaatttagaactcctcgtaaaagcatcaggcattaaactttggtatttcagatactacaaaccgttcacccaaaagcgcacgatgattgcgtttggtgagtacccttctattggactggcagatgcgcgcagactaaaagacgaagcaaaagcgatgctggctaaagatattgatcctgttgattggcgaaaacagcaagcagccgcaatacatgaagagaacagtaacaccttaaagaatattgctacccgctggtttgaggtgaagaaaaccactgtcagcgaggattatgctaaagatatctggcgctcactggaaaagaatattttccccaaactcggctcaacaccaatatcaaatctgaaagcgcccatgctggtggaagtgctcaaacctatcgaagcaaggggcaatctggaaaccatcaaacgcctgactcaaagaacggtagagatcatagactacgccatgaatttaggcgttattgatgccaatccctttactaccgtaagcaaggcattccctaagccaaagaaaaaacataaccctaccatccgacccgaagaactccccggattaatgcaagcactctccgttgcaagaatagaacgacaaacacgtttagttattgagtggcaactattaactgctatgcgcccaggagaagcggtaaaagcccgttggtctgaaatagactttgataacagaatctggaatgtgccagcacaaaccatgaagatagatcgccctcacacggtacctttatgccaaccggctttagatattcttgaaatcatgaagcctatcagcaggcatagagaatttgtgtttccccacagatccacccccaacatttgcatgaatagccagactgcaaataccgctctaaagcgtatggggtatcaggatatccttaccgcgcacggtatccgttcaatagtcagtactgcgatgaatgagcagggctttatgccagatgctatagaagctgtgctggctcacggtgaaaagaactcagtccgggcagcatacaaccgagccacctatttagaacaacgccgggttatgatgcaggggttacgcatgaaaatatttagtggataa

SEQ ID NO: 528 - DNA, 96 bp, Xenorhabdus bovienii
  Coding DNA location: Contig name=SeqID_16845; Position on contig =25091..25186bp; Strand=+
atgtctgggacaggggtgttctgctgtttaaattttataaatcatatagttaaccgtatcgggacggtgggacatcatctttggcgaaaaacttaa

SEQ ID NO: 529 - DNA, 150 bp, Xenorhabdus bovienii
  Coding DNA location: Contig name=SeqID_16845; Position on contig =25355..25504bp; Strand=+
gtgtattccgacgctatccgaatactaatttggtggagctggcgggagttgaacccgcgtccgaaattcctacatcctcggtactacatgcttagtctagtctttacattcgcttgccagctgcggacagacacgccactaacaaactag

SEQ ID NO: 530 - DNA, 219 bp, Xenorhabdus bovienii
  Coding DNA location: Contig name=SeqID_16845; Position on contig =25626..25844bp; Strand=-
gtggaaagtagacaaagaaagaataatgaagaattcagggcgttaatcactggcattatcatccaatattctgatatacttgcttttaacatacttggggctgattctggattcgacgggattcgcgaaacccaaggtgcatgccgaggggcggttggcctcgttaaaagccgcaaaataatagtcgcaaacgacgaaaactacgcactagcagcttaa

SEQ ID NO: 531 - DNA, 483 bp, Xenorhabdus bovienii
  Coding DNA location: Contig name=SeqID_16845; Position on contig =25799..26281bp; Strand=-
atgacaaagaaaaaagcacacaaacccggttcggcaacaattgccatgaataagcgagcccgccatgaatacttcatcgaagaagaattcgaagctggcttatcgctacaaggttgggaagtaaaatcgctgcgcgctggcaaggcaaacatcagtgagagttacgttttgctcaaagatggtgatgcttatctttttggtgccacaatcacaccattaaatgtcgcttcttcccatatagtctgtgatccgacacggtcacgcaaattactccttaacaagcgcgaacttgattcactatatggtcggatcaatcgcgaaggttatacaatcgttgcgctttccatgtactggaagaacgcttggagcaaaatcaaaattggcgttgcgaaaggtaaaaaagcgcatgataaacgttcagatatcaaagaacgtgagtggaaagtagacaaagaaagaataatgaagaattcagggcgttaa

SEQ ID NO: 532 - DNA, 102 bp, Xenorhabdus bovienii
  Coding DNA location: Contig name=SeqID_16845; Position on contig =26293..26394bp; Strand=-
atgtggttaaataaaaacctgatggcgtttggaacaataaatatgcatttattgctaaatatcactcagaagagatttctttcattaacgcatacagtataa

SEQ ID NO: 533 - DNA, 435 bp, Xenorhabdus bovienii
  Coding DNA location: Contig name=SeqID_16845; Position on contig =26439..26873bp; Strand=+
atgccacagattagtcgctctgcgttagtgccttacagcgtggaacaaatgtacaaattgatcaacgatgtaaagtcttatccggattttttaccgggatgtgtgggtagcagtgtaataagccgtagtaataatgagatgacggctgctgttgaggtctccaaggcagggatcagtaagacgttcgtgacgcgcaatacgttatctgataataaaagtattagtatgcagcttgttgatgggccttttcgaaagctgatgggcgggtggcattttaccccacttagcgaggatgcctgtaaagttgagctacatctcgactttgagtttaccaacaagttgattgagttggcttttggtaaggtgtttaaggaattagccggtaatatggttcaggcttttacccaacgtgcgcgtgaggtttacagtgtctga

SEQ ID NO: 534 - DNA, 312 bp, Xenorhabdus bovienii
  Coding DNA location: Contig name=SeqID_16845; Position on contig =26848..27159bp; Strand=+
gtgcgcgtgaggtttacagtgtctgatatcaatgtcgaagtcgtttatgctctgcctgaacggcaatatctgtgtaatgtgaaagtacctcagggatcgactgtcgaacaggcgattgtcgcatctggtcttttgacattacgtagtgatatcgatttgactaagaataaaatcggcatttatagtcgcccggctaaattgaccgatacgatggtagaaggggatcgtgtagaaatttatcgtccccttcttgccgatccaaaagaaatgcgtcgtaaacgggctgaacgagctaaaaatagcactcaataa

SEQ ID NO: 535 - DNA, 345 bp, Xenorhabdus bovienii
  Coding DNA location: Contig name=SeqID_16845; Position on contig =27224..27568bp; Strand=-
atgcgctgtaaattgttgactgccgctaccgtatcacttgttatgctgactgcgggttgctccatgtttgagcgagttgtttatcgtcctgatattaatcaagggaattacctgacaccggctgcggtatcaaaaatccacaaaggaatgactcaacaacaagtcgcttacactttgggaacaccaatgctgaccgatccgtttggaagtcaaatttggtactacatattccgtgagcagccaggccataagaaggccacacaagaaacattgactctcacctttgataataatggtgtgttgactgatatcaagaatgaaaaagctctgccagaggatcagtaa

SEQ ID NO: 536 - DNA, 1674 bp, Xenorhabdus bovienii
  Coding DNA location: Contig name=SeqID_16845; Position on contig =27682..29355bp; Strand=-
atgctgactcagttaaccatcagtaattttgctatcgttcgcgaactggaaattgatttccgctcaggaatgacagcaatcacaggggaaaccggcgcaggtaaatccatcgccattgatgctctgggcttatgccttggcaatcgaggcgaagccaatatggttcgtgctggtgctacccgtactgacatctgtgcccgtttttcactggcggatgcgccttctgcccgtaaatggcttgaagcccaccagcttgatgaaagtcgtgatgacgacaatgagtgcctgttgcggcgcacgattaccgctgatgggcgctcccgtggttttatcaatggcacggctgtccccctttcccagctacgtgaattaggttcacatctgatccaaatccatgggcaacatgcccaccaattacttttagaaaatcgtcaccaaaggcgtttactggacatttacgctggccaatttgaactgcaacatgaaatgaagcaggcttaccaacaatggcggcaaagctgtcaggcactcgcccgatttcaacagcaggctcttgaacgccgctctcgccagcagttactcgaatatcacttgaaagaactaaacgaactggcaccacaagtgggtgagtaccaagagcaggatagcgaatataagcggctggcaaattgcgggcagtttctatctgtcagtcagaacgttctccagatcttaaatgataatgatgaacagaacattgtcagccttctgaattatgcacgaaacgaactgactgaactggccagcatggatcacaaattcaacgaactgcttaacatgctagaagaagcagccattcaaattaatgaagtcagtgatgaattacgtcattacagtgatctactggaattagaccctaaccgcctgtttgaattggaacagaaaatttcacaacagatcagcatggctcgtaaacatcacgttgctccagaagaactacctgccctgcaccaacaacttttggaagagcagcatcagctctcccagcaggaagataattgtgcccatctcagtgaactcgtcagactacattatcaacaagcgctcaatgtggcagaaaagctgcatcaggttcgccaacaatatgctgtagaattaagccaactgatcaccaacagcatacatcaactctccatgcctcatggtcgttttaccattgacctcacatttgaacccgagcatttaaatattgatggtgccagcaaagttgagtttaacgtaacaacaaacccgggacagcctcatcaatcactggcaaaagttgcttctggcggtgaactttctcgtatggcactggctattcaggtcatcacagccaaaaaaatggaaacgcctgcattaatcttcgacgaagtggatgtcggtatcagtggcccaacagcggcgatcgttggtcgcctgctgcgtgaattgggagaatcaacccaagttatgtgcgtaacacacttaccgcaagtcgcaggatgtgggcatcaacacttttatgtcaacaaacaaaccgacggggaagaaacagaaacccacatgcaattgttggacaaaaaagcccgactccaagagctggcgcggcttctggcgggtaatgaagtcacaaaaaacacactggccaacgcaaaagagctattagcggcataa

SEQ ID NO: 537 - DNA, 900 bp, Xenorhabdus bovienii
  Coding DNA location: Contig name=SeqID_16845; Position on contig =29452..30351bp; Strand=-
atgctgaaggaaacaacagcaatgaataacgaattcaaatgcatcggtattgtcggccgtccacgtcaccctgaagcgctggccacccatgaaatgctttatcactggctggtatccaaaggatactacgtcatcatggatagacaagttgctagagacattagtttaaaaggtgttcagactggaggattgaccgaaatcggcaaaatagctgatctggtgattgttgttggcggcgatggcaacatgctgggagctgccagagtattgtcacgctatgacatcaaagtgattggcattaaccgtggcaatttaggctttctgacggatttagatcccgataatgccttgcagcagctttccgaagtactcaatggagaatatcgagacgaaaaacgtttcctactggaagctcaagtcacgaaaaaaggacagaaatcacggcgcagtacagcgctgaatgaagtcgtgctgcatccgggcaaagtcgctcacatgattgacttcgaagtttatattgatgagcgttttgcgttttcccaacgctcagatggcttaatcattgcgacccccacaggctcaacagcctactcgttgtctgctggtgggccaatattgacaccaaacttgaacgccattgtgctggtaccgatgtttccacacacgctttcagcgcgccctcttgttatcagcagcgaaagcagcattcgtctgaaattctcccggaacagcaatgactatgaagtaagctgtgatagccagatcgtgttaccgatccaggacagtgaagaagtcattatcaaacgcagtgaatataacctgcacttgatacacccgaaagattacaactatttcaatacactgagtacgaagctgggttggtcgaaaaaaatgttctaa

SEQ ID NO: 538 - DNA, 831 bp, Xenorhabdus bovienii
  Coding DNA location: Contig name=SeqID_16845; Position on contig =30205..31035bp; Strand=+
ttgtctatccatgatgacgtagtatcctttggataccagccagtgataaagcatttcatgggtggccagcgcttcagggtgacgtggacggccgacaataccgatgcatttgaattcgttattcattgctgttgtttccttcagcatatggttttgccctcacaatatgattgttcccttgaatccctcgttttgatccccataataagcgggagtagcgcaaataatacaaaatacgcggagatattcatgagtagtaaagaccaaaaagtacctgacgagcaagtctcagaaaatacagaaaatgtatttgagcaacaaatggatgcagaaaaggcagacacgccagagactgagagcattgttgacccgcgtgttgccgagttggaagaacaactaaaacaggctcaaattggcgaacgcgatgcaatgctacgtgctcgtgctgaagtggaaaatatccgtcgtcgcacagaactggatatagaaaaagcacataaattcgcactggaacgctttgccaatgaacttctgcccgtgatcgacaatctggaacgtgcactggaagcggttgatcgttctaatgacgcgctgttgccaatgattgaaggcgttgagttaacattgaaatcattcactaatgctgtaggtaaattcggcattgaagtggtgggtgacactaatgttcctttcaatcctgaagtacatcaggcgatgactatgatggaatccgatcagcatgaacccaatcacgttatgttagtgatgcagaaaggttataccttgaatggtcgtttattgcgccctgcaatggttgctgtttctaaataa

SEQ ID NO: 539 - DNA, 93 bp, Xenorhabdus bovienii
  Coding DNA location: Contig name=SeqID_16845; Position on contig =31039..31131bp; Strand=-
ttgattggtatcccacactgcctgagtgacaatagaataaccacaaaaatgccgccctgtgtatggcggcattgtaatcacgggatagcgtaa

SEQ ID NO: 540 - DNA, 681 bp, Xenorhabdus bovienii
  Coding DNA location: Contig name=SeqID_16845; Position on contig =31103..31783bp; Strand=-
atgcccgcatctctcacatggcacgaagtcattggccatgaaaagacacagccctatttcgttgacacattgacctatgttgccaatgaacgtaaggccggaaagacgatttatccgccacagcaggatgttttcaatgcattccgctataccgaactgtccgatgtaaaagtcgtgattttggggcaagacccttaccacggcccaaatcaggcccacggtctggccttctcagtacagcctggtattcctgcaccaccttctcttgtcaatatgtataaggagctggaatcggatattgctgggtttagccgccctaatcatggctgcttggtcagttgggcaaagcaaggcgtattgctgctcaatacggtgctgaccgttgaacgtagcaatgcacattcacatgcgaatttaggctgggaaaccttcactgacaaagtcattgcggcaatcaatgaacatcgtcacggcgtcattttcctactttggggttcccatgcccagaaaaaaggacacttcatcaatacccaacagcactatgtcctgaaagcaccacacccttcgcctttgtcagctcatcgcggttttctgggatgcaagcatttttcacaggcaaacagcctgctggaagctcaaggattggcgccaattgattggtatcccacactgcctgagtga

SEQ ID NO: 541 - DNA, 93 bp, Xenorhabdus bovienii
  Coding DNA location: Contig name=SeqID_16845; Position on contig =31752..31844bp; Strand=+
atgacttcgtgccatgtgagagatgcgggcatcgcgaatccctttctatatgattgtcagataggcttaagcttaccgattcccttcgcatag

SEQ ID NO: 542 - DNA, 1152 bp, Xenorhabdus bovienii
  Coding DNA location: Contig name=SeqID_16845; Position on contig =32102..33253bp; Strand=+
atgactttatcaataaatagcagttttttcagtgaattagggatttattcattacagggaagtccactgcagcttcaatcgagtcctccggtcaaatcaccatctgacaaggctgatgtgactcactccacaacacaacccacaacagttccgctttcagaaaatacccagcaaaataataatctttaccaatcattggttcgcgatcggcatctaagtgccatggcattacctgaattacatgccaatgatattgcaggaaaacattctaaacgcatcgattatgatctgtcactggtcacccgtgatgtttaccgtatgaatagcatgggaattggtgattatgtgcgtcttacgaaagatgaaatatcaaaagcgggcattgatcctgctatcttggaggatagttcaacaggatttcaggcaggcgtttatcgaaataagggcttatatatcgtgtcatttactggctcgaacgaaatacaggatttcatggcaagtattcgtcaagggcttggatttaaagaagagcaatatggtcaggctgtaaagttggcacaggcagcgttaaaaggatttggtgaaaatgtcattttcacgggtcattcaatggggggaggattggcatctgtggcggcgctgacaacaggaaaacccgcagttatttttaatgctgccggagtgtcagattcgacattgaaaagtatgggattatcaccgaaagcaagtcgtgaagtggcagaaaatgggttaatccggaattatattgttgaacatgactggcttgataacctgcaaaaaaccttgccaattccccagcccatgggaaataaaattctgcttgaatatgagtacgaaccggaagggatattggattccatttttgcctatcggtatgcttttcactcattcaaggcgcattttatggaagccgtgcaggaattgctgaccgtccataaaccttggttgaataaagcaggtgaaatgatagctgctactgaggacagtatgcaaaacaaggctattcctatgcaaaaacaggctttgaatacatgggggatgaatatggatgaggccaaaatcagcgaacagttaagggaagagcgtcatcaattggtttcacaacagcttgagaagcattattcagtataa

SEQ ID NO: 543 - DNA, 174 bp, Xenorhabdus bovienii
  Coding DNA location: Contig name=SeqID_16845; Position on contig =33241..33414bp; Strand=-
ttggaaaacgccgcactccttccggtgactccaaaccagaaacgtcagaaccaaccaacgattaatctcactggcaaaagcgggcaaacagcccgctttatcatctctgacaaacagaaacaatggattcagccttactcgtcattccatttgtacgaatattatactgaataa

SEQ ID NO: 544 - DNA, 1347 bp, Xenorhabdus bovienii
  Coding DNA location: Contig name=SeqID_16845; Position on contig =33350..34696bp; Strand=-
atgatgactgcgacaaacttttccgaattcgaacttgatgaacgcctgcttaatgcactgaacgaaaaaggctacgaacgcccgacagcgatccaggctgaagccattccccctgccatggatggccgtgacgtacttggctcggcaccgactggcacaggcaaaaccgctgcgtacctgctaccagttctacagcatttactggattttccacgtaaaaaatccggcccaccacgtatcttgattttgacccctacccgcgaactggcaatgcaggttgcagaacaggcacaagcacttgctgctcatactaatctggatgtcgccacaatcactggcggtgttgcttacatgaatcacgcagaagtgttcagtgagaatcaggatattgttgtcgcaactacaggacgcctactgcaatacatcaaagaagaaaattttgattgccgtgcggtggaaacgctgatccttgatgaagcagaccgcatgctggacatggggtttgccaatgatgtcgagaccattgccggtgagacacgctggcgcaaacaaacgttgctattttccgcaacgttagaaggcgaaaccatccgtgattttgcagagcgcctgttaaccgatcctgttgagatcgatgcagaaccttctcgtcgtgaacgcaaaaaaattcagcaattctattatcgagccgataatctggagcataaaaccgccttactgtgtcaccttcttcagcaacctgatgtaacaaaatcgattgtttttgtgcgcaaacgcgagcgcgtgcgtgaaattgtcgattatctacataaggcaggcattcaggcctgttttcttgaaggtgaaatggtgcagaccaaacgtacagatgccgtcaagcgactgaatgatggcagagtcaacgttatggttgcaactgatgttgcgtcccgcgggttagatattgaaaatatcagccacgtctttaactttgatttaccacgtactgccgatgtttatctgcaccggattggtcgtactgcccgtgcaggccgtaagggaaccgccattgcactggttgaatctcacgatcatccactgcttggcaaagtcacccgttatctcaacgaaccattgaaagtacgggttgttgatgaactgcgtccacaaactaaagcacccagtgagaaaaagagctataagccttctaagaaagtgctggagaaacgtaaagagaagaaaaaggtagaagaagaagcgaagaaaacacgagtgaaagttcgtcatcgcgatagtaaaaatattggaaaacgccgcactccttccggtgactccaaaccagaaacgtcagaaccaaccaacgattaa

SEQ ID NO: 545 - DNA, 114 bp, Xenorhabdus bovienii
  Coding DNA location: Contig name=SeqID_16845; Position on contig =34681..34794bp; Strand=+
ttgtcgcagtcatcatatacctctatttgggtcgccgattataaacaggttaggcgtattcttcatcctataaaaatatcctgtgggcaggtcgcttttatccgtgggctataa

SEQ ID NO: 546 - DNA, 741 bp, Xenorhabdus bovienii
  Coding DNA location: Contig name=SeqID_16845; Position on contig =34837..35577bp; Strand=+
atgggattgatacataaacccgcttttcgctgcggtggttttacatttaaacagttttttgttggacatgataaatgtgcaatgaaagttgggacggatggcgtgttattaggcgcctgggctccggtggataatcggaaaaaatgtctggatatcggttgtggcagcggtttggttgccttgatgatagcacagcgtactgatgatcattcggttattgatgccgtggagctggatactcatgctgcgagacaggcaatcgagaatgtgcaggaatccccatgggctgatcgtgttaaagtgcatcagcaggatattcatgattttactcagcaaaaccacttgcaatatgatttgatcgtgagtaatccgccctattttgaacctgccaacgcgtgtaggaatgaggcacgtagtcaggcgcgttacacgggatcattgacgcatcgtggattattggattgtgttgaacacttgattaaggccacagggctattttgtgttgtattaccctataacatcggcgagacatttgagcaaatggcggcagaacgggggtggtttactcatcatcgtgtcaatattcgtgataggcaggataagccgctgcatcgcttgttgctggcattttctcgacaagggcaggaaactcaggtgagtgaattgaccattcgtgtctcagatggcgtatattcaactgagtttcgtcagttagtaacagatttttatctttattattaa

SEQ ID NO: 547 - DNA, 135 bp, Xenorhabdus bovienii
  Coding DNA location: Contig name=SeqID_16845; Position on contig =35615..35749bp; Strand=-
ttgatcgtaattttatcttacaaccacctgttatttcgtatctcaccttttatgtatagtacaaatcatagtctctatttcccagggaatacgattttaagacaagaaaaaagaacgattcatttcattgcgtaa

SEQ ID NO: 548 - DNA, 738 bp, Xenorhabdus bovienii
  Coding DNA location: Contig name=SeqID_16845; Position on contig =35704..36441bp; Strand=+
gtgagatacgaaataacaggtggttgtaagataaaattacgatcaaagttgaacttcacacaaaatagagactcgaagtcatgcttgttcgggaagcaaggcatcatggctggcgtaattaagtataaatgtggagttttacctcaggagagtgagcctcggatgagcgagcagttaacggatcaaatgctggtcgaacgggtacaaaagggcgaccagaaagcatttaatttgctggtgataaaatatcagcacaaagtggcgagcctgattgctcgttacgtacctcaaggtgacgttcctgatgttgctcaagaggtgtttattaagacttatcgtgcgctttattctttccggggtgatagtgctttttatacgtggttgtaccgtattgctgttaatactgcgaaaaactatttagttgctcaggggcgtcgcccaccatccaatgacttggatgccaacgacgcagaaaattatgatgcgtcaagctcattaaaagaaatttcgaaccctgagaacttaatgttgtctgaagaactaaaggaagtggttttccgtaccatcgaatcgctcccggatgatttgcgggtagcgattacgctcagggagttggacgggttaagctatgaagaaatagccgacatcatggagtgtcctgtcgggactgtccgttcacgaatcttccgggcaagggaagccattgataataaagtccaaccgctgatccaacagtag

SEQ ID NO: 549 - DNA, 651 bp, Xenorhabdus bovienii
  Coding DNA location: Contig name=SeqID_16845; Position on contig =36474..37124bp; Strand=+
atgcaaagagagaaactttccgcattaatggatggcgaagctcttgatagtgaagtcgttcgtttgatcgctgaagacactgtgatgcagaaacagtgggaaagatatcacctcatccgtgacacattgcgtggtgaagtaggtgatgtattacatttggatatcgcgagccgagtcgcattggcgcttgaaaaagagccgattcatatcaatccagccgctattccagaatctcagccaaaacctgaaacatggcagaaaatgccgttctggaacaaaattcgcccgtgggcgagccagatgacacaagtcggcattgctgcgtgtgtatcattggcggtgattattggagtccagcaatataacagcgatggcagtgttgacgcggatacacaatctgatacgccagtcttcaatacattgcctgttatgggttccgcttcacctgtcggtttagctgcgcctgtagatgatgaagctttaggcagtgatttgaacatgcaagtgcgggaaagcaataaacgcattgatgctatgctgcaacagtatgaactttcccggcgcattcattcagaacaaaaccagaggctgccaccggctgataatactcagtctgtgggagcaaaaatacaacaggctccacagcaataa

SEQ ID NO: 550 - DNA, 960 bp, Xenorhabdus bovienii
  Coding DNA location: Contig name=SeqID_16845; Position on contig =37146..38105bp; Strand=+
atgaaacatatttgttttttcatcttcttgttggcgggtagcctgttcaatcctttgaaagcctcggcgcagcaaagcggcaccgaggctttgttacaggatatgggaaatgccgtacaaactctgaattatgagcttgctttcattaatttagagcgagaacttctgatccccctgcgttaccgccatgctattatcgatggtcaacccattgctcaaatcatacagatggatggatcgcgccgcgaaattatccaacgcggtaaccaaatcagctattacgagccaggcctggattcttttagtctacgtggcaaccacattgtggattattttccaccgattatttttgcggatttctcgcgattacagaagtactatcgcttcattgatgcgggcagtacccacgttggtgatcatcctgtgtactttgttcgtatcatatcgaaagatgaaactcgttataattataacctgttgattgatgcaaaaagtcatcttcccttgctgattgatctgttggacaaggatcataatattgttattgagcaattccgtgtggtgtcatcaacagtgaatgacagtataaaaaaagatctgattgctattgtcgatttgaaattaccaccaatgctggctatttcgccgtctgaaaaagtgaaattcgattggcaggtggggaaaatgcctgaaggtttcaaagaaatttcccgtaatagactcaaactagcagaaacagaatcgttggaatccatcatgtatagtgatggactgtttcaattctctgtaaatgtggcccatgcaggtaaagaagtagtcaataaacaaccatttcgacaaggtcggcgaacggtttatactttggtcagaggtaaaaataccattgcaatcgttggcgaactgcctttcgcaaccgccaagcagattgtagcaagtgtgacgtttacgggagatcattga

SEQ ID NO: 551 - DNA, 465 bp, Xenorhabdus bovienii
  Coding DNA location: Contig name=SeqID_16845; Position on contig =38105..38569bp; Strand=+
atggttaaagaatgggcgacggttgtccgttggcaaaaaggtcgcgcactattgcgttatggctcatcttcaggttgtggcagttgtcaggccaacgccgcctgtggctcttatttattggaaaaactggggccaaagaatattcatcagttagaactggaaatttcccaacctcttcaacctggtcaaaaagtagaagtaggtatacctgaaagtagcttactgcgttcagcaatgttagtttatttgaccccattattagggttgttcttagggggcttgctcttccaatactgggtaactgaccagttatgggtagttatgggaggcgttatcggcggggttactggtttcttctttgcccgcaagatagctaagtattgggataatcagcaagcgtaccagcccgttgtgttacaaattggtttacctcctgatacgattaaggttctacagcaggaataa

SEQ ID NO: 552 - DNA, 225 bp, Xenorhabdus bovienii
  Coding DNA location: Contig name=SeqID_16845; Position on contig =38494..38718bp; Strand=-
atggacacacagatggacataaagcgacagtttataggtttggccactggccaaagaggcgtattctacatgccaaacctgcgaaaacctagtcatgcctgtggttttcagtatgaccagaaagtgagagctgttaatggtaaagcagattattcctgctgtagaaccttaatcgtatcaggaggtaaaccaatttgtaacacaacgggctggtacgcttgctga

SEQ ID NO: 553 - DNA, 1797 bp, Xenorhabdus bovienii
  Coding DNA location: Contig name=SeqID_16845; Position on contig =38761..40557bp; Strand=+
atgaagcaaatacgaaatttctccattatcgcccacatcgaccacggtaaatccacactatctgaccggattattcaaatctgtggggggctgtccgatcgcgaaatggcagcacaagtactcgactcaatggatctcgagcgtgaacgcggtatcaccatcaaggcacaaagtgtcactcttgattaccagtcaattgacggacaagtctatcaactaaattttatcgacacgccaggccatgttgacttctcttacgaagtttcccgctctctggctgcctgtgaaggggctttactcgttgttgatgcggggcagggtgttgaagctcagacgctggctaactgctataccgccatcgaaatggatctgcaagttgttcctgttctgaacaaaattgacttgcccgccgctgaaccagagcgtgtagctgaggaaatcgaagacattgttggcattgatgcgacagatgccgtccgctgctctgcgaaaacaggtgtgggtgtgcaggatgtcattgaacgtctggttaaagagatcccgccaccagagggcaattccgatgcaccattgcaggccttgattattgactcatggtttgacaattaccttggtgttgtttcgcttgtccgtgttaaaaacggtacattgcgtaaaggcgataaaattaaagtgatgagcacgggacaggtatataacgctgaccgtctggggatctttacaccgaagcgtatcgaccgtgatatattgaactgtggtgaagtaggttggttggtctgtgcgatcaaagacattctgggagcgccagtcggggatactctgacaactgcgcgtcagccagcggacaaagcgctgccaggtttccaaaaggttaaaccacaggtttatgcaggtctgttccctatcagttctgaagactatgaagcctttcgcgacgctttgggtaaattgagcctaaacgatgcttcattattttacgagccagaaagttctactgcactgggctttggtttccgctgtggcttcctgggcttactgcatatggaaatcattcaggaacgtctggaacgtgaatatgatcttgatctgattactactgcaccaacagttgtttatgaagttgagacagtcagtgatgatattatttacgtggatagtccatccaaattaccgccattaaataatattaaagaactgcgtgaaccggttgcggaatgtaacatgctgttaccgcaggaatacctcggtaatgttataacgctgtgtgtggaaaagcgtggtgtacagactaatatggtttatcacggtaatcaggttgcactgacttacgaaatacccatggctgaagttgtgctggatttctttgaccgtctgaaatcgacttctcgtggttatgcgtctctggattataatttcatccgttttcaacactcagacatggtacgagtggatgttttgattaacggtgaacgtgttgatgcgttggcattgattactcatcgtgagaactcacaatatcgtggtcgtgagctggtggacaaaatgaaggagttgatcccgcgtcagcaatttgacattgcgattcaggctgccatcggtgctcacattattgcgcgtgcaactgtcaaacagttacgtaaaaacgtacttgcgaaatgttatggcggtgacgttagccgtaagaaaaaattattgcagaaacagaaagatggtaaaaaacgtatgaagcaggtaggaaacgttgaactaccgcaagaagcgtttttagcaattctgcatgttggaaaagataactaa

SEQ ID NO: 554 - DNA, 969 bp, Xenorhabdus bovienii
  Coding DNA location: Contig name=SeqID_16845; Position on contig =40578..41546bp; Strand=+
atggctaacacttttgccttgatcttaacgttagcaacgttaatcaccggtattatctggtgtatagatcggtttaaattcgcccctgaacgcaggaaaaaacttgctcagattcaggaacaggcagcaggtgcggaatctcaggaagctttggctacagagattaacaaaccttcatgggttgagacatttgcatctgtctttcctgtgttagccattgttttgcttctgcgttcttttgtttatgaacctttccagatcccttcaggttcgatgatgccaacgctgctgattggggatttcatcctagttgaaaaatttgcctatggtttgaaagatccaattacacagacaactttgattaaaacaggtaagcctaagcgtggagatattgcagtttttaaatatcccgttaatccgagtctggattttgtaaagcgtgtcattggcttgcctggagataaaattgtttacgatgacataaataaagaacttcaggtttttcctggttgtggttggaatacggtgtgtaagaatttacctgttacttatcgagatatgttcccaagtgaatggactatcaaagaggatattactcctgaaggcgcacctatgagaggggtttatccaattcctatcgaagaacaactgggatcaaacagtattcgccagggggaacgggttgagcgtttaggtaatgtgtcacaccacattttgactgtccctggagcatcaaatatcccgtttttcagtcagccagggttgccacttggaacttgggttgtccctgaaggtcattatttcatgatgggcgataaccgtgacaatagttcggatagccgggtatggggatttgtgccggagaaaaatctggtagggcgagcaacagcaatctggataagttttgaaaaacaggaaggcgagtggcccactggcgtacgtctgagtcgaattgggggaattcactaa

SEQ ID NO: 555 - DNA, 99 bp, Xenorhabdus bovienii
  Coding DNA location: Contig name=SeqID_16845; Position on contig =41636..41734bp; Strand=-
atgtgctaccaattcagtcagaattcatcaaaaaagcacacgcaacagacctgtggggatagaccctacaaaactgttgcgtttgcactggcttcctaa

SEQ ID NO: 556 - DNA, 681 bp, Xenorhabdus bovienii
  Coding DNA location: Contig name=SeqID_16845; Position on contig =41733..42413bp; Strand=+
atgaactccataataattaataggttacagcgtaagctgggatatacctttatacagcatgatttgttacttcaggcgctcactcatcgtagtgccaacagtaagcataatgagcgtctggaatttcttggcgactcaatcctgagttttgttattgccaatgcactttatcaccgttttccccgtgttgatgaaggggatatgagccgtatgcgggcaacactggtgcgaggcaatacgctggctgaactggccagagaatttgagttaggtgaatgtctgcgtttggggccaggtgagttaaaaagcggtgggcatcgccgcgaatctattttagcagatagcattgaagctttgattggggctatttttctggatagcgatattcagacaattgaaaggattatattgagttggtatgaaactcgcttgaatgaaattagcccgggcgacaagcaaaaagatcccaaaacacgtttacaggaatatctgcaagggcgtcatttgccgttgccatcatatctggttgttcaggttcgtggggaagcacacgatcaggaatttacaattcactgtcaaatcagtggatttgaacaacctgttagaggagtaggttccagccgtcgcaaggcagaacaggcggctgcggaacaagcattaaaacaactggagcttgaatga

SEQ ID NO: 557 - DNA, 906 bp, Xenorhabdus bovienii
  Coding DNA location: Contig name=SeqID_16845; Position on contig =42410..43315bp; Strand=+
atgagcgaagaaaaaaactattgcggatttgtggcaatagtcgggcggcccaatgtcggtaaatcgactttattgaatcagttactgggccagaagatatccatcacttcccgtaaaccccagacgacgcggcatcgtattatgggtatccatacggaaggggtttatcaagccatttatgttgatacaccggggcttcacatagaagaaaagcgtgctattaaccgtttgatgaaccgtgcagcgagcagctcaattggtgatgtggaactggttattttcgttgtcgaaggtacacactggacagcagatgacgaaatggtcgtgaataaactgcgtaatttgcattgcccagtgatattggctattaataaagtggacaatgtcacggataaagccatccttctgccccatatcggttttctcagcaagcagatgaatttccttgatgttgtgccgattagtgcagaaaaaggcatgaacgttgatactattgccaaaattgtgcgtgctcatatcccggaagctggacaccatttcccagatgattacattactgatcgctcacagcgttttatggcatcagaaatcatccgtgaaaaactgatgcgttttctgggtgatgaactaccttattctgtgacagtggaaattgaacaattcgttaccaatgaacgcggtggttacaccattcacggtttaattctggtagagcgtgaaggccagaaaaaaatggttattggtaataaaggcagcaaaatcaagacgattggcatagaagcccgtcaggatatggaaaagctgtttgataataaagttcatttagaactgtgggtaaaagtgaaagcgggttgggctgatgatgagcgagcgctgcgcagcctcggttacatcgacgacttataa

SEQ ID NO: 558 - DNA, 738 bp, Xenorhabdus bovienii
  Coding DNA location: Contig name=SeqID_16845; Position on contig =43325..44062bp; Strand=+
gtggacggctggcagagagctttcgtacttcatgggcgcccttacagcgagaccagtttactactggatttctttactgaaaatgaagggcgggtacgtgttttagcgaaaggtgtacgccgtcgtcgctctcatttgaaaggttgcctgcaacctttcaccccgttgcttgttcgttggagtggacggggtgaaatcaaaacattgcgggatgctgaccctatctcattagcgcttcccttgacaggaagtgtgctatacagcggtttatacgtaaacgagctattatccagagttcttgaacaaggcgcggcatatcctgcacttttctttgattatcttcaatgtttacaagttcttgcggcaagtgaatgcacgcctgaatatgctttacgtcgttttgaactcgccttgctaaccaatatgggatatggagtagactatcttcattgtgcaggtagtggtgaacctgtgtcagatacaatgacttatcgttaccgtgaagaaaaaggctttattgccagcctggttgttgatcacttcagttttactggtaatgaactaaaagcgttggcagccggtgaatttactgattctctcaccttgaaagcagctaaacgttttactcgcattgcgctgaagccttatttgggggggaagcccttaaaaagtcgtgaattatttcgccaattcgtacctaaaaaaactgatacccctaatcagcaaaatgaaaattaa

SEQ ID NO: 559 - DNA, 753 bp, Xenorhabdus bovienii
  Coding DNA location: Contig name=SeqID_16845; Position on contig =44110..44862bp; Strand=+
atgttattacaggagttaaaaatggctgaggtattattaggtattaacattgatcacattgcaacggtacgtaatgcccgcgggacacagtatcctgatccagtacaggctgcatttgttgcagagcaagcaggagctgatgggatcaccgttcacctgcgtgaagatcgccgccatattactgatagagatgttcaactattagcaaaaacgattcaaacccgtatgaaccttgaaatggcagtaaccgatgaaatgattgatattgcttgccaaatcaaacccgttttctgttgtttggttcctgaaaagcgccaagaagtgacaacggaaggtggcttggatgtattagggcaaaaagtgcatattgctgctgccgttaagcgtttatcggaagcaggtatttttgtttccctgtttatcgatgcagatcaccagcaaattgacgctgcggctgaagtgggagcgccatttattgagatccacacaggcgcgtatgcagatgcagaaaatgatacccagcaggaacaagaatttctgcgtattaaagaagctgtgacttacgccgctggtaaaggcatcaaagtaaatgcaggtcatggtttgacatatcataatgtacagcgtattgctgccttacctgagatttatgaattaaatatcggtcatgccatcattggccgtgccgtattcagtagtttgcctgctgctgtggccgatatgaaaacgttgttgcgggaagcgcgccgttaa

SEQ ID NO: 560 - DNA, 381 bp, Xenorhabdus bovienii
  Coding DNA location: Contig name=SeqID_16845; Position on contig =44862..45242bp; Strand=+
atggctattgttgggttaggcacagatatagttgaaatttctcgcgttgaggaaattgtcgagcgttctggtgaacgcttggcaaaacgtgttctaagtgacagagaatggcaacaatatcagcagcataaccaaccgattcgtttccttgcaaagcgatttgctgttaaggaagctgccgcaaaagcgctgggaacaggtattcgaaatggtctggctttcaatcagtttgaagttattaatgatcccttgggaaaacctacattaaaacttcatggtgaagcagaaactctggctgacaaactgaatgtaagatccctgcatgtcacattagcggatgaacggcgttatgcctgtgcgacggtgatattggaaagttga

SEQ ID NO: 561 - DNA, 261 bp, Xenorhabdus bovienii
  Coding DNA location: Contig name=SeqID_16845; Position on contig =45245..45505bp; Strand=-
atggcgctattaattaccaaacgctgcatcaattgcgatatgtgtgaacctgaatgtcccaatcaggccatcacaatgggcgcagaaatttatgaaattgactcagaacgctgtactgaatgcgtcggacactatgaaaaaccaacctgccagtccgtctgcccgatcaccaatactattattcttaaccctgaccaccaagaaactgaagagcaactgtgggataagttcgtgctcttacatcatgcagataagatctaa

SEQ ID NO: 562 - DNA, 102 bp, Xenorhabdus bovienii
  Coding DNA location: Contig name=SeqID_16845; Position on contig =45565..45666bp; Strand=-
atgacaaaaactccagagacacacagaatcgaaagatattatcacaatcattcacaacaacttagttggaagaaggcctataattattggggatttttttga

SEQ ID NO: 563 - DNA, 897 bp, Xenorhabdus bovienii
  Coding DNA location: Contig name=SeqID_16845; Position on contig =45665..46561bp; Strand=+
atgaaactaagctcttttacggaaataatattaccggataattatcacactcaagattttttggcttttcatcacagagatgaaaagggtgtttctgaaatagtgcaacaaagtcgaatgaaaaagggaattatttggcacggaaatccggctttactgactgtatctattgataaacaccgggcgcagatccagcttgaggttgatggtgatgacgcacatcaatcagagaaggctttatccacactagcttcacatatgctgggattgttgcagcctgttgaagaatttgaatctatgtatcaagctgatccggttattggcgagttggttaccaggcaggcggggttacgaatttatcagtcagcaacaccttttgaagcactcagttgggcaattattggtcagcaaattagcttaaatgcggcaatttctattcgtaggcgatttattcaggctattggcgttaaacattcttcaggattgttgtgtcatccgactcatgagcaaataattcagtgttcagaacacgatctacgccagtgtggtttttctgtcagtaaagccaatgcgttgctgaatgttagccaattaattgattcggctgagttaaaattagccataacagaaggtgaaattaaacggcttacggataatctgctcgccattaagggaattggcatgtggacaatcaattacgctttgttgcgcggatttaattatttaaatggttcactacatggcgatgtggctgtaaggcgcaacctccaatatttactcaagcagggagacaaggtcaacgctgagcaaacagaagcatggctgtcagagttttctccttggaaggcacttgtggctgcacatttatggaggcagcagtccagtagtgggtattga

SEQ ID NO: 564 - DNA, 135 bp, Xenorhabdus bovienii
  Coding DNA location: Contig name=SeqID_16845; Position on contig =46572..46706bp; Strand=-
atgtccgttggtaagggagaatcgatttatcttctcgaccctgacggacatcaacttgaaatccatgttggttcccttgcaagtcgccttaatacattacgtaaaacaccttacaaaggattagagtggtattga

SEQ ID NO: 565 - DNA, 105 bp, Xenorhabdus bovienii
  Coding DNA location: Contig name=SeqID_16845; Position on contig =46693..46797bp; Strand=-
atgctgacagaccttaaccatctgacactgacaacctcaaatcttgagcacagtctcgatttctatataaacctgttagggtttactccccatgtccgttggtaa

SEQ ID NO: 566 - DNA, 648 bp, Xenorhabdus bovienii
  Coding DNA location: Contig name=SeqID_16845; Position on contig =46841..47488bp; Strand=+
atgttatttttttcaccatttgaagatctagctcaacaacttttgcctattgcagtagaaggtgatgatggcgctcatgatattgcccatttgcatagagtatggcgaaacgcgaagagaatttgtgaggttgttgaatctggaaatttacagtgggtattggccgcagttttattacacgattgcgtcagcgttgaaaaaaatgatcccaatcgacatcttgcttctcatatggccgcagaaaaagcggcattgatactgaaaaatttagggtggggtggagaagatatcgctgctgtttgccatgccattgaagctcatagtttctcagccggtttaactcccagaacattggaagccaaaattgtacaggatgctgatcgattggattccattggaatggttggtgtagctcgttgtttttatactgccggccgtatgcgctctgcactgtatgattttcacgatcctctggcaaaacaccgtgaatataatgacactgcttacacgcttgatcatttttataccaagctattcaaaatagaatctggctttcaaacggaaacgggcaggcaaatggctcgtgagaggacagaacgcatggaacactttcttgaggcttttttgaatgaaattcaggttacataa

SEQ ID NO: 567 - DNA, 132 bp, Xenorhabdus bovienii
  Coding DNA location: Contig name=SeqID_16845; Position on contig =47514..47645bp; Strand=-
gtgcctgcattgccagttccattgcccgacgcatccagtattcatcactatatatttctgcactatatatctctgtcactacaggttctcttacttatgaaaatctcgctaattataactattagtcattaa

SEQ ID NO: 568 - DNA, 480 bp, Xenorhabdus bovienii
  Coding DNA location: Contig name=SeqID_16845; Position on contig =47612..48091bp; Strand=+
atgcgtcgggcaatggaactggcaatgcaggcacaatctcatggcgaaattcccgtaggggctgtactggttgccgataataaaattattgcagaaggctataatcatccgattaccgagcatgatcctactgcccacgcagaaatcattgccctgcggcgtggtggaatcgaattgcagaattaccgtctgttaaatacgaccctatacgtcactctggaaccctgtgttatgtgtgcaggcgcgatggtgcatagccggatacagcggctggtatacggtgcaagtgatatgaaaaccggtgcagccgggtcattgattgatatcctacggcatccgggcatgaatcatcagattgaaatcactggtggcgtattggcgcaagaatgtgccacgatgttgagtacgttctttaaacaacgcagagaacagcataaggcattgaaaaaattaaaaatacaacagcaggaaacgccataa

SEQ ID NO: 569 - DNA, 1551 bp, Xenorhabdus bovienii
  Coding DNA location: Contig name=SeqID_16845; Position on contig =48120..49670bp; Strand=-
atgctatatttcacatttcatacggaacctaccgcactgacaagagataactatttgagcaatatcaagataaattattttgtcatcgtcattatcgcgctcctctctgctgcaatcattggcctcaatatcagttggcccaacaaacagcaggagcagataaacaggattctggcacggggagagcttcggattagtaccatcagttcccctctgatttctgcgaacagcaaaaatgaagcaacgggattcgactatgaattagccaaacggtttgctgaatatctaggcgtaaaacttgtcattcattttcgcactaatattaaccagatttttgatgacttagacaacgataacgcagattttctggctgctggtcttatctataatgaggaacggctagatcaggcacgcactggccctgcctactactcagtctcacagcaattgatttaccgtaagggtacaccccgcccacgcacgtttggcgatttaaatggcacactggttgtcactgagggatctgcccatgccagagaactgaaaaaatataaagaagagtcttatcccaatttaacttgggaagatacatcacgcgataatacacgagaattacttgagcaggtgtccgaaggtaaaattgactatacgatcagcgattcgatcagtttttccctgcaacagcgtattcatcctaatttggcctttgcttttgaagtaaatggggaacgtcctctgacttggtatttgaagcgcagtgatgactatagcctttactctgccatgctcgattttttcaatcagatgtcagaaaacgatgtgataccacagctggaagaaaaatatttcagtcatatctaccaattcgattattttgatactatttcattcattcgcgctatcaatagtacattaccgatatatcagcctatttttgagaaatacgctggctcacttgactggcagttagttgcagccatcgcatggcaagagtcacattggaacccgcaggcaacctcgcccacaggcgttcgcggtatgatgatgcttactcgcccgaccgcagaatgggtcaagatcagtgatcgacttgatccggaggaaagtgtaaaagggggtatggcttatctgcattatctgatggagcggttgccgaaaaccattcctgaagatgaacgtatctggttcgccctagccgcttataacatgggttatgggcatattctcgatgtccgaaaactcacagcagaacaaaaaggtaaccctgaccgttggcgggatatcaaatctcgccttgatctgttaagcaagaaaaaattctataccaacacaacatacggctatgcccgtggctatgaagcgtatcgctatgtcgaaaacattcggcgttattatcagagtctggaagggtacttgcgagcgaaaaataaacgcagcaagaaagcagagcatgaaacaccaatagataaggtcatcgtgcctctttcagatggagaaggaaataaagccgtggttaatgaaaaaacgccggaagtcaaaacaccgacgtaa

SEQ ID NO: 570 - DNA, 102 bp, Xenorhabdus bovienii
  Coding DNA location: Contig name=SeqID_16845; Position on contig =49621..49722bp; Strand=-
ttgcacatcccagttttgttacgcaaaatgctcaattactggaaatttaaccatgctatatttcacatttcatacggaacctaccgcactgacaagagataa

SEQ ID NO: 571 - DNA, 3906 bp, Xenorhabdus bovienii
  Coding DNA location: Contig name=SeqID_16845; Position on contig =49863..53768bp; Strand=+
atgagagaacctattactatggaaattctgcgtggatcgcccgctttatcagcgtttcgtattactaagctcctttcccagtgccaagatcagcagcttcccgttacagagatttatgcagaatatgtgcattttgcagaaattcattcgcctatcacaggaaatgagcgggagaaattaaatcggttattaaaatatggcccctttttggatgaacatgaacctaaaggtcaactattgctggtgactcctcgtccgggcacgatatctccctggtcatcaaaagcgacagagattgtgcacaattgtggcctgaaacagattgcccgtttggaaaggggaattgcctattatatccagagtgatgaaatgagcgatgggcagtggcaggagctgtctgcgttactgcatgatcgaatgatggaaagtgtgttcactcaacctgaacaggctgaagctctgttttctcaccaagagcctgcaccactgaaacagatcaatatcttgcagtcagggcgtgctgcattggaatcagccaatattgaattaggattggctttggcagccgatgaaattgattatctgatgagagcctttcggacgttagggcgcaacccgaccgatgttgaactctacatgtttgcgcaggcgaactctgagcattgccgccacaaaattttcaacgcagattgggttattgatggtcaggaacaacctaattcactgttcaagatgatcaaaaacacgtttgaacagacgccggattatgttttctctgcttataaagacaatgcagccgtgatggaaggttcgccggttgggcgctttttccccaatcgtgaaagtggtgtgtatgattaccaccaagagcctgcccacatattgatgaaagttgaaactcataaccatccaaccgccatttctccttggcccggtgcggcaacgggatcaggcggggaaattcgggatgaaggtgcaacagggcgaggtgcaaaacccaaggccggattggtcggtttttcggtatctaatctgaaaattcccggatttgaacaaccgtgggaagaagatttcggtaagcctgatcggattgtcagtgcgctggatatcatgctggaaggcccgttgggaggtgctgcgtttaacaatgaatttgggcgtccagcgttgctagggtatttcagaacttatgaagaaaaggtgaattcccataatggcgcagaattgcgtggttatcacaagcccatcatgttggcgggtgggatcgggaatatccgtgaagaacatattcagaaaggcgatatttctattggcgcgaagttgatcgtactgggtggcccaagcatgaatatcggtttgggtggcggtgcggcttcctcaatgacatcaggccaatctgatgcggaactggattttgcatcagtgcagcgtgacaacgcagaaatggagcgccgttgccaggaagtgatcgatagctgttggcaattgggggataaaaatccgatcctgttcattcatgatgtgggggcgggtgggttgtcaaatgcgatgcctgagttagtcagcgatggcggccggggtggtcgctttgagttgcgtaacattctcaatgatgagctggggatgagtccattgcaggtatggtgcaatgagtctcaggaacgttatgtcatggcagtggcaccagaacaacttgcactgtttgaggacatttgtcgtcgtgaacgtgctccgtatgcagtgattggagaggcgacagaagaacgtcatttgctactgaatgacaatcatttcgataatcaacccatcgatatgccgctggatgttttactcggcaagacgccaaaaatgctgaaaaatgtggtgacactgaaagcgcagggtcataatttggaacgcagaggtattgatttagctgaagcggtaaaacgagtcctgcacttaccggcagtggcagagaaaacattcctgattacgattggcgatcgttcaatcactgggatggttgctcgtgatcaaatgattggcccgtggcaaattccagtggcggattgcgctgtcactacggctagtttggacagctattatggtgaagcgatgtcaataggtgaacgtgcgcctatcgctctgttgaattttgcagcatcggcgcgtatggcggtcggggaagcgctgaccaatatcgcctctgcttatgtacaagatctgaaacgggtgaaattatcggctaactggatgtcagcatcaggccatgccggggaagatgccggattatatgctgcggtaaaagcggtgggcgaagaactgtgtccggcgctgggattaacaattcctgtcggcaaagattccatgtcgatgaaaacttgctggaaccaaaacggtgaagagcgtgaaatgactgcaccgctttcattggttatcactgcatttgcacgggtggaggatgttcgttacaccgtgacaccagagttatctaccgatgatgacaacgcgctgctgctgattgatctggggcaagggcaaaatgcattaggagggacggcactggcgcaagtttatcgtcagcttggtgacaaaaccgcagatgttcgcagtactgagcaactcgcaggtttctttaatgcgattcagcaattagtttcagaacaaaagctgctggcctatcacgatcgctccgatggtggcttgttggtgacactggcagaaatggcttttgcgggtcattgtgggctgcgtgctgatatcagtgcattcgatgaagatattttggcagcactgtttagcgaagaattgggcgcagtgattcaaattcgtcagaccgacagagaacaggttgaaaaactgctggctgattatggcctgagcgaatgcgtacactatttggggcaggctcaggcgggagaggatttcgtgatctccagcaacgatatggacgtctatcgtcaaaatcgcagcacattgcgcttatggtgggcggaaacgacgtggcagatgcagcgcctgcgtgacaatccagagtgtgctgaccaagagcatcaggcgaaacaggatttgaacgatcccggcttgaatgtgaagttaaccttcgatccggcagaagatattgctgcctgctatatttcgaaacaagtgcgtccgagagttgcagtattgcgcgaacaaggtgtgaactcccatgtcgaaatggcggctgcattccatcgtgcgggttttgacgctgtggacgttcacatgagtgacttgctgagtgggcggattacgctggatcaattccagacattggttgcctgtggcggcttctcatacggtgatgtactgggtgcgggcgaaggttgggcaaaatctattctgtttaattcacaggtacgggatgattttgcgaactttttcgcaagaccggatactttagcccttggtgtatgtaacggctgtcagatgatctccaacttacatgaattgattccgggcactgaacattggccgcgttttgtacgtaatcgttcagaacgctatgaagcacgtttcagtttagtggaagtggcggatagcccttcactgtttttgcaaggaatggctggctcccgtttgccaattgcggttgctcatggtgaagggcaggtggaattcaggaatagccagagcttggctgaattggaaaaacaccagcaggttgcattacgttttgtcgataactatggtctggcgacagaaaactatcctgctaacccgaatggctctgtgaacggcattaccgctgttaccagccttgatggacgagtgacggcgatgatgccgcatcctgaaagggtattccgtactgtcagccattcttggcatcccaaagagtggggggaagacggcccatggatgcgtattttccgtaatgcgcgcaaacagttgggctaa

SEQ ID NO: 572 - DNA, 207 bp, Xenorhabdus bovienii
  Coding DNA location: Contig name=SeqID_16845; Position on contig =53836..54042bp; Strand=-
ttgttgcaatatggagacacttcaattgaattgcatcaactccagtttctattggcacgtacgatagatgattatgtgagttcacatagtgagtaccatagccgcagcattcttttgcagaactggtgcagtgagggcttacgaaacatttgtaagcaacactcctcattgctaaatcacaaaacccgcgtaaagcaggtcttgtga

SEQ ID NO: 573 - DNA, 276 bp, Xenorhabdus bovienii
  Coding DNA location: Contig name=SeqID_16845; Position on contig =54089..54364bp; Strand=-
ttggacggtaggcaccttacttcggcatcattctgggcttatgtggcatatttccacctaattgtggacctacataaaaagttgaatgagcaactgccctttattatgcatattgcatgccaactttcaaataaaaacactaatagattgattttattgaaaataaaaataacatcctcatacactcggctttgtgatgaatattttttgatatcaattatgtatttttgtcgccaatttatgacacttaaccatataaaattattttatcaataa

SEQ ID NO: 574 - DNA, 111 bp, Xenorhabdus bovienii
  Coding DNA location: Contig name=SeqID_16845; Position on contig =54369..54479bp; Strand=+
atgatactcgccttcgggccttatcaaactacgggcgacacgtggagtgaggcaccacctacatgctcatcaagcagtatgaagggtactcactggcgggatagtagataa

SEQ ID NO: 575 - DNA, 105 bp, Xenorhabdus bovienii
  Coding DNA location: Contig name=SeqID_16845; Position on contig =54501..54605bp; Strand=-
ttgttactttttctagtttttgaaaatagtggattgttgagagctatgcgggtgcatatacaaacggatgcctacatgaacacgatggacaggagttatctgtaa

SEQ ID NO: 576 - DNA, 1476 bp, Xenorhabdus bovienii
  Coding DNA location: Contig name=SeqID_16845; Position on contig =54643..56118bp; Strand=+
atgtcggttagcatcaatgtaattacaggttatgagatgatttctttgaataaatggcgtttatttccccgttcattgcgccaattggtgttaatggctttctggctggtgctattgccactcttagtactggcttatcaggcttatcaaagtcttgatcaactcagtactcaagctgccgaaattaaccgcacgactttggcagatgcccgccgtagcgaagcgatgataggcgtagcccttgaaatggaacggagctaccgccagtattgtgtattgggggatgccaggcttgaaaagctctatcaacgtcaataccgacagtacctcaacatgcttggcaatcagatgatgatgctggctaataaggaatataccgagaggtttaatcaattactgtccggtcttgccaaaatttcctgtagtaatggcatgccagaaccggcggcaaacaagcggcttgaacaattttccacagccaataatctcctggtgcaagaaacccgtaatatcatcttcattcgtggtgagcaactacaaaaagatattgcagacaaagggcagttatttggctggcagagcctaattttattcctgttgagtgcttttttgatcaccctttttacccgtatgattatcgggccggtgaaaaggatcgaaagtatgattaatcggctgggggcggggcaaacattggataatcagattgaatccttccaggggccacgggaattgcgatcactggcgcagcgtattatctggctgagtgaacgtctgtcttggcttgagtctcagcggcacgaatttttacgtcatatctcccacgaattaaaaacgcctcttgcgagtatgcgtgaaggcacagaattacttgcagatgaaatagcagggccactgacggcagatcaaaaggaagtggtgagtattctggacagcagcagtaaacatttacaacaactcattgaacagctgctcgaatataaccgcaaattggcagatagctctgtcgagcatcagattgtatctttaaaagaaattgtcgatagcgtcgtattgtcacatcagctgccagcacgtgcaaaaaatattaatactgaaattcaattggatacatctttttgttgggcagagcctaaactattgatgcgagtgattgataatctctactccaatgcagtgcactatggtgctgaatccggtaacatctggatttccagtcggcaagtaggtaaaaatattcagattgacattgctaatacggggacgcctatccctgaattagagaaaagcatgattttcgagccattttatcaaggaaagctgcaacgcaaaggcgcggtcaaaggaagtggtcttggcttgagtattgcgcaagattgtattaaacagatggggggagaactgcatctgatagaacccgaatttgctgacgtatgttttcgaattgaactgccattaaccgcagagaatgactaa

SEQ ID NO: 577 - DNA, 876 bp, Xenorhabdus bovienii
  Coding DNA location: Contig name=SeqID_16845; Position on contig =56124..56999bp; Strand=+
atgtataacaggtttacttaccgttttatgacgaagacggagcagcagaatattgtgattcaaccgatgaaaaaacctgctgtcatgcagcattttcttgagcgggcttcagccctgcgtttccgtgccataatactattgtttattccctacttgctggcaggatgcgccgaaactaccggaaatgatgagttattgacaatagcccaagctattatgccagaacagcgggttacggattaccgacttaagggatgtgatggaatatgggatattgtcaaaccagcggcaatggaaaacggtctttattggttgaaggtgatggattgcacggatcgattatcctcgctggaagctcgcgatgctgccaaacgttttacgccgactgcaccgactgattgggggcacgttttcaaacagagtatcttgatgagtcgagccactcctacgctgactgaacgtcgcaaaattgtagaaaacctcaaccgatatagtccacaatctccgtccgcattgcggccactactgcaattgtggcgcgaacagcaatatttgaagattaaccttgcagaagaaaggttgaaattccagcgactgcagtttgatagtgacagtaaaattgatcgactgaaagaaatacgggcacgtttggagcatgatcttcgttcaatctcccgcaaactggaaaacttgactgatattgaacgccagctttcctcacgcaaacaagatcagagcagtgttgccacatcgggtgaaaccgagcatttaggtaacgtagaatcctctgagcaattaaagccggaagccaagccagaaatgaaccagaaaaccgaatcagaagccaatctcccagaagaaaaaggagctgaataa

SEQ ID NO: 578 - DNA, 1338 bp, Xenorhabdus bovienii
  Coding DNA location: Contig name=SeqID_16845; Position on contig =57002..58339bp; Strand=+
atgaccgtgcgcaatcccgcccgtcttcttttagttgatgatgatccaggcatactaaaactattgggaatgcgtctgaccagcgaagggtttcgtgtcacgacggcagagagtggtcatgaagcgttgcgtctattggcgaaagaaaaagcggatttagtcatcagtgacttacgcatggacgagatggatggcatggcattgtttgcggaaattcagaagcagcaccccggtatgccagtgattattctgaccgctcacggttctattcccgatgctgttgcggcgacacagcaaggtgtatttagtttcttgactaaacccgttgatcgtgacgccctttataaagccatcgatgctgcgttggaactgtcaaaaccggccatagatgggcagtggtgcgaacagattgtaacgcggagccccttaatgctgcgtttgctggaacaggcaaaaatggtcgctcaatcagatgtcagcgtcctgattaatgggcaaagcggaacgggtaaagaagtgttggctcaagctattcatcgggtaagccctagagtgaagaaaccttttattgcgatcaactgtggcgctttgcctgagcaattgctggagtctgaattattcggccatgccaaaggcgcatttactggtgcggtcagcagtcgagaagggttgtttctggcggcgcagggaggaacgttattccttgatgaaattggtgacatgccactggcactgcaagtcaaactcttgagagttttgcaggaacgcaaaattcgtccattggggagtaaccgtgatatagacattgatgtcagaattatttccgccactcactgtgacttaccaaaggcgatgcagcgcaatgagttccgcgaagatctctactatcgactgaacgtcgtcaacatgaaaattcctgcactgaatgaacgggctgaagatatccctttactggctaatcacctgttacgtgcatccgccaaacgccataaaccttttgtccgcagtttctctactaatgcgatgaaatgcctgatggcagcaagctggccgggcaatgtacgtcagttggtcaacgttatcgagcagtgtgtcgcactgacgaccgcaccggtgatcagtgatgcactggtcatgcaggcgctggaaggggaaaacacggcattgccgacatttgtggaagctcgtggccaatttgaactgcattacctgcgtaaactgctgcaaatgaccaaaggcaacgtcacccatgctgcccgtatggcaggacgtaaccggacggaattttataaattgctggctcgtcacgaattggatgccaacgattttaaggaataa

SEQ ID NO: 579 - DNA, 1653 bp, Xenorhabdus bovienii
  Coding DNA location: Contig name=SeqID_16845; Position on contig =58415..60067bp; Strand=+
atgaattatggcccaggagagccgcaatctatgagtcgtactcttaatatcgttcttgcccagctaaattggctggtgggagacattgaaggtaacagcaaacgtatgttgcagacagtacaggaacagcaggaaaaaggtgctgatctggttatgttttctgaattggcgctgtcaggctattttcctgaagatctactgttccgtgctgatctgcatcaacgttgccgtgaacaattggtacgtttgcaggaggcaagctctcaggtcgctattctggttggtcatccgtggcaacaggacggtaagacttacaacgcactttctctgttttggaaaggcgaagttattgctcgttatttcaaacaattactgcctaactatggcgtttttgatgaagagcgttatttcaaagcgggtgatcaaagctgtgttgtaccattcaaaggctataatcttggtttattaatctgcgaagatttgtggtttgatgcaccaattgacgcgttgaaacaagcaggagcggatatcattctttcccttaacgcttcgccttataaccgggaaaaaccgaatattcgtagcacattgattcaatcgcactgtcagcgaactcaattgccaatcatctatctcaatcaggtggggggacaagatcagctgatctttgacggttgctcgaaagtctttgatgcaaatggcaaaattacccatcggatggcggcttttgaagagcaggttgagcagtgccgtttcaatgagatgaatattgagccaatggcaaatttgatccctcaattgtcgccgcttgcacaaatctacaaggcactagtgctttctgttcgtgattatgtgcagaaaaattgttttaaaggtgcattgctgggtttatcaggcggaattgactctggcctgacactggcgattgcggtggatgccttgggtaaagatcacgtacaggctgtgatgatgccattccgctatacctccgaaatgagtattcatgatgccagagaacaagcggaattattgggtgttgaatttgatgtggtatccattgagccgatgtttgatgcgtttatgacgcaactcgaaccgatgtttgcggggacagaaaaagacacgacagaagagaatttgcaggcacgctgccgtgcagtcattctgatggcgatgtcgaacaaacgccgccgtctggtactgacgaccagtaacaagagtgaatcggcggtagggtattcgaccctgtatggcgatatggcgggtggctttaatgcattgaaagacgtccctaaaactatggtatttgcactgtcgaaataccgtaatacagtatcccctgccattcctcaacgtgtgattgatcgaccaccatccgcagaactggcacccgatcaactcgatcaggatagcttgccgccatatgacatgttggacgctattcttgaaggatatgtagaaaaagataaatccgtggctgacttagtggcagaaggttttgacgaagccattgttcgtaaggtgatccggttggttgatatcaacgagtataagcgccggcaggcacctatcggcccacgtattacagagcgtgattttggtaaagacaggcgctacccgattacttctggtttcgggcgtaaaaactggtaa

SEQ ID NO: 580 - DNA, 339 bp, Xenorhabdus bovienii
  Coding DNA location: Contig name=SeqID_16845; Position on contig =60083..60421bp; Strand=+
atgaaaaagattgatgcaattatcaaacctttcaagctggatgatgtgcgtgaagctctggcagaagtaggtatcactggtatgaccgtgacagaagtgaaaggatttggtcgccagaaagggcatactgaactatatcgcggtgcagaatatatggtggattttctgccaaaggtcaaaatagaaattgtggtaccggatgatattgttgatacctgcgtcgaaactatcattcagactgcgcaaacgggcaaaatcggcgatggtaaaattttcgtctttgatgttgctcgtgttgtgcgtattcgtactggtgaacaggacgaagaagcgatttaa

SEQ ID NO: 581 - DNA, 1191 bp, Xenorhabdus bovienii
  Coding DNA location: Contig name=SeqID_16845; Position on contig =60505..61695bp; Strand=-
atgctggatagccaagttatcgctaccgtaaaatccaccatcccactgatcgtttctaccggcccaaaactgaccgcacatttttatgaacgtatgttcaaacacaatcctgaattgaaagatattttcaacatgagcaaccagttaaacggagctcagcgtgaagcgcttttcaatgctctttgtgcttacgcttccaatatcgataatttacaggcgctattacctgccgtagaaaaaattgctcataaacataccagcctgaatattcagcctgagcattatcagattgttggcactcacctgctggcaacacttgatgagatgtttcatccaggcgatgaagtcctgaatgcatggggtaaggcttacggggtattggcaaatgtctttatcaatcgagaagaagagatttatcaaagaggtgaatctgaggaaggcggctggcgtggattacgtcaattccgtgtcaacaagaagcaaccacagagtgacgttattaccagcttcgagtttgtgcccgctgatgggggtaaggtcatagattacaaagcaggacaatatttaggcatctacctggacactcccgcttttgaaaaccgtgaaatacgtcagtattcactgacaacagcaccaaacagccacagctaccaaatcgctattaaacgtgaagcacaaggcaaggtatcaaactatatgcatgataatgtgcaggaaggcgataccatattactggcagcaccacgcggtgactttttccttgatgtccaaccagatacacccgttacactgatttctgctggtgttgggctgactccgatgatgagtatgctgcaacatctgcataatcaataccatgtcggtacagtgaattggttccatgccgcagaacatggtggttatcatgctttcgcagataaagttaatgcgattactcaatctatgcccaatctgcatactcaagtttggtatcgtgagccaagaaacgaagatcaacaaggcgcagattaccagcatatgggactcatggatttatctgtcgtgaaagattcaatctctgaggaaggtatgcaattctatttctgtggccccgtcgtattcatgcaatatatcgcccaacagctcttggcaatcggcattgataaacaacatattcattatgaatgttttggcccacataaagtactttaa

SEQ ID NO: 582 - DNA, 168 bp, Xenorhabdus bovienii
  Coding DNA location: Contig name=SeqID_16845; Position on contig =61615..61782bp; Strand=+
atgtgcggtcagttttgggccggtagaaacgatcagtgggatggtggattttacggtagcgataacttggctatccagcataggaagctcctgaatttttctcaaatagcgttgaaatttataacatgcattttaaatacaacttatggcttttggcaatgtttttaa

SEQ ID NO: 583 - DNA, 126 bp, Xenorhabdus bovienii
  Coding DNA location: Contig name=SeqID_16845; Position on contig =61813..61938bp; Strand=-
ttgataaaaaccctaacgcaaacgattgtttatagccacgacacatactcagccgatagttcacccataatcatatttgtgacgttagtcagaccttgtagtaatacaaaccctcctctcgattga

SEQ ID NO: 584 - DNA, 924 bp, Xenorhabdus bovienii
  Coding DNA location: Contig name=SeqID_16845; Position on contig =61969..62892bp; Strand=-
gtgcatgacacgattgcccggatcatttcctgtattgaacctcgtcaattccagccatgctttatcggctggatgcagacggtgaatcaactcactgaaggcagtttaatcgcaattgatggtaaaacattacgcgcctcttatcaccgtgaagagcggcgttcaaccatccctatggtgagtgtgtttgccatagaaaacaagagggtactggggcaacaaagaacatcatcaaaatcgaacgaaatcaccgcaatacctgagttgttggccttacttgatatccgtggctgtcttatttctattgatgcaatgggctgtcagacaaagattgcccgacagagagttgagaaagacggtgattatttactggcggtcaaagacaatcaccccacattggcaaaagcggtcatacaaaggctgtctgaaagcacggcagagaaaagcaaacaggaggatgtccattttgaatacgctcatggccgtaccgaagcccgtgaatatcatggactcccagcaggaaagctgacgcagcagtttccagaatggaaagggttgaaacgcatcggtgtcgcattaggctatcgaatggataaatcagggaaagaatcactggaatatcgctactacatcagttcggctgcgctcaataaagaacaattcaaacaggcaattcgtagtcattggcttatcgaaaatagcttacattgggtactcgatgtgacgataaatgaagatacctgccggatttaccgggagaatgcggcagaaaacatagcctatatcagacatatagcactcaatacactgcgcaaggaaaagtcccagctcagtacacgcagaaaacagaagaaaacctggatgcaggtagattatgccgtacaggtattggaagttggtttcgaacaggtgggtaaaaagtaa

SEQ ID NO: 585 - DNA, 198 bp, Xenorhabdus bovienii
  Coding DNA location: Contig name=SeqID_16845; Position on contig =62808..63005bp; Strand=-
ttgtaccttgtcccgtcatcgccggagccgaaggctggcagaatattgaagactacggcaacggtcaccttaaaggctttcaaaagaaagggctgctcaaaaccggtatccctgtgcatgacacgattgcccggatcatttcctgtattgaacctcgtcaattccagccatgctttatcggctggatgcagacggtga

SEQ ID NO: 586 - DNA, 96 bp, Xenorhabdus bovienii
  Coding DNA location: Contig name=SeqID_16845; Position on contig =63044..63139bp; Strand=-
atgattttatacgctccttttcgggagaatccctatggatatcgacgcattttcactgcatttcggtcaaatagaagacagaaggccgtcatttaa

SEQ ID NO: 587 - DNA, 108 bp, Xenorhabdus bovienii
  Coding DNA location: Contig name=SeqID_16845; Position on contig =63191..63298bp; Strand=+
ttgccctggtctattccgttagataaaaacggtttatactgtatgatattccgaccctcaggggtattttttagagatgtagctgaattaggaaaagtatgtaaataa

SEQ ID NO: 588 - DNA, 480 bp, Xenorhabdus bovienii
  Coding DNA location: Contig name=SeqID_16845; Position on contig =63329..63808bp; Strand=+
atggctaattcgatatatttaacaattaatggctctaagcaaggcttaatttcggccggttgttcgacttatgactcaattggaaataaatatcaggaaggacacgaagatcaaatttttgtctattcgtttgatcatgatatatcacgagatcaaaatgttagccatttacccgttataattacaaaacctattgataagtcatctcctttgttaggtgtaactatttctgataacgaaaaaattgattgtgttttagatttctatagaactagtcaatccggtggagctgaaaaattttattccataaaattgcgaaatgcttttataaaacatatatctgttcattatcctaattcattaacacattcagatgcgcaaccttatgaaaatattactatttcatatgaaagtataacgtggcaacatcatatagccggtacttcaggatatagtatacatgaggatattgtttattga

SEQ ID NO: 589 - DNA, 438 bp, Xenorhabdus bovienii
  Coding DNA location: Contig name=SeqID_16845; Position on contig =63870..64307bp; Strand=-
atgatattaaacataaaaaaagaaataaaaataatattttccatcattctaattctatttatactcatagttggtatattatcaatatttttgatactaattactgccaatgaaaattatacagaggagaattatataaaatatcttatcttcacgacagatgaaataaaaaactcacccagaatatcaaataattacattataatgtatagatctatggatggtaattcaccacaaattaatgaaattacctatataaatactaaaaacaagaaaaaaatagaagagtatgtcaaatcaattggctatatttttattgaaaaaaatgattttggagaaaaatggcaagattctaacgatcattaccgaacaatatacataacggaaaacccagacgagaaaaaaattacacttagtgtggagtattctcaatattga

SEQ ID NO: 590 - DNA, 696 bp, Xenorhabdus bovienii
  Coding DNA location: Contig name=SeqID_16845; Position on contig =64304..64999bp; Strand=-
atgagtaaacgtaaagacataatcgatggatcattagcaggttcaaaaagaagtggattagtttataccgaattattgggttggatagatttgggtcatgccagaggtgatgatattaggaaaattcttgccaatatggaatctggtgataaagataatcatccttattatgaggttgtatatactcaatcaatgggagcatttagcggtagatttgcaacttcaaagttcactaaatggagagtaaaaaaaggattatctttacaagacagatacagtattgcactcactatgatgatgaaaacagcatatttatttgaatcatatcaaagcagatggtttttcaattggtatacagacagtgggtttagtagtgaagattttatttctgatttattaggtttttatcgcgtggttaagcctatgaattatttttcaataataaaaccagtaagcaaaaatgatgctttacgacgttgggattattatggtgaaataggcaagtataaaaacagatcatttaacccattgatttttcctgatcctgataaattacctaataatgccagaccctattatgttgaattaccaggtttcatgaaagcaatatcacctatgaaatatttcactacagataaatttgaaatcataaatggagatggcactgatttcaaattttggttcataaccatatga

SEQ ID NO: 591 - DNA, 144 bp, Xenorhabdus bovienii
  Coding DNA location: Contig name=SeqID_16845; Position on contig =64966..65109bp; Strand=+
atgatccatcgattatgtctttacgtttactcatttgattatcacctatttaaattgttactttattttttggataatagtgccagaagtggtttactaatcttacttttggctgtgtctaatggaattttaaagagattttag

SEQ ID NO: 592 - DNA, 120 bp, Xenorhabdus bovienii
  Coding DNA location: Contig name=SeqID_16845; Position on contig =65120..65239bp; Strand=+
ttgtctgtttttgacaattattcagtcaacatctcaatatcaactataagaagaaaccgtctggttagttttgcttgtaatgctgtaaacatttatcggttaggtattttctattgttaa

SEQ ID NO: 593 - DNA, 150 bp, Xenorhabdus bovienii
  Coding DNA location: Contig name=SeqID_16845; Position on contig =65371..65520bp; Strand=-
ttgcatgcagatggcaacaaggtatcaggactgggtatctggtcatacgagttactgatttccaatttgttattgatatttgtgaccttagtcagaccttatggtgatacaaatcgcttttccatcaacacagaatgtagcagtgtttga

SEQ ID NO: 594 - DNA, 138 bp, Xenorhabdus bovienii
  Coding DNA location: Contig name=SeqID_16845; Position on contig =65475..65612bp; Strand=+
atgaccagatacccagtcctgataccttgttgccatctgcatgcaatcgtttgcgtaaaatatcctgtcaaggctatctcatttgataaaaagagtttacactgtgtgacattctggccctcaggggtatttttttag

SEQ ID NO: 595 - DNA, 1254 bp, Xenorhabdus bovienii
  Coding DNA location: Contig name=SeqID_16845; Position on contig =65639..66892bp; Strand=+
atgttaaagcgtgaaatgaatattgcgaattacgatcccgaactgtggcaagcgatggaacaggaagttcgtcgtcaggaagaacacattgaactgattgcttctgaaaactacaccagcccaagagttatgcaggctcaaggatctcaactcaccaacaagtatgcggaaggctatccgggtaagcgttactacggtggctgcgaatatgttgatgtggttgagcagcttgcaattgaccgtgcaaaagaactgtttggtgcagattatgccaacgtccagccacactccggctctcaggcaaatgcggcagtatacatggctctgttgaaaccaggcgacaccgttttaggaatgaatctggctcatggtggtcatcttactcacggttctccagttaacttctccggtaaactctataacgtagtcccttatggtattgatgagagtggcaaaatcgattacaacgatatccgctctcaggcacacaaacatcagccaaaaatgatcatcggcggcttctctgcctactccggtgttgttgattgggcgaagatgcgtgaaattgccgatgaaatcggtgcctatctgtttgttgatatggctcacgttgctggcttgatcgcggcaggtgtttatccaaaccctgttcctcatgctcatatcgtcacaacgacaacgcataaaacactggctggcccacgtggcggcctgattttagcgaaaggcggcgatgaagaactgtacaaaaaattgaactcttctgttttcccaggtggccagggtggcccgctgatgcatgttatcgcgggcaaggcggttgcactgaaagaagcgatggaacctgaattcaaaacatatcagcagcaagtggctaaaaatgccaaagcaatggtcgatgtgtttttagagcgcggttataaagtcgtttcgggtgggactgaaaaccatttgttcctgctggatctggtggataaggatattacgggtaaagacgctgatgctgcattagggcgcgctaatatcacagttaacaaaaacagcgttcctaacgatcctcgcagtccatttgtgacttctggtatccgcattggtactcctgcaattacccgccgtggcttcaaggaagcagaaacttgcgaactggctggctggatgtgtgatgtgctggataacatcaatgatgaagcgatcattgaaaacgttaaacaaaaagttttggcaatctgcgctaaatacccggtttacgcataa

SEQ ID NO: 596 - DNA, 1254 bp, Xenorhabdus bovienii
  Coding DNA location: Contig name=SeqID_16845; Position on contig =66969..68222bp; Strand=+
atggggggtttgatggttgttccatcgacattttggctggggttaagttatttcacttactttttttcttttggcatctttttgccattttgggcggtctggttgaaaggagagggaattgagccagccatgatcggaatattgttgggagtaggcttggttgcccgtttcctcggtagtatgttcatttcacctacggttaaagatccttcaaaattaatcattgcattgcgattattgtcactattggcgctgctctttgccattggttttgcgtttggtagccattgggcatggattttctctgtcatgataggtttcaacctattcttttcgccactggttcccttatcggatgccttagcgggaacgtggcaaaaacagtttacttttgattatggcaaggtgcgggtctgggggtctattgcctttattatcagttcttcgctaacaggtatattgatgtcttccaatggcatcaacttctcaatcagcaatttagaattgagtatttcttttgacagaataaataattgggttggaagcaatctgtttggccatcaccctatcattcttgccttcttgattttcagcctttctgtcatgttactgggtatgatgttaaaaccatccattatgcctgcgggtaaaatcaaagccgtaaatactcatacggtatcgtttaaagaactgctgtctgagaagtctgtatggcagtttttattgtgtgtcaccttattacagggggcgcatgcgggttattatagcttcggttccatttattgggaaaatgcaggctattctccagcaactatcggttatctctggtcgctgggcgttgtgacagaagtcattatttttaccttcagtaagcagttgttccgtcgttggaatgcccgtaacttactgttgctctctgctatttgtgggattctccgttgggggctgatgggcacatcaactgaattgccagtgctgatcatcatccagctcctgcattgcggaactttcacggtttgccacttggcggctatgcgttttattggcgccagaaaagaaaatgaaattattcgtttgcaggcaatttactccgggttggcgatggggggaggtattgccgttatgagtgtgattgctggcttcttatatgaatatatgcaaaatggcatctattgggttatggcgttagtggcatttccggtgcttttcctgaggcctaaagcagaagcacgagtgtatccattacctaagtaa

SEQ ID NO: 597 - DNA, 771 bp, Xenorhabdus bovienii
  Coding DNA location: Contig name=SeqID_16845; Position on contig =68293..69063bp; Strand=-
gcgcgtaaagccggcaattacattgccaaaagctacgaaacacctgatgccgtcgaagctagccaaaaaggcagcaacgattttgtaaccaatgttgatcgtgaagcagaaaggctgatcatcgatattatccgtaagtcttatcctaagcacaccattatcactgaagaaagcggtgagcacttaggtgaagaagacgatttccactgggtgatcgatccactggatggcaccaccaactttattaaacgtcttccccattttgctgtttccattgctgtgcgcatcaaaggccgtaccgaagtggctgtagtttatgatccaatgcgcaatgaattgttcagctcagcccgtggtcaaggcgcacaattgaatggttatcgtctgcgtggcaccaatgcccgtgatctggatggcactatccttgccactggtttcccattcaaggcaaaacagcacactaccccttatattaaaatactgggcaaattatttgatcgctgtgcagacttccgtcgcactggctctgctgctctggatatggcgtatgttgccgccgggcgtgtagatggtttcttcgagattggtctgaagccttgggattttatgggcggcgaattgctggtgcgtgaatcgggttgcatcgttaccgattttgtcgggggtcacaattatatcaactccggtaatatcgttgcaggtagcccgcgtatcgttaaagacatgctgtctgaaatgcgtgaagaattaagtgaagcattaaagcgctga

SEQ ID NO: 598 - DNA, 711 bp, Xenorhabdus bovienii
  Coding DNA location: Contig name=SeqID_16846; Position on contig =12..722bp; Strand=+
atggaagcttcagacggtatcatggttgcccgtggtgatttgggtgttgagatcccagtagaagaagttatcttcgcgcagaagatgatgatcgaaaaatgtaatgcagcacgcaaagttgtcatcactgcaacccaaatgctggattccatgatcaaaaatccacgccctacccgcgctgaagcaggagacgttgccaatgccatcttggatggcactgatgccgtgatgctttccggtgaaagtgcaaaagggaaataccctatcgaagcggtttctatcatggcaaccatctgtgaacgtacagatcgcgtcatgagcagcagaattgaaattaccaaagcccaaaaactgcgcgttactgaagcagtctgtcgtggtgcagttgaaattgcagaaaaactggaagcacccctgattgtcgttgcaacctatggtggcaaatctgcaagatctatccgtaaatatttccctaacgcgcctatcctcgctctgactaccaatgaaatcactgcccgacaattgctgttggtcaaaggtgtttccacacaaattgtcaaagagatcgcctctaccgatgacttctatcggattggtaaggaagcagcactggcaagtggtatggccaataaaggtgatgccgttgtaatgatatccggtgcgttagtaccaagtggtacaacaaatacttcttcagtccacgttctataa

SEQ ID NO: 599 - DNA, 237 bp, Xenorhabdus bovienii
  Coding DNA location: Contig name=SeqID_16846; Position on contig =685..921bp; Strand=+
gtggtacaacaaatacttcttcagtccacgttctataaatttgcaccacgcccaatcatgaataagctgcccagacattgggcagtcttgttagcgatgttaataactataaataagatccaaatttggtttatatccaaatggatctttttatatttctatgccatatcattatcattatcattatcattatcattatcattatcattatcattatcattatcattatcattataa

SEQ ID NO: 600 - DNA, 141 bp, Xenorhabdus bovienii
  Coding DNA location: Contig name=SeqID_16846; Position on contig =947..1087bp; Strand=+
gtgagaaaatttatccacaggttccagtacaaaaatacttactgtttttatctatttggatttagagcaaacattcactatatggcaataattctcattaattcattggtagcttcaatgctttctctgtggttaaaataa

SEQ ID NO: 601 - DNA, 99 bp, Xenorhabdus bovienii
  Coding DNA location: Contig name=SeqID_16846; Position on contig =1326..1424bp; Strand=-
ttgcgacttgaacaacccgctaacagagtggaagccagaattactgccccaaatacaactttagtaccattcatcacaataccctctagattaagttaa

SEQ ID NO: 602 - DNA, 147 bp, Xenorhabdus bovienii
  Coding DNA location: Contig name=SeqID_16846; Position on contig =1361..1507bp; Strand=-
gtgaacagcgctgaggtcatttctcaattggtcaactttagaacccagagtgttaacctgagtggcaagttgttcaactttagttgcgacttgaacaacccgctaacagagtggaagccagaattactgccccaaatacaactttag

SEQ ID NO: 603 - DNA, 111 bp, Xenorhabdus bovienii
  Coding DNA location: Contig name=SeqID_16846; Position on contig =1524..1634bp; Strand=-
atggcgtaccttacttggtacgccatttttgttatctgctgcaagattatttcttgtaggaacgcacttggttatcaaggcgcttattcgcacgagctgcttcctctttag

SEQ ID NO: 604 - DNA, 111 bp, Xenorhabdus bovienii
  Coding DNA location: Contig name=SeqID_16846; Position on contig =1609..1719bp; Strand=+
atggcgtaccaagtaaggtacgccatttttatattcgctgatccatttgttcatctcaaaaatcgattacaaataccccctaccccaagtcaggataatggttcagcctga

SEQ ID NO: 605 - DNA, 1035 bp, Xenorhabdus bovienii
  Coding DNA location: Contig name=SeqID_16846; Position on contig =1734..2768bp; Strand=-
atgaagcgatttttgacttttatcggtatgtccttgatcggtatgttatcgttaagtggtgcgatcaatatagcccatgcgatggagtatccattgctaccaactaacagtcgcctgattggtgagaacgccatctatgttgtatctgatgatgggctttcgctggaagccattgccgccaaataccaaataggtttgctggccatgctggaggctaatcctggcgttgatccttatctgccgaaaccaggcaccaagctgattattccatcacagatgctgcttcccgatactcctcgtcaaggtattatcattaatctggcggaatttaggctctattatttccccaaagggaaaaattatgttgtcgtctatcccattgggatcggtcagcttgaacgtgatacaccgacgatgacaacgtctgtcagccagttgattaaaaatccaacatggacaccgaccaccaatattcgtaaagattatgcgagtcgagggattattttgccaacagtagtacctgctggggcggataatccgatgggggattttgccttgcgtttggctgctggccgtggagaatatttgattcatggtacgaatgcgagttttggtattggtatgcgtgtcagttcgggctgtattcgcttgcgccccgatgatattgaggatttgttttatagcgtgccacgaggaacccgtgttcaggtaattaatgaaccaatcaaatatacagtggagccaactgggaagcgttacgtggaaattcatcagccactgtcagataaacagaccgatgaccctcagactaggccgattcagcgcactgagggattggtaaaattcatcaataatcgtgaaacagacgctgttcttgttgatcaagagattattcgacgttcaggaatacctgtgctggtgaatacaggtattgttttatccaatcaggaagagcaagaagtttcaaggccgattgagattcgtgaagaagccacttatggtgttaacccagttgaattgccgccattaaattag

SEQ ID NO: 606 - DNA, 102 bp, Xenorhabdus bovienii
  Coding DNA location: Contig name=SeqID_16846; Position on contig =2821..2922bp; Strand=-
ttgagtgacattagcgcgtatagtgtgcatggaagaatgcgtatttttattttgttcggatttctccttgatttccgtaaaggtgatagaagagtctcttaa

SEQ ID NO: 607 - DNA, 414 bp, Xenorhabdus bovienii
  Coding DNA location: Contig name=SeqID_16846; Position on contig =3044..3457bp; Strand=-
gtgatttggaaacgtactacagatgtgaacgcgcttaatcaatttaatagcaagtgcatgctagaacatgtgggaatagaaattacccagattggtgacgattttattgaaggaacaatgcctgtcgatcaacgtactaaacagccgtttggtctattacatggcggggcatctgtggtgctggctgaatcgctcggttctcttgcagggtatctctgtttggagggtgaacagaaagttgtgggagtagagatcaatgccaaccatatcaaagcggtgagtaaaggtgttgtcaaaggtgtttgtaaacctgttcaccttgggcgctctcaccaagtctggcagattgacatctataatgaacggcaacagttatgctgcacatctcgcctgacaaccgcagtcttgtcatag

SEQ ID NO: 608 - DNA, 3072 bp, Xenorhabdus bovienii
  Coding DNA location: Contig name=SeqID_16846; Position on contig =3454..6525bp; Strand=-
atgatcccacgtataccacaagccccccatgtcagtgaactggcacaggaatatttgactgcactgaaggaagttggctttacaggcgatactgccagcagttatgccgacagattgaccatggcgacggataacagtatttatcaattattgccacaagcggttatctttccgcgctccagcgctgatgttgctctgctggcgagagttgcaggagaagaacgtttttattccctgacatttactcctcgcgggggaggaacgggtaccaacggacaatcacttaataatggtattgtggtggatatgtcccgttatatgaaccgcattcttgagatcaacccagaacaagggtgggttaaagtcgaagccggtgtcatcaaagatcaactcaatcaatatctaaaacctttcggttattttttctctcccgaattatcaaccagtaaccgtgccacgttaggcggcatgattaataccgatgcttctggtcagggatcgctggtttatggaaaaacgtcggatcatgtacttggtgtccgcgccgttttattgggtggggaaatgtttgatacccgtcctatgagtacgttattcgcggaatcgattgctcaagaagaatccgtcattgggcggatctataaaacggtgcttgaacgttgccgtgagcgacggaagttaatcgtcgaaaaattcccgaagctcaatcgttttctgaccggatatgatttgcgtcatgtttacagtgatgatatgcaaacatttgacttgacccgaatcttgactggctctgaaggaacattggcttttattacggaagcaacactggatattacgccattgccaaaagtcaggcggttggtgaatgtcaaatatgattcctttgattcggccctgcgtaatgctcctttcatggtggaagccaaagcgctttcggttgagactgtggattccaaagtgctcaatctggcgcgtgaagatatcatctggcactcagtgaaggaattgattacggatgtcgctgataaagatatgcaggggctgaatatcgtcgaattcagtggcaatgatgaacagcaaattgaccagcaggtttatgatctttgccagcgccttgatgaattgatgggggaaaaccagaccggcatcattggttatcaaatttgccatcatttagtggatattgagcgtatttatgccatgcggaaaaagtctgttgggttactcggtaacagcaaaggggccgccaaaccgattccatttgtcgaagatacctgtgtacctcctcagcatcttgccgattatatcactgaattccgtcagctccttgatagccatcagcttaactatggtatgtttgggcatgtcgatgcgggcgtcttacatgttcggcctgcgctggatatgtgtgatccacaacaggaaatcttgatgaagcagatttccgatgaaattgttcgtctgacagctaaatatggcggcttgctatggggagagcatggcaaaggttttcgggcggaatacagtccggacttttttggcgaaattttgtatgacgaattgcgtcggataaaagcggcatttgatccgctgaatcgtcttaatccgggaaaaatctgctcaccgattgacattgacgccccaatgatgaaggtagatgcggccaagcgcggaacttatgaccgtactatccctgttaatgtcagaacggcatttcgtggggcgatggaatgtaatggtaatggactatgcttcaatttcgatgttaaaagcccaatgtgtccttcaatgaaggtaagtcaacatcgcattcactctcctaaaggcagggcaacgctggtcagagaatggttgcggcttctgactgagcaggggatggaccccaagttgttggagcaggggcttgatcaagcgcgtcctagcctgcgggggctgattgacaagacgctctatagttggcaggcgtggcggggtgaatatgatttctcgcatgaagtgaaagaggctatgtcaggctgtctggcctgtaaagcctgttcgacacagtgcccaattaagattgatgtaccttcatttcgttcgcgttttctggcgctttatcacagccgttatctgcgtccgctgcgtgatcatattgttgccaatgttgaaaacaatactccgttgatggcaaaggtgcctcaggtatttaacttttttttgaaacgaccatgggtacagaaaatcagccagcacaccattggtatggttgatttaccgctactttcctacccaacactgcaacagcagctttcagaccactatgcagcaagaacgacactggaacagctcgaaactctgtcacaatctcaacgtaagcagcatgtgcttatcgtccaagatcctttcacgagttaccacgatgcgaaagttgtcgctgattttgtgcgattgaccgaaaaactaggatatcaacctgtgctgttaccgttttcacctaatggaaaagcacaacatgtcaaaggattcttgactaaatttgccaagactgccgagaagacagccaattttcttaatcgagtagatcgtctgaatattcctatggtgggagttgatcctgcgctggtgctgtgttaccgagatgaatacaaagatatcctcggtgagcgacggggtaactttaacgtccaattggtgcatgaatggctcatgagtattctgccagagacaccatcacaagagaaacgtgacggttcaacatccagctatgactggtatttactggggcattgcacagaagtgacagcgttacccaatagcggtaagcaatggacggatattttccgtcattttggctgtcaattgaacaatgtcagcgtgggatgctgtggtatggcaggtacatatggtcatgaaaaaaagaatattgataactcgatcggtatctataaactttcatgggctccggcgctggacaatcttgttctggaacgttgtctcagcacaggctattcatgccgtagtcaggtgaaacgcatagaaggacaagtagttaaacatccattacaagccttattggagataataccgtga

SEQ ID NO: 609 - DNA, 1110 bp, Xenorhabdus bovienii
  Coding DNA location: Contig name=SeqID_16846; Position on contig =6732..7841bp; Strand=+
atggaaaaatcgcaatcacgccaggatttacccaaactgctatttgtgctgttctttattctactgctcatcgcgacctgcttttgggtcttaagtccatttgtcctggggttcatttggtccggaatggtcgttattgcaacttggccattattagaaaaattacaacaacacctatggggaaaacgctggattgccgtttctattatgacattgctgctagttttattatttgttatcccgattgcattattggtcagtagcttgctggaaaacagcacgccattgattgagtgggcaaaatccccctcgacgtttcagttgcctcaattagagtggctcagccggattccagtcataggcgaagatttgtatattaaatggcaggatatgattgctgatggcagcaacattcttctcaccaaaatcccaccctatattggtaaaacagcaacatggttttttacccaagcggccaacgctggtcgtttcctgttccatctcgcaattatggtactgttcagtgttctgctttattggaaaggtgaacaggtcatgttaagtatccgtcattttgccatccggctggcagaccaacgtggtgatgcagtcgtactgctggctgcccaatctattcgtgcggttgctcttggtgtggttgtcacggcactggtacaggcaatcgccggtggaattggattagcaattgcaggcattccctatgcaatgatactgactgtattgatgtttatatgctgtgttgcccaactggggcctctattggtgctcgttccgtctatcgcgtggctttattggacaggtgaaacaacttggggaaccattctcgttatctggagcctggtcttgaccacaatggatggcgtgcttcgtcctttccttattcgacttggggcagatttgcccatggttttaatactcacaggtgtaatcggtggcatactttcattgggtttgattggactatttattggtcctgttgtattggccgtctcttatcgcttactgctagcatggatgaatgaagttcctaaacctgaaaataagacagaagacactgaaaaatacttcaaaaaagatcatatagaataa

SEQ ID NO: 610 - DNA, 177 bp, Xenorhabdus bovienii
  Coding DNA location: Contig name=SeqID_16846; Position on contig =7863..8039bp; Strand=-
atgagtttattcattaagaatcctcttaataaatgggagttggaaaagaaaaacgagggatataacttttttgcaacaaattacatggtttttttattaacctttgggtatgaatttatatttgtgataaaactgggagtttatattcatcaatatgataattgcgcgaaaaaataa

SEQ ID NO: 611 - DNA, 189 bp, Xenorhabdus bovienii
  Coding DNA location: Contig name=SeqID_16846; Position on contig =8023..8211bp; Strand=-
ttgagggataacagtaaaaattccaaaaaaaaaagcctatcatgggctgacaggcaaagactacacacagcaatatttattacgttactcgctccagcttttggcgtgtataggctggagcagcaattcgtaggaaacgtttgtttcgatgaaaagaatactaatttaataaatgagtttattcattaa

SEQ ID NO: 612 - DNA, 147 bp, Xenorhabdus bovienii
  Coding DNA location: Contig name=SeqID_16846; Position on contig =8139..8285bp; Strand=+
ttgctgtgtgtagtctttgcctgtcagcccatgataggcttttttttttggaatttttactgttatccctcaattattcatccatgtcaaaaaagattgtgttacacaaaacaaaaaagcctgcaaatattccaacaggctttttaa

SEQ ID NO: 613 - DNA, 2379 bp, Xenorhabdus bovienii
  Coding DNA location: Contig name=SeqID_16846; Position on contig =8308..10686bp; Strand=-
atgtccaataatggcctcaccccatgcaatgtgctctggtataaccaattaggcatgaatgatgttaatcgagttggtggtaaaaacgcctctcttggcgagatgatcaccaatctggctgaacttggtgtgtctgtccccaatggttttgctacgaccgcacaggcatttaatgattttctggaacaaagcggcgtcaaccagcgtatttatcagttgcttgatgaaaccaatgttgatgatgttaatcaattagccaaggctggcgcacagattcgtcggtgggtgattgatacgccatttacggtacagctggaaaacgatatccaagatgcctacctacaattgtccgaaggtgaacccgatgcctcttttgctgtgcgctcttccgctaccgcagaagacatgccagatgcttcttttgcaggacaacaggaaacttttttgaatgtgcagggcattgatgccgttatggtcgccatcaagcatgtctttgcatcactttttaacgatcgggccatttcctatcgtgtccatcaggggtatgaccatcgtggcgtcgcgctttctgcgggagtgcaacgcatggtgcgctctgatttggcatcgtctggtgtaatgtttacgattgatactgaatctggttttgatcaagttgtgttcattacgtctgcctatggcctcggtgagatggtcgtgcagggggcggtgaatcctgatgagttttatgtccataaacccacgctgcaaaataatcgtcctgcgatagtgcgtcgtaatttgggatcaaagagaatacgcatggtttatgcggacagtaaagagcatggaaagcaggtacgtacagaagatctgccagatgtgctgcgcaatcgtttctctttggcggatgacgaagtagaggcgctggccagacaagcactgttgattgaaaaacattatggccgtccgatggacattgaatgggcgaaggatgggaataatggcaagttatatattgtacaagctcgccctgaaactgttcgctcaaatcaacaggtgatggaacgctatcaactcaacgcacagggttctgtattggtagaaggccgtgctatcgggcatcgtatcggtgctggtacggttaaggttattcataacctcagtgagatggatcgtatccaggctggtgatgtgctggttactgatatgaccgatccagattgggaaccgataatgaaaaaagcggctgcgattgtcaccaatcgtggagggcgtacctgccacgccgccattatcgcccgtgaactgggtattcctgctgtagtaggttgtggtgatgccactgaacgcctgaaagaagggcaagaagtaacgatttcctgtgctgaaggggatactggtttcgtttaccaaaataaattggactttagcatccaaagctcccaagtcgatgaattgccaaaactggatgttaagatcatgatgaacgtgggtaatcctgatcgcgcatttgattttgcctgcttgccaaatgaaggtgtgggtctggctcgtctggaattcatcattaaccgaatgattggcgttcatccccgtgctttgctcgaattttcccaacaaacgcccgaattgcaggaacagattaatgcgttaatggtcggttatgacaatcctgttgaattttatattggacgcttgacggaaggcgttgcgacactggcagccgcattttggccgaagcgtgtgattgttcgtctgtctgatttcaaatctaatgaatatgcaaatttagtgggtggggatcggtacgaaccgcatgaagaaaatcctatgttgggtttccggggagcgggtcgttatgtttctgatagtttccgcgcatgttttgcactggagtgtgaagctatcaaacgggtgcggaatgttatggggctaaccaatgttgaggtgatgatcccgtttgtacgcacggtaacgcaagcagaagctgtcgtggcggaattggctgtgcagggcttgaaacgcggtgaaaatgggctgaaagtcatcatgatgtgtgagattccatcgaatgcattattggcagaacagtttcttgaacattttgacggtttttcaattggctcaaatgatatgactcagttagcgttggggctggatcgcgattctggtgtggtgtctgagttatttgatgagcgcaatgatgccgtaaaacaattactttccatggcaattcaagcggctaagcgtcaaggtaaatatgtcggtatctgtggacaaggtccttcggatcatgaggatttcgctgagtggttagtgaaagaaggcattgacagtttatcgctgaatccagataccgtggtaaaaacctggatttcgttggctgaaaacaattaa

SEQ ID NO: 614 - DNA, 126 bp, Xenorhabdus bovienii
  Coding DNA location: Contig name=SeqID_16846; Position on contig =10631..10756bp; Strand=+
atgcctaattggttataccagagcacattgcatggggtgaggccattattggacattgaaactatcctttttacattcggaagtacaaatcggaaaattaaggctgttctttacagcgtaaaatag

SEQ ID NO: 615 - DNA, 102 bp, Xenorhabdus bovienii
  Coding DNA location: Contig name=SeqID_16846; Position on contig =10837..10938bp; Strand=+
atgttaaccatagttctagtttgtgataaaaacgattcagccaacaactccacaaatccgataatacaccgtcaacccaacaataaaagaaagatacaatga

SEQ ID NO: 616 - DNA, 864 bp, Xenorhabdus bovienii
  Coding DNA location: Contig name=SeqID_16846; Position on contig =10935..11798bp; Strand=+
atgacagaaaaccatatctcccaaacacaggaaaatgaaactctggaacgcagtgtgttttttatttccgatggtacggcaattacagctgaagtactgggccatgccgtcttgtcccaatttccgcttacagtcacctcttatactctgccttttgtaaacagtaaaatgagagcagaagaaatcaaaactcagataaacgcgatatatctagaaacacagcttaagccactggttttttattccattatttcggatgaagtaaaaagtatcatcacaagcagtgacggtttctgtcaggatattgtccagacactggtggctccactgcaacaggaaatcgggctggaacccaagccagaattacaccgtacccacggtttatccaaaaagaatctggggcaatatgatgctcgtattgcagccattgattatgctctcgctcacgatgatggcgtttcattacgtaatcttgaacaggctcaagtgattattctgggcgtatcccgctgcggtaaaacccctaccagcctctatcttgccatgcaattcggtattcaggcagcaaattatcctttcaccgcagacgatatggacaatctacaattacctgccgccttaaagccctttcagcataagttattcggcctgaccatcagcccagaaagacttgctgctattcgagaagaacgacgtgaaaatagtcgttatgcctcattgcgacaatgccggttagaacttgctgaagttgaagcactgtttcgtaagaataaaattaactatttaaataccaccaattattctgtcgaagagatttcaaccaaaattattgacagtatgggattgaaacgccgcatgttctga

SEQ ID NO: 617 - DNA, 123 bp, Xenorhabdus bovienii
  Coding DNA location: Contig name=SeqID_16846; Position on contig =11751..11873bp; Strand=-
atgacatttgcacgagaaagtatcgtgcaaagatattgtgaaaaaagtaccgtagaaaatgctggggtttcgagatcagaacatgcggcgtttcaatcccatactgtcaataattttggttga

SEQ ID NO: 618 - DNA, 1047 bp, Xenorhabdus bovienii
  Coding DNA location: Contig name=SeqID_16846; Position on contig =11965..13011bp; Strand=+
atgcacaaaacagatgaattaagaacccgtcccattggtcgtttgattacacccaaagcacttgctgagcaatatcctatatcagaaaaaatcctgcaaaatgtgacattgtcacgcaagcgaattgaatccattcttacaggcaatgacccgcgtttactggtcattattggcccttgttcaatacacgatgttgatgcggctcttgattatgccgcccgcctgcaagtattgcgtgaaaaataccagcacagcctggaaatagtgatgagaacctatttcgaaaaaccccgtactgttattggctggaaagggttaatttcagatcctttgttagatggctcctgtcaggttaataaaggaatctctctcgcccgtaagctattaaatgatattaatgaactgggtatgccgacggccactgaatttctggatatggtcacagggcaatatattgccgatttaattagctggggagccatcggagctagaacgacagaaagccaaattcatcgggaaatggcatctgccctgtcatgccccgtcggatttaaaaatgggacagacggaaatacgcatatcgccatcgatgcaatacgcgcagcacgtgccaaacatatgttcttgtctcccgacaaagatgggcagatgactatttaccaaaccggcgggaatccccatgggcatatcattatgcggggtggtaaaaagcctaactacaaagcagaagatattgctgccgcctgccagaaattacatgaatatcaattaactgaacgcctgattgtggattgtagccacggtaactgtcaaaagatccatcgccgccagctagatatcgcgaaagatatcggccaacaaattcaatcgggttcaacatctattgcgggtgtcatggctgaaagtttcttggtagaaggtactcaaaaagtagtacatggagaacctttaacctacgggcagtccattactgatccctgtcttggctggcaagataccgaacaatttatcaatactctggccgaagcggtcaaaaatcgtacttga

SEQ ID NO: 619 - DNA, 150 bp, Xenorhabdus bovienii
  Coding DNA location: Contig name=SeqID_16846; Position on contig =13181..13330bp; Strand=+
ttgactatggaaaaattagcttactgccagtgctaccacgcaaatctcctgcaacagcagattcttcttgagctattcagtgatcccgtaaaaaacgattgtactggtgtgccgacagtcagaaattattgggataatcacgtaccataa

SEQ ID NO: 620 - DNA, 114 bp, Xenorhabdus bovienii
  Coding DNA location: Contig name=SeqID_16846; Position on contig =13353..13466bp; Strand=+
atgccattacgccagaccaaaactcgtagctttattcgaacaaataaaatcccagcaaactcgcctgatcaatatcgtggtgatgggttatttttgtgcacaaaacaccgttaa

SEQ ID NO: 621 - DNA, 2112 bp, Xenorhabdus bovienii
  Coding DNA location: Contig name=SeqID_16846; Position on contig =13435..15546bp; Strand=+
atgggttatttttgtgcacaaaacaccgttaaattatggagattaacctgcatgacctcaattaaattaccaaacctgaaattatcttcattaagtgtggtcattttgactgggttatcttctgctcacgcaacaacaattcctgctgaagaaaatacatcatccaaagatactttgactgtttacgcgactggcaatgaacgcgatagttttgaagcacctatgatggtaacagtcattaaaggaaactcggccaacaatagagttgcaggtaatgcccatgacttactgcgtaaccttcctggaattaacgtttctggttctgggcgcaccaatgggcaagacattagtatgcgcggttattctaaaaaaggtgttttaacacttgttgatggtattcgtcagggaaccgataccgggcatctcaatggtttatttctcgatccaagcctgattaaacaagtcgaagtcgttcgtggtccatccgccctactttatggcagcggtgcactgggaggcgttattgcctaccagacagttgatgcagccgatttattgcaagagggaaaaaatactggctttcgtgttttcagtcgtgcagcaacaggtgatcatagtctgggatttggtggtgctgcatttggtaagacagagcaacttgatgggttatttgcattcagtacccgtgatgttggcaatattcgctatggtaacggcctaaccggtcacaacgatgaaaccattggtaatatgctggcaaaagggaaatggaatatcaatgatagccaatcactcagtagcgaactccgctattaccgcaatcagtcccatgagcctaaaaacccgcaagctatcacagataatgctaaaaacgataacccgagagcggatcgcaccacgacacaacgtgatgcacaactgacttatcgactcaatccggcggaatacaactggctgaataccaaagcggatatctattattccgacgtcactattaatgcaaaaaccaaagagaaaggttttgaaggccgcaaacaagaaacttacggcgttaaattagagaaccgttcacatctgggtgtaaacactttttcagttcatcaattcacgtacggtggcgaagcttacaaacagaaacagaagccaaacggcaatacagaaagtttccctgatgccgatatccgttttgcatccggctgggttcaagatgaaataaccctgcgtgatttgcctgtttcactcatcgtcggtacacgttacgacaattacaacgcttcaaatgctaaatatgacgatatcagtgccaataaatggtcatcaaaaggcgctgtcagcattacgccaactccttggtcaatgttatttacttcctattctcaggcatttcgtgctccaaccatgggtgaaatgtataacgattctaagcacttccacatgccacccatgagaggaaagccgggattcacgaattactggaaacctaatcctaacctgcgtccagaaagcaatgaaactctggaatctggctttgggctacgtttcgatgatttattctccagcaacgatgagttgaaattcaaagccagttattttgacactcaagcgaaggattacatcacttccatcgtgacaatgccggatatgagatctacaacgtcaatcaatatccctaaaaccaaaatttggggttgggatgcttcaatgagttatgaatcaaattggttctcatggaatcttgcttacaaccgaacaacgggaaaaaacgaagaaacaggagaatctatcgccgacctcagtcctgatactctgaccagcatgctagatatccctctatctaacaccggtttttcccttggttggatcggtaaatttactcaacatactcagttcagaggggttaatggtgacaaaaatgagcgcggtcagaagctctctcaatacgcaggctacggagtcaatgatttctacgtcagttatcacggcgatggaaaattaaaagggctaacaacttctgtcgtacttggaaacgcgttcgacaaagaatattactcgccattgggtgcaccacaggatggtcgcaacggtaaactgttcatcagctaccagtggtag

SEQ ID NO: 622 - DNA, 1074 bp, Xenorhabdus bovienii
  Coding DNA location: Contig name=SeqID_16846; Position on contig =15620..16693bp; Strand=+
gtgaatcagtcactttatgaacgttacctacaggccaaagcggataacaaagctaaatatgcacgtgatctcgcggcttatctcaatgtcagcgaaggagaattattgcatagtcgtgttggtatcgacgcaaaacgtttgagcgttgatgcttctgccctgcttcaagaactggtaaccgtcggcgaaactaaagccattacccgtaatgattttgccgttcacgaacaggtaggccgttatgaaaatacgcagttcagcccgcatgttggtttgattctcaacccacgagaacttgatctgcgactattcttcgaccattgggccagcgttttctctctggttgaacccgccaaaaatggcctgcgtcacagtattcaattctttgaccgccaaggtgatgcgctgcataaagtgtacacgaccaaagataccgatatggctgcatgggaagccttgatcgaaaaatatcagaccgatgagaatccagctctggaaattcaacctgaaaaagcatctgagcacaaagaagtcacagaacaactgaaagctcagttggatgaagaatggcgtgctatgactaacgttcaccaattctttatgatgatgagccgtcataacctgaaccgtcagcaaattttcaatgcagtcggtaatgatctggcctaccgtgttgaaaattcatcactgactaaaatcgttgaaaccgcacataacgatcaaaatgaaatcatgatttttgtcggaaatcgtggctgtattcagattttcacgggcaaactggaacgtctgatgccttatcaggaagaaaattcccctcagaaatgggtcaacattttcaatcgtgatttcactttgcacctgattgaaagtgctattgtagaaagctgggtaacacgtaagccaacaacggatggttttgtcaccagtcttgagctatttgatgccgaaggcaaccaaatagctcaattgtacggccagcgtaccgaaggtacgcctgaacaggcacattggcgtaagcagattgccgcactgcctaaactggaatcagaaaaggaaacttgtatagtatga

SEQ ID NO: 623 - DNA, 819 bp, Xenorhabdus bovienii
  Coding DNA location: Contig name=SeqID_16846; Position on contig =16690..17508bp; Strand=+
atgaaaaagtggcttctaacatttatgcttgccacctctggcaatgcattctctgctgagcgcattgtcacaattggtggtgatgtgtctgaaattgtttttgcactaggcgaaggacagcacgttgtcgcaagggatagtaccagccaaaaccctaaggcattactctcactccccgatgtgggatatatgcgaatgctgaattcagaagggatcctatccatgcgcccatcactggtgatagcaagtgaatcggcgcaaccatctctagcacttaagcaagtcgaagattctagtgtaaaagttattaaagtgaccagcgaagcctcgttagaagccgttcctgaaaaaattttgaccgtcgcgaaggcggtcaatcaggaaaaacgcggtgaaacgctgacctcccaatatcgacaacagttagccgaactcaacacgtcaaatattcccactaaggtgatctttatcatgagccacggcgggatcatgccaatggcagccggtcaacaaacagccgcagatcagattatccgtagcatcggtgcacagaatgccatgcagggatttaaaggatatcgtcccctatctcaagaaggtgttattgccagccagcctgatttgctgctagtcagtacagaggggctgaaaacgctgggtggcatggataaactctggcagcttccggggttgaatttcactccggcgggcaagaaaaagcaggttgttgttgtggatgaaatgggtctgcttggatttggtatccaaaccccagccgtcatgaaacaagtccgcgaggcggcggagaaagtgcaatga

SEQ ID NO: 624 - DNA, 1002 bp, Xenorhabdus bovienii
  Coding DNA location: Contig name=SeqID_16846; Position on contig =17505..18506bp; Strand=+
atgagtcgctcccgcttccccagtttcggcttgatggctctcggcttgttgctattcttgttagcaatcagttcagccaatatgggggcattgccactttcttttaaaaccctgtgggaatcctcattggatgacccacagtggcagatttggttaaatatccgcttaccgcgcattctgctggctattttggttggcggtgcgttggctgtgtccggtgccgtgatgcaggggttgttccgcaacccccttgcagatcctggcttattagggatcagtagtggtgctgcacttaccgtagcaatggtaattgttctgccttttacgctacctgccagtatcgcgttatatggccatattattgcggcttttgtcggcagtttgctggtttcattcctgatattttcgttaaataaatataaccacggtaatctatcaaaattattacttgccggtattgccatcaatgccctttgtatgtcgtttatcggtgtgttgagctatgtcagtaacgatcagcaattacgccaattttcgatttggatgatgggttcattgagccaaattgaatggccaacactgattatcgccgcatctctcattattcctgtttgtatactggcattcagtcaatcacgaaaactcaatctgcttcaattaggcgatgaagaagctcactacctaggtattaatgtccagcgcactaagtatcaattattattactgagtgccctactgattggatgtgctgtcgctttgagcggtgtcattggttttatcggtctagtgattccacaccttgtcagactacggtttggcggtgatcatacctggcttctgccaatttcagtgttgggcggagcatgtctgctgttaagtgctgatacactggctagaacattagtttcccctgcagaaataccagtaggacttatcactggtttaatcggtgctccctattttttatggttgattcttaaaccatcaggaggccgtttataa

SEQ ID NO: 625 - DNA, 795 bp, Xenorhabdus bovienii
  Coding DNA location: Contig name=SeqID_16846; Position on contig =18506..19300bp; Strand=+
atggaatcggtaatgtcggaaaatttacttgaagccagaaatctaaactatttcattgggcatcgtcagatcatcaacgatatttcactttccattcagaaaggggaaattgttgcaattattggccccaacggggccgggaaatctacgctgttacgcttattaacaggttatattccgtccaactcaggcgagtgcttgttaaaaggcgtcccaatctcccgctggccaacccagcaacttgcacgtatccgtgccgttatgcggcaatacagttctctttcttttcccttcagtgtggaagaaatcattgctatggggcgtgtgccacatgaaaacacccacagaaaaactgccattgatgaagcgattatgctgacagaatgtgaagagctgagacatcgaaattatcagcagttatccggaggggaacaacagcgggttcaactggcaagagtactggcacagctttggcatccagagccaacagaatcttgcctatttctggatgagcccacatcagcattggatctttaccaccaacaacacacattacggctggtacatcgcctgacacgccaacgtcctcttgctgtttgctgtgtactacatgatttaaatctggcggcgctctacgcagacaaaattatcctgttacacaaaggaaaactggtggcgtctggttccccgcaggatgtgctgcgtgatgatattcttaaacagtggtatcgggctgatttaggggttactcagcaccctgaaacctaccaaccgcaagtttatctccggcaataa

SEQ ID NO: 626 - DNA, 498 bp, Xenorhabdus bovienii
  Coding DNA location: Contig name=SeqID_16846; Position on contig =19393..19890bp; Strand=-
atgaagattatcaatatattattttgtgcagctttatattgtttgttgatatccccagtccgggcagatgagaaaatggttaatgcagaaaaacaacagattctttctgctgactataatatggaatttaaaaattactcttcttctgtaaatgatatcgtgatagccaaacgaagtaccgactgtatgtatgatagtggtgcagatcagataaggattgagcctggcaaccagcaaagtacccacttacaagacaacgataatttatttagtgcttgtacacttaggcctaaatgggttgagtgggcggtttctagtggctcgatgagttgtgctttgagatttgagcgtgggtttgatggaggatggtatacggtgattaaagggtgtccggatatagtcaagagcgctacttgtggagatgccgactgcaatcagaataacgtttacggaagctcatcgtatatggatataagtgtggaattgcttattcagtaa

SEQ ID NO: 627 - DNA, 111 bp, Xenorhabdus bovienii
  Coding DNA location: Contig name=SeqID_16846; Position on contig =19976..20086bp; Strand=+
atgatagttactaatagcatacgaactatcgtgattctatcagctttagattataaagaattatttttactgctatacatcaaagataaacaggtgagcaagaggttttaa

SEQ ID NO: 628 - DNA, 246 bp, Xenorhabdus bovienii
  Coding DNA location: Contig name=SeqID_16846; Position on contig =20563..20808bp; Strand=-
atggtgcggatcagatgttcatttgtttttaagcacagtgatattatagccgcgttattaattataaatgaggctgtaatgcaatcgagtttgcttaagcgagcgatggtcgatttgtcaatcgctagttccaagtctttaactgtcaggctggatcatttgctgttgtttctggtgagagtgtgcttggtcgtcgtcaggcggttgaatatctatatcgtgatacggcatggattgaggacttag

SEQ ID NO: 629 - DNA, 378 bp, Xenorhabdus bovienii
  Coding DNA location: Contig name=SeqID_16846; Position on contig =20964..21341bp; Strand=+
atgtgggaggtaaatatgttagaaagtgtcatcaacgatattgtcagatggctagaaagccagcttcaacgtactgaaggtatcaaaatagatgccattgcacataaaagtggctattcaaaatggcatttacagcgaatttttaaggaactgaaaggctgtacactgggtcaatatgtgcgtagacgtcgtctccatgaagcagcaaagtctttgcatgaagatagcttgccgattcttgatattgctttgcaatatggttttagttctcaggctacatttacccgaatatttaagaaacattttaatacaacacccgctaaattcagggcaagtgggcagttacccgagtttaagactttcttacattgcgaataa

SEQ ID NO: 630 - DNA, 102 bp, Xenorhabdus bovienii
  Coding DNA location: Contig name=SeqID_16846; Position on contig =21429..21530bp; Strand=+
atggtcaacttccctatcgttgaccatttttttgccttcatgccatgtcgggctattcactcatttcaattcgttaaccaaccagtgatacaactgctgtaa

SEQ ID NO: 631 - DNA, 1017 bp, Xenorhabdus bovienii
  Coding DNA location: Contig name=SeqID_16846; Position on contig =21489..22505bp; Strand=-
atgtctacattacgcctgttgttgtctgattctcatgatccttggtttaatcttgctgttgaagagtgcattttccgacagatgtcaccagatcagcgcgttttgtttttatggcgtaacgccaacgcagtcgtggtgggacgtgctcaaaatccgtggaaagagtgcaatacacgaagaatggaacaggatggaataaaattggctcggcgcagtagtggtggtggcgctgtttttcatgatctgggtaatacctgttttacctttatggcaggtaagccagaatataataaaacggtttccactcaaatcattctggaaggattaaaaaaagcgggcatccatgcgatggtttctggtcgtaatgacttagttttatcatcccctgaaggtgagcgtaaaatttcaggttcggcgtatcgcgaaaccaaagacagaggttttcatcatggtacgttgttgattaatgcagatctgaaccgccttgccgattatcttaatcctgatcctaaaaaattacaggcgaaaggtataacttctgttcgttccagagtgacgaatttatcggagttattacctgatatcacatatgaaaaagtgtgtggtggaattatcgaagcattttttgaatatttcggtgaagtagccaagtcagagctcatttcgccgcaggccttacctgatttaccgggatttactgacgtttttgccaagcagagcagttgggaatggaattttggtcaggcaccaacgttcagtcatacattggatacccgtttctgttggggaggaattgaactacatgtcgatattgaacacggaactattggtcgttgccagattttcactgatagcctggaacctgcgccattcgagttattggctgaaaagcttgttgatgtactgtatcaaccacaggcagttgggcaagtgattcaacaaatcagagaacaatattccttactggataaagaattacagcagttgtatcactggttggttaacgaattgaaatga

SEQ ID NO: 632 - DNA, 135 bp, Xenorhabdus bovienii
  Coding DNA location: Contig name=SeqID_16846; Position on contig =22508..22642bp; Strand=+
ttgtctccggcaaaaaacagagctttaagatatcataaagcactaccagatttgatggctaaagacggggttacatcctgcgggcttgccaaaaaacacgtcgccaatacacattatcaagggaagagcgtataa

SEQ ID NO: 633 - DNA, 465 bp, Xenorhabdus bovienii
  Coding DNA location: Contig name=SeqID_16846; Position on contig =22578..23042bp; Strand=-
ttgtttttattatttaatctattcttaattggctgtaccaatcctgtttctaaatccaatttgcctccactgcgaacggcactttctgatccaattatggtcattgctcagttaaaagagcagcttaatcaatggcacggtacaccttatcgatatggtggaatagatcggcgtggtgttgattgctctggctttgtttaccgtacatttcacgatcgttttaatatctaccttccgcgcacaacaagcgaacaaaccaaattaggcactcagattagtaaagaggatttgatgccgggcgatctggtatttttcaagacgggcagtggcgagagtggtttgcatgtaggtatttatgatatcaacgacgagttcattcatgcatcgaccagtaaaggcgttatacgctcttcccttgataatgtgtattggcgacgtgttttttggcaagcccgcaggatgtaa

SEQ ID NO: 634 - DNA, 1113 bp, Xenorhabdus bovienii
  Coding DNA location: Contig name=SeqID_16846; Position on contig =23217..24329bp; Strand=+
atggcctactatagcatagaaaaacgcccccgcgcagacggtactgtacgttaccgctgtactgttggcgtcaaatctggcggtaaatatatttacagagagaaccgcacattcggaaaacagtctcacgccaaaacatggggagctatgcgggttgctgaactggagcaaaacggggttcctacgcagaacgataccaaagagttaacagttggtgaactgctgtataaatacatcaatgatccaaatctaggcatgaaagcaggaagaactaaaaagtatgcattgaatatattgctaaatagtgacttgtcaaaactaattctaactgagctttcaatcagccatattattgaacactgtaagcaacgacattccacaggaattactcccgccactatcaatcaggatgttatctatttgtcatcggtcttaaaatcagccagacccgtctatgatatagactacacctcaaaccccgcaagtgaagctcgttcacttttaactcaaatgggattgatcggaaaaggtcagcgacgtagcagaaggccagagcgagaagagttagaaagactaattgaagcactacgcaaacggagtggtcactggaaaagtaaaattccttatgaggatatactgaatttttcaatacttacctgtatgcgtataggggaggtatgcaaaattagatgggatgatattgatgagaaacagagagctgttcttgtaagggacagaaaagatcctagaaaaaaagttggtaatcatatgtttgtccctttacttggggaagcatggaatatcgttcaaagacaacccaaatctgatagtgggcttatatttccctacaatacgttaagtatatctcagggatttcatagagcgtgcattaaactaggtattgaagacctccgctatcacgatctacgcagagagggagcaagtcgtttatttgaagctggcttctctattgaagaagttgctcaagttacaggacaccgatctctcaatgtattgtggcaggtatacacagaactgtacccgcaatcattgcatgataagtttaatagactgatgcagcagaaaaaagacgattccaccccgactacctga

SEQ ID NO: 635 - DNA, 153 bp, Xenorhabdus bovienii
  Coding DNA location: Contig name=SeqID_16846; Position on contig =24337..24489bp; Strand=+
ttgatcgaacttcggttgacaaaacagcgtcaaccaaatttaccaaatacagtcatttcgtcaaccaacctacccactggtttgctgattacattgatgggatatcacaccttaaagacgaaccaaatttggatttcaatgtttttactatga

SEQ ID NO: 636 - DNA, 108 bp, Xenorhabdus bovienii
  Coding DNA location: Contig name=SeqID_16846; Position on contig =24578..24685bp; Strand=+
ttgaggaaatctcaatacctgcacaaacaaaaggtatggtggaaatcaccatacccaaggtgggatatcacaccttgcggcaaccgtggtgatttccaccctagttga

SEQ ID NO: 637 - DNA, 129 bp, Xenorhabdus bovienii
  Coding DNA location: Contig name=SeqID_16846; Position on contig =24717..24845bp; Strand=+
ttgacccaaccattagggaaatcccaatggttactttatgtgctggacaaacgcaataaattcattgtgtttcaacgtattacttggacacaaggggctggacaaaacgagttaaccccttgtttctag

SEQ ID NO: 638 - DNA, 102 bp, Xenorhabdus bovienii
  Coding DNA location: Contig name=SeqID_16846; Position on contig =24908..25009bp; Strand=+
ttgcataccaatattatcgtcgctcaaattataagcagactgcaaatatgcagcttgattagatatcaatgggttattgccaaaatgggcattcccacttaa

SEQ ID NO: 639 - DNA, 111 bp, Xenorhabdus bovienii
  Coding DNA location: Contig name=SeqID_16846; Position on contig =25070..25180bp; Strand=-
gtgggatttctcacctttaacttttgcatggtgccggcacgcttccgtttcaaacggagatgtgaaattaactacaaggattcctttagcttaaggagttatcactcttag

SEQ ID NO: 640 - DNA, 540 bp, Xenorhabdus bovienii
  Coding DNA location: Contig name=SeqID_16846; Position on contig =25226..25765bp; Strand=-
atgaggttaattaaagtatattctgactcatatgtgtttgaagaaccgcaccagaaagtgcaagggaaaaataggctaaccatagcttgtcatggttttggccatatagacggaatatcacaagtagtgatggatgatcagtacagaaacgcagtacaacttgcgctatctatcaaaacatggacagatgttgataagttgcataatattcggcttgtttcttgtgaaacagcgaatcctgctcccaacgaagaatatttacgaataactccagacctccgtagatacccgccctggataacctcttttggttcgcaattatctctttttttgccagatattctggtaaaagcatatatggggacaattgattcagattgctcagatagtttcacttggaatttttatacaaaacatggacacgatgatactaataccatgttaagtaagtactttaagttatataagggcggtcttgaccattatcatagtgtggtgtttttgaatggcagatttcataaacaacattatatagaataa

SEQ ID NO: 641 - DNA, 201 bp, Xenorhabdus bovienii
  Coding DNA location: Contig name=SeqID_16846; Position on contig =25857..26057bp; Strand=+
atgcaacataacattcaattacatagtgagagcggcttaagacttagctggtgcgaacaatattcaacccgcaattttctgcgggttcatatccacctcattcttccacttaccccagtctcacatcccaccccccccccccaacatccgcccacaatccacccaactacccgctattctcccctattggctatttattga

SEQ ID NO: 642 - DNA, 99 bp, Xenorhabdus bovienii
  Coding DNA location: Contig name=SeqID_16846; Position on contig =26040..26138bp; Strand=-
atgtcagaaaagaaaaaactctcttggctactattttggtttttgagtccagtcaacaccccgaacgaccacattcagccatcaataaatagccaatag

SEQ ID NO: 643 - DNA, 231 bp, Xenorhabdus bovienii
  Coding DNA location: Contig name=SeqID_16846; Position on contig =26269..26499bp; Strand=+
atgagtgaattagttagcactacagttcaaaacgacaaagcagtagcagatgcaaagaataaacagaaatacttactgtctgaagctcgggttgaatcaaaaaaacaattggatattcttgagcaacaaatgcgcttaaagcagctccaatgggacatgtattgtgtcaaattgcttgaactggatttttccacagcgcctgacatcaactggcctaaaaaaccagaataa

SEQ ID NO: 644 - DNA, 444 bp, Xenorhabdus bovienii
  Coding DNA location: Contig name=SeqID_16846; Position on contig =26526..26969bp; Strand=-
atgagcaaaaaatatatttttagtgtgaacaatgaaaaatatgatccgccgtgtccggggttttggcctgtagctgaacgtgaacattacccaaacacgttcccagagagtggcgtcgaggttgatgaggctgttcatgagttgttttcgggttcatggcccagcggaaaaatgttgggctgtgatgagacgggctatccggtctgggttgataccccgcctccccccaaagaagttctgatagaacgggctgaatatcaacgacgggaattactgtccgcagccagtgagaaaattgccccgctacaggatgccgttgagttggagatggcaacagatgccgagaaatccgcattaaccgcatggcgcaaataccgggtgttgctcaatcgggtggattgcactaccgcccccgatgtcaaatggccggagccgccgaagtga

SEQ ID NO: 645 - DNA, 1128 bp, Xenorhabdus bovienii
  Coding DNA location: Contig name=SeqID_16846; Position on contig =26972..28099bp; Strand=-
atgcaaaaaatcggtgatattacaaataccgctgatggcaatggtgagtacacgaacggcaatgtcgccgcgggggtagcaccgacaatattagacgcggcgtggtttaatacaatccagcgagaaataataaacgttatatctaaagccgggatcaagttaaataaaaataatgatgcgcaattatcagaggcaatattccaattaatatctaatggcaaaattgttttgacagataacttaggtaattccagtgggttagcggccagtcaaaaattaattaatcaggttaatgaaaacgctaacacccgtctggagaaaaacgagaacggcgcggacattccgaacaagccgaagtttgtagacaacctcggtttaacgaaaaccgtggagcgggcaaataatgccctggataaaaattccgggggtgagctgttggccccggttaaattttcgggattcagaacgaacaccggttcgattgttatctcgacgcaatcagacgggaatggtgttggtgatgggcaaacgcaacttggctataacgtggggaatgattcagcaccggtatttaaccattatctgcgcgggcagggtatcacaaacattgatacattaggtgggtgtgatattcgtgagggtctgcgagtcggtaaacaagttcagccgggagatttcgggaattttgacagccggtatttgaaattatctcaaaacggtagcgatataccgaacaaatcagcgttcagaacagcattagagttgggggatgctgcactgagaaccgttggcaatgaatatacaaacattcccagtatggggtattttctggcgagcctcgggtataacggctggcaacagatcccgtcacaggacgggagcggggatctgattattcaatgggggggatttgggggttataaatatggtgagggggcaaccgtcaaatttctgcgtcccttcccccatcgttgtgtatttgttgtccctgttgccattgtgccgtgggaaaccaaaacaacaaccatagaacccgtctatctagccgaaaaatccgcgacctatgccacgtttagaaaaggcggaacggaaacgctggatggcctctacattgcattaggatattaa

SEQ ID NO: 646 - DNA, 597 bp, Xenorhabdus bovienii
  Coding DNA location: Contig name=SeqID_16846; Position on contig =28154..28750bp; Strand=-
atgaaacaatatagcgtcagtgaatatacctcagcactcaacggattactgccaacgggaatggcatggacgcgaaacccaaattcagtgatgagcgccaccattagggctatcgcacacagttatcaccgtagtgatcaggatgcgcattcgttgctggagggggcattccccgcaacggcaaccattatgttgtcagaatgggaaaaatcactggggttacctgatgattgcgctattggggaaattgacagcatctcattgagacagaaatctgttgtatcaaaattattacggacgggtggccagtcaaaatcctatttcatcggtttggcggctgaactcggattcaaaattaccattacggaatttaggcaggccagagtaggtatgtctgcatgtggtgatgcactgaacggggaggattggccatttgtctggcgaattaatgccccgacaacaacgatcaattatgccatagccggtgggagttattgtggcgacccattacggtcatggggaaaccaaaaactcgaatgtcagtttaatagattaagcccgtctcacaccattttacagttcggttacggccaataa

SEQ ID NO: 647 - DNA, 1179 bp, Xenorhabdus bovienii
  Coding DNA location: Contig name=SeqID_16846; Position on contig =28747..29925bp; Strand=-
atgatgaggacgttcggtttttctgggtatgggagcgggacaatgccgtttaaacgaaaaacgctgacggaactccgggagcaaaaccgcagttatttgcagtcagaattacaggaaacaggcccattattacggttttctaatatgggggtgttggccgatatggatgcagggatggcacatctgcattatggctatctggattatatagcgaaacaaaccacgccattcactgcaaccgatgaatggttgtcaggctgggcagccctaaagaaaatatttcaaaaacctgcgtttcccgctcgctgtgagaaatatcaatttacgggtattgagggtcagattatttctgccggcacaatattaaacaggggtgatggctatcaatataaaaccgtcgatgaaacgcgtattcatcatggacggggtcatgctgttctcatcgcgatattacccgatgttacagatgataattcaggcggtggtgctgcgggtaacgccccttcaggcacagtattaacactggaccagagtattgccggtgtcgatgttgagggaacggcaatttcaccgataacgggcggcgcaaatatagagagtgagacagattttcgttccagaatgctactggcctatcagggatcacctcagggtggttcggatgatgactataaacagtgggctctcgctgtacccggtgttacccgtgcctgggtcaaacccagagcggcgggtgctggaacggtgggcgtgtatattatgtgtgacaataatgggcgggagggtttccctattggtacagatggtgtctcatcacatgaaccctatgctgttcatgcgtcaggggatcagttgcgtgttgctgattatatttacccgttacggcccgttactgcgctaatttgggtattgtctccgataaaacgaaccattgatttcactctcaatggactggctcatgcaggcactgaaataactcatcgcattacgatggccattgataatgtgttatttgagagtggaaatccggacggaacgggaaaaatattggtatccgatctgcagtatgcgattgccgatgtgccaggaacggcaggttttgttatcacgtcaccgacaaaaaatattgaattgtctgtcggacatttgcctgtgcggggtgaggtcaaatacacatga

SEQ ID NO: 648 - DNA, 447 bp, Xenorhabdus bovienii
  Coding DNA location: Contig name=SeqID_16846; Position on contig =29873..30319bp; Strand=-
atgagtgacattgcctcatggtgggatgtgaaaagcattcatgccgactggatagttgggcgcggtgatctggttaccggtgatgacctgcaaaccgccatgattattagtttgtttactgacagacaggccaggtctgatgatgacattgacggtgttgatcgtcgtggttggtggggagatagcggggctgattaccccataggttcccgtctgtggctgctgcaccggcagaaattaaccccagcggtcgcactggcagcagaggattacgcgcgtgaggcactgcaatggatgctggacgatggggttgcggaatccatcgatattcggactcagattgtctggccaaatcgcctaaatatgataattcgttaccagcgtcccggccgtgatgatgaggacgttcggtttttctgggtatgggagcgggacaatgccgtttaa

SEQ ID NO: 649 - DNA, 618 bp, Xenorhabdus bovienii
  Coding DNA location: Contig name=SeqID_16846; Position on contig =30316..30933bp; Strand=-
atgaattctatgacacgattatggagatgcgtaattatggaagttaaaaatttatatcgtcgcgccatgatgatgctcggtctggggcgggtcacaacctgtaatgataagggtgccatccaacaggttcagtatcaaacagcgatggaggttagggataaaacgaaccgcatggccgaatttgggttttcatcagggttgccaacaggaaccgatgtcgttctcgcgttcttaggtggtgaccgttccaatgcggtggtgattggcagcaatcatcagcaatatcggcatcagggattaaatcccggtgaggttgtgatttataaccaatggggactgcatatattactgactgaatcggggatcacagtagaggcacaagggaaatcagtcacagtcaataatgcgtctacggcaaccattaatgcgtcaaccaaggttttgttgaataccccggtattagaggtctctggcaatattattgataactgcaacagcaataaaaccaccctgcaacagttacgtgattcctataacaaccacacgcatcccgtgccaggtgttgagtctggcggttcaaccgtaaccagccaaacaacaggagcgacggttaaatga

SEQ ID NO: 650 - DNA, 1092 bp, Xenorhabdus bovienii
  Coding DNA location: Contig name=SeqID_16846; Position on contig =30887..31978bp; Strand=-
atgaaaaaaaataatgatgatctgtcattggttatcggtggcaggataattcacggctgggacagcattcgtgtgactcgcggtatcgagcggttgccctctgattttgaattgatattgatggactattatcccggcagtaaagaaaaacagttggtcgaggcaggtcaaccctgtcaggttctgttgggggatgagcctgttatcaccggctatatcgatatctggaattcatccattaataaaagtacgcaccagataagggttacgggtcgcagtaaatgtcaggatttagtggactgctcggcgaaatggccacagaacgtgatttcgtcggcaacggcattgcaaattgcccaaaaactggcgcagtggtacgggatagaagtgacatctgatgtgacagatatgcagccggtgcctcagtttactctgaactggggggaatcctcccaagaggtgattgaccgtattacccgctggtcggcgctgttgtattacgacacaccggatggcaatttattttttacccgagtcggcgataaggtggccgcgagcggtgtcgagcaggggaaaaacatcgaactgacggactatcagtcatccatgaatgaacggttttccgagtacagcggcctgtccatgaatgttagtggcctgagtgaattatctgacggacagggctataacgtagtcaccattgccaccgcaacagatcccgaagccgaaaagatgcgctaccggaactatgtcaccattatcgaaagcacacttcactcccatcagcgacatcaggaagccattgactgggaaatgaaccgccgctatgggcgtgccaaagtcctcaaagtgctggtcgatagctggcgtgatatcagcggggcgctatggcagcccaacaccctgatccccattcatctgcctgttttcggactggagtctgaacagtggttattgtcagaggtatcctatgtccgtaatagcgatgatggcacgagagctgaattaaccctgatgccgcctgcggcgtttaccgttcaaccctatgaattctatgacacgattatggagatgcgtaattatggaagttaa

SEQ ID NO: 651 - DNA, 1455 bp, Xenorhabdus bovienii
  Coding DNA location: Contig name=SeqID_16846; Position on contig =31975..33429bp; Strand=-
atgccgcttagccgcggtttttttgcgtccaaatttaaggtagtcgacatggcctttattaaagatgccatttcttcattgctgggtggtgatagctcatcatggaaatggtcagagcatttacggcctgcctcatttcgtggtgtgccatttgctgttgtttccggtgagagcgtattcggtcgccgccaggcggtgcatgaatacccgtaccgtgataccgcatggattgaggatctaggccgggcaacccgaaaaatcaccctacgtgggtttattgttcaggatagtctggtttataacgcgccggatgttatcacccagcgtaaaaatctggtcgcggcttgtgaaacaggttctacaggaacactaatccatcctaccctgggcgaactgacggtcagcgtgacagaaagcggccttcgtatgaccgaaaacgccgagtcctgtcgggtatttgagttcacactgacagtaatagaatccggattacaggtttttgccgtcacaaacagcaccaaatcagcgacggaaatcaaacagaactggtttcgggcatataccacgacgttggcgaaatatattgcggttgtgagaggagaaattcgctcggttgtgcaggggatgaaaatcatcaaggcgaccgctaaccagtggattggcatggttacccggtcagtggacgaggtgacgaatctgagcgatatgctcaaaacgacattgggtagcgagcgttacgggcgttatcagcgtgggaaaattggtggcacagtatccggcgcgacgggaattcggtcacgggaccctcagtatcgtgatgatgcggagatagttaaaaaaaccacagttgcagtggtgatgggccgtaaatctatttctgaatctatcgataaattaacccattcgctgaccgttgaagagttcagtcaggcggctcagggtgttgttgattctattatcagttcagcaggtagcacggatgagaaaattgctatttttgagaatttagcggcattccagaatacccgatatcaacagagttccacagaccgtcatgtgaccgaaatgacggtgttgttactggttgtgttgtctgccggggcaatggctcaggttgccagtgaatttaccccggcgaataatcatgaggctaatgacctacagaggcgggtgtgccatgcgctggatacggcattggtgatgtccggtgatttgggtatggatgacatctatcagtctctgatgtcgttgagatatgagtttgtcaccagtgcagaactgaaaggggcggaatcaggtcgactggctcagtttagtttgcccgcaattctgccatcgctgaatgtggccaaccggatttatcaggattcaggccgcagtgatgaactgattcaggcgactaatccccggcatccggcgtttatgcccgttaaattcaaggcgttacgtaaatga

SEQ ID NO: 652 - DNA, 171 bp, Xenorhabdus bovienii
  Coding DNA location: Contig name=SeqID_16846; Position on contig =33432..33602bp; Strand=+
atgaaaaagccctgtgatagggctatttttgtgtggttatctcttcaacaagacacatcactggagttttatggtgtatcgtatgcgcatggtataaagccggagtgttacagattaacttctcggctttactcaccgcctttgaacagtcaaaacttgcagcattggtag

SEQ ID NO: 653 - DNA, 201 bp, Xenorhabdus bovienii
  Coding DNA location: Contig name=SeqID_16846; Position on contig =33652..33852bp; Strand=-
atgcatagatttgggcgctttgtattacttgtcggtattgtgtggttgattgcggccctaaatatgggcaccaccgtttcttcttatggtgaaaccgttcataacattggattagtctcaagcaagcaaaaccacgtcattataggatgttttattatcctgtatggattgttagttactttgttctataccgagaagtga

SEQ ID NO: 654 - DNA, 1929 bp, Xenorhabdus bovienii
  Coding DNA location: Contig name=SeqID_16846; Position on contig =33911..35839bp; Strand=-
atggctaatgcatttgattttgaattacatgctgatgaaaacgcgacaaaggctttagctgagatagaagccagacttaaggggttgcagcctgtattagactctacgcgggaagggctgcgatttggcggcagtgaaacgctggataatgtcggctctgtcagtaataaattgcgtgatatgtcgcagtttgccaaagacaacgttcagcacatcggcgctattattccgccgctaaaaaatgtgggtgaactcaccgcaaaatatggcggtcttgccaaaaaatacggggggatcattggcggggtgggcgctataggatatggcgcaacaaaactgtatcaaggtatgagggatgcaggcaaagacgccattacccgcagtacacgggcaaaaaactcagggatgagtgtggcggattttacccgtatgtccggtgctatgcagatctctaccggcgcttcaatggacgctaccgatcagtctgtcgaatcactctatcccgttcttcagaatgccctcacgaacagaaatagcgccataaaagccgagctgaataaaattggcgtagaaatagcaaaaaataaaaacggtaatgcagacgtttaccagacaatgaaaaacctcgcggcggaatggaataatatcgtacctgaaacgcagaataccttacgcgaacatttaggattagatggtaatacgttgtcattcctgagagatggagggcagaaaaaagagggcaaacttaagattgaggaattactcaataaatcagataaatccgggctaacgatacaagataaggataatgaaagaatagaaaaagttggcgagcgtatcaatgaaatcgaagcccgcgccgctggcgcattcagaaattttaaaaacgatatgctactgacgggctttggtcagtgggacaaagcgagagaaaccgctaaagacaaaaatccggttcatggtttttttgcgggagcagcggcatttgctaatccattcggatttaataacggcggtgaccagttagcgttactgaaaaaagcacggaaagataaagaattcagaaaaaccttaacgtttaaagaaaatacagatcttttgctgacatatgcttcagaagacttaatcaaaaagttaaacgcttattatttcccgaatgaaaagccaagccatgttggtgaaaaggtgcctgactttcccatagtagaagaacccaactaccctaatccattaaagagtacagggaagaagccaaggggaatacgcaataataatcccggaaacttaactgatgcccctaatgcggtaggcaaagattatggtaatggtcatgtctatatgaaatttgcgacgcctcacgatgggataacggcgctgagtagacagttaatgctgcatggggatcgcggtcaaaatacgttaaaccacgttattcctatatatgcccctaaagcagcaggcaataaaacgaaagaatatattgattatacagctaaacagctaggaattagtccaaatgaaaagatggacttacataacccagccatgattgaaaagctgataaatgctataataaaaatggagaatttggggcagcagccatacagtcaggaacaaataaaaaatggaatttatgcttctattgatgatcctcgctgggctggattgcggtcggattattatttacaaaatcaacgttcgcaatatggctccaacgggcaaaatcaacaattcccatcactctacagcaatagacaggatgctgagtctgaggcagaaatagcaaaaggcatggcgaaagcgtttcaagaagccattagggataaacttcaagttgagatcattttggttaatgacaagaccggagaacgtcaaaaattccagtcaaaatctgcaggtaaagtcacaacctctatgcagcatccttga

SEQ ID NO: 655 - DNA, 96 bp, Xenorhabdus bovienii
  Coding DNA location: Contig name=SeqID_16846; Position on contig =35862..35957bp; Strand=+
ttgcgcctgttcagcccaccaactcagtttcgatcgactcaggagccacgcatcctgtggcccccagtggtaaaaataggtgacatctgccgctaa

SEQ ID NO: 656 - DNA, 300 bp, Xenorhabdus bovienii
  Coding DNA location: Contig name=SeqID_16846; Position on contig =35954..36253bp; Strand=-
atgatggaaaagacaaaagttatcagattaagcacgccgattgaagacaacgcgcagaagatcatttatgaagaaattcatttaagggagccttgtttgatggacgttgagcagttttacgacgtacaggcgaaaaatcttaatagttctcttcctgccatgcgatgtcttatcgcgttggtcagtggagtcactgaaactgcattaaaacgaatgtccatcactgattttaaccagtgcagggagtttctcatgttttttttgtcgggaaacttggactccagcattggcgacgattag

SEQ ID NO: 657 - DNA, 369 bp, Xenorhabdus bovienii
  Coding DNA location: Contig name=SeqID_16846; Position on contig =36260..36628bp; Strand=-
atgggtaatacatctaacaggctggcgggtacagcgtatgtcactgttgacggctttcgaatcatggtggtaggggatttcacctacagcccctcaacagtgacacgtgaaacgctgacaggtatggattccgtgcatgggtacaaagagaagcccgtcccaggattcatttcatgccgggttcgtgacagtggcgggaccacggtcgccgattttaataaccagaccaatgtcaccattgtggcagaactcggcaacggtaaaaccatcatcggtgaagggatgtggtcggtgaatcatcaggaagtcaaaagcgaagacgctgaattcgaagtccgctgggaaggcggttcggttactgaaaattaa

SEQ ID NO: 658 - DNA, 1473 bp, Xenorhabdus bovienii
  Coding DNA location: Contig name=SeqID_16846; Position on contig =36650..38122bp; Strand=-
atggcgatccccttttcccatattcccaataatctcagaacgcccctgttttttgttgagtttgataactcaatggcgaacagtgccatagcaacccagcgttcgctcatcattgggcaaatgctggatagtgccacagcaacgccggatatcccggttcgcgtttcttcggcagaacaagccgcctcacagtatggtcacggttcattgctgcacggcatggttgcggcctatttagcgaatgattccgccgctgaattatgggtattgcccctgaaagacggggataacctgctgactgcaaaagggctggtaaaagtctcatccctgcctacccatgctggggttatctcactgtatatcgcaggtcagcgcgtacaggtcaccgttatggccaccgataacacggcacagattgcggcggcactggccaccgcgattaaccgtaaaatctcgttgccggtgaccgcaactgtggcgaatgacacggtgacattaaccgccagaaataaaggtgcgcacggtaacggcatcaatctttgtctcaattaccgtggacaggcaggcggcgaggtcactccggcaggactggcattggtgatcactcccatgacaggcggtgcaggcgcccccgagctgaaaaacggtttgtctaacctgagtgaccgatcatttgattttatcgtcaatccgtacaccgacaccgcgtcaatggatgagatgaaatcattcctgtcagatattggcggtcgctggtcctgggagcaacaattgtatggccatgcgatcagtgtcgtcagcggaacttatggtgaactggcggatgccggagcgcgccgcaacaatcagcatgaaacattgctgggtgtaacgaaatcaccgacacccaactacatctggtcagcggcagtcaccggtgcagtcgcgccgtcactcagaaacgaccccggcaggccattacaaaccttgcccgtcgcgggtgttctcgcgccagcggatcagctcgacctgattgaacgcaacaatctgctgcacagcggtatatctaccgtaacggtcgcggatgatggcacggtacaggtggaaaacctgattacgacctatcagaaaaacccgtatggcgataatgatgacagctatttgcagatagaaacgctgtttttgctggcgtttgtctctcgttacattcgcacgcagatcacctctaaatttcgtcgcatgaaactggccaaagacggcacgcggttcgcggcggggtctgccattgtgacccagaatgtggtgcgtgcggaactgatcgcccagtaccggacactcgaatacaacggttatgttcaggattcgaaggcgttttcagaggggttgcgggttgaaatcaacgcgcacaatcctaaccgtttggatgttctctggactggcacattgattagccagttgcgcgtgtttgcactgcttaatcagttccgtctgtaa

SEQ ID NO: 659 - DNA, 183 bp, Xenorhabdus bovienii
  Coding DNA location: Contig name=SeqID_16846; Position on contig =38147..38329bp; Strand=+
ttgacgagtttattttccgtcacgggcggagataaacacacatcgccatcttttaaccgacgatgccaaaatagggtatccggcacctctgcaccagattcgggcaaaaattcgcccctgaccgggcagcgaacgagccgcccagtaacgggtttaacaaacatggggtttactccagattaa

SEQ ID NO: 660 - DNA, 540 bp, Xenorhabdus bovienii
  Coding DNA location: Contig name=SeqID_16846; Position on contig =38316..38855bp; Strand=-
atgaacgcatcaataatacgcaatatggttgtacaggcgcttatggggaaaacagacgcgaattccagcgtctattccccgcgagattggtcaacgcgaggggatgactacccttgcattctggtgcagaccccgtttgaccataaaaaatcgttaggccgtaatgtaccgcaattcaatacggtaacgacggtcaggatcaccggcagaactgaagcgttcgatggtgagtttgataatggtgtagagaaggcaggactggcattagaggcgttgcgggaacaaatcgaacgggctgtcattaatagttacgaattgacgaaaaatactcagcaatacgctgaaattcgttcgcaaatcgatattgatgccagtggtgagtcacatttcgcacaactcctgatggatatcgacattgaatactatcagggtgaggaggatttttaccccatagatacgcacccactggacggtattgacgtgaccgtagcgatgccagcacacacacccgaacccaaaatcagcattaatctggagtaa

SEQ ID NO: 661 - DNA, 336 bp, Xenorhabdus bovienii
  Coding DNA location: Contig name=SeqID_16846; Position on contig =38852..39187bp; Strand=-
atgccgattgactgggataaacatctgctggcgccgttgcacgaacagtttggcgagcgcgtgaattggcggccaaaatcaggcaaaccctacgacattatgggcgtgtttgatcgcgcctatacccaacaggtggagtcgctggacggtgacagcagtgtcaacaccactaaaccgctgctgggtgttcgtgatgcggtattcaaatccccgccacagcaacaagaccgggtgtttgtgtacagtatcaatgctgaatttgtcgtgagtgacgttcagccggacagtcacggtgggacgcatttgcaactcaacaggattaaacacaaaaaatga

SEQ ID NO: 662 - DNA, 393 bp, Xenorhabdus bovienii
  Coding DNA location: Contig name=SeqID_16846; Position on contig =39187..39579bp; Strand=-
atgcggcattatgtgcaatggtggtgtgatatggctaaaaaacaggaaatagtcactgatggcctgggcgaattaccgaccgaattgcaggtgaatgtgacagagaacctgcaaaaacctcagtcagagccagctctgacaaaattcccggatacactcccggaagagccagaagatgaagacgtgcctgaatgggtcgtgctgaaaggaaatacggttcagcatgacggtgtggcgtaccctgaaaactccgtcatttatttgtctggcgaggacgcggaacgcctgattcaactgggtgttgtgatgcggctggatgacctgaaatcccagttactgtccggtaactccgtcaccgttcaggacggggtcagagtccaacaggaggcctga

SEQ ID NO: 663 - DNA, 1047 bp, Xenorhabdus bovienii
  Coding DNA location: Contig name=SeqID_16846; Position on contig =39551..40597bp; Strand=-
atgaatatttatgatactaacgtgttagttcaggttgttcctaacctgaaaaccagccagaactggctgctggataaatttttcccgaatatcgtggaatctgataccgaagaggtgtctatcgacgtggatgtggggttgcgccgtatggccccgtttatctctccactggtggaaggcaaactggtcgaatcgcgtaaatttcaaaccaacagctttaaaccggcgtacatcaaagataaacgcgccccggatttacgcaaacccattcgccgccagattggtgagcgcatcgggggtcagtacaccgctgcggagcgtgagatgttaaatatccaatttgagctggctgaccaaatcgatatgattaaccgccgattagagtggatggcggccagtgcgctggcaagcggcaccattacggttgctggtgtaggttacgaaacgaaagtcgtcaatttcgggcgctctgctgacctgaccgtcaccttaagcggcagtgataaatggccgaccaaggtcgatgcaggtaaaaccaataaccagccaacacaggatattgaaacgtggtcacagcgcattctgaagaattccggtgccgtgccgaccgatttggtgtttaccacccagtcatggaacgcattccgtctggataccacggtgaccgacagtgccattaagttcccggcattaaacccgtacggtaaccagattaatccgggtacacaggtgcagaaaggtgccgtctacaaaggccgttgggggcaatttgatttgtgggtgtacaacgattggtttatcgacccggctgatggtaaagaaaaaccgatgctgccagaggggacggtcattatgtctggtgctgacctgatgggaacccgtgcctttggtgccatcattgaccccgcatttagctatggaccaatggcctatgcgccgaaatcgtggttacaggaagatcccgcgcagcgtttcctgatgatgcaatccgcaccgttggtcatccccagccgggtgaatgcggcattatgtgcaatggtggtgtga

SEQ ID NO: 664 - DNA, 282 bp, Xenorhabdus bovienii
  Coding DNA location: Contig name=SeqID_16846; Position on contig =40715..40996bp; Strand=+
ttgggctttcagttctgggagtgtccagctttcatcgaaaatcacccaatgatggttaaactcgcccatcaggtaaacgccacccgtcacactgtcggcggtggtatcaacattgtctaccagaatcgcactggggatctggctgccattgtctgccccttttttactgaccgcgtattcccctgttgccgcaatgacacccagtaccgtaccgcgcttcagaatacccgctttggcaatcgttacgctgtcggtgacaatttgcaacggaccggaaattag

SEQ ID NO: 665 - DNA, 621 bp, Xenorhabdus bovienii
  Coding DNA location: Contig name=SeqID_16846; Position on contig =41062..41682bp; Strand=-
atgtctataacaagatttgctcatctgatcccgtcatttggcatgaaatccaaaatgtcagaagaagagcaggacgaaaagaaaaaaggtaaaaaagccaagtctcgtaaagcggaagaggataaggaggagactgacgcagaaaatgatgatcctgatgcggaaggcagtgacgacgataaagaaacggaaggcaaaaaggcgaaaaaagcaaaaaaagcgaaaaaggccaagtcagaagatgatgacgatgacgaccctgatgccgaagacgacgaggatgatgaaaacgcggaagaagacgaggatgtcaaaaaaggccgtcgcgctgaacgcaaacgctgtgccaaaatctttggcagccaatatgcagccggtcgtccggatatggcggcacatttggctctcaataccagcatgtcagccagcgaagccatcagcacactgaaagcgatggggacggtgcagtcgcaaccctcccgtgcatcactggacagccggatgcgtaccgagcagcaagtgcgtgtcggaccggatgccagtcaaccggcaacaggatcacccgaagcactggtgagcaaaatgaccagtttatatgacgctaataaaggagcgaaataa

SEQ ID NO: 666 - DNA, 855 bp, Xenorhabdus bovienii
  Coding DNA location: Contig name=SeqID_16846; Position on contig =41684..42538bp; Strand=-
atgatgaacttaccccacttagcccagcggctatttaacgttccgctggcaatacacccgcgaaaagcggaagtggtcatggcggcattaaccgaccgattgggtatcactaaaattcaggccggtatggactgggatgatgaggatgaatcattttcccgtcgcaagcgcgataccggttacgacgtactggaggggatagcggttattcctgtgcaggggactctggttcagaagctgggctatctgcggccgtatagtggtatgacaggttatgacggcattcgacaggtatttttaaccgcattgaatgaccccaaagtcaaaggcatctgtctggatatcgattcccccgggggtgaagtggccgggtgttttgatttggctgacctgatttatcagtcacggggtgacaaacccattcatgcgatcctgaatgagaacgcttattcagcggcctatgctatcgccagtgctgcggacaaaatcacagtcccccgcacaggtggtgtgggctctgtcggcgtgattgttatccattgtgactggtctcagcgtattaaagaggatggtttgacggtgacaatcattacgtatggtgaccgtaaagcagagagtaatccctatatcaaactcagtgacgaggcgcgtcaatctattcaggatgatatcgatgtaatgggaaaactgtttgtcagtacggttgcccgcaatcggggtgtttccgagaaaattattcgtgacacacaggcggcctgttttttggctgcggatggtgttcagttggggttggctgatgcagtggccacgcccgatgccgcatttcaaacattaatgaacgaagttggagattaa

SEQ ID NO: 667 - DNA, 1647 bp, Xenorhabdus bovienii
  Coding DNA location: Contig name=SeqID_16846; Position on contig =42535..44181bp; Strand=-
atgagcgttaaaatcttaggacccgatggtgagccgttaccgccttcaaatacgaaattaaaattcaattcattgtccggcagcagtcgcattccttatgatgccgccgactcatccagcgaccaactggcaaactggcaaccggcgctggggtcaccggataatgaaattaatatttaccgcgaccgcatcgtgtcacgtatgcgcgatctggcccgtaatgatggctgggcttccggcactatcacccgcgttttagataatgccatcggtgcgaactaccggcctatatttaaaccggattatcggatgcttaaattactcacgggcaataatgcctttgatgcaacctgggcggatgagtacggcaaagttatcgaagcgcactggcgttcgtgggcgaatgatccggggctgtattgtgatgtggaacgaaaacaaaccgtttcccaaatgctgcgtctcggctttcgacataaactgctcgacggggatgcgctggctattttgcagtaccgtaccgacagattaggtcccggtcgcggacgttatgctaccacggtgcaaatcatcgaccccgaccggctcagtaacccgcaacagaatttcgatatgcagaacatacgtggtggcgtggaaattgatagtgacggcgcaccgattggttaccatatccgagaagcccatatgggtgactggtggtcgggtgcgaaaaccatgacgtggcagcgagtacagcgcgaaaccgcatggggccgcccgatggtggtgcatgattttgaccacgagcgcggcgctcagcatcgcggtatcggtatcttagcgcccatcgttcaacgactgaaaatgctgattaagtatgaccagagtgagttggaagcggcgatcctcaatgcgattttcggggcctatatcgaatcaccctatgattcgcaaatggtggcatccgccctcggtgacaccgttgattccagtggtgacgaactcagcgcatatcaaacacagcgtgcggaatattatgaagataagcgcctgaacttacaaaatggtgcacgtattcctcatttattcccaaacgaaaaaattgtcaccatttcggcgacaagacctaccagtaattttgacggatttgaaagtgcggtactgcgaaatattgctgctgcgaccggactttcaacgcaacaggttacgcaggactggtcagacgtaaactactcatcagcgcgtgccgccatgctagaggcgtggaaaaccctgacccgccgtcgtgatgatttcgctgtcggttttgctcaacctatcgcctctgcttttgtagaggaaattcacgatattgaaaaattgcccctgccaaacaacgctcctgattttctggatgcgaaagcggcttattgccgtgcgcgctggatgggacccggtcgtggatgggttgacccggtggccgagaagaaaggcgcgattctggggatgaatgccggactctccacgctggagatggaagcggcagaaaacgccggtgaagactgggaagagatgctcgatcagcgcgcgcgtgaaattgaagcgtttaaagagcggggcattccactgcctgaatgggctgagccgacaccgcaacaacaaaacaacagaggatcaggggaatga

SEQ ID NO: 668 - DNA, 252 bp, Xenorhabdus bovienii
  Coding DNA location: Contig name=SeqID_16846; Position on contig =44181..44432bp; Strand=-
atgcgtcaaagaaccagtctgctgaccggcatgagccgtgaacagttaaaaacagccctcggcacggctcaacaagcctatatcgaactgtcaaccggaacgaaaggggtctcattttcgtatacgcaaggcgacgggacgcgctccgtgtcgtaccaacaaaccagtctgggggatttattggcgctcattcaggcaatacaaaccgagctggggatcacgacccggcgaccaatcacggtgagatactaa

SEQ ID NO: 669 - DNA, 1977 bp, Xenorhabdus bovienii
  Coding DNA location: Contig name=SeqID_16846; Position on contig =44442..46418bp; Strand=-
ttgatcacagtaaacaagggggataatgcagcatggcaaaactttacccttgtactgaatcagtgccgttctgatatttgtcccccggagcctttatccttaagcgaatgggcgaataaatacgccgtcctgtccaaagagaacagcgcccagacggggaaattccgctcctttggttatcaggatggcatcatggatgccattaccgatccgggtgtcacccaagtgtctgtgatgaaatcggcacgcgtgggctacaccaaaatccttgaccacgttgtcggctattatttgtctcacgacccgtcacccatactggtggtgcagccccgcgtggaggatgccgaggactacagcaagactgaaatcgcgccgatgctgcgtgatacgcctgtgctgaaagaaattgcgggggaggcaaaagccaaagacagtggccagaccattcttaagaagcagttttccaacggggctaatttaaccctggtgggggctaactcgccgggtgggtttcgtcgtatcacttgccgcatcatcttatttgatgaagtggacgggtatccctctggcggtgccggggcggaaggtgaccaaatcgcactggggatcaagcgctccgaaacattctggaaccgaaaaattgtcttgggttctacgccgaccgtaaaagagaccagccggatagaaaaagccttcaaggacagtgatcaacgctactaccacgtcccctgtccacattgtggcgagtttcaggttctggagtggggcggtcctgataccccttacggcctgaaatgggataaagacagcaatgacaagggattgccggataccgcgtattacgtttgccgtcataacggctgcgttattcatgacagtgacaaacccctcatgatcaaaggcggggagtggcgggctgaaaaaccgttcaccggtcatgcgggctttcatatctgggcgggttacagcctgttcccgaatgcagcatggaaatatctggtcgccgaatggttgcgagtgaaagacgatccgttaatgcgccagacgttcattaaccttgtattgggtgaaccctatgaagaccggggcgaaaaagccctcagtgagcgtaagttactggagcgctgcgaagtctgggcggccgaagtaccggacggagtggctttgctgacggccgggattgatactcaggatggtcgatttgaaatagaggttgttggctgggggcggaatgaggaatcgtggtcaatagcgcacgatgtcattgaaggggatctggagacggatgaaccgtgggcccgtctggatgcttacctgaaacaaatttggcgtcgagcagacggtcggggctttaccattatggcggcctgtatggactccggtggccatcatacacagaaagtgtacggttttgcgcgtgaacgcttgggtcgtcggatttgggccatcaagggggaatcggcacggggcggtaaacgctccccggtgtggccaaccaagcgtctgacttcacggtctaaatccagttttaaaccgatcattatcggcgtgaatgctgctaaagatactatccgtggtcggttacacattgagccgccagagaatacagacccatctccttcttatatgcactttccggctgatcgtgaattgcattatttcagccaattattggccgagcggtcggtgattaaagtatcaggcggtcaacaatatcgcgtgtgggagcagattcccggtcgtgccaatgaagcactcgactgtcgtgtttatagttatgccgctttgtgcggcctgatgtacatggggctgaaactgaatgcgctggcagacaacatcgtcggtaatcctgatcggttaatcgcacccccggtacaaccggaaataaaaaccaatctgcgcttccccggggccatcattcctgaatcaacggaggaagcgcccaaacggaagcatatgtcacagcttttgccctaa

SEQ ID NO: 670 - DNA, 585 bp, Xenorhabdus bovienii
  Coding DNA location: Contig name=SeqID_16846; Position on contig =46393..46977bp; Strand=-
atgaaccagtcagaatttgccaagttgcacggtgtcagtcgcaagacggtcacccaatggaaagcccgtggctggctggttacggacggtgacgatattaatgttgaggcatcaaatgccaacattgcgcgttaccggaaaagtgttacccgaccggaaaaaaaagtagcaggtaacagcaaaggtaacaaacagggtaacacactccaaggtaacacttcgggtaacaacccagaccccgataccccggcaaaaattgtcgagcgcattctgactgaacggggggcaacgatgacactggatgaagccagaaccatgaaggaaaactatctggcgctcttgacccagtacgattacgacctgaaatccggccaggtgttaccgtggcaggatatgattgatgtcgttaggcaggaatattctcggatgcgcacccgattgatcgctatcgcccctgaacacggtccccggctgagagctctggcaaccacctcaacggatacggcgtttgtcgcggccttacaggaaatcatctacgaggcaatggaggaattgagccttgatcacagtaaacaagggggataa

SEQ ID NO: 671 - DNA, 123 bp, Xenorhabdus bovienii
  Coding DNA location: Contig name=SeqID_16846; Position on contig =46934..47056bp; Strand=+
ttgcgactgacaccgtgcaacttggcaaattctgactggttcatctgttaccctcgtgttacctgttacccaaatttcaaaagttcacagctagtgaaatatcgcggcgcgcaatgcccgtga

SEQ ID NO: 672 - DNA, 270 bp, Xenorhabdus bovienii
  Coding DNA location: Contig name=SeqID_16846; Position on contig =47047..47316bp; Strand=+
atgcccgtgatatataagatctcgggtaaggacccaaaaaattatgcgccgttaccatcgtgttacctcgcgttaccctcccactattacaccgaatatttaccatcgacgtggggtgggaccacggtcccaggtctcacgaccgaatcaaatcatccaatggggaacacagttcatcaggaatatcgatgtcctctccaatacagctggcgactattgcatgacacgctgctatcagtggtgtctcaccccaaccatcagcatcattga

SEQ ID NO: 673 - DNA, 435 bp, Xenorhabdus bovienii
  Coding DNA location: Contig name=SeqID_16846; Position on contig =47183..47617bp; Strand=-
atgaaactaaaaacatatgggttaacaggccaggcattggactgggcggtggcattggcgattggcgctacagaaaaaatcatgcccagtggccgtacgtggctgaaattgcccaatgatagttattatgtttctaatcgtggttcatataattttaaaccatcaaccaactgggcgcagtgtggtccattgatagcagagcattcaatcatgttggctcagtctggtgacaaatggtatgcattcagtaaagacaacgaattcaatccatacagagggagccactatattgattgtttattcaatgatgctgatggttggggtgagacaccactgatagcagcgtgtcatgcaatagtcgccagctgtattggagaggacatcgatattcctgatgaactgtgttccccattggatgatttgattcggtcgtga

SEQ ID NO: 674 - DNA, 510 bp, Xenorhabdus bovienii
  Coding DNA location: Contig name=SeqID_16846; Position on contig =47680..48189bp; Strand=-
atgacgacacataactacatagaacaattgaaattattgaatacgcagattgaagcgtctctgagatatattgagaatgttcgattattgaaaggtgaggctgaagccgacacttttgcggaaaatgacctgaaatcattgctgtcatatcattctcagaaactgttatatcattatcagaaagcagaagaatcacaacgacagcagcatcgggtaatagcattggattgctctagggtttcatttggtcaggacattagcaatgctacggagaagttaatcctgaaacgagcacgcgtttttgaagagtaccccgtcacttggattatccagcttggtgcaaaaggggttttattcagtcgtgttacaaacgggcgcatagatgaagactacgctcccgttaacagacaaaaagcaaatgtttatgcgtcagctattctgaatgaatttgagccaccaaaaggccttcagttatccgatatgcagactattcaacgtcaatctgaataa

SEQ ID NO: 675 - DNA, 351 bp, Xenorhabdus bovienii
  Coding DNA location: Contig name=SeqID_16846; Position on contig =48178..48528bp; Strand=+
atgtgtcgtcatgtttgtcaccagataggattgtttgataataagtcacaaggtgggaccacggtcccaggtctctatctctttgttccgctagttgagtatgtcctcaaaatcaaggtctcctttctgcttgcaaccatacaccgtaccgcaagtcatatccgcctgagtatcaacaccgccgaccaatatacaatcgcacagcttgacatcctcatccgcttcatcacttccgctacctcgtttaggatcttctgtttcaagagcaataaaactatctctaatatttcgggcaagatattttgccctgtcatcgtcaatatagcctcgagatttcatctctataaatag

SEQ ID NO: 676 - DNA, 207 bp, Xenorhabdus bovienii
  Coding DNA location: Contig name=SeqID_16846; Position on contig =48652..48858bp; Strand=-
atgaaatatgaactaattccaactgtgatactgcctacatcggcagaggttggaaatatcatcaatcaattgaaatcagaactcagtaaattcgagggtaatccgagtttggcatcactgatggttcatgagttgcaccagaggctatgtgctgcaattaaatgtagtgttgagtcaaaatcacagcagatagataccagtgcatag

SEQ ID NO: 677 - DNA, 666 bp, Xenorhabdus bovienii
  Coding DNA location: Contig name=SeqID_16846; Position on contig =48900..49565bp; Strand=-
atgagcatggccaatctaaaagacctttcgaaccagttggcagcaatcagaaaacaaattccgttcgctatggctcaggcgctaaccagcgttgcgcgtgatatagagaaagcacagaaggttgcgctagaacgtcgattggagaacccaactgcgttcacagtgaaatcagtcagaagtcagggcgctcgcaaagataacctgaccgcgaaagtgtttgtgatgccaaccgctgccagttatctggagccatttgaagtcggcggagtgcataagctgaatggggctgcactgcttaaccccaagaacgtcaagctaaacaaacacgggaatctgcccagaaacaagctgagtcagttaaagggtaaacaagatgtgttcatcggcgaattaacaacgcggtacggtaatgatgttaatggcgtatggcagcgcaagaaggctaagaaagttaagaaagggaaaaaacggttaaagcgttctcctaatggcactcgcagggagagaccgaagcagcgtccgccaaaactactcattcggtttggtgatgctctacccgttgatcccgtgctcggttatcaggaacgggcgcaacaaatggctcaatcgttgatgcctgctgctatcagtcaggcgttggatgaggcgatacgaacggccaaatag

SEQ ID NO: 678 - DNA, 429 bp, Xenorhabdus bovienii
  Coding DNA location: Contig name=SeqID_16846; Position on contig =49520..49948bp; Strand=+
ttgctgccaactggttcgaaaggtcttttagattggccatgctcattccccaaacaaataacccggcgtactattgggctgtcattatttgaatcacctataatgaatttgctaatcacaggagttcatatgaaaaaattagcgatactgttagccgcattactttcgtttggtgcttgtgctaaaaccagagtcgatgtgtctaaaatttatgggaacattaaagttgttagctctggtgcggactataaggttaaggtcgttagctcgtcacccgacctgaaagtcaaaattgtcaccagttccgctaactcgccgggtaaatggaaaatggtaaattcattccctgattacaaaattcagttcgtaaactcattcccggactttactatcaaatacgtcgattcgttccccggcccgactaaatga

SEQ ID NO: 679 - DNA, 186 bp, Xenorhabdus bovienii
  Coding DNA location: Contig name=SeqID_16846; Position on contig =49950..50135bp; Strand=-
gtgacaataacgacaaactacatcaactttagccatatctcaccgataaaaatggggacgtttatcgcaatatctaattattggagccatgacctcgttttagataaccaatcactttatgacaaccacctccgggtggttttttactatatggagggcaggcaacaccctccgtcggtaagatga

SEQ ID NO: 680 - DNA, 249 bp, Xenorhabdus bovienii
  Coding DNA location: Contig name=SeqID_16846; Position on contig =50140..50388bp; Strand=-
atgtttttggtgctttgtgctgccttcttaccgctggttattcttattacgataacgttattgtttgtattgatagcagggatcagggattgtaagataaaaaattactcatttaatgatcgggtaggtatcgcgataataggcgtggtagctgccttatcattctgtttggcctgtttcctttggtctcaacttcccgcatttatcgaatggatggtaccacctggttttaggtcacgcttttactaa

SEQ ID NO: 681 - DNA, 111 bp, Xenorhabdus bovienii
  Coding DNA location: Contig name=SeqID_16846; Position on contig =50431..50541bp; Strand=+
ttgaagtttcagtctactttatacttaggttactgtcagcgccctaagcatgggcaatatccgataatcggacttgggttctttgactacatagctatcacgactctgtga

SEQ ID NO: 682 - DNA, 96 bp, Xenorhabdus bovienii
  Coding DNA location: Contig name=SeqID_16846; Position on contig =50631..50726bp; Strand=+
ttgattatttttgattccgacctgtacgctcgatgcaaagggaacatgtcatggctaatacaggcagacggcgataacccggcgcaaaggaactaa

SEQ ID NO: 683 - DNA, 1023 bp, Xenorhabdus bovienii
  Coding DNA location: Contig name=SeqID_16846; Position on contig =50723..51745bp; Strand=-
atgccatcagttaacgcgggtggcatttttgtatctgagttccgcgcactcaccgcgcatatcaataaaacgcagccttacagaaagtcgaacctgagaaatccgttaatgggtatttctgcgggcggctttctacgtgagcaggttcgattttctataaggaaatacccgatgagtaacatcattccatttgagtatgacggtcaccctattcgctttaatgaagaggggtggatcaatgccactgatatagcaatgaagtttgataaggagccgacagcatggcttcgtcaaattgatgttctggaatatatatccgctcttagttttcgtgtatttggtatttctggcactgtgccagagattaacgaaatcaagaggttagcaataagttcaggtgcagctagagccaagatactgagatttgctaaaaagagcggacttgtgaaagtgaaaagtggtccaactggaggcacatggttacatccaaaactcgccatccgttttgctcgctggttgtctgttgacttcgaaatttggtgtgatgaacaaatagatgtattgatccgtggtatccaacccacattcactgaccaacgcatcaatgccatttttcttcttgataagcccgccacatgggaaaagcgttttcagcagcccttttatcaggcactcagccgtatgtcaggtttgctttataagggtcatgttggcggcaccccgtcactgtttgggatgatcacatccaagtgggtgtatcaggttgtgttgcctgactcggtatatgcggaggcaaaagaagcagccaaaagtagcggggacaagatccatcaataccttaaaccggaagcccggaaactggtacaggagcaactgaaagcggtcacgatactggctaacggctgcgtggattacaaagactttgaggctcgttgcgttcagtcatttggaaaatcaggtgagcaaggtttgctgattttaccaatagaaagggaattcagttactcagcggtcagacattag

SEQ ID NO: 684 - DNA, 93 bp, Xenorhabdus bovienii
  Coding DNA location: Contig name=SeqID_16846; Position on contig =51811..51903bp; Strand=-
ttgactctccatgtttcgcttgaagtaacattatcgcaacaacacttaagcctatttctgcccaataacaagcgaataatatttaataattag

SEQ ID NO: 685 - DNA, 156 bp, Xenorhabdus bovienii
  Coding DNA location: Contig name=SeqID_16846; Position on contig =51873..52028bp; Strand=+
atgttacttcaagcgaaacatggagagtcaaatgaaaaaattcattcttctttgcctagtggcaggcacgactcttttagcttcaatgcagacttatgcttatgcctgcatacccttggttctatatccccaagcatatataaactgtatagctag

SEQ ID NO: 686 - DNA, 135 bp, Xenorhabdus bovienii
  Coding DNA location: Contig name=SeqID_16846; Position on contig =51972..52106bp; Strand=-
atgatactggggttgcaggagtcatcctgtctcctgcttgattgttattatatacagagtggactctctattccgcatctagctatacagtttatatatgcttggggatatagaaccaagggtatgcaggcataa

SEQ ID NO: 687 - DNA, 234 bp, Xenorhabdus bovienii
  Coding DNA location: Contig name=SeqID_16846; Position on contig =52103..52336bp; Strand=-
atgaaagcgccagttcaacaagcggccgctagagaaattgacgtggatatagcaaaagccgctttcgaggaatatcgaaaacaatttggtgatgctcaatcatttgagcgattccatcagcgcggtggcttttgctgggctgagctggctgtatttctttttcagcgtatccagtatttggaaaaggcgatacgggaaatagaaaagaacaccttgccaccgcagagcaaatga

SEQ ID NO: 688 - DNA, 474 bp, Xenorhabdus bovienii
  Coding DNA location: Contig name=SeqID_16846; Position on contig =52333..52806bp; Strand=-
atgaaactcacactaacccactacacgatcattgttctgattgttaccacaggcatagccacattcggaagctaccattacagcactgagtatgagaaacagaaagaggctaatgggcgccaagcaaccgaaatccagcaactgaccgacaccctcaactaccagaacacgcacattgatatgctgcatgaactcgataccaaacacattcgggaactcgacaatgccaaatctgaaattgacactcttcggtctgatgttgccgctggtcgtcgcaagctgcgcatcaaagccgtctgtcccgtgcatgaaaccactccctccggcagcgtgggcgacgcaggaaccccacaacttacagaagcagctcgacaagattattacgatctcctccgaatgatggcggagaacgaacggcagactaagtatttgcaagattacgttaacactgaatgttataaggtgaagaaatga

SEQ ID NO: 689 - DNA, 435 bp, Xenorhabdus bovienii
  Coding DNA location: Contig name=SeqID_16846; Position on contig =52803..53237bp; Strand=-
atgaaaatcagcaataaaggtctgggcttcatccagcaatgggaaggactaaagctgaaagcctatcctgacccggcaacaggtggtatcccgtggacaattggttatggccatacgaaagatgttaagcccgggcaagtcattaccgagcagcaggccgaagcctttttacacgatgacctcatacccgcttacgctacactggagcgattggttaaggtgccactgacacaaggccaattcgatgcgctgtgctcctttatcttcaattgcggcagcggtaatttctccggctctactttgttgaagaaaatcaatgccggtgattacgcaggtgcagcggcagagtttccccgatggaataaggcggctggtaaggtgatgaatggtctgactcggcgtagggcatctgagcaacagatgtttttgtcatga

SEQ ID NO: 690 - DNA, 351 bp, Xenorhabdus bovienii
  Coding DNA location: Contig name=SeqID_16846; Position on contig =53221..53571bp; Strand=-
atggggtggaatatgaagatgaaagagaatcctgatttctggatgcacctcggagactggctcatatcggtaagagagcaaggcatctgggcaacccttgcagggacgatggcattttttcgcggtcgctataacggtggcggctgggtaaaggtttcaatcgacgcttttatgtgtgccatgttcgcctggttcatacgtgatgttttaaatttcatgggtctgaatccagacttggcttacatcggcagtgtggtgatcggctacttgggtacagacttcattggtcaattgctgcgtaaggcggcagagaaaagagcgggggtatcttctgatgaaaatcagcaataa

SEQ ID NO: 691 - DNA, 162 bp, Xenorhabdus bovienii
  Coding DNA location: Contig name=SeqID_16846; Position on contig =53556..53717bp; Strand=-
gtgtctcagttcgaatctgagattctccgccaattttgccgccgcaatcactttcagtacctccgtatttcctattgcggtcggcatcctattaactcaactcacaggggcgaccatagctcaccccacggacgcccattgttcaaatggggtggaatatga

SEQ ID NO: 692 - DNA, 174 bp, Xenorhabdus bovienii
  Coding DNA location: Contig name=SeqID_16846; Position on contig =53698..53871bp; Strand=-
atgaggcgctccaacctcactattgtgaattataattttcacaaagcacataaattaatccaaaggccatctaatgacggcctttttactttttggagaactaaccctaacggtaagggagctgtcttgaaaatagctagtagccgagaaatcggtgtctcagttcgaatctga

SEQ ID NO: 693 - DNA, 738 bp, Xenorhabdus bovienii
  Coding DNA location: Contig name=SeqID_16846; Position on contig =53837..54574bp; Strand=-
atgcctgtttcagggagacctggctcttttgctctttctttccaagcggacaaaatggaaggtattgaaccattactaaaagaattgaatacagttatattacatcacagcgacatagctagctttgttagacaacgcaatatcgatgttcaggtgctaacggggttattccaaagtgttatagagacaagttccaaccttgaattaaaaagtaatagtaccgatgacctcatattaatgataagaaagactgatgctgagttttatattaaaactctggctaaacttgccagtgagtttgttggcgggtatcaagtaccgcaggcaaatataatcacgaaggtttttgagatagtgaatttaaaatggcaggataagcgccttaatctacagtcaacagggttggatgatagacatattttatactatatccacgctgcaaaaatactcggcttcattagtaatggtggaactgtaactgcgttaggtcagcaactggcagaggcttctcaagatcggcgtttaagaattgcagcaagaagttttgaatccagtcattgtggatgggcttgggtcacatggagtggtgcaaataatattaatggcattgatcctaaaacagccgaagagttcttgttagataagtgcttgtctctgagtatgaaaactataaacagaagagcatcaacactgcgtcagtggtatgaggcgctccaacctcactattgtgaattataa

SEQ ID NO: 694 - DNA, 105 bp, Xenorhabdus bovienii
  Coding DNA location: Contig name=SeqID_16846; Position on contig =54664..54768bp; Strand=+
atggctgtgtgctatttgagcttttctttatatgtatctcatgcgttgagaactcaatgggtttacctagtttgcccgtatcaaggactggtgttaccccgctaa

SEQ ID NO: 695 - DNA, 324 bp, Xenorhabdus bovienii
  Coding DNA location: Contig name=SeqID_16846; Position on contig =54805..55128bp; Strand=-
atgagcgctgtatttttaggagatactcatttaggctctttattcatgagaaatatttatgagtatttcgaggaacctcgttttttctctgtctccaatgaagttggtagtttatttattgtatattggataggtgatgattatgattatgataaatggctagttattcctatatctaaagaacgtcttgaatacttagaaagaaaaaaaatagatatttatgcatctttagtttatcaggagcaaaagtattattatcaggtaaatagaaactatgatgatagtgttgagtctgtatttttgcgattggaatcaaagatatag

SEQ ID NO: 696 - DNA, 441 bp, Xenorhabdus bovienii
  Coding DNA location: Contig name=SeqID_16846; Position on contig =55125..55565bp; Strand=-
atggcaaataatacacagaaagcaatggtcgagtctcttgaggttatatttccgagttattacccgcgaggagtccctccaagagaagctcaggacgcagaaggtgcatttttcaggattgtgaaaacatcacctccaaccgttgattgttttaaaaatatgtatgaatcaaaccctaaaagactaaataaattcaaaggactgagtcttaaatgttgctatggaatttctgtttttacagatgaaacttctgcggtgaacgcatttgaaaagttcccgcaaggaactgaagacagttacattgcgaagggtgtggtagatcgaactgatggtaaaatgctaaagacaggcgaacctgattcaactcatcatactttatggttaggagatggaactaaaatacataaaaagttttcatgtataagggggttggttaaatga

SEQ ID NO: 697 - DNA, 141 bp, Xenorhabdus bovienii
  Coding DNA location: Contig name=SeqID_16846; Position on contig =55757..55897bp; Strand=-
ttgggtggcgtggtcaacacctcgatccccatagataactcaacctgttggcgagaccaactagttcaaattcaagattgcgctccggtgtggcctttttgttttgtctcggatatttttcaatatatgttgtgtggttga

SEQ ID NO: 698 - DNA, 378 bp, Xenorhabdus bovienii
  Coding DNA location: Contig name=SeqID_16846; Position on contig =55995..56372bp; Strand=-
atggtgttaggaggctatatgagaactgaacataccagatctgctcagactattagcccctcgacagagatagtcgataagttttttgacaccaattcccagaaagaattttttatcaggcggttgagttgccggaatgatataaaacgacaactatttatagtaaccataaagaatgataataaaagtgatggtttctatgttgtgccatttgctgaacttactgtatgtagaagtaaggtaaggtatattgttaagccaactcagcaatatcctgatttgggagataaccttccctcaataagtaacaacattgaaaagattattcgtaatttcattctgaattatcggcctgccgttactgcatcgccgagataa

SEQ ID NO: 699 - DNA, 132 bp, Xenorhabdus bovienii
  Coding DNA location: Contig name=SeqID_16846; Position on contig =56401..56532bp; Strand=+
ttgtctcaacaaaaagccccgcactgggcgaggcttagaattcgtagtgagtatagttacaagttcccactatttggagatattaagccaatgccggacaaaaagcaacggtttattttgtcatcttattaa

SEQ ID NO: 700 - DNA, 780 bp, Xenorhabdus bovienii
  Coding DNA location: Contig name=SeqID_16846; Position on contig =56513..57292bp; Strand=-
atgaaacttgaatcagcattaaaacactttcacccgaaaacaccgacgttcagtgatgcgtcaaccagtaccgcaccggacagaatgaaaggcatggataccgcagcagctttggggatggcgggatcacaagccaagttcgggatggcggcatttttcgccaagaatgaggtcagtgaagaagacaagttcagtaccgtagaagaactgacccgatatgcaaggcgaactgtccctaagctgatatcaaaggcagcagggaataaactggggccctgtctggttatcttatcgaagatggcgtttgaagattatgcccgttcagcggcgtcaacttgtcagtgttcggaatgtcgcgggaaaggacttatctacggcatgaaagaagtggaaaaacatcccggcattattcgcgcggacggtgaagtgattattgcgccgtggattgaaaaagagcaggtgggtgaactttgccagaagtgcaacgggaaaggtaagctgtcaagtcgttgtcgctgcaaggggcggggtgtcgtagtcgatgaagaaaagaccgcattacagggcgtaccggttgataaaatctgccctagatgctcagggcggggttacagcagagtgccatcatcagtggcttatacggcaatcaaggcttacttaccagagttgaacgaaaggacatggcggcggaactggaaacccttttatgaaaaactggtgagtaagtgttatgccgaagaaagtcgtgccgaagctgcatttaataagatgacaaaataa

SEQ ID NO: 701 - DNA, 858 bp, Xenorhabdus bovienii
  Coding DNA location: Contig name=SeqID_16846; Position on contig =57289..58146bp; Strand=-
atgatggacaacacagcacacaaaacccttttcactatccctgagcctcgttacagcacggcgctggccacggtgaaaccgttacctgttcagcggaagatcaccggcaataaacaggtggatgcttacctgtgggtactggcagtcattaagaccaatgaacccgcccaccttgaggccgctgaggaagccttgaagaagctgaaaatcacccccaaggcagcccagcagaaatattctgactacctgatgaaatcgggtgcacatcctttccagatagcctttggcactatgagtatggataacccacaaggttatataaacagtgcgaaggagcaaatcaaaaaggccagtcaggtgagggcgtcttttgccagctatgaagccacactggaactcactgaaccggagaaattaatgctggtgggggagctgtcagacatttatgaacctttctactactggaacgaaacagaacaggcagaagggtgtatgcacggtgatcgcatttgcgaaacggataaattacgccaaacgacggcgaaagggtttgctgaacaactccccgaaccgcgcaccttgtctgatgttgttcgtgagtttctttattgggactggttatatcagatgcgtaatgtagccgctaaagaacttgatccgggtggatacggtgatggtgataggtatcacatctatgaccgggaaggttatctcgaaggaaaactggccactatccaagccgtaagccgtcaggaagccatcgatgtctgtaagtgggtgctggaagaagaacggttccatgatcgtgagctgaccgacaaaattattcttaatctggtgggggagtgtgcggtatga

SEQ ID NO: 702 - DNA, 96 bp, Xenorhabdus bovienii
  Coding DNA location: Contig name=SeqID_16846; Position on contig =58126..58221bp; Strand=+
gtgtgctgtgttgtccatcattacgctgtctcccgcagcttgataactctgatttctaccttggattatttcgctttacatcagtggcgtttctga

SEQ ID NO: 703 - DNA, 267 bp, Xenorhabdus bovienii
  Coding DNA location: Contig name=SeqID_16846; Position on contig =58201..58467bp; Strand=-
atgagaacgatcacattaaaagttcattaccaaaaagaatttcacccattcatttgttatgtggaaggtgaaaccatcattgatgaattaaaagagatagaagaattcatgctgtcctcgccagaactaaaaatggagggagattatttgtttactttctcttttaagtatgaagatggagctcctgataatggctgggagtatgagttgattgccttctacccaatggatgaggacgggaaagtttcagaaacgccactgatgtaa

SEQ ID NO: 704 - DNA, 1371 bp, Xenorhabdus bovienii
  Coding DNA location: Contig name=SeqID_16846; Position on contig =58464..59834bp; Strand=-
atgaataattacgattttgaatccagtgtaattggcggattgttgattagtggcctaacacctgatgccagtgatgtattggcaacgctggagccagaggcatttgctaccccgttctaccgtgaaacgttcaaaactatcagagcacaggccaagaccagagggttaattgattctctgatggtggctgatgcgatgggtgagaatcatttcgccaatgtcatgatgactgccaagaactgccccagtgccgctaacctcactggctatgcgaacaaagtttcagccaactatgaacgcagactcatgattgagttaatggacgaggctaaggaacgcattctaagtggcacggttgagaacgcggcggagtctatggactggtttatttcccaagttgcagaggtgcgtaagccacgcgatgagatccgtccgctgcatgtttctgagttactggatgattacaccgaggttttggagaaacgtctcaaaaatggcgagcaatcagacacgttgaagacaggcattgaagagctggatgagataaccggtggtatcaacccagtcgatttggtgattgttgctgctcgccctggcatgggtaaaacagagtttgcgctgaaagtcgctgagggagtcgcaaaccagacaatcacaggaaccaaacagaaacgcggcgtactgatcttctcaatggaaatggattcccagcagattatcgaacgccagttggctggagccgctaacctgccagtatcagttttacgaaatcctgcgagactggatgatgaaggttgggattgggttactgttggtttggggcgattacaaaacttggatgtatggatcattgatgccagtaaattgacggtggagcagattgcttcaatttcacggcgtcacaagaaagcacacccggcattatctctcatcatggttgattatctggggctgattgataagccaaaggcagagcgtaatgatctggccgtggcgcatatttcttccagcttaaaacgactggcgaaagacctcaaaacgcctgttatagccctgagccaattatcccgcaatgttgaaacgcgtcccaataaacgccctgtaaacgctgacttacgagattccggcagtgttgagcaagatgcggacagtatcatcatgttgtaccgcgatgccgtgtacaatgagaattcccccgcagcaccatacgctgaaattattgtaacgaaaaacaggttcgggcagctcggtacagtttaccagcgattccgcaatggtcactttgtatcggtcgatcaggaagaagcggccagagtttgccagaacaacaacaaacctcataaacgctttactaaaggagcaaatgtatga

SEQ ID NO: 705 - DNA, 855 bp, Xenorhabdus bovienii
  Coding DNA location: Contig name=SeqID_16846; Position on contig =59827..60681bp; Strand=-
atgggtagcttagcggtaaataacgtcattcagttaagtccacctacaaccttcggttcgggggaaagagtggccaatacagatgatggatatacaagactggcaaatgagctttatgaagagttgattggggcaaatctgacaagaaatcaagcgaaagtggctcatgctatttgcaggaaaacctacggtttcagtaaaaaagtagacagaatttcagatagtcagttgagccagttaaccagactgccaagacagaaagttaacaaggcaaaaaatgaactcatcactatgaaagtaatagtgaaagttggaatgatgatagggccaaataagaacttatctgaatgggaaattccagagtgtcaccaaaatagtgactttgtcaccaaaacagtgacaaaaagtgtcaccaaaagcgtgacagtgctgtcaccaaaacagggacacacaaaagatactattacaaaagaaaagaaagaaagtaatacaccccttacccctcacgaggggaataacggagaggttgctaaacctaaaaagcgaaaacccactcccaaaatcaactacgacgaatacctcaatgcctacaatgaggcggttggtgacaggttgccccatgctgtagagatcaatactccgcgccagaaagcgttaaagaaattaattcccaagctgttaacgccaaatgttgacggattcggagcctatgttcgggcattcgttggtcaggctaggccgtttttctttggtgggagtgatagcggatggacggcagactttgattatttgctgagagaaaaaacattaaccggcgttcgtgaagggaaatttgcggagaaagaccatgaataa

SEQ ID NO: 706 - DNA, 282 bp, Xenorhabdus bovienii
  Coding DNA location: Contig name=SeqID_16846; Position on contig =60674..60955bp; Strand=-
atggatacaagagacgttggcgaagctgagagccagcacacgggcgatgtttctcaaagaatattgcgaagagctgaccggagagaagaagcgatgaataaggctgtatcgattgaaaattacaaacgcagagctaaagagcttatcccgcatataccaaaagaaaatggtttcacattcattccaaacaagtttctcgatgatcttcttaaagaggatttttcagtagaacagtttaacgagattctcagagtgtttaagccgggggttgtaaatgggtag

SEQ ID NO: 707 - DNA, 240 bp, Xenorhabdus bovienii
  Coding DNA location: Contig name=SeqID_16846; Position on contig =61004..61243bp; Strand=-
atgattaacacggcaatagagaaagcgataaagctttggggtagccaaaagagatttgcagaacatattggcaaagcccaatccacggtaagtgattggttaactgggaagaaaagaatatcaccagagaacgtggtgataatcgtcgaggccacaaacggcgcagtccaagcccacgagctacgacctgatctgcctaaagtgtttccaccgcccacagaacatgaccatgtttcctaa

SEQ ID NO: 708 - DNA, 177 bp, Xenorhabdus bovienii
  Coding DNA location: Contig name=SeqID_16846; Position on contig =61178..61354bp; Strand=+
atgttctgcaaatctcttttggctaccccaaagctttatcgctttctctattgccgtgttaatcataatctcctcagctacaaattaatcgctatagctattatacatatcataaagcatcaatcaaatgctatagcgattttgatttatcatcgccatagcgatatacttaaataa

SEQ ID NO: 709 - DNA, 585 bp, Xenorhabdus bovienii
  Coding DNA location: Contig name=SeqID_16846; Position on contig =61423..62007bp; Strand=+
atgcacgaaggcgggtttagccaaggctcattagccaaggcagctggtatggctcaatccagcgtatggaaactaacatcaggaactgcaacccgaaccactagactcgttgatatcgctcgcgttttaggtgtgcgcccagagtggttatctgatggtaaagagccaatgagaaccgaaaaaaataacgagtcagaatgcaatgatatggaaatcattgaatataaaggaatgtttccggttgatatgtatgaaggggatgagcctactggtgatcggataatgattcctaatttggtggaatctgaaacctgtagagcatacaagctacatgtgaatagtgggtgttcggaagctcctgccggcgcaattatagttattgatagtaatgaggcagcaggaacaaatgatctggtatatgccagagtcaacaaagcgttatcagtctataaattcgttcagggtggctctcatggatatctatctgttgacgatagccgcgtcccactagttaacgttggaagccctgacgttgaagttattggagttgttgtattccttcttcgaaatatgaaacatcgctga

SEQ ID NO: 710 - DNA, 330 bp, Xenorhabdus bovienii
  Coding DNA location: Contig name=SeqID_16846; Position on contig =62346..62675bp; Strand=+
atggaaagcggtaatcaaagtacgacctataatgtcgagttagtccagaagtacggccttgtcgattcgtattcaatcgaatacataaataaaaaacgccccaaccactcattacttaaagggcattatggtagtgaagtcatatattctttatatataatgaatggcgattatatggtgctggtcgatgcttttaaaaccttaagtgaagccaatcaggaagctcggaaaattattggtaattatccccaaacggaaaaaaatttagcatcactagataataaaggtaattatgaaaacttttatcttcggcgcaatagagcgagctaa

SEQ ID NO: 711 - DNA, 162 bp, Xenorhabdus bovienii
  Coding DNA location: Contig name=SeqID_16846; Position on contig =62638..62799bp; Strand=+
atgaaaacttttatcttcggcgcaatagagcgagctaacacaaaacaaagccgccctatatgcattaaggctcaggcaactaatgagcaggaagcgagaaagtcactagctcctacgcatgtaattttaggctggatgggtcaaatagttaatcgtaactga

SEQ ID NO: 712 - DNA, 150 bp, Xenorhabdus bovienii
  Coding DNA location: Contig name=SeqID_16846; Position on contig =62786..62935bp; Strand=-
atgcgcttgttttatctccatcttcaatttcgaccatcaatggaactaataacgtttccatttcttctgcaatctcgacggctgcttgtagtttattgttcatgtttaattcctatcagaattaatattgtttatctcagttacgattaa

SEQ ID NO: 713 - DNA, 138 bp, Xenorhabdus bovienii
  Coding DNA location: Contig name=SeqID_16846; Position on contig =62875..63012bp; Strand=+
atggaaacgttattagttccattgatggtcgaaattgaagatggagataaaacaagcgcatatttaatatgtcggggtatttatcgtcaatctaaagtattggctgagaaattaagggaagtagcagggggggggtaa

SEQ ID NO: 714 - DNA, 156 bp, Xenorhabdus bovienii
  Coding DNA location: Contig name=SeqID_16846; Position on contig =63041..63196bp; Strand=+
ttggaaaacacccaaaaactgtcagagaaattacaatcacttttacagctctggatggaagggaatttaactgaggatgatgcttatattttaagtatcgccactgacattaaccataatgtattgcaagaaatagcacgagtcagaggagaataa

SEQ ID NO: 715 - DNA, 351 bp, Xenorhabdus bovienii
  Coding DNA location: Contig name=SeqID_16846; Position on contig =63196..63546bp; Strand=+
atgttcatgaatgacatccgaaaacacatttgcgttaatgaagaccgtttatctgaaatgaaagaagatgatttaaattatctaatctcatcaagtgaagatgtcatactcgcaatgaccaatggattattatctattggaaatttagcaagtgccgcagttcatagtgaagaatattcccaagatgatgccatgactgatctagaaagaatagcgcacctgttaactgtagtccctcttattatagaagcggaacacgaaaacaatattagtgcaggaattgagttaagagagagacaagcaataaaaaaagaaaatcaattaattgaatcaataaggaaaaaatcatga

SEQ ID NO: 716 - DNA, 417 bp, Xenorhabdus bovienii
  Coding DNA location: Contig name=SeqID_16846; Position on contig =63543..63959bp; Strand=+
atgaaaaaatttgcctctattgaaaacgccaccaatcaagatatcactatcgaattacgcgatgtctatgtcgttcgcggttccggcaagacttatctgagtgagaaaggtgcactgaataaactggcttacgttcgggcgcaagagcaattcaatgcagaagacagaccaagcaacttccctgccgaagaagtcattcaggaagacggcacccctgcattacgcaatggtgagatgcgacctgagtttatagagctacacgctcaggtattggaggaactgaaagctgatgttaggcgggagagagatttaattagaactcaaaaggaacacaaaaaggcaatagaaaaatacagaaaagcccaagatgaattaatagcactgggaaataagattcttaaattaaaatcaaaataa

SEQ ID NO: 717 - DNA, 354 bp, Xenorhabdus bovienii
  Coding DNA location: Contig name=SeqID_16846; Position on contig =64035..64388bp; Strand=+
atggaaaatacaagtttattagccagaagaagaaagtcattcgttaatgctttctttgagcatttaagaaaaaaaggtaaggcatcatcatttaagcgaaaagttaacggcatcgaatatcaaatcgatttagatgacaaggtatttactcaggcattaattactctttatgaaaataaagtatgtaaagcagcaagaatgaacgagcaacagattattaattattacgctgagtattttaataattacggaaatctcacgccagcaggtaaggagtttattagcttcattacagaactaatcgctaaacaattacaccagaaggacttaggtaatgacaaaacgaagaagtaa

SEQ ID NO: 718 - DNA, 219 bp, Xenorhabdus bovienii
  Coding DNA location: Contig name=SeqID_16846; Position on contig =64369..64587bp; Strand=+
atgacaaaacgaagaagtaaaacccgacagggatttgatggaataacaattcctcagttattccgattaaaagagaactcaataacagaatacgcaaattcaaaaaaatttatcgccccttattcgataggtgacgaagtgttaataccactcaatcgggcaatgagacgtcacgcaaagaaaaaagggatcaaattggaagaggtgaacaatgactaa

SEQ ID NO: 719 - DNA, 765 bp, Xenorhabdus bovienii
  Coding DNA location: Contig name=SeqID_16846; Position on contig =64580..65344bp; Strand=+
atgactaagaaaaatgaattaattaccattaataaaactcaaatgcctgtcgtggaatatcaaggacaacgcgttgtgacgttctcaatgattgatcaggttcacgcacggccagaaggaacggctgggcgcaacttccgtgaaaatcgttcacgcctgattgaaggcgaagatttttatgaactcactgccgacgaaattcgtcgtcagtcactaactcacatttttgcacctagaactccaaaaggtatcgtccttacagaatctggttacttgatgttagttaaatctttcaccgatgacttagcttggcaggttcaacgcgaattagtgaatagctacttccgcaggccacaaacagtactgagcgaacttgaaatgattgccaggatcgccagccatacagcccagcaacaacgtcagattaaccacattggcgaacaggttgagcaggttcatgaaaccgttgagcaaatcaagcgcggaaccatccctgtcggttggattgggttctctctggctgcgaccgaatcagggctaaccaatcccaaatgccgcactttggctgaacagtacaacgttcctattgataccgtcaccattatgacaccggacggacaacctcgccccatgaaaatcgtattcaaggaagacttcataagtgcgttccatctgatgatgggtgaagccgagaagcgtggtactcgctggacgcatcccaaaatggggatctttcaggtcatcggttgggagggcaagcaatga

SEQ ID NO: 720 - DNA, 459 bp, Xenorhabdus bovienii
  Coding DNA location: Contig name=SeqID_16846; Position on contig =65341..65799bp; Strand=+
atgactattcgttcatattcgccacatatcgccttggttcatgtaaccaaagaagaaacacccgatacctcagcatacagtgagaccgctgaaatggaaaaagtcacttatatccccgtaatgaactatgaccacaatttaactctttgcatgagaaaagctgaacatgtagtcaggctaacattcgcacaatgggaatatcgccaaattgttgatgtagtcgtcactgccaatattcgcggactgtatgttatcggtcaggcggttcaaaacctgtatgactctttgcccaccatatcattctttaaccatgataccgacaaagacgacggaatggctgagtttcatgtgggtatccttaagtgcattgacgaaggacaggaaggagttgattggctcaacgaaatgcttatcaaagctgaaattatcagcatcaagccggaggtgaagtcatgctga

SEQ ID NO: 721 - DNA, 606 bp, Xenorhabdus bovienii
  Coding DNA location: Contig name=SeqID_16846; Position on contig =65793..66398bp; Strand=+
atgctgattgcttctgatttgttacgcgccgctttgatctgtgtggccaaaggcgaagatgcggaaaaacgcccccaattatcgggggtgcacattacccgaaaacatcttgaggcaactaacggtcatgcattggtacgcatggaactcacggaaaacgtcattaactttgatgatgatactgacgtcgatctgattatccggttctgcggcgatattccagaaaaggcttgcttcacagacatccagttaggtgacgaaccaaaggctttccatttgggggaagacgaggtggtctttagccttactcatctggagataatcaacgggcgcttccctgatttagacaaagccatcccgacagagaaacagaatgttatcccgtactttggtgctaagtatctggcctacccctatttgatgtttggcagaggggcggtactcatagaaccatccggtatggaaacagcttgtcgattccggtttggcgctttcacaaacaagctttacggcaaccctgtttttatcgttctaccactttataaagacgctttcgaagctgccgagcagaaggtaagagagttggaggctgaccgtgacagataa

SEQ ID NO: 722 - DNA, 204 bp, Xenorhabdus bovienii
  Coding DNA location: Contig name=SeqID_16846; Position on contig =66409..66612bp; Strand=+
atggcagacattgacgatgtgcttgttaaggccacattccacatcgacgacggcacagatcaaacacagcggctcattcatatcatgaggcgtaaccaacatattcatgagggcatctgccctcctctgccacccgcaccgaaagtggccgaagtgaaattaacaccggtgaagaaagcgcgtaataagcgaggtaaagaataa

SEQ ID NO: 723 - DNA, 381 bp, Xenorhabdus bovienii
  Coding DNA location: Contig name=SeqID_16846; Position on contig =66612..66992bp; Strand=+
atgatcaagattaatcaatccgaattacttgtcgccatactcaatgaagccgcccgtcagaattccggcattgaaatagaggaacaccagttcaacgaaataaccaaagcagcagacttgatttgtgccgtgcttgaagggaaagcaattgaacaacagatgataccttgggtaaatgttcaggacagaatgccagtagatgatgatggctactctccaccgtgtcttgtttatgtctcttgcggttctctctccgggggtggttacgaccactgggacacaaacataaatcaatggtcagtgcacgaaaacgatgaagtaacgcattggtgctatatgactgatatccctgctccagtaacaaaggagaagcagccatga

SEQ ID NO: 724 - DNA, 321 bp, Xenorhabdus bovienii
  Coding DNA location: Contig name=SeqID_16846; Position on contig =66989..67309bp; Strand=+
atgatcagtaactccttccacttgactcaaatcatcgcctcggtctggggcgatccttctgacatcaccgatgcaatctggcaagcaggataccgtaagccagaacggggagaaaaggaaatcgccgagcttattattgacgttatgatgggggtgcctgatcaggtgccctactctgaaaggccgaagaatctgaacgacattctaacaacggagctgaacaacattatttttgatgcgacatggagtgacactgtaacaccggcaacggtggctaaaataattttggagaacaggtatcagaaaggagaaaagcaatga

SEQ ID NO: 725 - DNA, 270 bp, Xenorhabdus bovienii
  Coding DNA location: Contig name=SeqID_16846; Position on contig =67306..67575bp; Strand=+
atgagaatgaacacagcgttcttgttaatggcagagtttgaaacctcgcaaattcctttgtcaactatagccgagaaataccttaaactaactcccgcgacagcagaacgtaaggctattgaaggcaagttaaaattcccgacatacagaatgaatgacagccaaaaatcaccacgaattgttcatgtgcacgatctcgcggagtacatcgataagcaaagggagttggcagcaaaggaagtggaaagaatgcagtttaaaagaaaataa

SEQ ID NO: 726 - DNA, 168 bp, Xenorhabdus bovienii
  Coding DNA location: Contig name=SeqID_16846; Position on contig =67623..67790bp; Strand=-
atgctccgccagataaagttcgttcgttttgacgttatttctgaggggcagactaatgagagtaacattagggcatttgtgcttattattgagttttttcttaataggttaaatgatattataaatcaattagttatgatttattggggtgctattggggtgccgtga

SEQ ID NO: 727 - DNA, 174 bp, Xenorhabdus bovienii
  Coding DNA location: Contig name=SeqID_16846; Position on contig =67723..67896bp; Strand=+
atgttactctcattagtctgcccctcagaaataacgtcaaaacgaacgaactttatctggcggagcatgaaaaaacaagtttatccctcatacagtaccaccaattatgctgtaggcgggcaattaatgagatcgtttggcttctggtcggctaataagccagacccccaataa

SEQ ID NO: 728 - DNA, 396 bp, Xenorhabdus bovienii
  Coding DNA location: Contig name=SeqID_16846; Position on contig =67846..68241bp; Strand=-
atgagaggttatctttgggggttggcgagtgtgctgctggtcactgtggcacaattattgttgaaatggggagttgttcggttacctgagctttcgttatcaacatactggctggatatagattggttttgggcacatcacaatcctttgttgatggtcatggcaggattggcaggttatgcattatccatgttatgttggctttttgctctgcaatacctgccattgaataaagcttatccgataatcagcctgagttacgtttttgtttatttaatggcagctttattgccttggtttaatgaaaccctctcatggttgaaaacggctggagtcctttttattttattgggggtctggcttattagccgaccagaagccaaacgatctcattaa

SEQ ID NO: 729 - DNA, 351 bp, Xenorhabdus bovienii
  Coding DNA location: Contig name=SeqID_16846; Position on contig =68238..68588bp; Strand=-
atgaccagcaatttagcattattgatattagttagcctgctgacctgtgccggacagctatgccagaaacaagccgtcacctgttggcagaaaacagataccccccataagggggtatctgtggcgatctggctgacgggtgctattcttttgttggggatagggatgatattctggctgcgactgctgcaatatttgccattgagtattgcatatcccatgcttagtattaattttgtcgtagtaactctggtcgggcaattcctgtatcaggaaaaagtggggctaaaacactggataggcgtttttgcaattatgttcggaattttattgatgagtctaaatcaatga

SEQ ID NO: 730 - DNA, 1662 bp, Xenorhabdus bovienii
  Coding DNA location: Contig name=SeqID_16846; Position on contig =68585..70246bp; Strand=-
atgttgaatagttgggcaagtagagttggagcctttttgatggctcttttttttattcttacttatttattacccctgaatggccgccttttgtggcagccggatgaaactcgatatgccgaaatcagccgggaaatgctacaacgcggagattggatcgttccttatttcttcgatattcgctattttgagaaaccggtagcaggttattggttcaataatattagccaatggatttttggagacaacaacttcgccgttcgctttggctcagtgttcagcactttgctcagcgcatttcttctctatcgactcgcgatgatgatgtggcaaaaccgtcagattgcttttgtctccagtctgatttacatctccatgtttattgttttttccattggctcttatagcgtccttgatcccatgttctctttatgggtcactgcggggattgtaagctgctattgggcacttaaagctggcagtactcgtgagcgaatgttggcattatctgccttagggctggcttgtggcatggcatttatgactaaaggctttttagcattagccttgcccgtcatttccatgatacctatcacgatataccagaaacgtttttgggaaatggttcgctttgggccacttgctgttattttcgctattttgattagtttgccgtgggtgattgcaattgccctgcgggaacctgattactggcattattttttctgggtagagcatatacaacgttttgcatcagataaggcacagcatattgcaccgatgtggtattacctgccaatactggtgttgggtgtgcttccttggcttggattattgcctggttccttgatgaaaagctggaaagagaaaaaaagccatccagaaatgtttttcttgctttgttggttcatcattccatttgtcttctttagtattgcaaaaggaaaattgccgacttacgttttgccatttatcgggcctttggcactgatgatggcaaaatacagtattgattgtgtcagtaatggcaacatgaaagcgctgaaaatgaatgggctggtgaatgttctctttggcattatcgcgatattggtgttactcgttatgcagacactcttaaatcgccctttttatcaacccagcgaatggccaaaatgggtattgggaacggtggcttttggcgcctggggaattattggttacctgtgttttattcataatggcaaacgttggatgtgggcagccgcctgttcattggtactcagtttgacatttggtagcgcattgcccaacaggactatcgattctaaactgcctcagagtttcattaggcaaaatgtgcaagagttggctgacagtaaatatattttatctgaggcagtgggtttgggagccgcggtagcatgggaattaaaacgcagtgacatttacatgtttgatcgcacaggcgagttagagtacggtcttgcctatcctgacagccaataccgatatgtagcacaagaaaaattccctacgtggctggagaaagcgcgtaaagaaggtcaagtagcgattgttttcctattgtcttcaaaaggaggtcttcctgagttgcctaaacctgatcttgtgcgccgtagtgaccgttttgttcttgtgatttataaaaagcaatcatga

SEQ ID NO: 731 - DNA, 912 bp, Xenorhabdus bovienii
  Coding DNA location: Contig name=SeqID_16846; Position on contig =70254..71165bp; Strand=-
atggttgggaataatgtgatgaagaaagttggtttgagaattgatgtggatacttatcgaggcacaaaggaaggtgtaccgcaattgcttgaaattttgcagcgacaccacattcaggccagctttttcttcagtgtagggccggataacatggggcgccatttgtggcgcctactgcgaccaaaatttctgtggaaaatgttgagatcaaatgccgcgtccctttatggtttggatatcttgctggctggtacggcgtggccagggaagaagatcgcaaaagatttagggtatctgatgaaacaggcaatggaggctggtcatgaagttggtctgcatgcatgggatcatcaaggctggcaagccaaagtagagcgctggtcagaggttgaattagcagagcaggtgcagctaggtattgatgcattgaaaaaagcaacagggcaagcgattacgtgctcggcagttgcaggatggcgggcggatgaacgtgtactgacggttaaacagcgatttggttttgattacaatagtgattgtcgtggaacacacccattcaggccactattacccgatggaaccattggcactgtgcaaatccctgtcacattaccgacctatgatgaagttgttggaacacaggtcagagatgtagatttcaatcgctttatccttgatgaaattaaaaatgatcttggtgtttctgtttatactattcatacagaagttgagggcatgtcgaagtcttcacagtttgaaaccttactgaatatgctccctcagcaaaatattcagttttgtaaattaagtcatttgctacctgaaaatagagaaacgcttcctgttgggaaaattgtccgttcagattttcctggtcgtgaaggctggctaggttgtcaacaaaaggtatga

SEQ ID NO: 732 - DNA, 1986 bp, Xenorhabdus bovienii
  Coding DNA location: Contig name=SeqID_16846; Position on contig =71168..73153bp; Strand=-
atgaaagcagtaatttttgcctatcatgatattggttgtgtcggacttaatgcactgattaaagctggctttgacattcaggccgtatttacacacactgatgacccgaatgaaaaccattttttctcttctgttgcacgcattggtgccgattttggattacctgtatttgcgccagagaatgtaaatcatccgctttggattgatcgcatccgcgagatgaagccggatgttatcttttctttttattatcgcaacatgctcagtcaggatcttttatctttagcagaaaaaggtgcgtttaacctgcacggttcattattgccgaaatatcgtggtcgcgctcccgttaactgggcggtgttaaatggtgagaccgagacaggcgtgacactgcataaaatggtgataaagccggatgcaggagatatcgttgcgcagcagactgtactgattggtgaaaccgatacttcactggatgtgcatggcaaaatccgcgaggccgccgttgaattactggatagtatcttacctcaaataaaatcaagtcattatttgtccatcccacaggacgaaaatcaggccacttattttggtcgtcgtacggctgaagatggcgaaattgattggcataaatctgctaaagagattaataacctggttagggcggtaactgagccatatcctggggcatttacgttccttggcgagcgtaaaatcacggtttggcgttcgcgtccactcactcaggttcatgacaaacttccaggaacggtgctttctactgctccatttgtcattgcctgtggagaaggtgcactggaaattaccagtggccagggcgaatccggtctttatgttcaaggaagccgactggtgttagaaatgggcattgtgacaggtgttcgagtcggatcgaaagcaaccgcacaaatcagtcgtcgtaagcgcgtgctgattctgggagttaatggatttatcggcaatcacttgacagaacgtttgttaaacgatggcaagtatgacatctatggaatggatattgggtcttctgccattgagcggtttattggcaatccacgttttcattttattgaaggggatgtcagtatccatacagaatggattgaatatcacatcaaaaaatgtgacgtcattcttccattagtggcgattgcaacacccattgaatatacccgtaatccactccgtgtctttgaactggattttgaagagaacctgaaaattgttcgctattgtgtgaaatataataaacgaattattttcccgtcaacatctgaagtctatggcatgtgtgacgacaaggaatttgatgaagatacttcacgcctgattgtcgggccaatcaataaacaacgctggatctattcagtatccaaacagctacttgaccgggttatttgggcatacggtgtaaaagaaggtttgaaattcactttattccgtccatttaactggatggggccaagattggataacctgaattcggcgcgtattggtagctcaagggcgatcactcagttgattttgaatctggtagaaggctcacccatcaaattggttgatggaggagagcagaaacgttgtttcactgatatcaatgacggaattgatgctctgttcagaatcatcgaaaaccgtgatggactgtgtgacgggcaaattattaatatcggtaacccaaccaacgaggccagcattcgccaactcgctgaaatgttgctggaaagttttgaagaacatgaattgcgcggaaatttccctccgtttgccggattcaaaaagatcgaaagcagtagctactatggtcagggctatcaagatgttgaacatcgcaaacccagcatcaagaatgcggagcgtctgctgggatggaaaccaaccattgatatgaaacaaaccattgatgaaacactagatttcttcctgcgtggggaaattgaagaattaacaagggaagattag

SEQ ID NO: 733 - DNA, 1014 bp, Xenorhabdus bovienii
  Coding DNA location: Contig name=SeqID_16846; Position on contig =73153..74166bp; Strand=-
atgcaatcactgaaattctttcggagcatagaaatagtgacatttgaaaaaattaagaaagtctcggttgttattccggtttataacgaagaagaaagtctaccccaattattggaaagaacgatcgctgcgtgccaacaacttgagcagaaatatgaattaattctggtggatgatggcagccgtgacagctctgccgatattttaactcaggcggctgaaacccccgaaaatcacgttattgctattttacttaaccgtaattatgggcaacattctgcaatcatggcgggatttcatcaggctgatggtgatcttgtcatcacacttgatgcagacttgcagaatccgccagaagaaatcccccgtttggtgaaaacggcagaagaagggtatgacgttgtgggaactcgccgtgccaatcgtcaggattcttggttccgtaaaactgcgtccaaaataatcaatgcgatgataactaaggctacaggccgttcgatgggtgactacggttgcatgctgcgcgcttatcgccgtcatatcgtacatgcgatgctgcaatgccatgaacgcagtacatttattcctattctcgctaacacatttgcccgtagaacgactgaaattgatgtaactcatgcagaacgtgaatttggggattctaagtacagtttcatgaagctgatcaatctgatgtatgacctgttgacttgcctgacaactgcgccgctgcggttattgagtgttgtaggaagcattattgctgtgacaggttttctgctggcggtattactgatcgctttgcgcctcattttcggatcaatatgggctgctgaaggtgtatttactctatttgccatccttttcatgttcattggtgcacaattcgttgcgatgggattgctcggtgaatacgttggccgaatatataacgatgttcgtgcccgcccgcgttattttattcaaaaagtagtcggagttagaaagatcaacgacaatcaggaaaaaagctaa

SEQ ID NO: 734 - DNA, 1158 bp, Xenorhabdus bovienii
  Coding DNA location: Contig name=SeqID_16846; Position on contig =74120..75277bp; Strand=-
atggataattttctgccattctctcgtccagcaattggacatgaagagatagaagcaatagaacaggttttacgttcaggttggattacgacagggccacaaaaccaccagttagagcaggatttttctcgtatatttggttgcagacacgcaattgcattatgttctgctacggcggggatgcatttggttctgctagcattgggcattggcccaggtgatgaagttatcaccccttcccagacctgggtttccaccatcaacatgatttgtcttctgggcgcagagcctgttatggtcgatgttgaccgtgatacgctgatggtaagtgcggaagcagtcagaaaagcgattacaccaaacactaaagctattattcctgtccattatgcaggcgcaccttgtgatcttgatgccctgcgtattgttgctgacgaagctaatatccctctgattgaagatgctgctcatgctgtaggaacccgttataaaaatgaatgggtgggagagcgaggaacggcaatcttttcttttcatgccattaaaaacatgacatgtgctgaaggcggcatgttcgttacggataatgacgagcttgcacaccgggttcgctgcctaaaatttcatggattggctgtcgatgcatttgatcggcagattcagggcaggaaacctcaggcagaagtcattgagcccggttttaaatataacttatcagacattcatgcggcgatggcggttgtacagttaggcaaactggaatccatgaatgcccgtcgcggggagttagtagctcggtatactgccgcactgagcaattcaccgttacaaatgttgagtgttcctgaatatgaacacgggcatacccatcatctattcatggtgcgtgttgaccaagatgtctgtggtattgatcgcgatactttcatggcacgtttaaaagaaagaaatattggtacaggcttgcatttcagggctgcacatacacaaaaatattatcgggaacgttatccggtgctgtctttgcctgcatcggagtggaactcggcaacactttgctcgttgccgctttttccagacatgaataatgacgatgtagatcgtgtcgtgaatgcaatcactgaaattctttcggagcatagaaatagtgacatttga

SEQ ID NO: 735 - DNA, 768 bp, Xenorhabdus bovienii
  Coding DNA location: Contig name=SeqID_16846; Position on contig =75434..76201bp; Strand=-
atgacctgtcaaccgattttagaattgaataatattacggttgacaagagactgaccacattgtctgaatctgttatagcaagagagcaaattcatctggtcggattgaatggttcagggaaaagcacgctgctttcagcgattgcaggaattttaccttacagtggcaagattcatctgaacggcagaaacctgtgtgattatcggcagcacgagttagctaaatatcgggcatggttttcccaatcagtttctgttcctatcatgccagtttaccagtatctggatatgtatcgtcctgattcagtgccattggatcagagtgaaagtgtgttatatgaactttgtcggcagctaaaactcacttcattactgtcttcgtcaattgggcaactatcaggaggtgaatggcagcgtgtcaggctggcaggggtctttttgcagatatggccagagttgaatccgaatggaaaattattactccttgatgaaccgacaaacaacctcgatattactcagcaagcagttttggatcagttaatcaaacaattttgttcattgggcggctcggtcttaatgagcagccatgatcttaatcacacctatgaacaagctactagtgtatggttattgtcgcatggaaaattgttagtatctggaataccacaaaatgttatgaccaatcaaaatttatcagaaatttttgaagtaaatattagacatatccaaaataccagctataaactatggagggtcgatcatctttaa

SEQ ID NO: 736 - DNA, 996 bp, Xenorhabdus bovienii
  Coding DNA location: Contig name=SeqID_16846; Position on contig =76234..77229bp; Strand=-
atgcactctgtctatgaattaatcactctccagaaaaaacgtgactatcgtgtgatagcactcctatctatcttatttattatgttatttattttgtcattgtgtgcaggagaattatggttctggcctaatcaatggctgtctgactcggctcgattgtttatctggcaattgaggttgcccagagcgattgcggtgatagtggttggtgcgagtttggctgtgtctggcgccgtcatgcaggcgttatttgaaaacccgctggcagagccgggattattggggatcagtaatggcgctggagttgttgtggtatgtctgatccttgtctttcatggtattgctccattgtggttattaagtattggtgcggttcttggggcgttcgccatgactgctattttgttgggcttttccagaaaacatcaagtgacgaatacacggttgctattgattggcgtcgctttcggagtgatatttggcgctatgatgacatggatggtttacttcagtaccagtttggacctgcgtcagttgatgtattggatgatgggtagtttcagcggtattgactggcgtcagaaatggctggttattgcactggttcccgctactttctggctgagtcaacaagggaaaatccttaattacctatcgcttggtgagttacaggctcagcaattgggaatatcacataataagtggcgtaatttatttgtatcggtagttggattgttggttggtttgagcgttgctttggcaggggcgattagtttcattggtttggtgattccacatatcttaaggttgactggtctgacagatcataagaccttgcttccagcttgtgcactggcgggaagtagtggcttattattggcagatctattttcccgcctgtcattatcccatgcggaagtgccgattggtgtggtcacggtaaccttgggagcgccaatttttatatggctactattaaaaacacatcatagataa

SEQ ID NO: 737 - DNA, 165 bp, Xenorhabdus bovienii
  Coding DNA location: Contig name=SeqID_16846; Position on contig =77224..77388bp; Strand=+
gtgcattggcggcaccagaaaaaagaaatgtatcccattgtatacaatgggatattaaaggtaagaaaaagaccgcacaataatgcggccttttttatgtgttttattcttttggtaaagctttttccacccgatttttcaacttttgacctgggcgaaacgtaa

SEQ ID NO: 738 - DNA, 297 bp, Xenorhabdus bovienii
  Coding DNA location: Contig name=SeqID_16846; Position on contig =77327..77623bp; Strand=-
atggcgcttactaaagctgaaatgtcagaaaatctgtttgagaaactgggtattagcaaacgtgacgctaaggatctagtggaaatattctttgaagaagtgcgtcattctttagagaatggggagcaggttaaattatctggatttggcaactttgatttacgagacaagaatcaacgtccaggtcgtaatccgaagacaggcgaagatattccaattacggcccgtcgtgttgttacgtttcgcccaggtcaaaagttgaaaaatcgggtggaaaaagctttaccaaaagaataa

SEQ ID NO: 739 - DNA, 2388 bp, Xenorhabdus bovienii
  Coding DNA location: Contig name=SeqID_16846; Position on contig =77628..80015bp; Strand=-
atgaaattcagtgaactctggttacgcgagtggactaaccctgccatcagcagtgaagcattgtctgatcaaatcaccatggcaggtttagaagttgatggtgttgaaaaagtggcaggtcaattccacggtgttgttgtgggtgaagtcgttgaatgtggccaacatccaaacgcagataaattgcgtgtcacaaaagttaatgtaggtggcgatcgcctgctggatattgtttgtggtgcaccaaattgccgccaggggctgcgtgtcgccgttgctacagtgggcgcggtgttaccgggtgatttcaagatcaaaactgcgaaattgcgcggagagccatcagaagggatgctctgttctttctctgaactgggtattgcaaatgatcatgatggcattattgaactgcctgcggatgcaccgattggtactgatctgcgcgattatatcaaattgaatgatagcgtcattgaaatcagcattacacctaaccgtgcagattgtctaagcatcatgggagttgctcgtgatgttgctgtcatcaataaactgtcaatgacagagccacagatcgagtttgtaaaactaactacagaagctacattccctatccgtgtcgacgcaccagaagcctgcccacgctacttgggacgtgttatcaagaatgtaaacgttaaggctgaaacaccactgtggatgcgtgaaaaactgcgtcgtggtggtattcgttctattgatccaattgttgatgttactaattatgtactgttagagttgggacaaccgctgcatgcattcgatttggaacgcttaagtggctcaattactgttcgtctggctgagcagggtgaaaaattaacactgctagatggtaacgaaatagaactttctgctgatacactcgttattgctgatgaaaagcaagcgcttgcaatggcaggaatttttggcggccaatattctggtgtgaatgctgaaacacagcatattttactggagtgtgctttctttgcaccattagcgattacaggccgtgctcgtcgttatggtctgcatactgatgcttcccatcgttttgagcgtggcgtagatccacagcttcagtataaagcgatggaatatgccacccaattgctgattgccatttgtggtggggaagcgggagagatcattgatgttaccagtggatcctatttgccaaaatcggtgactattactctgaatcgcaagaaattggatcgcctgattggtcatcatatcgttgatgacgaagttacggatattctgacacgtttaggctgtcaggtgacagttcagaacgatagctggcaggctgttgtacctagctggcgttttgatatgcagattgaagaagatctggttgaagaaattgcacgtatttacggttacaataacatcccagacgtgcctgtgcgcgctgatcttgtgatgactgcacaccgtgaagctaatctgccattgaaacgcgtcaaaacgatgctggtggacaaaggctatcaagaagcgattacctacagttttgttgatccaaagattcagcaatatttgcatccgcaggaagaagcattgatcctgccaaatccgatttcggctgacatgtcggctatgcgcttgtcattgttgacaggattattgaccactgttgtttataaccagaaccgtcagcaaaaccgtgtccgcttgtttgaaactggcttgcgttttgtgcctgatgaaaatgctgaacatggtattcgtcaggaattgatgcttggtggcgtgatagcaggaaatcgttttgaagaacactggttgattgaaaaacaagcagttgatttctttgatcttaagggcgatttagaatccgttttagaattgactggtatgctatctagcatttcatttagggcggaggaacatcctgctttacaccctggacaaagcgctgggatttatctggaaaataattatattggttatataggtgttgttcatccagaattggagcgcagatttgacttaaatagtcgcaccgtgatattcgaattattgtgggccagtctggtggaccgcgtgattcctgaaatgaaggaagtttctcgcttcccatctaatcgccgtgatatcgccatagttgtgcctgaaaatgtagccgcagaagatgttcttgctgaatgtaagaaagttggcgtaaatcatatagttggcataaacttatttgacgtgtattgtggtaaaggtgtcgcggaaggctacaaaagccttgctattagcttaatcttgcaggataccgtgcgtacactggaagaagaagaaattgctgcgaccgtcaacaaatgcgttgctgcattagaacagcgattcaaagcatccttgagggactga

SEQ ID NO: 740 - DNA, 984 bp, Xenorhabdus bovienii
  Coding DNA location: Contig name=SeqID_16846; Position on contig =80030..81013bp; Strand=-
atgtcacatcttactgagctggttgcaaaggcaaaagcagccgtagaggaagcccaggatgttgccgcgttggatttggtgcgagttgaatacctgggaaaaaaaggccatttaaccctccagatgtcatcgctgcgtgacttaccagccgacgaacgtccagcggcaggggctgttattaatcaggcaaaacaggaagtgcaggaagcattgaatgctcgtaaggcaaaactggaagctgatgttctgaatgcacgtttggcagcagaaaaaatcgatatttcattgcctggccgtcgtatggaaaatggtggattacatcctgttacccgcactattgaacgtattgaaactttctttggcgaattgggtttttctgttgaatctggcccagaaatcgaagatgactatcataacttcgatgccctgaatattccggcacatcaccctgctcgtgctgatcatgatacattctggtttgatgcaacgcgcctgctgcgtacacaaacttcaggagtacagatccgtactatgaaagaacgccagccgccgatccgcatcattgcaccaggtcgcgtataccgcaatgattatgaccagacacatactccaatgttccatcaggcagaagggctgattgttgataaaaatatcagctttactaatctgaaaggtacattgcatgactttttgaataactttttcgaagaagagatgcaggttcgtttccgtccttcctatttcccatttacggaaccttccgcagaagttgatgtgatgggtaaaaatggtaagtggctggaggtattgggttgcggcatggtacatccaaatgtattgcgcagtgttggcattgaccctgaagtctattctggttttgcttttggcatgggaatggaacgcttaactatgttgcgttacggcgtcacagatttacgtgctttcttcgaaaacgacttgcgtttcctcaaacaatttaaataa

SEQ ID NO: 741 - DNA, 117 bp, Xenorhabdus bovienii
  Coding DNA location: Contig name=SeqID_16846; Position on contig =81061..81177bp; Strand=+
atgccccaaatagctattagtgaggtcataaaaataaaaaagcctccacactggaggctcaagcgctgtttttcgtttcttttcttacgcgcaaagccccccgatttcaggcgctaa

SEQ ID NO: 742 - DNA, 126 bp, Xenorhabdus bovienii
  Coding DNA location: Contig name=SeqID_16846; Position on contig =81167..81292bp; Strand=-
ttgctccctcttttactttcccccaaaatatggcttactattgattgggttaataaggacataatggagagaatggcaatgatgaaattagctttttttcgtttctttttttactttagcgcctga

SEQ ID NO: 743 - DNA, 357 bp, Xenorhabdus bovienii
  Coding DNA location: Contig name=SeqID_16846; Position on contig =81313..81669bp; Strand=-
atggctcgcgtaaaacgtggtgttattgcccgtgcacgtcacaagaaaattttaaaacaagcgaaaggttactatggtgcccgttcgcgcgtttaccgtgttgctttccaggcagttatcaaagctggtcaatacgcttaccgtgaccgccgtcagcgtaaacgtcaattccgccaattgtggattgcacgtatcaacgctgctgcacgtcagaacggtatgtcttacagccgtttcatcaatggcctgaaaaaggcttcgattgaaatcgaccgtaagattctggctgacatcgctgtattcgacaaagtagcgtttgctgctctggttgaaaaagcgaagggcgctctggcataa

SEQ ID NO: 744 - DNA, 198 bp, Xenorhabdus bovienii
  Coding DNA location: Contig name=SeqID_16846; Position on contig =81713..81910bp; Strand=-
atgccaaagattaaaacagtacgcggcgcggctaaacgctttaagaaaactgccagtggtggtttcaagcgtaagcacgctaaccttcgtcacatcctgactaaaaaatcaactaagcgtaagcgtcatttacgtccaaaaggcatggtctccaaaggagatttgggcctggttgttgcttgtctgccatacgcataa

SEQ ID NO: 745 - DNA, 339 bp, Xenorhabdus bovienii
  Coding DNA location: Contig name=SeqID_16846; Position on contig =82006..82344bp; Strand=-
atggactacggcaagttcctctatgagaagagtaaatcagtcaaagaacagaaaaagaaacaaaaggttattcaggttaaggaaatcaaattccgtcctggtacagatgaaggcgactatcaggtcaaactacgcaacctgattcgttttctggaagatggcgataaagctaaaatcaccctgcgtttccgtgggcgtgaaatggcgcatcagcagattggtatcgaaatgcttaaccgcattcgtgaagatctgagtgaactggctgtggtcgaatccttcccatcgaggatcgaaggccgccagatgatcatggtgctcgctcctaagaagaaatag

SEQ ID NO: 746 - DNA, 183 bp, Xenorhabdus bovienii
  Coding DNA location: Contig name=SeqID_16846; Position on contig =82343..82525bp; Strand=+
atgatacgacaaaccggcggttcggcatttgggctgatttcaactaaatcaacaccagcttcctcagctttctcaagagcttctctcagactgacaataccaatctgttcgccatctaatcctgttaaacgaacttcagaggcgcgaatctcttcattaatgcgatttgggcgcgccggttga

SEQ ID NO: 747 - DNA, 270 bp, Xenorhabdus bovienii
  Coding DNA location: Contig name=SeqID_16846; Position on contig =82549..82818bp; Strand=-
tatgtacaggaattggttaaaaaacttcaagatgctggcgttcgtgcaaaagcagacttgagaaatgagaagattggttttaaaattcgcgaacacactctgcgtcgagtgccttacatgcttgtttgcggcgataaagaggtcgaatcaggaaaaacttctgttcgtacccgccgtggcaaggatttaggtagcattaatgtcagtgagtttacagaaaaactactgacagaaatacgcagtcgcaatcttcatcaattggaggaataa

SEQ ID NO: 748 - DNA, 633 bp, Xenorhabdus bovienii
  Coding DNA location: Contig name=SeqID_16847; Position on contig =923..1555bp; Strand=-
ttgagtaagaaaattgctgaaacaatacggaataaattggttattggggagttgttacccgggcaacgcttatcagaagccgcgctcagtgaacagcttgagatctcacgcaatacgttacgtgaagtattccgcgttctaactcaagaaggattactgaaacaccagcccaatcgcggtgtatttgtagcgattcccgatattgcatccattattgatatctatcgggttcgacgactgattgaatgtcaggctctcactcaggcatattccatgcaccccagcgttgccaaaatgaaagaggctgtgaccagtgcgcaactgtatcgaaataaccaagattgggttggcgtcggcaccgcaaatatgcgttttcataccgcaattgtggaattaactgacagtgaaagattgattgctttctaccgcaatatctcagcagaacttcgtttggcttttgggcttttgaatgatcctgagctactgtatgccccttatattgataaaaatgcatatatactggagcttttagattctggtcagacagaattagcagctaaaaagatgaaagattatctagagttatcagaaagaacagtattggcagcttatactcgtaaaaataacgaataa

SEQ ID NO: 749 - DNA, 1167 bp, Xenorhabdus bovienii
  Coding DNA location: Contig name=SeqID_16847; Position on contig =2020..3186bp; Strand=+
atggcaacatcggcgattgggccgggtttcattacgcaaacagcaacatttactgcaacgatgggcgccgcttttgcttttggtattttggcctcgatcctgattgactttgtggtacagcaaaatatttggcgaattgttaccttaactaagatgcagtcggccgatatcgccaatgcagtgatccccggaagcggttatttattggctgcactagtgatgtttggaggattggtcttcaacgtcggcaatattgctggcgctggattggggcttaatgctctgattggtttagaacctaaatggggcggattattaagtgccttgatggcgatttatatttttacctcgcgtaaggctggggttgccattgatcggattattgtcgtattaggcgtagttatgatagggctgaccctgtttgttgcgatagtttccaatcctccagtgggggaggcgttgcggcaaacggttctgcctgatgacatcaattttgcgactattacgacaattgtggggggaacagtcggtggttacatatgctatgcaggggcccatcgtctgctggataaaggtatgacaggcgtagagaacattgatgctgtatccagtgcggcaactaaaggaattttggcagtaggactgatgcgttattttttatttttggcaatattgggagtggttgccagtggtgtcacactcgatattgccagtgaaacggcaaatcctgcttcacaagcctttcaggtcgtagtgggtgaatttgggttgcgtatttttggcttgattctgtggtctgcggcaatcaccagtgttattggggcggcttatacctctatctcttttgctcgcgtatttaaaaaacaattgactgatcgtcagctcaatatagttactctctgttttattaccctctcattagcagtttatttattgataggaacacctccagctgctttgctggtgtttgcaggcggctttaatgggctgattttaccccttggtttgactatctttgtttatgttggctggaaacgggctgatctcatgggaggataccattatcctcgctggttactatggtcagggttcatcacctgtgtactgacatggtatatgggagcgatgtctattagttcaattttcgcttttctgaaagcagcttaa

SEQ ID NO: 750 - DNA, 768 bp, Xenorhabdus bovienii
  Coding DNA location: Contig name=SeqID_16847; Position on contig =3197..3964bp; Strand=+
atgataaaagcaattgatttaaatagtgatcttggtgaaagttttggtcagtggaagatgggtaatgatgcagaaatgctgggtattgtcagtagtgcaaacgtcgcttgtggttttcatgctggagatccggtaggtattttgcagacgctgaaatctgcaaaggaaaaccaagttgctatcggagcccatgtatcttatcccgatttagtcggttttggtcggcgtagtatggatattgccagccacgaattgacagcagatgtgatttatcagattggcgccctgcaaggtttggctctagcagcaggaacaagtgttcgttatgtgaaaccgcatggtgcgctgtataacacgatcgctaatgatgagcgccaggcacttgctgttattgaagggattttggtgattgatcctaatcttgctttagttggattggcaggatcaaatatcctccggttggcacaggaaaagggtttgaaaactatcgcagaagcctttgcggatcgtgcttataccgcagcaggggagctagtttcccgtcgtgaagccggtgcggtgttgaacgatgcgaatcttgtggcacaacgcatgttgcaattggtgactgaaggtggagtagattccattgatggcaaattcacacctatcaaggcggattccatatgtgtgcatggggacagtccaggggctttggatatggcaaaacaggtaaaaaaagttctgcgacaggcagggattaccattcagtcatttatccacgcataa

SEQ ID NO: 751 - DNA, 1599 bp, Xenorhabdus bovienii
  Coding DNA location: Contig name=SeqID_16847; Position on contig =3996..5594bp; Strand=+
ttgcgttttttacctgttaatttcaatacaatacttgttgaactcagtggattgccagaaacactggcgttgtttgattcactgagtattgctcctgtattggggattgaagagattatacctgcggcgagaaccctgatgattcgttttcgtccaacgaaaatctcaattcaccaactcgtagcagaaatgggtcaccgtgacttgcatgagtgcagtcattctcaaggaaaacagattgaaattccggtgcactataatggtgaagatttagcggaagttgctgaaatattggggggcacggttcaagacgttatccgccagcataccgaaaacgaatatacagtggcttttagcggatttgcgcctggttttgcttatatggtgtcggatacggcacagtggaatattccccgtcggcaaacaccaagaacccgtattcctgctggtgcggttgcactagcgggagaattcagtggtatttaccctcaggcgagtcccggtggttggctgattatcggcatcacaaccgaacgtatgtgggatctttcccgtcctgatcctgctctattacaaccgggttatcgcgtcaattttcgggatgctgaacgtgccactgtaacggtaagtttgccagaaacctcacgcaccaattcggtttctcaatctgaaacttctcgctatttagaaatccggagtgtgggattgcaaaccctatttcaagatttaggacgttttggtaaatcgggattggggatctcagaatccggtgctatggataaaagtgctttgcgaagtgcaaaccgtatcgtagggaatgcttccgagcaggcgtgtctggaaatcgtgcagggtggttttaaagcggttgcctgtgggcagatgatggttgctgttacaggtgcgctatgttcaattgagatcaaaaccccgcagggtgaactcatttatgtaagtgcttacaaacccattgatttaaatgatggtgatgaaattatcttgggaagacctgatgcgggaacgcgttcttatttggccgtgcggggtggttttacgatcccctccgtattatctagtcgctcatttgatacgctatctcatatcgggcctgagccattaaaagccgaagataaattggctgtgggaacaacgtctcattgcgctgcggtgtctttctcggagacgcctgcttttgtgatgccgaataaaaatgaggttgtggtattggatgtactccttggccctcgcactgactggtttactcaagagtcgattgatttattacgaaaccagatttggcaggtgacgccacaatccaaccggattggcttaagattaaatggtgagtgctcactatcacgtattaagcgccaagaactgcctagcgaaggaacctgtgccggagccatccaaattcctgccagtggtcagccagtgctgtttttgtctgatcatccattgacgggggggtatcccgtcattgcttctgtggcacattatcatcttgatcttgctggtcagatcccggtcaacgccaaagttcgatttaatcccatcagacaattccacgaaatatcagggagtgaagacttgctatga

SEQ ID NO: 752 - DNA, 1776 bp, Xenorhabdus bovienii
  Coding DNA location: Contig name=SeqID_16847; Position on contig =5591..7366bp; Strand=+
atgaacaccactgtgaacaatataaataagaatccaaacaaagtgctgattgccaaccgtggtgagattgccgttcgtattattcgagcctgccgtgattatggcgtgcagactattgctgtttatgcggatgctgatattaatgctcaacatgtgcaattggcagatgaagcttacggtttatcggggaatagctccgcagaaacctacctcaatattccacgtttattggcgatagcgaagcagtcgggggcaacgatggtgcatcccggatatggattcttgtctgagcgagctgaatttgcccgtgccgttatggacgcaggattgatttggattggccctaacccagaaaccattgatgaacttggcgataaggttaaggctcgtaagatcgcccacaaagttggtgcgccattggtcgttggtacgtcggagccagtcaaagatgcgcaggaagttgtcgcctttgcggaggaacatggcttgccgattgctattaaagcagcatttggcggagggggacgtgggctgaaggtcgcttggcggctggatgaagtggaagaactttatcactcggcagtacgtgaggcgacagccgcatttggccgtggcgaatgttttatcgaacagtttcttgataaaccgcgtcatatagaagcacaggttattgcggataaacagggccatgttgtggtgcttggcacccgtgattgctccttacagcgccgcaaccagaaattagtggaagaagccccgacaccatttttgactcaacagcaacgggagcgtattcatcaggcggcaaaagcgatttgtgcggaagccaattatgtgggagcgggtacagttgaattcttactaagcgccgatggaacgctctcttttttggaagtgaatactcgcttacaagtagagcatcctgtcacggaggaaacgacaggtatcgatctcgtgattgaacagttgagaatcgcggaaggccatccattgagtattcaggagacgccagttccaagaggccactcatttgagtttcgcatcaacgctgaagatgcaggcaaaggtttcttaccgatgtcagggactatcagcgaatttaccccgccttccggccccggtattcgtctggattctggcgtgatcagtggctccactattcctgcgacctttgattctctgatggcgaagttgattgtcacaggcacaacccgcgaacaggctatttcgcgcgcacgtcgggcactacgggaattcaaaatccgtggtgtggcttcagttttgccttttcatcaagccgtgatggaacatcctgattttgtttctgatgatgtcttcaatgttcatacccgttggattgaaacggattttgcgaatgagattgaagcgttaccacgtcaggttgtgacagaagatgacagcatcactcgtacatatattgaaattgatggccgcaggcatgagctcggattgcctgccgatttattagcgggattttctcatttggcgcctgttagggaacagcaatcttcccagtctgcgataaaggaaaaaatgccggcagactctcgtcaggtgaaagcaccgatttccggtatcttacattcttggattgtgaaagaaggtgaacaggtcaatgaaggtgatgtaattgctgtgatggaagccatgaaaatggaagtgcaaattaatgcacaccgtgcagggaaaatcacattctgtgtacaggcaggggattatcaggatgcagaaagcactctggcccatattgagtag

SEQ ID NO: 753 - DNA, 270 bp, Xenorhabdus bovienii
  Coding DNA location: Contig name=SeqID_16847; Position on contig =7614..7883bp; Strand=+
atggttaagacaatatctcagaaggcagctcgtgaaagcttaggatctccagaattctttgagggaggggtttatgtcaccaaaaatggtgtttctgaattatttgttcaaacggcgaatgaacgagatgccgaattggaggaaagagtgcttgagcgtcaggttcacgcactactaaaactcactatgatggcaaaacaggatgttgttcatgaaagaacgatgacacctgatgaagcgttaaaaaaattacgagcatcgagaaaataa

SEQ ID NO: 754 - DNA, 339 bp, Xenorhabdus bovienii
  Coding DNA location: Contig name=SeqID_16847; Position on contig =7896..8234bp; Strand=+
atgtccaatatcaggctgacagaaacagcagttcggtgtttagaagatattgaatcatttaatgccttgcgattgtcaccacagaaagcgattaaaattacagaatcattgcttcgtgagtcaattactgcgattagtgatgatcctaaacgttatcgcttcaatgcgagtttgttggatttaggtttatttgttcgggaacgtttagatattgatagaggatatcgagtgttatacgaaattaaggatgatttaatttatattttattatttttaagcactaaacaagatctcactgacgcactttatcgtcaccaaatcctgcgttctctccaataa

SEQ ID NO: 755 - DNA, 354 bp, Xenorhabdus bovienii
  Coding DNA location: Contig name=SeqID_16847; Position on contig =8271..8624bp; Strand=-
atgaatcaacgacctaagcgttccgatgaaccgattttctggggtctatttggtgccggcggcatgtggagcgccattgttggtccggcgatggttctgctgctgggctttctgatcccgttgggattggcaccggaagcactctcttatgatcgtgttctgacattctgccagagtttcattggccgtatttttttgttactgatgatcagcctgccgctctggtgcgggatgcaccgtctgcaccacggtatgcacgatctgcaaatccatatcccagccagtaaatgggggttttatggtacagccgctattttgagtgtggttgccttgattggggtgtttacgctgtaa

SEQ ID NO: 756 - DNA, 396 bp, Xenorhabdus bovienii
  Coding DNA location: Contig name=SeqID_16847; Position on contig =8641..9036bp; Strand=-
atgacgactaaacgtaaaccttatgtgcgcggtatggaatcccattggtggcataaattaggcttctatcgtttttatatgatacgcgaaggcactgccattcccgccatttggttcagcctgctggtgctctatggtctgtttgccctgaaagatggctcagaaagttgggtgggttttatctcttttctacaacatccggcggtactggtgattaatattatcaccttgctggcgaccttgctgcatacaaaaacgtggtttgaactggctccgaaagcgctcaatatcattgtcaaaaatgaaaaaatgtcaccggagccgattatcaaactattgtgggcaatcactctcattgccaccgccgtgattctcggcgttgcactattttactga

SEQ ID NO: 757 - DNA, 735 bp, Xenorhabdus bovienii
  Coding DNA location: Contig name=SeqID_16847; Position on contig =9051..9785bp; Strand=-
atgactgagatgaaaaacctgaaaatggaagtcatgcgctataacccggaaatcgacagcgaacctcatttcgtcacctacgaggtgccttatgatgagcaaacctccttgctggatgcgttaggctacattaaggacaatcgggctcccgacctgtcttaccgttggtcttgccgcatggcgatctgcggttcctgcggcatgatggtaaaccgtgtgccaaaactggcgtgcaaaatctttctgcgcgattatccgcaagggatgagaattgaagcgctcggcaacttccccattgaacgagacttagttgtcgatatgactcactttattgagagtctggaagctatcaagccttatatcattggcaatgatcgcaagcccgctgatggcccgaatgtgcaaacacctacacaaatggcgaaatatcaccagttttcaggctgcatcaactgcggcctgtgctatgccgcctgcccgcagttcggcctgaatcctgaatttatcggccctgccgcagtcacgctggcacaccgttataaccttgatagccgcgaccacggcaagaaagagcgtatgcctcagatcaacagtgacaatggcgtgtggtcttgtacttttgtcggttactgctctgaagtttgcccgaaacacgtcgatccggcgggtgcaattcaacagagcaaagcagaaagtgccaaagatttccttatctccatgctgaaaccacaataa

SEQ ID NO: 758 - DNA, 1797 bp, Xenorhabdus bovienii
  Coding DNA location: Contig name=SeqID_16847; Position on contig =9778..11574bp; Strand=-
gtgcaaaccttcaatgccgatttagccattatcggagccggtggcgcaggcctacgggcagccatcgccgctgctgaagccaatccccagctcaagattgccctgatctcaaaagtttaccccatgcgcagccatactgtggccgcagaaggtggatcagcagccgtcactcaatcccatgactcctatgactttcacttcaatgacaccgtgtcgggtggcgactggttatgtgaacaagatgtggttgagtatttcgtcaaacactgcccgacagaaatgatccagctggagcaatggggctgtccctggagccgcaaggaagacggttccgtgaacgtgcgtcgtttcggcggcatgaaaatcgaacggacatggtttgccgcagataaaaccggctttcatatgctccatacgctgttccagacttccctgaaatacccacaaatacaacgctttgatgagcactttgtgctcgatattctgatagatgaaggtcaggtgcgcggtttggtggcactgaatatgatggaaggaacgaaagttcagatccgtgccaatgcggtcattatggcaacgggcggagcaggacgcgtataccgttataataccaatggcggcattgtcacgggagatggcatgggaatggcattccgccacggcataccactgcgtgatatggagtttgtacaatatcacccaactggcctgccgggttctggtattttgatgacagaaggctgccgtggtgaaggtggcattctggtgaacaaagatggctaccgctatctacaagattatgggatggggccagagacgccccttggccaacccgaaaacaaatatatggaactggggccaagagacaaagtttctcaggctttctggcatgaatggcaggcaggccgtactatcgcgacgccgcgtggtgatgtggttcatctggatctgcgccatttaggtgagaaaaaactgctcgaacgcttgccattcatctgtgagttggcaaaagcctatgtcggtgttgatccggttaaagaaccgattcctgttcgcccaacggcacattacaccatgggcggaatcgaaactaacccgcagtgtgaaacccgcatcaaagggctgtttgctattggcgaatgttcttccgtcggcctgcatggggcaaaccgcctcggttccaattcactggcagaactggtggtatttggccgcttggcaggtgaagaagccgtcaaacatattcaacaagccacacctgccaatgaaaacgtgctggatgcacaagcccgtgatatcgaagataaactcaacaaactgctgaatcagaaaggcggtgagcactgggcgaaaatccgtgatgaactgggtacttcaatggaagaaggctgcgggatttaccgtactccagagctgatgcagaaaaccatggataaaattgcggagctgaaggaacgcttcaagcatatcgaaatcactgaccgttccagcgtgttcaatactgatcttctctacacgattgaactgggctttggtctggatgtcgctgaatgtatggcgcattccgccatgaaccgcaaagagtcccgtggagcccaccagcgccttgatgcaggttgtacagaacgtgatgatgagaatttcttgaagcatacgctggcgttctataacccagaaggtgcaccacgtttggagtacagtgatgtaaaaatcactaaatccaaacccgcgaagcgggtctatggtggtgaagccgcagcacaagagaaacaacagaaggagcaggcgaatgactga

SEQ ID NO: 759 - DNA, 978 bp, Xenorhabdus bovienii
  Coding DNA location: Contig name=SeqID_16847; Position on contig =12446..13423bp; Strand=+
atgaatgaagtcgcggattggcagtcaagtgcccctatcgccaatttattgcaaagggcgaagattcttgcggagatacggcgctttttcgcagatcgtggggtgttggaggttgaaacccctgccatgagtcaggcgaccatcactgacatccatcttgtgcctttccagacacggtttgtcgggccgggagcagcggatggcctgactctgtatctgatgactagccccgaataccacatgaagcgtcttttgacagcaggaagtggttccatttatcagatgggtcgcagtttccgtaatgaggaagcgggtcgccaccataatcctgagttcaccatgttggaatggtatcgtccacattacgatatgtaccgcttgatgaatgaagtggatgatctgttacagcagatcttagattgcgaaagtgcagaatctctttcttaccagcaggcgttcattcgctatctggagattgacccgcttaccgcgagtaaagaaaaactgcgtgaagtggcagcgaagctcgatctcagcaatatcgctgatcaggaagaggatcgggataccttgctgcaactgcttttcactatgggcgttgaaacgcatatcgggcttgaaaaaccgacatttatttatcacttcccggcttcacaagcgtctttggctgaaatcagcaaggaagatcaccgtgttgcagagcgttttgaagtctatttcaaaggcatggaactggcgaatggctttcgtgaactgactgacagccatgaacagcgcctgcgtttcgtgcaggataatcgtaagcgtgaagcgatgggattgcctgttatgccgattgatgaacatctgcttaaagcccttgaacacgggatgcctgaatgtgccggagtcgctttgggagtggatcgcctgatcatgcttgcgctgggcgctgaacggatcagtgaagtgattgcctttccggtcgggatctcctga

SEQ ID NO: 760 - DNA, 1077 bp, Xenorhabdus bovienii
  Coding DNA location: Contig name=SeqID_16847; Position on contig =13511..14587bp; Strand=-
atgcaaacccctatcaaaaccatcatggcaggcctgctgttagcgtcgtcgatgtccggtattgcacatgccgcagacaagattgtgatcgcccatcgcggagccagcggctatctgcctgagcacacactgcctgccaaagccatggcctatgcacaaggtgctgattatctggaacaagatctcgtaatgacccaagataatgaactcatcgtgctgcatgatcattatcttgaccgcgtaacagatgtagcagagcgctttccaaaccgtgcccgtgccaatggccgctactatgctattgattttaccttaccggaaattaaatccctgaaatttaccgaaggttttgatatcgaggagggtaagaaagtacaaagctatcccagacgtttcccaatggggaaatcagatttccgcattcatacttttcaggaagaaattgagtttattcagggtatgaacaaatctactggcaaaaacatgggtatctaccctgaaatcaaagccccatggttccaccaccaggaaggtaaagatatcaccgccaaggtgctggaagtcctgaaacaatacggctacaccaaaaagagcgataaagtttatctgcaatgctttgatgccaatgaactgaaacgcatcaaacatgagctggaaccgaaaatgggcatggatctgaagttgatacagctcatcgcttacaccgactggaaagaaacttatgagcagatacaagatggctcatgggtgaattatagttatgactggatgtttaaaccgggtgctatgaaagaagtggcaaaatatgccgatggcattggccctgattaccatatgctcatctccgatgactccacaccaagcaacattaagctgacgggtctggtgaaagaagcccatatgagccatttggccgttcatccatacactatccgtgtcgatcaactgccaaaatatgccaccagcggtaatcaattattcgatatcgttttcgataaagccaatgttgatggtgctttcaccgatttccctgatttagccgtgaaatttctggaaaaacgccacgaacataaataa

SEQ ID NO: 761 - DNA, 1356 bp, Xenorhabdus bovienii
  Coding DNA location: Contig name=SeqID_16847; Position on contig =15123..16478bp; Strand=-
atgttaagtatttttagaccggcaccccacaaagcccggctgcccgcacaagaaatagatccagtctaccgtcgctttcgctggcaaattttcatggggatcttctttgggtatgcggcttactatttggtaaggaaaaactttggattggcaatgcctcacttagcggaacaaggtttttccaaaggtgatcttggcttcgctttgtcagggatttcgattgcatacggtatctcaaaatttatcatgggttccatttctgatcgttccaatccacgtgttttcttacctgccggcttgatactcgcagcagcagtgatgctgtttatgggtttcgtgccgtgggcaacttccagcattgccatcatgtttgtcctgctatttctgtgtggctggttccagggcatgggctggcctccctgcggccgtactatggttcattggtggtcacagaaagagcgtggtgggatcgtttctatctggaactgtgcgcataacgttggtggcggcttgcctccgttactgttcatgctgggtatggcgtggttccaagactggaaagccgcattttatatgcctgcatttgccgccatccttgtcgcaattatcgtattttccttgatgcgcgatactccacaatcctgtggtttaccgccgatcgaagagtacaaaaatgattatccgcctgactatacggacaaaaatgaaaaagaattgactgcaaaagagatttttttgcagtacattctgcctaacaaattgctgtggatgatcgcgattgccaacgtattcgtttatctgctgcgctacggtatcctcgactggtcaccaacatacctgaaagaagtgaagcactttgctatggataaatcgtcctgggcttacttcctctacgaatatgcgggtattcccggtacgctgctgtgtggatggatgtctgacaaagtgttcaggggcaaccgtggtgccactggcgtattctttatgacactggtgactatcgccaccatcgtattctggttgaacccggcgggtaacccaaatatcgatatgctctgtatgttggttatcggcttcctgatttacggcccagtgatgctaattggcctgcacgctcttgaactggcaccgaaaaaagcggcgggaacagcggcaggctttaccggtttgtttggctacctcggtggttcggttgccgccagtatcattgtcggttataccgttgacttcttcggttgggacggcggatttatggtcatgatcggcggcagtgccctgtccgtcgttctgctgttgtttgtcatgttaagcgagagtaaacataagcaggaaatcgctcgtaatgctagccagtaa

SEQ ID NO: 762 - DNA, 3237 bp, Xenorhabdus bovienii
  Coding DNA location: Contig name=SeqID_16847; Position on contig =17399..20635bp; Strand=+
atgaatacacacacacacaaggcaatattacacacagcattcactgagcaaacatcttcacctgatgacaatattaatagtagtaatatcagtcataggatagcagcacttgaaccatggtttgatgacgtaccatctcgcttggcaaaactggcgaaaacgataccgaatgatattgcggtttctgatccctatgaaacactggcatttggtgaattacagcagcgtgttgaaaatgcagcaaatattttgcatcagtacggtgttaaaatggggagcaacgttgctattgctgccgaacggggaattccatggtttgttactatgctggcggtttggcgaattggggcggtatatattcccctcaatacgatgatgccagaaaaacgtctgaatgacattctcgccagcctgtcggaaagtgttctcgtatcggatgatacggtatctgcggggctgaaggcatcaacattaatccctttgcacacccttctgaataacaccagtgaaataattaatgatgaaataacagaaaacatcgatatgcttgcattgggtgatcacccggcttatgtgatgttcacttctggctctactgggttgccaaaagcggtacaggtgcagcatgacaatctggctgcctgcctgtgtgcattcggcaagttactgtcagtcaatcagcatgattgtatgcttgccctgacgaccttttcttttgatatctcattattggaattactactgactgtcgttcatggcggcagtatctacattacatcaattgatactcagcgtgatgcgcaggctctgtcgcaaacgctgtctgatccccaattcacctttgcacaagcgacgcctgtcacttggttaatggccttgaatgctggctggaaacctcgttcaaagttgagcatgctttgtgggggagaggcgttgtcacaggatctggctgatcaactaacggcatccggtggcactttatggaatctctatggcccaaccgaaaccactatctggtcaacagcatttcgtatgagaaaaggagataaggttcaattgggtgggccgatccccggcacaaccatcaccattgtagacaaatacttgcggccagtgccgaaaggaacggtgggtgaaatccttatcggtgggcttggggtgacggctggatatcgcaataacccaaccgaaacggccaaacgatacgtacccgatatgacacaaaaaggtaaaagagcgtatttgaccggagatatggcacgtatgcttgaagatggctctctcatttatatgggaaggcaggatgatcaggtaaaagtgcgtggatatcgaatcgagttgggcgagattgaaaccgcattaagaaaacaaaatggcgtacaggatgcgattattcgtgttgtcggcagtggcgatcttgccaagattcaggcatttgtactgttcgatcccaatagggttgtacccgaagagtgggtacgtgaaacccaggtttcactcagggaaattctgcacgaagcctggatacctgccgaatattatcgtatcccttatatcccactgacgagcagtggcaaacgcgatagaaaacggttagacgaagtcgcagagcggttgaatgccagctatgacgttgtactgcctcaaacagaaactgaaaaacaggtttatgcaatttggcgtgacctgctggcgacagacgtattgggtgtcaccgataatttcttccaggttggggggcattctattttggttgcccgcatggtggaacggattgaaaaagccttttcactccggataccgatttcaggtatctatgttgaacctacggttgccagaatctcgtctattctggatgaaatgatggaagcgtatcaggcaaatccggctagcgctgggggagtctatcacagtgaggcgttaattcagcaacatgcagaaacgctcagaaaagatgtctacctgaaagaaagtgtgcgccctgatggcctgcctcatgctaactggtatcagccggatacggtattgctcaccggcgccacgggatatcttggtctgcatttgctggagcaattgctgaaacagactgcggccagaattatctgtttgtgccgtgactctgatgaagaacacgcacgagacagaatcaaggccgggtttgacaagtaccagattgatgttgctaacgggcttgagcgcgtagatttcattatcggagatttggggcagccacgctttggcttattaccggaaacatgggcacagctcgctgaaaacgttgatgtgatttatcacaacggggcgttggttaactttatctatccttatagcgcactgaagagcattaatgtcgatggaacccgaaccgcgctggaatttgcctgcacagcacgactgaaacatttccattatgtctcttccgtgaatgccctgtttgccacagaatcaccccgtccatttatggaagatgatcgcgctatgagcgagtcggtacgagatccttcaggttactcaggcagtaagtgggtatctgaagggatcatcaatattgcccgccagcgaggcgtacccgtcagtatttatcgtccgggtctgatccttgggcatacccgcacaggagctgcacaaggcaatgattatctcgttgcttccctgaaaggttatctggcaatgggcttttaccctgagcatggattgctgcttgatattgtaccggttgattatgtcgctgcatcgttggttcatatctccaagcaaccggaatccgatggtaaattctttaacttatttaatccggttcaagtctctatccggcaatttttcgattgggtacaggagtttggctatatcctcaacccagtccccttcaatgagggtaaagagaagatccttgcactggatgatacacacccgttgtatccattgatcccattgattagggacatgacagagaaaccttatcgagcgttagatccggtttatgttcatgaaattcacccagaactggagttgaagcaaacgctggcattattggccaacactgacattaaatgccccgtcattacggcaggatatgtccatcaagtattacaatatttgatagatacaggtttcttacccgcagcactgccagaaaacttcaaaccggaggcctatcttggaacagctaacaggaaacgaagccatgaattggatagtcgtcgtgaacagcagaaaaaagtattcggtctggcctga

SEQ ID NO: 763 - DNA, 162 bp, Xenorhabdus bovienii
  Coding DNA location: Contig name=SeqID_16847; Position on contig =20975..21136bp; Strand=+
atggcgttccataccccgtgccacatggaaaaaatgggctgggcggcctattctattgaattgactaagcgtattccgggtgttgagggcatgaggcaattaggcgtgttatttgcctcattttgtgaggcgaatagcgttgttaatcgcctcaccttgtga

SEQ ID NO: 764 - DNA, 1104 bp, Xenorhabdus bovienii
  Coding DNA location: Contig name=SeqID_16847; Position on contig =21178..22281bp; Strand=+
atgtggatttggcagcacgaagattggcctgattttcaatgggacgaaagtgtactggcgccagttctgcgacagattcattttaatcaggggctattgctgggtagatctgagactgaaaatacagagcagacgacactagataatcttctggccagcattctctactcctgtgaaatagaaggggagaaattaaatgcgacatcagtacgttcttcattggcaaatagattggggatcagtgaagaaaaaccgtatccaaccagtgaacaagctgatgggatggcacagattgctcttgatgtggtggaaaaatacaatgaacctctaacccttgaacgtattttgaaatggcatgagttaatgtttcctgtcggctataccctatttaatcctgttaaaggtgggcagctccggaatgggggcatggaggtagtttccggcagaatagacaagcccgtaatccattttgaagctcctcctgctgaaacattatgccaggaaatcgcaaaatttattgtatggttccatcattcccgccatgaagaaaatcttgatccagtattacgggcggcaatcacgcacttgtggtttgtcacgctccatccaatggaagatggcaatggacgtataactcgttttttgaccgatttggtattggctcagggagaaagccgctcaatccggttttatgcgatgtcagtgagtatttgtgaacaacgtaagcagtattatgacattttggaaaaaactcagcgcggcgggttagatattaccgattggatgatatggtttctgcaaacactcaatgacacactcatcgctaaactgaaagccattgatggtgttgtgaaaaaatccaggttctggaaacgaattgatcaaacccaacttactgaagaacaaactaaagttttgaatagaatgcttgatggcgattttgaacaagggatcaacagtagccagtatcagaaagtcgccaaagttagtcgggcaaccgccactcgacatttaagccatcttcttgagctgggctatatggagaagacaggtgctggtggccgcagtacacgttatgttattcatcatgataagaaacaataa

SEQ ID NO: 765 - DNA, 1101 bp, Xenorhabdus bovienii
  Coding DNA location: Contig name=SeqID_16847; Position on contig =22350..23450bp; Strand=-
atgctgaaagtgatccagtctccatccaaatatatccaagggccaggtgcgttatctcacatcggccaatacaccaaaatgcttgctgatcacgtttttgtgattgccgataatttcgtgatgagcctcattggagataccgttagcaaaagtctggaagaacacgcagtaaccagccattttgagatcttcaacggtgaatgtagccgtggcgaaatcaaacgcctgtcagacatttcagcgagtaaccaatgtcaggccgtaattgggatcgggggcggcaagactcttgataccgccaaagctatagcgcatgaatgcaagttacctgtaataatttcccccaccatcgcttccacagatgccccaaccagtgccctttccgttctgtataccgagctgggtgaatttgatggctacctgctgtatccacaaaaccctaatatcgtactgatggacacccgtattattgccaaagcaccggttcgtctgcttgtggcaggaatgggagatgcgcttgccacctattttgaagcccgggcaaatagcgctgctcataaaccaacgatggctggtggtgcaacatccaatactgggctggctctggccaaactgtgttacgacaccttactggcagaaggttataaggcaaaactcgcggtggaagcgggtgtcagtactccggcagtggaaaatatcattgaggcgaatacttatctcagtggtatcggttttgaaagtgcggggcttgccgctgcccacgccattcacaatggcttcaccgtgctggaggaatgtcatcatctctatcacggagaaaaagtggcgttcggcacactggcacaattgatgctggaaaacagcccgaatgaagagttggaaaccgtgctcgatttctgtgttcaagtcggtcttcctgtcactctggagcaactcggcttgcgggacagtgagaaattgcaccagaaaatcatggaagttgccaaggccagttgtgccgaaggtgaaactattcacaatatgccgtttaaagtcaccccagaacaggtccatgcagcaataatggccgcagaccgcatgggcatggattggctgtattaa

SEQ ID NO: 766 - DNA, 669 bp, Xenorhabdus bovienii
  Coding DNA location: Contig name=SeqID_16847; Position on contig =23674..24342bp; Strand=-
atgttccacttgaccacgcagcagaaagccacagcgttgatctggctttcacttttccacattttgatcattacttccagtaactatctggtgcaattgcctgtctccatttttggttttcataccacttggggagcattcacatttccttttatctttttggcaaccgatctgactgtacgcatttatggtgcaccattggcacgtaagatcatcctcactgttatgctaccagcgctgctgatttcctatttcatttccgcgctattttttcaaggaacgtggcagggattcggggcattagtaacctttaatctgtttgttgcccgtattgcagccgcgagctttatgggttatgtcctcggccagatattggatgtgggagttttcaatcgcctgcgtcagaaacgccgctggtggatagcaccgactgccgccatgtttttcggtaatttgctcgatacactggcatttttttttatcgcattttatcgcagcagcgatgcattcatggcgacacactgggtagagattgctctggtggattacgctttcaagctgttcatctgtatgcttttcttcctgccagcttatggcatcctgttgaatttaatcctgaaattttccttctctcattcaacagataaaactctggtcaacaatcattga

SEQ ID NO: 767 - DNA, 195 bp, Xenorhabdus bovienii
  Coding DNA location: Contig name=SeqID_16847; Position on contig =24281..24475bp; Strand=+
atgtggaaaagtgaaagccagatcaacgctgtggctttctgctgcgtggtcaagtggaacatattatacctttttgatgaatggggtaagggaacccaaaaaaacaaactttctttgcctgaattatcaggtaaaacgcatcatacgcgcgttgcgcaacaaaagcaaagtgcggcagttgatgatattttgtaa

SEQ ID NO: 768 - DNA, 279 bp, Xenorhabdus bovienii
  Coding DNA location: Contig name=SeqID_16847; Position on contig =24495..24773bp; Strand=+
gtgtttgaacctacagagattgttatgtccaatgtttttgctaaccctgacaaaacgcttgatacgcaggggttacgctgtcctgagccagtgatgatggtacgtaagatcgttcgccatatggatgctggccagacgttattgatcattgctgatgatccggcgacgacccgagatattccgggtttttgccgttttatggagcacgccttgattgcacaggagacaggacaaactccttatcgatatttgatcaaaaaaagcgaaaatgtagcttaa

SEQ ID NO: 769 - DNA, 2304 bp, Xenorhabdus bovienii
  Coding DNA location: Contig name=SeqID_16847; Position on contig =24986..27289bp; Strand=-
atgttctccatatttaaaaaacataagcaattacagcacggctctttgtcttacaaaaataaagagcatcaagataaagaccacgagcattcccacggctctcatggcaaagaagataaaggttcacacgactcccatcaacatgctcaaggacactgctcacacgaccatgcccctaccatacgggatacaacccctcttgaattaaccgccaaccagcgttttaactggatcatccacggcatggattgcccaagctgtgcgggcaaaatcgaaaatgcggttaaaaaattgccagaagctaaacaggtcaaggtgctgtttactacggaaaaactggtggtcgatgctgattctgatattcgcgcagccgtcgaacaagcggtaaaacaggcgggttttgaaatcaagcaaacggattcgacgactaaattgcctccagcggcaaatcactggaaaaccttttccccaattctcattcttatagcattaatggtcatcagttggggcattgcaaaaataaatccacccactggacagattgctttcattattaccacgttgatagggttatacccggtcgctaccaaagctatcaaactgatccgttcaggaactccctttgccattgaaaccttgatgagtgtcgcggctatcggtgccctattcattgatgccaccgcagaggcggcaatggttattctgttgttcaaagtgggagaagtactggaatcttatgccgcaggacgggcccgccgtggtgtcagtgccttgatggctctggttcctgaacaggcgctgctggtgacaggaggagaaaagaaaaccgttcctgcggctgacctgcgtccgggggatattattgagattgcgccgggtgcccgtttacctaccgatgccgaactactcagtccgttcgccagttttgatgaaagtgctctgacgggtgaatctattccagtagagcgccagcagggagaaaaagttgctgcgggctgcctctctgtcgatagcgcagtgcaaatgagagtgatctctgaaccgggacacaatgccatcgaccgtattcttcaactgatagaagaagcggaagagcgccgtgctcccattgagcgcttcatcgatcgattcagccgtatttatacaccgctgattatcctgttctctgtactggtcgtggtaatccctcccctcgtccttgccgagccttgggaaacttggctctatcgtggactgactttgctattaatcggctgcccctgtgcgctggttatctcaacgcccgcagcaatcacttccgcactggcggcagcgacccgtcgtggtgccttaatcaaaggcggagcagcattggagcagcttggttcagtcaccaccattgcgttggataaaaccggtacactgaccgaaggaaaaccccaggtcacggaaatcgaacccgtggaaaacatcagcgtagaaacactgctggcgctggcaggggcggtcgaaagcggctcgcaccacccattggcaaaagctatcctcaacgcggcagaaaataaaggcgtgacggttgtcgaagctgaacaccgtaaagcgttgtctgggatcggggttgaagggctattgtcggggcagaagattctggtctcggctccggagcggctgccggaaaatacgttatccaccgcatggaaacagagggtcacggagctggaaagcagcggtaaaacggcggttgccgtggtacagggtgagcaatttgtgggtttgattgccatgcaggacaccttgcgtcaggatgccatagacgcgatccgcgccctgaaaaagcaaggcatcaatgccgtgatgctgactggcgataaccctcgtgctgcagccgctattgcagatcaattggggatcgattatcgcgcgggtctgttgccggaagacaaggtaaaagccgtcactgagctaaatgaaaaacaccataccatgatggtcggtgatggcatcaacgatgcccctgccatgaaagcggccagtatcggcgtcgccatggggagtggtactgatgttgcgctggaaacggctgacgccgccttaacacacaatcggctgacaggtttgcctgaaatgatcaccctgtcccggacaacgcactataacatccgccagaatatcactattgcgttaggcttgaaggcgatattccttattaccagtctattgggcatcacggggctgtggatggccgtgctggctgattcaggcgccacggcgctggttacagcgaacgccatccggctgctgcgggttaagtcgcaaaaacgatga

SEQ ID NO: 770 - DNA, 270 bp, Xenorhabdus bovienii
  Coding DNA location: Contig name=SeqID_16847; Position on contig =27531..27800bp; Strand=-
atgtttattcaattagggaaagttatcatggttctcgtttggggaattatgattttcaatttgatccatccctttcctaatccattgagatatttcatggatatcgccatggttttcacggtgataatgcatgcctttcaacttttgctattaaaaaactcccagcccaaagatcaaaagttttctgtttttcttcagaccaagatcttcttttttggtgtgtttgagttattggcttggcagaaaaaacagcgtcaagataagaaataa

SEQ ID NO: 771 - DNA, 579 bp, Xenorhabdus bovienii
  Coding DNA location: Contig name=SeqID_16847; Position on contig =27842..28420bp; Strand=-
atgactaaaaaatcacagagcacgtctttgggacaaatccgcattattggcggaaaatggcgcgggagaaaattacccgttcctgatagtgaggggctacgtccgacgactgatcgtgtccgtgagacactctttaactggctgatgcccatcattcaggaagctcgctgcctggattgcttctccggcagcggagcacttgggtttgaagccttatcgcgcaatgcaagtcacgcgaccttgcttgaatatgatcgtaatgtagcaaaacaattgtcagccaatttagccttacttaaggccgaaaatgctaatgtggtacagggaaacgccctgcaatatctcaaccagacaggcacaccttttgatgtggttttcctcgatcccccatttcgcaaggggatgcttgttgagacaatcaacttactggaagccaacggttggttggctgaagagagttggatttatgttgaagcggaatcagaatctgctgcaacagaagctccctcaaactggcagttacatcgggaaaaaattgccgggcaagttgcttaccgactgtatatccgccgccagtag

SEQ ID NO: 772 - DNA, 1347 bp, Xenorhabdus bovienii
  Coding DNA location: Contig name=SeqID_16847; Position on contig =28750..30096bp; Strand=+
atggcagaagagaaaaaaagaggtttcttctcttggtttggacgtggtcgtcaggaaaagaaacagcaagaagaacaacttgaacaagacaaatcagcggcggaagaagccgagcagcagcgtttagccgaagaagtcgcccgtcgcgcagcagaagaagccgaacagcaacgtttggccgaagaagccgcccgtcgcgccgcggaagaagccgagcagcagcgtttagccgaagaagccgtccgtcgcgccgcggaagaagccgagcagcagcgtttagccgaagaagccgcccgtcgcgcagcggaagaagccgaacaacagcgtttggccgaagaagccgcccgtcatgccgcggaagaagcggagcagcagcacttagtagaagaaccatccgtattacccaaagagcaggatcgtccgagcaaagaaggcttttttgcgcgtttgaaacgtagtttggtgaaaacccgccagaatctgggttccggatttttagggttattccgcggcaagaaaattgatgatgatctgtttgaagaattggaagagcagttactggttgcggatgttggtgtcgaaactacccgtaagatcattaacaatttaaccgctcatgccagccgcaaagaattaaaagatgcggaagcgttatacacgaaactgaaagaagaaatgtcagatattctggcaaaagttgataagccactggatatagaaggtaaatctccttatgtcatcctgatggtgggtgtgaatggcgttggtaagacgacaaccatcggtaaactggcgcgtcagtaccagtctcagggcaaatccgtcatgttagcggcgggagataccttccgtgcggcagcagtggaacaattgcaggtctggggagagcgcaacaaaatcccggtaattgcacagcataccggcgcagatccggcctcagtcatttttgatgcgatccaatctgccaaggcgaaaggcgttgatattctgatcgctgataccgcagggcgcttgcagaataaatcccatctgatggaagaactgaaaaaaattgtccgtgtgatgagaaagctggacgaagagactccgcatgaaattatgctgactctggatgcctgcacaggccaaaatgcggtcagtcaggctaaactctttcatgaagcggttggattgacggggatcacactgaccaaactggatggtactgccaaagggggggttatcttcgccattgccgaccaatttgatatccctattcgttacatcggtgttggggaaagcattgaagatctccgtccatttaaggctgacgattttatagaggctctttttgcccgagaggattaa

SEQ ID NO: 773 - DNA, 666 bp, Xenorhabdus bovienii
  Coding DNA location: Contig name=SeqID_16847; Position on contig =30103..30768bp; Strand=+
atgattcgctttgaacaggtcagtaaagcctatctgggagggcggcaagcgctgcaaggggtggattttcatctgcttccaggggaaatggcattcttaaccggtcattcaggagcgggtaaaagcacgcttttgaaacttatttgcggtatagaacgcccaagtgtaggccatatttggtttggggggcatgacatcagccgattgaaaccccgtgaaaccccttttctgcgtcgtcagatcggcatgatttttcaggatcatcacctcctgctggatcgcacggtttacgagaacgttgccatgccactgattatctcaggggcaagcgccgaggatatccgccgacgggtatctgcggcgttggataaggtaggcttgctggacaaagcgaaaaacgtccccattcagctttctggtggtgagcagcagcgtgttggtattgcccgcgcggttgtaaacaaacccaccgtcctgctggcggatgaacccacgggaaatctggatggggaactgtctgaggggatcatgcgcctgtttgaagagtttaaccgcgttggtgtcacggttctgatggcgacgcacgacgttgctctcatagaacgaagaaattaccgtatcctgacgttgaatcaggggcgtatgcaaggaggacatcatggttaa

SEQ ID NO: 774 - DNA, 981 bp, Xenorhabdus bovienii
  Coding DNA location: Contig name=SeqID_16847; Position on contig =30761..31741bp; Strand=+
atggttaaaaatgtccgtcattcagcgaaaaaaacaacaccgcctaaacccaagtccaaatcattgaaagggggctggcgcgtacagcagcgttacgcgtggaaaagcaccttgtcagatatgctgcgccagccgctggcgacgttgttgactatcatggtgattgccatctcattgaccttgccgagcgtgttttacatcgtctggaaaaatgttaatcaagcggtggaacagtggtatcccgttccgcaacttacggtctatctggataaatccttgaacgacggcggcgccagacaggtgattgagcagttgaaagtcattgatggtgtgaaatcggtgaattacctgtcccgtgaagaagccgagaatgaatttcgtgcatggtctggttttgcgggtgctttaaatctactggaagaaaacccgctgccagcggtcgcgattatttcccctcaaatggattttcaagattcgacggtattaacaacattgcgtgatcgggtttcccagatcaaaggtatcgaagaagtcagaatggatgagagttggtttacccgtctcacggccttagcagatcttattggccagattgctgctgtaataggtattttgatggtggttgcgctacttttggtcattggtaacagcgttcgtctcagtatctttagtcgtcgcgaaactatcaatgtaatgaaactgattggtgcaacagatggttttattctgcgtcccttcctcaatggtggagtattgctggggggattgggcgcggttttttctctgatcctttcatcgttactggtttggaaactctccaatgtcgttacggatgttgcaggtgtctttggtactacctttaaattgtacggtttgggatgggatgaatccctgttgctggtactgatttctggcatgataggctggcttgcagcatggtttgcgactattcagcatttacgccgtttcaggccggaatga

SEQ ID NO: 775 - DNA, 855 bp, Xenorhabdus bovienii
  Coding DNA location: Contig name=SeqID_16847; Position on contig =31969..32823bp; Strand=+
atgacaaaagaaatgcaaactttggcattagttccacaaggtagtttggaagggtacgtccgtgcctccaatgcttatcctatgctctccgcagaggaagagaaggaactggcagaaaggctgcattaccagggggatctggatgcagcgaaaaagctgattctgtctcacttgcgcttcgttgttcatgtcgctcgcagttattctggctatggtctgccacaggcggatttaattcaggaaggcaacattggcctgatgaaagcagtccgccgatttaatccagaagtaggcgttcgtctagtttcttttgctgttcactggatcaaggcagaaatccatgaatatgtactgcgtaattggcgcattgtgaaagtcgcaacgacaaaagctcagcgtaaactgttctttaatttgcgcaaggctaaacaacgtctggggtggttcaatcaggatgaagttgatttggttgccaaagaattaggggtaaccagcaaggacgtccgtgagatggaatcccgcatgtcggcacaggatatggcgtttgatatgtctgatgatgacagtcatgacagccagccagtggctcctgtgctctacttgcaggacaaggcttctgactttgccgatggcattgaagaagacaattgggaaaaccacgcggcggataaactttctctggcgatggaagggctggatgagcgtagtcaggacattatccgcgcccgttggctggatgatgacaacaaatccaccttgcaggaactggcggataagtatggcgtatcggccgagcgtgttcgacagctagaaaagaacgcaatgaagaaattgcggctggcgattgaagcgtaa

SEQ ID NO: 776 - DNA, 1140 bp, Xenorhabdus bovienii
  Coding DNA location: Contig name=SeqID_16847; Position on contig =32930..34069bp; Strand=+
atgaaaatcgtgattgcccctgattcatttaaggaaagcctgagtgccttgcaagtcgcggaggcgatagagcagggatttagggaaatctttccgcaggcaacttatatcaggttgccaatggcagatggcggagaaggtacagtggaatctctggtggccgcaacgggcgggcagagaatttcatgttcagtaaccgatcctttggggcagccggttgatgctttctttggtttgctgggagatgggaaaaccgccgtcattgaaatggctgctgcttctggcttacatctcgtgccgatggaacatcgcaaccctttgataacgacgagttacggtactggagaactcattctggctgcgctggaacacggtgtgcagaagttgattttgggtattggcggcagcgctaccaacgacggtggtgcaggaatgatgcaggcactgggtgcgaaactctgggatggggacagccgcatcctgccattggggggggcggcactaacccgattggaaagtatcaatctttcctctcttgatccacgtcttaatcagcttgaaatcactgtagcctgtgacgtgaataacccattatgtggcgaattgggggcatccgcgatatttggcccacaaaaaggggcgacaccggaaatggtcaaagtgttggattcggcattgcaccattatgggatgaaaattgaatcactgacgggaaaaaaagtgattgatgtcgcaggagcaggtgctgcgggaggtatgggcgcttccctgttaggttgtttggatgccaacttgcagtcgggtattgagattgtcattaatatcctgaaactggaagaagccattcagggggcggatttggtgattacgggtgaaggccgtatggatagccagaccatacagggtaaaacgccgattggcgttgcccgtgtcgccaaaaagtttggtattcccaccatcgctttggttgggggaatgagccgtgattaccatgttgtgcatcagcacgggctggatgcagtcttttccattgtgccgggtgcctgctccctttccgatgcccttgtcaatggggctgataacttacgggtaacggcgcgtaacgttgcctcggtttggcgtatggcttattcgcaataa

SEQ ID NO: 777 - DNA, 402 bp, Xenorhabdus bovienii
  Coding DNA location: Contig name=SeqID_16847; Position on contig =34057..34458bp; Strand=-
atgaaattaacaattaaaccaataagggttttatccccacaggataagattgatttgaaaaaaatttggccggaacaagatgcgcaggagtgggaagtgctgttagcaggtgatcaaaaactatttgtggcacagtttaatgaccggctacttgctgcggttaaagtgacgctcaactcatcaacaggaatactggaagatttttgtgtacgggaagtgacccgccggcgcggtgtgggttcttatctgctggaacaggtcaaggccgcgtttcctgagatcaaccgttgggaatggagcctgaatcattttcctgatatccacgctccggcgttgagtggttttatggcggccagcgatttccgctatgatgcccaaaagaatgactattattgcgaataa

SEQ ID NO: 778 - DNA, 1113 bp, Xenorhabdus bovienii
  Coding DNA location: Contig name=SeqID_16847; Position on contig =34664..35776bp; Strand=+
atgaagcttactgagataagcctcaaaggctttaaatccattgataatgtgaaagggcaaaccatagtatttggcgatattacgttgctgctcggtgccaatggctcaggtaaaagcaacttaatatctttctttcgtatgctggtatccatgacatcgggagatttgcagaaatatattggtcggcagggggtcagccaactcttgcattatggctcaaaagtcactgagtcaatgaacttcagtattcgattagaagatgaagctgaatgggatacctatgaggccacgttgtcttatgctctttcagatcggcttttttttagcgatgagtgtgtaacgtctcaaaaacagaataatgcaacacagtcgaaatatgttttaccaagagatggaagtgaatcagggttacacagtgacaaacatacgacaagcaaagaaataactgccttccttgccggaataaaaacatttcaatttcacgatacatctgatacatcacgcatcaaagaccgaacttatgttgatgatgcaagctatttgagaagcgatgctggcaatcttgccgctttccttaagatgatgaaggataatgctcagtatcgaacttattacgatcgtatagttaggcatatacgtaaggtaatgccccaatttgaagattttgtgttggatgccttgccagggaatgagttatttgttcgtttgaattggtctgacaattaccgccctgatcatttatttgggccggaacagatatcaggtggctctcttcgttttatggctcttacggttttattgcttcagccaccagaattattgcctaaagtgattgtacttgatgaacctgaattgggtttgcaccccgaagcaattaccgagttggcaggaatgatcaaacgtgcttcaaaaaacacacagattgttgttgcaacccaatctacacggttagtagatgagtttgatgccgaacagctgataattgttgagcgtgataatcagactggagcaagcacctttaaaaagttaaaacatgaaagtttgagtgaatggcttcagcgctatagtttatctgaactatgggagaagaacgttcttggagggcagccgtga

SEQ ID NO: 779 - DNA, 702 bp, Xenorhabdus bovienii
  Coding DNA location: Contig name=SeqID_16847; Position on contig =35743..36444bp; Strand=+
atgggagaagaacgttcttggagggcagccgtgattagattacacgtaacggctgaaggccaaacagagaaggctttcgtttcccgcgttttggcacctcatttagcgacctttggcgtgtatgctgatgcccgctgtgtcttgacgggtagagataagcgggtatcaaaagaatatcgtggaggattacttagttatcaaaaggcaaaagcggatattcaaacttggatgaaagaagatcgggacagaaactgtcgatttacaacaatgtttgatttatatgcattacctgacgattttccaaattatcgacaagctaatcagcaagatgcctattccagagttcgaattcttgaggatgcattcttgaacgatgtaaaggatgaaagattcattccatatatacagctccatgagtttgaagctttaattttttctgaccctgcgaaattagattgggaataccttgagcatgatactgccatcgcttctttggttagtatggctgaagatcaaaatccagagcttattaatgatggcaaagaaacagccccatcaaagagaatttttaacgcactttctgattacgataaagttagcgcaggtgtttctgttgttgaacatattggattgcagaaattgagagaaaaatgtaggcattttaatgagtgggttacccaattggaaaacttaagtcgttga

SEQ ID NO: 780 - DNA, 210 bp, Xenorhabdus bovienii
  Coding DNA location: Contig name=SeqID_16847; Position on contig =37066..37275bp; Strand=+
gtgaaatcgtttgaatattattatcagcgggaatttgattatttaaggcaacttgcaaaaattgtgagtgaagaaaacccgcacctccgtgatgtattgggtggcggggatcctgatgtcgaaagactttttgagggtgcctctgtgttaacggcgcgccactggataacgtggcgctcagcgagcagcttggcaccagcgtttctctga

SEQ ID NO: 781 - DNA, 1875 bp, Xenorhabdus bovienii
  Coding DNA location: Contig name=SeqID_16847; Position on contig =37236..39110bp; Strand=+
gtggcgctcagcgagcagcttggcaccagcgtttctctgaccgtcatgcgcgatggcgtcactgaacgcaccgtcaacggcattgtggcgggggcagagcagggcaatactgacggtctgcgtacctattacacatttattgtccgccctgaaatgtggttgatgacgctcaatcaggacagccggatttttcattaccaatccgtaccggatattctcgcccggttgctgaaagagcatcgcatcaaggcggagagtaaattctataaagatcaccagcaacatgcaatacgggaatacaccacccaaaaacgtgaatctgcctatgatttctggtgccgtctggcggcagaagagggcatcatgttctggcttgaagaggacaagctgttctacagcaacgcccaccttggcatgttggcggcactgaccctgacctacaacgttcaggccaataccgacaacagtgattcaaccgcatggcagtggaattacggcgaatacctctgccctgatgaaaccctccataaagacaacaacttcctgcgcccctcctacccattgcaacataccgctgcactggaaaaaggcatggggcattcagtttttgaaagttatggccgttttcagaaggatgcagaaggtcgtcctttcacccaattgcggctggagcagttgcagaaccagagcaaagtcggtaaagcgagtaccaactgtatcaaattaagaccgggtcggatcttcgttctgcaatcccacccgattggtgccatgaatgatcgctggcagatagtcacggtttcccatcaggggcatcagccacaagcctccggtgaggccggggagggaaccaccttgatcaaccagatttcctttattccgggcaggcaggattggcgtccgccttttcaatataagccgctggcggatggcgatgaagtggccaccgtcgtggggccggagggggaagagatctacgtcgacaaacatggcgctatcaaagtgcatttccattggaaccgttacgatgaagcagacgaccgggcatcctgttgggtgcgggtggcgcagggctggaatggtgatggctatggttttatggcgatcccccgcatcggtcaggaggtgattgtttcctacctgaacggggatattgatcgcccgatcgtcaccggctgtacctacaacgggcgcaaccgcccaccgctggatctgccagcggaaaaaacgcgtaccaccttcaagacccgcacccacaaaggtgaggggtttaacgaattgcgctttgaagatgcgaaaggcagtgaagagatctatatccacgcccagaaagatcagcttatcgagataaaccacgataaaacccagcgtgtgggtcacgatgaaagccactatgtcctgaacaaccgcaaacatgaaatcggccacgatgaattcatccggatcatgcatgaacagcacatccagattgacctggaccagtttgaaaccattaccaaagatcgcaaaacccgcatcaacaataactggcaggaaaatatctttgcggatcacctgcaagaagtggggcgggacaaaaccgccaaaattaacaacaactacaccctgaatgtggtcaacaacatccagagcctgacgaaagtccatacgctacaggccagcgaatccgtgctgatcaaaggcaaggcggggtcgattaagctgggtggttcaggggtgacgatcactggcaaaatcaccctgcaaggggatgtgtcggtaacggggggtagcccgggtacggtgccgtcactcagcggatcagccaatgaagggttggtcatggccgaggattgccgggaaaaagcccgtaagccgcaggagtcatcggaataa

SEQ ID NO: 782 - DNA, 1197 bp, Xenorhabdus bovienii
  Coding DNA location: Contig name=SeqID_16847; Position on contig =39110..40306bp; Strand=+
atgtcctggatacccgattatgccgaacattgggtggtggattatgcctataccacgccacaaggcgaacatgactctgcccgggcgattgtccatgcaacgagccagccgcaggcgctgtcggcgctggcagaatatgtcctgcaggcgggagattcaccggggcaataccaaagtattcagccgttgcctgaataccttgccgccagcgctgaggtcgaattgccgctactgcggcagttccggcagggggtggagcggaatgcccgggtgatcccgctgaacgcacacaataacaaccccctcctgccggccgcgcgtggcgtattgcagttcgccgtgacggaaaccctgcccgccagggagcgcgggcaataccgctatatggtgattgatgccaccgtttaccgccgggtcatgggcagttttatcgtgccagacctgatggtctccaacctgcgatgggaaagcctgtttcagggagaaacccaaatcacgctcgaagacagcgccccttatctggtggagttaacggatgacccaacggtgcactcggcttttcagcagaagatcacccagccgatcaccccggagccgggcatttttatcgacagtgaccagccatttcctgtgatccgtaatcacctgcgtaaattcacctatctgagaaatgaacaacaccaatcctgggtgttttaccgcttctatgtgccgcaaggcttgctcccgctactgaaaagcctgccggatgaacaactgatgcattttatgcgcccgataatgcggatcggttatttcgacagccagacggggcagtactacgccctttctgtggctgaaaacagcctggatcaggaaaaaacggctcccgtggtcatcaaccgctctctggtgggcatattggcggggcagacccaagcgcgggcggtggcgcagatagtgaaatttattgcagagacccagcctgaactgtcgccagaacagcaagaacagctgcccgcctttgtggtgcaacaggccaatcttgcctgtctggcgggattcgcccatcagcgttcgattctgtatctggtggcgggcagaagtctggcgcgggataacgaagcgctctggcagcgggcatggcagcatgcctgtgtcgaagcacaggcgctggcttgttatgagtattgttttaaaaaccgggcattaagttaa

SEQ ID NO: 783 - DNA, 3126 bp, Xenorhabdus bovienii
  Coding DNA location: Contig name=SeqID_16847; Position on contig =40325..43450bp; Strand=+
atggaaaaatcgatattaacgaacgcgggtgacgctcttgagaccgccgcgaaaaaagcggcgaaaacgtttgaaaaaatggtcgatgaggcgaagacacgcatacctcatgagctggacatggataccgttgtcaggccctgtgacgccaatatccggccggtttatcctgtcagatatgcttatatgaatttttttggtgacacatggatagatgctcaattaccgccgccaataaatacgtttattgatccttatgatgattcattaagtgccagcgttctggggggctatagtattcgaatgccaagaccgggttggatctatgtcaaagaagaaggggcgattaaaacccggggttcccaacagggtggcaaattactgattttcaaattcagccctgaaattgtcaccttagagggcaaaagggggatggtcacaaaatacaccaaatatgagcaaaaagccggaagctcatcgtgggaagaaatccaccctgccagcggtacagcgggattaggctatccttttctggcgattgataaagatgtgacccaaatcagcctcatttacagtgaagtcgagctggctaaatctgtcctgaataagatggataacgataaaaacttccgcaagaatgcgatgcaatttgtggatttagacagtgaggtatcagattatgccattgatgccagacaagaacatttcgacggattagtggaagatttcaaagatcctgaaaaacaatttcaggcatacaaaaatcaattagccgatccgcttttacacgctgctgatttgggggatatcacgacggaaggcagttttttcatggatgccgatatggaaatgcgttatatagacagtcttatctgcccttattacaaagataaagcgaagattgtggtattgcatgatccggtgggatatcagcgtgatattttaatggcctataagttacttaatctttgggagctaagctatagtgcaactaatatgtatcctcttacgatagggaattttgttgagatattatctgcatcaaaaaataaagaaattaaaaaatgtgttgaggagtgtattcaccaagaaaattggaaaacttggtggcctaaattaactacgccgattaagagtgtaaaagatagaaagaaagagattcttgaattttataaatgtttttttgaaagtgaaatgattgcaggtaaattaggtgggcttacacattattttaagaattttttctccgtatctgataaaaaggacatttataccgaaggtgatgcaaaagaatttgaacgattctgtattttacacgctgaattaatggagccgctaaagcattcagaagagggattgttggcgatggaaagtattattgcgggtccattggccatagacggaaatagtgcgtgggaagttgccctcaatggaatagtgaattcattgggccatgatggcgttgataaaggttccattgcaaagttcctcaatcggggaatagatataatactcagtgtcgttggcaatttactggctagactgtatgtatttacaacagagttatcatataaagggatattacatttacatgtgttgagtgttaaacaggtaacgcataaacttgtgcctaaaatcttagattatttggggcttgaaataaagcaaggaaaatatttcgaattaaccgagaaagaatattataagtttctaaaagaaattgaagaatatgaaaatcaaggagtatcaggtaaaattaagaaaggcatggatcatgctgagtctggcttgaaaaggtttgtagggaaaaaagtgtttgactggtctaacaggttggataattacaataataatataaagataaaaataccgctgattaaatttaaaaggcctgagttaaatcctcagtttaagtttttttataatgaaaataagtctgctggctatttattgagctctggcttaagtggtttggatttatttatgaagagttatatgttatataaattgacatcaatgtctcgtttcgaaaagaatgcgccatttaatgcaaacagacttccttattattatgtttcaagctatgcgaatactatattaggcggattaattgctgcgaaaggtgtttccgctattggtggagatgctattaaagttgcagctagcctggcgggtaaattgaatagccccgcagcgaaagcgttattggattctgcatcacgcaggcttctgttagaaagtgctttaataacaaaatgggtaaatggtggattaattactacagggtttgtgagtggagcactttcttattacgatgcctacaactcttttggttttggtaatgataaagaagcttattctcatatttcaataggtacaggatcaataataatggctgtaggatggtctatggcggtagccgcgtcggaagtgacttttggcatcagtcttctgattgcgctaggtgcttcactaatgcttggtggaacattcgcagctatatacttcaattgggtagatttggaaacgttgttaaagaactgcttttgggggaatggagagaaatatgctttttggagtacagataaagatcgtctatctttagatagtcaattaaaaagaatgagaaactttgatgaagaaattaaaaataaatacttggttgagaaacaagtatttttaaatctttttattaaaccaatattaaaaatagaaaataataaacaagggaagatgatttataaatttatactacctagtttcaaatggggggaatcagatatatatcatgaagtcatgccatctggtttgtcagatggctatagtgaccctgatgcgtcaataactgaacgtagttatggtagatatcattattttgtggcgaaagataagtttgataaagcaatagatatcgctcgtaaaaatcgtgaaaatctaatttatgacgaggaaagtggtttaactacactaaccgtagaagtagacgaacaatattctgtgtatatgaaagtcttttggtattataagccaacagaagatattgtttctcctcttcactataaatggggaaaagagccaacattggaaaatgcggtttatggatatgaagatgaggtattacgttaa

SEQ ID NO: 784 - DNA, 969 bp, Xenorhabdus bovienii
  Coding DNA location: Contig name=SeqID_16847; Position on contig =43451..44419bp; Strand=+
atgagtatattaattaaaaaaatattcaagaaaatttttagagtgaagacacctccaacagagccattatctacatttggtgatcccgttctggaggaaaagctaattttactggataataaaaccgtaaaacgtgcaggatttttggatgcaataaatagcaaggagtgtcattttcgtcataatcttatcagagcaagaaaagaagttataatacctgtgtttgttgggtttatgttagggttttgttttttcattaataattttgttaaagtatggaaagctaatgaagaagattatctttggttcttaaaagatgcaaaagaaagctatggagagcaattttatttaaatcctaatgcacctgcatatactaaatcattacagattatatcagatgacaaaaaggtatctttattagaatatctctatattaaatattataaagatagtttttatggtgaagaaagggctagacgatatctgattatagatgccagtttcgggttgtttttcctgagtgccaatattcttattatcagcatctttttgagattacgtaagcctgcaaatttcatcattgatcatgaaaaacaacttttttacacttggaaaaaagggaaggtgtatgtatctcgctataaagaattaggcgtagcgtttgctaataatattttgcatttcaaatgttatgggctgaacgaaaagaatgaactgacatatcagttttttatcccttatcttagccttttcaactcagacgaggataaagcttatatttttgcatttatgtcaaaatatttattacaaggaaaagaggctgtcagttcagttgattttaaacgtcaagagcgattaccgtggtttcgtaagcaaataaaaccagcagattgggaaactcagattacggcaattgtagctgaattggataggcttgggcctccgaaaggggcgactgatcctaaataa

SEQ ID NO: 785 - DNA, 207 bp, Xenorhabdus bovienii
  Coding DNA location: Contig name=SeqID_16847; Position on contig =44831..45037bp; Strand=+
gtggatacgtctttttatctgtcttcgcctgatatcacccctgaatttattggtgcatcaacccgtgagcactggcaccttgaaaatagtcttcattggttactggatgtggtttatcaagaagatgtatgtcgggttcatgacatgaatgaggctgaatctctggctatcatcaggcgcttggcattaaatttagccaaactgtaa

SEQ ID NO: 786 - DNA, 114 bp, Xenorhabdus bovienii
  Coding DNA location: Contig name=SeqID_16847; Position on contig =45157..45270bp; Strand=+
atgttgactgtgggtattatgatgataacgctattattcacagttattaaaataagtgttaaggaaaaagaggcgttgtacgcctctcttatttataaatcttattcagagtga

SEQ ID NO: 787 - DNA, 1113 bp, Xenorhabdus bovienii
  Coding DNA location: Contig name=SeqID_16847; Position on contig =45690..46802bp; Strand=+
atgaagatatcaaaaacgaaaacagttctggcaggttttatcgcgatggcgataagccagcccgtgtgggcagaagagatcaaagtcgcggtcgtgggggcgatgtcggggccggtggcgcaatatggtgatatgcaatttacaggagcacgtcaggctattgcagatatcaatgccaaaggcggtatcaatggcgataagctggttggtgtggaatacgatgatgcctgtgacccgaaacaagccgttgcagtcgcgaacaaaattattaacgataatatccgttatgtcatcggtcatctatgttcttcctcgacacagcccgcttctgatatttatgaagatgaaggcgtgatgatgatcaccccagcggcaaccaatgccgatctgacaacccgtggctatcagacgatcctgcgtaccacggggctggattctgatcagggaccgacagccgccatatttattggcaatagcatcaaaccacagcgtctggctatcgttcatgacaaacaacaatacggagaagggctggcgcgttccgtgcgcgatagtctgaaaaaagccggtatcactgccgtcttgtttgaaggcgtgaccgcgggcgataaagatttctcggcactggttgcccgcctgaaaaaagagaacgttgattttgtttacttcggtggttactaccctgaaatggggcaaatcctgcgtcaggcaaaacaagcaggtttgacagcccgttttatggggccggagggcgtgggcaatacgtcactgtccaatattgctggagccgcgtcggaaggcatgttggtaacactaccaaaacgttacgatcaggttctggcgaacaaagctatcgttgatgccatcaaggcgaaaaaacaagatccaacaggcccgtttgtctggacaacttatgctgctctgcaatctctgagtacagccatgaaacgcactggcagcgccgaacccgctgaactagcggcagatttgaaagctaatcccgttgataccgcaatggggaacctgagctgggatgcaaaaggtgacctgaaaggcttcgaatttggtgtatttgagtggcatgccgacgggacatccacagcagcaaaataa

SEQ ID NO: 788 - DNA, 927 bp, Xenorhabdus bovienii
  Coding DNA location: Contig name=SeqID_16847; Position on contig =46872..47798bp; Strand=+
atgttagaacacattctttattttattcagcagatgctgaacggcctgactcttggcagtacttatgccttgattgccatcggttataccatggtttatggcattatcgggatgatcaactttgcccacggtgaagtttatatgataggcagttacctctcttttattgtgattgccgccctgatgatgatgggcattgatgtcggctggttgctgattgcgacggcatttttggcttcgatcatcattgcgagcgcctatggctggagcattgaacgcgtcgcctatcggcctgtgcgtcattccaagcgtttgatcgccctgatctctgccatcggtatgtcgatatttctgcaaaattacgtcagtctctcgcagggctcccgtgatctggcactgcccggtttgatcagcgggcagtggacattaggagaaagcaacggtttttctgccagtgtgaccgcaatgcagctaaccatctggatcgtcacaatcgtagctatgttggtactgacattgtttatccgctactcccgcatgggacgagcctgccgtgcctgcgctgaagatctgaaaatggcgagtttgctgggcattaatactgatcgcgtgatttccatgacttttgtcattggtgcagcaatggcggcggtggcaggggtgttgctggggcagttctatggtgtgattaatccttatatcggctttatggcagggatgaaagcctttaccgcggctgtgctgggcggtatcggcagtattccgggagcgatgctggggggattgatccttggcgtatcggaagcactgacctcagcttacttaagtacggaatataaagatgtcgtgtcattcgctttgctgattggcgtattgttggtgatgccgaccggaattttaggtcgtccggaggtagaaaaagtatga

SEQ ID NO: 789 - DNA, 1275 bp, Xenorhabdus bovienii
  Coding DNA location: Contig name=SeqID_16847; Position on contig =47795..49069bp; Strand=+
atgaaaccggccaactggattaatgcgattatcgctacggtaacgctgtttatcttggcggctttcatgatgggcatgcaattgtcactgcaaggcacaaaacttgtggtgcagcgtgctgacgaagtgcgctggatgtggatttccataggttgtgcgatcgtttttctatttcaattatgtcgccccatgatccagcagacagtacagaagatcccgtcaaaaagctggaagttagctgatttggatggatcaacccgaaaacagcaattactgggggtactcattgttgctgccgccattatttggccttttgtggtttcgcgcggtagtgtcgatattgccacgctgaccctgatttatgtcatgctcggcttggggctgaatgttgtggtcggtctgtcagggctattggtattgggctatgccggtttttatgcgattggggcttatacctatgcgttattgaaccactattacggtttgggattctggcaaagcctgccactggcgggtttgactgcggcattgttcgggttactgctgggttttccggttctgcgattgcggggcgattatctggcgattgtcacactgggctttggggaaatcgtccgtatcctattgctgaacaacacagaaatcaccggtgggccaaacggcatcagccaaattcctaaacctaccctattcggattagaatttaaccgtagcgtcaaagagggcggctgggataccttccataatttctttgggttgaaatacgaccccagtgaccggatcattttcctctacttggtggctttgctgctggtggtattgacgctgtttgtcattaatcgcttgttgcggatgccattgggacgagcttgggaagccctgcgtgaagatgaaatcgcctgccgttcactggggcttagcccgacgtgcattaaactgaccgcattgactatcagtgcggcttttgctggcattgctggcaccttatttgcggccagacagggcttcatcagcccagaatcttttacttttgctgaatctgcttttgttctggcggttgttgtgctgggaggaatgggatctcagaccgcagtgatcctgtctgccatcatattagtggtctcccgtgaaatgatgcgtgatttgaacgaatacagcatgctgctgctgggggccttgatggtgttgatgatgatctggcggccacagggattattgccgatgaaacgtcgtcagcttgaattaagtactgaacagagagaccacaaagcatga

SEQ ID NO: 790 - DNA, 774 bp, Xenorhabdus bovienii
  Coding DNA location: Contig name=SeqID_16847; Position on contig =49066..49839bp; Strand=+
atgaatgcgacccctttattacaggtctcaggcctgactatgcgcttcggtggtttgctcgcagttgataacgtagagctggccttgaaccaaggtgaaatcgtttctctgattggtcccaatggggcaggaaagaccacgatattcaattgtctgactggtttttaccggccaacctgcggcatgataaaactgcgggaaaaacacctcgaaggtttgtctgggcaagaaattgcccggttgggcgttatccgcacctttcagcatgtcagactgtttcgtgaaatgaccgtcattgaaaatctgttggttgcccaacatcgatttctcaaaaacagtatttttgcgggtttattgaaaacaccggcattccgacgagcggaagctgaggcgcttaacagcgcagctatctggctggaacgggttggattgctgccactggcaaaccgtcaggcgggtaatctggcttatgggcagcagcgccgcttggagatagcccgttgtatggtgacacgcccggaaatattaatgctggatgaacccgccgcaggacttaacccgaaagagacggaagcgttggatgccttaattgtagaattaagaacgcagtatcaggttgctattttgctgattgagcatgatatgaaactggtgatgggaatttcagatcgtatttacgttgtgaatcagggcgcgcccttggcacaagggcgtccggaagagatccgtcataacccggaagtgatcaaagcctatttgggtgaggcctattaa

SEQ ID NO: 791 - DNA, 702 bp, Xenorhabdus bovienii
  Coding DNA location: Contig name=SeqID_16847; Position on contig =49841..50542bp; Strand=+
atgttggagtttaatcaagtatctactcattacggcaaaatacaggcgctgcaccaagtcagcttgaacattcagcaaggggaaatcgtcaccctgattggcgccaatggggcaggaaaaaccactttgctcagtaccttgtgtggtgagccaagggcaacggaaggctgcattatctttcggggcaacgagattactcaatggcagacggcacgtatcatgcgtgaagcgattgccatcgtaccggaagggcggcgggtatttgcccgcatgacagtagaagaaaatctggcgatggggggattttttgcgcataagcagcaataccatgagcgtattacccgggtttaccagctcttcccccgtttacttgagcggcgcagccagcgttcaggtacgatgtctggcggtgaacagcagatgctggcgataggcagagcgctgatgagccagcctcaattactattgctggatgagccctcgttgggattggctccgattatcatcatgcagatttttgacaccatccagcaattgcgcgatgaaggtatgacgatttttctggttgaacagaatgctaatcaggcattgaaattggccgatcgcggctatgtgctggagaatggccatattgttctggaagaccgcggagccgcgctgttagccaatgaagccgttcggagtgcttatcttggcggataa

SEQ ID NO: 792 - DNA, 465 bp, Xenorhabdus bovienii
  Coding DNA location: Contig name=SeqID_16847; Position on contig =50877..51341bp; Strand=-
atgaaagatactaaattggtattgccagatgaacttaaagctgaggctataaaggctttctgtgattcaatgagtggtaaaagttcatctaaaaatattgataaaacaatcaaaatgatgttcgataaaaatgatgattatttgtttagtgcatcagtatctataataagtgaaatcattcattataatgtcacggcaacacttgacgatggttccaaaaaattttcgggaggtgcttggggagcaagtacagcaggttacgcagattattggtcggggactgtaacgactgcaaatcctactgatctttttgcgaaaacagttcatttttgggcttatacatggacatttgcgggtaaacttatatttcaggatagtaactattatccgttgggaggctttatgggaaagggacttggtacccttacaggcctagctaagggcgatggtgattggaattcatga

SEQ ID NO: 793 - DNA, 201 bp, Xenorhabdus bovienii
  Coding DNA location: Contig name=SeqID_16847; Position on contig =51933..52133bp; Strand=+
atgttgcacgttgctgattatcctcaaatgaagcagatcgcatggtatctaaaagatgacgctgaattagatgaaaaggaagctttagccttttatgagcgcaactggaaatatgtagagccagaggcgctggaaccgcatgagaaggcgctaatcgataaattggtaaaagaatacggcggcggtattttaaatgtataa

SEQ ID NO: 794 - DNA, 1878 bp, Xenorhabdus bovienii
  Coding DNA location: Contig name=SeqID_16847; Position on contig =52570..54447bp; Strand=-
atgactaacaaatatacttacacatcatcaaaagcaatgtccgatatcagtgatgttattggtgatccactcactgcctggaaacaacaggaaggcgggcgggtttataacgtgatttttaatagcaacgtttataccaatacttactgggttgaacgctggcatgtaccgggtcaatctggccaggaaagttcgccgcacaatgcctggcagtacgtccgtgcggcaacggcagaagagatcaacgcacatggtaatccaacggagggtacggtaaacccgaaagaagagattccatcccccgttctgcaatctgaccgatacacggaagagacttacgagaaggtgaagtacaaacccgatggctcaggcacaaacctctcttataccgcgacccgtgtctgtaaaccgatgtataaccaatatgagcgtgatccggccaaacccaaactttctgcttacattacggactggtgtcaatatgatgcccgtcttgatgacaagaatgaaaaccccgaggatcgcggcagaggctttgatctatcgacgattgacccgaccacttacgataaattgattttcagcttcttgggtatttgtggggatattggcgtcaagaaagaaaaagtgaatgaagtctggaaaggctggaattcccagactaaccagaaaatcaccgaaggccatattgtgccactggacccttacggcgatttaggcaccgcccgtaacgtcggtctgcctgaatcgagcaaaaatacttcaattaatgcagggacttttctgccctattatcagcagagtaaagcggcgggtttgctgggcggattacgggaattacaaaagcgcgcgcgggcggcaggacacaaacttgagctggcattcagtatcgggggctggagtttatcgagttatttctccaagatggcagaagataaaaaccaacgtactgttttcatcaacagcgtggttgatttttttgaacgcttcccgatgttcagttgtgttgacattgactgggaatacccaggtgctgcgggagatgtacacaatattatcagtgaagacgacggcaaaaattatgccttgctggttaaagatctgagaataaagctggatgatcagttcggcataggcagtaaagaaatttctattgcctgtagtggggtaaaagccaaacttgctaagtcaaatatcgctgaattagttaaaaatgggctggataatattttcctgatgagttacgacttttttggcaccggatgggccgcctatatcggacatcattccaacctctattcccctaacgagcccgatcctaatggagaatatgatctctcggcagaagcggcgattaattacctgcatcaagatctcggtattcctctgagtataattaacttgggttatgccaactatggacgttcgggtaaaggtgccaagctggaaacacgtttgtacgataagccgggtgatgctctgggcacaatggaaaaaggggcgccggaatttttcgatattgtcaataactacatggatagtgaacatacactgagtacaggaaaaaatgagtttgtactgatgacagataccaatgctaatgcggatttcctgttcagtgaaaaacaggggcatttcatctcactggatactccccgcacggtgaaacaaaaaggagaatatgtcaccgagcatcaactgggagggatcttttcctggtctggtgatcaggattgcggtctgttggccaatgccgccagagaaggtatgggatatatcgccaaatctaatcatgaaactatcgatatggggccgttgtataatccggggaaaccctactatttaaaatcgctccgtgaattgaaatcttcgcgctaa

SEQ ID NO: 795 - DNA, 3708 bp, Xenorhabdus bovienii
  Coding DNA location: Contig name=SeqID_16847; Position on contig =54539..58246bp; Strand=-
ttggaaagtgtgctgaatcagggaaaactgacggataacgtcgctcagaaggcggtccttggttacctgaacaattttgaagaagtcagtaatctggaaattatttcgggttatgaagatggtattgatcttgccaatgacaaaacctatttcattgctaaaacccgtacccagccttatcgctatttctggcgaacactggacatgaaacagcgtaatacggactcgaatgagctgtatccaacagcctggagcgagtggaaacctatcagtgtgccgttagaaaatgcccgcaatggcgttgtccgtccggtcatcatgaataaccgtctctacataagctggtttgaagtctcaaaagaagaagagaaaaacaaaaacgacgaaagcaagaccatcattcgataccgtaccaagctcaatctggcgcacttgggatttgatggtacatggagcagcggcaccaccgtacgcgaagaggtgcttgaccatgctatggacaaaatgattgccgtgctcgaccgaaccgaaaaagaagaccgtctggcactggtggcatttacccgtcttaaaggaaaaaacagcgaaggcccttatgactatgacatagtattcagttatatctgcgataacatgctgatggcctccacagatctgccgccctcaaccacgaaactctctgaccaagatgattatggtaacaaactggtttggttcttcttccgtgaaccccagaatggtggcatggatgaattcaagcagctgatcctctatcccgtccatatcaatagaaagtggccgattgagaaggaaagaacatttgagggctcactggggaacaaggaggatttcgacctcaaagctgactatttggaagattcactggatatgtatctgacctccatctccacctacaaatacgatttcagcctgagcaaaaacatcctgtactgcatctggctggaagacaaaaataaaaacagatgttggctggattacaaagtactgacagaagaggattttaagcaagggaaaatcgagttcagtgtcagagtcaaacggtgtcacagcgatgacctcagcgacatcacgattgtcaccggtttcagcttgcctaaggcaaatgccgacgatatcggcggcagaatcagagtcatcttgagcgtgggcaggcgggttcgtgaaaaattccagatcaagcaaaccaagcaaacccaatatctgcaattccctgaaaatccacctactcccgtttggtatgccgataaacaaatccgcttaaataccctgttcgccaaggaactcgtcagtaaagccagccagaaactggatctggtgctcagttgggatacccagaacctgcctgaagagtcgatttccggcagtggcacagaaccgattgatctcaagggtgccaatggcatctatttctgggtactgttcttccatatgccgttcatggtggcatggcgtttcaatgttgagcagcgttatgaagaagctaaccgctggctcaagtatattttcgatccttatgaaaatgaggataagccggctctgaaacaaggaaagccgcgctactggaacagccgcccattgattgatgaaccgaagaaaaactacagcctgatgcagccgagcgatcccgatgcaattgcttccggtgaaccgatacattatcgcaaggcgattttctatttcctggtcagaaacttgattgacgacggtgacatggaataccggaagcttcaacccacggcaaggactattgcccgtttgagttatgcaaccgccagttcgctgcttggccgacgccctgatgtgcaattggcaagcttctggcaaccgctgtcccttgaagatgctctctaccgatatgacaacagtgagctgcgccaactggagatgcaaagccagccattgccccatattcccgtcgttcatgacaacacgatccgcgcccttgataatgagctattcatgaagccgatcaataatgaactgacggagatttgggatcgtatggaaaaccggatttacaatttacggcacaacctgacgctggatggcaaagagatcaacatggcactctatgatgagaagatctcgccacgcgacctgatgaacctgcgttaccagcgcgtcgtcactgcccgcaatgccagccggatgaatttcaaaacgcccaattaccgttttgaaccgatgctggcacgtgccagagcaggtgttgaaacgatgatacagtttggcggcaccttactgagcctgctggaacgcaaggacagtttgagctttgaaaaattccagatgctccaaagtagtgatctctaccgcttctcaatcgatctgcaacagcaggaaatcaacatcaatcaagccagccttgaggttttgcaggtcagtaaaaaatcagctcaagagcggcatgaacactttaagggattgtatgacgaaaatatttcgtcaaccgagcaacaggtgattgaactgcaatcccaatccgcttcagcgttgctgacggcacaaactttgcgtaccggcgcggctgcactggatatgctacccaatatctatgggctggccgtgggcggatcgcgctggggagctgcactgaatgcggcggccgaaatgatcatgatcaaacatcaatctgacagtatcaaagccgatagtctgaatgtgtctgaatcataccgtcgacgccgccaagaatgggaagtgcaatacaaacaggcggaatgggaagtcaattccattgatcagcaaatcaatgtccaaaacctgcaattgactgcttccatgaaacggttggcacaggttgaggcggaacagcaaaaatcgctggcactgttggattatttctccagccgctttaccaatgaaagcctgtacacatggatgattagccaactgtcaaacctgtacctgcaagcctatgatgccgtttcatcactttgcctctccgcagaagcctcattgcagtacgaattggattcagagcagacctttattgaaggcagtagctggaatgatctctatcaggggttaatgtccggtgaaacactgaaactggcgctgcaaagaatggagcgcgcttatgttgaacaaaactcacgcttgcaagaaatcactaaaactatctctctcaaggcattacggaaaacagcatgggaaagcgatcttgcaaccctgaaacagcactctcctattacttttaacctgcaagaatcagactttgctaaagattaccctaaccttgccaatcgccggatcaaatctgtctcggtttctctgcccatgttaatcgggccttatgaggacatttgcgcccaactctctctgggcgtcaatacccgcatggtgaaagccgacatccagacaatggaaaagctggtgaaagaagggattaatgctgattcgccttatctggcacgcagcatccatcccaaccagcagatttccttatccactggcataaacgacagcggtatgttcacactgaattttgatgatgagcgtttcctgccatttgaaggcgcgtgtgtcgaatcaagttggacattcggctttaccaataactcgcaaaatctcgacagtctgaccgatgtgattctccatgttcggtataccgcaaaaatcggctcctctacattcggtaaagccgttcagaaattgctggtagaacaaaaaatcacggactcataa

SEQ ID NO: 796 - DNA, 333 bp, Xenorhabdus bovienii
  Coding DNA location: Contig name=SeqID_16847; Position on contig =58316..58648bp; Strand=-
atgtctaattccatcgaagcaaaattacaagaagatctgcgtgatgcgctcgttgattactatcttgggcaaattgttcccaagggaaaaaatttccagttttatcgcgacaaaatcaagaacgtcgatgatctctatgattttctgctactggatacccaggtctcttcaaaagtcatcacatcgcgcgtgtctcacgtaacccaatcgatacagcagtatatcaaccgtattgtgctcaatttggaaccgggtctttccatgactcaggaagaaacctacgactggcaggagtttgccaaccgttacggttattggtctgccaatcagtaa

SEQ ID NO: 797 - DNA, 2457 bp, Xenorhabdus bovienii
  Coding DNA location: Contig name=SeqID_16847; Position on contig =58641..61097bp; Strand=-
atggacaagaatcacaattattctgatgaacagcagaatatgaaaaaagtatcaccattattgacggcggtggctgaaatatcattaccggaaataccatcaccggaaaaatattcactcaccacagtgaaacagcacaataccccaccatctgtttcgttggtagattcactcagaaatctgggctatcactccatcttcgatattgtcagcctgtcaaaacagcgttttattaaacgtcacaatgaatctcttgcgggtcatgctgaaatcatctttgacaaagcagtgagtatggctaaccaactggttcaatactatcggcagaacccgctcagacaatacgatggacagactgcggctttcctgtcaaccacgacagataatcagaacaccaacgaacaaacaggaaaattgcctgattatagcggcctgttcccggagccttgggatgacttctgtcagccggatgccatcgaatcccttgatagccctgccaactatctgttggatctgtataaatttattcagcagattgaagtggatggcaccaatcaggcgattttgctggcaagcaggcggtcggatatttcacatctgatgctcgatagcgatgcgctttataaagagcttcctgctctgaccatcgtaaatgatgtgctgtctgaaagcgccagaatatatattaaccagacaggggaagccaataaaccggttaatcaggtattgggagaaacgcgttttccctttacgttgtcctataacttgccgactcagcagatcaaccggaggctggcagaaagcaaaaatgaattgggtaccgtgatccggcaagtcgatacgcatttcccgtggcatactgaaatttcaaaatatgaccagatcttgctggcttattcacagttgagcaatgaacaaatcagcctactgaccgaagctgcccctttctctcagaacctgctgtcacgggatcagctcatcaaagcctattacggcagcagtacgacagaacttgtgcctgacaaagatatttcgcggcatgcttatattgttgctcaagatgacagtgttgaaggtccgatcaaactggtcgaaaattcgcccaatgcctacgataggatttccatcacctgcaaaaatcaggcagacaaaaccatctcggtcaagctacgggcagaaaacgttctcacttactatcgcgtcaaggcaaggatggagccgtttgacaactctccgccctttagccgccagttaaagctgacctatgtggaaagcgataactcagacattggcaatctggatgatggcccatactttggtaatatgaccatttatgcggcgacccccaaagaaacaccatcaggtgaaaatcaaccaaccgggccaatagacggtattgtgtttcaggcaatgagttatcgtcttgcgattgccaaatcaggtacgtcatcttccgaattatcaccgcaggcgaatgacttctttatcaataattatggtctttcagaagaagaaagcgcccagcttaagaagatcgccatttttggcgaccaaaccggaacgcaagttactcacattgaaaatctattcagtagtggtaactaccggcctatcgtttcccctaatgcccatttttccaacccgatttttttcaacgggcaaagcaccgccaccttcccggccgcttatcattatggcggggtttacattaatgccggacaacaagatgctctggaaattattcgggcggataacgggcgtgaaatcaaagccgtatccaacttccgttatgatcggctgaaccgctttgtccgcttgcagcgctggcttggcctgccttaccaccagcttgatcttttgctggcttccggtatcaaggcagaagccgataatctggatatgagcattactgacaatgtactgaaagagttggggctgttcaggcatctcaataaaaacctgcttttgctacgcctgacaaaaccagaatggctcggtttgtcaaacagtaaaacatcaaattcattgtcactgaatgaaatatatctgttgacccgctatcaagacttcgtcaacaacgccaatcagaacgaagacaagatccatgactatttttcttacgcgaacaagccgcaagccaatggaaaggccgtcaaagacaataatgatgaaagtgaaaaatgtgcagaaattctggccgatattctgggctggaacgccgatgaaatttatctggcctgcacattgcgagaattgacacccccgcaggccaaaaatttaccccatatcgattggttacgccgattacagcagcttgcagtcacgaccagcctgtcagtcaaaacgttatgggatgccagcacattaaccctcaatactgatttcagcctttaccagagtgtcggtgaagcggtcatggcggcgttaaaaacgcaaggagataacgagaatgtctaa

SEQ ID NO: 798 - DNA, 1641 bp, Xenorhabdus bovienii
  Coding DNA location: Contig name=SeqID_16847; Position on contig =61190..62830bp; Strand=-
atggataacactgaaaaagatacagaaagcaaattagtttataacactgatccaggatatcaacatccaagccctgttcagggttatggcaaggaagcaacacaaaaaacctatcaattaaacggttataatccggcaacaagcaccgatattttaacctatacccccacccgcatggctaagacggtgtttaacacctataacgatgatgatgaattcagtatcgcgtgttacttcacggactgggctcaatatgatgccagaggaacaatagaattccctacagatgaacaatttaaaactcaaggcgggcgcggtgccgatttgacccgcattaaaggtgattcaaccaatggcagcccctttaagaaattgatattcagttttgccggcatcgttggtgatgaagggccaaagaaaaccacaattctgagtgctgccaaaggttggggattcggagccgatgaggttgaaaccctcaaaaattacactggatggcctatcccaatcgacccatgggccgatgtcagcgcttactttaactgcggtttcgatagtggagcattcgatccgtacccaacaatatataaccaagataaagctaaaggattactgggcggtttcaattcattgaaaaaggccgatcctaatctggaggtttccgtcagtatcggcggctggtcaatgagtggtgctttttatgacatttgtcgcagtgaaccctatcgtaaacagtttattgatggaatcagagatctattcagtcgtttctcaatgttcaatcatatcgatattgactgggaataccccggctctgcgggaatgggaaatcaatttagtgcagatgattacgtctattataaaaaactgattgaggaattaacggcagccaatattcccaatttacaaggaattagtattgcggcttcagccgatcctaaaaaaattgatgatgcccatattccagaactgatgaaagccggtgtcactggcatcaacctgatgacttatgatttctttaccttgggtgacggtaaactttctcaccataccaacctttatcgcaacaaagatgaccaacattccaaatattctattgatgatgccgttcagcatttaatcactctgggtgttgacaagaaaaagattttcattggttatgccggttatacgcgcaatgcaaaaggcgcagacattaccagtaaaagcccgcttcaaggaagttataacagccagggcaatatcgtcggaactttcgaatctgcggttatcgaatggactgacgttatctataactatgttgatttcgaaaatggcataggtcgtaatggctatgaaatcattcaagatagtgttgctaaggcggattatctttataacaaagatctcaaggtctttatgtcattggatacgccacgctcagtcagagaaaaagcccgctacgtcaaagaaaaaggattgggcggcttatttatttggtccggtgatcaggataatggcctattaaccaacgcagcccacgaaggtctgggacgtaccgttaagaaaagtgttatcgatatgtcaccgttttatttcgataacgatgatctcccttcttacgataaacccaaagaacctcaatgtaaggactgtgtttaa

SEQ ID NO: 799 - DNA, 1191 bp, Xenorhabdus bovienii
  Coding DNA location: Contig name=SeqID_16847; Position on contig =63437..64627bp; Strand=-
atgaatagccaaacttcaagccgtaatttaaaaacgatcttctacctggtgtgcttcagtgcttttttaggctcgctggcacagaatatttatactccggttatccctctcatcaaggtagtgttcaatacttcgctacccttggtgaatttgacaatttcagcattcacgtttgttttggccgtgatgcaactcgtgtatggcccgttgattgacagtaagggacgaaaaaccgttttactgcccagcctcgttatcttcgttatgggatctctcggctgtgccatgacaaccgatatctattggctgatcttctttcgggttattcaagccattgggctgggcgccattcccgttgttgcggcgacaatcattggcgatctgtatgagggacagcaacgggcaaaagccatgagtacctaccagatgttattggctctgactcctgccgttgggccactgttcggtggttatctggctgaattaaatggctatgttgccatttttcagtgtcttgccattattggtggtctgttaatcatagggaatctgttttggctgccagagaccaagcctgaactccccacacaaaataaaaaaatgaaggatcacttccatcaaatcctatcaaataacatcagccaatctgtgttttgtatcagttttatgctgttttactgttatttctgtctactcacttttttacccattattttaagtagtgagtatcatttcagccctgccgatattggctggatgtttattcctatgtccctggcaatgattggcggcagttacagctatcgcatgatccaccagcatgtttcccaaaaaagagcgttaattatcactagcctattaaatttgttcataattttgatatttgccatgacttattcaatgagtattgctgttttagtcacaatcaccgtcttctatggtttcacattggggctatcgatgcccacacatgcaactttactaatctcagagtttgtcgaagaacgagcaaccgcaatcggcctttataatttcatcaggtatacagggatgtcggctggccctatgattagcagttttctgttattcgataatcactatgaatggatctttatcgcaggtgcattgctatttgctctagcgattggtttggcaatcctcattctgaaatcacgctatcaaccaaactag

SEQ ID NO: 800 - DNA, 303 bp, Xenorhabdus bovienii
  Coding DNA location: Contig name=SeqID_16847; Position on contig =64847..65149bp; Strand=-
atggaagaagctaacctattagtcggacaacgtattcaggccaaaaggaaagagttgagtatgacagcaacatcattggcgaaaaaaattggcattagccagcagcagctttcacgttatgaaacaggaaaaaatcggattaatatagttcatcttgttgaaattactatattgttggatactccaattagctggttctttgaagattgttataaagataaaaaagagggcagcacagtcaataaactcactgatcaatatattcccattgctgaaacagttataggaaaagatggtcgttaa

SEQ ID NO: 801 - DNA, 876 bp, Xenorhabdus bovienii
  Coding DNA location: Contig name=SeqID_16848; Position on contig =27..902bp; Strand=-
atgagacagcgtatggctatcgcaccccaggccgagaatactttctcactggaagctacaacttctgatttacctaaaaccgcccgaccaacgattctagtttttgattcaggtgtgggcggtttatctgtataccaagaaattcgacaattattgccggagctccactatatatatgctttcgataatgaagcatttccttatggagaaaaaacggcggaagtgatcattgagcgggtcgttcgagttgtcgatgaaattcagaaaagacaccccctagctattgtcatcattgcctgtaatacagctagcacggttagtttgcctgcattgcgcgaacgtttttcttttcccgttgttggtgttgtgcccgcaatcaagcctgcggcaaagttgacttgtaaccgagtaataggattattggcgacacgggctacagtcaatcgcgactataccaaagaattaattacaagatttgccacggattgtcaggttcattctataggctctgcagaactggtagagttagccgaacgaaagctgcatggtgagaagatcccactggaaatattggaaaaaattctcaaaccgtggttgagaatgagagaaccgccagatactgtcatcttaggttgtactcacttccccctgattgcagaagagctttcacaagttttgcctgatggcacacgattgattgattctggagctgctattgcgcgtagaacggtgtggttggtgaagaaccaaaataatttatttttaacaacagcggataatttggcttattgcacaaaaatagacctaaatagcgaggctctgcgacccgtattacgagattatggcttccttacgctggaaaaactagcaacttaa

SEQ ID NO: 802 - DNA, 1851 bp, Xenorhabdus bovienii
  Coding DNA location: Contig name=SeqID_16848; Position on contig =835..2685bp; Strand=-
atgacaaataacaaacgtatccttttatctgctgcttctgtggcagtgttttctagctggagccattttgcagctgctgataatcaagatccactggtggtgaccgcgaaccgctttaaacagcctattccttcagttttagcaccaatgacggtggtaacccgcgaagagatagatcgctggcaatccagcagcttggttgacgttctacgtcgcctacccagtattgatattgcgcagaatgggggaatagggcaacacgcttctttatttgttcgaggtacggaatcacatcatacattggtgctagtagatggtattcgcttaaatcaggcgggtatcacgggcgcggccgattatagccagataccgctttcaatggtgcagagaattgagtatatccgcggcgctcgctctgccgtatatggttctgatgccattggtggggtaatcaatatcattaccaagcgagagcaacagggaacaacattgaatgcaggtatcggctcgcacggataccagaactataatggttcgacccaacagaagctcggcgagaataccttattgaccgcagcggccggatatacctataccaaaggattcgatgtggtggctggtggcggtacgggtgggcatcgtcagcctgatagcgatggttttatgagcaaaatgctgtggctgggcgttgatcataaatttaatgatcagttcagtgggtttgcccgtgcgcatgggttgaataatcgaacggcttatgatgcctattatgatagtgacaatcagatgctgatagatactcgagagctattcagtcgtacttatgatgcaggccttcaatttacacagggaatttattctgcccaatggattgccagttacagccatgtcaaagattacaactatgatcctaaatatgggcgttatggcaaaggctccaacttaagtaactccaaacaatataatgtgcaatggggaaactcatggcaagtaggtcatggggcaattagcggtggtgttgactggaaaagagaatcggttgcggcaggttcgaataatattcctgtacaaaaagacgtagataacaccggcctgtatttgacgacacagcaaaagattcatgatgtcacgctggaaggtgctgttcgttcagaccgtcattctgaatataattggaataccacatggcaaactggcatgggttgggaattcattgatggctatcggttgatcgtctcgtatggaaccgcatttaaggctccaacattgaatcaactctatagcaagtggggaaatgaaagtctcaaaccagaaaaaagtaaacagtgggaaggtggaattgaaggattaactgggccacttaattggcgcttatctgtttatcataatgatattgaacaactgataaattttgccaataaccactatgagaacattggtaaggcaaaaatcaaaggtgttgaatggacaggaaccatggataccggaatattccagcaccaattgacattacagtatgttgatccgcgtgatggcaataataagcggttagctcgcagggctaaacagcaggttaaatatcaattagattgggaattatacaatattgattggggagtaacctatcaatatatcggtcagcgcgatgatgcagattatagtgtttatcctccgaagccccttaaattgggtggtgtcagtttatgggatatcagcgcatcatacccaatcactaaccacctcacaatccgtgctagaatagcaaatctgtttgataaaaattatgagacagcgtatggctatcgcaccccaggccgagaatactttctcactggaagctacaacttctga

SEQ ID NO: 803 - DNA, 105 bp, Xenorhabdus bovienii
  Coding DNA location: Contig name=SeqID_16848; Position on contig =2703..2807bp; Strand=-
atgtccagttttctggcacatgagcctctttttgatagggggtcattctggactgtctcccgccttcatcgtagcatgacactttattcgctagattcaatatag

SEQ ID NO: 804 - DNA, 1188 bp, Xenorhabdus bovienii
  Coding DNA location: Contig name=SeqID_16848; Position on contig =2787..3974bp; Strand=+
atgtgccagaaaactggacatcctttgcactttccctacaatgccgctcggaaatttttcttaacgcgaccatacgagaaccagataatgcagaatgtcttgccaacggaagattatgaaaatcaattgatggaaaaggtccatcgtctgaaaggaatgatgatgccatttagtgcacctgagcctgaggttttccgttcccctgcatcacattacagaatgcgggctgagttccgcatctggcatgagcaagatgctctttaccacattatgtttgaccagcagaccaaacaacgtattcgtattgatcaatttccggttgccaatgagctgattaaccagatgatgcaggcaatcattgctggcgtgaaagataattctctcttgcgtcataaactgtttcaagtggattatctgtcaaccctcagcaataagattattgtctctctgctttatcataaaaagttgaatgatgaatggcgcgagcatgccatcacactacgtgatcaattaaaagcgaatggatttgatgttcagctgatcgggcgagcgtcaaaaaccaaaatcatgctcgaccatgactatattgatgaagaactgccgattgcgggtaagacgatgatttaccgtcaagttgaaaacagtttcacgcaaccgaatgccagcatcaatattcatatgttggaatgggcgatgggtattactaaaggcgccaagggagatctacttgagctatattgtggtaatggcaatttttctctggcattggcacagaactttgatcgcgtactggcgacagaaattgccaaaccttcggttgctgccgcgcaatttaatattgaagcgaaccaaattgataatgtgcaaattatccgtatgtcagcagaagagtttactcaagcaatgaatggagagcgggaatttaaccgactgcatggcattgatctaaaaagctatcaatgtgaaaccatttttgttgatcctccacgcagtggattagatgatgcaacagttaaaatggtacagggatatccacagattctttatatttcctgtaatccagaaacactcagccagaatctggaaatactgacacaaacccataaaataagcaggctggcactctttgatcaattcccttatacgcaccatatggagtgtggtgtattactggaaaaacgtaactaa

SEQ ID NO: 805 - DNA, 378 bp, Xenorhabdus bovienii
  Coding DNA location: Contig name=SeqID_16848; Position on contig =4071..4448bp; Strand=-
atggaacaataccgccaagataaaagcactatgttgctggctcttatcgttggattggcaacacacggaactttctcagcatttttcaactcgcttgtgcctttttcaattttcccgattatcgcactggtattatctctgtattgcctccatcatcgttatttgaattatccaatggcagatggattaccaaagttggcggctggctgctttttcttaggaatcttcatttacagcgccatcattcgggtggaatatccagaaattggttctaatttcctgcctgtcgtgattgatactgctttagtattttggatttacagaaagatcaaagggcgtaaacaacaagctatactcacttcagaaagccatggctga

SEQ ID NO: 806 - DNA, 651 bp, Xenorhabdus bovienii
  Coding DNA location: Contig name=SeqID_16848; Position on contig =4470..5120bp; Strand=-
gtgagtaacgtaactggtgtcagagcgaaacagaaagaaaaaacccgtcgttctctgattgaagctgcattcagccaactcagtgctgagcggagtttcacaagtctgagcctacgggaagtagctcgagaagcgggtatcgcgcctacttcattttatcgacattttcgggatgtggatgaactggggctgacaatggtggatgaaagtggcttaatgttgcgtcagttaatgcgtcaggcgcgtcagcgtatcgcaaaaggcggcagcgtcatccgaacctctgtttcaacgttcatggaattcatcggcaacaatcccaatgctttccggttattactacgcgaacgttccggcacatcggctgagtttcgtgcggctgtcgcacgggaaatccaacattttattgcagagctggcagactacctcgaacaggcaagccacatgccgcgtcattttactgaaattcaagctgaggcgatggtgacaatcgtattcagcgcaggtgcagaagcgctggatattgatgaggaaaaaaggcgtcgtctcgaagaacgtttagttttgcaactccgcctgatttccaaaggtgcttattattggtatcggcgggaacaagaaaaaaaactgtccctaaaacctcttgaataa

SEQ ID NO: 807 - DNA, 195 bp, Xenorhabdus bovienii
  Coding DNA location: Contig name=SeqID_16848; Position on contig =5043..5237bp; Strand=+
ttggctgaatgcagcttcaatcagagaacgacgggttttttctttctgtttcgctctgacaccagttacgttactcaccacaatcctgatatatccattcgactatataatgaagcaaatatatcagattctgctgtgtttgctgtgattgttctcttaaagctattatcccatattccccggtttcatttctaa

SEQ ID NO: 808 - DNA, 1398 bp, Xenorhabdus bovienii
  Coding DNA location: Contig name=SeqID_16848; Position on contig =5331..6728bp; Strand=+
atgcaatatactcattttgatgccattgtgattggctctggtcccggaggggaaggagcagcaatggggctggtgaaacagggaaaaaacgttgcagttatagaacgttacaatagtgtcggtggtggctgtacccattggggtacaattccatcaaaagctctccgccatgctgtcagccgtattatcgaatttaatcaaaaccccctctatagtgataactcccgcattcttcgttcctcattttctgaaatcctacgccatgctgacgttgtcattagccagcaaaccaaaatgcgtcagggtttttatgaacgcaatcggtgccaaatgtttgcgggcgaggcagcattcattgatgaacatcgtgtgagtgtccgttatgctgatggtagtgttgatatattaagtgcagataagataatcattgctactggttcccgcccttactgccctcccgatgttgatttcactcactcccgtatttataacagcgacaccatcctgcaactggatcatgaaccccgccacgttatcatttacggcgcaggagtgattggctgtgaatatgcttctatcttccgagggctgggcgttaaggtagatttgatcaatacccgtgatcatctgctgtcttttcttgatcaagagatgtctgatgccctgtcctatcatttctggaatagcggtactgtcatccgccataacgaagaatatgaaaaaattgaaggtcttgatgatggcgtgattgttcatctgaaatccggcaaaaaggtcaaggcagactgtctactgtatgccaatggccgcaccggcaatacagataagctagggttggaaaatgttggtctggaaacagacagccgtggtttactgaaagtgaatcgcgtctatcagagcagcaatgaaaacatttacgctgttggtgatgtcatcggctatccgagtctggcttctgccgcgtatgatcaaggacgcattgccgcaaaagctatcatgaccggaaacgccaacctacatctggtggaagatattccaacagggatttataccattcctgaaatcagttcaatcggtaaaaccgagcagcagctcactgcgatgaaaatcccgtatgaggtaggacgcgcccaattcaaacatctggcaagggcgcaaattgccggcatgaatgttggtagtataaaaatcctgttccatcgtgaaacaaaacagattctgggcatccactgttttggcgagcgtgccgcagagatcatccatatcggccaagccattatggaacaaaaaggagaaggcaatactatcgaatatttcgttaatacaaccttcaactatccaacaatggcagaagcctaccgtgttgctgcactcaatgggttaaatcggttattttga

SEQ ID NO: 809 - DNA, 918 bp, Xenorhabdus bovienii
  Coding DNA location: Contig name=SeqID_16848; Position on contig =6720..7637bp; Strand=-
atgaatatccgcgatctggaataccttgtagcgcttgccgaataccggcatttccgccgagccgctgattcttgtcatgttagccaaccgacactgagtgggcaaatccgcaaacttgaagatgagttgggcgtgatgctgctagagcgcaccagtcgtaaagtgctgttcacgcaacagggaatgttgctggtggaacaggccaaaacggtattgcgagaagtgaaagtcttgcaggaaatggcctctcttcaaggtgaaagcatgtctggccctctgcatatcggccttatccccaccgtcggtccctatatcttgcctcttatcattcctgagttacacaagctattccccaagctggaaatgtatttacatgaggctcagactcagaacctgctggcgcaactcgatagcggaaaactcgattgtgccattctggctttggtaaaagaaaccgaagcgttcattgaagtgccactctttgaagaaccgatgaaactagcgatttatgaagggcacagatgggcgaataggacgcatatcaagatggaagagcttgctggtgaaaaattattaatgctggaagacggacattgtttgcgtgatcaggcgatgggtttctgttttcaggcaggagccaaagaagatactcattttagggcaaccagtctggaaaccctgcgtaatatggtatcagcaggcagtgggattacattgctgcctgatttggctgtgccaaaagagagaaaacgcgatggtgtctgctacctggaatgtatcgaaccagagcctaagcgtacgattatcttggtttatcgccccggctcacctctgcgcggtcgctatgagcaattggcagaggcgattcggactaaaatgggtgactattttgaagtttttggcaaaacatcaaaataa

SEQ ID NO: 810 - DNA, 165 bp, Xenorhabdus bovienii
  Coding DNA location: Contig name=SeqID_16848; Position on contig =7560..7724bp; Strand=+
atgacaagaatcagcggctcggcggaaatgccggtattcggcaagcgctacaaggtattccagatcgcggatattcattcccaacctcagtatttgatatcaatgatagaattgatcaataaatcattatacgcacgagggaataaaactatcaaatgcttgtga

SEQ ID NO: 811 - DNA, 159 bp, Xenorhabdus bovienii
  Coding DNA location: Contig name=SeqID_16848; Position on contig =7844..8002bp; Strand=+
atgctactgatattctcgttcactcaacaccttaaacgctgtatcaaattcattaaaaaaaattactattatatcatcctttcatttatgggcagtaaactcacaatattcctcttcagaaatcagcaccgctttgccaaaagatttgttataacttaa

SEQ ID NO: 812 - DNA, 1380 bp, Xenorhabdus bovienii
  Coding DNA location: Contig name=SeqID_16848; Position on contig =8050..9429bp; Strand=-
atggcactttggggcggacgtttcagtcaggaagccgatcagcgattcaaacaatttaacgattctctgcgttttgattatcgtttggcggagcaggatattattggttctgttgcatggtcaaaggcgctggttacggtgggagtattgacttccgaagaacagcaaaaactggaactggcgctgaatgagttactgggtgaagtgcgggccaaccccaaggccattttgcaaagcgatgcggaagatattcatagctgggtggaagggcaacttatcgcgaaagtgggcgatttgggtaaaaaactccacacaggtcgtagccgtaacgatcaggtcgcaactgatctgaaactgtggtgcaaggatcagatagccgatattcagcaggcacttgtggagctgcaacaggcgctggtgattacggcggagaataatcaagatgcggtgatgcccggttatacccatttgcagagggcgcagccagtcactttcgctcattggtgcctcgcctatgccgaaatgctgggtcgtgatgagagccgcctgcaagatgcactgaaacggctggatgtcagcccattgggctgtggcgcactggcgggaacagcctatgatatcgatcgtgaacaattagcgtcatggctcggttttgcctcggcaacacgtaatagtctggatagcgtttcagatcgggatcatgttctggagctactgtcagatgccagtatcagcatgatccacctttcacgctttgctgaagacctgattttctttaacagtggagaagcgggttttattgagttatcagatcgggtaacttccggctcttccctgatgccgcaaaagaaaaaccctgatgcactggagcttattcggggcaaatgtggtcgggttcagggcgcattgacgggcatgatgataacgctgaaagggcttcccctcgcttataacaaagatatgcaggaagataaagaaggtctgtttgatgcgctggatacatggcgggattgcctgcatatggcggtgctggtgctggatggcattcaggtgcaacgcgggcgctgtgaggaagcggcaaaacagggttatgccaacgcgactgaactggcggattatctggtagcaaaaggtgtcccatttcgtgaagcacaccatattgttggtgaagtggtaattgcggccatagcggaaggtaaagcgctagaagaactgtctttgtttgaactgcaaaaattcagtgaagctatttcgctagatgtgtatgacgttttatcgctgcaatcctgtttggataaacggctggcaaaaggtggtgtatcacagaaacaggtggcacaggcgattgcagaggttaaacagcggttaacaatgggttag

SEQ ID NO: 813 - DNA, 1212 bp, Xenorhabdus bovienii
  Coding DNA location: Contig name=SeqID_16848; Position on contig =9477..10688bp; Strand=-
atgactaaaagcattaaaaaaatcgttctagcatattctggtggtttagatacatctgcgattattccttggttgaaagaacattatgacaattgtgaagttgtcgcgtttgttgctgacgttggtcaaagccgcgaagatctggaaggtgtggagcagaaagcgttgcgatctggtgcgtcggaatgtcacgttatcgacctgcgtgaagagttcatcaaagagtatgtttatcccgtactgaaaacgggcgcactgtatgaaggcagctatttgcttggtacatcaatggcacgcccaattattgccaaggcacaggtagaattggcgctgaaagtgggagctgatgctgtagctcacggtgcaacgggcaaaggtaacgatcaggttcggtttgaaagtacttatactgcgttagcgccgcatctgaaagtggttgctccatggcgtgaatgggatctgcgttcccgtgaggctctacttgattatctgaaagtccgcgatattcccaccaccgccacgctggaaaaaatttacagccgtgacgaaaacgcatggcatatctcaaccgaaggtggggtattggaaagtacatggaatgctgccaataaagattgctgggtgtggacagcagagccagaagatgcgcccaatgagccagaatatgtcaccgtcacggttgaaaaaggtgaggtggttggcgtgaatggtaaggtgctgtcaccctatcaatgcattaatgcattaaatgaactgggagccaaacatggtatcggccggatcgacattgtggaaaaccgtttagtaggcatgaaatcccgtggttgttatgaaacaccgggtggaaccatcatgatggccgcattgcggggaattgagcagttggtgttggatcgcgacagcttcaaatggcgtcagcaattggggttggaaatgtcctatgtcgtctacgatggtcgttggtttgcgccattgcgccagtcgattcaggctgctgcggaaacgttggctgacagtgtcagtggggaagtggtcttaaagctgtataaaggccaggtgaccgctgaacagaaaaaatcgacatacagtctctattctgaagaattcgctacttttggagaagatgaagtctatgatcaccgccatgcagaagggtttattcgcctctattcgctttcttcacgtattcgtacactgaacagcaaaaaataa

SEQ ID NO: 814 - DNA, 120 bp, Xenorhabdus bovienii
  Coding DNA location: Contig name=SeqID_16848; Position on contig =10675..10794bp; Strand=+
atgcttttagtcatagggataaccttttatttttgttcatctcagccaaatactgtgccactaatcgacaaaaccaagccaattacgccgaaatccgcgtaccggtgggtatgccattaa

SEQ ID NO: 815 - DNA, 774 bp, Xenorhabdus bovienii
  Coding DNA location: Contig name=SeqID_16848; Position on contig =10757..11530bp; Strand=-
atggagccgttagttatcaaattgggtggtgtgttgttagacagcgaagaagcgctggcgcggttgttttccacattgcagtcatatcggaagacgcataagcgcccgttagtcattgtacatggcggtggctgtttagttgatgaactgatgcagagattgcagctaccgattgtgaagaaacaaggcctgcgggtaacgccagcagatcaaattaatatcgttacggggacattggcaggaactgctaataagacactgctggcttgggcgataaaataccgattgcctgcgattggattgtgtctgggagatggtggtgtggtgcaagtttcccagtttgatgaggaattcggtcacactggaaaagctcatccgggtaaatccgatctcctgaaaattttgctggatgtcggttacatgccaattatcagctctattggcatcaccgaagagggtgagctgatgaatgtgaatgcagatcaggcggcaaccgccattgcgcaggtgttaaatgcggatctggcctttctgtctgatgtcagcggtattttggatggaaaaggtcagaaaatcccagagctgacagcagaaaaaataaaacagctcattgagcatggaatcataaccaatggcatgattgtgaaagttaatgcggccttggaagcggcaaaaacgctggggcatccggttgatattgcaagttggcgacatacggatcaattaattgcattatttaatggcatacccaccggtacgcggatttcggcgtaa

SEQ ID NO: 816 - DNA, 1005 bp, Xenorhabdus bovienii
  Coding DNA location: Contig name=SeqID_16848; Position on contig =11568..12572bp; Strand=-
atgttgaatacgctgatagttggtgccagtggctataccggagcagagttagcagcatatctgcaacgtcatctccatgtccatctctctggcttaatggtttcgtctcaaagttcagatgcggggaaatgtttttcagatctctacccgcagtacaagggcattgttgatttacctttacagccgctgactgatgtggctgaagcagtgaatggtattgatgtcgtcttcctcgccactgcccatgaagtcagccatgatattgtgccgatatttctacaagcaggttgtaccgtcttcgatttatccggagcctatcgcgtacaaaatacacagttttattcaaaatactatgggttcgagcataaaaatacggcttggctcgatcaggcagtttacgggctggcggaatggcaggcggaaaaaatcaagactgcccagttgatctcagttcccggctgttattccaccgtctctcagctttcattgaagcctttgctggaaaaaaatctgctggatactgaacaatggcccgtcatcaatgctgtcagtggtgtcagtggagcagggcggaaagcaacaattaataacagtttctgtgaagtcagtttgcagccttacgggatttttaatcatcgtcatcaacccgagatcgcggcacatttaggcaccgaagtcatttttatccctcatctgggtaatttctcgcgcggtattctcgccacgatcacctgcaagttgaaatcaggcgtaacagaagagcaaattagggaagcctaccagcaggcgtatcatgataaaccgttggtgcgtctatacacggaaggtatgccggcattgaaatcagtcgtgggtttgccattctgcgatattggttttgccgttcaaggacagcacctgatcattgtcggggctgaggataatttgttgaaaggcgcggcagcacaagcagtacagtgcatgaatattcgttttgggtttgcagaaactcaggcattgctttaa

SEQ ID NO: 817 - DNA, 1158 bp, Xenorhabdus bovienii
  Coding DNA location: Contig name=SeqID_16848; Position on contig =12675..13832bp; Strand=+
gtgaatattaaattaccatcatttattaaattatatcatcagctcattgccacaccttccatcagcgcaaccgatgctgaactggatcaaagcaatgaaatattaatcaacctgctggctggctggttgaaagaccttggttttaacattgaaattcagcccgttcctgaaacccgcagcaagttcaatatgctggcaacattgggtagtggttctggaggtttattgttatgtggtcatacagatacagtaccattcgatgaaggacgctggacacaagatccctttacactgaccgagcgggataacaaattttatggccttggcaccgccgacatgaaaggcttctttgcttttatcattgatgcactgcgagatattgatgccagcaagttatcgcatcctctttacattctggccaccgcagatgaagaaacatcaatggcaggtgcgcgttattttgctgccaataccgccattcggcctgatttcgccattattggcgaaccaacatcgttacaacctatccatgcgcataaggggcacttagctcatgttatccgcattgagggaaaatccggccattccagcgatcccgcacgcggtgtcaacgcacttgaactcatgcacgaatccatcacgcaattgatggaattacgcactaccttgcaggaacgctatcacaatccagcatttgttattcctcatccaactatgaatttcggccatattcacggtggtgatgccgcaaaccgcatctgtgcctgctgtgaactgcatatggatattcgcccgctgcccggattgaccttgcaggatatggacgaattactgcataaagcactagagccggtgaaacagcgctggccgggacgtttaagcgttacccctctccacccccctattccgggttatcaatgcccgaccgatcacaaattggttagcgtgatcgaaaatttgttgggaacgaaagcagaaaccgtcaattattgtacggaagcgccttttattcaggaattgtgtccaacattagtcttggggccaggatcaattgaacaggcacaccagcccgatgaatttttaagtatggaatttgttgagccgaccaaaaaattgatttctcagctggttgaacatttttgcctgcaagcccattaa

SEQ ID NO: 818 - DNA, 96 bp, Xenorhabdus bovienii
  Coding DNA location: Contig name=SeqID_16848; Position on contig =14066..14161bp; Strand=-
atgcttaagtgtttacatgtctatacgtttagatgtctaaatagaatgggcgaagcaatatgtttagtcaacagcaaagtgacttatccgaaatga

SEQ ID NO: 819 - DNA, 888 bp, Xenorhabdus bovienii
  Coding DNA location: Contig name=SeqID_16848; Position on contig =14212..15099bp; Strand=+
atgagtttttttcacgctaatcagcgagaagcgctgaatcagaatttggcagagcttgaagggcagattcgtgtttcttttgagttctttccacccagcacgactacgatggagcaaaccctgtggaaatccatcgaacgcttaagcaaactgaagcctaaatttgtctccgtaacctatggtgccaattccggtgaacgtaaccgcactcatagcatcatcaagggcattaaagacaaaaccggccttgatgctgcccctcacttgacttgcattgatgccaaccgtgaagagctgcgtaatattgctcacgattattgggagagtggtattcgtcacattgtggcattgcgcggtgatttacccgatagcagcggtaaaccggaaatgtacggtgccgacttagttgagctcttaaaaaaagaagcggattttgatatctccgttgctgcttacccagaagtgcatcctgaagcgaaaagtgctcagtcggatctgattaacctgaaacgcaaaattgatgcaggagcaaatcgcgccattacccaattcttttttgatgtagaaagttacctgcgttttcgcgaccgctgtgttgcaacgggaattgatgtggaaattgtgccggggattctgcccgtctcgaacttccgtcagttacagcggtttgccacaatgactaacgtccgcattccaagctggatgaccagaatgttcgaagggctggatgatgatccggaaagccgcaatttagttggcgcatcgattgcgatggacatggtgaaaattctcagccgcgaaggggtgaaagatttccatttttatactctgaatcgggcagaattaagttacgctatctgccatacgctgggagttcgtccttgttga

SEQ ID NO: 820 - DNA, 174 bp, Xenorhabdus bovienii
  Coding DNA location: Contig name=SeqID_16848; Position on contig =15096..15269bp; Strand=+
ttgattgttgatagaattaacggacgctgggccaagataagatttctttgcggatcacaatcaaacggtggcgatgtaaatcggaatcgcctccccaacagagggcatcccacttttcaagaaaggaaattgtatgttctacgttattttctgaaatacacagtttgcggttaa

SEQ ID NO: 821 - DNA, 282 bp, Xenorhabdus bovienii
  Coding DNA location: Contig name=SeqID_16848; Position on contig =15385..15666bp; Strand=-
atgaaggttatatggacacctcaagctttgcaggatagtgaaacaatatgggaatatcttgttactaaaaatccagtggccgccgtaaaaatggatgagttattcgaaactgctgcggaacggttgattgaatttccttatatgggacatgccggtgaaatttcagggacattcgaagttttcccgtatgagaactatcggctggtttatgaggtttcaggggaaagtgtctggatattagctttggtgcatacttctcagctctggcctcctgtgaaatga

SEQ ID NO: 822 - DNA, 267 bp, Xenorhabdus bovienii
  Coding DNA location: Contig name=SeqID_16848; Position on contig =15663..15929bp; Strand=-
atgaataaacaagctgtttttacgatgaagctggaatctgagttgcgtgaagattttatggcagctactgccgcggaacatcgtcctgcttctcaggttgttcgtgaactgatgcgggaatatatccaacgtcatgagtatcgtaactttcttcagcgaaaagttgatactgcgcgtcaatccataaatgctggagagggtattgaacatactgatgccaaagcgatttttgcagctcgtagagcacggaaaaaggccgataaatga

SEQ ID NO: 823 - DNA, 2637 bp, Xenorhabdus bovienii
  Coding DNA location: Contig name=SeqID_16848; Position on contig =16313..18949bp; Strand=-
atgaatcaacaatactctgcaatgcgcagcaatgtcagtatgcttggtaagttattgggtaacactatcaaagaagcactgggagaaggcattcttgataaagttgaaacgataaggaaattatccaaatcatcccgtgcaggaaacgaggctgatcggcagcaacttttatctacactgcaaaatttatccaatgatgagttattgccggttgctcgggcctttaaccagtttcttaatctggccaacgttgccgagcaatatcacagtatttcaccgcatggtgaagcggccagcaatcctgtagcgctagaggctttattcaatcggctgaaagataaaaaattcagcaatgatgacttgatcaacgcagtcaatgaacttgccattgaattggtcttgacggcacatcctaccgaaattgcccgtcgtactctgattcataaactggtcgaagtgaatgcctgtctggcacagcttgaccatgatgatctggcggattatgaacgcaataatatcatgcgccgtttacgccagttgattgcccaatcatggcatactgatgaaatccgcaaaattcgccccactccgattgatgaagccaaatggggatttgcggtggtggaaaatagtttgtgggaaggtgttccagcatttctgcgtgaattcaatgagcaattggaagaatccattggctatagcttacctgtggaagccgtgccgattcgtttcacttcttggatgggcggcgatcgtgatgggaaccccaacgttaccgcagaaattactcgccatgtactgttgctcagtcgctggaaagcagcggatctgtttttgaaagatattcaggtgttagtttctgaactctccatgtcggagtgtacacctgaactgcgccagcttgcggggggtaatggggtgctggaaccttaccgtgaaattgccaaacaattgcggacgcaattaaatagcacgctgacgtatctggagaaacaccttaaaggagagcaagtcctgccccctgcgggtttgctgctgcataacgaacaattgtggcaaccgctgtatgcctgctatcaatcactgaaaacctgcgggatggaaattatcgccaatggccaattgttggataccttgcgccgcattcgctgctttggtctgtcattggtgcgtattgatatccgtcaggaaagttcccgtcataccgatgctattgccgagctgacacaatatctggaactcggagattatgcgagctggtcagaaacggagaaacaaacttttctgctgcgtgaattgaattcaaaacgtccgcttattccacatcgttggcagccaagtgaagaaaccctagaagtcttcgaaacctgtaaggtcattgccgaatcgccacaagatgcgattgcagcctatgtaatttctatggcgaaagtcccctcggatgtactggccgtgaagttgctactgaaagaagcgggttgctcactgaaattgcctgttgcaccgttgtttgaaacccttgatgacctgaacaatgcggaaagtgtgatccagcaattactgggaatcggctggtatcgcgagctgattcaggataagcagatggtgatgattggctattccgactctgccaaagatgcgggagtgatggcggcatcatgggcgcaatatcgggcgcaggatgcgttgatcaaagtgtgtgagcaggaaggcgtaacgctgacgctgttccacggccgtggcggtacgattggtcgtggtggtgctccggcacattccgctttgctttctcagccgccgggcagtctgaaaggtgggctgcgcgtgacggaacagggcgaaatgatccgctttaagtttggtttgccacaggtgacgattagcagtctggcgttgtataccagtgcaattttggaagcaaatttactgccgccgccagaaccaaaaccggaatggaagcaagtcatggatacgctctctgatgtttcctgtgacatgtatcgtgattacgtgcgtgagcagccagaattcgtaccttacttccgagcggcgacgccagaacaggaattggcgaaactgcctttggggtcacggccggccaagcgtcgtccgaccggcggtgtagaaagcctgcgtgcgatcccttggatattcgcttggacgcaaaatcggctgatgctgccggcatggttgggcgcgggagcagcgctgcaacatgtgattgatgcgggcaaactgtcggtattggcagatatgtgccgcgattggcctttctttaatactcgtattgccatgttggagatggtatttgccaaggccgatttatggctggcggaatattatgatcaacgcttggtggataaaaaactgtggccgttgggaataacgctgcgtaatcagttggcagaggatattaaaactgtgctgacgatttcgcaggatgaacaattaatggcggatttaccgtggattgcggagtctattgcgctgcgtaacgtatataccgacccgctgaacgtgttacaggcagaactattacagcgctcccgccagcaggaacagcctgatcctcatcttgaacaggcattgatggtgacgattgcgggggttgcggcagggatgcgcaataccggctag

SEQ ID NO: 824 - DNA, 159 bp, Xenorhabdus bovienii
  Coding DNA location: Contig name=SeqID_16848; Position on contig =18950..19108bp; Strand=+
gtggtttctgaccttgtgttgctgtatttaatccatttcacccgatcgttgatcgctttaatcggcatccaccctgtttgcagagcatatttttgtttatttctgatgttctattcatatcagaaaatgaacgatttgggcgaattttatgaaatttaa

SEQ ID NO: 825 - DNA, 2439 bp, Xenorhabdus bovienii
  Coding DNA location: Contig name=SeqID_16848; Position on contig =19315..21753bp; Strand=-
atgagtgcactggcaacagcgggggcggaattcggccgccagttacataaatttggcggcagcagccttgctgatgtgaaatgctatcagcgggttgcagaaattatggcgaattatagccagccgggtgatttgatggtggtatcggcggcagggagcacaaccaatcagcttattgattggttgaaactgagccagagtgaccgaatttcagcgcatcaagtacagcaatcactgcggcgttatcagcaggagctgatccgaggtttattgcctgaagtgattgcagaagaactcgtggcgcattttatctcggatctggaaagattaagtgtattgctggataaaccgattactgacattacgtacgccgaggtggtcgggcatggtgaaatctggtcagcccgtttgatggctgcggtgcttgagcataagggtatttccagtgcatggttggatgcacgccaatttctgcgggcagaacgcgctgcccagccgcaggttgatgtgaacttgtcccaacctttactgagccaactgctgattcaaaatcccagtaagcgtttggtggtcacggggtttatttccagaaatcagaagggagaaactgtactgctgggacgcaatggcagcgattattctgccacacaggttggtgcattggcaggcgccaaaaaagtaacgatttggagcgatgtagcgggtgtttacagtgctgatccgcgtaaagttaaggatgcgtgcctgttgcctttactgcgtttggatgaagcaagtgaactggcgcgcctggcggcacccgtacttcatacccgcaccttgcagcctgtttccgtcagtgatatcgatttacaattgcgttgcagttaccagcctgaacaaggatctacccgcattgagcgggtgctggcaacaggtactggggcgaaaattgtgaccagtcatgatgatgtctgtctgattgagctgcacatttcttctgcccatgatttcaagcagatttacaaggacattgattcattgctgaaacgcgcacaagtccggccgttggcgacaggtctgcacgctgactgtaatttgattcagctttgttatacctctgaagtcgtgaacagtgctctcgatgtgttgcaggatgcgtctttgccaggaaaattgtccttgcgagaaggattggcgttggtggctttggttggggcgggagtgtgcaagaatccgttgcatagccaccgtttttatcagcagcttaaagaccagcccgttgaatttatctggcatgcggaagaggggatcagccttgttgctgttttgcgcctgagccagacttcacatctgattcagggattgcaccaaagtctgttccgggcagaaaaacgcattggtctggtgctgtttggtaagggaaacattggctcacgctggctagaattgttcgctcgtgaacagaagaatatttctgcccgcagtggttttgaatttattttggcgggaattgtggacagtcgtcggagcttgctgaattatcagggacttgatgcgagtcgagcattggcattctttgatgatgaagccactcaacatgaagacgatgcgctgtttttgtggatgagagcgcacccttatgacgatttggtggtgttggatgtcactgcaagcgaggagttggctaaagactatattgattttgccagctatggctttcatgttatcagcgctaataaagttgcaggttcttcgaacagtaacacttatcgcatggtccgcgatgcttttgcaaaaaccggccgtcattggttatacaatgcgaccgttggtgcagggttgccgattaaccactctgtcagagatttgcgggaaagtggcgataccattctgtccatcagcgggattttttcaggtacattatcgtggctgttcctgcaatttgatggttctgtgcctttcagtgatttggtggagcaggcgtggcagcaaggattgacggagcctgatccccgtatcgatttgtccggtcaggatgtgatgcgcaagctgattattctggctcgcgaggcgggttatgagatagagcctgatcaggtgcgtgttgaatccctcgtgccagtagaggccagaaccggttccatcgaagatttctttgaaaacagtgccgttattaatgagcagatgctccaacggttggaagcatcacgggaaatgggcatggtactgcgttatgtcgctcgctttgatgccaccagtggtaaagcaaaagttggtgtcgaagccgtgcgtgcagatcatcccttagcttcgttattgccgggggataatgtctttgcgatagaaagccgctggtatcgtgacaatccactggtgatccgtggtccaggtgctgggcgggatgttacggcaggagcgattcaatcggatttgaaccgtttgtcacagcttctttaa

SEQ ID NO: 826 - DNA, 1161 bp, Xenorhabdus bovienii
  Coding DNA location: Contig name=SeqID_16848; Position on contig =21763..22923bp; Strand=-
atgggatgtaaacaagcaacagtcgcggttcaaagtggttcaaatattgatgaacaatatggttgtgttgttccgcctatctatctttccagcacatataatttcactggtttcaatgagccaagggcacatgactattcccgacgtggaaatcccagtcgagatgtcgttcagcaggttttggctgagctggaaggtggagcgggggcagccatgaccagcagtggcatgtcggcgattcacctgctgtgtaccgttttcttgcaaccgggggatttattggtggctccccatgattgttatggcggcagttaccgcctgtttgacagtctgagtaaacgtggggcgtacaacgttatttttgttgatcagtcggataatcaagccctgaaacaggctctggcgcaaaagccaaaactggtgctgatagaaacgccgagtaatcctctgctgcgcattgttgatattcaatatatctgtgggttggcgcatgaagttggagcattggcgattgttgataacactttcttgagtcctgtattgcaaaagccgttggatttgggcgctgatttagttgtccactcttgtacgaagtacctgaatggacattccgatctgattgcgggggcgattatcgccaaagatcccgtgatcgcagaaaatttggcgtggtgggcgaacaatattggtgtcaccggtgccgcctttgacagctacctgttgttgcggggtattcgtaccctgtctgcacgggtaatgctacagcagaataatgcagcggccattgctgagtacctgcaacagcagccacaagtgaaaaaactctactaccctgctttgaaaaatcatcccgggcatgaaattgcccttaaacaacaagcaggcttcggggcgatgctgagttttgaacttgatggtgatgaacagaccctacgccactttttatctgcgttaaaattatttactctggctgaatctctcggtggtgtagagtcgttgatttctcatactgcgacgatgacacatgcgggaatgtcggcagaagcaagggcgcaggcagggatcacggattcacttcttcgtgtctctgtaggaattgaagatagtcaggatttaattgcggatctggacaaagcatttcaggcagcagcaacgaggtaa

SEQ ID NO: 827 - DNA, 318 bp, Xenorhabdus bovienii
  Coding DNA location: Contig name=SeqID_16848; Position on contig =23214..23531bp; Strand=+
atggctgagtggaatggtgagtatgtcagcccttatgctgaacatggcaaaaaaagtgaacaagtcaaaaaaattacggtttcaattccattaaaggtcttgaaaatactgactgatgagcgcactcgtcgtcaagtgaataatctgcgtcatgcaacaaatagcgaattgctgtgtgaagcatttcttcatgctttcactggacaacccttgcctaatgatgatgatttacgcaaagagcgtcatgatgaaatcccagaggcagcgaaagacataatgcgtgagctcggtattgatcctgaaacatgggaatactga

SEQ ID NO: 828 - DNA, 354 bp, Xenorhabdus bovienii
  Coding DNA location: Contig name=SeqID_16848; Position on contig =23550..23903bp; Strand=+
atgcaaacatcgggcgtttttgtttcaaccgtactgcctgtaaagtttacaggcagaaaatggtcattacttactagagcctggaacgctgaaacgtttgttgaagcgatcaacacgaccacccgtcgcaacgtcacgctgcttgcctgtgtagaacgggtggcattcaccacaaacgtccagattcaggttgtgattaacggtagagttgatggtgataacgttaccgcaagagcaagatgcagtaattgcttcgtatttaggatgaataccttttctcataggaaacctctgttaaggccgtgtcgctatccagccttgttgccgccagacaccacacgtcgtgttgattga

SEQ ID NO: 829 - DNA, 2199 bp, Xenorhabdus bovienii
  Coding DNA location: Contig name=SeqID_16848; Position on contig =24059..26257bp; Strand=+
atgacagttgttcaggttgcgctgcctgtccccttaacccgctcttttgattatctattacccgaaggattgccattgcccacgacaggtgtgcgggtgctcgtgccgtttggcaagcgcaatgcaataggcattgtcacgggaaccgcaggcagcagcgaaattccctttgaacagctcaagccacttgccgcgatccttgatgcacaaccgcttttccctgacgacctttggcaattgctccagtggtcagcctgctattatcactatccactgggagaagtgttgttccatgccatgcccgtcttactgcgacagggaaaacccgccgaatttactccactttggcaatggcaggttacggaagcaggccatgaattccctctggagcagcttaaacgttccgttaaacagcaacaagctctggcttcgctacgcctgaaacccatttaccgtcatcagatttctgaactggcattcagcgaaagcgcattgcaatcattgaaaaagaaagcgctgattgatctgcatccgatacagccggaggcaaaaaactggcatgagcagtttcaaattattggtgaacggctacaactcaatacagagcaggccagcgcagtcggcactgtccgagcagaagatcaggttttttctccatggttgcttgcgggtattacgggttcaggcaaaaccgaagtgtatcttagtgtgctggaaaacattctcgcgcagggaaaacaagcgctgattttagtcccggaaattggtctgactccgcaaactatccgccgattcagagaacgtttcaatgcgcctgtcgatgtcctgcactccgccttaaatgacagtgaacgtctgtcggtatggctacgagccaaacggggagataacgcgattgtcattggtacgcgctccgcattgtttaccccctttgcccatttgggtgtcatcattatcgatgaagagcatgacagctcctataaacagcaggagggctggcgctatcacgcccgtgatttggccgtgttccgggccaagaaagaagacattcccatcatgatgggtacagcaacgccggctctagaaacgctgttcaatgtgcagcagggaaaatatcgacaattgacactgacccaacgggcgggtgaagctaagcctgcggttcagcatttgctagatttgaaaggcttgccattgacagtcggtttatcccaaccgctcatcaatcgcattggcgagcatctgaaagcggataatcaagtcatcctgtttctgaaccgccgtggttattcccccgctttgctttgccatgaatgtggttggatagcggaatgccaacgctgcgatcactactacactctgcaccagaaccatcgccatctgcgttgccatcactgtgacagccagcgcccgatcccgcgccaatgcccccaatgtggcactactcatttaattcccgtcggattgggaaccgagcagcttgaagatggcatcacaaaattgtttcctcatattcccgttacccgcatcgatcgggacaccactagccgcaagggagcattggaacaacaactggcggcagtgcaccaaggcggtgcccgtattttaattggtactcagatgttggcgaaaggccaccatttccccgatgtcacgttagtcgtcttgcttgatgtcgatggcgccctgttttctgccgatttccgggcggctgaacgtttcgctcaactgtatacccaagtctccggccgcgcaggacgggcgggtaaacggggggaagttgtccttcagacccaccatcccgaacatccactcttgcaggtgttgctggaaaaaggttatgacgcatttgcccgtcaagcgatggaagaacggcaacaagtgtttctgccgccgtttgccagccacatcctgctccgttcagaagaccacgacaatcagcaagcccctgcttttttgcagcaaatgcgtcaattgtttgaacatcacgctctgcgtgatgaacatttatggatcatggggccagttcccgcattgcaggccaaacgtggtggccgctttcgctggcaattactgattcagcacccttcacgcatttttctacagaaaatgatggcggcaatttatccgcaaatcgccgcgctcccgcaggcacgcaaggtgaaatggaacattgatgttgatcccaccgaaggctga

SEQ ID NO: 830 - DNA, 1026 bp, Xenorhabdus bovienii
  Coding DNA location: Contig name=SeqID_16848; Position on contig =26551..27576bp; Strand=+
atggaaaaaaagaattgtgcattggcaaccatgaaagatgtcgccaatgtggctggtgtttctaccgcgactgtatcaagaacacttatgaatccggacaaggtttctgcccgtacccgtcagaaagtagaaagtgccgtactggaagtgggctactatcctcataaccttaccaaaaacttaagacgcaatgaatccagagcgatcttggttatcgttcccaatatcagcgatcctttctttaccgaagtcattcgcggcattgaagaaacagcagcagagcatggctatctggttctgattggcgactgtaagcatcagcagcaacaggaacatgcctttatcaatcttctgattaccaaacggattgacggcatggtgctgcttggctcaaacattcctttcgatgtttccaaagaagaacaaaaaaacctgccaccaatggtcatggccaatgaattcgcacctgacctggaactaccgactgtccacattgacaatctgacttcggctttcaacgctacctatcacttacaaaaactgggacacaaacgcatcgcctgtattacggggccagaaataatgccactgtgccattaccggcttcagggctacattcaggcattgcatcgtacgggagaagcgatccgcgaagattatatcctcaggggagatttcacccatgaaagcggagctgaattggcagaaatcttgcttaacctgccagagccacccagcgcgattttctgccatagcgatatcatggctattggcgcaatgtggcaagccaagaaaatgggattaaaattaccagaagatctgtcagttattggctttgataatttaaatctggcgcaatacagcgatccaccgctaacaaccgtggcacagccatgttatgagattgggtattattcaatactgttgttgctggagcagcttcagggccgcatcgtttccaaaggttcacgattattggatgcagaattgctcattcgtgcgagcacttgttcgcctaaaagctag

SEQ ID NO: 831 - DNA, 789 bp, Xenorhabdus bovienii
  Coding DNA location: Contig name=SeqID_16848; Position on contig =27651..28439bp; Strand=+
gtggcacaacgagattatgtaagtcgcgggcgttctaatccccgtcagaaaggcactggtaagaaaaaaaatcaggctcaaggattacccaaaactacattagccgttgccgtggccttggtggtcatgtttattggtggcctttatttcatcgcacacactaagaacgatagtgtacaaaatccaccaccacccgctcatcattccaaaaaccaaggcctaccgccaaaaccggaagaacgctggacttacattaaagagttggaaaaccgtcctgttggacttccttcgatacaggaaccgacttctgctaatcaaccaaccaaccaaccagcgaaactaacgcaagaacaactccaattacttgcacagatggaggcagacattcgccagcccccgacgcccttaaaagaagtgccttacaacagtgaacctgttcctcgctcacaggtcattatcaccccgcctgaacaaaagccgcttgttgcacaagaaaagaccccgccagcacaatctctggcacccagtgaaaccaataaatcaccgaaacctgcgataaatgaatccaagttgatgctacagtgtggctcgtttcgaacaatagagcaggcagaatccgttcgtgccagcctcgcattcgcaggcattgagagccagattacaacaaaagacaattggaaccgggttgtagtagggccttataaaaacaaggaagccgcggaaaaaatgcgcagccatgttacaaatgcgggtgtgccaggctgtattctccgccctgccgggggttga

SEQ ID NO: 832 - DNA, 183 bp, Xenorhabdus bovienii
  Coding DNA location: Contig name=SeqID_16848; Position on contig =28469..28651bp; Strand=-
atgacccattgttgcttgtccatcaccaccgatgacgacctggccattacggcgaacacttacgattgtagtcacgagttagcccctggttacaaaatagaagacgttacacacggtactttggcttgttatgccacaattgcaagctgtattgctggaaaagcaccgcgtgtctgttattag

SEQ ID NO: 833 - DNA, 531 bp, Xenorhabdus bovienii
  Coding DNA location: Contig name=SeqID_16848; Position on contig =28577..29107bp; Strand=+
gtgactacaatcgtaagtgttcgccgtaatggccaggtcgtcatcggtggtgatggacaagcaacaatgggtcataccgtcatgaaaggcaatgtccgcaaagtacgccgcctttacaatgacaaagtcatcgcgggttttgccggcggcaccgcagatgcatttactctgttcgagctgtttgaacgcaaactcgaaatgcatcaggggcatctgaccaaagcagccgttgaacttgccaaagactggcgaacggaccgcatgcttcgcaaactggaagccctgcttgcggtagcagatgaaaatgcttctctgatcattacaggtaacggtgatgtgattcagccagaaaatgacctgatcgccattggttccggtggttcatacgcacaggcagccgcccgggcaatgctagaaactaccgaactcagcgccagggaaatcgcagaacgcgccctgactattgcaggcgatatctgtatctacaccaaccataatcacaacttcgaagaactgccttcaaaagcgtaa

SEQ ID NO: 834 - DNA, 1332 bp, Xenorhabdus bovienii
  Coding DNA location: Contig name=SeqID_16848; Position on contig =29119..30450bp; Strand=+
atgtctgaaatgactcctcgcgaaattgtcagcgaacttgacaaccacattatcggtcaggataaagcaaaacgcgctgtcgccattgctctgcgtaaccgctggcgccgtatgcagttggatgaaacactgcgtcatgaagtcaccccgaaaaatattttgatgataggcccaaccggtgtcggtaaaaccgaaattgcccgtcgtctggcaaaactggccaacgcgccttttatcaaagttgaagcgaccaaattcacagaagtcggttatgttggtaaagaagtcgattcaattatccgtgacttgactgatgcagcagtaaaaatggtgcgtctgcaatccattgagcaaaaccgctatcgtgccgaagagttggccgaagaacgcattctggacgttttgctcccaccagcgaaaaacaactgggggcaaacagaaacacagtccgaaccttctactgcccgtcaggcattccgcaagaagctacgcgaagggcagttggacgataaagaaatcgaaattgacgtcgcatcagcacctgttggcgtggaaatcatggctcctccaggcatggaagagatgaccaaccaactgcaatctatgttccagaaccttgctggtcagaagcaaaaagcacgcaaaatgaaaatcaaggatgcgttcaagctgctggtggaagaagaagccgcaaaactggttaatcctgaagagctgaaacagcaggccattgatgccgttgagcagcacggcatcgtctttatcgatgagatcgataaaatctgtaaacgtggccagacttccggcccagatgtttcccgtgaaggcgtccaacgcgatctgctgccactggttgaaggctgcaccgtttccactaaacacggcatggtaaaaaccgatcacatcctgttcatcgcctccggggcgtttcaggtttccagcccttccgacctgatcccagagcttcagggtcgtctgccaattcgtgttgagctacaagcgctgacgacagaagactttgaacggatcctgacagaacctaacgcttcactgactgaacagtataaggcgttaatggcgacagaaggcatgaatatcgatttcacaactgacggtatccgcaaactcgccgaagccgcatggcgagtgaatgaaacgactgaaaacattggtgcccgccgtctgtatactgtgcttgaacgcatgatggaagatatttctttcgacgccagtgaacgtcaaggacattcggttgaaatcaatgccgattacgttaaagagcatttggatgagctcgttgcagatgaagatctgagccgatttattttataa

SEQ ID NO: 835 - DNA, 918 bp, Xenorhabdus bovienii
  Coding DNA location: Contig name=SeqID_16848; Position on contig =30561..31478bp; Strand=+
atgaattcaacaacgtctatcagtcagatgcaggcatggttggaaagcttgcgccccaaaacgctcccacttgccgtggctgctgtcgtgagcggttcagcccttgcatcatggacaggccatttcaagtggcctgtggcgttgctggctttattgactgctgccctgctgcaaattctttccaacctcgccaatgattatggcgatgtcgccaaaggcagcgatacagaaaaacgtattggcccgatgcgtggtatgcaaaaaggcatgattacggccaagcagatgaaaacagccttgaagatcaccgtgctgctctcctgtctatcgggaattgctctcattaccgtcgcctgtaacagcccaagcgatatcatcggctttctgacgctgggagtattggctatcgttgctgccatcacttataccgtgggaaccaaaccctatggctatatggggctgggcgatctttccgtcctgattttttttggctggctgagtgtcattggcacctattacctgcaagccaatacttttgatctgagtaccgtgctgccagcaaccgcctgtggcttactctccgtggcagtcttgaatattaataacttgcgcgatatcgaaagtgatcgccaaaacggtaaaaatacgctggccgtcaggctgggggcaaaaaaagcccgctattatcacgcggctctgctgatcggtgccatcctctgtcttgcggcctttacacttctgcacctgaagggctggtctggctggttattcctgctcgctgttcccctgctgttgaaacatatgtggaaagtactgcacgatcggacgcctaaaggcatgcgcccaatgctggtacaaatggtcaaagccgcattattgactaatgctctgttttccatcggattggtatttaattaa

SEQ ID NO: 836 - DNA, 210 bp, Xenorhabdus bovienii
  Coding DNA location: Contig name=SeqID_16848; Position on contig =31471..31680bp; Strand=-
atgaagtacgcccaccaaagttggagaataaaggttctaccacgttcacatcttcttgatagatatcacaaagttcggaagtatcatatttcatgggatttacgtctggtttatgcaagggacagacagtatatccttttcaagctagtgttggcaaaatcatcaatcttaaaatttatgtgtaaaacggatacttactcgcttaattaa

SEQ ID NO: 837 - DNA, 510 bp, Xenorhabdus bovienii
  Coding DNA location: Contig name=SeqID_16848; Position on contig =31587..32096bp; Strand=+
atgaaatatgatacttccgaactttgtgatatctatcaagaagatgtgaacgtggtagaacctttattctccaactttggtgggcgtacttcatttggtggtcaaatcatcacggtgaaatgctttgaagacaatggcctgctttatgatgtgcttgaagaaaatggcagtggccgtattttgctcgttgatggtggtgggtctgtccgcaaagcgctggttgatgccgggctggctcaacttgccgtcaacaatgagtgggaaggcattgttgtctatggcgcagtgcgtcaggtcgactcccttgcagagcttgatatcggcattcaggcgatggctgcgatcccagcaggctccaacagcgaaggcatcggagaaagtgatatcagggtgaattttggcggcgtgactttcttttccggcgattatctctacgctgataatactggcatgattttatcagatgtcccgttggaaattgacgaagaagatgaagatgatgaagtataa

SEQ ID NO: 838 - DNA, 123 bp, Xenorhabdus bovienii
  Coding DNA location: Contig name=SeqID_16848; Position on contig =32050..32172bp; Strand=+
atgtcccgttggaaattgacgaagaagatgaagatgatgaagtataatcacttcatcatctattatgccaaaatgttaaagagggcgtattcatcgcccttctcaacaaaactgcaatactga

SEQ ID NO: 839 - DNA, 243 bp, Xenorhabdus bovienii
  Coding DNA location: Contig name=SeqID_16848; Position on contig =32174..32416bp; Strand=-
atgtcatttgaagtttttgaaaagctagaatctaaagttcagcaggcgattgatactataactctcctgcaaatggaaattgaagaactgaaagaaaggaacgcagcgttgtctcaggatatccaaagtgcggcaagtagccacgactcgttggtgcgtgagaatgaacagttcaaacaggaacaactggcgtggcaagaacgtttgcggactttgctgggtaaaatggaagatgtgcagtaa

SEQ ID NO: 840 - DNA, 207 bp, Xenorhabdus bovienii
  Coding DNA location: Contig name=SeqID_16848; Position on contig =32489..32695bp; Strand=+
atgttcgttataacgagaaatatagtgactaatccgaaatgcaagcgagatcacatttccatgatgaacaaaaccccaatcaaatgcgaattcgctcattttgttgacgcaacacgcagatttcaatttcgctatttctcgtttacgctcattaacgataaattcacagtcatctttcttttaagagaagaaagcactaataattaa

SEQ ID NO: 841 - DNA, 798 bp, Xenorhabdus bovienii
  Coding DNA location: Contig name=SeqID_16848; Position on contig =32727..33524bp; Strand=+
atgagccagaccaccacaccaacattatcaggtcaatgcatttcagaatttctgggtactgcattgctcgttttcttcggcttaggctgcgttgccgctgcccgactggcaggcgcacaactggggctatgggaaatcagcatcatctggggcttcggtgttgccctcgctgtttatctgactgccggcatttcaggtgcacacctcaatcccgcagtcaccatcgccttatgcctttttgccagctttgacagaaaaaaagtgctcccttacatcattgcccaaatgctcggcgggtttgccgctgccgctattgtctatatgatgtattacaaccttttccttgattatgagcaagttcacaacattgttcgtggttcacaggaaagcctcttcacggctggtgtattctccacttatcctgcgtcacagctatctgtattacacgcgtttattgtcgaggttatcatcgcagctgtcttactttgcctgattctggcactgacagacgatggcaacggcatcccgcgtggcccaatggctccgctgttaatcggcattttgattgccgttatcggtggttcatttggctctttgaccggatttgctctgaacccagcccgtgattttggccctaaactagtcgcttatttagctggctggggagatattgccctgacaggaggcagagacattccttattgtcttgtgccgttggtagcccccttcattggtgcaattctaggcgcattcggttatcgaaaactgattgcccgccatttaccgcgtgcggtgtaa

SEQ ID NO: 842 - DNA, 1524 bp, Xenorhabdus bovienii
  Coding DNA location: Contig name=SeqID_16848; Position on contig =33594..35117bp; Strand=+
atgacaatagaaaatatcactgagaaaaaatatatcgtcgccctcgatcaagggacaaccagttcacgagctgtcgtactcgatcacgatgccaatattgtctgtatttcacagcgtgaattcccacaaatctaccccaaaccaggctgggtagagcacgatccaatggaaatctgggccagccaaagctcaacattagtcgaagtgctggcaaaagctgatatcagttcagatcaaattgccagcattggaatcaccaaccagcgagaaacaacgattgtttgggaaaaggaaacaggtaggccggtttataacgcgattgtgtggcaatgtcgccgaacagcagacatttgtaccaaactaaaacaaaaagaggggctggaagaatatatccgccacaatactggcttagtcgtcgacccttacttctccggaacaaaaataaaatggattctggataatgtagaaggcatccgccatcgtgctgaaaatggagaactgttattcggtacagtcgatacttggctcgtctggaaaatgactcagggtcgtgtgcatgtgaccgattacaccaatgcttcccgcaccatgctgttcaacatccacaatctcgattgggatcagaaaatccttgatgagctgggtattccccgcatgatgctgccaaaagtgtcatcttcgtcagagatttatggccagaccaatattggtggtaaaggtggcacacgcattcctatcgcgggtattgcgggcgaccagcaggcagccctgtacggccaattgtgtgttcatcccggcatggcaaaaaatacttacgggacaggctgctttctgctgatgaatacaggaacagatgccgtacgttccagtcacggcctgctgaccactattgcctgcgggccacggggtgaagtgaactatgcactggaaggcgctgtcttcgttggcggcgcgtctatccaatggctacgtgatgaattgaaactcatcgccgatgcggcggattccgaatatttcgccactaaagtgaaggacagcaatggtgtttacgttgtgccagcctttactggcctgggcgcaccttactgggacccttacgcccgtggcgctattttcggcctgactcgtggtgcgaacagcaaccatattattcgcgccacgctagaatctatcgcttaccagacccgtgatgtattggatgcaatgcaggctgactccggcacacgcctgcaatccctgcgtgtagatggcggtgctgtcactaacaatttcctgatgcaattccaggccgatattctgggtactcgtgtagaacgccctgacgtacgtgaaagtacagcgttgggtgccgccttcctcgctggcctggccgtcggtttctggaaagatcttgatgaagtgaagagcaaagcgacaatcgaaaaagagttccgtccgggcatcgaaaccactgagcgaaaccacaaatacaatggctggaaaaaagcggttgcccgcgctcaggaatgggaagaccgcgcttaa

SEQ ID NO: 843 - DNA, 1188 bp, Xenorhabdus bovienii
  Coding DNA location: Contig name=SeqID_16848; Position on contig =35210..36397bp; Strand=-
atgagaaaaatagaacactttaatttattagtgatgttgattgctctggctgcggtgggtcagatgacacaaacaatttatgtgcctgttattgcagatatggcgagtgattttggtcagcctgctggcgaagtgcaaagagtcatggcggcatacttgttttcttacgggctttcacagattttttatgggccgttatccgataagattggtcgccgcccagtgattttggccggaatgaccctttttctggtggcaacaacctgcgcattgtttgcctccagtttgttggtgctggtgattgccagtgtatttcaggggctgggaacgggggtggcgggagtcatggtgcgcaccatgccgagggatttatataccgggacgtcgttgcgttatgccaatagcctgctaaatatggccgtgttggttagccctttgctagcaccgatgataggtggcatggttggtcattattttggttggcgtgcctgctattggtttctgctgtcattgggggcaacagtagccttctttttgttccaacacttgccggaaacccgccctgtgcagacaaaacagagcaccatgctggtttctttccagcaattactctccaatagtgcttttgttgcttacctgattatgctagttggtggtctggctggcgtcgcggtttttgaagccagtagcggtgtgttgatgggcgctgtgttgggattggatagcttaacggtcagtatcctgtttattttgccgatccctgccgcatttttgggagcatggtatgcggggcgtgatggcaaaacgttttatcggctgatgtggcattctgtcatgtgctgtttgctggcgggcgtattgatgtggctgcccggctggttcggtattatgaatgtctggacactgctgatccctgcaactttattctttttcggtgccggtatgctgtttccattggctaccactggtgctatggagccatttccttatttggccggagcggcgggggcgctggtgggtggattgcagaatgttggttctggcgtgacgacatggttgtcggcgatgttgccgcaaaatagccagttcagcgtcggtatgttgatgttttccatggcgctgcttattttgtcttgttggttgcctatttcccagcgagttcagcgccaagagcatacggcctcataa

SEQ ID NO: 844 - DNA, 162 bp, Xenorhabdus bovienii
  Coding DNA location: Contig name=SeqID_16848; Position on contig =36553..36714bp; Strand=-
gtgattgtcgggaatagacttatcgattacgtgttacagtttgattgtctttatttatgccaatactttggttttatatgtacacttttattgacatacatggataatatcactgttattttttcttcatgtgaaattgtatcctgtctggaaaaaatataa

SEQ ID NO: 845 - DNA, 747 bp, Xenorhabdus bovienii
  Coding DNA location: Contig name=SeqID_16848; Position on contig =36775..37521bp; Strand=+
atggcaaactgggttacaggaaaagttaccgacataaccaattggacagattcactattcagcatcaaagttcatgcaccgattgaaagatttaccgctggccaattcgcaaaattggctctcgaaattgaaggcgagcgtatccaacgcgcttattctttcgtcaattcccccgacgacaatagtctggaattttatttagtcaccgttcctgaagggaaactcagccctcggctcgcagcattaaagaatggggaggaactcctcgtcacagaacaggcggcaggtttttttgtccttgatgaaatccccgattgccaaaccctgtggatgctctcaaccggtacagccattggcccttacctttccattctccagcaagggaataatctggaacggtttgaaaatattgttttggttcacgccgtgagactggaacaagatttgagttatttgccgatgatgcaacaactagagaaaaagtttcaaggcaaattaagaatccagaccattgtcagccgtgaaaaatgcccaaattcactcatggggagaattccggcattaattgaaaatggcgagctggaagctgccgttggtttaccgatgcaggcagaaaatagtcacattatgctgtgtgggaatccccaaatggccaaggacacccaacagcttctgaaagaacaacgcaatatggcaaaacacctgcgccgtaaaccagggcatatcaccagcgaacaatattggtaa

SEQ ID NO: 846 - DNA, 447 bp, Xenorhabdus bovienii
  Coding DNA location: Contig name=SeqID_16848; Position on contig =37545..37991bp; Strand=-
atgacattacaacaatggggattttcattcaaaggccgaattgggcgacgggaattctggatcggcattggcatctgcttcgccctgatatttatgcttttgaccttgcatggcatgaatgccttccccatgcattatgccgcagtgggtatcgccttgatcctgtacccgacagcagcgattatagcgaaacgtctgcatgaccggaataaacatggtggctgggtgctactgctggctttagcttgggtattgcttttcctcgattggagcgcaatggcagctatctggcaatgggggattggtcgtttcattccaacgttgattttcgttatgattgtgttggattgcggtgtatttcgtagcatggacgggccaaaccgttttggtgagatggcagaaacggttgagtatatttctgccagtgaacctgctccaaaacgctga

SEQ ID NO: 847 - DNA, 795 bp, Xenorhabdus bovienii
  Coding DNA location: Contig name=SeqID_16848; Position on contig =37876..38670bp; Strand=+
atgccatgcaaggtcaaaagcataaatatcagggcgaagcagatgccaatgccgatccagaattcccgtcgcccaattcggcctttgaatgaaaatccccattgttgtaatgtcatgtattcttttccaattgtggatgctgtttttccggtatttacactcagcgagtacaacatgaaaacaggcatgaataaacttctggtgacaatattaatcgcttttggtatcagtttgccattatcgacctttgcaggtgaaccttctatcacaccggacacacgctcacaactgatgtatttacttcctgattcccctacttttgaggaaaccattccggtatttcgggaaaaatacaacaaaaaataccctgaaatccccctgcatgaatataaagtcattgtcagtaaagatatctccctgcctttcattcgtgctgccagcaaaattaacgaaaaaatttattcttcggcagtactggaacggggcagcgaaaaaattaaaagtttgcaaattaccctgctgccaccacaaagtgaaccggagaaagaacacaatctcgcactgataaaacagtatattactgccctgatcagtcaattcgagccctcgctttccccagatcaagccaaccaacaattagaaaaatttttacaggctgcgcaaagccaccgattcttcagccaaaaaatcggtgcgatacgttatgtcatcgtaaacagcagcgaaaatataatgaccttcgcaattgaaccgattaagctatcgttatctgacgcacccgcgagcaaaaattag

SEQ ID NO: 848 - DNA, 768 bp, Xenorhabdus bovienii
  Coding DNA location: Contig name=SeqID_16848; Position on contig =38810..39577bp; Strand=+
atgcgacatccattagttatggggaactggaaattaaatggcagtacccacatggttaacgacctgattgcaggcctgcgtaaagaactgagcaatgttgacggctgtggcgtcgctatcgcaccaccaacagtttatgtttctctggcaaaaaatgcactggctggcagccgtatcgctctaggtgcacaagatgttgacgttaacctttctggtgcgttcaccggcgaaacatccgctgaaatgctgaaagatgtgggcgcgaaatatatcattatcggtcactccgagcgccggacttactataaagaaagcgatgagctgattgcgaaaaaattcaccattctgaaagaacaaggactgattcccgttctatgcattggtgaaaccgaacaggaaaatgaagcaggccaaaccgaagccgtatgcgcacgccaaatcgatgccgttctgaacacgctaggtgttgaagccttcaaggataccgttatcgcatacgagcccgtctgggcaattggtacgggtaaatcagcgactccggcacaagcacaggctgttcataaatttatccgtgatcatatcgcgaagcaagatgctgctatcgctgaacaggtcatcattcaatacggcggctccgtcaatgccagcaacgcggcagaactgttcacccagccagatatcgatggtgctctggttggtggtgcatccctgaaagccgatgctttcgccgttatcgtgaaagccgctgctgaagcaaaaaaggcataa

SEQ ID NO: 849 - DNA, 1014 bp, Xenorhabdus bovienii
  Coding DNA location: Contig name=SeqID_16848; Position on contig =39671..40684bp; Strand=-
atggtcacgagatgggcagcaagaaggtatgccgtgttgacggcattattgatggtcttggcaggaggtagtgcatgggcaaaagaggtgcaactcttgaatgtttcctacgatcctacccgcgaattgtatcagcagtatgatcaggcattcagtcagtattggcagcaaaaaaccggagatcacgtaacagtccgccagtcacacgggggttcgggtaagcaggcaacgtctgtcatcaatggccttcaggcggatgtggtgacattggcgctggcatatgatgtgaatgcaattgcagagcgtggtcgcattgccaagaattggattgatcgcctgccggagaattccgcgccttatacttcaaccattgtttttctggtacgtaagggcaatcccaaacatatcaaggattggtcagatttggttcgtcccggtgtttctgttgtgacaccgaatccaaaaacgtccggtggcgcacgttggaattatctggcggcttggggatatgggctggcacagaataatcaggatcaaggcaagactaaagcctttgttaaggcgctttataagaatgtcgaagtgttggattctggcgcgcgtggtgcaaccaatacctttgtggaacgcggaattggggatgtgttgatcgcatgggaaaacgaagcgttattggctacccatgcactggctcaggataagtttgagattgttacaccgagtctttccattctggcagagccaaccgttgccgttgtcgataaggtggttgataaacggggaacccgtgagctggcaacggaatacttgaaatacctgtattcgcctgtcggacaggaaattgcggcaaagaattattatcgtccccgtgataaagccattgcagaaaaacatcacgctgtttttcccgtactgaaattgttcacgattgatgaagtatttggtggctgggataaggcccaggaggcgcattttgccacgggtggcattttcgatgaaattatccggcgttaa

SEQ ID NO: 850 - DNA, 153 bp, Xenorhabdus bovienii
  Coding DNA location: Contig name=SeqID_16848; Position on contig =40772..40924bp; Strand=-
atgcggtgcaaaatatgcagcgtgtttttaagaaagactggctggaaacggcgaagcagctttactaaacctttctcgcctgcaacatactttttcaagggcagccatattttatggctgcccttttctgcactatattccacttatgcataa

SEQ ID NO: 851 - DNA, 978 bp, Xenorhabdus bovienii
  Coding DNA location: Contig name=SeqID_16848; Position on contig =40857..41834bp; Strand=-
atgatcaacaagattaaaagaatcggagtcttaacgagtggcggtgatgcgcctggcatgaacgccgctattcgtggtgttgttcgtgtcgctttaaccgaagggttggaggtttacggcatttatgatggctatctggggttgtatgaaaaccgcatgaagaagctcgaccgtttcagtgtttctgacatgattaaccgtggtgggacgtttctgggatcggcgcgttttcctgaattcagggatgataaagtccgtgaaattgccattgaaaatatgcgtaaaaatgacattgatgcgctggtggtgattggaggagacggttcttatttaggggcgaaaaagctgactgaagcgggttttccttgtattggtctgcccggcacgattgacaatgatgtggcaggaacggattacactatcggttattttacggcgttggaaacagttgtagaggcaattgaccgtctgcgcgatacctcgacatcccacaagcgtatttcgattgtagaagtgatggggcgctattgcggtgatttgacgttgtctgcggcaattgcgggtgggtgcgaattcattgttttgcctgagaatgaaatcccgttcgatcgtgaagaattgctggcggaaatcaaggcgggtatccaaaaaggtaagcgccacgccatcgttgccattactgagcatgtctgcaatgtggatgaactggcgaaatacattgaagcagaaacacgtcatgaaacccgtgcaacagtactggggcatattcaacgtggcggtgcgccagtggcgtatgaccgcattctggcttctcgcatgggggcttattctgtccagttgctgctggaaggttttggtggccgttgtgtgggtatccagaacgagaaacttgttcatcacgacattattgatgcggtgcaaaatatgcagcgtgtttttaagaaagactggctggaaacggcgaagcagctttactaa

SEQ ID NO: 852 - DNA, 297 bp, Xenorhabdus bovienii
  Coding DNA location: Contig name=SeqID_16848; Position on contig =41886..42182bp; Strand=-
atgatcaacaagattaaaagaatcggagtcttaacgagtggcggtgatgcgcctggcatgaacgccgctattcgtggtgttgttcgtgtcgctttaaccgaagggttggaggtttacggcatttatgatggctatctggggttgtatgaaaaccgcatgaagaagctcgaccgtttcagtgtttctgacatgattaaccgtggtgggacgtttctgggatcggcgcgttttcctgaattcagggatgataaagtccgtgaaattgccattgaaaatatgcgtaaattttcccgttag

SEQ ID NO: 853 - DNA, 138 bp, Xenorhabdus bovienii
  Coding DNA location: Contig name=SeqID_16848; Position on contig =42309..42446bp; Strand=+
atgatacggaaaaacacccagtctgcattaagattatgtttattttctgacgctcttttgattatgaataaattccccgttaatcccaacggtttttatgcttctctggcacaacggagcaaggatcttggtgaataa

SEQ ID NO: 854 - DNA, 900 bp, Xenorhabdus bovienii
  Coding DNA location: Contig name=SeqID_16848; Position on contig =42388..43287bp; Strand=-
atgagtataaattatgggcgatgggtcagtgctgctgcactgtcggcaacgatactggccagtgtgttgctggtcgtgaaaattgttgcttggtggttgacgggatcggtaagtttattggcggcactggtggattctttagtcgatctggccgcttctttgactaattttttcgctgtgcgctattcgctccagcctgccgataaagagcacaccttcgggcatggtaaggcggaatcgctggcggcgcttgcccaaagtatgtttatttccggatcggccattttcctgtttttaacgggttttcagcatttggtctcctccagtccattggagcatgcgacgataggtatctgggtgatcgtcatcgccctgatttcaacgatttgcttggtgacgttccagaaatgggtgatcaataaaactcaaagtcaggctattcgcgcggatatgttgcattacaagtccgatctgttgatgaatggggcgattcttctggcattggtctttagtatgtatggtttccggcgtgcggatgccctgtttgccttgggaatcggggcttatatcctctacagtgcgttacggatggggtacgatgccgtacaatctttacttgatcgcgctttgcccgatgaagagcggcaagagattattgagatgatcaagcgctatcccggaatagcgggtgggcatgatttgcgaacacgtcaatcaggtccaacgcgttttattcagttccatctggagatagatgatcatctgccgctggtggaagcgcatgctttggccgaggggattgaaaataaattgcgggatagatttccgggtgccgatattattattcaccaagatccttgctccgttgtgccagagaagcataaaaaccgttgggattaa

SEQ ID NO: 855 - DNA, 945 bp, Xenorhabdus bovienii
  Coding DNA location: Contig name=SeqID_16848; Position on contig =43315..44259bp; Strand=-
atgaccaagattgataatgacctgatgcttttgctgggcgggatatttggggtattgattatcgccagtgcgattggcggcatattgtcgctttggtattcgggggcaaagcgcagtgcgactatcgataacctgaatgctaggatccgtggctggtggatgatgtgtatcatctgtgtgctggctgttatcgttgggtctgtggggtcggtgatcctgtttacggtgatgtcattttttgccctgcgtgaattcatcacattgacaccgactcgccgcggtgatcatgaggctcttttctggtgtttctttgtctttatgccgatccagtatgtcttggttgggatgcaatggtacggcttattctcggtttttattccggtttacgtttttctgtttttgcctgttcgtattgcattggttggggataccacccgctttctggaacgaaccgccaaaatccaatcggcaatgctgatcacggtgtttgccctgagccatgctccggccttgttgatgttgcatattcccggttatgaggagcagaatatcaagctattgttgttcctgatgatcgtcgtgcagatgtccgatattttgcagtatgtattcggcaaattattcggtaagcgtccaattgtgccgaaattaagccccaataaaacggttgaagggtttattggcgggattttggcctcttcgctgctagggatgtcactgtattgggtgacgccattttcaccgtgggaagcggggctgatgtcattggctatcacgttgatgggctttattggtgggttgtgtatgtcagcaatcaaacgtgacagtggagtgaaagactttggcggaattattgaggggcatggcggtatgttggatagaattgattcgctttgttttgctgcccctatatttttccatctgacacgctatttttatacttga

SEQ ID NO: 856 - DNA, 642 bp, Xenorhabdus bovienii
  Coding DNA location: Contig name=SeqID_16848; Position on contig =44256..44897bp; Strand=-
atggctaactctcataaaataagcctattagcaagatgcatgggcgcgacgttattgggcctgtgccgtgtcttgaccggtgtacaagtacgatggattggctgtcagccatcgacctcaagccgcatttattatgcaaatcataccagccatcttgatggattggtgatctggtctgggcttccgcccaaattgcgttatcagattcaccctgtagctgcacgggattattgggataaaaccaggctgcgtcgctatcttatgtataaggtatttcgtgcagtcttgatcgagcgtaaaggcgaacatacctcaaaatcgggggttcttgcacctttggaagctattctggcgaaaaaagagtcgttgattttctttccagaaggtacacggggagatggtgaacaactcaatccgtttaagggaggcttgtatcatctggcccgtcagtaccctgatgctgaaatgatccctgtctatctggaaaattcaaatcgtgtcctgccgaaaggaaaaagattattggtgccgattatttgttcggcaacatttggtaagcctctggataaattgggtgaaaatgaaagtaaagtcgccttcttgcaacgtgcccagtctgcactggaggagttgatgcgatga

SEQ ID NO: 857 - DNA, 159 bp, Xenorhabdus bovienii
  Coding DNA location: Contig name=SeqID_16848; Position on contig =45136..45294bp; Strand=-
atgtccatgaacttgccagaacctcatttttatctgtattggttgatcgcgcagaagatttccaaaataactgaacccctattaatgccgtctattgagctatttttcagccccaaaatgtcaagagaaccgctcatggccgcatttttggtaggctag

SEQ ID NO: 858 - DNA, 135 bp, Xenorhabdus bovienii
  Coding DNA location: Contig name=SeqID_16848; Position on contig =45333..45467bp; Strand=-
atgcatctctatgcgcctcttttgttttcaaaatacatatcaaattacctgatgaggaatcgtggccagctaagatgcccgttgttgcacgtaagagtaatagctatctcgcgtgtatacccgtcattagtgtga

SEQ ID NO: 859 - DNA, 291 bp, Xenorhabdus bovienii
  Coding DNA location: Contig name=SeqID_16848; Position on contig =45579..45869bp; Strand=-
atgcgtgatgatttagatctctacattgaagaaagaacaaaagaaaacccccgatttaaggccgcgttagcggaagaagaaaaagagcttgagttagcgattgaaatgcagaatatactggctgaatggcggaaaaatgccgggctgaccagcgctcaggtcgctgaaaaaatggggatcaaaccaccgactgtatcaaaaatagaaagaaatatcgttaaggcatccatcgatacactcagtcgttatgcgcgcgcctgtggtgttaacgatatcaatatatccttataa

SEQ ID NO: 860 - DNA, 264 bp, Xenorhabdus bovienii
  Coding DNA location: Contig name=SeqID_16848; Position on contig =45881..46144bp; Strand=-
atggtcgcgttaattaagcgattaagagaaaacccgaccagcctgagagagccgcattcaaaaccgatagagggatacaaaggactgtttgagctgagaacaaaagccaaagatggaatagccagaagttttttttgttatgccgcagggaagaaaatctatctgttacgatgctttgtgaaaaaaaccaataccactccccttaatgaactcaggatagcgattgcgcgaagaaatgaactgacagaaccatcaagagattaa

SEQ ID NO: 861 - DNA, 258 bp, Xenorhabdus bovienii
  Coding DNA location: Contig name=SeqID_16848; Position on contig =46143..46400bp; Strand=+
atgcgcagttccagcgagtcgggcagtttcttcctgcatacagtaaaacccgacttacctaaaggacaggcaacccatgtcctaaggcatactttcgctagtcatttcatgatgaacggaggaaaaataattgcattacagcagatacttggtcacgccagcataacccaaacaatggcctatgctcaccttgccccagactatctacaatatgcaattacattaaatcaccttaagtgtggaattaaagtagcgtaa

SEQ ID NO: 862 - DNA, 150 bp, Xenorhabdus bovienii
  Coding DNA location: Contig name=SeqID_16848; Position on contig =46504..46653bp; Strand=+
gtgcactgtaagtgcttgaaaaaaaagccccacaagggggctgaaagacagggatggtgtctatggcaaggaaaactgttgttgatgcaactttacgtcaagggtattaatagaaatcagttcatttctcgatcaacacgcacttcataa

SEQ ID NO: 863 - DNA, 498 bp, Xenorhabdus bovienii
  Coding DNA location: Contig name=SeqID_16848; Position on contig =46620..47117bp; Strand=-
atgcgtaacatagcaatcttggctttagcgtcaatgtttgttcttagggcaaccgatgctttagctgaaactgctggtactgataatgttactgcggatgacttctcacaatattgtatgccatatggtaataagaataccgttagttattgcctgaatgatgaacgtaactataactatagttgtatcttcgctggagtcactttaacagagcagcaacgccagcagatatgggatttagtgaaaaagcaacgtctgcatgagaaacccgtggcagatattagagcggaacgtcggaagatgtatagccttttgaattcaacgaattttgatgaggctgcggttaggttgcagcttgaaaaaatagcgaaagaaaatgttgatttgagtatagagatcgcacgtattcgcaatcagatttatcaattgttgacagcagagcagaaagtacaactccagaaacgttatgaagtgcgtgttgatcgagaaatgaactga

SEQ ID NO: 864 - DNA, 159 bp, Xenorhabdus bovienii
  Coding DNA location: Contig name=SeqID_16848; Position on contig =47157..47315bp; Strand=-
atgtcagttcacggtcatcatcaactaataagattttatgcatgttttcttcctccgagagcaaaatacgataacaaactttgctattccataactttacgttcttttacatgctctgacgctagtttgcagcagcagggttatagtgatccgcactga

SEQ ID NO: 865 - DNA, 693 bp, Xenorhabdus bovienii
  Coding DNA location: Contig name=SeqID_16848; Position on contig =47273..47965bp; Strand=+
atgcataaaatcttattagttgatgatgaccgtgaactgacatcgctattaaaagaactgctcgagatggaaggattcactgttgtgctcgctcatgatggcgaacaggcattacaatatatcgattcttcaatcgatctgctactactggatatcatgatgccacgtaaaaacggcattgagacgctaaaagagctacggcaagaccatcagacccccgttattatgttaacggcgcgtggaagcgatttagaccgtgttctagggttagaactgggtgccgatgattatctccctaagccgttcaatgatcgtgaactggtggctcgtatacgcgcgatcctgcgccgttccaactggagcgaacaacaggctgatagtgggacacctgtactcgaggtcgataaactacaactcaaccctgggcggcaggaagccagctttgacggtgcgattttggatcttaccggaacagaattcaccctgctttatttattagcgcaacatttgggacaagtcgtttcccgcgaacatttgagccaggaagtcttgggaaaacggttaactccctttgacagagccattgatatgcatatttccaacctgcgccgtaaattgccgaaccggactgacgagttaccctggtttaagacactgcgcggtcgtggatacttaatggtctctgcaaaatga

SEQ ID NO: 866 - DNA, 1371 bp, Xenorhabdus bovienii
  Coding DNA location: Contig name=SeqID_16848; Position on contig =47962..49332bp; Strand=+
atgatcaatagtttgacagcccgtatttttgcgattttctggcttacactggcgctcgtcctgatggtggccttaatggcaccgaaactggattcacggcaattgacaccgctgctggacagtgaatatcaacagggcactatactcgcgaaacagatagaaaaagagttaacccgctaccctgccaatgaactgttttggtggctacggttggatcgcgcaattgcaaaatggacgccaccggggcaacttttactgctcgttaccagtgaagggcgtatcgttgatatccagaccagtgaaaagcaggttgtccgtaacttcattggtcaatccaataatgcagatcatcccaagaagaaaaaatatggtcgctctgaaatactcgggcctttttctatccgcgatggtgaagatcactaccagctttaccttattaggcccgcaggtagcccccagtctgactttattaacttaatgtttgaccgaccccttttattacctgcagcaaccatgttaattagtgcgccattgctattatggctggcatggagtttagccaaacctgctcgtaaattaaaaaatgcggcagatcaggttgcgaaaggcaatttacggccacaccctgaactggaatcaggtccacaagaatttttagccgctggcagcagcttcaaccagatgatcaacgcgctggacagaatggtgacagcccaacaacggctgatttctgatatttctcatgaactgcgcacaccactgactcgcctgcaattggctagcgccctgctgcgccgacgtcatggtgagagcaaagagctgcaacgtattgaaacagaaactcaacgattagatgagatgatcaatgatcttctggtactttcccgcaatcagcataagaatgaactgctgcgtgaaaatatcaaagccaacgatatatggcacgatatcctagagaatgctaaattcgaagtcgagcagatgaacaaaacgctggatatcgtctcccctcccggttcttgggttatctactgtaatccggcagtacttggcagtgcattggaaaacatcgtccgtaatgcccttcgttattctagcagtcatatcgccgttgcgtttaaggcggataaccatggagtgacaattacggttgacgatgatggcccaggtgtcagccctgaagaccgtgaacaaatcttccgcccgttttatcgaacagatgaagcgagagatagagaatcgggtggaacaggattggggctggcgattgttgaaacggctgttagtcagcaccgaggatgggtgaaagcagaagatagccctttaggtgggttacggctgataatttggttgccgttgcatgtaagatga

SEQ ID NO: 867 - DNA, 96 bp, Xenorhabdus bovienii
  Coding DNA location: Contig name=SeqID_16848; Position on contig =49405..49500bp; Strand=-
atggatttgatattgttatgtttttttaataaaaaaaaccataagcacaaaccatttgtgttaagcagcgacgaggttagaccttcgctgctttga

SEQ ID NO: 868 - DNA, 96 bp, Xenorhabdus bovienii
  Coding DNA location: Contig name=SeqID_16848; Position on contig =49491..49586bp; Strand=-
ttgaaatatatattgggatgtttaattaaagctaccgcactaggttatggctcccagaatgcctgccctaccttaggggattatgtatggatttga

SEQ ID NO: 869 - DNA, 276 bp, Xenorhabdus bovienii
  Coding DNA location: Contig name=SeqID_16848; Position on contig =49988..50263bp; Strand=+
atgttaaaagcagtaaacaagaaagctattcatataatcaatgtattctcagcctgcaataatgtgatttcagtcaagattaaagcagatgataacaccaatgaaattaaaacaatactcggagtattatatttactagcaataacaaactgtttaaacacgatatatacaataggccacctaaaaaattactccaatgcagaatgtcaaaaccgtagtaaaaaaagatacggtttcacgccaagctatcagttacttatccgatttacccaatag

SEQ ID NO: 870 - DNA, 468 bp, Xenorhabdus bovienii
  Coding DNA location: Contig name=SeqID_16848; Position on contig =50713..51180bp; Strand=+
atgaaaactgtaataacatacggaacgtttgatttgtttcatgttggacatgttcgtttactgaaaagactaagaaatttaggtgatagacttatcgttggcatatcaagtgatgagtttaatagtataaaaggaaagaaatcatttttttcttttgaagaaagagctgagattgtaaaagcatgccgccatgtcgatgatgtctttgccgaaaatacgtggaagcagaaaagagaagacattattaaatataaggcttcaattattggtatggggagtgattgggttagtaagttcgatgatttaaatgatatctgtgaggtgatttatcttgatagaacagaaaatatatcatcaacaggtataaaaagtgcattagcaaaagtgacaccgaatgaaatttctcaaatggaaacacagataagcactatgttggaaatagttaaagtactatccgcaaataaataa

SEQ ID NO: 871 - DNA, 1107 bp, Xenorhabdus bovienii
  Coding DNA location: Contig name=SeqID_16848; Position on contig =51194..52300bp; Strand=+
atgaaaaaatttataatagcacttttgaaaaaaatcacatatttaataccaaagaaaaacaatagagtatgctttaaaagttttcctgattatagtggtaatgctatagcagtgtatgaatacatgaaaaaaaacactgattatgaacttatatggttaattgataatgaaattaagcctaaaattggagcaaaaaaatcaaagtcaattagcggattatggacatttttccgtgccaaatatattataactactcacaatgattttgtgtccatttcaccatcaaaccaaatctatataagtttatggcatggaatgcctttaaaaaaaataggctatactggcaatgaacatataggaatgaagtctatttcagcattgagaataagtacatctgagttgactcgtagcctaatatctgccagtttcaatgaaccagcaaataacgtttttataaccggacaacctgtttgcgataagcttttctcacaaaaaaagataagtgatttttttgatgtaccgaatgatgttagaaaagttatattttaccttccaaccttcaggcaggattttaatgaaaaaaaaatagaaggacgaaaagtcagctcacataatatttttaggtttgacaaatataaccatcacgagtttataaaatatttagaatatgaaaaaatattgcttattgttaaactgcaccccgcagaagaatgctatttaaatgaaattgaggaaaacgggtactttaaatttattaaatctaaagatattgatttatatgatgtgctggcagtagcagatagtctgattacagattattcatcagtttatatagactaccttattttagatcgcccactagcatttgtagttcctgataaggagcaatatatacaaagtcgaaacggttttactcttgaaccatatgacgactggacaccagggaacaaaatcatatccgtatctgatttgtttaattttattgatatgctatcttctggacaagataattataaaaatgatagacaaagagtaaaaagaattatgcatagatatgatgacgatcaaaattccaaaagagtttttgatatgctaatcaagagataa

SEQ ID NO: 872 - DNA, 1128 bp, Xenorhabdus bovienii
  Coding DNA location: Contig name=SeqID_16848; Position on contig =52309..53436bp; Strand=+
atgatatatatcttattaccatttatattatttttttttgttttcttggaacagattaagatttcaaagaaaaattcctttatattatgtttttttgtagtatgcatagaaattcttttctttggatctagatacaaagttggagtagactggcaaaattatgtaaactactttaaaacattagatgaatcgtatcgatttgagattggttattatttaataaatgtaatatttaagtttattggtcttaattattgggctatttcattttttgcatcttttattttttccatcacactgtttgccacaatctggaaaaaggttcctttccctattctttttttagcattgtattttatgataaatatgcttaaccagatagaggcagtaagaagcctaattgcatactctattattttatattcattgcaacaggttattttagggcgttacttaaaagcattaatattttcatgtttttcaattctctttcaccaaacaatgattgtctttattccatgtatttttttatataataagaaaatatcaaatggctattttttcacattactcttcattggtctatttctatatgcaatcaatatatcaccaatcaatgctcttcttacagaactatcaaattattttttcaaagatagattacaacattatttattaatacaaactgatgggaagtatgaaagtgtcctttccgtaactttaataataaaaattataatattttcagcaattactttattcaagaaaaaattagataaaaaatatattaaaaacccatcatttaatgtgttttataatattggagctgggtacatactgatatatgtatatatgctaaatgaacctgcaattatttataggctttccgatttatttgtgattgggtttatcgcaacaatttgcttcttcattaactttttaaatgaattaaataaaaaaattgttatacttggaatattagtcatttcgctcctcatttataatagcccatttagtgataaatattatcaaaactatattattaactatacttctttcctatcattaattttctccaatgaaaaagaatcatataatgtaaatagttactggaataatcctaaatga

SEQ ID NO: 873 - DNA, 1137 bp, Xenorhabdus bovienii
  Coding DNA location: Contig name=SeqID_16848; Position on contig =53433..54569bp; Strand=+
atgaaaaacacaaaaataacattcgttgttggtgacattagcgccaaaggtggaactgaacgagttacatgttcgataataaatgctttaaataaagttgttcccgtagagttaatttcgcttgaaaaaacaggtgagccttttttttccatcagcaattctgtaaaactaaagtatataaatgaagatccttcgtcatcaacactatatggtaaaaaagttttttttcttaaaagatttttcttagatgctctttacattgcaaagactttacctaaaatacgaaattatttgattcaagtagaatcaagccacgttgtatccacagatacaaaaatggcacttttgctcaaattagcaacatttgcaacaaagactaaagttattgctatggagcattttggttactatgtacctcataaaatgatcagaggtataagatctatattatatagatatgtacacgcagtcgttattttaacgaatgaagacaaacaatgttatttaaaattcaataagaatttacatataattccaaacatagttgcatttcaatccattgaaaatcctaatttagactctagaagaattattgctgtcggcagacttacttaccaaaaaggctttgatattctaattaaagcttgggaaagtgttgaatctcaaacatcagaatggaggctcgatatatttggagaaggtgaggattatgataaattaacctcactaatcgaggaaaaagaactaacacagataagtataagaaatttctcaagcgatattgaaaaagaatatttgcagtccagttttttagtaatgtcatcccgatatgaaggactaggaatggtattaatagaagcaatggcttgtggaataccttgtattagctttaattgtcctacagggcctagtactattattcaaaatggtattaacggatatcttgtaccagagcagcaagaaaaagcactttcagaaaaaatattatatttgatacaaaatgagagtgaaattaagataatttcaaaaaatacaaaaaaaagcattactccattcacagaaaatgttgttgttgataaatggttatcattgttgtatggtgagacgatagatgcaaataaaaactttgaaaaataa

SEQ ID NO: 874 - DNA, 1311 bp, Xenorhabdus bovienii
  Coding DNA location: Contig name=SeqID_16848; Position on contig =54544..55854bp; Strand=+
atgcaaataaaaactttgaaaaataaagggattcttgatttaacatattatgtgttaggagacctctttataaaagggatgatgtttattacattaccattattaactatatttttgactccggctgaatatggtacattgtctatacttacaacaatgataacattttttgctgttcttttcagtgtgaatattgaaaattcagtaaataattactatatgagaaacggtgaagattttggcggttttttatattctaatataatttttattattttctttcaattgattgttttttcagttttttacctgctttcatcagaaatttcagattttttcaaagtaaaaaaaatagactcaattttagtaggaataatttgcactgttattttctactataatctatatatgctttatttgcagggggctaaaaaaagcagggatttttctctaataaatgtattcaataaattattggaaatagggctgttacttttattggcttgggaaataacaaataacaaatatcttagtaagatatatgcacaactagtcgcaatttcaatatttttaccatatatattattcaaattaaaaaacttgtgttcgtttaattttaagttctcatatgtcaagtattcattggccttctcaatccctctaataccacatgtattgtcaaacactattttaagtcaaagtgatcgagttatgattaacttgatgataggagaaaaagagactggtctatattcattcgcttataatctaggcttgtcaatggcagttgtaatatcagcatggaatagcatgtggcaacctagattttatgaattatataataaaaaagattttgatgaaataaatgggcttatatctttttatagcaaaataatctcagcgataggtgtgctgacgatattaataacgggtcctattgtgaaaatatttgtctcgcctgattactatggttcattaaagataataccgattatcattgcatcaaatgcattattctttcagtattatctatatgtaaattatactttttaccatagaaaaagtttaattatttccagtagtacgttagttgcggcattagttaatttatctttaaattactttcttatccccaaatggggagtcgagggagctgcttatgctacattaatcgcgtatttcatattagctattattcattatttaaatgcgaagaaggtttctacagataaagtaataagtctatctctggcttttaagtggagtattcctatttactttactgcgataattgtggcctggatgtcttaa

SEQ ID NO: 875 - DNA, 1086 bp, Xenorhabdus bovienii
  Coding DNA location: Contig name=SeqID_16848; Position on contig =55856..56941bp; Strand=+
atgcaatacattcttttttatggtgaacttcccccaagcgtaataaatggcgtctcactttcaaacgaaaaaaacattgaaatcttaaacgatttttacaaaattataaaagtcgaggaaaaacctgtttcttctaaataccggtggtttagtaagattattaatattttttatgattttttaagcgttagaaaaaaatgccgaaaatataaatttgattttatttatgtatcgttaccgacttctattttaggtgcatttaagattctaaccataacaacgttatcaacttttctcttacaaaaaaataggatagtcctacacctgcatagaggagacttcgataaaatatataaaaattcattcttctatagattaattttaaatatattaatcaagaaaacttatagaatagtatcattatcagaacaacaccgaagacaattgttaaatttttttcctgataaaaaaatctctgttgtcactaatacaataagagaagaatttttcataaaaaaattaactttagataaaattcgttttttatatttatctaattatcttggagctaaaggtatttttcatcttttgagagcattcactcaactaaaaaaagaaaatatcaattctaatgttgaattatgctgttatggcgcattcttagatccatctataaaagaagaaattttatcatataacggaactaatggtatttcaattcatgagactttggatgggttagataaaatcaatgtattagagcaaattgatgcattgattctaccttcttttaatgaaggtcagcctttatccatcattgaagcaatgtattacgagtgtgctgtcatcactacagatgttggttttatcaaagaaatgttacctatacattatccgctattattagactctcctgacgaaaaaatattaaagactgcaatgaataaatttatttctatgaataacaatgaaaaggaaaaattagtctgtgaacttaaaaataattatgataaaaatttttccaattcaatacataaaactttagtaaaaaaggtgtttaactgtgaaaataatttttgtaaataa

SEQ ID NO: 876 - DNA, 1110 bp, Xenorhabdus bovienii
  Coding DNA location: Contig name=SeqID_16848; Position on contig =56919..58028bp; Strand=+
gtgaaaataatttttgtaaataatagtttagtaccgtacagacatcatttttttaattatttattttctaaaaataataatgaaataaacgattcaatcgtattatatcttactgaaaaagagtccattcgtaaatggaatgaaaatgaaaatgaaaatgaaaatgaaaatgaaaaatataaatatttttttcttaaaaggatatttcaagcaaggaataaaaaaacaacaacctcagactacattattaatcactcatatttgaaatttttaaaaaatattgatgtagttttcactttaggatatagctattctacatatataattatgtgcctgtatgctaaaataaaagggataaaaaccgtttgtttttgtgaaacaaatgaatcagataaatcccgtaataaaataaaagggaaactaaaaaaaatacttcttaactttttatatgatcattttactgttccaggagaaaatgcgaaaacgtatctacttaacctcggcatccccgaaaaaaaaataacaattatcggaaattccgctccatttggaaaatttaatttgaaacaaaatagccatcaggataaaaaatataatagaataagaatcctatacgttggaagattttctgcagaaaaaaatattatttttgctttaaaaaatttagagaaagtaaatgaaaaaataaagataacattagttggaaatggagagcttgaaaatgatattaatcatttagctactaagtctaaacatgaatactctattcttcctttttgcgatagggaagaattaccaacactgtataacgcaaatgacatacttttattaccatccctgagtgaaacatggggattggttgtaaatgaagccttagaatttggtttggcaatattggcttcaaatcatgttggttgtgctccagaactagtaaaaaacaatggagagatattttctgttcgttcagaaaatgattttttagataaagcaaaaagaataattgatgacattagtaattataaaaaaaactctagaatcatttacgaacacaataatgttttaacaaactcggagaaaatgatgaaatgtttgagaaacataacaaaataa

SEQ ID NO: 877 - DNA, 936 bp, Xenorhabdus bovienii
  Coding DNA location: Contig name=SeqID_16848; Position on contig =58004..58939bp; Strand=+
atgtttgagaaacataacaaaataataaggaagctattctatatagaagaatggaatacaggaataattaaaagaaaaaaatctgatataaagaacatctccgattatatattacatgaagatatctcctggttgaaaaaatacaatacatttcaggcagacccttttattttagaacgcaatgggttaatatatattttttacgaatcattaagcctgataaattctaaaggtgatatcaaatgccgagttttagataatcactttaaagaattagatgatatattgttgataggactaaacaacactaaatgtcatttgtcttatcctttttattttgagcatgaaaataaattatttttaataccagagacttctgaattaagtgaagtttctctattcgagtgtgtacattttcctaacgagtggaaaaaaatacatactcttgtttctggggtaaagttaactgatagttcaatcatacgttcaaataaagaatactacttattatcaactgacttagataataatttaattatccatatgaatacaaacctttttggtgattggaaacggatttttccaaaattaaaattatgtaatcaacattctaggggggcgggagccccattctattcccaagatagcgtgttttttttcactcaagaatgttttgaatataactatggcaatgcaatctttatgaaaaaaattacagcaatagggaggaatgaattttcagaagaattgataagtaaaattgaacctctaaaaggaagttataacgaggggattcatactattaatttttcggataattatatagtaatagattctaagaaattgaagtttaatttgttttcattttttattaaacttatttataaaataaaagttaaattacgacaatcctattgcattggggagagatcatga

SEQ ID NO: 878 - DNA, 1104 bp, Xenorhabdus bovienii
  Coding DNA location: Contig name=SeqID_16848; Position on contig =58936..60039bp; Strand=+
atgaaaattgcattaattacaggaattaccggtcaagatggttcttatcttgcagaattacttttagaaaaaggatatactgttcacggtctcatcaggcgttcatcatctttcaatacaactcgtattgattctttctgcaagaatgagaaattaaaattgcattatggtgatctaactgatagttcgaatattataagattaataaaacatatcgaacctgatgagatctataatttaggtgcaatgtctcatgttgccgtttcatttgagtctccagaatatgtagcggacgttgacgcattaggaacattaagactcctcgaagcaataagaataaatagacttgaaaagaaaactcgattttatcaagcatccacctctgagctatatgggctcgttcaagaggtgccacaaaaagagactacgccattttatccacgttctccttatgcagtagctaaaatgtatgcgtactggattactataaattatcgagaatcgtacggtatatatgcatgtaatggtctattatttaatcatgaatcaccacgtcgtggtgagactttcgttactaggaaaattactcgttcgttagctaatattgcacaaggtatcgaaacttgtttagaactaggaaatttagattcattacgcgattggggacatgctaaagattatgttcgtatgcaatggatgatgttacagcaaaaacaagcggaagattttgtcattgcgacgggtaaacaaatttctgtgagagaatttgttcgcatgtctgctaaagagctcggtatcacacttgagttcagtggaaacggtatcaatgaaattgcaaaggttatatctgtttcaggagaaaatgcgccgatagttaacattggtgatatcattgtacgagttaatccaaaatattttcgccctgccgaagttgaaacattactaggtgatccaagtaaagccaaagaaaaactaggctgggttcctgaaattacagtagaacagatgtgtgcagaaatggtgttttctgacttagaacaagcaagacaatatgccatattaaagcaacatggatttgatgtatcagtttcgctggagcattaa

SEQ ID NO: 879 - DNA, 966 bp, Xenorhabdus bovienii
  Coding DNA location: Contig name=SeqID_16848; Position on contig =60041..61006bp; Strand=+
atgataaaaaaaagaatttatgtggcagggcaccgaggcatggttggctcagctatttgccgccatttagaaaaaagaaataatattgaattaatcgtacgatcaaaaaatgatttagatttgacaaatcaagccgcagttgaaaatttcttccgctctgaaaaaatcgatgaggtttatttggcagcagccaaggttggaggaattcatgctaataatatttacccagctgattttatctatcaaaatttgatgattgagtgtaatgttattcattcggcacacaatactaatatccaacgtttgttgtttttaggttctagctgtatttatcctaggcttgcttcacaaccaatgaaagaaaatgctttattaacaggagttcttgagtcaactaatgaaccttacgcagttgcaaaaattgcaggtattaaactttgtgagtcatataaccgccaatatggaagagattaccgaagtgtaatgccaacgaatctatatggagaaaatgataattttcatgtcgagaactctcatgtaattccagctcttttgcggcgttttcatgaagcaaaacttcataataaagaaaaaattgttgtctggggaagtggtactccaatgcgagagtttctatatgttgatgatatggcagcagcgtcagtttttgtcatggaacttgattataaaacatatacagctaatacatcagacatgttatctcatattaacattggaacaggaatagactgctcaattaaagagttggctgagactatggctaatgtagttggatttaacggaaaaattatatttgatgacactaagcttgacggggcaccacgtaaattaatgaatattgagcgtttattaaatataggttggcgatattcttttaatttaaaagaaggtcttgaaaaaacatatcaatggtttttaaaaaatcagaatagctttagaacgtag

SEQ ID NO: 880 - DNA, 171 bp, Xenorhabdus bovienii
  Coding DNA location: Contig name=SeqID_16848; Position on contig =61089..61259bp; Strand=-
atgatgacaggtaacagcatatcattccatcttgttaagaaaatagtttttagatatatcaggcgttatataaatatcatagaaatacactgtgagattttattttctgatgagaaaatcgtgtattatctatataaattaaggtgccgtaataacagtatttctctgtaa

SEQ ID NO: 881 - DNA, 1407 bp, Xenorhabdus bovienii
  Coding DNA location: Contig name=SeqID_16848; Position on contig =61240..62646bp; Strand=+
atgctgttacctgtcatcatggccggaggctctggcactcgactttggcctctttctagaactctttatccaaaacaatttctatcattaacaacagaaatgacaatgcttcaagatacattgcagagacttatatttattgagcatcaatctccgattattatttgtaatgaggagcatcgttttattgtagcagagcagttgagaaaagctgagcttgaacatagcggtataatattagaacccataggaaaaaacactgctccagccgttgctcttgctgcgttgcaagcatcaagtcaagggaatgatcctcttttgcttgtgttggctgcagatcatgttatcagaaatattactgcctttactgatgcggtgaataaagcaactgaatatgcaaagtctggtcatcttgtaacatttggcattgttcctgataagcctgaaacgggatatgggtatataaagaaaggaaaaaatatatcaactgatgcttttattgtggaacactttattgaaaaacctgacattttaactgcaattgaatatatttctaaaggtgattacctttggaatagcgggatgtttttatttaaagcatcagtttacattgcggagcttaaaaaatatcgtcctgatattctacatgcttgtgaaacatcaatgtcaagtgcaaaactagatcttgattttattcgccctaataaaaactcttttatgatgtgtcctgatgaatctattgactatgctgttatggaaaaagtagattcagccatcgctatacctcttgatgcgagttggagtgatgtgggttcttgggctgcattatgggaggttagtgataaagatagtgataataatgctattagaggtgatgtattaatagaggaaactgaaggaagctatatatattctcaagacaggctagttactacggtaggaattaaagatcttgtcgttgtggagacaaaagatgctgtacttgttgctcaaaaaaataaagtacaaggtgtaaaaaacattgtcaagagattaaaagaaaaaaataggctggagcatatacaacaccgagagatttatcgcccttggggaagtcatgatgctattgctgatggcgctcgctaccacgtaaaacgtgttattgtgaaaccggggcaaaaaacagcaatgcaagtccatcatcatcgagcagaacattggataattgtttctggtacagcgaaagttttttgtgatgataaagagtttctaattaccgagaatgaatctacttatattcctattgggtctcctcactctatagagaatcctggtaaaattcctttggaaataattgaggtcaggtctggagtctatcttgccgaggatgatgtcgtacgagtgtcaacttctggggttggttattaa

SEQ ID NO: 882 - DNA, 747 bp, Xenorhabdus bovienii
  Coding DNA location: Contig name=SeqID_16848; Position on contig =62646..63392bp; Strand=+
atgcgtatttcaattatcactgcaacttataatagcgaaaaaaccttacgcgacactttgatatcgcttgaaaatcaaaattataataatgtggaatatattatagttgatggcgcttcaaaggataaaaccatcaatttaattactagtaccagtacaaaagtctcaaaaattatctgtgagccggataaaggaatttatgatgccctgaacaaaggcattaatgcagccacaggagatgtcataggatttttgcattcagatgatctacttgcatacaacgatgttcttaaggatgtcgctgaaaaatttgtgtcgacaggttgtgatgcagtatatggagatttggaatatgtttcacagaatgatatcgcaaagcgtatcagactctggaaaagtggtgaatttagtcgaaccaaacttcagtttggatggatgccccctcatccatcattctatatgaaacggtcctgctatcaggaacatggtaatttttcactcgactatagaatatcggcagattatgattctctgctaaggtatattcttcaaaaaggaattactgtttcgtatattcccaaaatactggtcaaaatgagagtcggaggcattagtaaccgttcagtatcttcaatgtttagcaaatcattagaagatattcgagtcatgaagcagaatggtattgtttggccacttgccctcatttataaaaacttatcaaagatttctcagtttatcaaaaaataa

SEQ ID NO: 883 - DNA, 1503 bp, Xenorhabdus bovienii
  Coding DNA location: Contig name=SeqID_16848; Position on contig =63322..64824bp; Strand=+
atggtattgtttggccacttgccctcatttataaaaacttatcaaagatttctcagtttatcaaaaaataaaattatgatgaatattaaatcaactatagatcaaagtaatattgcttttggcactagtggtgcaagaggcctcgttgttgatttcacacccgatgtctgctcagcatttactcatgcctttttgaatgttacaaaacaaaacttcaaatttgataaagttgccgtcgctatagataacagaccaagtagttatattattgcacaagcttgtgctgatgctattcaaaaacaaggtcttacgcttgtctattatggcgtgattcctactcctgctcttgcttacaaagcgatgcaagataatatcccttgcattatggtgacgggcagtcatattcctttcgatcgaaatggccttaagttttatcgaccggatggtgaaatctcaaaagaagatgagcatgcaattcttaattgtgactatccgtttgagtcaccgtcaccatccactctatcagagttaaaagtctcaactgatgccgctgaagcctatacactccgctattcgtctctttttgattcgtcattactagccggaaaacgcatcggtatctatgaacactctagcgcaggccgcgatctttatgccaacatcttggcctctttaggagccgaggttatttcattaggacgcagcgataagtttgtaccaattgatactgaagccgtaagtgcggaagatcgcactcaggctaaacagtggtcgaagcaatatcatctcgatgcgatcttctcgactgatggagatggcgacagaccgttaattgccgatgaacaaggtaattggttacgaggcgatatactcggattattatgtgccgaggcgcttaaaattgatgcagttgcggtgccagttagttgcaatacagccattgaactttctaacaaattcaagaaagttaaaaaaaccaagattggctctccttacgtcatagaagcttttgatggactaagccaggattaccgtacaattgcgggttttgaggcgaatggaggtttccttctcggaactgatgtttcggtgaatggtaagcatctcgccgctttaccaacacgtgatgcagtactgcctgctttgatggtactcagtgcggcccgttttaataccattgcggagctggttgatcagttgcctaaacgtttcactttttctgatcgtctgaaaaacttccccggagaggaaagcaaaaccattcagcagcaagccgtgcaagatcctgcagctttccttgtcgatgttggattcgccgggcgcacggtaaaatcaatcgaccagactgatggggttcgattcttgatggataatggcgatattatccatttgcgcccttcaggtaatgcccctgagttacgctgttatgcggaagcagaaacagaatctcaggctcaggaatatgtcgagcgaaccttagctttgcttgcttctatgtcatag

SEQ ID NO: 884 - DNA, 288 bp, Xenorhabdus bovienii
  Coding DNA location: Contig name=SeqID_16848; Position on contig =65137..65424bp; Strand=+
atgactgttacgatagaagtgacttgtcgatattgcgaccgagctgaacctgtacgcaaacacggaacaggtaaggccgggtttcctcgttattattgcaagggttgccaaaaaaccttccaactcaattatcgttacaatggccataagccgggtatgaaagaaaaaattgtcgatatggcgatgaatggctccggtgtgagagacacgggacgtgttttaagtatcggtatcaatacggtaatgcgtactttaaatctatggtctcccccgtttttgcaaccctga

SEQ ID NO: 885 - DNA, 174 bp, Xenorhabdus bovienii
  Coding DNA location: Contig name=SeqID_16848; Position on contig =65369..65542bp; Strand=-
atggcttatagaagccgtgagttttttcaggattaccgggtgcggaactcattgtggcgcgggaacttttccccatacagacgtcagatagatttaggcaagtccacatgcgtcaaaatcagggttgcaaaaacgggggagaccatagatttaaagtacgcattaccgtattga

SEQ ID NO: 886 - DNA, 1005 bp, Xenorhabdus bovienii
  Coding DNA location: Contig name=SeqID_16848; Position on contig =65672..66676bp; Strand=-
atgaacagaacaacacttatcggcattgacttgggtaaacattcctttcacctgcacggtcaggataaaaatggaaaagcgctttatcataagaaaatgacccgcactaaactccttgagtttctggcagtgacacccaatgccactgttgtgatggaagcttgtgccggtgcgcatttcatggcgcgtaaaatcgcggcattaggccatgaaactaaactgatttcacctcagtttgtccgtcctttcgtcaagagcaacaaaaacgatttcattgatgccgaagcgatttgcgaagcggcttcacgaccttctatgcgttttgttcagccacgtacggaaagccagcagaccatgcgggcattacatcgtgtccgagaatccctggtcagagataaagtgaaaaccactaaccagatgcatgctttcttactggaatttggtatcagcatgccaaaaggtattgctgtgataagacagctgtctgaagttatcgctgaaaatgatttgccctcttatctggtacagctgctccaacgcctgcacgcccattatctgtatctggttgagcaaattagcgagattgaacaagaacttgttctgactattaaacaagatgagggtgctcaacgattgctgactattccgtctatcggccccatcacagctagcgtactggcatcagggttaggggatgggaaacaatatagccacagccgggaatttgccgcttccacgggattagtcccgaagcaatacagtacgggagggcgtaatacactcttaggcatcagcaaacgaggcaataaacaactcagaaaactgctcgtgctgtgtgcccgggtttacatacagaaactggatcacccgtcaggaaaattggcggagtgggttaaaaagcagctaacgcgaaagcattcttgtgttgtggcctgcgcattggccaataagctggctcggatcgcttgggcaatcattacaaaaaaaggagtattcaatcagtaa

SEQ ID NO: 887 - DNA, 192 bp, Xenorhabdus bovienii
  Coding DNA location: Contig name=SeqID_16848; Position on contig =66715..66906bp; Strand=-
atgggcgatgacttgtttccttttcgtatcaaaagcataccaaagccaatgacgttgttttttattgcctacaaaagacccttgctcatccaattcacagataagtgtgacatcgtcataagcggtctgtcgcgatgttacttgttttggcgagagtttaatgagatggtctcccccaccctgttgcagtaa

SEQ ID NO: 888 - DNA, 249 bp, Xenorhabdus bovienii
  Coding DNA location: Contig name=SeqID_16848; Position on contig =66814..67062bp; Strand=+
ttggatgagcaagggtcttttgtaggcaataaaaaacaacgtcattggctttggtatgcttttgatacgaaaaggaaacaagtcatcgcccatgtctttggcccccgaacggatgcaacctgccgaaaattactcaacttattggcgccttttaatattcgtttcatcacgaccgataactggggaagttataccagagaagtggcgccggaaaagcatctaataggcaaaattttacccaacgtatag

SEQ ID NO: 889 - DNA, 120 bp, Xenorhabdus bovienii
  Coding DNA location: Contig name=SeqID_16848; Position on contig =67134..67253bp; Strand=+
atggaaatccacgaaaaactcattggcgcatatattgaaaaacatcattacaaccctttggggtcatgctccaatctttatcgccaatctcggaaaaatatgaagataatattttattag

SEQ ID NO: 890 - DNA, 750 bp, Xenorhabdus bovienii
  Coding DNA location: Contig name=SeqID_16848; Position on contig =67439..68188bp; Strand=-
atgacgctcctcattttattccacatgagccattatcgtgattttaaaacgttttatattcagcatgtcaaacactaccttaaagccgattttcccaggttggtcagctacacccgtatgttaaccttaaagcacagggcgctcattcctctctgtgcttttttttcgtcacgcaaggctgaaacccaggggatcgcctttattgattcaaccaaaattgctgtttgtcacaacctccgtattccccgtcatcgcgtatttgagggcgtcgcacagcgagggaaaacgagtacaggctggttttatggctttaaacttcatttggttatcaatgattgtggtgaacttttagcggttaagctgacctcaggaaataaagatgatcgtcatcccgtcaaagcacgggtacaagggttaacagggtgtttgtatggcgataaagggtatttgtcacaggccttgtgcgatgaactggaagcagaaggaataacgttaatcactcatgtccgtagtaacatgaaggcaaaagcgttatctctctgggataagctgatgttaagaaagcgatttttgatagaaacggtcgtggatcagctcaaaaatatttctcagatagagcattcaagacaccgtagtcagctcggttttttattggaaatcgtcgctggcttaatagcttatacattccaacctaaaaaaccgagcttgaatttacgggattgtgatatcgctatttttaaacgaagctga

SEQ ID NO: 891 - DNA, 126 bp, Xenorhabdus bovienii
  Coding DNA location: Contig name=SeqID_16848; Position on contig =68258..68383bp; Strand=-
gtgcctgaggcacgatcaaagtttttgtcaaagaaaacaaaatcgtggagatcctcaggcatgtctaatttagaagaactttactgctgcgtcgatgacttttgccaaaaatttattcctctctga

SEQ ID NO: 892 - DNA, 504 bp, Xenorhabdus bovienii
  Coding DNA location: Contig name=SeqID_16848; Position on contig =68611..69114bp; Strand=+
atgctaaacatcgtcctattcgaaccagaaatcccgcctaacacggggaacatcatccgcctttgtgccaacacgggctgccagcttcatttaatccaacccttgggtttcacatgggatgacaaacgcctgcgtcgcgcagggttggattaccacgagttcgccaacattaaacaacaccatgatttccatgctttcttggagagtgaaggtttaagtccggtgaattcacaatcccctactagggtgcggttgtttgccttaaccacaaaaggcacgcctgcgcacagtaatgtcagctatcgggatggtgattacctgatgtttggcccagaaacccgtggtctacccgcttatgtgttagataatatgccaacagagcagaaaatcaggatccctatgctgtcagatagtcgcagtatgaatctttccaattctgtggctgtggtagtctttgaagcatggcggcagttagggtattcaggggcgttattgcgggattaa

SEQ ID NO: 893 - DNA, 837 bp, Xenorhabdus bovienii
  Coding DNA location: Contig name=SeqID_16848; Position on contig =69184..70020bp; Strand=-
atgagaatgattgctatgtctcgagaagaactgaacgaagtctggaaaaatataaaaaatgaagcgagagtgctggctgattgtgaacccatgttagccagtttttttcacgcgacattactcaagcatgaaaaccttggtagtgctttgagctatatgctggcaaataaactggcaaccccgattatgcctgcgattgcggtcagagaagttgttgaagacgcctatcgcagcgatccagagatgattggctcggcagcccgtgatatcaaagctgttcgtctgcgcgaccctgccgtggacaaatactcaacaccactactctaccttaaaggtttccatgcattacaggcataccgcatagcgcattggctctggaagcaagagcgccaggcattggcgatttatatgcaaaatcagatatccgtctcttttggtgtcgatattcatccagccgcgaaaattggttgcggtatcatgctcgaccacgcaaccggtattgtgattggtgaaaccgcagttgttgagaatgatgtctccattctgcaatccgtcacacttggcggtacaggcaaagcgggcggggatcgtcatccgaaagtgcgtgaaggggtgatgattggtgcaggctctaagatcctcggcaatattgaaattggccgtggcgcgaaaattggggcgggttctgttgtcttacgtcctgttccgcctcataccaccgtggcgggcgtaccggcgcggattgtgggtaaaccagaaagtgacaaaccatcactagatatgaaccagcattttaatggtatcagtaatgggtttgagtatggggatgggatttga

SEQ ID NO: 894 - DNA, 1020 bp, Xenorhabdus bovienii
  Coding DNA location: Contig name=SeqID_16848; Position on contig =70106..71125bp; Strand=-
atgaataccgcttctatgacagtcatcggtgccggttcatacggcaccgctttagccatcacattggctcgcaacgggcatgaagtcgtgctctgggggcataaccctcagcatgtccatgccttgcagcaggcgcgttgcaatcaggcatttttgccggatatttctttccctgataatttattgctcgaagcagacctgaagaatgcggtttcaaccagcagtaatattctgatcgtggttcccagccatgttttcggggatgtgttacagcagataaaaccacatttacaaccggactcccgtattgtctgggcaacgaaaggccttgaagccgaaaccgggcgtttattgcaggatgtggcacgtgagatattaggtaacgaaatcccattggcagtggtatctggcccgacattcgccaaagaattggcggcaggtttaccgaccgcgattgctgtatctgcgacgacacctgagtttggcgaagaactccagcagctttttcactgcggcaaaagttttcgtgtgtacaaaaatccggatttcattggcgtacagcttggcggcgcaataaaaaatgttattgcaattggtgccgggatatctgatggtatgggttttggggcaaatgctcgcacagcattaatcacccgaggcttggccgagatgagtcgccttggtatcgcattaggcgctgatccttcgacatttatgggtatggccggattgggtgatttagttttgacctgtactgataaccaatctcgtaaccgtcgttttggcatgatgctgggacaaggtatcagcgttgacgatgcacaacatgagattgggcaagttgttgaaggctaccgtaacaccaaagaagctcgggcattggcagaacgagccggtgttgaaatgccgattacagagcagatctatcagatactatattgtaataagaacgttatcgaagcagcccagacattattgggcagagcgacaagagatgagggagaaagccttaactcttga

SEQ ID NO: 895 - DNA, 465 bp, Xenorhabdus bovienii
  Coding DNA location: Contig name=SeqID_16848; Position on contig =71125..71589bp; Strand=-
atgtcagaacaaaacaacaccgaaatggctttccagatccagcgtatctacacgaaagatgtttctttcgaagcaccgaaggcacctcagattttccagctggagtggcaaccggaagtcaaattagatttggataccgcctccaatgaattagttcagggagtctatgaagttgttctgcgtgttactgtcacagcggcattaggggaagaaacggcgttcctgtgcgaagttcagcaggcgggtattttctctatcgacggtattgatggaacccaactggcacattgtttaggcgcctattgcccgaacattctattcccatatgcccgtgaatgcatcaccagcttggtaggccgtggtactttcccacaactgaatctggcaccagtcaactttgatgcactgttcatgaattacctgcaacagcagtctgagcctagtgaagctactcaggaagcctga

SEQ ID NO: 896 - DNA, 438 bp, Xenorhabdus bovienii
  Coding DNA location: Contig name=SeqID_16848; Position on contig =71663..72100bp; Strand=-
atgctgcaagaaatcatgcaatttattagccggaacacgatcctgagccttgcctggattgcattgctggtggctgtcattgtcatgacggcaaaaagcgtgttctccaagagtaaagagatcactcgtgcacaggctatccatttcatcaataaggaagatgctatcgtcgtggatttacgctcccgtgacgatttccgcagagggcatattattggttccgttaacctgacgccatctgagattaaagaaaataatctgggtgagtttgagaagcataaaaaacagcttgtcattgtggtttcagcgaatgggctggaatccagaacgccggctgagcatctgatccgtgcaggctttgaacaggtttattccctgaaagagggaattacgggatggtcaggtgaaaatctgccattggcccgcggcaaaaaataa

SEQ ID NO: 897 - DNA, 1326 bp, Xenorhabdus bovienii
  Coding DNA location: Contig name=SeqID_16848; Position on contig =72411..73736bp; Strand=+
atggtaggcaaggtactcaataagatggctgatagtaaggatctaaaaagccgtaatcatcggcagaagcaggatcagtggcaatccagaggcttagtgctctgtatattgctgtttgcctttttcagcacagatacctttgccaatcagatttcagagaataaagaccagctcaaggatattcagcaggatattgccgagaaagagaaaagtgtaaaacagcagcaaaaaaaacgcactaatctactaagtcaattaaaggaacaagagagcacaatctcagaagtggggctttctctccatggcacccaaacccacctgaataaactgggcaatgagattacatcactgaatgcgaatatcaaacgcctgcaaacgcaacaaaaagaacagcgtcggctgcttgccaaacaattggattcagccttccggcaaggaaatcaccaagggttagagctgctgttcaatggtcaggaaactcaacgcaaagagcgcatactcgcttattacagctatctgaatcaggcgcgtcaggaaacgatcaataaactgcaaaaaacaaccaagcagcttaaccagcaaaaaaagctgcaactggaaaaacaaaatgagcagaaaacaatactgagcagccagaagcaacaaaaacagaaaatggaagttgtccatattgcgcggcaaaaaacgctgacggagctagaatcctcactgcaaaaagatcaacaaagtctgaccgagcttcggcagaatgaaacccagctaaggaataagattgtcaaagcagagcgagaagccaaagcccgtgctgaacgtgaggctcgtgaagccgcacgcgtccgcgcacaagtcgcagccaagcagaaacaggctcaacagaaaggctcccgctacaaaccgacggaagaagaacgctcgctgatggctcgaacggatgggcttggtcgcccggccgggcaggcaatctggccagtacgcggtcgagtcatccatagttttggtgaggcaatacaaggtgagctgcgctggaaagggatcgtcattgccgcagcagacaatacggaagtgaaagcgatttcagatggacgggtactgttggcggactggctccaaggctatggtttggttgtcgtagtgcaacacggcaaaggagatatgagcatttatggttataacaaaacgacgctggtcagtgttgggcaacaggtacgagccgggcaacctatagcgttggttggcagcagcggcgggcagcagcagccttcactgtattttgaaatccgccgccaaggtcgggcagttaacccattaccgtggttaggaaaatag

SEQ ID NO: 898 - DNA, 1047 bp, Xenorhabdus bovienii
  Coding DNA location: Contig name=SeqID_16848; Position on contig =73751..74797bp; Strand=+
atggtgaagtctcggttaataaggcgagttatcccgttcacactgttatcttggatgctcctgttttgcctatcattactgtttaccctgaatgctcatgccgcacgtctggccattgttattgatgactttggctatcgtgttcagcatgaaaacaagatattacaaatgccgacggcggtttctatcgcaatattgccagattccccacacggccgggaaatggcgcaaaaagcccataaacaaggccgggagattttgatccatctgccaatggctccactcagtaaacaaccattggagaaaaatacgctgtatccttccatgagccgagaagaaattggccgtattattcacgatgccatacagaaagttcctcatgctacgggcatgaataatcatatgggcagtgcaatgacatccagtcttagtggcatggagaaagtgatgcaagtgttatcttcttaccgccatctctactttctggatagcgtgaccattggcaagacacaagtcaccaaagcagcgatgggaacgcccgttcaggtgctccgccgtcatgtttttctggataatgtgcagacagaagcagaaacacggcatcaactcaatcgagccattgctcttgcccgtaagcaaggttctgccattgccattgggcatccttacccaaccacggttcgggccttacagcaagccctcacaactttacctgacgatattgaactggtaacgcccagcaggctgttaaaccccacttcagcgagccaaaacgattaccagattgcacgtaaatgtgcaaaacctcatgagccagaaaccgtacctgcaaccaaactggattatctcaagagggtaggcaacgcattaacgcacaatgctattgttgagacgttgagtcagcacatcgataaacttttgggaaaaacatcaaaacaacaagaagtgctacaccatgcaggaaaaacagcgtcgccgcaaaaagataaaacagtacaaggcagcacagacgcccgtacaacgacagacgcctgtgctgatttttaa

SEQ ID NO: 899 - DNA, 1026 bp, Xenorhabdus bovienii
  Coding DNA location: Contig name=SeqID_16848; Position on contig =74818..75843bp; Strand=-
atgaaatcattgtcaaaattaaagccagaagaaggtatttggatggcggatgtgcccacaccggaactggggcacaatgatgtgatgattaaaattcgcaagaccgccatctgtggtacggatgtgcacatctataactgggatgactggtctcagaaaacgatttctgtgccgatggtggtagggcacgaatatgtcggtgaagtggtcgcgattggtcaagaagtcaaagggttcaacatcggtgaccgtgtgtctggtgaaggccacatcacctgtggtcattgccgtaactgccggggtgggcgtacccacttgtgccgtaatacgaccggcgttggcgtgaaccgtgcgggtgcatttgcggaatatctggttatcccggcatttaatgccttcaaaattccggacaatattccagatgaactcgccgctatttttgacccgtttggcaatgctgttcacactgcactgtcttttgatctggtcggggaagatgtactggtatctggtgccggcccgattggtattatggcggctgcggtgtgtaagcatgtcggcgcacgtcatgtcgtgattacagatgttaatgaatatcggcttgatttggcgcgtaaaatgggtgtcacccgtgccgtgaatgtcagtaaggaaaatctaaccgatgtcatgaaagaattaggcatgacagaaggttttgatatagggctggaaatgtcaggtgcgccacaggcattccgcactttattgagtaccatgaaccacggtgggcgcattgccctgttggggatcccaccttcagatatggcgatagattggaatcaggtcatctttaaagggctgtttatcaaagggatctatggccgtgaaatgttcgaaacatggtacaaaatggcggcattgatccagtctggtttagatctgaccccgattatcactcaccaattctcgattgatgatttccagaaaggctttgatatcatgcgttcagggcaatccggcaaagttatcctgaattgggattaa

SEQ ID NO: 900 - DNA, 1197 bp, Xenorhabdus bovienii
  Coding DNA location: Contig name=SeqID_16848; Position on contig =75853..77049bp; Strand=-
atgtcagcgtctttttatcaaagaattaatgagcagttggagcaaacccgtacggaagggctattcaaacatgaacgcatcatcacttctgcgcaaaatgccgatatttccgttgccgatggtagccaagttattaatttctgtgccaataattatttagggttagctaatcaccctgacctgatcgctgccgcaaaagcgggactggatagccacggttttggtatggcgtctgttcggtttatctgtggtacgcaagactcccataaagaactggaaaataaaatagccgaatttttgggtatggaagatgccattctgtactcttcatgttttgatgcgaacggcggcctgttcgaaacattgtttgggccagaagatgccattatttcagattctctgaaccatgcttcgatcattgatggcattcgtttgtgcaaagcgaagcgttatcgctatgccaataatgatatgcaggaattaagagcacagttggaaaaagcaaaagcagacggtgcggagaatatcctggtggcaaccgatggggtgttttcaatggacggtgtgattgctgacttgaaatcggtctgtgatctggccgatgaatttgatgcgctggtcatggttgatgattctcacgccgttgggtttgttggcaaaggtggacgtggtacacatgaatactgtgatgtcatgggccgcgttgacattatcactggcacactcggtaaagcgctgggcggtgcatctggcggttatactgcggcacgcaaagaagttgttgaatggctgcgtcagcgttcacgcccttatctgttctccaattcactggcgccttccattgtagcagcctccatcaaagtgttgggtatgctgaaacatggcgacgaattacgtgaccgtctgtggagaaatgccaacctgttccgtgcaaaaatgaccgccgcaggctttacactggcgggcgcagatcacgcgatcatcccggtgatgttaggcgatgcgaaactggcgcaggaattcgcggctgagctgctgaaagaaggtatctatgtggttggattcttctatcccgttgttccgaaagatcaggcacgtatccgcacccaaatctctgctgcccataccgaagagcaaatcgaacatgcggtggctgcgtttatccgtatcggtaaacagttgaatgttattgcataa

SEQ ID NO: 901 - DNA, 231 bp, Xenorhabdus bovienii
  Coding DNA location: Contig name=SeqID_16848; Position on contig =77021..77251bp; Strand=-
ttgaagcgtataatagcacttaacattactgacgacagcagcttaaacaggggaaaatcctgcgatcttgcagtacatcagcctccaagccgtgatcggctttacaaagttgatattatctttctcactgtatcgtcactggcaggatctataagtaaaatacaccacgcctttcacttattcaggtactcaggagagaaaaatgtcagcgtctttttatcaaagaattaa

SEQ ID NO: 902 - DNA, 939 bp, Xenorhabdus bovienii
  Coding DNA location: Contig name=SeqID_16848; Position on contig =77287..78225bp; Strand=+
atgattattgtcactggcggcgcagggtttatcggcagcaatatcgtcaaggcactgaatgacgaaggctataaggatattttagttgttgataatctgaaagacggcacaaaattcgtcaatctggtcgatttggatatcaccgattatgtggataaggaagatttcattgccagtatcgttgcgggtgatgattttggcgatattgatgccattttccatgaaggcgcgtgctcatccacaacggaatgggatggcaagtatatgatggacaataattatcagtactccaaagatatattgcattactgtcttgagcgccagatcccttttctgtatgcctcttcggctgcaacctacggcggccgcagcgagaatttcattgaagagcgtcagtatgaaaaacctctcaatgtttatggctactccaagttcctgtttgaccagtatgtccgcgacattttgccacaggcggattctcaaatttgtggcttccgttatttcaatgtttatggaccacgcgaagggcataaaggcagcatggccagtgtcgcctatcatttaaacaatcagattcaccaaggccaaaatccgaagttattcgccggtagtgaacatttccgccgcgatttcatctctgtcggtgatgttgccgcagtgaacctgtggttctggaaaaacagcgtttctggcatttttaattgtggtacgggccgcgccgaatctttccaagccgttgccgatgccgttaccgagttccatacagaaaaatcccctgtcgtggaatatattgaattcccaaaaaaattaaagggacgctatcagagttttactcaagctgacctgacgaaacttcgtgctgcaggttatgacaaaccattcaaaaccgttgccgaaggcgtcactgaatatatgcaatggctcaatcaggataattaa

SEQ ID NO: 903 - DNA, 1053 bp, Xenorhabdus bovienii
  Coding DNA location: Contig name=SeqID_16848; Position on contig =78235..79287bp; Strand=+
atgaagatattggtgataggcccatcatgggtgggtgacatgatgatgtcacaaagcctctaccgaaccttaaaggctttgtaccctaatgcagaaattgatgtcatggcacctgcatggtgccgcccattactggcaaaaatgccagaggttaaccaggctctggccatgccgttagggcatggtactctcggcctgggtgaacgccgtcgtcttgggatcgcactgcgcgaaagtacatacgaccgcgcttatgtgcttcccaactcgttcaaatctgccttagtgccttttttcgccaatatccccctgcgcacaggctggcgtggtgaaatgcgctatggcctgctgaatgatattcgtgttttgaataagagcgcctttcctcttatggttcagcgctatgtggctcttgcgtatgatgggaaaatgatgagtggtgctgaggatcttccccagccgctgttatggcctcagttagacgtcagtgatgaagatattgcggaatcaaccgcagcctttaatatcgctgatcatcgtcccattattggtttttgcccgggcgcagaattcggcccggcaaaacgctggccacattatcattacgccgcccttgccgaacaattgatcactcaaaaaggctatcagatcttgctgtttggctctgccaaagatcacgaggctggtgaagatattcgagcactgttgagcgaaaatgcccgtgaagattgcctcaaccttgcggggcaaacttctcttgaacaagccgttaatatcatcgcagcctgtgatgccatcatcactaacgactcaggtttgatgcacgttgcagcggccttaaatcgtcccctagtcgcgttatatggcccaagtagcccggattttacgcctccgttatcaaacaaagcagaagtgatccgcctgatcacgggttaccacaaagtcagaaaaggtgacagtgctggtggctatcatcaaagcctcattgatattcaaccagagcaggtcttggcctcattggagaaactgctacaggtggagaaccagaattaa

SEQ ID NO: 904 - DNA, 948 bp, Xenorhabdus bovienii
  Coding DNA location: Contig name=SeqID_16848; Position on contig =79317..80264bp; Strand=+
atgggtgatgtgctacataccctgcctgcattgacagatgcaaaacagcactttcccgatatccagtttgattgggcagtggaagaaggattcgcccagatcccaacatggcacagtgccgttgaaaatgtgattcccgttgctattcgccgctggcgaaaaaattggtttagaaaagatattcgtgaagagcgggcgcggtttagggaaacattacggcaaagccaatatgatgccattattgatgcccaagggctgttaaaaagtgcctttctggtgacacgtttggcacatggctcaaaacacggttatgacagcaaaagtatccgcgaaccactggccagctttttctacgatcaccgtcatacaatcagtaaacagcaacatgcggtagagcgtatccgtgcattgtttgctgatagtctgggttatcaaaaacccacagaacaaggtgattatgccatcgcccgccactttctaaactcacagattaaaggccaaagtgactatctggttttcctgcacgcgaccacccgtgatgaaaaacattggtcagaaaaccactggcggcaactgattgcagagatccagccaacaggtatgcgtatcaggctaccttggggggcagaacatgagcaccaacgggcattgcggttagcagaaggcttcgcccatgttgatgtgttgccaaaattaacactggctgaagtggctcaggtattggcaggcgcaaaagccgtggtttcggttgataccgggctgagtcacctcactgccgcccttgatcgcccgaatatcactctgtttggccccaccgatccgggtttaattggcggctatggaaaagaacagtttcccctgaaatcggtagataatacgatgcaaagcattgcaccactgaaagtgatgcagctattgcagaacgtattaaaatataaccttgcctag

SEQ ID NO: 905 - DNA, 885 bp, Xenorhabdus bovienii
  Coding DNA location: Contig name=SeqID_16848; Position on contig =80244..81128bp; Strand=-
atggcaaaaataaagccatttcttctaggatggaagagatgtaattttgaacgatacaaagaagcttatacactattaggtgggagtgtatcaacacatcctaacattgtatcattcttaaatgaaaagctagataatgaattattcttctatattaaggaacacagctcttcgattgtgggagcatattttacttgtgttaataataagttagcagctagtttacaaaaaaaatacccatttctttatgatgaaatcatttttccaatttcaaaagatgtcaaaatcatttttcctgaaaaatcgaaacgtttgtcattgcttcataaaggaaatatcgtcaatgccagctacactcttttcaacaaacgaaaaatctgcctgatcaaagacagcttttcttacaaaacccgccgtaaccgcagcaacgagatcaacaaattcaagcgagcggggggagaaattcgtccttcgagtgaattcagtgcagaagaattggtgaatatctatgttgatctgtaccaaaagcgctgggattacaatcactcggctgagcaacgcaagcatttgcttgagatgtacacagagcttcgtgagcatatctttggctatgtgctactgatcaatggcaacccttgcgcatacgattttgtcttgcgtgccgatagccctaaatggatttcatttgatgcgatcaatggcgggtatgatcccgaatatgctgatcttagcgttggcagcatcttgatgtgggttaatacccaagaagcaaaagcacagtgtcaggaagcagacaaaactatgcgttactcattgggtaatcctacttttgagtataaaaatcgctggtgcgttacacttccgctaggcaaggttatattttaa

SEQ ID NO: 906 - DNA, 954 bp, Xenorhabdus bovienii
  Coding DNA location: Contig name=SeqID_16848; Position on contig =81319..82272bp; Strand=-
atgactaaaccagcattcatcatcacaattgatactgaaggcgataacctttggcaaaacagtgataagatttctaccgaaaatactcggtaccttcctaggtttcagaatctgtgtgagcgttttggatttaaacccgtctggttaaccaactatgagatggcaatggatgatagctatatcgaatttgccaaggatgtgattgccagaaacacgggggaaatcggtatgcatttacatgcttggaacagcccacctataattcctctcactgttgatgatatgggttataagccttatttaattgaatatcctaaggatcaaatcaaagcgaaagttgatttcatgactcatttgctggaagagaagctccagactaagatgttgagtcatcgtgctggccgctgggcattcaatgaatattacgcccaactattggttgaatatggttatcaagttgattgttctgtgacaccgaaagtcaattggcattttaccaaaggcgatcctaacggagatggcgggacagactatagtcgttttccggctcatgcttattttatggatttgcaggatatcgccaaagaaggtgattcttcgttactgcaagttcctatgagcattcagtataagcattctccggttatgaattttattaagcaaaagtatgatcatttacggggtaagcaccgttcttcatctgttaactggttacgtccaaaaggcggaaacttggagcagatgaaaaaagttgttcagcaaactttggctgatggtaatgattatgttgagtttatgttgcattcgtcggaatttatgccgagtggaagccctacctttaaggatgaagaacagattgaacaactttaccaagatttggaagagttatttaacttcttgaattcattagttcagggaatgacattatcagaatattataattataaaaaatga

SEQ ID NO: 907 - DNA, 570 bp, Xenorhabdus bovienii
  Coding DNA location: Contig name=SeqID_16848; Position on contig =82402..82971bp; Strand=-
atgaataatataggaattgataattataatatgcagtatgacatacatattcatcaggttattaaggataaagtatgtgatttttatacgggtttatctggtaacatcaccgtagttattaatccttttgctgctgatgagaaaagagatctttctaaggagcaattgattggaataatgtctcaccttaattgtttagatcaatcaattaatattatattagttggtaaacttgaaaaattaaatgcgctttcatatttgagtggatgtgttgttaatccatttggtgattttctcagtgctgtagaaattataaaacacgctgacttagttatttcaccagatacttcaattgtacatgttgcagcagcatatgaaaaaaacacagttgcactatatggcaatgacaaacatggatgttttataaacaatgatgtgtggggaccaggcaataaaaatgcggtccagttagttcaaaataaaaataacagtaaaatcagtgaaatgccgttagaaattattgtagaacagatagatgcttttttcagcacattggcaaaaaagatctag

SEQ ID NO: 908 - DNA, 483 bp, Xenorhabdus bovienii
  Coding DNA location: Contig name=SeqID_16848; Position on contig =83019..83501bp; Strand=-
atgactgaaaaaaaattcaaaaagttacgtgaaataaatagaaataaaaactatttttttaaaaagcttcgctttaatttagctaaaatatttattgataaatggagtaagaaacaatttcatcttggtgacataaacaaaattctttttttacgagatgataacaaaattggtgacatgattgtatttactcctgtattgagagaattatctctgaacgggttcaagctgcatgtactatcagggccttcgaattattgtgtgattgaaaataatccatatatcgacaaggtctatttttatcctagaaaaaacatagatatacttaacttaggattgaaattaaaacaagagaagtatgatcttgttatcgacatgggcgatcaaacccctgtcatctatctcttatttatacggctcattaatgctaaaatactattggctttaataaagatgacattaatatttacaataaaagtataa

SEQ ID NO: 909 - DNA, 1101 bp, Xenorhabdus bovienii
  Coding DNA location: Contig name=SeqID_16848; Position on contig =83538..84638bp; Strand=-
atgaaagggcatatcctgtttatcattgacggattaccgggtggtggtgcagagaatgtcactgtccgtttatgtggtggcctgcaaaaaaaagggtttgatattacattgttgtcgctgtctgacaaatgtgaatacccgatccctgaccatgttgagttgatcgttgatactgatgaatatgcaggcccttttagaagacagactgagatttatcgcagagctaaatccatggatacggtattggagaaagtctttctgcaaaaaggtacccctgtgctggtgatatctaacttacacaagacggatcgtattgtagccaagtctaagatattagcagatttgaacgtatggttttgtattcatggtgtattctctaaatcataccttgaaaataaaacgggattggcgcgttggattaagaaatggaaaattcaacgcgtttatcgggatcgtaatttgatttgtgtttctgatgcggttggcttggatttgaaggagaatgtatcgctggctcctaaaaggatagttacgatttacaatccatttaaccttgctgaaatcaaagctaactcattagaaaataatccttattctggtgaagactattttcttcaccttgggcgttttcatggtgtaaaacgtcatgatcgcttgttggaagcttttgccagagcgaatttgccttgcaaattgttaattgcgggtcagggcgatgaaaaaacaaccaatgaaatcaaacaaaaaattgtgtcacttggcctgcaatcgaaagtgacactaatcggttttttagtgaatccattacccgtgatacggggcgctaaagctgttgtgctgagttcagacagtgaagggttgggtaacgtcttgattgaggctttgatttgccatacaccgattgccagtacgaactgccctggtggagtcagtgagattatggtgggtgaattggagcaatacacatctgaactgacatcagagtcattagcggaaaaaatacgtttggtttatcaaaggccacctgtgattacggcagatttgtataaaaaatttgatttggaagttgtgcttgataagtatttatctttgatagaataa

SEQ ID NO: 910 - DNA, 1134 bp, Xenorhabdus bovienii
  Coding DNA location: Contig name=SeqID_16848; Position on contig =84635..85768bp; Strand=-
atgatgaaatctgtgcgtcttgccattgtccggcaaaaatatcggcctgatggtggcgctgagcgctttatttccagagctctggaagcattggataatgaaaatctggaattaaacgtcattacgcgttcttggcaagggagtatgaaccctaactggcatgtgcatttggccaatccttttaaatggggacgcatcagtcgtgaaaagggatttgccaacgctgccagagaaatttggcaaaaggaagggttcgatatcgtccagagccacgagcgtattgcgggatgtgatgtttatcgggctggagatggtgtgcatcaacgctggttgcagcagagagcgaggatcttgccatcttggaaaagtaagttgctttttgccagtcgttatcaccgttatgtcatggacgccgaaaaaaaaatgtattctgctcctgaattgaaaaaggtgatttgtaattctcagatggtaaaacaggaagtgatggaagattttgacctgtctgaagagaaaattgctgttatctataatgccattgatccatcacaattttttcctgctggggaagaagaaagaattgaattacgacagaaatatagcattcctgcacaggcaaagtgttttgtgtatgttggttcaggttttgaaagaaaagggctaaaagcggcaattgaagcaatcagcatgacagaagcttatctgattgtgattggtcaagataaggaagagtctaaatataagcagttggctagtgctctcggctgccatgagcgaattcggtttttgggagtacaaaaaaagacattgccattttatcaaatggctgatggattactgctgccaacgttatacgatccttttccaaacgtcattttagaagcgatggcatgtggtttacctgtcataaccagtaagacttgtgggggagctgaattcatagtttcaggagaaaatgggtttgtgtgtgatgccttagatattcaggcattggcggaatctatatccttaatacccgcagaccatttaactagcaggatctccatgctatcaaaagaaaagatagccaactatacacccgcttatttgtcccagcagcttactgagctgtatagcaaggtgctttccttatga

SEQ ID NO: 911 - DNA, 1062 bp, Xenorhabdus bovienii
  Coding DNA location: Contig name=SeqID_16848; Position on contig =85765..86826bp; Strand=-
atgggcaaaataaccactcgatttgaaaagattttgatcataaaactaagacatcatggtgatatgttgctcatcactccagttgtgaatacgttgaaagaaaattttcccgatgctgaaattgatgttttactgtacaaagaaacaaaacctatgctgatgaattttgcatcaatagcccatattttccccatagacaggcagtggaaaaaagaaggtgcaaaagcctatgttgctcatcattggcgtttgctgaaacaattgagaaaccgaaactatgatctcgtcattaacctcgctgatcaatggtatagtgccttggtttctcagcttatcagtgctccagctcgcataggttttgattttcccaagcggcaaaacctcatatggaaagcctgttttacagatttggtatctactgagggtgaagaaaacctgcatgttgttgaacagaatctatcagccctgaaaccacttaatctttccgatattaatattgatgtaacaatgagttatagtgaagaagacagacagaaagtgtctgatcttttgcatagttccgggattaatgaaaagtatattgttattcatccggcatcacgctggtttttcaaatgctgggatgaagagaaaatcagcgaaaccattaatgctttgcaggccgacgggcatgctattgttttgacatcaggaacggaggcgcgggaaaaagagatggtcgcgaaaattttatctgcctgctctcaagagaatatcgtctctttggcgggacagataacattaccacaacttggggcgttgattgatcatgcgaagttatttattggtgttgattctgttcccatgcacatggctgctgcgttgaaaactccctgcatcgcgttattcgggccatctaaattggttttttggcggccatggaatgccaatggtgaagtgatctgggcaggaaattacggtaaattgccggatcctgatggcattgatacaaaaacagatatccgctacctggacttgattccggtggatgttgtgattgaagctgcccggagatatttatga

SEQ ID NO: 912 - DNA, 183 bp, Xenorhabdus bovienii
  Coding DNA location: Contig name=SeqID_16848; Position on contig =86857..87039bp; Strand=+
atgttcattaaattatattctaaggacaacaagatctcgcttctctctttacatatcgagctagttaaccttaacaaaaagtttacccccttgtccttttgggagagaggcgagcaacatatccgcattttacacactttcttcaggccaatgtggtactatagccgcagtctatgtcagtga

SEQ ID NO: 913 - DNA, 1278 bp, Xenorhabdus bovienii
  Coding DNA location: Contig name=SeqID_16848; Position on contig =87050..88327bp; Strand=+
atgttgcttcgcttatatcaggtacttctctaccttatccaaccgcttatctggttacgcctgctgctgcgcagccgtaaatcccctgcgtaccgcaaacgctggggtgaacgctatggtttttgtgccaaaaaagtcgcaaaaggtggaatattactccattccgtttctgttggagaaacattggccgccattccattagtaagaatactacggcaccattatcctttcctgccgattaccgtgacaacaatgacaccgactggctctgaaagggtgctttctgctttaggtactgatgtcaaccacgtttacctcccctatgatttgcctggctccatgagccgtttccttgataacgtcaaccccaagctggtgattattatggaaacagaattatggcccaatttgattacccaactgaaccaacgcgaaatccctctggtcattgccaatgcaaggttatcaacccgttcagccgcgggatatcaaaaaatcagcaactttattaaaactattttaaataaaataacactgattgccgcacaaaatcaggaagatggtgagcgcttcatcgaactcggcttaaaacgttcccaactcgccgtcactggcagcctgaaattcgacatttctgtcacgccagaattggcagcaaaagcagtcacactgcgccgccaatgggcaccacatcgtccggtctggattgccaccagcacccatgatggagaagaaaccatcatattggatgcgcactgcaaattaattcaacaatttcctgatctactgttaattctagtaccacgccatcctgaacgctttaccaaggccgcagagttaacccaaaaagcgggattaaattcgatattaaggagctctgacacaatacctgatgccaatgtgcaggtggttatcggagatactatgggcgaattgatgctcttgtatggtatcgctgatctggcttttgtcggagggagtctggtcgagcgtggaggtcataatccgctggaagccgcagctcatgctatccctgtcattatggggccacatactttcaactttaaagatatttgtgccaagctggataaagccaatggccttatcgccgtcactgatagtcactcgttgagtgccgctatcaatagcctgctgacagatgaggactatcgtctttattacggtcgccatgccgccgaagtcctgcacgaaaaccagggagcacttcagcgattgctaaaactactggaaccttatctcccgccacggggtcattga

SEQ ID NO: 914 - DNA, 777 bp, Xenorhabdus bovienii
  Coding DNA location: Contig name=SeqID_16848; Position on contig =88327..89103bp; Strand=+
atgagcaagagaaaacgcctgtccgttgtgatgattgctaaaaattccgccgatttgattgcagattgtctgctatccgtagattgggctgatgaaattatcgttctagacgccggcagtactgatgcaacttgtcaaatagccagcgaaatgggcgcgaaagtctacatcaatacgcaatggcccggcttcggtcgtcagcggcaactcgcacaatcctatgccagcggtgattacattttcatgattgatactgatgagcgtgtaacccctgaattaagaacatcaattgagcaggttttggcagatcccgacgatgataaagtctatgactgcgcacgtctcaacctgtttatgggtcgttttatgaagcacagtggctggtatcctgataaagtcattcgtctctattgccgcgaacgttatcaatataacgacaatcaggttcatgaatcacttaacactcaaggcgcccgcatcgtgacattaaagggcgatttacgtcacctcacctgccgtaatctgatggaattccagcaaaaacaattgaattacgccagagattgggcaaaatatcgccacgaacaaggtaaaacagcccgttatttttctatcttcagccatacgttaggcgcattttttaagacatggctgttaagggccggcttcctcgatggcaaacaagggttggtattagcaatggttaatgcccagtacacatttaataaatatgctgccctctgggaactcacccaaacagagagtaaaaaacgatga

SEQ ID NO: 915 - DNA, 492 bp, Xenorhabdus bovienii
  Coding DNA location: Contig name=SeqID_16848; Position on contig =89117..89608bp; Strand=-
atgatcaccccccttttcacgctatcttatttgccgaatttctttagcattgcctgtgcaacggattctggcaggaatgatgaaacatcaccatcatggcgtgcgacatccttgatcaaggatgatgatacgaaggacaggttttgcgagggcaataaaaagacactttccagttctggcataaaatgtcggttcatgttggcaagctgccactcatattcaaaatcagaaacggaacgtactccacggattaaaatggtggcttgttgttttttggcaaaattggccatcagttcactaaatccgaccacttctacgttatccagatgggtggtgacttcttttgccagtgcgattcgctcttccagattgaacatggggttttttctgtcactattggcaatggcaagtaaaacatggtcgaacatgtttgctgcacgggtcacaatatcaaggtggccgtgggtgatagggtcaaaagtaccaggataa

SEQ ID NO: 916 - DNA, 810 bp, Xenorhabdus bovienii
  Coding DNA location: Contig name=SeqID_16848; Position on contig =89629..90438bp; Strand=-
atgccggagctaccagaggttgaaaccagtcgccggggaattgaaccccacttgacgggtaatgtgatccaatattccgaggtcagaaattcgcgcttgcgctggccagtttccgaacaaatcatgaagcttgctgaccaaccggtactcagtgtccggcgtcgggcaaagtacttattgcttgaactgcctgaaggctggattattattcaccttggtatgtctggtagtttacgtatcttgctgaatgaatctcctcctgaaaaacatgatcacgttgatttgattatggcagatggcaaaatcctccggtataccgatccccgacgttttggggcgtggctatggagtgacaatcttgatgagtgttctgtattggctcatttaggccctgagcctctttctgacacgtttgatggtgaatatctttataccctttcccgcaacaaaaaaacggtgatcaaaccttggttgatggataacaaggtggttgttggagttgggaatatctatgccaatgaagctctctatgttgcgcatattctgcctgagcgccccgtgaattcattgacacaggaagaagcttatttactggccgatacgataaaacagatcttacatcgttctattgagcagggaggcactacactgaaagattttctgcaatccgatggtaagccgggatattttgcgcaggaattatttgtttatggcaaaaaaggtgaactttgtccgaagtgtggtgaaaaaattgagagtataaaactggggcaacgcagtacgtttttctgtcgtcagtgtcagcattga

SEQ ID NO: 917 - DNA, 1290 bp, Xenorhabdus bovienii
  Coding DNA location: Contig name=SeqID_16848; Position on contig =90500..91789bp; Strand=+
atgtatcatttgcagccaaatttggttgggatagttgagagaatagaaattactatgcttgatataaaaaacagatttaacataggcaacaacaagaaatccttatggaatttatccattattggtctgtttatcattcttgtttatctgccagatattacaagatataaaaatcttgtcatgatccttatctgtgcaaccgcactctgctatctcgtaaaagattttcgtcaggtagtcaattcactacgtagttcgctatttttatccattttgttattcgtattggcaatattctattctatcggcatttcgattgatcctgctctgagtttcaaggaaatgaacaaacccatactcaatggattactgctgttcagcatgactttcccaattgtgctctatcaggaaaagaaacagcacatcgcgaagatgattctgattgcgtttattattggcatgagccttatctcgctgacagatattgcgaaatacatcatcaattattacgcaactggcgaaatgccgtttatgaattacaatcatcgggaattttcttacggatttcttttctatttccctgtgttgctatgtacctgggcattatggaaaaaacattctctgctgagttggctactactgattattgcctcagctatcggcctgttcttattactcggtactctttctcgtggtgcttgggttgccattgttgtagccacagtatttattattgtgattaataaagagtggaaactcactctggctgcgacaatatgtctggggctactggccggagccattcactggtcagcagtatctaaccccgccacgaaattactgcttcacaaactcacccaaacagacagcagtcatcgctatagcaacggaacccaaggttcagcatggtcattaatcatggagaatcccgtaaaaggttacggttttggtaataaagtctaccatcaggtctacaatagccgtgttgctgattatcctgattgggcattcagaacttcgattggcccacataacgtatttttatcgctttggtttgctggcggtctcttcggtttgatcgccacccttttgatgacgctttccgcattatttacaggaagccagatcattcgccagcatagcgggatcatccgacaagctggcctgatacttctgacggcctttattggcctgtttatcgtcaggggagcttttgaaaatgcctatatcaatgaaataggtctcttattgggtttaatgattactctatacaagcaaaaagatgattag

SEQ ID NO: 918 - DNA, 111 bp, Xenorhabdus bovienii
  Coding DNA location: Contig name=SeqID_16848; Position on contig =91812..91922bp; Strand=+
atgccagcctatacgacacaaattggacgggctggccttcaagctatttcagcaatcgcttatttagacaggttttccgctatcacttgcatgatcagctttgcacgctga

SEQ ID NO: 919 - DNA, 1179 bp, Xenorhabdus bovienii
  Coding DNA location: Contig name=SeqID_16848; Position on contig =91871..93049bp; Strand=-
atgaagattgcgtatattgacccttattccgtacctgattatcgagttgcttcgctgcagattttgcagaatgtcgatgcttttgcccggcaggggcacagcgtctacctgattacgccagaaggtcaaaagcgtgttgaggagattataggcagagcattgccgccttccgctgagctgatagctctgcgcaatatgcgtagaaagtggtatttccccctcaatacacagaaattgttttattttcaggtttctcgctggctgaaagatcatcaaattgacgctatttttactcgcaatattaaaatggcgaattacctcctgcgtaaacatcctgatatcccgcatttttttgaaagccacgaagtttttgcacaatcgtttaaagaatcccataacttagataaacgtaaaaatcgtcgtaaatatcataagctcagaaacacggaacaacaggtttatcatcattccaaggtcgtgtttgtgctgacttcactattgagtgaggatatttataaagaatatagtgttaagacgccgattatagtggcacctgatggtgttgatatgctggcggttgaatctacaaaaatagcgtcttctggcagaagggaaaaattgggagaaacaactcaggtgctgtatttgggcagtttgcatcgctggaaaggtgttcctactgttatgaaagcgatgtgctaccttgacaatgctgtactgaacattgccggtggcgatagcgtgcagattgaacgattgaagtgtacagcccaacagattggcgtgagtgataaggtaaatttccttgggtttatccagccgaaaaagcgttttcaggttattgcagagagtgatatttgtgttctaccattgacgaaaaccagcattggcagccgttatacatccccactcaaactttttgaatacatggcgatgggcaaacccgttgttatttctgattttccttctattcgcgatgctgtggatgagaaggcggtcaattttgctgacagcgaaaatgcggagagctttgcagaacagattcaatcattgattgataaccccgctgaaatgatggctaaagtgggttactcacaacgattggtagcagaacgttttaactgggatcagcgtgcaaagctgatcatgcaagtgatagcggaaaacctgtctaaataa

SEQ ID NO: 920 - DNA, 1104 bp, Xenorhabdus bovienii
  Coding DNA location: Contig name=SeqID_16848; Position on contig =93049..94152bp; Strand=-
atgaaaataggatttatcgatgtcaccgttactatgtcttatggcggtattcaaacagcggtttgggaattggcgaaggctttgacagatgcggggcacgagatccatattttcggcggaacaggtgacgttaggccagtattgggagagcgaaatattcatattcacacatttccatttactcccagagaacgagtcatcaatattggacggcgttttcaacgcattgttgagcgttattcttttgcccgtcatgcccgtgaaagggttatcgctgaaaattttgactgggtgattttgacgaaaccttttgattttttctggcccagaatgatgccgaaaacttcctgcacaaagttttgctatatgagtggcggaaccagttttttcaaaggtgatcgggcattaggtaacaaaatatctgcgtgggttgcatgcagccactttaatgcttggcagatccagcaccattttaaacaatttccaaatgtgatttataatggtgtcgatattgataagtttaaacctgttaattctgatctccggaatcggctagatatcaatgaaaatacgtttttgctgactttcgctggcaggctggtgggttggaaaggcatgaaagtcgctattgatgcgatggctttactgcgtgacaaggatgtaaggttattgattattggcgcaggtgatgatctgaagttgttgaaaaaaaaggtttcggaactgaatttagaaaaaacagtcatttttcatcctcctgttggtcatgatcaattacctgaattttatgctgcgggagatgcgggtatctttcccagtattggtgatgaagcatttggtattactatcgctgaagcaatggcatgcggacgtcccgtgatagccagttatattggtggcattcctgaggtggtcggcaatgagaatcatgcgggtattctggtcgcacctggcaatgcagcggctatcgctgatgcagtcaatcatcttttgtccttaccggacagggggaaagcaatgggaaaacaggctcgtcagcggattgaaacgatgtatacttgggaacattctgcaagtcgtttattgggcgcgataaaaaaataa

SEQ ID NO: 921 - DNA, 990 bp, Xenorhabdus bovienii
  Coding DNA location: Contig name=SeqID_16848; Position on contig =94167..95156bp; Strand=-
atgcagcctaaaaatattctggttattattattgcccgttttggtgacactctgcttataacgccagtgatccgggcgttgaaattacgatggcctgaagcgaatatttatgtattagcacataaaaaaacgaaagagatccttgagaatattagtgaaattaattcaataaccgctttttcaaagggacaggcaaaatggaggggatggttttcccgtcgacgttatgatcttgccctggtatatggtcatgataaacccctattacaatatgctaaacgtaaatcagatttaactatttatttttcggaaacttcttgtcataaatcaaatgagctagcagtggtaaagccgcgggcgttcactcaagcacagcaagaaagggcgctgttgattaatgcacttgatattggtgtcagtgactggcgcttgcagtattgcgtgagccagaatgaagagaagtatgcctgcgattttcttcggcagcaggggttagaacaacgattacgaattggctttcaactccagagttttccagcaaaatcttatcgtgattggcctcaggaacatttttacgagctggcgcaacgtatttattgtcactatccgcatgcccatattttgctgttgggcagtaaagatggtgaagcgagtgcgcagatactctctgaaaggctgggaacacaaagatgtacatcattggcgggcaagacgacgatgaggcagaatgcggcaataatgagtcaacttaatttgtacgtcggtgttgatactggcacaactcatctggcaggtgcgctgggtattccgatggtggcaatgtaccatagttttcatcctggccgttttcttgctcctcagcaacatccaaaattggcggtgattgaacatccgatagattatcaacaggcgactcgccaagatgcaatgtcagcaatatcggttgaacaagtctggagctccgttcagaacttgttgaaaaacacatga

SEQ ID NO: 922 - DNA, 1116 bp, Xenorhabdus bovienii
  Coding DNA location: Contig name=SeqID_16848; Position on contig =95361..96476bp; Strand=-
atgactaaaaaaaccttaaatatcttacacactgaatcatcgtgtggttggggagggcaagagattcgcatcctgacggaatctcagggcatgatacaacgcggtcatcaggttgttattgtttgctgcccagcgtcaacgatttatcatgaagcccattcgtatggtgtacctgttgttgcgctgccgattgaaaaaaaacgccttccctgcttgcgggcgatgcgccgctggctaaaagctgaaggccgtcaatttgatgtcatcaatactcacagctctactgattcttggttggtggctgcggcatgtgccacattgaaaggtatgccaccgatagtccgaacccgccatgtttccactaacgtatccacatccgtggcgactcgctggctgtatttgaaatcctgtcagcatattgtgacaacaggggagaagttacgccaatatctgcatacgaataatggttatccattacctcacatgacctctgtaccgacgggaatcgatctgacgcattttcatcccgaaaataagcaactttgtcgtcagcgtattggtattgcagataaaccgaccctgggtattgtcgctacgatgagaacctggaaagggcaccgttacttgcttgatagttggaaaatattgcaccagcgttatcctgactggcaattgctgtttgtgggggatggcccccagcgaaaaaatctggaaccctgggttaaacacgaagggctgacggagagtgtcattttcctcggtaaccgacaagatgtgcctgactgtctgaatgcgatggatgtctttgcactaccttcgtttggcaatgaaggtgttccacaaggcattatgcaggcaatggcctgtggtttgcccgtggtatctacttcggtaggcgcaatcactgaggccgttattgatggtgatacgggttatattattgagccaagatgtgttgaacagttaactgaaaggttagatattttaatgaaaagtgctgagttgcgtttgcagatggggaacgcctcattggaacgggctgccgatttatttagcatggataatatgttagaaaaaatggagtttatcttttacggtagtatggaacgtaaatag

SEQ ID NO: 923 - DNA, 111 bp, Xenorhabdus bovienii
  Coding DNA location: Contig name=SeqID_16848; Position on contig =96536..96646bp; Strand=+
atgttacgtccatggataacctatcttcaaccaggctatccatgcattctggcaggtataaaaaaacccagcatacgctgggttttttctcaatccactaaaattatttaa

SEQ ID NO: 924 - DNA, 168 bp, Xenorhabdus bovienii
  Coding DNA location: Contig name=SeqID_16848; Position on contig =96639..96806bp; Strand=-
atggctaaaggtattcgcgataaaattaagctggtttcttctgctggtactggtcacttctataccactacgaagaacaagcgcaccatgcctgaaaaactggaactgagaaaatttgatccagttattcgccagtatgtggtgtacaaagaagctaaaattaaataa

SEQ ID NO: 925 - DNA, 237 bp, Xenorhabdus bovienii
  Coding DNA location: Contig name=SeqID_16848; Position on contig =96818..97054bp; Strand=-
atgtcccgagtctgccaagttactggcaagcgcccggtgagtggtaataaccgctcccatgcattaaatgcgactaagcgtcgttttctgcctaacctgcattctcaccgtttctgggttgagtctgagaaacgttttgtaactctgcgtgtaactgctaaaggtatgcgtgtgattgacaaaaagggtatcgatgtagttctggccgaactgcgtgcccgtggtgagaaatactaa

SEQ ID NO: 926 - DNA, 228 bp, Xenorhabdus bovienii
  Coding DNA location: Contig name=SeqID_16848; Position on contig =97053..97280bp; Strand=+
atgtctattctccaaaaatcaaatcagctcgagctttatattgggtatgaccgcctcgtcaggcttaggagcccatctcagcacattttcatcactgaaaagactcacattatcccaataaaaaaacttactgagataggctcttctcgccaaacccaagatcctcaaaggtggcgtagtatacgccctcattcgctgatgctcaagtcccgaacaactaagatctga

SEQ ID NO: 927 - DNA, 693 bp, Xenorhabdus bovienii
  Coding DNA location: Contig name=SeqID_16848; Position on contig =97302..97994bp; Strand=-
atggatgttactgtgatggaaataagcgatgaattgcattcaaatcttgctcctcgggagaaattgctggcttatggcgccgtttccctgacggatgccgagttgttggctatatttttgcgtacgggaacccgaggggttcctgtcgtgcaaatggcggaacatctactgaaatcatttggttcactttatcacctgctctctgcggattatgccgatttttgttcacataaagggatggggctatgcaaatatgtccagttgcaggcggtatctgaactggcaaaacgttttttctccagtcaatttatccatgaagatgtgatgagtagcccagtcgcgacgcaaaattatttgcaggatttattgtcctggcaggatcgtgaagtctttgtggtgctgtttttgacgaatcagaataaagtcatctgtcatgatgaaatgtttaaaggaacgataaacaaagttgaagtgcacccgcgtgaaatcgtgaaacaggcagttaaagttaatgctgcatcgattattcttgctcataaccacccctccggtaatccagaacccagtctggcagacaaattggtgaccgaaaaaattattgatgcttgtgagttggttggcgttaaagttttggatcatatcgtgattggtaagcaacattgtgtctcatttgtggaaagaggctggatttag

SEQ ID NO: 928 - DNA, 135 bp, Xenorhabdus bovienii
  Coding DNA location: Contig name=SeqID_16848; Position on contig =97956..98090bp; Strand=+
atgcaattcatcgcttatttccatcacagtaacatccatatactccccctcattccctttcacccagtggcttcacgccgccaatatcccatgatgaaaaaagcaccgccagccccattttcatggcttgcgtag

SEQ ID NO: 929 - DNA, 1245 bp, Xenorhabdus bovienii
  Coding DNA location: Contig name=SeqID_16848; Position on contig =98185..99429bp; Strand=+
atgtggataatcagaatggcaggattttccagcaaacagctttctggtaaacatatcgtgctcggcatcagcgggggaatcgccgcttataagacagctgagctggtacgccgtttacgtgatcgcggtgccgaagtacgcgtcgccatgacgccagcagcagaagcttttattacgccactgaccttgcaggccgtatcgggtcatccagtctccgatgaccttttagaccccgccgctgaagctgcaatggggcacattgaactggctaagtgggctgatttgattattctcgctccggccacagccgatctactcgctcgtttaaccgcaggcatggcaaatgatttggttaccacgatttgtttggcatcagcagcccccattgctgtcgctccagcgatgaatcagcagatgtaccgtgcgcaggcaacccaacataacctaagtgtactcaaagagcgtggcgtgctgatttggggtcctgatgagggaagccaggcatgtggtgacgtcggcccgggaagaatgcttgaacccatggcgatggtcgaactggcaacacaacatttcaacaccaatcaagatttcgccggtctttgcatcaccattaccgcagggccaactcatgaagctttagatcctgtccgctttattaccaatcacagttccggcaaaatgggattttccatcgcacaggcagcagcggaacgtggtgctgacgtcacattgattgcaggccccgtcaatttaccgacaccaccgggtgtcaaacgtatcgacgtaaccagtgcgctggaaatgcatgagcacgttcaggtaaccgcagcttcacagcatattttcatcggctgtgccgccgtagcggactaccgtttcaaacaaatagcgactgagaaaatcaagaaacagggtgatgaagtcacatttacactggtgaaaaatcctgacattgtagcgagtgttgccgcgatggaaacaaatcgtccatttgtcgttggatttgcagccgaaacccagaatgtggaagaatacgcccgcggaaaactcaagcagaagcatctggacttgatttgcgcaaataatgtatctctggccgaacatggcttcaacagtgataccaacgcattacatctattctggcatgatggcagcgttaatttacctcacagtagtaaattacagctcggccactgtttattagacgagatactcaaacgctatgacgaaaaaaatcgacgttaa

SEQ ID NO: 930 - DNA, 459 bp, Xenorhabdus bovienii
  Coding DNA location: Contig name=SeqID_16848; Position on contig =99407..99865bp; Strand=+
atgacgaaaaaaatcgacgttaaaatccttgatccccgcattgggcaagaatttcccctaccgacttatgctacacctggctctgcgggtttagatttacgtgcttgtctggataatacagtagaactggctcccggccagactgaactcctgccaacagggatcgccatccatatcgcagatgaacaattggcggcggttattcttccccgctccgggctgggtcacaaacacggtgtggttctgggcaatctggtggggcttatcgactccgattatcagggacagctgatggtttcagtttggaaccgtggtgataagatgttcatcattgaacccggtgagcgcattgcccaaatggtttttgtgcccgttgtacaggccgaatttaacttggttgaagattttgaaaccagcaaacgcggcagtggtggttttggtcattccggtcgtcaataa

SEQ ID NO: 931 - DNA, 147 bp, Xenorhabdus bovienii
  Coding DNA location: Contig name=SeqID_16848; Position on contig =99899..100045bp; Strand=-
atgtgtgccagtgcctgcaagatttcctcacgtctatttttcttttttgtacgttctttttctgccatgtgtgataagacccctgctaaaacagcaaaacaaatccagctattttttgcccaccacgatcatgggcaaaaaatatga

SEQ ID NO: 932 - DNA, 600 bp, Xenorhabdus bovienii
  Coding DNA location: Contig name=SeqID_16848; Position on contig =99978..100577bp; Strand=+
atggcagaaaaagaacgtacaaaaaagaaaaatagacgtgaggaaatcttgcaggcactggcacacatgcttgaatccagtgatggcagtcagcgcattaccacagcaaaactcgccgcaaatgttggggtttctgaagcagcactttatcgtcattttccaagcaaaacccggatgtttgatagcctgattgagtttattgaagacactttgatttcgcggatcaatctgatcctgcaagatgaaaaagacaccattacccgcattcggttaatcctcaccctgcttttgggctttgcggaaaagaaccccggattgacccgtatcatgacaggtcatgccctgatgttcgaacaagacagactacaaaaccgcattaaccaattatttgaacgtattgaagcgcagctccgccaaattttaaaagagaaaaaaatacgtgatggacagggattcgattatgacgagaccgtactggcatcgcagttactggcgttttgtgaagggatgctttcccggtttgttcgttctgaattccgctatcgcccgacccaagagtttgaaatacgctggccattgatattgactcaactgcaataa

SEQ ID NO: 933 - DNA, 237 bp, Xenorhabdus bovienii
  Coding DNA location: Contig name=SeqID_16848; Position on contig =100464..100700bp; Strand=-
atgccattactgagttactttatagtgaactcaactagaagatgcatgttaacacaattcaacgaaaaaaccgcacgttatcattctcagcatgaaagagggaatttcacggtgcaggctcagttattgcagttgagtcaatatcaatggccagcgtatttcaaactcttgggtcgggcgatagcggaattcagaacgaacaaaccgggaaagcatcccttcacaaaacgccagtaa

SEQ ID NO: 934 - DNA, 105 bp, Xenorhabdus bovienii
  Coding DNA location: Contig name=SeqID_16848; Position on contig =100694..100798bp; Strand=+
atggcatcgttaccgtattacatgcgggatgtcatttctactactcaccccgcccggccattgggcgagggtttttttttatctcagttgtttttacttagctga

SEQ ID NO: 935 - DNA, 642 bp, Xenorhabdus bovienii
  Coding DNA location: Contig name=SeqID_16848; Position on contig =100802..101443bp; Strand=-
atgaaagcctatcagcgcgaatttattgagctggcactgaagaagcaggtgctgaaatttggtgaatttacactgaagtccggccgccagagcccctattttttcaatgcgggactatttaatactgggcgtgatttggcattgattggtcgtttctatgcagctgcactgttggatagtggtatctcgtgtgatctgctatttgggcccgcttataaaggtattccgattgcaaccacaacggcagtcgcgttggcagaacatcatgacatcgatatgccttattgttttaaccgtaaggaagctaaagatcatggtgaaggcggatcactggtcggtagcccactacaaggtaatgttgtcgttgttgatgatgtgattacagcaggaacggctatccgcgagtcgatggaaatcatcaagcaacacggtgcaacgttgtctggtgttatcttgtgtttggatcgtcaagaacgcgggcgggagacgctttcagctattcaggaagttgagcgtgactatcactgcaaggttttttccatcattactttgaatgacttgattagctatctacgtgaaaatccagatatgcagccttatttggcggcggtggaagcctatcgcagagaatacggtatctga

SEQ ID NO: 936 - DNA, 729 bp, Xenorhabdus bovienii
  Coding DNA location: Contig name=SeqID_16848; Position on contig =101533..102261bp; Strand=-
atgagtccagtaggaaagcgtccagcaggaagaacggcagggcaggtgcgtcctattaaaatgacccgtcattacaccaaacacgcggaaggctcggttctggtggagttcggggataccaaagtgttatgtaatgcctccgttgaagaaggaattcctcgtttcctgaaaggccaggggcaaggctggatcacggctgaatatggcatgttgccacgggcaaccaatagccgtaatgcccgcgaagccgccagaggcaagcagactggccgtacaatggaaatccagcgcctgattgcgcgttcactgcgtgccgcagtagatttgaaaaaattgggtgaatataccattacgctggattgcgatgtgattcaggccgatggcggtacgcggactgctgccatctctggcgcgtgtgtggcactggtggatgcgctgaacaagctggttactgatggcaagctgaagaaaagcccaatgaaatcaatggtggcggcagtttctgtcgggattgttaagggtgaaggtctttgtgatctggaatatgttgaagactcggcggctgaaactgatatgaatatcgtcatgatggatgacggccggatgattgaagtgcaaggcacggcagaaggtgaaccgttcagccatgatgaattgctctcattgctttccctcgccaaagaggggttggaaacgatttttgcagcgcagcgagatgcgttgaaataa

SEQ ID NO: 937 - DNA, 135 bp, Xenorhabdus bovienii
  Coding DNA location: Contig name=SeqID_16848; Position on contig =102263..102397bp; Strand=+
gtgttctctccgctgttaaaacattattgggggcgcattatacggcctaacgaggcgaatgcctatcctgcatctacgcggggcgttataatccgctcatcattctataaactggaaacgaattatgatccgtag

SEQ ID NO: 938 - DNA, 864 bp, Xenorhabdus bovienii
  Coding DNA location: Contig name=SeqID_16848; Position on contig =102387..103250bp; Strand=+
atgatccgtagcatgaccgcttttgcgcggcgagatatcaaggccgattggggaaacgcagcatgggaactgcgctccgtcaaccaacgttacctggaaacctacattcgcctgcctgagcaattcagaagccttgagccagtcattcgcgaacgtattcgttctcgcctgactcgcggcaaagtggagtgtaacctgcgttttgatctggatacccgtactcagggaaccttgatgctgaatgaaaatctggcgaaacagctggttgaagcggcaaactgggttaaacagcaaagcaatcaaggtgaaatcaatccagtagatatcctgcgctggccgggcgtgatgtccgccgaagaacaggatttagacgccatcagcatacaattgctggcagagcttgatctggctcttgatgcctttatccagagccgtgaaacagaagggcaggcacttaagacgctgatcgagcagcgtttggatgcagtaacagaagaagccagcaaagtccgccagcaaatgccggaaatcttacaatggcaacgtgagcgcttacagaccaaactggaagaagcacagattcagttggagaataaccgtcttgagcaagagctgcttctaatggcacaacgcattgatgtggcagaagaactggatcgtctggatgctcatgtaaaagagacacgtaatattctgaaaaagaaagaagccgttggccgccggctggattttatgatgcaggaatttaaccgggagtcgaatacactggcgtcgaagtcgattaatgcggatgtgacaaattcagcgattgaattaaaggtgctgattgagcagatgcgcgaacagattcaaaatattgagtaa

SEQ ID NO: 939 - DNA, 153 bp, Xenorhabdus bovienii
  Coding DNA location: Contig name=SeqID_16848; Position on contig =103275..103427bp; Strand=-
atgaaaaaattagggggtgtacccaaaatggttttcttaatgtgctatgggtacacctttgggtacacgccaatcatgcgctattgtgatttgctctgcaatgctctgatagtaaaaaagccagatataacaaagtatatactggctttatga

SEQ ID NO: 940 - DNA, 477 bp, Xenorhabdus bovienii
  Coding DNA location: Contig name=SeqID_16848; Position on contig =103441..103917bp; Strand=+
atgcctaaactcacagataaagagatcagggcatggattaagtcaggtgaaaggttcgaagggaaagcggacggtaacggactatatttacgttttagagaaattgaccgaattccatcatggcgtttcagatataaattggctggaaagtctaggactatgaatttgggaacatatgctgacttatcgctagccaaagcacgagaactcaccagagaactatcagcccgtgttgcgttgggctatgacgttgctggggaaaagcagcaacgtaaagccgaagcactggcaaaaattgaagctgaaaagaacgctataaaagtttcagatctagcagccgaatactttgagcgccaaatactgccacgctggaagcaccccgacatactccgcagacgaatacttactgggttgctatcgctcgtggtcatatatttaatgatggcaacaagcgcacagcgtttttcgtcaccatga

SEQ ID NO: 941 - DNA, 153 bp, Xenorhabdus bovienii
  Coding DNA location: Contig name=SeqID_16848; Position on contig =103914..104066bp; Strand=+
atgacctttctctaccgtaacggtatcaagatccgtgataacgacaatacgttggaaaacttaacggtggaggccgctacgggtgagaaaaccgttaatcagctagcacagcacttacgagagttagtggataatatcgcctcaattagttaa

SEQ ID NO: 942 - DNA, 1413 bp, Xenorhabdus bovienii
  Coding DNA location: Contig name=SeqID_16848; Position on contig =104165..105577bp; Strand=-
atgatagtaactgaggaaaatagttggagtgatcttttttccagcaaaaatgcggcgaatgcaatggcgctttcactgggtgtagcattagttgctattaactctttaattgcgattaccatcttgccttctgtcgtaaacgacattggaggtttgaatctctatgcttggaatacaacgctatttgtcgtgacatcaatcattggtgcgatactttccgcacgattattgagagctttgggagcgagaaaatcctatctgattgcggcactggtcttttttgtaggcagtttattctgtacgttggcaccgacgatggaagtgatgttgattgggagaactattcaaggatttgggggtgggttgttgttcgcactttcatattccatggtgaatctggttttcccccaatcactctggcctcgtgctatggcgttgatttctggtatgtggggcgtagcgactttagccgggcctgccatcggcggcatttttgctgaaatggacacatggcgttatgcttttggcatcatgttgccaatcacgctgttgtacgccttattcacctacctgattttaccgaaaaaaaatgcacagaatgaaaccaaagcggcattgccgattgtacagctgtttctgctgtcggctgcggttatggcggtttctgcaggtagcttgtcacaagatgtgaaggccaatattatcggtatcattgcagctgtggtattgatcgtattatttattatccatgagcgccgtaccctagtgaaattattgccccagaatgcgttgagtttacgttctccccatctggtattgttcacaaccatgttgttattagtgattggcctgtcggctgacgtttttgttccttattttctgcaagttctgcatggtcaatctccactggtttctggatatatgattgcagcagcagcggtaggctggacgattgcagaaatactcagcgcgggttggcagggggcaaagatgcggttctccattgtgagtggccctatttttatgttgcttggcatggtgttgctgattgttatgctgccgcgctcatcgtcaggtcagtggcaaaccatattgccgcttattcttgggctggggctatttggttttggggtcggttttggctggccgcatattgtgacccgcatcttacaggtttctgccgattctgataaagatatcgcgggggcatctattaccatcgttcagctatctgcgagcgcatttggttctgcgttggctggcatgaccgttaatgtgtttgggttttaccaacccggcggtgtcagtggtgcttcctcctcttcttattggttatttttattctttgccattaccccactattggcattatttactgcctggaaatcagcaaaaattcctgctgggaaataa

SEQ ID NO: 943 - DNA, 657 bp, Xenorhabdus bovienii
  Coding DNA location: Contig name=SeqID_16848; Position on contig =105672..106328bp; Strand=+
atgtcaagcattgacttggaaaataacatcataactgcacaaactgtgagcgagcggttattgatgctactgaaaacacgaggcgccatgcaagcctctgatgcaggcaaaatattgggaacctctggagaagctgctcgtcaacaatttgtgaaactggctaaagaggggctggttgaagcagaatcagagacaaggggagtgggtcgccctactcagctttggcatttaacggacaaaggccacgcccgattccctaatactcacgcagagctaacggttcaactgctgaccatcattcgcagtcaactcggcgaaactgccatggatttaatcatcaacacgcgtgaacaaaaaacttctgccagctataaaatcgcgatggaaaacgcagaggggttacaggaaaaaattgagcgtctggtcgcaatacgcaatcaggaaggttatatggcgcaatattcggttcaggaagatggcgcgattctgtttattgaaaaccactgtccaatctgtgccgccgccacagtttgccaaggattttgtcgggcagagctgaaactgtttcaggaaattctgcaagccgaagtggagagaacggaatatatcttgaacggtgcccgacgctgcgcctaccgcatcacaccattgaaatag

SEQ ID NO: 944 - DNA, 924 bp, Xenorhabdus bovienii
  Coding DNA location: Contig name=SeqID_16848; Position on contig =106391..107314bp; Strand=-
atgaaggtgcctttactgcctgttgtggttatgggttcggctacaggagatattgttctcaggttatctgaattaccccacagcggtgaatattgggaagctgaagaagttgatcggcaagtaggcggctgtgccttcaacgttgtgcgggcattgtgccgtcttcaaattccggttatcaatggcatattcgtgggtaatggtgtttggggagaacgtgtcacagaagagatggaaatgctcggattaacggtgacattgcgtcatccaaaacgtgacaatagctggtgcattgccatgatgacgcctgatgatgagcgcatatacgtttctgtccccggttgtgacgatagttggaatgccgatattctggcgactattccgcttccgaagccggggtatgtctatttcagcggctatgaattggcaaatcccaaagcaggcgctttgcgtgaatggttgctggcttctccctcagggctgacattggtattggattttggccctcgtttgcctgatatagatagggaatttattcaagcactgcctgctgaaagaacgatattgagtttaaatcttgatgaaacggcgatgctgtgtggcgccggcgatcctgtggtacaggctggccgttatgttaatgagcggggattcactgccattgttcgtcttggtgcagagggagcgtggatatgtcagccgggctgcgaaccggaatatattcctgcttatcaggtcaacgttgaggatactattggtgcgggtgatgcgcattgtggcggcatgttggctgggctgtctcaggggatgtcgctgcgtgatgcggtggaactgggcaaccgtgttgcggccgtgactgtcagccgttctggccctgatggcgcaccgactcaggatgaactgatggattttgtatttggttga

SEQ ID NO: 945 - DNA, 1416 bp, Xenorhabdus bovienii
  Coding DNA location: Contig name=SeqID_16848; Position on contig =107311..108726bp; Strand=-
atgatggaaaacgtaatgggtacacagcagaataatcagggattctggaaggtagaacacacaggtattgatattgtccctccttcagaacgcacgggtacaccgatggacctgttctggatctggtcggccgccaacattggcattctcggcattatttatggtgccatcattgtttcctttaaactctcttttctacaatctgcacttgcggtattgatagggctatccagttttgccttagtgggttatctcagtttcagcggtaaattgggaagaacttcaactctgacgctttctcgtaacatttttggcatcaggggaaatattgcgccgaccatgattttttggggcatctccctcgggtgggagtccattaatatcgttactggaactttgacactctctgcgttatttcaggcttgcgggctcgctgaaagtacacttttgaccgtgatcagcatgatattatttgcagggctgtcaattggcgtcactctgctgggaaaagagatgctcattgccatgcagcgctggattatccacgtttttggcgcgatgacactggttgtcgtgttctatattttgtttacgacagagtgggaagcggtgctggctatgccatccggcagttggttaacggggttcctgcctgcggtttcggtggttgcggcggggactggcatcgcatgggcggcgacgggagcggattacagccgctatcagagcgaaagttcttccaaattaaaaattttcacagcggtaaccgcgggaggaatgattcctttggtgctgttattgtttgcgggcattctgctctctgttcaattacccaatcttcccacatcagagaaccctatcgctcaaattggctcgattttgccggattggatggtgatcccttacttgatgacggcaacggcagggatagtaacaatggcagtcttgagcctctattctgctagcttgaactttttgacattagggataaaagtcaaacagatccatgctgtcaccattgattccattattgttctgactcttgcgatttatcttctttttgttactggcgacttcatggggccatttgtctcattcctgttattctgcggtgtgtttctggctccgtgggaggcggtattcttacttgattacattatcgtccgccgtaagcagggttattgtaccgatagtttgtacaatgatattggtccaaatggtggcattaaatggatccccgtattgtgttggttactgggcgcatttgtcggttttctggtgacgaaaaatgactttatcagtggtccatgggcagttggaatttttgcgaattccagtcttggcctgttcctgtcattttttgttagttttatttgttatggtctgtatttgatgctgggtaggtatacaagatga

SEQ ID NO: 946 - DNA, 105 bp, Xenorhabdus bovienii
  Coding DNA location: Contig name=SeqID_16848; Position on contig =108905..109009bp; Strand=-
atgaggcacttgaagaatcagaggctttgttggcttcgtcaagagttaatcgagtcggtacgtagtgctctggtcatagtgagattttttatggtactccgataa

SEQ ID NO: 947 - DNA, 783 bp, Xenorhabdus bovienii
  Coding DNA location: Contig name=SeqID_16848; Position on contig =109300..110082bp; Strand=+
atgccaaatcactttgttgactgggtacgcgaagaactgaaaaagaaaagtagtagtcctcgttacatacaattacaacaaaccattgaaattgcgattaaaaaacaattaataaacgaggatgattttttaccgcctgagcgccggttagctgaattgctcaatatatcgcgagtgacagtcagtaaggctatgcagctcttggaagaaaaaggggtgatcatacgccagcaaggtgttggtacgcaggttgccaaacccggagggggctcactcaatcaggccgtgggtttcacttcccagatcgtgaaagaaggtggaacggtatccaattattggttatcgcggcgtatcattcctgcaccggaagatattgccaagaaattatccattaacatcggtgaaaaaattgctgaactgcgtcgtatccgccttgctaacggtacacctgtttcccttgaaaatacctatattccccgtgaatatttgcccaatcctgaattattggaaggttccctgtatgcgcattgggaagagcaaggtattcatctcaccaacgtgaatcacaaaattaaggctattgcctgctctatggaacttgccatattgctcaatatcgctgaaaaatcgccattgctgcaaattcatcaaataagccagaacaatcagaacgagattattgagttcagtgaaatattatgccgcggtgatatttatgggttggatttcaatgcaccacagaatatcgacattaaatataataaaaaaagccgtcatcaatag

SEQ ID NO: 948 - DNA, 117 bp, Xenorhabdus bovienii
  Coding DNA location: Contig name=SeqID_16848; Position on contig =110154..110270bp; Strand=+
atggatgaaatgtatacctacattaaaaataacagggtaatagatcctcaattatggggaaatgtcccgatacggagaaccgatttcttcattgttcgtagaatccacgatcaatga

SEQ ID NO: 949 - DNA, 378 bp, Xenorhabdus bovienii
  Coding DNA location: Contig name=SeqID_16848; Position on contig =110348..110725bp; Strand=-
atgcaaggaacgacaatcatgtctcaatcacaacattttacccccgctttaaccgtattcatgctggtcaaaacaacccctgaatggctgggtttctctatcgaccaacgcttcaaacactttgctgaaatctttacccccatcatcaaaaaacatgccgccggtgtttcgctgcgtttttatgacgtcgagttttattcaacacgagtcacagacatctgggtatgggatgccaaagatcatgaaagctatcaactgctcgttgaagagttgcgtgaaacaccgttatgggatcggtactttgatatcgttgaaatccttacgggggtcgaaaatgcttacgctaaaaactatgggcgcgatgtcgtctcagcttaa

SEQ ID NO: 950 - DNA, 114 bp, Xenorhabdus bovienii
  Coding DNA location: Contig name=SeqID_16848; Position on contig =110674..110787bp; Strand=-
atggggggaatgcgagttgtgaacataagtaatagctcgcattatagaggcctcaacaacgaatgcaaggaacgacaatcatgtctcaatcacaacattttacccccgctttaa

SEQ ID NO: 951 - DNA, 648 bp, Xenorhabdus bovienii
  Coding DNA location: Contig name=SeqID_16848; Position on contig =110786..111433bp; Strand=+
atgacaacgttatcaaaccaagagcgaccaagattacgaaaacagccgaaacaagcgcgctccctcgcgatggttgaagcgattattgaggccactgctcgcattttggagcggcatagtcacgaaggtttttcgacaaatgccgttgcagaactggctggcgtgagtatcggttccctgtatcagtactttccatgcaaagatgcgctgatgggggcgctaatcgtgcgtgagtcagcacgacttatcaccgaagcacaaaaggcggtaacaaagacgagtgggcgtgccgggatttctgcctttattaagtcctgtgtcgatcaccaactgcgccgccctactttggcgcggttgcttgattttgaagaggcacgtttgccttttgatagtgatgtgcagcgggcgaatacacagttgcgcagcatcatcactgaattgctgataacccccgatattccttcccagactgatatccaggttgctacgcgagacgtgatggcaataatcaaaagcatggttgataccgcaggtgaatacggtgaatctgccaaatcagggcttacggaaagggttgaacgtgccgtatttggttatctgtctttcagatttatccccttctgccagacatctgacagaaagggatag

SEQ ID NO: 952 - DNA, 1728 bp, Xenorhabdus bovienii
  Coding DNA location: Contig name=SeqID_16848; Position on contig =111440..113167bp; Strand=-
atgcacggtatatcgggcaaccatgctattttcatcggtcggtgcaaaactgaactcaattgtggaactgaatggcgtatgaaaaaaaagataatctcggggatctatttgggggtgctgctgatcgcgtcctggataatagtgtttgaaaaaagcagtgatatctatccagcattagtttctgtcggcgtattcggtgtcatctttggtctgacgtttttggtttcagcccgttggctattttcggcggcgtttaccggaaccgtattcattatcatcaaattcatcaaccagataaaagtccattactacaaagaacacctgatgttttccgatttgaatgtcatgctagacccgtcaaatcaggaaaccctgcgtcattattggctggcaggggttgcgatggcagcgatgctagtctggttgatcttcaatatggtgttgagttggcgaaaagcagatcctgtgcgcgggataaaatggcgcgttgccagtgtggtgctggtcgccgccggtgtctgtgtcgtcaatctgaccaccaatgcttactacacaacatggcagggggaattgccgaaagggcgtggaaccatgactaacatgatgatgtcagctaaagatactgaataccagccgccccaatttggtgagtctgcggactattttctgcaacaggcaaaaagcgttaccttgcctgagcctcagtccgatgtgaaacctgatgtggttctgctattacaggaatccaccgttaatccccatatttaccaattgcctgccaatgctcagctgccggatctttatatgttccagcgtgatgtaggtgtcagcgctcaaagcccactcagagtgcaaacctttgggggtggaacatggctatctgaattctctgttttgacgggattgaacacggatgatttcggctcccgcaaaaatgcagtattttattttgtcgttgatcacctgcaaaacagcttgttccgcgccatgaaagataatggttattacaccgttgtactgacgccattcaataaatcggcctaccatgctggacacgcttacaagacaatgggtgttgatcgcattatccagccacaggaactgggttatccagccagtctggaggaaaatttatggacgatcccaacacaagatatgctgtcttatgtgaaaacgattctggccaaggagacggacaaaccgatctttattttctctctgacgatgtatgaacacggcccttatgatgaagggcatagcgatgattacggtttgacagacaaactggagggttcatcagcagtaggtaagttcagtcattatatggagaaaatcaaggcatctgatcctgctatcaaggatttcagtgaatttgttgccacacgcgataaaccaacgcttttcctctattttggtgatcatcagccaagtattcattttgggaattatgattctccgttagctgatccggcacacataactcaatttactatgcgggataatctggcgcagggaactgccattacaacaggcaagctgacggatatctccttcctcggtggtatgattctggaacgcgctcgattgacggcaccgccattctatcaggctaacatgacgatgcgtcatttatgtgatggtgcgttgaatgactgtcaggacaaagctctggtcgatagttataaacactatatttaccagcaattgaattcggcaggaaaagagtag

SEQ ID NO: 953 - DNA, 1875 bp, Xenorhabdus bovienii
  Coding DNA location: Contig name=SeqID_16848; Position on contig =113258..115132bp; Strand=-
atgatttttgctacagcaggccatgttgatcacggtaaaactatgttgattcaggcgattacgggtgtcgagaccactcatttaccggaagaaaaaaaacggggcatgactatcgatctcggctatgcctactggccgcaacgggacggcactgccgtggggtttgtcgatgtacccggacatgaaaaatttttgtctaatatgctggcgggtgtgggcggtattgatcatatcctgctggtcgtcgcctgtgatgatggggtgatggcgcagacgcgtgaacatttggctatcctgcggttaatcgggcgccctgccgttaccgttgtactgactaaagccgattgtgtcgaacaggcgcggattgatgaaatccagcagcaggcccgacaattgctgatgacacaaggttggcaatcagcgctcctgtttgtgacagcagcggcaacgggggatggcattgccgagttcaggcagcatctgatcgcgattcaccaacaacatcagcagcatgaaaaattgaatcaacgttttcgtctggcaatcgatcgtgcttttactgtcaaaggggctgggttagtggtaacgggaacggcacttgctggcagtatcaatgtgggtgacatgttgtggctgaccaatagtgatcaaatagacagagagcaaatagtcagagtacgtggcttacatgctcagaatcaaacaacacaatctgcgcaggcggggcaacgtatcgcactgaatatcgcgggggatatcagcaaggtacagatttcccggggtgattggctgctgtcacaaaaaccgctgtctgcgacggaaaaagtgttggtggaagtcgaaaccgatgaaccgctgcaaaactggcaatctctccatattcaccatgctgccagtcatataaccggccgtatttcgctattgaccccgcttttagaaacgccggtattagctgaactggtgttggatcaccctttatggctgacagagaatgatcgtctgatcctgcgggatatcagcgccagaagaacgctggcgggggcgcgagtgattaacctgaaccctccacgcaggggcaaacgtcagcctgaattcctgaactggttagctcaactggctcaatcttctagccatacggaaaatcttgccctgcatttaccgcgtggggcgctgtcactcagccattttgcatgggcgcgccaactgacagaaaagacactgaaccgtctgctgatcgatgttaaagccattattgctgacggtatgatgctgtcacaacctaacgcaatgttggcggaacaaaagttattgcagattttgactgaatatcacgagaaacaccctgatcagctgggattgggaaaagcgcgtttaaaacgaatgacgttacctgcactggatgacgcgctggtttatacactaattcatcttctgcttgagcgaaaagcgctaaaacagactcatggctggctgcatctgccggaacatgggctggcgtttacggaagagcaagccagcctatggtcaaccgcagaaccttatttcaaggatgaagcgtggtgggtacgtgatttagcggccgaaatgggaaaagaagaagaaaccattcgctatttgctacggaaagcagcacaactggggttgattactgccatcgtgtccgatcgttattaccatcgcaggcgcattcagcaattcgctgatgtgatccgtaaatataatcaggataacggcggaataaccgcagtggattttcgcaatgcattgggtgttgggcgaaaactggcgatccaaatactggagttttttgaccgcacgggatttacccgcagaaaatctgattggcatattctgcgggatgagggaatgttctaa

SEQ ID NO: 954 - DNA, 1410 bp, Xenorhabdus bovienii
  Coding DNA location: Contig name=SeqID_16848; Position on contig =115160..116569bp; Strand=-
atgacacaagaaatttatgggttgtatcgtcagttacctgctatcgacagcttgctgcgagagccggatatctttcagctcacggatcttcacgggcaggtgcgggtggtgaataccctgcgggaaatgcaggagcaggcacggtttgatatcagggagcatcaggcattgccagcatggagtgataactgggcaaatgcgttgtgccagcgcttgacgcaagatcaatcttcggcattgaagcccgtgtttaacctgagtggaacggtgctgcataccaatctgggtcgggcagtattggcggaatccgcgattgaggcggtgacaaacgtgatgcgctctccggtcacgctggaatattctctcgatggtgcagggcgcgggcatcgtgatcgggcgctggccgatttgctgtgttctctgacaggtgcggaagatgcctgtatcgttaacaacaacgccgctgcggttttgctggtgctggcaacggtggcgcagggtaagcaagtcgtggtttcccgtggcgagctggtggaaattggtggcgcatttcgtattcccgacgtgatggtacaggcaggctgccacttggttgaagtaggaaccaccaaccggacacatctgaaatattaccaacaggcgatcaatccagaaacgggtttgctaatgaaggtacataccagcaactacagtatcgaaggctttaccgctgaagtttctggtgccgaactggcaaaattgggaatgacctcccaggtagccactgccgttgatcttggcagtggctcaatggttgatatgacacaatatggcctgcctgcggagccgataccacgggattacctggaccacggcatcgatctggtgactttctccggtgataaattactgggaggcccgcaagccggcattattgtcggcaagaaactgtggattgaggctatccagcgtcatcctctgaaacgtgcattgcgggcagacaaaatgactctcgccgccctagaggcgacattgcgcctctatcaacatccggaacaattgtgccaaaaactgccgaccctgcgtctgctgactcgtccgcaagccgaaattcgtgatatggcgcaccagttactccctcacattcaggcatattacggcgagacattcattgctcgcgacgaaccttgctattcccagattggcagtggttcattgcctgtcgatcgtctgcccagttgggcgctgacttttactgccattgatggacggggcagtacgctggaaaaactggctcaccaatggcgcaatttagaaaagccagttattggacgtctgtatgatgggcggttatggctggatttacgttgccttgaagatgggaatgccttgttgcagacgttgttgttacaggaatcgttacagaaatag

SEQ ID NO: 955 - DNA, 924 bp, Xenorhabdus bovienii
  Coding DNA location: Contig name=SeqID_16848; Position on contig =116587..117510bp; Strand=-
atgagtattcgcatcgtacccaaagatcagctaggcaaagagcgcgtgaatgaaaggggagccggatttatccctccgttgttgtttgccaacctgaaaaacctgtatcaacgccgtgccgagcgtctcaaagcattggcgacagacaatcacccattctcaagttatctcaattttgctgcggaaattgtacaggcgcagcaaaaagcgctgtatgacaatccattgaatatggaattggacgatattttattgcaaacaaacagtgttccgctggattgcaaaaccattccccgaactcagcattggcataatatcctgtattccctgatcgccgaattattgcctacgatgcctgagcatgtgaagcctactcttgaaaatctggcaaaaaattctgtgcaggaattggaagaggtggccagcgcgctgctgaccacggaatttgccaaggtcagccctgatcaggcagtgtttgtctgggcggcactgtcagtctattgggcgcagatggccagtttgatccccggtaaagcgcgggctgagtacggtgagcaccgtcagttctgcccggtctgtggcagtatgcccgttgccagtgtcgtgcagattggttcgagccaagggctgcgctatctgcactgccatttgtgtgaaagtgaatggcatgttgtacgcataaaatgcagtaactgtgaacagactggcgatctgaattattggtcgctggaaagcgaacaggccgcgattaaggcagaaagttgtggggattgcggtagttacctgaaaattctgtatcaagagaaagatcccaacgtagatgcggttgcagatgatctggcatcactgatccttgatgccaaaatggaggaagaaggttttgctcgcagcagcctgaatcccttcctgtttcctaacgaataa

SEQ ID NO: 956 - DNA, 144 bp, Xenorhabdus bovienii
  Coding DNA location: Contig name=SeqID_16848; Position on contig =117497..117640bp; Strand=+
atgcgaatactcataacctttttaccttttatctttctggctcggtggtctattgtagtcccatcattcgtaagcagtaaccctttgcttagggcaaatttgtattattggacattgtcattccatctgaatgatgggaaataa

SEQ ID NO: 957 - DNA, 792 bp, Xenorhabdus bovienii
  Coding DNA location: Contig name=SeqID_16848; Position on contig =117754..118545bp; Strand=+
atgattcagaataaaaaatccgtccaattatcacattctgttgttcattattactgtgtgggagaaggtgatggcattgtgtttttgcacggaactcacagtgatggagaaagcagttttggtcatatcgtcagtgaattcgcgaaagacaacacggtaattattcctgattatgccggatgtggaaattctacccttccacaaggcgaaatcacggttgatcaattggcagagcaaattgccgcgatgatcaaagacagtgcaaaatcccctgttactttggttggcacatcattaggcgctgtcattgccgccgttgtcgctgccaattatcctgaattaatcagcaaactggtattaaccgccccttgggcaaggggccaagatgccagacaccagttgatgtttcaaacttggttggcattagaacaaaacgccccagacagcgccacggcttttggcctttctcacgtattaagcccggtgtttctgacctcattgggcagtgaaaaaatcaaacagatttgcagtaaagcatcggcaaaagatacggataaaagaattcaacttgggctgaatatcgatattaatgagtcattaagcatgataaagcagcctactttagtgatagggttggagttcgatactctgatcccgctttatcaagtaaagacggttcatcagaaaataacacagagccaatatagtgaaatagccagtgggcatgctgtacaactggagaatccacaggattggataagttgtattaaaaactttttacagagaaagtga

SEQ ID NO: 958 - DNA, 150 bp, Xenorhabdus bovienii
  Coding DNA location: Contig name=SeqID_16848; Position on contig =118889..119038bp; Strand=+
ttgtctcatctttcttttgttttattatcacatctctattttagtgatgtttttttaaaagccatagatcatagaaattcaaaatggaggggaaaggcagggcatactaaactatttaacgttgagtgtagcccacatgggcgtggatag

SEQ ID NO: 959 - DNA, 93 bp, Xenorhabdus bovienii
  Coding DNA location: Contig name=SeqID_16848; Position on contig =119272..119364bp; Strand=-
atgagtatcaatcagaaaaaaataactcatacaagattaactaattgttcaacatataacagtcattccgcagctatatctgtaatatactga

SEQ ID NO: 960 - DNA, 546 bp, Xenorhabdus bovienii
  Coding DNA location: Contig name=SeqID_16848; Position on contig =119321..119866bp; Strand=-
atgtcagtaaaatggaaacttataaagaataaaaaagttatattttctatcgtgataatagctattgtttctatttattatatcgcatcttataaatgggatgtgaaagatgctatcactagttatgttgataacaactgtgaatggaggaacgagtgtctagtcgattttcggaatgtgataccatttgagtgggatagagcttacatctttcaacctggtgatgcgccggaaaatatcaatatagccattggtatgaaatacagtttcgttgatgttggtttaaaatttatttttattaaagggaacgaaattgtttactcagaagagtattttcctgatccggaatttgaggaaaaagcacacatttacccgaaatttaataacgaaggaagaaattttccagattactattatataacaaaagaaaacagtaaaatatttattcaaaatacgagcacaacttatggagccagacaatcctacgttgtacgtccatcaaatgagtatcaatcagaaaaaaataactcatacaagattaactaa

SEQ ID NO: 961 - DNA, 93 bp, Xenorhabdus bovienii
  Coding DNA location: Contig name=SeqID_16848; Position on contig =119906..119998bp; Strand=-
atgagtgattcgattgaatttcgtattatcggtgatactattgggcagagagctaatgtttggcgagtcagtaaatttttattcgtgcagtag

SEQ ID NO: 962 - DNA, 126 bp, Xenorhabdus bovienii
  Coding DNA location: Contig name=SeqID_16848; Position on contig =120064..120189bp; Strand=+
atgcgttctgagcacgtccggtcgctcggttgggtgcgggtgaaactactgaagaatgagttgggaccgcggtcccattatcgtactatgattcggatgcatcatctggttaaaattaaaccataa

SEQ ID NO: 963 - DNA, 471 bp, Xenorhabdus bovienii
  Coding DNA location: Contig name=SeqID_16848; Position on contig =120279..120749bp; Strand=-
atgcagcactctccctatccagccgtacttgatgcatgtgttttatacccggcaagattgcgcgatttacttatgcatttagggctggctggtttgtaccaacccaaatggtcggacactattcaggacgaatggaagcgaaatttactaaaacagcgcagtgatataaagcccgaagtactggaacaaacaacaacattaatgaatacagcattgccggatgctaatgtcacaggatttgaactgttaattgaagggctcagactacctgatgaagacgatcgccacgtgctagccacagccatacgtgcaaatgcagaagtcatagtcactatgaacttgaaagactttccgcccaagattttggctgaatttgatattgaagcgcttcatccggacgagtttatttcagacctttttgacttaaaccacgcagctgcgctggaagcggtaaggcagcaacatatataa

SEQ ID NO: 964 - DNA, 465 bp, Xenorhabdus bovienii
  Coding DNA location: Contig name=SeqID_16848; Position on contig =120753..121217bp; Strand=-
atgaacaacacaactttaaccagcttgaatcttccagcacaacatgagattgaaatcgcaatgcgtggccaacgagagctggccacgtttctttctactaaatccgaaactcagcagattatcattaacggtgctgataacgtgtcgcaccaaattgaactgcctacctcggtattaaccatgctgatgaatatactgggtgaactggcggtaggcaacgccgtacaaattgtaccagtacatgctgaactaacgacgcaggaagctgcgaatataatgaatgtatcgcgtcctcatatggttaaattattagaggacgggaaattacctcatcataaaacagggcggcatcgtcgagtgttattcgccgacctgatggaatacaaaaagaaacgtgatgctgacagcatagctgctatgcaagagcttgctgctcaggcgcaagaacttaacttgggctattga

SEQ ID NO: 965 - DNA, 519 bp, Xenorhabdus bovienii
  Coding DNA location: Contig name=SeqID_16848; Position on contig =121363..121881bp; Strand=-
gtgaggcagggtaccaaacagattgttgaaacatatccaaatgatttagtcacctcgtctcagctgcgtacattagggttcaacattccactgacaaaacggtatttagaattcgcagctgatgcattagaacaggaaattggcgaaaacggtcgatatcagcgggtagataattctccaaatatcattattcaggacgatgaggatgaggaactggagactgacatcattgataatgaatccattgaggatgatgagatagaaattaatgatgatactgccgagaacggatctgaaccagaacaggagcctgaacctaattcagaatttgaggaaaaactggaacagatagaacaaccagaatcagcagaacgcccacgattttctgcaccacatcgccgtaacgatggtcagtggatagttagattcgaatatagtggacaaaattacgcatgggttggtcaggcggacaacctgaaagatgcgatgattcaggcgtggcttgcgtattttgattaa

SEQ ID NO: 966 - DNA, 642 bp, Xenorhabdus bovienii
  Coding DNA location: Contig name=SeqID_16848; Position on contig =121884..122525bp; Strand=-
atgaaaaagcgcaacgatatcattatccgtcattccccgattgaacgaatcaatcactgggccgtcgttatcgtcttcttgttcaccgccatcagtggtttgggattctttttcccttcgttgaactggatgatgaatatctttggtacaccgcagttgtcacggatactacatccgtttgccggctccgtgatgtttttcctgtttgtctttatgtttttcagatatttcaaacataacctgctcgacagggatgacattgagtgggcgaagcatgttcacaacgtgttgcgtaatgaggaaaccggagataccggccagtataacctcgggcagcaaggcatttactggtctgtcagtgtttgcctgctcctgttgctggttagtggcatcatcatctggcgtctttacttcgcggaatacttcccgatcccgctgattcggattgctttgctggtgcactcgctgtcagccatcagcctgatcctgaccattatcgtccatgcttatgcggcattctgggtcaaggggtcggtgcgggcgatggtggaaggctgggttacgcgcggctgggcgaagaaacaccatccgcgctggtatcgtgagattttgaaagcagaacagcagaaagagaaagaataa

SEQ ID NO: 967 - DNA, 609 bp, Xenorhabdus bovienii
  Coding DNA location: Contig name=SeqID_16848; Position on contig =122522..123130bp; Strand=-
atgcactgtgccgatccgggctgtctgacagcctgccctgcggaaggggcgattatccagtatgccaacgggattgtggattttcagtcagaacactgcatcggctgtggttactgcattgctggctgcccgttcgacgtgccgcgtattaacaaggaagacaatcgggcctataaatgtaccctgtgcgttgaccgtgtgggcgtagggcaggagcctgcctgtgtgaaaacctgtccgacaggcgcgattcatttcggcagtaagcaggatatgaaagcgttggcggcggaacgagtggaagagttgaacgggcgcggttatgacaatgcgggtttgtacgatccggaaggcgtcgggggaacgcacgtcatgtacgttttgcatcatgccaataagccgaagctttatcatggcctgccggataacccgaccatcagcccgacggtgacattctggaaagggatttggaagcctctggcggcgataggttttgccgcctccattttccattatgtcggaattggcccgaatcgcgtatcggaagaagaggaagagagtgcgcgcaaggatgttgaatcttcagccaatgaggaagaacagcaatga

SEQ ID NO: 968 - DNA, 279 bp, Xenorhabdus bovienii
  Coding DNA location: Contig name=SeqID_16848; Position on contig =123152..123430bp; Strand=-
atgtcattgcagactcaagacatcattcgtcgctccgccaccagctctctgacccccgcaccccgtgtgcgggatcaccagcaggaagtggcaaaactgatcgatgtcacgacctgtattggttgtaaagcctgtcaggtagcttgttcagaatggaatgacattcgtgatgaagtcggccataacgtcggcgtttatgacaatccggccgatctgacagcgaagtcatggacggtgatgcgattttctgaagttgaggaatatggcaggctggaatga

SEQ ID NO: 969 - DNA, 2412 bp, Xenorhabdus bovienii
  Coding DNA location: Contig name=SeqID_16848; Position on contig =123443..125854bp; Strand=-
atgaccaaccactgggtggatattaagaacgcgaacctgattgtcgtgatgggtgggaatgccgctgaagcgcatcctgtcggtttccgctgggcaatggaagccaaaattcacaacaacgctagactgatagtgatcgatccacgttttacccgtacggcatctgtggcggatttctatacgccaattcgttccggtacggatattaccttcctgtcaggtgtgattttatacctgatgaacaatgaaaagattaaccgcgaatacgtcgaggcttacaccagtgccagcctgatcgtacgggaagacttctcattcgatgatggcctgttcagcggctatgatgcggaaaaccgccgctacgacaaaaccacatggaactacgcgctggatgaaaacggttttgccaaacgcgacaaaaccctgagccatccacgttgtgtctggaatctgctgaaagagcacgttagtcgctatacgccggatgtggtgaccgatatttgcggtacaccgaaagaggatttcctcaaggtgtgtgaatatctggctgaaaccagcgtaaaagacaaaaccgcgactttcctgtatgcactgggctggacgcagcactctgtcggcgcacagaacattcggactatggcaatcatccaactgttgctcggtaatatgggcatggctggcggtggcatcaatgcgctgcgtggtcactccaatattcaggggctgacagatttggggctgctgtcccaaagcctgccgggttatctctccttgccatcggaaaaacagaccgatctgcaaacttacttgcaggccaataccccgaaatccactgtcccggggcaggtcaactactggggtaattatcccagattctttgtcagcctgatgaagagtttctacggcgatcatgcccacaaagagaatgactggggtttcgatctgttgccgaaatgggataagccgtatgacgtcctgcaatatttcgaaatgatgtcacaaggggaagtgaacggctatatctgtcagggattcaacccgatagcgtcgttcccgcacaagaacaaagtggtggccgcgttgtcgaaactgaaattcttggtcacggttgacccactcagcactgaaaccgcctcattctggcagaaccacggcgagtttaacgatgttgatccttcttccattcagaccgaagtcttccgtctgccctcctgctgttttgcggaagaaaacggctcgatagtcaactctgcccgttggctgcaatggcactggaaaggtgcggatgcgccgggggaagcgatcagtgatggcgaaattttgtctgggatcttcaagcgcatgcgggatatgtaccttgaagaaggcggggcttttcctgaacaggtgttgaacatgacatgggattattttgatgccgataatccaacgccagaagaagtcgcgcaggaaagcaatggtcgagccttagttgatttgctggatgccaacggcaatgtgctggtgaagaaagggcaacagctctcatcctttgcacaactgcgtgatgatggaactaccgccagtggctgctggattttcgctggaagctggacaccggaaggcaatcagatggcgcgtcgcgataatgctgatccgtcgggtatcggtaatacgctcggttgggcgtgggcgtggccactgaaccgccgcatcctgtacaaccgcgcttctgccgatccacagggcaaaccgtgggacgctaaacgccagttgattgcgtgggagggtgataaatggagcggagttgatatccctgactacagcaatgcggcaccgggaaccgatgtcgggccatttatcatgcagcctgaaggtatggggcgcctgtttgccatcgacaaaatggcggaagggccattccctgagcattacgaaccatttgagacgccgctgggaaccaacccgctgcatccgaatgtcatttccaatccggctgcccgtatcttcaagagtgattttgaatccttgggtaaggcagataaattcccttatgtaggcaccacttaccgtctgaccgaacatttccacttctggacgaaacatgcgttgctgaacgccattgcccagccggagcaatttgtggaaattggtgaacggttggcggcggagaaaggcattaaacagggagataccgtcaaagtcagttccaatcgcggctatatcaaagcaaaagcggtggtgacgaagcgtatccgaaccctgaatgtgcatggccgtcaagtggatactatcggtattccgattcattggggttttgaaggtgcggcgaaaaaaggttttctggcgaataccctgacgccgtttgtcggtgatgccaacacgcagacaccggaattcaaggcatttttggtcaatgtggaaaaggtgtag

SEQ ID NO: 970 - DNA, 588 bp, Xenorhabdus bovienii
  Coding DNA location: Contig name=SeqID_16848; Position on contig =125903..126490bp; Strand=-
atgcaagtcagcagaaggcagttctttaagatctgcgctggcggtatggcgggtacgacggcagccgcgctgggttttatcccaaccgccgcgcttgcacaaacacgtaactataaattattacgtgcgcgtgaaacccggaatacctgcacatactgttctgtcggctgtgggctgttgatgtacagcctcggtgatggcgccaaaaatgccaaagcaactattttccatatcgaaggggacccggatcaccctgtaaaccgtggcgccctctgtcctaaaggggctgggctggtggattttgtccacagcaaaaaccgcctgcactatccggaatatcgtgcccccggctccaatcaatggcagcgaataagctggcatgacgctttcgaccgcatcgcgaaactgatgaaacaagatcgcgatgccaatttcatcaaaaccaacaatgacggtgttgaggttaaccgttggctgacaacggggatgctctgcgcctccgccgctagtaatgaaaccggctatttgacacaaaaattcactcgcgctctcggcatgctggccgtagacaaccaggcgcgtgtctga

SEQ ID NO: 971 - DNA, 159 bp, Xenorhabdus bovienii
  Coding DNA location: Contig name=SeqID_16848; Position on contig =126517..126675bp; Strand=-
atgatactgtttgtgtggataaatcgtgagcgtagggagtttacacgatttaaacgcatgatgttgttgacagacagaatccaaaatgaaaagaaaaacattcataaatctaggcctaaaattgcatacctacgggttttccgtcagggcatgtgttaa

SEQ ID NO: 972 - DNA, 831 bp, Xenorhabdus bovienii
  Coding DNA location: Contig name=SeqID_16848; Position on contig =126703..127533bp; Strand=+
atggataatgcaaattcaggaaacaggttaataatcgacgagatttgcggagccactcgcatcaatgtgcaacaaaaaaaccatctgaatagcccaaaaccggactgggtggcagaagaagtcccgattgcattggtctacaacggtatttcccatgttgtgatgatggccagccccaaagatctcgaccatttcgcgatgggcttttcattatcggaaagcattatcacttccccacaggaaattcacggcatagataccgtaatcagttgccacggcggtattgagctgcatatcgaactttccagccgccgttttgcggaattaaaagaacgccgacgcaacatggcaggcagaaccggttgtggtatctgtggcaccgaacagattgccgaaattttccgtccaattccctccttgcctttcacccagactttttcattggattatcttgatcaggcgcttgcacaattaccccgtcttcaggaaatcggcgcggccacaggttgtacgcatgctgctggctggattgatgctaaaggggtattgcttggcggcagtgaggatgttggccgccatgttgcactggataaattattgggaatgcgagccaaaacgggctggcggcagggcgcggtattggtttccagtcgcgccagttatgaaatggtacaaaaatccgctatgtgtggtgtagaaattttgtttgctgtttctgccgccacctcgctggcaatcgaagtcgcggagaaatgcaatttgacactcgtgggtttctgcaagctgggacgggcaacggtatatacccatccacggcgtctggtggattaa

SEQ ID NO: 973 - DNA, 765 bp, Xenorhabdus bovienii
  Coding DNA location: Contig name=SeqID_16848; Position on contig =127530..128294bp; Strand=-
atggacgctaaaataatcattcaatctgcggaagagagggctgatttagacgaacaaatatatgatcttgttcgtcatttatggcctttttttatgaatcaagatcctgttgcccaacaacattgggaaaaattatatgaacccgatttcagtcgcttccagaaatttgccattctgcaacaagggcaggaagagcgccttattgggttattgaatgccattcctttcccgtgggaaccgcacgctttggatcaattgccggatgaaggatgggatgccgtgtattgcgcaggaatggcagcaaaaggaaaacaacagccgaccctgctgtcagcactttcggtgaccgttgcccctgaattccgtggacataacgtgcctgcgttattgatcaacagcgtgaaacagactgcccgtgaagcgggattgcagggttttgtggttccggtcaggccgagcctgaaatgcagttatcccctgcaagatttcgttcagtactgtgaatggaaaaatgaaaaaggtgagccttttgacccttggatccgcactcattggcgcttgggagcaaaaatcattaaacctgcgctacgctctatggatatttacggtaccgtggcggagtggcaagaatggacaggcatgaaattcccacaaagtggggaatacatcattccgggcgggttggtgccgctgctggtggatgttgaaaaacagatgggctactacattgaacccaacttgtggatgttccatagtcttgattaa

SEQ ID NO: 974 - DNA, 750 bp, Xenorhabdus bovienii
  Coding DNA location: Contig name=SeqID_16848; Position on contig =128893..129642bp; Strand=+
atgaggataatgatgaaaaagatcaatgtattagtcgccgctttaggcgcattagggtttatggcacaagctcaggcaagtgttggatttggtcagagtcaagaagacactacacctcacattaaggttggtgccaccaaagcgagttcaagtccacacggtggctcaggtgatgaaccaggtattggcgtcagttccgttcgtgacggtatgcttatcggtttttccggattaacccgtatggctcctgctgacagcaatggtattcataatatctcgatggcaggcgcacccggctctcacggtggtatgggtgtattccatttcagcaaagtcgccaatgcggacgtttactttggcgaatggtcagaaacaggtaatgcaacagacacaacccataccgtttattatgcgggcaaggacattaccaccaatatgccaaccgatggtacagctacctatgtggtgaacggtattaaccagtacagcggtgacaatgccctttccggcacattaacagcagattttggtgaaaaaacgctgatcggctccatagaaaataccgctatgacagtcagcattgatgccgatatccagtctgatgcccaattctcaggtcttgctacaacaggcgatcttgagggagaaacccaaggtcacttctttggtgatggcgcttccagtctggcgggatatgccacatttgatgataaatccaaggataccgctttcggtggttcgaaacagtaa

SEQ ID NO: 975 - DNA, 1479 bp, Xenorhabdus bovienii
  Coding DNA location: Contig name=SeqID_16848; Position on contig =129759..131237bp; Strand=+
atgtctgacaatataacaaccccaatattattaacggcactgatggccttatgcctctccctgcccgtttatgctgatgaagataccaaccgcaaaatctggcaggaggcgcagcacaatcaacaagaaaatgaagctgatctgataacgccagagcctatttttattgaggatggcgcttcatcgattgtcattaacggacaaacatttcaggtagaaaacaacctcaataacatcggtcaggcgctataccttgccactaaccatcgacagtggccggacgtcagacgttttctgacggcttatcaaaaactatccgggcatgatgtcatgctggtctcttttgcccaaggcggcctagcgcgttttgaaggcgatttggatctcgccgcctatcattatcaaaagctcctgaaccaacaacccgacttcacacgcatcaagctggaactggcccgtgtctattttgaaaatcataaaaacagggaagccgagcaactgtttgcgggattgagtgaacagaccccgttaccggaaacggtcttgaaaaatatcaacagctatctgaaagcaatagcattgagaagtgactggcgtggctctttttcggtgggttatgcctataacgataatgtcaatatgtccccggatcaggaaccaacctgccttacctataaccctgatgggagttgctatgagaaactccatataccaaaagccattaaaaagtggggaatgtcttatgacgccaccctaagccgacgttaccaactttccggtcatcacggtatttttgggcgtggcctgatttatggcgaaaactaccgtgattaccacgctgaaaatgaaaataccgtcctgctggtcagcggatacaactataaaagcagaaatcacgatttctcttttggccccctgcttgaatataaacaacgggcgggtgatacctattatcgcgccacaggtgttaaaacggaatggagacaaacattcagccctaaaacggctctcaatatcgagctggagcataaacaactgcggcatcagcagcgttaccactggaaaaatggcgacctttcctcttcctatctcactctatcccatgccatcagcaaagaatttgtcgtatttggtggcggtgactgggtctatcggaacaatccgcaaccggcggatcgctatcaacaatggggaattcgggcaggcatatccggacagatctaccccggtattaatggctcactgtctgccacactgcgagagcggcgctttggtgcttacagcccgatactgcacgccagacgtcaggacgatgaacagatctatactgccgtcattaaagtccctgccgctgaaatattgggtatgaccccctctatcactttccgccatcgacgcaatcacagcagtgtgaattggcggtacaactataactataacaaaaacgaagtactgctgaggctggaaaaatatttttaa

SEQ ID NO: 976 - DNA, 2934 bp, Xenorhabdus bovienii
  Coding DNA location: Contig name=SeqID_16848; Position on contig =131300..134233bp; Strand=+
atggcataccgagttaaaatacagctaacccccattacaattgcactatcactggtattttcgctgacagcacctcccctgtttgccgaacccaaatctaccgtcacttctccaagcaagcagacggatttaggcaaaattcgtgtcacagataacagtgataaagatgaagccagtcatgatgcggtctatgacaaagatatctcaaatatctatatcggcaaggaacagatagagcgctataaaggggcatctccagccgatctgataaaaggtgcggtaggtgtctacagcggtgatgcccgtaatagcggcgctttggatatcaatatccgtggtattcaggggcaagggcgcattcccgtcacgattgatggtacggagcaggctattacagtgggacgcggttataatggcgccaataaccgcaactatattgatcccaatttaatcaatagcatcgaaattgaaaaaggcccttccctgaaccgcaacgtcaaagggtcaatcggtggagccgtggttatcaaaacattaaccattgatgatgtcgtgccaaaaggggaaactttcggcatcaataccaaactggaaaccagcagcaattcagttagggaacgcaagccttctttggcactgggacaagactaccgtgatgttcccgactttatccaaaatggtgtcgaagctgatcctgagctgaaaatcacgccccattcgtcaaaagacaataaatttcccggatttaaagataatgctttccgggtcgcattaggaacgcggcaggaatattttgatctgatgctggcttatagctaccgtcgtcaggggaattattttgccggcaaaggcggtgcacaccgctatgatgaacctatcacggcagcagataccgaattaatgaatggctataaaacaacgttagatccttacctaccgtttgctgcccatatctatcgccccggcaatgaagtacccaatacttccagtgagatgcgctccgtgttaatcaaaaatacttggcgcctcaccgatgatcaggcattacagttaggttttcgcaatactcacatggaatttggcgatatcatgccttcgcgcttaggctgggtgaaggccgaagataatgctgttccacaatggccactggcgaatgtccaccagcaggccgtcaatctgacttataaatggcaggcggcggacaacccctatatcgattttgatatgaatctctggacgacccgcacgacaagcaatactaataccgctgggggatatccccgaacgcctgtagagagggactactcttgggataatggcagtggtgtcaaagcctctcacattgatggctcgttgattgataccgccaaaaccaatgcccaaaacaatcgctggggcgtggatatctccaataaatttaccttggcttccagtttggatctgaccttaatgggaaatttccaacgcgagcatctcgactccaatgatggctacaaccccttaaatatgtacttcttccagtcgccagcacggaaagggcagcgtcaggaaatcaatctcgcctttaactttgactggcggccaacatcatggctggcactaagtgccggtgccaaacgtgtctcctattggtccaaagatgactttcttaatgaacgacgtgcagcaagagatgcccgttatagaaataactcggaaaccaccgggcatcaaataagttactaccgaacgatgaccgaaagagaagcttatataaaacagaaaaaactgtctaaaatgagtagagaagaacgaactgaatattttaaggtaaaaacaggagatatcacctctcgcgatgggcagcagcgcaaaatggttcgtcaagaagtcgactggctctacaattccagcaatggccaacttaataaaagcgataacccctactttaatgggcagttggatatgcaggaaaagattatcgacccaatgacgggtaaagagggatataaatatgaatatggctcaggagttgatgcaaatggtataaggcgtgagattcctgatgctgatccctgggaacctgcctctaaacgcaaagatcacgcgtgggcgcccactttctctgccacggcctatattacagacgatttccgtatctatacccgctatgccgaagccgtcagaatgcccagtatttttgaagatactgtgggtttctccggtaacaaaagcaatcgcgtaggccagaaattcaaacccgaacgcgccaaaaccactgaagttgggttcgtctatgatttcagccagttggttgatgcagaacgccatgccgatatcaaaatgtcttactacaacaccgtgattgaaaatgtgtttgaccgggataacacctatgagttttcccaaatggacaaacagaaacttgccggtctggaactacaggcgcgttacgacaatggcagtttctttaccgatatgggattaacctacaacctgaaaaataaagtgtgtgacaacaattcttcattgagaatgaattcattgaatcgctacgatataccagaatgtattgatggcggttttgcgggaggctatctgcgtacctccattcagccccgatattcagcgaatctgactgtcggcgggcgcctgtttgatgagaagctggagctgggcagccggatgttctaccacagcaaagcagaaaacaaagacgaaaaatggttgatggaaacattacccgatgtctataaaggccagtcaaataacccaatgcgctggaatccggttctcaccgtcgatgcctatgttagctaccagatcacgccaaccctatcgatggaactgaccggaacgaacttaaccaatcgctactatctcgatcctctgacgcgctccatgatacctgcgccggggagaacctttaaactcagtattaccagccagttttag

SEQ ID NO: 977 - DNA, 801 bp, Xenorhabdus bovienii
  Coding DNA location: Contig name=SeqID_16848; Position on contig =134242..135042bp; Strand=+
atgactaacacagccatattggaaagcccagccaaccattttccgcttctgcccggaaagcaacttctggttggtatcctgattgccattttattgcatatcagtctgatatggctgttcaatcgacatgcctcatatgatgacagcgctcatcatgtaaaccaaagctcgcccttaacggggctttccatcacgatggtagccgcttcatcatgggcgaatgaaccagagtctgtctctcctccgccaccgttgatcaccgcgcctgaatcgccgacaaagccaaagattgctctggataaagcggttcagcccgaaagtaggctggaaaaaccactggaatccgtcaaaccgcaaaaacaccaaaagccgcaggagaaggcagaaaaaaaatcagcgctatcaccacaagttcaggacagtaatgaggaacttgaaaccagcggcaccgatcagatcaattcacaaagtagcatgagccgagccgcaactacacagcctctggtgggtcagggcaatagcgcactggataattacccatcaagactcaagcaagaagttgaaagccacaaacgttatccccgtaaagcaaagcgaatgaaacaacaaggcacagtgaccattggttttactctgcttaatgacggttcattcacggctgccagagtgattaactcctctggcaacagcgtactggatgatgccgcgctggatgccatcgctcgtgccagttcggttggtcccaaaccggcagatttggcacccgatgtaacacttgaaattgattttgagctggattaa

SEQ ID NO: 978 - DNA, 567 bp, Xenorhabdus bovienii
  Coding DNA location: Contig name=SeqID_16848; Position on contig =135039..135605bp; Strand=-
atgaaacatatgattatttatgcccaccctaatccaaaaagttttaatcatgctatcaaggaaaagattattagcgaaataggtaataagggtgaggaatatagttttatttccctctatgatgaaaaatttaatcctgtgcttgccagttcagattttgaagctctgcatcgtggagaagtattacccgatgtagcgaaaagtcagtctatgattaaagaagccgatcatcttatttttatttatcctatttggtggtttggtcagccagctattcttaagggatggatagaccgggtcttttccaatggctttgcttactatgaagatgacaaaatttttaccccttttctgacagacaaatccgcaacggtgtatgtcacgttgggtacggcaaaagaagtgttggttcagaatgacatggagatagataacttcatgcgtgacatgacacttggaacgctgggattagtgggtatttatcctgtgaatgttgtgcctttctatgccattcccacaatcagtgatgcagaaagaaattctatgctggaatcgattgttatttaa

SEQ ID NO: 979 - DNA, 744 bp, Xenorhabdus bovienii
  Coding DNA location: Contig name=SeqID_16848; Position on contig =135739..136482bp; Strand=-
atgttaacatttattgtcacaggcgcggctagtggaattggatacgtcgtttgccagaaacttgttgtagccggatattatgtcattgcaattgatattgaacatgatggattaaatcaactggttgaacagtcaccagaatatattaaagcaatccagattgatttaactgatgaaaacgcaataattaatgaagtattccctttgattaagagtggtaacttacagggaatcgtaatcagtcatggtaaagataatagcaatgatattgggcagagtgatatctgggattcgatattagcaaccaatttatattcaacacaacgcctattatcgcatgttgtacctgaaatcctccttggaggcagggttgtggttatttcttctattcttggtaaagcgggaaagaaacataatagtgcttattctgcatcgaaacatgccttactggggctaacaaagtcactggccttggatttggcagaacggcagattaccgtcaatgctgtcttgccttcttgggtggatacgccgatgttagtgaaggggttagagccgcaggcaaaattgcttggctgttcaacatcagccctgcttaaacgcattgaaaaacgtattccattgcggcgtttggtcagcccgcaggatgttgccaatacagtcatgtttttcatttctcacgatgcttccatgatcacagcccaaggattggtcattgatggtggagatagttgtggagcgtaa

SEQ ID NO: 980 - DNA, 765 bp, Xenorhabdus bovienii
  Coding DNA location: Contig name=SeqID_16848; Position on contig =136497..137261bp; Strand=-
atgagtgaaaacacacaggtagggcaagacgccgtaaaaaaatgtgccatcgtaacgggaggcagtaagggcattggccgggcaatagtgctaagtctgttggagaagggatatcgggtcgcgttttgttatcgaaatgaaatgcctcaaacagccgattttatcgctgaagtgacacacgattatcccgacgtactgccaatcagagccgatcttgccaaagcggaagatgtcagcacatttattaataccgtgagtgaggcgtttggccgaattgatcttctggtcaataacgcagggattaccagagatggattgttggccacaatggaaaccaaagatattgaactactgataaataacaatttattgagctatatcttgtgtagccgtgaagtattgaaagtgatgatacctcagcgtagtgggcatattatcaatatctcgtcgatttcagccaaaaggcccaataaaggtcagtcaatttatgcggccaccaaaggcggaatagaatcattgacgcgggcacttgctgttgaagtcgcagccaagaatattcgggtgaatgcggttgcaccaggcattattcagacggaaatgtcggaatcattattaaatacacataaagaattaattaataacaaggtattacttaaacgagttggcactgtcagagaaattacctcgtcggtacattttcttatagagaataattacataacgggggaagtgattaatgtcaatggtggaattgcattaagctaa

SEQ ID NO: 981 - DNA, 2859 bp, Xenorhabdus bovienii
  Coding DNA location: Contig name=SeqID_16848; Position on contig =137258..140116bp; Strand=-
atggaaaattacgctaggttttgtaagccattgcttacccgtgcattggtttctattggtttagacaaaacttatcatcgggcttcgggcaattttttgtattacaaagatgaacaggatcaggaaatacccgtattagatcttttaggaggatatggtgcgacattgcttggccacaattcccttcttatcagagaaagaattaagcactatcttgatgaagagataccggttcataaccagttttccatcagaaagcctgcggccgtcttggcagaaagattgaatgaattactgaaggaagaaactgcgaccagcggcgattttgtgttctgctttaccagcacaggagcagaatcgatggaagttgcgctgaaaagtgtcgaattcacacgtaatgcagagcttgtagccttggagcaagaggttgcacaggctactgctaaaataaacggcgggtcagtgattgcgctgacagatgagcagtgccagcagctgcaactagaggaaaaggcttctgcccaagatatccaacgtgcgttgactgcattcaaccagagtcggttagattcaaagccaacatttcttgcccttgaacatgcctttcatggaaaaatgatagtaacggcgaactgtacacacggtactatgtatcgtgattacttgaaacgcctgaaaatcaacacttatttcctttccactgagaaactgtctgagtttgttgagatgggagagaaagccaatgacattctgaatggttggttatggctgccacaggaagaaaatgaccggattatcctgacgaaaaagaaatttagaaccgttgccgcattgttgatagaacccgttcagggagaggggggcgtttacccacttagtgcagagcaggtaagcggagttaatcaactaaaacagattattagatgtccaatcattgcggatgaagtgcaggctggatctgggcggtgtgggtttctggtggcatccagtgatgtgggtattcatgctgattattatgtcctttccaaagcattgggtggagggtacgccaaaatcggggttgttgcgatccgtcaggagagttttactccggggtttgatttaattcaaagctcaacgtttggtgaggatgatttttcctgccgggtggctttggactatataaacttactgcatgctgatcagcgccagttacttaagcaagtcacccaactgggggaagagttcaaggtacggctccatgccctgaaagaagactaccccgatattattcgagatgtgcgcggaaaagggctgatctggggggtagaattccatgatgtagatgattcagattcttacattttgcaaaatatcgctgttcagggcagcctgggctatatcatcagtggttatttactgtgcggcagccatatccgtgttgcgccttcaggtagtgcgtccaatgtgatccgtatggaaccctctgtttttctggaacttcgggatattgtccggtttgtggatgagcttgccaaagtttgtctggcgattcgccatgccaatgcagggttcattgtggcccctatccttgggaagttgaatcaatccactcctgctgattatcgtagcagggaagtgggccaacaaaatggcagttcagcaaattataaggcggcgttcattaaccatctgatttctgcagactggctcagagaagttgatccctctttcagcattttcagcgatgaagaattggaatcgtttgtcgagagcaccagctttaatctggcgactaaacctttcaaacccgcacgtataagctcggttaatgggcagtcggtagactttacgctgtatccgattcctgtgacatcaaaaatgattaaggctgcactggcccaaaatgatttggcgcggttgaggcatgaaattgatgttcgtattgctcaagctgtggagtctggtaatacggtagttgggttggggatgtttacatcgattattaccaataatggtaaatcagtgaaaaataaccagataggtataacgaccggtaatgctttgactgtggggattgggattgaagccttgcaaagaagtacatcgcatcgagatataacccaaatgcggcttgcggtgattggtggtgcagggaatatcggtcgggtttatgcagaaattttggggccacaatatcaggaaatggtgctgataggcagtaataatcagggttcagtgagaaaactgaatgaagtgaaataccatatttatcaatatatctatgaacaatttattgtcaataaacagccgttaatgggtgggttggcacaaaggatcgtggattgtcttgcattgatgccagatgatgactttattagccagttcaatgagggtaaaaccagcataggtgaagccattgatcactatctggttcagcattatcccgatcaggtatttatccatatttctcagagtatttctgatattgagcacagtgatgtcattgtgtgtgccgccaatgcctcagaagcctttatatcggtagaccagataaaacgggatgcgatcgtttgtgatatttctgttccgcataacctttccgatgatgatttgaggaaccgaccggatatcaaaatactgcggggaggaattgtccagactcctcatcatgacagtctagatccgcgggtcagggcctatttgggagaaggtcagctttatgcctgcatgacggaaaccattttgctggcgttggaacagcataaagataatttttcatacggaaatatctctacccatcaagttctcgacattatggcgatcgcgaggaaacaccatttcaccctatcggatatcaaagagaattctagcttatga

SEQ ID NO: 982 - DNA, 777 bp, Xenorhabdus bovienii
  Coding DNA location: Contig name=SeqID_16848; Position on contig =140171..140947bp; Strand=-
gtgataaatagaggcgtaaaacttattagctataatgtgactagtcatcatccgtcattgaatagcttgaatcatgagaataatggcggtgagctgattaaaaatgacaagttgaggcgtttttattctatcggaacggaaaaaggcattatttcagcgcgaagagcgttaatgttatccggtttggatatcgctgatcctaataaaagatttggcctgtataccacacagtatggctatcttcatcctatgccttcggaattgaatcctgaacaggaagaacatggggcagagaatgaacatgaaatttatcaaactatctggaattcagtacaggtaagtcctttcttaattaccctatcgctcagtaataacctgctaggtgtgctttcccaagaattgagcctgcaatgcgattgtgcttcttttttacgtggaaatatcggtttgttgtcagcattcagtgaggctgagttattcctgagcaacggcatgattgactatgcattagtggtggcttctggcatgggaaatatcactcatgatgctcaatctgatggtgaggaagactttgtggaatttggcgtcacttttattctggcgaagggtgaaagaccgacactgcaagattatccgaccatcgatatttcctctctgagcagaatgtatcgtgaaggaaatcattgtgctgaagccgtcttgtttatcaatgaaatagcggactatatgtcagcctgtgtacggactgagactgccagccctagtctcaaaccatag

SEQ ID NO: 983 - DNA, 1326 bp, Xenorhabdus bovienii
  Coding DNA location: Contig name=SeqID_16848; Position on contig =140937..142262bp; Strand=-
atgcattgccattttgcttcgcatggggatgcccaaagagggggagttgtgatggtttctgatcgtcgcgttgtagtcacgggcatggggatcgtcagtgctttcgggactcatattgatgttttctggcaaaaactttgcgatggagaatctgccgttaaaccactggcgtttgcagataatggcgcattacctatcaaatatgctgcacagattgattttgattcactgattgccaatcactctgcgtacctgccggaatccgggatgacagacagacgtggagtgatgggaattattgctgcagccaaggcattggaagatgcggggctacatccggcacagcttgctgggaagcgcatcggaatttatgggtgtagcggggtttctagcactcttgaagatgatagaaatctgtgccgtcattctcatgaaccagttatgcaatccctgttgcagcaacgcaataatttgggtacttattcaggcataagatgcagtaatgatggaatggtaacggagatcgctcgccagcttgctttagcggggcctgtcgtcaatgtcaatgcggcttgtgctggtgcgactcacgctattgggctggcctgccagtccattcgaaggggagaggccaccatgatgttagcgggaggggctgattcggtcataagcctgcgcactttggtcgggttgaatttgttgggagcaactgccacaacagaaaaatggggtgacaggttttgtcggccttttgataaaaatcgcagtggtttggttgctggcgaagggggtgctttcttagtccttgaaagtgaagaaagtgcgttgagcagaggcgcgaaaatttacgctgaaattacaggatatggtgcttcccttgatgcttataagctgaccgctccccatcctgatggtattggggcggaaaacgttatcaggaaggctatcagggacagcggattagaacctcaccagattgattatgttaatgcccacggtacatcaaccccattgaatgatgagttggaaactgcggttatcaagcggatctttggtagccagccgcccctgatttcatcaataaaatcgatgttgggccactggatagccgcagcgggagcggttgaaactgtagcaacggttctgacggtgaaaaacaagtttattcctcctaccatcaatcttgaaacgcctgatccactgtgtgatttggattatgttccacagaagggcaggcctttccccgtaaaaaatgcgataacaaactcatttggctttggtggcattaattcgtgtttagtgataggggattacggtgataaatag

SEQ ID NO: 984 - DNA, 1101 bp, Xenorhabdus bovienii
  Coding DNA location: Contig name=SeqID_16848; Position on contig =142211..143311bp; Strand=-
atgggaatctacattgccagtggagttagcctgcttcctgatggcctgaatatggacaacctgatacagggtaatatagcagcggctgaacgttcagatagttcacttcatttacccaatatcgtaggtgaaaggcttattagcgataaggcttttgtcatgccacgtatggataagattgtccggcgggttgcgaatgcgcaaagtcggtgggtgctctattctggcatcaaaacgtgggaaagtagcactggggataaaatttcgcctgaacaacgaggattgtttatcggattaggaaccagtgatgctgatgatgacatacttcctattgcctttgatgcacaggacgatgaaagttatgtttccagagccttggttgaaacacctccattaatgggattggcactgttaaatacgtcaacagccagccatttatctcaacatcttaatattcagggagacaatggttttttttctcctcatgttgatgcaggtggcaatgcatttctggaaggctattacagtattaaagaaaaacgtagccaatgggttctctgcggcgggggcagccagaaaatttcaccgtggtattaccttgcatacgaacgcctcataaaaaataccccgtggctaccagcagaagcggcggcatttatcactctgcatgaagatgttcataatgcggacggtgagatcctccgttttgaacgttcatttctgcacaacacagcctttcacaacaataatccgtatcagcgttttctgactgaattgacggaggaaaatttatcgccatgccaaatcatccatgttggaaaagctactgatgggttcatagcactggcaagcgatacttttcctgatgctatacaattttatcttgataaaacaatgggatattcagggcctgctgcaccttttattgcgattaatctggccattgacatgcataaaaaagggatcagtgttgataacgtcaatcggaatttcatccgtccactgccgcctagtttggtgttagtcgtggttcatggtttggaaaatcaatgcattgccattttgcttcgcatggggatgcccaaagagggggagttgtga

SEQ ID NO: 985 - DNA, 1263 bp, Xenorhabdus bovienii
  Coding DNA location: Contig name=SeqID_16848; Position on contig =143315..144577bp; Strand=-
atgactggtattagtacagataatattgctgtaaccggttatggtttaattgttcgcaatcatgattgcccaagtgatttatttaattctctatcggaagggaaatcacttatctgtgaagatgagttattaaaagagtatggaataacccatattccgagtgccaaattatcctccaaagatatagataggttacgtagtcaattcagctgtacaggacaattatccaataatcgtgttttcttgatggcttgcggtgctgcatcaaatagtttgcaaatggcgggattgactcaaacggagttaaatcaatcccaatgtgagttattttttgccaataacaagatgtttgttgatggtgaggcattatcccgttatttcaattcaggaatatcaccctcaaaatatatcgatattgaacaatttggggcgctgatgcgcccatatgaaatcgccgaagagctggcaaacagcttaaatatctcaacactacccaaaatttatagtgatgcttgtacagctggcatggtcgcactctattcggcctatcagcacctcaagagtggcaggcttgacattgcattggttggtgcttctgaagaagccacccacccgattatgcaattattgttcaagaaagtcagagcgctgtatgacggtaaatttaccgatatgagcgaatcttcacgggcatttgataaagataggtcaggttgtgttctggctgatgcttctgcatttttggttgtagaacgttgttctcatgctattgccagaaaggcgaacatcatagctgaaattgcaggaatgtctcggcaatccgaagggtataaaatgacgtcaaccgatctctctgggcgatattaccgggactgcatgtctgctgcattgcaagatgcgggcttatcagcggaggatattgagcacattaattctcatggtacatcaaccgtcaataatgatcttgctgagagcaaagcgattaatgcacttttcccccataacccattggttatttccacgaaatcagcgatggggcactcgcttgctgttagcggactattggaagccatcctttccattgaaacactgaagaatgaactcattcttcccagccttaatttttctgaggcggggaaaacagatggggtggttaacgttaacagcactgcaaaagtgaaacgcgttaatcacatcttgagtaattcctttgggtttggtggggaaaatagcagtctgatattaaagcggcatgaggggtga

SEQ ID NO: 986 - DNA, 462 bp, Xenorhabdus bovienii
  Coding DNA location: Contig name=SeqID_16848; Position on contig =144685..145146bp; Strand=-
atgaaaaaatatgtatctgcggtatgtgaggaattatcctcaattctctttgttgaagaaaatactattcatgaaaattcttcattaattaatgacttgggtgccgattctttagatgttattgatttgtcatttaaccttggtaagaaatttaaaatcacgatgccgacaaaaagtgtttttgcccatgcttatgaagttctttccgaagaggtactgaaccgactgttagctgaggatactcttactcaagaaggcaaaggattacttgtttatagttgttatgattatacaccggaacagttgaataccattcatactttgggtgacgtatttggtgaaaccaatgttcacaattgggcttcattatgtaaagccacttacgagtcgaatggaaaaaatgcggatgagattatcctggaagaaatagaaaaatattgttcagaaatgttaattaaataa

SEQ ID NO: 987 - DNA, 129 bp, Xenorhabdus bovienii
  Coding DNA location: Contig name=SeqID_16848; Position on contig =145388..145516bp; Strand=+
atgaataaaaaaacaataataacaaattgttattttattcattttatcttaaataacaacaaattaataatattaacacaaaacattacaatggaatttaatttgttacttataataaatatgatataa

SEQ ID NO: 988 - DNA, 240 bp, Xenorhabdus bovienii
  Coding DNA location: Contig name=SeqID_16848; Position on contig =145849..146088bp; Strand=-
atgggtaaaaaatatcgggtaacgttcactgaggcttatcaaatgtatattttgatgagctttgctaggattggcttatgctctttctcagataaattatctaccttattttgtatattcaaaataaactaccattgtatctccaaaagaaagttgatgctctcccggacagtacgcgttcaccgtaatatctgcactagcatattctttcgctgcacatcggctattgctttaacttga

SEQ ID NO: 989 - DNA, 1365 bp, Xenorhabdus bovienii
  Coding DNA location: Contig name=SeqID_16848; Position on contig =146089..147453bp; Strand=-
atgaataccaccgatacgatagtcgctcaggccactcctccgggacgaggcggtgtaggcatcctgcgtatttctggccctaaggcggcggaagttgctgaggtggtattgggcaagttgccgaaaccccgttatgcggattacttgcccttccgtgatgtggatggaactgtgctggatcaaggcatcgcgctttacttccccggccccaactcttttaccggcgaagatgtgctggaacttcaggggcacggtgggccggtcattcttgatttgctgttaaaacgtattctgacaatttctgctgtgcgtattgccaatccgggtgaattttctgaacgtgcatttttgaatgacaaactcgacttggcacaggctgaggcgattgcggatctgattgatgccagttctgagcaagctgcccgttcagccatgaattctctgcaagggacattttcccatcacgtccaccaaatggtggaagcgcttactaaccttcgtatctacgttgaagcggcgattgattttcctgatgaggaaattgattttctttccgatggcaagatagaagccaagttggatgaggtgattgcggagcttggtcacgttcgttcacaagctcgtcagggaagcttgctgcgtgaaggaatgaaagtggttatcgcggggcggccaaacgcgggtaaatccagtttgctcaacgcattggctggccgtgaagccgcgattgtcaccgatattgcaggtacaacccgcgatgttttgcgcgagcatattcatgttgatggaatgccgctgcatattattgatacggcggggctgcgcgaagcgagcgatgaagtggaacgcattggtatcgaacgcgcatggcaggaaatcgagcaggcggatcgcgtgctgtttatggtagatagcacgaccacggatgccgttgaacctgcgaaaatctggccggaatttatggcaaagctgcctgcatcactgcctgttaccgtgatccgcaataagaccgatatgaccggagaagaaaccggcgtattagaagtaagtggttactcattaatccgcctctctgcccgtgaggggaaaggtattgatttgctgcgggatcatctaaaagaggcgatgggtttcaacagcaataccgaagggggcttcctcgcccgtcgtcgccatttacaggcattgaatacggcggcagaacatttgcaggaaggccatcaacaactggtttttgcccgttcaggggaattgctggcggaagaattgcgactggcgcaacaggtattgtgtgaaattaccggcgaatttacttcggatgatttgctgggcaggattttttcgagtttttgtattgggaagtga

SEQ ID NO: 990 - DNA, 1614 bp, Xenorhabdus bovienii
  Coding DNA location: Contig name=SeqID_16848; Position on contig =147531..149144bp; Strand=-
atggattcgcaacgcaatcttcttttcatcgctttgctgtttgtttcgttcttggtctggcaggcgtgggagaaagatcagaacccacaaccaacggcacagatcacgcaacaagcaaatacgccgagtagcgaagcaagcagtgggcaaggtaaactgatcaccgtgaaaacggatgtgctttctttgcacattaatacccgtggcggtgatatcgaagaggctgatctgctggcctatcctgataccctcggttcaaacaaaccattcaaactgctcgaaagcacccctgagttcatttatcaggctcaaagtggattaactggcaccaatggcccagataatcaagctgaacgcccgttttaccacaccactcaggatagctacgttttggctgatggtcagaatgaattgcgtattccgatgacttacactgcaccagatggtgttgtttatgtcaaaaccttcattttgaaacgcggtaattacgcggtttctgtcgattacaacatcgataacgtgactgacaagccgttgcagatggcgttctttggtcagttgaagcagagtgttgagttgccgaaaagtcgtgatactggcagcagcaactttgctctgcatacttatcgcggtgctgcttattcatcagctgaagcaaaatacgaaaaatacaaattcggcgatattgaagataaagcgttagccgtaacgaccaacggtggctgggtagcgatgttgcagcaatatttcgccactgcttgggtgccgggcgcaaactctaccagtactttctacacgattgaccagaaaagccagaaaatggcgataatcgggtacaaaggtgaaaccgtcaatatcgcacctaacagcaagcagaatatctcctctactctgtgggtaggccctgaaattcaggacaaaatggctgaagttgctccacatctggatctgaccgttgattacggctggttgtggtttatttctcagcctctgttcaaattgctgaaattcctgcatgaattcatcggtaactggggcttctccatcatcgccattacctttatcgtgcgcggtatcatgtatccgctgactaaggcgcaatacacctccatggcgaaaatgcgtctgttgcagccgaaaattacggcgatgcgtgagcgtcatggtgatgatcgtcagcgcatgagtcaggaaatgatggcgctgtacaaaacagaaaaagtgaatccactgggcggctgtctgcctctggtgattcagatgccaatcttccttgcgttgtattacatgctgatgggttctgttgagctgcgtcatgcgccattcattggttggattgaggacttgtccgcacaagacccttactacattctgccattgctgatgggtgcgaccatgtttgtgatccagaaactgtcaccaacgaccgtaaccgaccctatgcagcagaagatcatgacttacatgcccgtaatgttcactgtcttcttcctgtggttcccgtctggtctggtgctgtactatatcgtcagtaacttggtcaccatcatccagcagcaggttattttccgcagtctggaaaaacgcggtttgcatacccgcgaaaaaaagtag

SEQ ID NO: 991 - DNA, 261 bp, Xenorhabdus bovienii
  Coding DNA location: Contig name=SeqID_16848; Position on contig =149147..149407bp; Strand=-
atggcgtcgtcactgtcgcttggttcgcggctcttgattgcgataatcaggggctaccagttggtgatcagcccactgttggggcctcgctgtcgttttcatcctacctgttctcaatatggcattgaggcactgcgcaggtttggaatgataaaaggcagttggttaacagtgaaacgcatattaaaatgccaccccttacacgaaggtggtgatgatcctgtcccacctaaaaaaaacgaagataacagagaacattaa

SEQ ID NO: 992 - DNA, 360 bp, Xenorhabdus bovienii
  Coding DNA location: Contig name=SeqID_16848; Position on contig =149371..149730bp; Strand=-
gtggttaagctcgcttttccgagggagttacgtttgttaactcccgagcatttcacttatgttttccagcagccacaacgggcaagctccgcagagataaccattcttgggcgccttaatgagctggggcatccccgcatcggtctaaccgtcgccaaaaaaaatgttaaacgcgcccatgagcgtaatcgtatcaagcgattggctcgtgaaagttttcgtttaaaccagcataaattgccttccatggattttgtggttttggtgaggaagggggttgctgagcttgataatcgtgagctaacggaggcgttgggcaaattatggcgtcgtcactgtcgcttggttcgcggctcttga

SEQ ID NO: 993 - DNA, 141 bp, Xenorhabdus bovienii
  Coding DNA location: Contig name=SeqID_16848; Position on contig =149749..149889bp; Strand=-
atgaaacgcactttccaaccgtccgtactgaagcgtaaccgtacacacggcttccgctctcgtatggccaccaaaaatggtcgtcaagttctggctcgccgtcgtgcgaaaggccgtactcgtctgactgtttctaagtaa

SEQ ID NO: 994 - DNA, 135 bp, Xenorhabdus bovienii
  Coding DNA location: Contig name=SeqID_16848; Position on contig =150092..150226bp; Strand=-
atgatccttgcgctttattacacagtccgtataatcctccaccctgcgtgttatgccaacgattttttccggctatggctggttaagttttgggtgagcacctcgggtagcaaaagtctggtaatgtctggttaa

SEQ ID NO: 995 - DNA, 114 bp, Xenorhabdus bovienii
  Coding DNA location: Contig name=SeqID_16848; Position on contig =150295..150408bp; Strand=+
atggaatttgctatataccatgattacactacagtatcttctacgagccttatattctccgagtgccaaagcgtggcgatctccctgtggataaaaagcgtcaaagctgtgtaa

SEQ ID NO: 996 - DNA, 1569 bp, Xenorhabdus bovienii
  Coding DNA location: Contig name=SeqID_16848; Position on contig =150433..152001bp; Strand=+
ttgcgttatgatcaccgatcccgatctcactatacggatcgttgggggagcgatgatagtaaaaatcgccacaaggtacatgcgaccttcctcatcatcgggggaatgacgctttatacccagtataacgtatctattattccgatttcttttattggtcttgttttaggggagttcgccgtgtcactttcgctttggcagcaatgtcttgcccgattgcaggatgagttacctgccacagaattcagtatgtggatacgaccccttcaggcagaactgagtgataacactttggctctctatgcccccaaccgtttcgtgctggattgggtaagagagaaatatatcaacaatatcaatttgttattaaatgatttctgtggccctgaagtaccgttactgcgttttgaagtcggtaataagcctgtttcaccgaaccagtctacatctcagaaaatcattgccaacatgccgatagctactgcgccgtccagtttatctgtacgcccaagctgggataatgcaaaagcccagccagagttatcctatcgttccaatgtgaacccaaaacatacgtttgataactttgttgaaggtaaatccaaccagctcgccagagctgcagcccgacaagttgccgataatccgggaggcgcatacaatccgctgttcctctatggcggcaccggcttgggtaaaactcaccttttgcatgccgtcggcaatagcatcatggcgcgcaaagccaatgcaaaagtggtatacatgcattctgaacgttttgttcaggatatggtaaaagcattgcaaaacaatgcgatagaagaatttaaacgttattatcgctcagtggatgccctgctgatcgatgatattcaattttttgcgaataaagagcgatcccaagaagaattctttcacacgttcaatgccctgctggaaggtaatcaacagattattctgacatcagatcgctatccaaaagagatcaatggcgtcgaagatcggttaaaatcacgttttggctgggggctgaccgttgccatcgagccaccagaactggaaacacgcgttgcctttctgatgaaaaaagctgacgagaaccaaatccagttacggggtgaagtggctttctttattgccaaacgcctgcgatccaacgttcgtgagctcgaaggcgctttgaacagggtcatcgccaacgccaattttaccgggcgggcgattaccattgattttgtacgcgaagcactacgtgacttattggctctacaggaaaagctggtaactattgataatattcagaaaacagtcgctgaatattacaaaatcaaggttgctgatctgctttccaaacgccgttcacgctccgttgcccgcccaagacaaatggcaatggcgctggcaaaagagctgacgaatcacagtttgcctgaaatcggggatgcctttggtggacgtgaccatacaacagtccttcacgcatgtcgtaaaatcgaacagctgcgtgaggaaagtcatgacatcaaagaagatttttctaacttaatcagaacattatcttcctag

SEQ ID NO: 997 - DNA, 1101 bp, Xenorhabdus bovienii
  Coding DNA location: Contig name=SeqID_16848; Position on contig =152006..153106bp; Strand=+
atgaaatttatcattgaacgtgagcaattattaaaacccttacagcaggttagcagtcccttgggtggccgccctaccctgccaattttgggcaacttgttgttgcaggtgacggaaggttccctgttgctaacaggtacagatttagaaatggaaatgaaggcacgggttgcgctgtctcagccgcatgaacagggcgcaacaaccatccccgcgcgtaaattttttgatatctggcgagggttgcctgacggagcggaaatcagtgttgaactggatggcgatcgcattctggttcgctctggccgcagccgtttttcactgtctaccctgccggcttcagattttcccaatcttgatgactggcagagcgaagtcgaattttctctgccacaggcaacactgaaacgtctgattgaatccacccagttttcaatggcacatcaggatgtgcgctattacttgaacggcatgctgtttgaaaccgaagaggaagaactgcgtaccgttgcaacagacggccaccgtctggcagtctgctctatgaatatcggccagaacctgccttcccattcggtgatcgttccccgtaaaggcgtcattgaattgatgcggctgctcgatggcggcgatagcccgctgcaattgcagattggcagtaataacattcgcgctcatgtcggtgatttcgtcttcacatccaagctggtggacgggcgctttcctgattaccgccgcgtactgcccaaaaacccagataaaacgctggaagcaaactgtgacgtgcttaagcaggcattttcacgggcggcgattttatccaacgaaaaattccgtggtgttcgtatctatttaagcgaaaaccaactcagaattaccgcaaacaacccggaacaggaagaagcggaagagattgtcgatgtcagctaccaaggcactgaaatggaaattggcttcaatgtcagctatgtgctggatgtcctgaatgcattgaaatgcgagcaggtaagtctcttgctgacggatgccacctccagtgtgaaaatagagaattcagccagtcaggccgcgacttatgtcgtgatgcctatgcgcctgtaa

SEQ ID NO: 998 - DNA, 1215 bp, Xenorhabdus bovienii
  Coding DNA location: Contig name=SeqID_16848; Position on contig =153001..154215bp; Strand=+
atgcgagcaggtaagtctcttgctgacggatgccacctccagtgtgaaaatagagaattcagccagtcaggccgcgacttatgtcgtgatgcctatgcgcctgtaaccacattaactcattttatgattctctcgcgtttgctgatccgcgattttcgtaatatcgcgaatgccgatctgactttggcaaccggttttaattttctggttgggccaaatggcagtggtaaaacaagtatactggaagccatttatacattgggccatgggcgggcttttcgcagcattcaggcgggaagggtgatccgccatgattgtgaagaattcattcttcatgggcggctggaacagcaattccacgaacggatcttggcggtagggctgagtaaaaaccgtctgggtgacagcaaagtcaggatcgatggcagtgacgggcataaaattgccgaactggcgaaaatgctgccgatgcaacttatcacgccagaaggttttacgctgctaaacggtggccctaaataccgccgcgcttttattgactggggctgttttcacaatgagccgcgtttttttactgcctgggtcaacctgaaaaggctgctcaaacagcgaaatgcggcattgcgacaagtgacctgctacagccaaatccaacactgggatcgtgagcttgcaccgctagcgactgaaataagccaatggcgggctgaatacattgcaggtattgctgaagatatcgagaaaacctgcaaacaatttttacctgaattcaccctcagcatcagcttccagcagggctgggacaaagagagtgaatatgcagaactgctcgcgcggcaattcgagcgcgacagaacgttaacctacaccgcttccggcccccataaagccgatctacggatcagggtggacggcacaccggtagaagatatgctctcccgtggtcagttgaaattactgatgtgcgcgttgaggttagcgcagggtgaatatttcacccgacagagcgggcaaaaatgcctgtatctgcttgatgattttgcttctgaactggatgccggccgtcgtcaactgttagccgagcgtctaaaatctacgcaggctcaggtatttgtcagtgcaatcacgcttgggcaagttacagacatgattgatgtaaatagcaggatgtttcgcgtagaacatggcaaaatcgaggttcaaccacaggattaa

SEQ ID NO: 999 - DNA, 2415 bp, Xenorhabdus bovienii
  Coding DNA location: Contig name=SeqID_16848; Position on contig =154234..156648bp; Strand=+
atgtcgaatacatatgactcctcaagtatcaaggtattaaaagggctggatgccgtccgtaaacgtccaggcatgtatatcggtgataccgatgatggtaccggcctgcaccacatggtcttcgaggttgttgacaacgctatcgacgaagccctcgcaggtcattgtgacaaaatacttgtcaccatccatacagataactctgtttctgttcaggatgatggccgcggtattcctaccggcatacacgaagaagaaggtgtttcagcagcggaagtcatcatgaccgtgctgcatgcggggggtaaattcgatgacaactcctataaagtttccggcggtctgcatggtgtaggggtttctgttgttaacgccttatctgaaaaactggaactgactatccgtcgtgacggcaaagtccacgaacaaacctaccagcatggggttccacaggccccgttgaaaatggtcggagatactgagcagactgggacaactgtccgtttctggccaagtatggacacgttcaagctcaacaccgaattcgaatatgatattctggcgaaacgcctgcgcgagctgtcattcctgaactccggcgtttccatccgtttagtcgacagacgcactaatgcagaagaccatttccattatgaaggtggtatcaaagcgtttgttgaattcctgagccgcaataaaacgcctattcaccctaatgtcttctatttttccacggaaaaagacggtattggcgtggaaatttccatgcagtggaatgacggttttcaggaaaacatttactgtttcaccaacaacattcctcagcgcgatggaggagcccacttggttggtttccgtgccgcgatgactcgtaccctcaacagctacatggataaagaaggttacaacaaaaaatccaaagttagcgccacgggtgatgatgcccgcgaaggcttgattgcagttatttccgtcaaagtccctgatccgaaattctcttcccagactaaagacaagctggtttcttctgaagtgaagactgcggttgaaacccagatgaatgagaagctggtagaatacctgctggaaaacccgaacgatgccaaaacggtcgtcggcaaaatcattgatgccgctcgtgcccgtgaagcggcgcgtaaagcccgtgaaatgacccgccgcaaaggcgcactggatctggcaggtctgccgggcaaactggctgactgtcaggagcgtgatcctgctctgtccgaactctacctggtggagggtgattctgcgggagggtcagcaaaacaggggcgcaaccgtaaaaatcaggcgatcctgccactgaaaggtaagatcctgaacgttgaaaaagcgcgttttgacaagatgttgtcttcacaggaagtcgcaacgttaatcaccgcactgggctgcggtattggccgtgatgaatacaacccggacaaactgcgttatcacagcattatcatcatgaccgacgccgatgtcgatggttcccacatccgtaccctgctactgacgttcttctaccgccagatgcctgagatcattgagcgtggctatgtctatatcgcccagccacctctgtacaaagtgaaaaaaggcaaacaagagcaatacatcaaagatgacgatgccatggaagcctaccagatgtcgattgcactggatggcgcatctctctacaccaatcagcacgcgccagcactgaaaggcgaagcgttggaaaaactggtcactgagttcaatgccagtaacaaaatcattaaacgcatggaacgcctgtatccgcaggctttactgaataatctgatttaccacccgacactgaccgaagatgccttgaacgatcaggcaaaagtggaagaatgggtgagtacgctggctattcgtctaaatgataaagagcagcatggcagcacttatagctatcaaatccatgagaaccgtgagcgtcagatttatgaacccgttctgtgtatccgtacacatggcgttgataccaactacaatctggatttcgatttcatccacgggggcgaataccgccgcatcaccaagctgggagaattgattggcaacctgattgaagaagatgcatacattgaacgtggcgaacgtcgtcaacccgtgagtaactttgaacaggcattagaatggctgagtaaagaatcacgccgtggcctttccatccaacgctataaaggtctgggagaaatgaaccctgatcaattgtgggaaaccaccatgaacccagaaacccgccgcatgatgcgtgtaacagtgaaggatgcgattgctaccgatctactgtttacgactctgatgggagatgcggttgaacctcgccgtgcatttatcgaagagaatgccctgaaagccgcgaatattgatatttaa

SEQ ID NO: 1000 - DNA, 825 bp, Xenorhabdus bovienii
  Coding DNA location: Contig name=SeqID_16848; Position on contig =156770..157594bp; Strand=-
atgacgcaggcacttatgcctacagtagggcaaaaaagcggattctcaatgagtttaggagcactattgccccgagcatttaaaactcaaaatctaaccttgaaggagcaagcagaagcgggtgctaggtacttcgatattcgagtagcacagcgcaaagatggttcatttggttttttccatggccctagcgttgcaggaggtgatgccactgccgatgttaaggcactattggagcatgcaggaaaagatactaataatttctatgtgctcaaaatggtatttaaaggggaaggaaagaagaaagcaacgtctagaacatcggcttcagatacatttttacaggatgtactcactacccaccgtaataatcttattacacctgatgatacatcgagtttaggtgaagcaacggttgatttactgagtaaaggaaaaaacatagggcttatggttcatggctatgatggaactgagtcccattggaaatacaaagaacaagttcatactcagtgggctaatagagcgagcgcaacggagacagccgagtttttgagtgagtatcatgcaaccccagcgcctgacagccagcttaatgttattcaaacgaatattccatttgcctctcctgggcgtgggcaattgacttcaggggtaaaacgttacttatctaaaaataagggcattttggctgatgctgtcgataagatccctcatgcgggaataattagtggggattatatcgggagtgagcacggggcaagttcaagatttatgaaaacgattgaattacataatcaaagcctaatgagtacgcatttataa

SEQ ID NO: 1001 - DNA, 195 bp, Xenorhabdus bovienii
  Coding DNA location: Contig name=SeqID_16848; Position on contig =157512..157706bp; Strand=-
atggtgagaaataatcctattacattatttgatccgactggaaaccttcccataaatcataatgagttacctgcggatactaagttatctcagatagcaatgctgggcagccatgacgcaggcacttatgcctacagtagggcaaaaaagcggattctcaatgagtttaggagcactattgccccgagcatttaa

SEQ ID NO: 1002 - DNA, 1182 bp, Xenorhabdus bovienii
  Coding DNA location: Contig name=SeqID_16848; Position on contig =157751..158932bp; Strand=-
atgataaataaaaaccttcaggttcaccacaaaacgccagtggtcaccgtgcaggataaccggatgctgactgtgcgtgatatccattatcattgtcatcctgatcagccagatcacatcgatgatcgtatcactcgctaccggtttaacgcccccggcagtttgagcacgagtattgatccgcgcctggctgaattgcagcagtcgaaccaagcgattaatcccaatttcacttatctctcctccctcaccggtgatgtcctacgtactgatagtgtcgatgctgacgctacccgcttttggcgcaatcagaaggtagatgctaaagcgatttatgttttacgacagcctgtatcaattgggcagcaaactaatcaattgccgacaccgattattcctctggatactgacagcagcacttacactaactacacccgcacttacacgtatgaccgtggtaacaatctaacccagatacgccacagcgcgccggcaaccggtcacaactacactactgctattactgtctccgaacgtaataaccatgccgtactcagcacactgacagacataccatcaaaagtagatactttttttgataaggcagggtctcaactgcaattaatgccagggcagagattggattggacgatgaggggggagttgcaacaagtgacacgggtaaatcgtttatctggtcaaccagacagggaaagttatctttatgatggcagtaatcagcgtgtggtgaaagtcagtacgcagcagactggtggcagccaacagcaacagcgggtgctttatctgccggagctggagctgcgcaccacaaaaaacggcgatgtggaaaaggaagtacttcaaatcattaaggtcggtgaggcggggcgggcgcaagtgcgggtactgcactgggaaagcggcaaaccggatgcgctcagtaacaaccagatacgctacagctacgataatctggtggggagcagcggactggaagtgggcggtgacgggcagatcatcagtctggaagaatactatccgtatggcggcacggcggtgtggacagccagaagccagacagaagcggactacaagaccatccgatattcgggcaaggagcgggatgcaacggggttgtactactatggataccgttccaaccgtggacagcgcgttggttaa

SEQ ID NO: 1003 - DNA, 147 bp, Xenorhabdus bovienii
  Coding DNA location: Contig name=SeqID_16848; Position on contig =158974..159120bp; Strand=-
ttgcctgaggatctccacgatgaggtttcctttgacaaaaactttgctcgtgcctcagacactgagtttccttctgaagtgaaattcaggtggttatcaataaatcacacaacctttttaacgacccctagccatgacaaaacttga

SEQ ID NO: 1004 - DNA, 1107 bp, Xenorhabdus bovienii
  Coding DNA location: Contig name=SeqID_16848; Position on contig =159545..160651bp; Strand=-
atgaaaaatgtaggtttgatcggctggcgtggtatggtcggctcagtattgatgcagcgtatggtggaagagcgtgattttgaccagatcaatcccgtcttcttcacaacatcccagcatgggcaacccgcgcccgactttaccgggaaagcgggcattttgcaggatgcttttgatattgaggcactgaatgcgctggatattatcattagctgccaaggtggggattataccaatgaaatttatcccaaactgaaggagacaggctggcaggggtattggattgatgcggcttctgcgctgcgtatgagcgatgatgccattattattctcgatcccgtcaaccatcagcatattcaggatagtctgaataaaggcattaaaacctttgttggcggcaactgtactgtcagtttgatgttgatgtctctggggggactgtttgccaataatctggttgagtgggcatcagtcgcgacttatcaggcggcttctggcggcggtgctcgtcatatgcgtgagctgctggtgcaaatgggcatgctgcataatcaggttgaaagtgagctgcaaaacccggcttctgcaattttggatatcgaaaagcgtgtaacagatttcactcgcagtggcgcattgtcgacggatcaatttggtgttccgctggcaggtagcctaattccgtggattgataaacagttggacaatgggcagagccgtgaagagtggaaagggcaggctgaaaccaacaagatcctcaatacaggcaataatatcattcctgttgatggcctgtgtgttcgtattggagcgctgcgttgccatagtcaggcatttaccctgaaattgaaaaaagatatttccatccatgaaattgaaacgctgctggcttcccataatgattgggttcgcgttatcccaaatgatcgtgaattgagcatgcgtgaattaaccccggctgcggttacggggacactgaatgcgcccgttggacgtctgcgtaagctgaatatggggccggaatatctgtcagcctttaccgttggtgaccaattgttgtggggagcggcggagcctctgcgccgtatgctgcgtattttgctgtaa

SEQ ID NO: 1005 - DNA, 114 bp, Xenorhabdus bovienii
  Coding DNA location: Contig name=SeqID_16848; Position on contig =160716..160829bp; Strand=+
atgataaaaggtgcaagtaaatttatatgctatggcaaccgtatttcagcaaagatccgcttaccatttacggggaaaatatcagtgaaatacagctggaacggcctgagctga

SEQ ID NO: 1006 - DNA, 195 bp, Xenorhabdus bovienii
  Coding DNA location: Contig name=SeqID_16848; Position on contig =160797..160991bp; Strand=-
atgggtcattgttgtcatcaagtctatcagcatgttgctaattgccgttattacagcttttgttacggggggatatttgagggttattcagttgctgttactcaggcgggtcagattgtctatctgttcaatcagcaggatgacagtccttcagtaaccgactcagctcaggccgttccagctgtatttcactga

SEQ ID NO: 1007 - DNA, 93 bp, Xenorhabdus bovienii
  Coding DNA location: Contig name=SeqID_16848; Position on contig =161250..161342bp; Strand=-
atgatagatacagtcaagaggcttttttatttcacgtgtttccactatacaaagacccgcatgtattgcttctttatatatagtggtcaatga

SEQ ID NO: 1008 - DNA, 660 bp, Xenorhabdus bovienii
  Coding DNA location: Contig name=SeqID_16848; Position on contig =161374..162033bp; Strand=+
atgaataagaactgcaaacgttatacagaatggtggttggagcaggaaaaattaagaacgaatgatgaaaccccggtaaaaatcacactggcaggaattaagttatctgttattcctcaagtatttcttccatctccattacaaacgcactctacaccattacttataaaaaacattatagatcatgattttactgggaaaaaagttcttgatataggaactggcagtggtattcttgctatttactctgcccttaatggtgcatctttggtagtagcaacagatatcaatgataatatattacaccatgctaaaagtaatgcttatctgaataaggttactgatatccattttataaatagtaatatctttgagtctattgatggtaaatatgactatatattcgccaatgggcccatttctcctgagtcttggtcagaaaaaacactttccgggcatacaatatcgagttacggagaaactatttttagtcagtatcgtaactatctgataaatgaaggggtaatgtttatgacattcgcagagtttggctcaacagagatattctacaagacacttcaaaaaaattccgttatgcacagagaaaaaagagaaacaaaatttggcgtatggtggagttttcacgaaataaaaaaataa

SEQ ID NO: 1009 - DNA, 255 bp, Xenorhabdus bovienii
  Coding DNA location: Contig name=SeqID_16848; Position on contig =162003..162257bp; Strand=+
atggtggagttttcacgaaataaaaaaataaaactgatgagaagccctaactcaacaccgacttatctggaggtatttatcctattgacatttactacagttatatttatttgtaattttttactgttgattccaatccagacaataaataatgttaccactataaaaacaaaatattcaaataataacaatcaatatataacaaacagattttataattccagtacaaataatagaatatcaacagcattgtaa

SEQ ID NO: 1010 - DNA, 141 bp, Xenorhabdus bovienii
  Coding DNA location: Contig name=SeqID_16848; Position on contig =162600..162740bp; Strand=-
atggagtgggtcatcagtaacgtacttagcatcaataatgcaggaagattactgaacaagtgtttccagctaccgtgtagaaatggggatagcggaataccgatcaggccttggaagtatctgggaatgataccgaaatga

SEQ ID NO: 1011 - DNA, 369 bp, Xenorhabdus bovienii
  Coding DNA location: Contig name=SeqID_16848; Position on contig =162749..163117bp; Strand=+
atgttcttgccagtctgtttattatctttatggaagggacactggtctggttatttggccgaacatctattcatattggtgccagcggctggatttttgggctgtggggattattgctggccaatgctttcttccagaggagagcaaaagatttcttctttgccattctggtctttgtgtattacggtgggatcgcctttggcttgttaccatggcaagaagatgtttcaacggaagggcatatttttggcgctattgcggggctggttttttcttggctcaccaagaaatggattatcacgaaccgttaaacaccgtaaaccctcgtccagtgcgagggtgtcgcaaaaggacgggggccgtcactaa

SEQ ID NO: 1012 - DNA, 1449 bp, Xenorhabdus bovienii
  Coding DNA location: Contig name=SeqID_16848; Position on contig =163156..164604bp; Strand=-
atgagtaaccagtatgatgttttgatcatgggggccggggttgctggcattggtatggcatgtcatttaacaagagaatgtcccgataaaaaggtgattattttagagcgccgtcatgctatcggagggacttgggatttatttcgttatccgggcatccgttcagattcagatatgatgacttttggttataaattccggccttggtctgaaaccagtgtttttgccgatggcgagtcaattaaaaactacgtcaataaaacggcaaaagagtatggaattgataaaaaaatccagtttgggttaaaaattactcatgcggactggtctggcacgactaaccaatggagcattaccgctgttgaggagacgagtggagaaactcgaacttttacctgtaattatctggtcgcggcgacgggttattacaactatgatgaagcgtatttacctgaattccccggtattgaggatttcaaagggcccgttattcatccccagtattggcctgaagggttagactataaagggaaacgggttgttgttattggtagtggggcgacagcagccacgttagttccaacaatggcaaatattgccgaacatgtcactatgctacagcgctcccccagttattatttgtctgtacccggaacagataaaatcgctgagtttttaagtaaatttataccaaaacgctgggtttactcattcagccgaaatcgtaatatctttatgcaccgtttactttataaaaccagccgacatttacctacgctgttgaaatcgtttttattgtcgtcagcccgcaaaagggttgggccaagttttaatatgaatcaccttacaccaaagtacatgccttgggatgaacggttgtgtgtgatccccaatggtaattttttaaagtcactgaaagaaggcaaatcctctattgtgaccgaccaggttaaacgctttactgaaaatggcattttactgcaatctggcaaggagttgccggcggatatcatcgtttctgctacaggtctgaaattacgctctcttggtggagttgaaatttctattgatgagcaaaaactgcagggcaataatcgtatgctctacaagggaacgttgatacaggatattccgaattttgcttatttgtttggctatatcaacagttcttggacattgaaagtggatctatccgcagattatgtttgccgattactgaaagagatggatcgtcgtggtgctaagtctgtgacagcttatgctcagccggatgaaatgttgaaacacgaaaacatttttggtgagttacaatcgggttatgtgaggcgaggtgatgaaggtcttcctcgtcaggggcgcagcccgaattggcatgttccacatgattataaaaaggataaagaggtattgggacagcctgtagatgatacggcactgagatgggaataa

SEQ ID NO: 1013 - DNA, 135 bp, Xenorhabdus bovienii
  Coding DNA location: Contig name=SeqID_16848; Position on contig =164675..164809bp; Strand=-
atgtatttcaaaaacagttctcattttactggttatattcaggttgctttagccatgcgtctggtcggtagcaataattccctgtctctaactatgatacccctatctcataaatacaaatggttgtcctattaa

SEQ ID NO: 1014 - DNA, 1242 bp, Xenorhabdus bovienii
  Coding DNA location: Contig name=SeqID_16848; Position on contig =164818..166059bp; Strand=-
atgaacttgatgaaaaagtatagcgttaccaactttgttatataccaagtcagtgatgttttattcactatctccattaaaacaataggaatgttgtttacatggattatgcttaatcaactcggattggtcgttgagttaggctattttctttttatatcgtgggcattgcaggtgattactttgcttgctttcggtttgtatggtgacaagttttcaactaaattctatttgatttcattctgtattttaagcttacttattatctccagcctgtactttattgaaagtaaaaactacttttactggggaatattttttatcgttacatctctgttctctatactgacccaaccgattggaaacagtatcatcagccgaatattgcataatacaaacaccgatcttgctttcagagctagagggttggtcagttcactgaacgttgtatcaggcccggctatctctggaatattaattagttatcttgcatatgggcatatactcgtcattgtattttgcagtgtcgtcatctctttcttaggttttctttgggtttctatgatgccatcagaaaaaaaagctgatacatcaaaggtgagtttaaagatcttaaagaacaaccctacagaattaaggttaggtgcaatttctggtgtttttaattttgtcatcgtcccattggtttcttactttattccttttttgatcatcaatacgatgaaactaggtgcatttgacttgggggtagctgagtttttctttggtgcgggaatgttcttggggagtagcgttttagtaaaatttttcaatcagatgctcggtaaaggttatgcatcattgactggaactattttagtttcacttggtattttcggcgtatccatatcgcagtcaaatattcatatcaatatatccatgttgattgcaggcattggcgttgttatttataacataaacacaacatctatcaggatgacggcaacaccttcttcacaaaggcactccatggaatctgtatttttatctctgtgcattatccccattccattgggaatgttattttctacttacagtatccagtttctaagtgttaacagcattctgcttggcatgtcattgatattgttattctgttccattttgattattaaaacgcctaattttatgcatctttgcaagatgagcagtgaatcgttggatggatattatgaaaaactgtatccgcgttctgttggttaa

SEQ ID NO: 1015 - DNA, 228 bp, Xenorhabdus bovienii
  Coding DNA location: Contig name=SeqID_16848; Position on contig =166330..166557bp; Strand=-
atgttttcgaataaaaacaaaaaaaagtttaattacgactggttaaaagatttatttttagactgttccgaagagtttttttggatttttattattgcaatagtaattttagttttatttgttacgttacttattatttttacagatatattggtaggaattatcttttttgcagttatttttattttatgtatttttgtactttacataatttccataataatatga

SEQ ID NO: 1016 - DNA, 96 bp, Xenorhabdus bovienii
  Coding DNA location: Contig name=SeqID_16848; Position on contig =166596..166691bp; Strand=+
atgttgattgtattcattattttattaataaggctaacatcttttaataaaacaatacaatataaattaaaaaaatactcattcaatatcaaataa

SEQ ID NO: 1017 - DNA, 1830 bp, Xenorhabdus bovienii
  Coding DNA location: Contig name=SeqID_16848; Position on contig =166923..168752bp; Strand=-
atgtgtggaattgttggagcagtagcacaacgtgatattgcagaaatactgatcgaaggtcttcgtcgcctggaataccgtggttatgactcagccggtctagcggtggttgacagtgaaaaccgtatgacctgtctgcgtgaagtcggcaaagtacaggtgctggctgatgaagcagataaacagcttgtcattggtggtacggggatcgctcatactcgttgggcgacgcacggtgagccgaatgagcgcaatgcccatcctcatgtttctgaacatattgcggttgtacataacggcattattgaaaaccatgaagcactgcgcgaattattaaaagagcgcggttataccttcttttctgatacagataccgaaactatcgcccatcttatccactgggaacagaaacaggggggggcgctgctggaagtggttcagcgtgtgatcccacagttacgtggcgcttatggcaccgtaattatggacagccgtcaccctgatgtgctggtggccgctcgttctggcagcccgctggtgattggccttggcgttggtgaaaacttcctcgcatctgatcaattggcgttattgccggtgactcgccgctttatctatctggaagagggtgacatcgttgagatcacccgtcgtaccgttcgcatctttgatgtcacaggtgcagccgttgagcgcgagcagattgaatccaacgttcagtatgatgcaggtgacaaaggtatttaccgtcactacatgcaaaaagagatctacgaacaaccgatggcaattaagagcacgctggaagggcgtttaagtcatggtcagatagatctgtcagagctgggcgctaatgctgcggaattactgtctcaggttgaacacattcaaatcgttgcctgcggtacgtcttacaatgcgggcatggtttcacgctactggtttgaatctttggcaggtattccctgtgatgtggaaatcgcctctgaatttcgttaccgcaagccagcacgtcgtaagggaagtttactgatcactttgtctcagtctggtgaaacggctgatactttggctgcactgcgtttatccaaagaactgggctatttgacttcgctggtcatctgtaacgttgccggctcctctctggtacgtgaatcagactttgccctgatgaccaaagcaggagcagaaatcggcgttgcatctaccaaagcatttaccacccagctgaccgtattattgatgctggtggcttacatggggcgcctgaaaggtgctgacgcagcattagaacaagatgttgttcacgcactgcaagcattgccaagccgcattgaaagcatgttgtctaaagacaaagtcattgaagcactggcagaagatttctctgagaaacatcacgccctgttccttggccgtggcgatcaatacccgatcgcggttgaaggcgcactgaaactgaaagagatctcttacattcacgcggaagcctatgctgccggtgaattgaaacatggcccgttggcattgatcgatgcggatatgccagtgatcattgttgcaccaaacaatgaactgctggaaaaactgaaatctaacatcgaagaagtccgcgcccgtggcggccagttgtatgtgttcgctgatcaggatgcaggttttaccaacagcgaaaatatgaagatcatctctttgccacacgtggaagatctgatcgcgccgatcttctataccgtaccactgcaattactgtcttaccacgttgccttgatcaagggaacggatgttgatcagccgcgtaacttggcgaagtcagtgacggtagagtaa

SEQ ID NO: 1018 - DNA, 129 bp, Xenorhabdus bovienii
  Coding DNA location: Contig name=SeqID_16848; Position on contig =168751..168879bp; Strand=+
atgtgttttattcctaaaaacagggctgataaaagccccttttatgtcgctaacctgattgtgttccggctttgccggtccccgagctttgtagaagtggggattatttttatatttattttttcttaa

SEQ ID NO: 1019 - DNA, 1380 bp, Xenorhabdus bovienii
  Coding DNA location: Contig name=SeqID_16848; Position on contig =168866..170245bp; Strand=-
atgtctattagtgcaaatagcgcaaaaagtgtcgtgatccttgccgctggcaaaggcacgcgcatgtattctgctctccccaaggttctgcactcgctggccggtaaaccgatggttcagcatgtcattgacaccgcaatggcgttgggcacccaaaatgttcatttggtctatgggcatggtggtgatctgatgaagcagactctctccaatcaaaaccttaactgggtactacaggcggaacagcttggaactggccatgcaatgcagcaggcagcgccacattttgcagatgatgaagacattctgatgctctatggcgatgttcctttgatcgctcaagacacattagagcgtctggtggaaatcaaacctgaaggcggtattggcttattgactgctattttgaataatcctgccggatatggccgtatcattcgtgaaaatggcgaagtggccgggattatcgaacagaaagatgcgactgacgagcagcgtaaaatcaacgaaatcaacaccggtattttggtggcgaatggcggtgatttgaagcgctggttatcccagctggataacaacaacgctcagggtgaatactacattactgatattattgctctggctcacaaagaaggccgccaaatcaaggctgttcatccgagccgtttaagtgagatggaaggggttaacaatcgccttcagctttccacactggaacgtatttaccaatcagagcgagcagaaaaattattgctggcaggtgtaatgctgctggaccctgcccggttcgatcttcgcggtacattagaacatggccgtgatgtggttatcgataccaatgtcattatcgaaggtcatgttgcattgggaaataacgtgcatattggatctggctgcattttgaaaaactgcgttatcggtgatggcacggtcatcagcccttatactgtgatcgaaaatgctgaaattgctaccgaatgtacggttgggccttttgctcgtttacgtccggggtctaaactggcggaaaaagcgcatgttggcaattttgtggaaatgaaaaaaacctcccttggtaaaggttccaaggcgggtcacctgacgtatcttggcgattctgaaatcggcaataatgtgaatattggtgcgggaacgatcacttgtaactacgatggtgctaataaatttaaaaccatcatcggtgatgacgtgtttgtgggttccgatacccagcttgtcgcaccggtcacagtagctaaaggcgcgaccattggtgcaggcaccacagtaacaaaaaacgtcgctgaaaatgagctggtcatcagccgcgtgaaacaaacgcatattcaggactggcaacgtcctgttaagaaaaaataa

SEQ ID NO: 1020 - DNA, 642 bp, Xenorhabdus bovienii
  Coding DNA location: Contig name=SeqID_16848; Position on contig =170319..170960bp; Strand=+
atgcaaaaaagccagttagctttcaccaactggctttttatcttactgcctatattacatccgttgttttgtcagttcgattacacgaagttttgcaatcgctttcgacaattcagcagatgcctgagcataatcaacatcgccgtgagaattacgaacgtgttcttcagcctcgcgcttcgcttcaagcgccttggcttcgtccaaatccttaccacggatcgctgtatcggccagtacgataacgccgtttggctgaacttcaagaactccaccggacaggtagataaattcttcttcaccaaactgcttaacaatacgtatcatgcccggttttatggcagtaagcagtggtgtgtgctgaggataaatacccaactcaccttcactgccagtcacctgaattttttgtaccagcccttcaaacaatcgtttttcagcgctgactacgttcaggaagaacgtcattgcagccatatcaacctcccgtcagccgtattacatcttcttcgctttttctacagcttcgtcgatggtaccaaccatgtagaacgcctgttctggcaggtggtcataatcaccgtccaggatgcccttaaagccacgaatggtttctttcagagagacgaacttacctggtga

SEQ ID NO: 1021 - DNA, 1383 bp, Xenorhabdus bovienii
  Coding DNA location: Contig name=SeqID_16848; Position on contig =170817..172199bp; Strand=-
atggctactggaaagattatccaggtaatcggcgccgtggtggacgtcgaattccctcaagacagcgtaccaaaggtatacaatgctcttgaggttaaaaacagtgaagaaaaactggtgctggaagttcagcagcagctgggcggtggtatcgttcgctgtatcgcaatgggtacctctgatggcctgcgccgtggtttggacgcgattgatttagggcacccaattgaagttccggtgggtaaagcgacactgggccgtatcatgaacgtattgggtgatccaatcgacatgaaaggtgagattggcgaagaagagcgctggtcgattcaccgtacagcaccaagctatgaagagttgtccagctctcaggaactgctggaaaccggtatcaaggttatggacttgatctgcccatttgctaagggtggtaaagttggtctgttcggtggtgcgggtgtaggtaaaaccgtcaacatgatggaactgatccgtaacatcgctatcgaacactccggttactctgtatttgccggtgtgggtgaacgtacccgtgaaggtaacgacttctatcatgaaatgaccgattcaaacgtactggataaagtatctctggtatatggtcagatgaatgagccaccaggaaaccgtctgcgtgtagcactgacgggtctgactatggctgagaaattccgtgatgaaggccgtgacgttctgttgttcgtcgataacatttaccgttataccctggcaggaacagaagtatctgccctgttgggtcgtatgccatctgcggtaggttatcagccgacattggcggaagagatgggcgttcttcaggaacgtatcacttcaaccaaaacgggctccatcacttccgtacaggcggtttacgtccctgcggatgacttgactgacccatcaccagcgacaacctttgctcacttggatgcaaccgtcgtattgagccgtcagattgcttcactgggtatttacccggcggttgatccactggattcaaccagtcgtcagcttgacccattggttgttggtcaggagcactatgatgtggcgcgtggtgtacagtctatcctgcagcgttatcaggaactgaaagacatcatcgcgattctgggtatggatgaactgtctgaagaagataaactggttgtggcacgtgcccgtaagatccagcgcttcttgtctcagccattcttcgttgcagaagtcttcactggctcaccaggtaagttcgtctctctgaaagaaaccattcgtggctttaagggcatcctggacggtgattatgaccacctgccagaacaggcgttctacatggttggtaccatcgacgaagctgtagaaaaagcgaagaagatgtaa

SEQ ID NO: 1022 - DNA, 864 bp, Xenorhabdus bovienii
  Coding DNA location: Contig name=SeqID_16848; Position on contig =172234..173097bp; Strand=-
atggccggcgcaaaagagatacgtaccaaaatcgccagtgtgcagaacacgcaaaaaatcactaaagcgatggagatggtcgccgcgtccaaaatgcgtaaaacgcaggatcgcatggcggccagtcgtccttatgcagaaaccattcgcagcgtgattggacaccttgcgttaggtaatctggagtacagacatccataccttgacgagcgcgaagttaagcgtgttgggtatttggttgtttcgacagatcgtggtttatgtggcggtttgaacattaacttgttcaaaaaattgctgatagaaatgaaaggctggtctgataaaggcgttcaagttgatttagcgcttgttgggtcgaaagcggtttctttcttttcttctgttggaggcaacattgttgcccaagtaacagggatgggagataacccatcattgtccgagctgatcgggccagtcaacgtcatgatgcaagcatatgacgcagggcgtctggataaattgtatatagtgacaaacagattcatcaatacaatgtctcaggttccgacaatgactcagttattgcctctgccagccggagacgatgaaacactgaagaagaaatcctgggattatctgtatgaacctgatcctaaggcgttgttggataccctgctgcgccgctatatagaatcacaagtttatcagggcgtcgttgaaaacctggctagtgaacaggccgcacgaatggtagcgatgaaagccgcgaccgataacggtggcaacctgatcaaagagttgcagttggtttacaacaaggctcgtcaggccagcatcactcaggaactcaccgaaatcgtttcgggtgcttctgcggtttaa

SEQ ID NO: 1023 - DNA, 1542 bp, Xenorhabdus bovienii
  Coding DNA location: Contig name=SeqID_16848; Position on contig =173157..174698bp; Strand=-
atgcaactgaattccaccgaaatcagcgaactgatcaaacagcgtattgctcagttcaatgtcgtgagcgaagctcacaatgaaggtacgattgtttccgttaacgacggtatcattcgtatccacggtttagccgatgtcatgcagggtgaaatgatttctctgcctggcaaccgttacgcaattgcactgaacctggagcgcgactctgtgggtgcggttgtgatgggtccgtatgctgacctagccgaaggcatgaaagtcaaatgtactggccgtattctggaagtacctgttggtcgtggtctgctcggtcgtgttgttaacacactgggtgagccaatcgatggcaaaggcgctcttgagaatgatggtttctctcctgttgaagttattgctccgggtgttattgaccgtcagtccgttgaccagcctgtccagacaggttacaaatccgttgatgccatgatcccaattggccgtggtcagcgtgagctggttatcggtgaccgtcagacgggtaaaaccgctctggctattgatgcgatcatcaaccaacgtgattcaggtatcaaatgtatctatgttgcaattggtcagaaagcatctaccatttccaacgtagttcgtaaactggaagagcacaacgctctggccaatacgattgtcgttgttgcatccgcttctgaatctgcggccctgcaatatctggcaccttattctggctgtgcgatgggtgaatacttccgtgatcgcggcgaagacgctctgattgtttacgatgacctgtctaaacaggctgttgcttaccgtcaggtttctctgttgctgcgtcgcccacctggacgtgaagcattccctggtgacgttttctatctgcactcccgtctgctggagcgtgcagcgcgtgttaacgctgattatgtggaaaaattcaccaacggtgaagtgaaaggtaaaacgggttctctgactgcattgccaatcattgaaactcaggcaggtgacgtttctgcgttcgtaccaacaaacgttatctccattaccgatggtcagatcttccttgaatctgctctgttcaacgcaggtatccgtccggcggttaacccagggatctccgtatcccgtgtaggtggtgctgctcagactaagattatcaagaaactgtctggtggtatccgtaccgctctggctcagtaccgtgaattggctgcattctcccagtttgcttctgatctggatgatgcaactcgcaagcagttggatcatggtcagaaagtcactgagctgttgaaacagaaacagtatcagccaatgtccgttgcacagcaggctctgtccctgtttgcggctgaacgtggctatctggaagatgtcgaaatcgcgaaagtggtcagtttcgaatctgcgctgttagcttatgctaaccgtgaacatgctgatcttctcaaagagattgaccagtctggtgactacaacggagagatcgaagcgaagctgacagctctgttggattccttcaaggcgactcagtcctggtaa

SEQ ID NO: 1024 - DNA, 534 bp, Xenorhabdus bovienii
  Coding DNA location: Contig name=SeqID_16848; Position on contig =174713..175246bp; Strand=-
atgtctgaatttgctacggtagctcgcccctacgccaaagcagcttttgactttgctgtagagcaccaatctctcgaacattggcagaacatgctggcgttcgttgctgaggttactcgcaatgagcaggttggtgagctgctttccggttcattggcaccggaaacgttagccaataccttcatcaccctttgtggtgagcaggtagatgagcatgctcagaactttattcgtgtaatggcagaaaatggtcgcttgctggtactgccagaagtcttccagcaatttacccaattgcgtgcgtcacttgaatcaaccatcaatgttgaagtgatttctgcgtctgaattgaatgagcagcagcaggctaaaatttctgcggcgatggaaaaacgtctgtcacgcaaagtgaagctgaattgcaaaattgacaagtctgttatcgccggtgtggttatccgcgcaggtgatatggtgatcgatggcagcattcgcggccgtctggatcgtttaacagacgtcttgcagtcttaa

SEQ ID NO: 1025 - DNA, 471 bp, Xenorhabdus bovienii
  Coding DNA location: Contig name=SeqID_16848; Position on contig =175259..175729bp; Strand=-
ttgaatattaacgcaacaatcctcggccaggccatcgcgtttgtcctgtttgttttgttctgtatgaagtatgtatggccaccaattatggcggccattgaaaagcgtcagaaagaaattactgacggtttggcttcagcagaacgtgctaaaaagaacctggacttagcgcaagccaatgcgaccgaccaactgaaaaaagcgaaagctgatgcgcaagctatcattgagcaggctaataaacaaaaagcccaaattattgatgatgccaaaacagaagctgagctggaacgtaacaaaattgtagcgcaggctcaggctgaaattaatgctgaacgcaaacgcgctcgtgaagagttacgtaaacaggttgcgatgctggctatcgcaggtgccgagaaaatcatcgaacgttccgtggatgaagctgctaacagcgacatcgttgataaactggtcgctgaactgtaa

SEQ ID NO: 1026 - DNA, 246 bp, Xenorhabdus bovienii
  Coding DNA location: Contig name=SeqID_16848; Position on contig =175784..176029bp; Strand=-
atggaaaacctgaatatggatctgctgtacatggctgccgctattctgatgggtctggctgctattggtgctgcgatcggtatcggcatcctcggaggtaaattcttggaaggcgctgctcgtcagcctgatctgattcctctgctgcgtacacagttctttatcgttatgggtctggttgacgccatccctatgatcgctgtgggcttgggcttatttatgatgttcgctgtcggcggtaagtaa

SEQ ID NO: 1027 - DNA, 828 bp, Xenorhabdus bovienii
  Coding DNA location: Contig name=SeqID_16848; Position on contig =176080..176907bp; Strand=-
atgtctgcatcaggagaagttttaacttcgcaggagtacataagtcatcacctgaagcaccttcagttagacttgcgtacctttgagttggtcaatccccacgctagtggttatgagacgacgttctggacgttgaacattgactcgctttttttctccgtcatattaggaatattgtttctgtttgtattccggagagttgcggttcgcgctactgatggcgtgccgggtaagctccagactgcagtagaaatggttttcggtttcgttgataacactgtgcgtgatatgtatcacggtaagagcaaagtgatagctcctctggctttgactgtgttcgtctgggtgttattaatgaacgcattggacttgctgccaatcgatttaattcctttgatcggtgaacgctatttcggcctgcctgctctgcgtattgttccaacagcagatgtcagtgtcactctgtcgatggcgctcggtgtctttgttctcatcctgttctacagcattaagatgaaaggaattcgtggttttgcgaaggagctgacattacagcctttcaatcacccactgtttattccaattaacttaattctggaaggggtcagcttactatctaaacctatatcactcgctctgcgactgtttggtaatatgtatgctggcgaattgatctttattcttattgcggctcttttaccgttttggtcacagtggttactcagcctgccatgggcgattttccacatactgattatcacgttacaagcctttatcttcatggttctgacggttgtttatctgtcgatggcatctgaagaacattaa

SEQ ID NO: 1028 - DNA, 378 bp, Xenorhabdus bovienii
  Coding DNA location: Contig name=SeqID_16848; Position on contig =176939..177316bp; Strand=-
atgtctgtatccctttacagcggtagaattgcactgaaactgttacttttgcagttaatgacttttgttattctcagtgtggctttttgtaccagaagtatcgaatggggcgcttctgcttttgccggtgggttggcgtgctggctgccaaatgccatttttatgctgctaacccgcttccaaaaagcaaaagaagaagatgtaccagtacgcattgcatggttcttcgctattggcgaagtggctaaggttatcattacgatagctgtgctgatagttgccttgggagtgtttaaggcggcatttgcaccacttggtgtagcctatttagcggtgctgattgtgcagatcatcgcacctgccgtaatgaacggttag

SEQ ID NO: 1029 - DNA, 621 bp, Xenorhabdus bovienii
  Coding DNA location: Contig name=SeqID_16848; Position on contig =177927..178547bp; Strand=-
ttgcttaacaaattggaatcgctgctggcgaaaacagacattgtgttatcgctagcacaaaaacaacagcttgtcgcttacgttgatatgctcaacaaatggaacaaggcttataacttgacatctgtccgtgcccccgaacaaatgctggttcggcatatcatggacagcatagttgttaatccttttcttcacggaacgcgatttattgatgtgggaacagggcctggcttgccgggcatcccgttggcaattgtacggcctgattctcatttcactctgttggacagtttaggaaaacgagttcgcttcttacgtcaagttcagcatgaattgggcttgggcaatattgatcccgtacagagtcgggttgaagaatttattcctgaacctccttttgatggggtgatcagccgtgcatttgcttcgctgcaagacatgctgtcatggtgtcgtcatcttcctaaacccgcagaagggcgtttttatgctctgaaaggtgtgctgccggaaaatgagttgactcaactgccttcaggaataacgcttgatacggtggtttctctgcaagttcctgagttagatggggagcgtcatttggtcgtacttaaatcaaactaa

SEQ ID NO: 1030 - DNA, 1890 bp, Xenorhabdus bovienii
  Coding DNA location: Contig name=SeqID_16848; Position on contig =178560..180449bp; Strand=-
atgttttatccagagcactttgacgtcatcattatcggcggtggtcacgccggtaccgaagcagcaatggctgctgcacgtatgggacgtcaaaccttattactgactcacaatattgatactttgggccagatgtcatgtaatccagccattggtgggatcggtaaagggcatctggtaaaagagatcgatgcacttggtggcctaatggctcaagcaactgatcaggccggtattcaattcagaacactgaatgtcagcaaaggtccagcagttcgggcaacacgagcacaggcagatcgagtactttaccgacaagccgtaagaaccgcattggaaaaccaacctaacttaatgatcttccagcagtcggttgaagatctcatcgttgaaaacaacactatcacaggcgttgttacacgtatgggattaaaatttaaggcaaaatcagttgtactgactgttggtactttccttgatggaaaaattcacatcgggctggaaaactacagtggcggacgtgccggagatcctcctgcgatcgcattatcccatcgcctgcgtgaattgcctttacgcgtagctcgcctgaaaacgggaacacctccccgcattgatgcacgaaccattgatttcagccagcttgagcaacagttgggtgataacccgatacccgtattctcattcatgggcaacgtagatcaacacccactacagatcccttgctatatcacacataccaatgaaaaaacccatgaagtgatccgtaataatttggatcgtagcccgatgtatgcggggatcatcgaagggatcggaccacgttactgcccttccatcgaagacaaagtcatgcgttttgcggatcgcaacgctcatcagatcttccttgaaccagaaggcctcaccagtaacgaaatctatccgaacggcatttcaaccagtctgccatttgacgtgcagatgcagatcgttcactccatgaagggtatggaaaaagcccgtatcgttcgccctggttacgcgatcgaatacgacttttttgatccacgtgatttaaaacagacactggaaagcaaatttatcaatggcctgttctttgctggtcaaatcaacggcactacaggatacgaagaagcggcagcacaaggattactggcaggtttgaatgccgcacgttatgccgcagatgaaaacggctggttccctcgccgtgatcaagcctatatcggtgtattggttgatgacttgtgcacattgggtacgaaagagccttaccgcatgtttacgtcgcgcgcagaatatcgtttgatgctgcgtgaagacaatgcggatctccgtttaacggaaaaaggccgtgaattaggcttggttgatgatcaacgttgggagcactattgccgcaaagttgagatgattgaacaagaacgccagcgcttacgaaatatctgggtacacccgcattctgatagcttggatgaaatcaaccaaatgctgaaggcaccactgtcaaaagaagccaatggtgaagatttactgcgtcgccctgaaatgaattatgaactgctgacatcactgccacgttttactccggggctgacagaacctcaagcagcagatcaagttgaaattcaagtgaagtacgaaggctatatcgcccgccagcaagaagagatcgaaaaacaattacgtaatgaaaatgccgctttgccactcgatctggattacaaacaagtcaacgggctttccaatgaagttattgcaaaactgaatgatcataaaccaagttcaattggtcaggcctcgcgtatttctggtattactccagcagctatttccattttgctggtatggttgaaaaaacaaggtttattacgtcgtagcgcctaa

SEQ ID NO: 1031 - DNA, 162 bp, Xenorhabdus bovienii
  Coding DNA location: Contig name=SeqID_16848; Position on contig =180563..180724bp; Strand=-
gtgtataactacgcatttagatcccagcttatactgacttggatcacggatcattcacagcaaatgatcctttacagcgccatgatctttctatggaaaaatcacttatccacagatgatcgcgatcctaataacagatctaataaagagatctttaaataa

SEQ ID NO: 1032 - DNA, 444 bp, Xenorhabdus bovienii
  Coding DNA location: Contig name=SeqID_16848; Position on contig =180825..181268bp; Strand=-
atgatgagcacaataaccttaatcagcggcagcacaatgggaagtgctgaatatgttgccgaacatatggcggagatcttagaaaatcacgggttttcaactgaggtccttcatggtccttcactggatgatctgcgccttggtgggctatggcttgtggtcacatcaacacatggggcaggggacttacccgaaaatcttcagcctctggcagacacgatcgcacaagaacagccagatctaagtaacgtgacatttggttcggtcggtattggcagttccgaatatgacatattctgtggcgccatcaaatcatttgagcatctattgaaagatcgcggagcaaaaaggatcggggatcgattggaaatagacatccagaagtatgaaattcccgaggatcccgctgaagattgggttaaagaatgggcaaagttactctga

SEQ ID NO: 1033 - DNA, 462 bp, Xenorhabdus bovienii
  Coding DNA location: Contig name=SeqID_16848; Position on contig =181359..181820bp; Strand=-
atggcagaaatttatcagatcgataatttagaccgtgacattcttcacgctttaatggataacgcacggacaccttatgcagaattagccaaaaaattcgccgtcagcccgggtacaattcatgttcgagtggaaaaaatgaagcaggcagggatcattacaggcactcgtgttgatatcagtgccaaacaactggggtttgatgtgtgttgctttatcggcatcattttaaaaagcgccaaagactatccggccgcattgaaaaaactcgacatgcttgatgaagtggttgaagtctattacaccacagggcattacagcattttcactaaagtcatgtgccgctccattgaatcgcttcaagatgtacttatcaacaagatccagacaatcgatgaaatccagtcaacagaaaccctgatctccctgcaaaacccaatcataagaacaatcaagccttga

SEQ ID NO: 1034 - DNA, 993 bp, Xenorhabdus bovienii
  Coding DNA location: Contig name=SeqID_16848; Position on contig =181986..182978bp; Strand=+
atgaaaacatcctttattgaaaaacagcagcagattagttttgtgaaatcatacttttcccgtctgctagagaagcaactcggtttaatcgaagttcagggacccattctgagccgtcttggtgatggtactcaggacaacttgtctggccatgaaaaagcggtacaggtaaaagttaaaacattgccagatgcaacgtttgaggtggttcattctctagctaaatggaagcgcaagacattaggtcgctttggttttcaagctgaacaaggattgtatacccacatgaaggctctgcgtcctgatgaggatcgcctgactcctatccactctgtctttgttgatcagtgggattgggaaaaagtgatgggtgaaggtcaccgctcactcggttatttaaaacagacagtaggtaaaatctacgaagcgataaaagaaacacaaaaagcagtaagtaaggaatttggtctggcaccgttcctgccagatcaaattcactttcttcacagtgaagagcttctgaaacgttaccctgatctggatgctaaaagtcgtgagtgtgaggccgccaaagagtttggtgcgattttcttgatgggaattggtggtaagttatctgatggtcagtcacatgatgttcgcgcaccggattatgacgactggacaacgccaaacagcgacggcttcttcggcctgaacggtgacattattgtctggaaccctgtattgcaagatgcttttgaaatttcgtcaatgggtatccgtgttgatgcagaagcactgcaacgtcagctcgagctaacttgtgatgaagatcgactgcaatatgactggcatcaggcattggtcaaaggtgatatgccacaatccatcggtggaggcattggtcaatcacgtttggtgatgctgctgctgcaaatggcgcatattggtcaggttcagtgtggtgtctggtcacccgaaattatcgaatctgttgaaggtgtattgtaa

SEQ ID NO: 1035 - DNA, 1458 bp, Xenorhabdus bovienii
  Coding DNA location: Contig name=SeqID_16848; Position on contig =183012..184469bp; Strand=-
atgttaactctggcaacgctcgatcttttactctcgatcaatgaaggtgaactgatcgaggagatcattttagcactgttaagtacccctcaattggccattttttttgaaaaattccctaggttcaagcgcgcattattgaaagatgtacctgcatggcagcaaacactacaacaaagaataaaagatacactcattccagcctctctagctgaagaatttcagttataccagcaattactaacggctaatacgaccgaattttatcaacaactctctgatctcgcagagaagcttgaacagatcaaatctccttttacccatgacgcccacacattgcgagaagcgttatctgaacacacccacgcaggacaaatcctgtttattcaacgctggcgcaccagcctgatcctgcaagtaacaacctttcataagcaattgctggaacaggaaaaagaacaattattggcagagatccagaaacgattggttctcagtggcaatctcgatccgatattcgatgaaaatgatcgcgccgcagggcgattgtgggacatgagcaaaggccgacttcacctgacgtcgcacaataccgcattattcacccaatatgctgaatttctcagacagcagcctgaactggaaaaactggcacaattactcggccgcagccaagcggctaaatcaattcccgaagatagcgacacccttgaaccattcacccagatagagcgaatgccagataccgtgccagagcaagtcagcggtatccaacaaggtgacgatatcctgagacttttacccacagaactggccatgctgggaattgaagatttggagtacgaattttatcggcggctggtggagaaaaagttactgacctaccgcttacaaggagacaactggcagccaagaaccatattgaagccggttactcaccatgatcatgcagaacagccccgaggaccatttattgtgtgcgtggatacttccggatcaatgggcgggttcaacgagcattgtgcaaaagcattttgtctggcactgatgcgtattgctctggcagataatcgtcactgccacatcatattattttccacagaactcatacactatgacttaacgtcacaagatggactaacacaggcggtacattttttggggcaaactttcaaaggaggaaccgatctggcattctgcctgaatgccatcattgagaaaatgcaagaaaatatctggaaagatgccgacgctgttgttatttcagatttcattgcccagcggttgccagacgttctaatccatcagatacaaaacctgcaacaacgccaacaacaccgcttccatgcagtttccctatcccattatggaaagcccggtatcatgcggatattcgatcatatctggcgctttgataccgggattacaagccgtttactgcgaagatggcgacactga

SEQ ID NO: 1036 - DNA, 1503 bp, Xenorhabdus bovienii
  Coding DNA location: Contig name=SeqID_16848; Position on contig =184474..185976bp; Strand=-
atgcaattggtcgagaaaatatcccagttaagtcagcatctagaaagcggattatatgaaagacgacaagccatccgtctctgtcttctggccgccttatgtggagagagtgtttttctcctggggccaccggggatcgcaaaaagcctgatagcacgccggctaaaatttgcgtttcaaaatgctcacgcttttgagtatttgatgacacgcttttccacaccagaagagatcttcggcccactctccattcaagcactcaaagatgaaggccgttaccagcgcctgacagaaggctatttgccagaagcagaagttgtttttctggatgaaatctggaaagcaggccccgctattttgaataccttgctgaccgcaatcaatgaaaagaaatttagaaatggcaaccaagaagaaaacctgccgatgcggttattggtcacggcatccaatgagctgcccgatgctgatagcagcctggaagccctctacgatcgtatgttgatccgaatctggctgaacaacattcaggaaaagaaaaattttcgtgccttactgactgatcgaaacaatgggaatgacaatcctgtacctacccatttccaaatcacagatgaggaatttcatcaatggcagtgtaagattaaacacgtctccctgccaggctacattttcgagctgatttatcagctacgccagcaactgaatgcctctgaaaatctcccttacgtttcagatcgccgctggaaaaaagccatccgcttattgcaggctagtgcattcttcagtgggaaaaataccatatctccgctagatttggtgctattgaaagactgcctgtggcacgacctgagtgccttaaagcttctgccgcaattccttcatgatttgctaacagaacaagcctatcaacagcgtttcctgctacagaaaatggatggagtataccaacaatggatacaaaccagccgagatgaaactcaccttcatcccttacagttaaccacgaattcatcacttttcggccgcaagacccactactcatttcccaaaactatcaatgatgaaaaactgacgctatttctgtatcccgcattacatctgcatgatattgaagttaatttcattgaaatagataggaaagtactggaaaacgtactcaaaaatagcagtggagaagtgctcgcttgcttaaatggcattggttttccactgaaaatttcggccgagatcaacgaaaaacatcaactggaagtgctggatatgagccgtaacagtgccattctctgccaagcggaagcaaagcaactaacaatagaaaaaacaaataacgagtggaatgaaaagctgatatctattagtgatgccatccagcatcagcgccaattgttcggtcagcatcaaccttgtttatttatcgaagaatattggattgccaacattgaacaaagctttctgcaattgatcgaaaaattgaaacaattgagatcaaaaatggggtag

SEQ ID NO: 1037 - DNA, 129 bp, Xenorhabdus bovienii
  Coding DNA location: Contig name=SeqID_16848; Position on contig =186163..186291bp; Strand=+
atgatcacattttcatatcaagcatgttgtctttgctatagggctttatatgatgacggtttagcgaaacgtttcgctttcgctaaggagttaataaaaaatgaaaaaaggcgttttattgcattctga

SEQ ID NO: 1038 - DNA, 420 bp, Xenorhabdus bovienii
  Coding DNA location: Contig name=SeqID_16848; Position on contig =186263..186682bp; Strand=+
atgaaaaaaggcgttttattgcattctgatatttctgccgttatttctcgtttggggcacactgatcagatcacaatcagtgatgcggggctacctatcccgttgtccacccagcgaattgatttagcgttaacccagggaatacccgatttgatgtctgtgtttgacgtggttgtgcaggaaatgcaggttgaagcagccattttggctgcggagatgattgatcacaaccctcagatacatgaacaaatcatcaagcgcattgctgaactcgaaacaaaacagggaaatgcaatcgcgatagagtatgtgagtcataacattctgaaagagaagacagaaaagagcaaagcgattatccgtaccggggaatgttctccttatgccaatatcctcctttgttctggcgtaactttctga

SEQ ID NO: 1039 - DNA, 1518 bp, Xenorhabdus bovienii
  Coding DNA location: Contig name=SeqID_16848; Position on contig =186690..188207bp; Strand=+
atggagccattgctggagttaaaggaaattgataaggctttccctggggtaaaggcgttgtcgggtgcagtccttcgcgtttatcccgggaaagttatggcgctggtcggcgaaaatggtgccggtaagtccacgatgatgaaagtcttgaccggcatctataccaaagatgccggttcaatctattatcttgggaaaaatgtggttttctccgaccctaaatcgtcccaagaggctgggattggcattattcatcaagagttaaatcttatcccccaactgacgatcgcagaaaatgtttttcttggacgtgagttcgtcaataaactgggtatcatcaattggcaaaaaatgtatgaagaggccgataatctgctgaagcgtttgaatatccgttatagcagccgtcgactggtttctgaattgtccatcggcgatcagcaaatggtggaaattgccaaggtgctgagtttccaatccaaagtcatcataatggatgagccaacggatgccttaactgataccgaaacagaatcgctgtttcatgtcatacgggagctgaaagctcaaggctgtggcattgtctacatttcccatcgtctgaaagaaatctttaaaatttgtgatgacgtgacggtatttcgtgatgggcagtttattggcgaacagccagttactgctctgcaagaagatacgttgatcgaaatgatggtgggacgcaagctggaagatcaatacccgcgtctggatctgccgcgtggggaaaaacgactggagattgaaaacctatctggagcagggatcaaaaatgtcagtttttctctgttcggtggcgagattctgggaatatccggtttaatgggagctggtcgtactgaattgatgaaggtgatctacggagcattgccgaaaactaaaggcaggatcctgctggatggaaaacccctgactattcgcaatccacaggatgggctggctaacggcattgtctatatttcggaagaccgtaagcgtgatggcttagtgttgggaatgtcggtcaaagaaaatatgtccctcacagcgttacgttatttcagtcaaaaaccctatcgtttgaatcattccgcagaacaaaaagccgtaactgacttcatcaaattattcaatatcaaaactccctcaatggaacaatcgattggcttgctttctggcggtaaccagcaaaaagtggcgattgcccgtggtctgatgactcgcccgaaggtattgattttggatgagccaacccgaggagtggatgtcggtgcgaagaaagagatctatcagttgatcaatcagttcaaaaaagaaggtttgagcatcattttggtctcgtctgagatgccggaagtcatgggaatgagtgatcgtattctggtgatgcatgaaggtggcataagtggtgagttcagtgcggataacgcctctcaggaagcgctgatggtcgctgctgtcggcaaacaatacggtgcagttaaaggtaatgatcaaggataa

SEQ ID NO: 1040 - DNA, 972 bp, Xenorhabdus bovienii
  Coding DNA location: Contig name=SeqID_16848; Position on contig =188213..189184bp; Strand=+
atgaattctaacacagcaccaacctccagacgtttgctcacgaaagcctggttgatggagcagaagtcactgattgcactattgattctgattgttgtcgtttccttcctcagccccaattttttcacactgaataacttatttaatatcctccagcaaacttctgtcaacgctatcatggcggtgggaatgacgttggtgatcctgacttctggcattgatttatccgtcggatctctactggcactgacgggagcggtggctgcatctatggtcggtacggatgtcaacgcgctggtggcagttgttgcagcactggcattgggggcagcgattggcgcatgtaccggtgttattgttgcgaagggcaaagtccaggcgtttattgccacattagtgatgatgctgttattgcgtggtgttacccgtgtttataccgatggcagtcccatcaataccggattcagtgataatgccgagctatttggctggtttggtattggccgtccattaggagtgccggcgccagtctggatcatgttgctggtttttgctgctgcctggtacattctgcatcacactcgccttggccgttacatctacgctttaggcggaaatgaatctgcaacacgtttatcaggtattaacgttgataaaataaaaataatcgtttattccctatgtggcctattggcagctctgggcagtattatcgaagtggcccggctatcttctgcccaaccgatggcaggaagtggttatgaactggatgctattgcagccgtggtgctggggggaaccagcctggctggcgggaaggggaggattgtcggtacgctgtttggtgcgctgattttaggctttttgaacaatggattgaacttattaggtatttcttccaactaccagatgatcgtcaaggcagttgtgattttactggcggtcttggttgataacaaaagtagtaaataa

SEQ ID NO: 1041 - DNA, 891 bp, Xenorhabdus bovienii
  Coding DNA location: Contig name=SeqID_16848; Position on contig =189209..190099bp; Strand=+
atgaaaatgaagaagctggcaaccattctatccgccgtagccttgagtgcaaccatgagtgccaatgcactggcgaaggatagcattgcattggttatttcaacattgaataaccccttctttgtcacgatgaaagacagcgcacagaaagaggctgataaactcggatatgacctgattgtgcttgattctcaggataatccggcaaaagagctggctaacgtacaggatttgactgttcgtggcacgaaattgatgctgattaacccaacagattcagacgccgttggtaatgcggtcatcatggcaaacaaggcgaatattccggtcatcacccttgaccgtacggcgaataaaggaaacgttgtcagccatattgcttctgacaatcgcttgggtggcaaaatggccggtgattttatcgctgaaaaattgggtaacaatgccaaaatcattcaattggaaggtatctctggtacttctggtgcacgtgaacgtagtgaaggtttttttcaggccgccaaaaaccatcaattcaatatgctagccagccagcctgctgactttgaccgtacaaaagggctgaatgtcatgcagaacctgctgacagcccacccatcagtacaagccgtttttgcccaaaatgatgaaatggcactcggtgcgttgcgtgcgttgcagacagccaataaaaaagatgtgctggttgtcggatttgacggaactgacgatggcgtcaaggctgtacggagcggtaaattaagtgcaacgattgcacagcgccccgatcagattggcatcattggcgttcagacagcagacaaggtgctgaaaggtgaaaaagttgacgctactatcccggttgaattggaattagttatcaaaaaataa

SEQ ID NO: 1042 - DNA, 924 bp, Xenorhabdus bovienii
  Coding DNA location: Contig name=SeqID_16848; Position on contig =190169..191092bp; Strand=+
atggcaaaacttgccgtgatgggcagcattaatgcagatcacatcttgaacctcgaatcttttcctcagcctggggaaaccgtgatgggaaaacagtatcaggttgcatttgggggaaagggagctaatcaggcggttgctgcaggtcgctgtggtgctgacattacatttattgcttgtgttggccaagatgatattggcgagcgtatccgtcaacaattggcgaaagataatatcaatacctcggcaatcggagttattgaaggtgaaacaacgggtgtagcactgatttttgtgaatcagcagggagaaaacgtcattggcattagcgcaggagcgaatggcgcactaacatctgaatatttccaccatcatgagcaggtggtcaaagaggctgatgtgttgttgttacaactcgaaacaccgttggaaaccgtacagctagccgctgaaacggccagaaaacataacaccaaagttatcttgaaccctgcgccagcacagaaactctctgaacaattactttctttggtcgatatcatcactcctaatgaaacagaagcggaatacttaactgggatcgctgtaaaagatgatgtgggagcagaaaaagccgctcaggacttgcataataaaggtattgaaatcgttattatcacattgggcagccgtggtgtatggctgagtgaaaatggtaagcaaggtaaaattgttcctggatttaaagtcaaggcaatcgatacgattgcggcgggcgatacatttaatggtgctctggtaacggggttattggaggggaaagaaatagtatcggcaattcgttttgcccatgctgcggcagctattgctgtgacacgtcagggagcgcagcctgctgttccgtggcgacatgagattaatgcatttctggctgaacaggactaa

SEQ ID NO: 1043 - DNA, 993 bp, Xenorhabdus bovienii
  Coding DNA location: Contig name=SeqID_16848; Position on contig =191104..192096bp; Strand=+
atgaaggacgttgcccgtcttgcgggtgtatcgacatcaacggtctcttatgtaattaatgataaccgttatgtcagtgagagagtgaaaaagaaagtcaatgcggccattgatgagttgaactatgctccttccgccttggccagaagtctgaaaatcaagcaaaccaaaaccatcggtatgctggtcactaccagtaataacccgttttatgctgaaattgtcaggggagttgaacggaattgttacgagcggggatacagcttaattctgtgtaataccgaaggtgacgtgacgcggctgatccgcagtatggaaacactattgcaaaaacgtgttgatggcttgttaatcatgtgttctgaaaatgcggtactacccaatgattttttgctccgatatccacttataccgatggtaacaatggattggtcgcctttttatgtatccagtgatgtcatcaaagataactctctattgggaggcgaattagctacaagttatctgattagccgaggttttcgtaaaattgcctgtatcgctggcccacaagataagacgccagcccgtcagcgtctggctggatatcgaaaagcaatgaaagatgcccagttagagatccctgaagggtatgaaatccacagtgattttgaatttgctggtggattgtcatcaatggaacagctactccaattatctaaacctcctgaggcggtatttgcaggaaatgacgccatggctattggggcttatcaagccttacatagggcgggtctttctgttcccgatgatatctccgtgattggatatgatgacatttcgatggcgccttacatgaccccaccactgaccaccattcatcaacccaaagatgaattgggtaagctggctattgatactctgctctatagaatgggtaatccaggaagtgagccaaagcaattgattttgaagccaaaactgattgagcggaattctgtagccagacgctga

SEQ ID NO: 1044 - DNA, 1383 bp, Xenorhabdus bovienii
  Coding DNA location: Contig name=SeqID_16848; Position on contig =192102..193484bp; Strand=-
atggtcaaatctgcacgcagtatgtcgggattgccctggattgctgcgatagctttttttatgcaatccctggatgcaaccatccttaataccgcattgccggcaattgctgaaagtcttaatcatcatcctctggcaatgcagccagccattgtcagttataccttaacggtggcaatgttaattccggtcagtggttggttggctgatagattcggcacacaacggatattcatttatgccgtttcccttttttctttaggttcactcgcctgtgcgttatccagcagtttctcttttttggtagctgcccgcgtcattcaagggattggtggtgccatgatgatgcctgttgcccgtttggcattactgcgggcatatcctcgcagcgaattgttgcccgttctgaattttgtgactatgccaggtttgcttggcccaattttaggccccatgcttggcggattgttagtaacctatgcaacttggcattggatcttcatcatcaatattcctatcggcctactgggtattatttatgccagaaagcacatgcccaactttaccatgcctaaatgcccctttgattttctgggattcatgctatttagtgtagggctggtgatgctttcggtcagcttcgatttatttggtaataatactctgcctaactatgttcccgttgcggttatggcgggtagtatcattatgctgtcaggatatatcttccatgcaaaaaggcatccaaatccactcatcgacctccagttgttccaaacacgtaccttttcagttggcatcaccagcaatattgccactcgcttaagtacgggttccctctcatttcttattccgttaatgctacaggtgggttttggttactcggctattattgccgggataatgatggcaccaaacgccattggcgcaattctcgctaaatcttttgtcaccaagttactgactcgatttggatatcgaaacacgctcatttgggttacggtgatcattggtgtgatgattgcacagttttcgctacagacaccggagatatcactcgtctttttgatcattcctctatttattttaggaatggcaatgtccacgcaatttacatcaatgaataccattacccttggtgatttgaataataacaatgccagtgcgggcaatagcctattggcggttactcaacagttatctatcagtttgggagtaacagtcagtgctgcaatccttcggttttatgagtcagcagaatacggttcaacagtggatcacttccactatacttttattacgataggcgtgattactctagcctcttcttttgttttcctgttattgaagaaagaagatggccggaatttgattaaaaagtaa

SEQ ID NO: 1045 - DNA, 150 bp, Xenorhabdus bovienii
  Coding DNA location: Contig name=SeqID_16848; Position on contig =193664..193813bp; Strand=+
atgccaattttgttgaaaaaaaacacgaacggaaagaaaattcaaaaaaactattgtcaggcggcgaaaagtccctataatgcgccaccactgaccgacgctgagcgaagacacgccgcggcggacagcgagagaacagcccggaaataa

SEQ ID NO: 1046 - DNA, 630 bp, Xenorhabdus bovienii
  unsure (1)..(630): unsure at all n locations
  Coding DNA location: Contig name=SeqID_16849; Position on contig =151..780bp; Strand=+
atgatcgcgctcatgaaaattaatctgacagatgcccaaaaagaagccctcgaattgatgcatgatacgactcgcgatggacgagtacgtgaccgcattaaggccgtgcttttggcctcagaaggctggactgcccagatgattgcccaggctttgcggatccatgaaagtacggtgagtcgccatctgaaagattacttctctgaggaaaaactcgcccctgaaaatgggggctctgaaagccgtttgtctgccgaacaaacgacagcattagtggagtatctgatggcaaatttgatgcacactaccgcccaaattgtggcctatgttcgggctcgatggcaggtgactttcactgttgcaggaatgacgaaatggcttcaccgtcagggtttcagctacaagaagccaatgggtgctccgcataaatttgatgcggataaacagcaacagtttattgaaacctacaacgcgttgaaagaagaatgtggccagaatacgcctattttgtttattgatgcggttcacccgaccctgtccacaaaattaagttatggctggatgaagagcgggcggaagcacgtcaaagtggttgaaaccacgggcagtcgtactcgactcannnnnnnn

SEQ ID NO: 1047 - DNA, 282 bp, Xenorhabdus bovienii
  unsure (1)..(282): unsure at all n locations
  Coding DNA location: Contig name=SeqID_16850; Position on contig =73..354bp; Strand=-
atgatcgcgctcatgaaaattaatctgacagatgcccaaaaagaagccctcgaattgatgcatgatacgactcgcgatggacgagtacgtgaccgcattaaggccgtgcttttggcctcagaaggctggactgcccagatgattgcccaggctttgcggatccatgaaagtacggtgagtcgccatctgaaagattacttctctgaggaaaaactcgcccctgaaaatgggggctctgaaagccgtttgtctgccgaacaaacgacagcattagtggagtan

SEQ ID NO: 1048 - DNA, 825 bp, Xenorhabdus bovienii
  unsure (1)..(825): unsure at all n locations
  Coding DNA location: Contig name=SeqID_16851; Position on contig =116..940bp; Strand=+
atgaaagaattagtggatgtcttttctgattttccagacccacgttgtcagggaaaggtcaaacaccgtgttattgatatcttagtgatcgcggtatgcgctgtcattgctggggctaacgcctggactgatattgaacagtacggtcaactcaaaaaggattggctgagttcatttcttccgctcaaagggggtattccgtcacatgatactttccggcgctgtttcagtttattaaacccgagcctctttgaacatcatttttatcaatgggtttctcgtgacctctcttcagaaaaacgggctatcattgcgattgatggtaaaagtttacgtcattcgtttgataagaaaattgaccaaagcgcattacatatggtgagtgcattcacggttgagaaagggcttagcttatgtcaatgtgccgtagacggaaaatcaaacgaaattaaggccattccggcattattatcgatgctttcattgaaaggccatctcgtgacgatggatgcgatgggttgccaacgcacgattgctcagcaactacgcgagagtgaagccgattatattttgtcgcttaaaggcaatcaggggaaaaccttttcggaagcggttaactattttcaacaacaacagataacccaaaaaccttaccttaaacctgaccatgatgaattcgatgatggccacggacgtaccgtcagacggcgcggatgggttctgccactgacatcagaaacaaaacacttaaggtcttggccagatattcaagctcttctggtaacagaaacgatacgacaagaacactattctgacannnnnnnn

SEQ ID NO: 1049 - DNA, 369 bp, Xenorhabdus bovienii
  Coding DNA location: Contig name=SeqID_16852; Position on contig =389..757bp; Strand=+
gtggatgcgcatggtatgccgatcagagcgcttattacaagcggtcccacagcggattgctcacaagctgaggccttgattgacggaatagatgcagaacatttattagcggatcggggctatgacagtaataccgttgttgaacaagcagaaaaacaaggcatggcagcgcaaattcccggccgaaaaaatcgcaaagtgaaacgagaatatgatcgggaactctatcgactcaggcatttagttgaaaatgcttttcttcatcttaaacgctggcggggtatagcgacccgttatgccaaaaatagtgcctcatttcttgctactgttcagatccgctgtcttgctctttggttaaatgtcttatga

SEQ ID NO: 1050 - DNA, 948 bp, Xenorhabdus bovienii
  Coding DNA location: Contig name=SeqID_16853; Position on contig =2..949bp; Strand=+
gttttccgtgccgcacaagagcgttcagacatcgaaatcgttgctatcaatgatctgctggatgcagagtacatggcttacatgctgaaatacgattcaacccatggccgcttcaacggtactgttgaagttaaagatggtcagctggttgttaacggcaaaaccatccgcgttacatctgaaagagacccagctaacctgaaatggaacgaagtgggtgttgatgttgttgcggaagcaaccggtattttcctgaccgacgaaactgcacgtaagcacatcgctgccggcgcgaaaaaagttgttctgactggcccatccaaagacgacacgccaatgttcgttatgggtgtcaaccacaatgcctatgcaggtcaagagatcgtttccaacgcatcttgcacaaccaactgccttgctccactggctaaagttatcaatgacaaattcggtatcgttgaaggtctgatgaccactgttcacgcaacaactgcaactcagaaaactgttgatggcccatcagcaaaagactggcgtggtggccgtggtgcagcacagaacatcatcccatcttctactggtgccgcgaaagctgtaggtaaagttatcccagaactgaacggcaaactgacgggtatgtctttccgtgttcctactcctaacgtttctgttgttgacctgactgctcgtttggctaagccagcaacttacaaagaaatctgtgatgcaattaaagaagcctcagaaggcgaactgaaaggcattctgggttacaccgaagatgatgttgtttccactgatttcaacggcgaaaaactgacttctgtatttgatgcaaaagcaggtattgcgctgaacgataactttgtgaaactagtttcttggtatgataacgaaacgggttactctaataaagttctggatctggttgctcatatctctaaataa

SEQ ID NO: 1051 - DNA, 873 bp, Xenorhabdus bovienii
  Coding DNA location: Contig name=SeqID_16853; Position on contig =1089..1961bp; Strand=+
atgcttgataaaattttctcattaccggttgtagaacaaatatctccttatatcagtcagcgaaatattgaaggatttccgctgattgttgtttcacaccctaaagtgcgcggcgcaatcagtattcagggggcacatcttattacatggcagcccagtggcgaaaaacctgtattatggttaagcgataacactgaatttaatacaggtacagccattcgtggtggcattcccatttgctggccttggtttggctcgacaagcgctcccagtcacggttttgcacggatcttaccttgggaattcagggcacaccatgaaaatgaaaacggcgtgatcttgacatttacgctacaagataacgccgatacacataagttatggtcacacgagttcacactcattgcccgttttaagttaggggaaacctgcgaaatagagctggagtctcacggagaatatcaagcaacatgtgcgctccactcttacttcaatatcagtgatgtcaatcaaatctgtgtcagcgggcttggtgctcattttatcgataccgttgccgataaaaaacagtacgttcacgaagatctgacttttaaaggacgaattgaccgtatttatactgaaccagaagatttcagcctactcagtgatacaccgtggaaacgaactattgaaattcaccattatcaccatagtgatgtagtttgctggaatcccggtgccgaactttccagcagtatgaaagatatgagtaaagaaggttataagaatatggtttgcatcgaaactgcacgtatcaattccccacagctatccagaaataacaaccctgccagactttctgtggttatccgttgccgcaaaaatccttga

SEQ ID NO: 1052 - DNA, 747 bp, Xenorhabdus bovienii
  Coding DNA location: Contig name=SeqID_16853; Position on contig =2059..2805bp; Strand=-
atgactaataaggtgtttattgcagtagtggggctttgcctgtcttcttctgtggcatatgctggcgaatggtctattgggttgtcggcattgtatgaagctaaaccttacaacggattgaaaaaaaaagataaaatactgccggttcccatggtatcttatgagagtgaaaacttttattttcagactttggcagcaggttattacctctggaaccagccaaaggataaactttctgtagatctgttctattctccacaagctttccatcccaaggatagtacagatgagcagatgaaaaaactggatcgtcgtcgtgacacggttatgggtggtttcacttataaacatcatgaagattggggggtgctgcgtgcctcattagctgccgatatactgggcgaaagtaacggtatcagtgctgatttcgcctatttatatagtttccagcagagcggctggttattggaaccaggggtaggcgttgtctgggatagcaaaaaacagaaccgttatagttatggcatcaaaaagagcgaatctgtgcggagcggtctggctgaatatacaccgggcgatagctggagcccttatcttgaattgtctggttattacaccttcgataagaattggactgctttcatgatggggcgtgtagaacatttaccaagcgaagttaaaaacagcccgatgaccaatcgctcatactccggtactatctggtcgggtattacttatactttctga

SEQ ID NO: 1053 - DNA, 1068 bp, Xenorhabdus bovienii
  Coding DNA location: Contig name=SeqID_16853; Position on contig =3085..4152bp; Strand=-
atgccacgtcctattttggcgacgatccatctcgatgcattccgccataacttggcggttatccgccagaaagtcggtgacagcaaaatctggtcagtagtgaaagctaatgcatatgggcatggattggacagaatatggcagtcactcatgcaaacggatggatttgcgctgcttgatatgaatgaagctatttatttaagggaacacgggtggcaagggccaatcctgttattggaaggttttttcaaactttcggatttgcagctcattgatcaatatggcctgacaactacagtgcatagttactggcaactcaaggcaatagaagaggccagactgaataaccccattgatatctatttgaaactcaatagcggaatgaatcgtctgggttttacccccgaagaatattcacaggtggtctcaatggcgaatcgcataaaaaatatcaattcagtcacgttgatgactcattttgctaattcagataatgagattggtattgatgggcaatttgcggttgttgaatgtctgcaaatgggctcacttcctcgctgtctagccaattctggtgcagttttgtggcatccgaagacacatggtgactgggttaggccgggtattatcctgtatggtgcatccccgagtggaaagtggcgtgatattgctgatgtgggtttgaaatcagcgatgagtttgcacagtgaaatcattgcggttcatgacctacccaaaggggcaaaaattggctatggcagccgttatacaacccagtatcctacccgtgtaggtacggtggcatgtggttatgctgatggttatccaaggcacgccccaacgggtacccccatccttgttgatggcgtccgtacacagttactgggtgccatatcgatggatatgatgacggttgatttgacgccgtgtccacaaacagaaataggtagtaccgtggagttatggggggaaaacttgccagtggatgaagtggcggaatccgccggaaccattggttatgaactgctctgtgctttagctatacgtgttccggtagttgttaactga

SEQ ID NO: 1054 - DNA, 1302 bp, Xenorhabdus bovienii
  Coding DNA location: Contig name=SeqID_16853; Position on contig =4169..5470bp; Strand=-
atgaaagtccttattttaggcggtggcgttattggcgtcaccagtgcgtggtatttggcacaggaaggccatgaagtgactgtggttgatcgccagaatagtgccgctgaagaaacgagtgcaggtaacgctggtcagatctcaccgggatatgcaacgccatggggagcaccgggaataccactgaaagcagtaaaatggatgtttcaacgccatgcaccactggctattcgccctgatggttcactgtttcagctacgctggatgtggcaaatgctgcgcaactgtgatgcagaccattacgccatgaataaaagcaggatggtgcgattggcagaatatagccgtgattgcattaaacggttaagggcagatactggcatgcaatatgaagggcgtcagggaggaactctgcaattatttagaaccgccaaacagtttgataatgccgccaatgatatcgcagtattggaacaagaaggtgttccttaccaattattgaccgcagaacaactggcatcagtggagcctgcacttgcccatgtttctcataaattggcgggtgggttacaactgccgaatgatgaaacgggtgattgtcagatatttaccaaggcactggcaaaaatggcagaagaggcgggagtcaagtttgtatttagcaatcaggttaaacagattctggtggatggaaacaaaatcacgggtgtccagtgtgatgatggcattatgacggcggataactacgtggtggcgatgggatcttattctaccgacatgctgaaagaattcgttaaaatccctgtttatccgctgaaaggctattctctgacgatgccgattatggatgaagcaagagcgccaacctcaactgtgctggatgaaacttacaagatagctattactcgttttgataaccgtattcgcgttggtggcatggcagaaatggttggtttcaatatgaatgtgccgaataatcgctgtgaaacgttaaaaatggttgtgcaggatctctaccacagcggtggcaatattgctgaagctacattctggactgggttacgcccaatgacgccagatggtactcctatcgtcggcccaaccaaatatagtaatctctatttaaacacagggcatggaacgctaggctggacgatggcctgtggttcagggaaattattgtctgatttaatttctggtaagacgccggaaatcgcggcagatgatctctcggtatttagatacatcaatggattcaatacaaaagtgcttcgagtgaagcatcgtttacatacggcataa

SEQ ID NO: 1055 - DNA, 723 bp, Xenorhabdus bovienii
  Coding DNA location: Contig name=SeqID_16853; Position on contig =6008..6730bp; Strand=-
atggtaattaaggctcaaagccctgcgggtttcgcggaagagtatatcattgaaagcatttggaataatcgctttccaccaggttccatgctgccagcagagcgtgagttatctgagttgatcggtgtcacccgtactactttacgtgaagtgttgcagcgccttgcccgtgatggctggttgactattcagcatggaaagccaacaaaggtcaataacttctgggaaacatccggtcttaatattctggaaacgctggcacggcttgatcatgatcgcgttccccagttaattgataatctactggcggttcgtaccaatatcgctgctatttttattcgtactgcatttagacataatcctgaaaaatcattggaagtattggcagaaaaagagaatgtggaagataccgccgaatctttcagtgccgtggattatgatatttttcgtgggctggcttttgcgtcaggaaacccaatttacggtttgattatcaatggattaagagggctttatacccgcgttggccgctattatttctcaaaccctgatgcccgtatgctggcactgaatttctatcagcaattgagtacgatgtgtcgggaacaatcctatgacaaaatcatggattgtgtgcgtagttatggtaaagaaagcggaatcatttggcatggcatgcagagtgttatgttgaatgatttaacagaagcacgtcacagctga

SEQ ID NO: 1056 - DNA, 1551 bp, Xenorhabdus bovienii
  Coding DNA location: Contig name=SeqID_16853; Position on contig =6967..8517bp; Strand=+
atggaaatcagtattcgacatgcagtggtgaaaaactttctcggcaactcgccggattggtacaaattggctatcattgtttttcttattatcaatccactggtttttttctttgtcaatcccttcgttgcagggtggatgctcgttgtcgagtttattttcacgttggcaatggcgttaaaatgttaccctttacaacccggaggattactcgctattgaagcggtcatcatcgggatgacttctccaaaacaaataagtcatgaaatctccaacaatctcgaagttattttgctgttgattttcatggttgccggcatctatttcatgaagcaactgctactgtttgttttcacgaagctgctgttaactattcgctccaaaaaaatgctggcactcgcgttttgcctggcgagtgcctttctgtctgcgttccttgatgccttgaccgttattgccgtcgttatcagtgtctcggtagggttttactccatttatcaccacttcctttcctccagccaaaatgacaattctgacctgaacgatgatcagtttattgacagcgaagataaaaagcagactctggaacagttccgggcatttctgcgcagcctgatgatgcatgcaggtatcggcacagctttgggtggtgtaatgaccatggtgggcgagccacaaaacctgattattgctaaacacgttggctgggatttcgtgacgttttttgttcgtatgtctcctgtcaccataccggtatttgtctgcggtctgctggtttgcttgctggtcgagcattttaaattgtttggttacggtgctgaattacccgatcacgttcgttcggttttagaagattacgataaaaaaaccagtgaaaaacgtactcggcaggaaaaaactcaacttgccgttcaggcattaattggtatctggctgattttggcactggctttccatttagcagaagtcgggctgattggtctgtcggtaatcattctggctacggcattctgcggtatcaccgaagagcatgctttaggtaaagcgttcgaagaagctcttccgtttactgcactgttaaccgtttttttctctgtcgttgccgtgattattgatcagcaattgtttacgccattcattcaatatgtgctgcaatcttcgccagcctcacaattgtcattattctatctgttcaatggattgctttctgccgtttctgacaacgtattcgtagggacggtttacattaatgaagcgctaatagccttgaagaatggtttaatttcacagcaacaatatgagtttctggcagtagctatcaatacaggtaccaatttgccatcagtggcaacacctaatggacaagccgcatttctgttcttgctaacatctaccctgtctccattgattcgtctgtcttatggccgcatggtgatgatggcgctgccttataccattgtgatgacattggtcggcttgttgagtgtggaattctggcttgttccagcgactgagtatctgataaaactcggtctgatcactccattttaa

SEQ ID NO: 1057 - DNA, 228 bp, Xenorhabdus bovienii
  Coding DNA location: Contig name=SeqID_16853; Position on contig =8603..8830bp; Strand=+
atggttaattttatttttttatggtttttaaaacggcaaaatgagccatcatttatagttaaatttaaacgatgggaaaaacagaaaaatgtttcgatttttaaaacagagttcccaagggcgaagcgcatggttactgatggcgttaacagctcttatattagaattgacagcactttattttcaacatgtgatgaagttacagccctgtgtgatgtgtatttatga

SEQ ID NO: 1058 - DNA, 468 bp, Xenorhabdus bovienii
  Coding DNA location: Contig name=SeqID_16853; Position on contig =8742..9209bp; Strand=+
atggcgttaacagctcttatattagaattgacagcactttattttcaacatgtgatgaagttacagccctgtgtgatgtgtatttatgagcgaattgcactatttggcattttcggagctgctctgctcggtgccattacaccaaaaacgccactacgttggctggcaatcctgctatggctgtatagtggatggcagggattacaactggcgtgggatcataccatgatgcaactccacccttccccttttaatacctgcgaattttttgttagattcccgtcatggctacccttgaatgaatggctgccttctgtatttcaagccactggtgattgttcgatgaaacagtggtcatttctgactctggatatgccgcaatggttaattggtatttttgctgcttacttggtgatgggtgttttggttctgatcagtcagttttttactgttcggggtaagaactga

SEQ ID NO: 1059 - DNA, 249 bp, Xenorhabdus bovienii
  Coding DNA location: Contig name=SeqID_16853; Position on contig =9420..9668bp; Strand=-
atgggatgggtattagcgggttgcagtgggcaacaaactgatcattcatctaaacgccacaaaaattatcagtattctgatctgaggatcaatctgagtgaaaatgccagtatgacctgctttgatgcagggggaattctagtgctggcaatacagctcaatggaaatcaaacgccggtttgccaattagcaaatgggcggcgctgtgatgaacgagccctgttggatggtggctgcacgtctatttga

SEQ ID NO: 1060 - DNA, 756 bp, Xenorhabdus bovienii
  Coding DNA location: Contig name=SeqID_16853; Position on contig =10667..11422bp; Strand=+
atgaaaaaattgcttattttattagctggaattgttttgttgtctgggtgtgctgaattcgaaaggattgatactttactggctgaaaagaaagctgccactacagacgttcaaaaatataactatttgatgcaagtctcaaaaggacaaacttacatctatgaacactcatccagaaaacccgaaacttttgaaagtatcagagatagatactttcaagaagctgggttaacggaagaaccaaaaattgtcaaaagagatttaatttataaatgctttaataaaaaaacttacccatatgaagattttgagtgtgtatataaattttactcaaaagagatagatatagaaaaagccactagaacagcagagaatcaaacggatagattgcaccaaatcagaatggaagatgcccacaatatagccaaaaccgtaaccgaagaaggtggggcagaattcacagaagtaaatataggtagattctgtcgtgcatcatccagagtggttgcaactgcttatgcaagcgttgtaaatacttatcatatttatgatctcgaagccgataagattatgcttcttggtcttacggataaagcttttgtacgccttaagaaaaaagtgacctcagataagcgaggtattgctatggtgcgtaacaatcctcaagatcaaaaaatagtttatgaggcatatgatatgctttgtaactcaaacccaaaatcatatattctgaattataagaaaatatttcgttga

SEQ ID NO: 1061 - DNA, 426 bp, Xenorhabdus bovienii
  Coding DNA location: Contig name=SeqID_16853; Position on contig =11714..12139bp; Strand=-
atggactattactattacagcccctcagaagatgtattttatccggaagtgctgaaacagggttatattgatgctggcacatggccgcaggacggtatgaaagttgatgaatcggtttatattgaattcactcaaaacacaccaaaagggaaacgccgtgttgcgggatcggatggcctaccaacatggggagatatcttccccctttcttctgaagcattgcaacgacaagcggagtacgaaaaaaggaacctgataaaggaaatccgagaaaaaatagagccacttcaggatgctgtttacttagatgtggcaaccgaagaagaaaagaccgctttaacagcatggcatcgctacagactagcgctctatcaattggatctctccaccgcacccagcatcgactggcctgcaaaaccagaataa

SEQ ID NO: 1062 - DNA, 786 bp, Xenorhabdus bovienii
  Coding DNA location: Contig name=SeqID_16853; Position on contig =12739..13524bp; Strand=-
atgcaaaacgttacgctcatcggtatcgatctcggcaagcattcttttcatgtccattgtcaggacaagtctggtaaggcactgctgcgtaaaaagtttacgcgtaccaaactaatgcagtttttggcagagtgtccatcttcggtggttgttatggaagcctgtgctggcgcacattttatggcgcggaggattactgatttaggccacgagacaaagctgatctctcctcagttcgttcgtccttttgtcaagagcaacaagaatgactttgtggatgctgaagccatatgtgaagctgcatcacgcccttctatgcgatttgtgcaacccagaactgaggctcaacaggcaatgcgggtgctgcaccgtgtcagggaatcgttagtcagagataaagtcaaaacgaccaatcagatgcatgcttttctactggagtttggcatcagtatgccgaccgggactgcggttataaaacggctttcaacagttctggcagagaatgaacttcctccgtatctgacgcagttgctgatgcgcttacatgctcactatctctaccttatcgaacagatcgcagagcttgagacggcactggaacaggagctgagtcgtgatgaaacaggacagcgacttcagacaatacctggtgtcggaccgataaccgccagtgttttgtcatcgcagttaggcgatggtaagcagtatggctgtagccgtgattttgctgcatccacaggtctggtgcttcgccagtacactacaggtggcaaaatacgcttttag

SEQ ID NO: 1063 - DNA, 468 bp, Xenorhabdus bovienii
  Coding DNA location: Contig name=SeqID_16853; Position on contig =13851..14318bp; Strand=-
atgacgacagcgtctaagctgtattcgactcttttacaggcagggacgcagcctagcaagtttgatgataagaaaggtcaagattggggatatctgaataacaaaggctggcttggtccaagccagcctacttttggtattttgactgaaatccacaataaaacagatattaaaaacatcttaatgttctattggggggagaaagaatcttctaacacctataagggcctgtatttaagggtatcttctaatgagggtaattatcagacggtggtagagttacttaagaaaagtcttgatatcacagttgataacgcaacccataattttggtactaccccacctaaaaaagaaggaaatactgattatatatacacagtccagtatgttaatgatgaagcacgaaaattaggcagtatcttaaaacaagtagatcaaaccaagcacttctgtttcaactggcgttaa

SEQ ID NO: 1064 - DNA, 369 bp, Xenorhabdus bovienii
  Coding DNA location: Contig name=SeqID_16853; Position on contig =14315..14683bp; Strand=-
gtggatgcgcatggtatgccggtcagaattgttattacaagcggtaccacagcagattgttcacaagcggagaccttaattaaagggctcgatgcagagcatctattggcggacaggggctatgatagcaacgcaatagtagaaaaagcagaacaacaaggcatgcaagtccatatccctagccggaaaaatcggaaggccgccagagaatatgatcgtgaactctatcggtttcgccatttggttgaaaatgctttccttcatcttaagcgctggcgtggtatagccactcgctatgcaaaaaatagcgcgtcttttcttgccgcagtgcaaatccgttgccttgttctttggctgaaaatatcatga

SEQ ID NO: 1065 - DNA, 477 bp, Xenorhabdus bovienii
  Coding DNA location: Contig name=SeqID_16853; Position on contig =14605..15081bp; Strand=-
atgagtacacctgcacaccgccgccacgatatttcagatcgcgtctggagcctgcttgaacctcatttgccaggacgtcaaggcgcttgggggcgtgtagctgaagataatcggcgttttatcaatggggtgttttggattttacggacgggtgcgccttggcgagacctacatactgattatggtgactggaaaaatacccaccgccgtttttgtcgctggagagataaagggatatgggaaaaactgctcgaacaattggttaatgaccccgatttcgagtggttgatgattgatgccagccatattaaggttcatcccgatgcggcaggcgctaaagggggtaatcaggatatggggctcacaaaagggggctcaataccaagatacatttggccgtggatgcgcatggtatgccggtcagaattgttattacaagcggtaccacagcagattgttcacaagcggagaccttaa

SEQ ID NO: 1066 - DNA, 318 bp, Xenorhabdus bovienii
  Coding DNA location: Contig name=SeqID_16853; Position on contig =15176..15493bp; Strand=-
gtggggcaagcccatgaaagtcgagccgccatccctttgctcgatggcattggcatacagcgcaaaaatggtttcatgaaacggcgcggcaaagccgtgctggcagataaaggctattcgggcggaaaactctgcggttatctgcgtaaattgaggataaagagcgttattccttataaaatcaatgaaaaaggccgtgctgatggtcgtacgcaatttgatgaacaggcgtatcgtgaccgcaatgttgtcgaacgctgtttcggttttcttaaaggaaatcggcgtatcgcaacccgttacgaaaaaaccgcatga

SEQ ID NO: 1067 - DNA, 810 bp, Xenorhabdus bovienii
  Coding DNA location: Contig name=SeqID_16853; Position on contig =16003..16812bp; Strand=-
atgccatcccctgccaaaatctgggaacaggcgctacaggcattacatacccgtctggctcccttatttcactctaccggctcacgacaacgcagcctcgcctatcttcggggattgctcagtgatgttgaacgtaagaatagctggcaactggctgaatgggtgggggaaagtacccccgatgggattcaatatttgctggaacgcgctgattgggatgtcgatatggcccgcgatatcctgcgggattatgtcactgaacatttgggcgatgaacagggtgttctcatccttgatgaaaccggttttatcaaaaaagggacacattctgccggggtacagcgtcagtatagtgggaccgctggacgggtagaaaacagccagataggcgtatttctttgttacgccggcaacggagggcatgcctttgttgaccgggcattatacctgcctcgccagtggacagatgcccgttcccgctgtgaagccgcgggtatccccgccagcgtcacttttgcaacgaaacccccgttagcccggcagatgctggaacgaacatgggatgccggcgttccctgtcgctgggtgaccgcggatgaagtttatggccgtgaccgtcgtctaagagtctggctggagtcccgatacccgccctttgtgttagccattccctgcaatatccccttatggtggcgagggccagagtatatccgtgctgaccggattgccgataccctgaccgccgccggggaaatcatcggcttacagagcaattacggctgtagtactaggctgtgtcccttaatgtaa

SEQ ID NO: 1068 - DNA, 345 bp, Xenorhabdus bovienii
  Coding DNA location: Contig name=SeqID_16853; Position on contig =16894..17238bp; Strand=-
ttgctcgacggcattggtatacagcgcaaaaatggtttcatgaaacggcgcggcaaagcggtgctggcagataaaggctattcgggcggaaaactccgcggttatctgcgtaagttgcggataaagagcattattccgtataaaatcaatgaaaaaggcagtactgatggtcgcacacaatttgatgagcaggcttatcgtgaccgtaatgttgtcgaacgttgtttcggttttcttaaaggaaatcggcgtattgcaacccgttacgaaaaaaccgctcgaaactatttgtccagggtgaaattaggctgtattcgactcttttacaggcggttatctaattaa

SEQ ID NO: 1069 - DNA, 459 bp, Xenorhabdus bovienii
  Coding DNA location: Contig name=SeqID_16853; Position on contig =17277..17735bp; Strand=-
atggcacgctacgacattcctgatgacgcatggatagtgataaaaccttgtttacctccggtccattcagagcgggcgggacgtccacatgttgaacaccgccgagtgatgaatgggatgttctgggtcttgtgctctggggcaccgtggcgtgatttacctgaacgctatggtccttggaaaacggtctataaccgatttaaccgcgggtcaaaatcgggcattatcaacaagatatttaaccggttactgtccattctggatgaaaaaggcttgattgactgggctgaaatttgcctggatggcagcaatattcgcgcgagtaaagatgccgcaggcgcgaaaaaaaacctcccgatatcgctgacgatcatgcgctgggtcgctcacgcggtggttatggcaccaaaatccatctggcaaccgacagacggggttttcccctcaacctgcttttga

SEQ ID NO: 1070 - DNA, 369 bp, Xenorhabdus bovienii
  Coding DNA location: Contig name=SeqID_16853; Position on contig =17783..18151bp; Strand=-
atgcgtaatttagtcaacttatattgtcatgtcgacgatttttgtcagatttttatgcctcaatggcaaaagtacctgattgagagcggtgaacgtcaacgtttacgccaaggacgaatgagtacgagtgaaattatgaccattattattgcttttcatatgtcacaccagcgtgattttaagaatttttatcttggattcatttacttatatcatagaaaagcgtttcctacattgcttagctacacccgttttcttgaggtcatgccaatggtacttatcccattgagttcgttttttacgcatcttaaaggcaagccgacaggcattgaatttattgattcaactaggctgtgtcccttaatgtaa

SEQ ID NO: 1071 - DNA, 888 bp, Xenorhabdus bovienii
  Coding DNA location: Contig name=SeqID_16853; Position on contig =18405..19292bp; Strand=-
ttgggtgttgcggctaccggattcggaattggtgctttattgggctttaatgttggccggatcttggaaaaggccggaggattacttgcccgtttcttacaaggacgttccacgctcttgcaagcagcggcaggtgctgcctctgccgcatcttatggcgccacgacacaaggtactgcagtagctacagcggcaggcactgcgacgggaacaataggcgcactaatcaacaatgctgacagtggaatgggcggtgcgattggtgcgggaacggcagtgggaaccattgataccatgatggggagttccgttactctgacccacgaagttggtgcagcagtgggcggggctgcgggaggaatgttaaccggaaccagcggtagtacgcgtgccggtatcaatgccggaacggggacctattatggctcttgggtcggttttgggttagatgtcgcaagcaacccctccggacatttactcagatatggctcgggttacttggctggccgtggcgctgaaatggcaatgagtcacttatttggcggtgggttacttggccgcttactgggtcgtctcacagccccattagcaacggggctagccagacaagccgtgcagtttggcatttcccgtccgttctttgaacctattttcagctttctcggtggtcttgctggcggtattggcaccgggctacaaagacggttaggtcgagaacataccctgtctagaatgattgaaaccattggcagtggtattgaccagcttgcgggtatgattggtaaacggttcaggggacaagtgttgtggcaaactggccttgccaatctcagggattatggtatgagtgcattgaatgcgggacgcaggatgttaatgccagattga

SEQ ID NO: 1072 - DNA, 411 bp, Xenorhabdus bovienii
  Coding DNA location: Contig name=SeqID_16853; Position on contig =20192..20602bp; Strand=-
atgaaaatacttaaacccattgaaaccgccaccaaccaagatatcactatcgaattacgcgatgtctatgtcgttcgcggttccggcaagacttatctgagtgagaaaggcgcactgaataaactggcttacgttcgggcgcaaaagcagttcaacgccgacgaaaggccaagcaacttccctgccgaagaagtcattcaggaagacggcacttctgcattacgccgtggaaagatgcgacctgagtttatagagcgacatgctcaggtgctggaagaactgaaagccgatgttagacgagaaagggaaaagatagccctacggaaaaagtattcaaaagcaatgaataaaattaactcattacatgaaacaatatctgagttagaaatacaaatagccgaattagaataa

SEQ ID NO: 1073 - DNA, 213 bp, Xenorhabdus bovienii
  Coding DNA location: Contig name=SeqID_16853; Position on contig =20730..20942bp; Strand=-
atgaaaaacatctacaaacacactcgcgttagtaatatcagaataagcgatatggatgatagcgatttacagttattagtatcatcaagcgaagacgtcatttactcgataacaaggggaatgaaatctattgctaatttagctagcgcggctgttaatagtgaagaatactcccaagatgatgcaatgactgaccttgatagattatcctga

SEQ ID NO: 1074 - DNA, 192 bp, Xenorhabdus bovienii
  Coding DNA location: Contig name=SeqID_16853; Position on contig =20939..21130bp; Strand=-
atgtcagataatcaggcattcgatgaattggaaggcgttgggagtgaaatagaaaatctaagaacatatgtttctttattagttgatacggataaaagtctgtccggtgcagaattacttagtattacattagtcgcaatatttaatataggcaaggaattagcacgagtcagaggagtagaatatcaatga

SEQ ID NO: 1075 - DNA, 132 bp, Xenorhabdus bovienii
  Coding DNA location: Contig name=SeqID_16853; Position on contig =21179..21310bp; Strand=-
atgaacaataaactacaagcagccgtcgaaattgcagaagaaattgaagcctcaatatttcccgtagtcactgcaactcagaatggagccgaacaggatacttatttaatgtgtcgtggtgtacatcgttaa

SEQ ID NO: 1076 - DNA, 165 bp, Xenorhabdus bovienii
  Coding DNA location: Contig name=SeqID_16853; Position on contig =21300..21464bp; Strand=-
atgttcaacaatatcacatcaaaggaagattatttcgacctacacatagtattagaaacggtaatgatattagaaaaaatggaaaatagcagagcaaataacatagctaaacaactcattgaattattaagcgcaaaagctaaagaggccaatgatgaacaataa

SEQ ID NO: 1077 - DNA, 165 bp, Xenorhabdus bovienii
  Coding DNA location: Contig name=SeqID_16853; Position on contig =21525..21689bp; Strand=-
gtgttgactacaccaatgaaatttgtggctgaacataaagaaaaatttgaacgttatcgtcagtgggctatatccgaagcgccgcgttctgagattcgtcgtcgtttggcaaaactgtgttgggtcgaacgtaagtactatcgtgagtgggcggctctcagttga

SEQ ID NO: 1078 - DNA, 246 bp, Xenorhabdus bovienii
  Coding DNA location: Contig name=SeqID_16853; Position on contig =21793..22038bp; Strand=+
gtggatgcttacctgtgggtactggcagtcattaagaccaatgaacccgcccaccttgaggccgctgaggaagccttgaagaagctgaaaatcacccccaaggcagcccagcagaaatattctgactacctgatgaaatcgggtgcacatcctttccagatagcctttggcaccctgagcatggataacccacaaggttatatcaccagcgcgaaggagcaacttaactaccacctactgaagtag

SEQ ID NO: 1079 - DNA, 504 bp, Xenorhabdus bovienii
  Coding DNA location: Contig name=SeqID_16853; Position on contig =22189..22692bp; Strand=+
gtgagggcatcttttgccagctacgaagccacactggaactgaccgaaccggagaaattaatgctggtgggggagctggcagacatttatgaacctttctactactggagcgaaacagaacaggcagaagggtgtatgcgcggtgatcgtattaacgaaacggataaattacgccaagcgacggcgaaagggtttgctgaacaactccccgaaccccacaccttgtctgatgttgttcgtgagttcctttattgggactggttatatcagatgcgtaatgtagcggacaaagaacttgatccgggcggatacggtgatggtgataggtattacatctatgacagacaagattatctcgaaggaaaactggccactatccaagccgtgaaccgccaagaggctatcgacgtctgtaaatgggtgctggaagaagaacggttccatgatcgtgagctgaccgacaaaattattcttaatctggtgggggagagtgcggatgcgtga

SEQ ID NO: 1080 - DNA, 405 bp, Xenorhabdus bovienii
  Coding DNA location: Contig name=SeqID_16853; Position on contig =22685..23089bp; Strand=+
atgcgtgatattcagatggtattagaatgctggggtgggtgggcagcaagtggacacagcagtatcaattattcatctattgcggcaggcttcaaagggttgctgccttccacgtcaaaatcaaggctatcttgctgtgataacgatggcattgctgtagatagcgcggtaggacgattaatcaaatcagggcgtacagatgagtttgagttaattgaattacattacatccacgacatttcgaaatcagaaatagccagaaaaaagaaatgctctgagggcaagatacgtcaaaatctgatggtcgcagaaacctttatagaagcctgtttaatcatggcggaggtgactttggaaatggacgcttggacacataaagagacaccaacagaaaaagtggcataa

SEQ ID NO: 1081 - DNA, 765 bp, Xenorhabdus bovienii
  Coding DNA location: Contig name=SeqID_16853; Position on contig =23332..24096bp; Strand=+
atgtctgaaattaataagctggataataaacaatgcccgtttgatcccgaccaatacaaatataataaaaaaattgatatcgaagttgataatgtggcaccaactggttctttaccatgggcattgattcaagtgtatttaggaaaagaggtgcatcgtagtggttggaatgcccctatagaacacatgcgtcttacccataaatcagaggttggtaatacagatgatggggctgcttatattgaaaagagtgataagggtggctattggtctcgttggcagccaacccaagaagatttgatggcttgtgattggagtttattgaaatcagaaccgaagccagataattgtatgctggaatttgatcttaagataggaactgaccaatatcaatatggtggcggcacggctcaagattgggggtatatgaccaaagctggggatataagtgtaggtgaatctacttttggcgttctggccgatcttcaaagcattataggtgttgggagcatctcaactttcagattatttgaaaaccccatcggtactttttataatatactattggaggttgacacccaaaaccagccagacttagagagtaaagctcttgaagtaacggcgaatggttcaacgtataatcttggctcaacctcaaattatacaactgatttcagctatacctctgacggcgcaaaacaactaggcgacctactgaaacaaaacgtaggtaatacgctacatttttgcttcaactggaagtaa

SEQ ID NO: 1082 - DNA, 162 bp, Xenorhabdus bovienii
  Coding DNA location: Contig name=SeqID_16853; Position on contig =24215..24376bp; Strand=+
atgaatatttcaatgtggcaaatagaagaaatggctgaagaaatcatttctggactttttgcagacggtaaaactccaatggaacaatttggtattaattggaagcaagctgaacgattagactcacgaaacgaggctcaactctccggtaattccagttag

SEQ ID NO: 1083 - DNA, 189 bp, Xenorhabdus bovienii
  Coding DNA location: Contig name=SeqID_16853; Position on contig =24687..24875bp; Strand=+
atgatgattgaaaatcaaatacccccaatgctgattgagcatcgagtgcaaactaatcaactatcatcctcacagtcgctattcaggatgtattgcctggcattgcagttagaggcggttatgggtgagatagaaaagcgagccaagatcatgagagcagaaaacaccttgccaccgcagagcaaatga

SEQ ID NO: 1084 - DNA, 219 bp, Xenorhabdus bovienii
  Coding DNA location: Contig name=SeqID_16853; Position on contig =25052..25270bp; Strand=+
atgaaatttgtagttaaaaatatcagctatctttcaaattatatgcctccagaagatatagaagtggagcttaggatttttacggatgaaaatagcagaaacttttttacagcttgggttgagtttccatatagcgacaacttgtctcttggcgagattaaagaaaaagctgtagaaaaagcgaaagaaaagtttaaaacagtatttagtcaaatttaa

SEQ ID NO: 1085 - DNA, 141 bp, Xenorhabdus bovienii
  Coding DNA location: Contig name=SeqID_16853; Position on contig =25362..25502bp; Strand=+
atgactgaaccgaacccgaactatgaagcgattgggcactgcaagatattaaaggaaaagatagccgagcttagtattcagagagtcaggcgcattgaaaaactgaatgatgagattatgcgcttgcagggatatccctag

SEQ ID NO: 1086 - DNA, 201 bp, Xenorhabdus bovienii
  Coding DNA location: Contig name=SeqID_16853; Position on contig =25507..25707bp; Strand=+
atgttggctaaacggttcatcatcgaaaccatcaatgatcagcttaagaacgtcacacaaattgagcattcccgccatcgtagtttgcatggcttcatgctgaatttattaggtggattaatcgcttactgcttaaaacccaaaaagccatcactcaatatcacaagcgctgaaaaaacaggacttcgggtgatggcttaa

SEQ ID NO: 1087 - DNA, 1128 bp, Xenorhabdus bovienii
  Coding DNA location: Contig name=SeqID_16853; Position on contig =26137..27264bp; Strand=-
ttgaattatcagttgattacctccgatgctcaattgcagtcaatctgtgaacgggcaaaaaaacacgcaacaattgcattagatacagaatttgtacgcacacggacgtattatccccaattaggtttgatacaactgtttgatggcgaacaactttctctgattgatcctctcgatatttcagaatggcagccctttcgggagttgttgactgatccagatgtattaaaattcatccatgctggtagtgaagatttagaggttttttggaatagctttcaatgtttgccaacgccgatgattgatactcaggtactggctgcgtttattggccatcctatgtcgtgtggtttcgcaacactggttgctcaatatcttcacgtggaattggacaaaagtgagtcccgcactgattggctagctcgtccattgagtggaaagcagtgtgaatacgccgcggcggatgtttattatttattgcctttggcagatattctggtggcggcaacgaagcaggcgggatacatggatgcggcacaagatgaaagttatctgatcgcccaacgccgcaaagaaatattgatgccagaatgtgcttacaaagatataggtaacgcgtggcaattacgtccaaagcagctggcctgtttgaaaaaactggcgggatggcggttaaatcaggcacgggaacgggatttggcaatcaattttgttattcgcgaagaaaatctatggcaggtagcccgttatatgccgacttctttgggggagctggatgccttaggattaagtgggcaggaaatccgttgtcatgggcgtcgtttgctggtaatggttgcagagagcagagatattccagatgaagcctgtccggctctcattacaaacctcattgattatccgggctatcgtacggcctttaaggaaattaaatcgctggtcactcaggttagtgagtcccagcagtttagtgtggaattattggcttcccgtcggcaaatcaatcaattgctcagttctcattggaaactgaagtcacccgattatcagcctgaattactccgtggatggcgaggagagttgctggctgagcctgttgctgaaatattagcaaattatccggcttaa

SEQ ID NO: 1088 - DNA, 1698 bp, Xenorhabdus bovienii
  Coding DNA location: Contig name=SeqID_16853; Position on contig =27428..29125bp; Strand=-
ttggaaaaagtttggctaaaacattatccggcagatgttccggcagaaatcgatcccgatcgttatttgtcgttgattgaaatgtttgaaaatgctgtggcacgttatgccgatcaagtcgcatttatcaacatgggcgaggtgataactttccgtaaattggaagagcgtagccgagcctttgcagcctatttacagaatggactggggctgaaaaaaggggatcgcgtggcattaatgatgccaaacttattacaatatcccgttgctctctttggcgtcctgcgtgcagggatggtagttgtcaatgtcaatcctttgtatactccgcgcgagctggaacatcagcttactgatagcggaacatcatccatagttattgtttctaactttgcgcataccttagaaaagattgttttcaacaccccggttaagcacgttattctgacgcgcatgggggatcaattatcccgtccgaaaggaactcttgtagatttcgtcgtaaaatacgttaaacggcttgtaccgaagtatcacttaccggatgccatttcgtttcgcagcgtgatccacaagggttaccgtatgcagtatgttaaaccggatgtggacggcgatgctctggcatttttgcaatataccggcggaacaacgggagtggcaaaaggagcgatgctgacccaccggaatatgttggcgaaccttgaacagggaaaggctaattacgctccgctgatggctcccggacaagaattagtcgtcaccgcattgccgctttaccatatttttgcgttgacggtcaattgcctgttgttcattgaacttggtgggcaaaatctgctgattactaatcctcgggatatcaatggaacggtcaaagaattgtcgcgttactcattcactgccttgtcgggagtgaatacgctatttaatgcatggttgaataaccctgaatttcagaaactggacttctcctcattacgtttgtcggttggcggtggcatggccgtacagagaatagtggccgaaaaatggcaaaatttaacggggtgtcatttacttgaaggctatgggttgacagagtgtgcacctctagtttcaggtaatccctataacctgactcattatagtggcagcattggtttccctgtaccttcgacagaaattaagctggttagcgatgatggcaatgaagttcctttggggcaagcaggggaaatgtgggttcatggcccgcaggtgatgaaaggctattggaatcgccctgaagcaacggctgaagtattgaaagatggctggctggcgacaggggatattgccaatgtagatgaaagcgggtttttacatatcgttgatcggaaaaaagacatgattttggtttctggtttcaacgtttatcccaatgaagtagaagatgttgtttcttcccatcctaaagtgttagagtcggcagcaataggtgttccaaacgataactcaggtgaaaccgtcaaaatatttgtggttcgtaaggatcagagtttaactgagaacgagcttaagacgcattgccgtcgttatctgaccggatataaagtaccgaaactcattgagttccgagatgaattaccgaaatcaaatgtaggtaaaattcttcgcaaggaactgcgtaacgaagaattagcaaaagcgaataatgctgcgacagcggcgaattga

SEQ ID NO: 1089 - DNA, 192 bp, Xenorhabdus bovienii
  Coding DNA location: Contig name=SeqID_16853; Position on contig =29205..29396bp; Strand=-
atgattaaatcagtgtataatcaaagcgttatacatccaagtgttggttatttaattaactcattgataaataataaaaaaataaggcagcagaagctgccttattttttggcagagacatatagtattaaattagtgatgtatatcgccaacctgaacaatgtttcttttcaaactggtacgctgagttaa

SEQ ID NO: 1090 - DNA, 594 bp, Xenorhabdus bovienii
  Coding DNA location: Contig name=SeqID_16853; Position on contig =29624..30217bp; Strand=-
atggaggagcttatgcttaaggggacgcactatcgagtcatgctgcaagtggttgcattggcgggagcaatagcaatgatacttacaggttgtgtatcggttcctgatgcaataaaaggaacgaccaaaacacccgtagaaaatctgctttctgtcaaaaatacacctgaattatatattgggcatgaagggcgctttggtggcaaggtattgagtgtcttaaatgaaaaagacaggactcggctagaaattttggctttaccactggcaagtaatgcagctccgcttttgaataaaccgtctcttggacgagtttatgcctatgtgaatggttttttggaaccaaatgattttaaagatcattatgtgacagtggtgggttcaattacagacctcgaaaaagggatggtggggaatagtccgtataattatgtcgtgatgaatgtcgtcggttttaaacgctggtatgaatctgaacgtgttgatctaccacctgttggtaactctgttttctggaactattatggtaccccttatttttcagactggggccagatagtgagtatgaaggacgctttggcggaaaggtattga

SEQ ID NO: 1091 - DNA, 696 bp, Xenorhabdus bovienii
  Coding DNA location: Contig name=SeqID_16853; Position on contig =30320..31015bp; Strand=-
atgtccacgcggattttagctattgatactgcaactgaagcttgttctgttgcactttggaacgaaagtgtcattgaggcacagtttgaaatttctccccgggaacatactcaacgcattttaccgatggttcaggcggtattgtctcagggcaatttgagtctgcaacagctggatgcgctggcgtttggtcgagggcctggcagttttactggggtgcggattggtattggcattgctcaaggtctggcgttgggagctgagttgccgatgcttggtgtttcatcgctcaaaacgatggcacagggggcatttcgcctaaaaggcgctcaaaatgttctggttgccatcgatgcccgtatgggagaggtttattgggggcaatatacccgcaattcacaaggtgaatggcagggtgatgaaacagaggcagttttgaagcctgaacaggcacaggccgtcatgaatgccttaactggagtttgggcaattgccggaactggatgggaagcctatcctcaattattggacactcatttagatttggtaaaaagtgacattactttacctcatgcggaagatatgctgccactggctgttcagatgtggaaagcaggagaagcaacggtagttgaacatgccgaacccgtttatctgcgcaatgaagtgacatggaagaaattaccaggccgttaa

SEQ ID NO: 1092 - DNA, 1917 bp, Xenorhabdus bovienii
  Coding DNA location: Contig name=SeqID_16853; Position on contig =31080..32996bp; Strand=-
gtgtcagacgattttgcgaaaaatggcgtacttgccaaggcaatacaaggtttcaagccccgtgacgcacagcgggaaatggctttagccattagcgctgcaataaaaaaacagcagcaattggtggtggaagcgggaacgggaacgggtaagacttttgcctacctggtgcctgcattacgttcaggcaaaaaagtgattatttccacaggttccaaggcgttgcaggatcagctttataaccgtgacttgccgaccgtcgctgatgcgttgaagtttacgggcagtctggccttattgaaagggcgctcaaattatctctgtcttgagcgccttgaacagcaatcacttggcagttctcaacttgagccagagatgctggcagaagtggttaggctgagaagttggtcatctcagacagaagatggtgatatcagtacttgccaccaaatcgcagaagacagcactgtctggccattagtaacgagtactaatgacaattgcctcggtagtgattgtccgcgctatcaggaatgtttcgttctgaaagctcgccgcaaagcgatggaatcggatgtagtcatcgttaaccatcatctgtttatggcggacatggtggtgaaagataccggatttggcgaattaatccctcgtgcggatgtggtaattttcgatgaagcacaccagctccccgatattgccagccagtattttggtcagcaattgagtagtcgccaattgatggatttatcacgagatatcatcatggcctaccgtaccgaagtacgggatcaggcccaactacagaaaagtgcggatcgcctcagccaaagtgcgcaggattttcgcctgtccctgggagagaacagttatcggggcaatctccgtgaagccttgcagcagccacagatacagcggatgctggtacggttggatgatgcactggaactctgttatgacgtaatgaagctctctttggggcgctcggccatgttggatgctgcttttgaacgggcaacggtctatcgtaatcgtcttaaaaggctgatcgacgttactatacccaactatagctattggttcgaaagttatggacgacattttctgctggcactaacgccactatctgtatccgataaattcagtgacatgatccgtgaacagtctggttgctggattttcacgtccgcaacattatctgtcaatgaacagcttgaacacttcacggcacgcttgggattgaagcaagcccagacgttgctcttgcccagccccttcgattatcagcgccagatgttactgtgtgttccgcgccatttgccctcaccgaaccagaatggcggggcaaaatggttagcacgtatgttgaagccattaattgaaagcaataaggggcgttgtttttttctttgcacttctcatcagatgatgcgcggtctggcggaagagttccgtgccagcctgacattgccggtgttggtgcaaggagaaacaagcaaaggacaactgttgtcacagtttatttctgcgggtaatgcgctactggtggcgacgggtagtttttgggaaggtgtggatgttcgtggtgatgcattgtcctgtgtcattattgataaactgccgttcaccgcgccggatgatcctctgctcaaggcacggattgaagattgccagcttaaaggcggagatgcctttagtgaagtccagattcccgatgcagtgatcagtctgaagcagggcgtagggcgtctgattcgtgatattgatgattatggcgtggtcgttatttgtgataatcgtttagtaatgcgcccatatggtgaaatttttcttaacagcttaccgcctgcccgccgtacacgtgatttatcgaaagcggtggcatttcttaaatcacgtccaacagagtcagagtaa

SEQ ID NO: 1093 - DNA, 345 bp, Xenorhabdus bovienii
  Coding DNA location: Contig name=SeqID_16853; Position on contig =33099..33443bp; Strand=+
atgactattgaacgcattgatccagatacccgctggtcagaagcggtcattcacaatgacactatctattatactagcgtgccagaaaaactggatggtaatatcacagaacaaaccgccgatacactggcagcgattgatctcatgttacagcgcttgggttcagataaaagcaaaatcatagatgcgacgatttttctggcagataaatccgactttgccggcatgaatgcggcgtgggatacatgggttattgcgggaagcgcacctgtacgctgtactgttcaggctgaactgatgaatccaaaatacaaagtggaaattaagatcatcgcagccctataa

SEQ ID NO: 1094 - DNA, 333 bp, Xenorhabdus bovienii
  Coding DNA location: Contig name=SeqID_16853; Position on contig =33544..33876bp; Strand=-
atgttgacaccatttgaatggtggcatgccgctttcctcgttctggcggttctactggaaatagtggcgaatattttactgaaactgtccaacggttttcagcgcttctggatcggggttttatcgctggtggctgttttggcggcattcagtgcgctggctcaagcagtaaaaggtattgaactttccatcgcttacgcgctttggggcgcattcgggattattgccacagttgcagcaggttggatcatgtttaatcaaagactgaatgtcaaaggttggggtggcattgtgctgctattaattggcataattatgattaaaatggcttaa

SEQ ID NO: 1095 - DNA, 351 bp, Xenorhabdus bovienii
  Coding DNA location: Contig name=SeqID_16853; Position on contig =33878..34228bp; Strand=-
atgatttattggatatttcttgcactggcgattttgacagaagtgattggtactctgtccatgaaacaagccagtgtttcaggtgattttaccggcatgattgtgatgtacaccatgatcacaacttcttatattttgctggccattgccgtgaaaaaggtcgctctgggagtggcttatgctctatgggaagggattggcatcctgtttattacagcttttagcgtattgtggttcaatgaatcactgtcacccatgaaaatcggtggattggccctgttgatagccggaattgcactgattaaatccggtacaaaaaaagcctcgaattatcaaatgaaggaggcatag

SEQ ID NO: 1096 - DNA, 1476 bp, Xenorhabdus bovienii
  Coding DNA location: Contig name=SeqID_16853; Position on contig =34722..36197bp; Strand=-
atggcggtgacatccgtagctcaggcttgtgatttagtgatttttggggcgaaaggagacttagcacgccggaaattaatgccttccctttaccagttagaaaaagcgggttatatccatccagacacccgaattatcggagttggccgcgctgactgggataaaaaagcctacacgaaggtggttgaggaagcgttggcaacatttatgtctgaaaaacttgatccagaattgtggaaaaaactgagtacacgtctggagttttgtaatttagatgtcaatgaaacggaacatttcactcgactggcgaaaatactcaaacaggacagcctgccagctattcattatttcgccatgccacccaatacctttggctccgtgtgtcatgggctgggggcagcggggttgaataaagagcctaatcgcgtagtgatggaaaaaccactggggacggatctcgcttcttccagagcaattaatgatgaagtggcaaaatatttcaatgaaagccagatctaccgcattgaccattatttaggtaaagaaaccgtactgaacctattagcgctgcgttttgccaattcactgtttgccaataattgggatcatcgtacgattgatcatgtgcaaattactgttgctgaagaagtgggtattgaagggcgctgggggtattttgaccaggccggacagatgcgcgacatgatccagaaccacctgctgcaaatcctgaccatgattgccatgtctccaccgtctgatttaaccgcagaccgcatccgtgacgagaaagttaaaatactgcgttcattgcgtcgcattgatcagaccaatgtgcgggaaaaaaccgttcgtgggcaatataccgcaggcttcgtgcatggtaaaaaagtgccgggctatctggaagaagagggagcgaataaagtcagcaagactgagacctttgtatcgattcgcgttgatatcgatgactggcgttggtcaggtgttcctttctatctaagaacaggtaagcgcttaccggcaaaatgctctgaagttgtcgtctatttcaaagagccttcattaaatttatttgccaattcttatcagcaattgccgcagaacaaattgacgatccgcttgcaacctgatgagggtattgatatcgaagtcctgaataaagcaccaggactggatcacaagcatcgtttgcagaccacgaaacttgacctgagtttttctcaaacatttagtcagacacatcttgcagatgcttatgagagattgctgctggaagccatgcgtggtattcaggcgttgtttgtccgccgtgatgaagtggaagaagcgtggaaatgggttgattccattatggacgcttgggaagcagataacgaaccaccgaagccttatcaagcaggaacttgggggccagtagcttccatcgctatgattacccgtgatgggtgctcgtggaatgaatttgagtaa

SEQ ID NO: 1097 - DNA, 885 bp, Xenorhabdus bovienii
  Coding DNA location: Contig name=SeqID_16853; Position on contig =36555..37439bp; Strand=+
atgaaatcgttaaaaccaaaggttgaactgcgtcttatgaatacactggaacgcctccaaaatagccttgatattttaagtaagtcagaaaaaaaggttgcgcaggtcatccttgcttcaccacatactgccatccattcaagtatcgccaccctagctaagctggcgaatgtcagtgaacctacagttaatcgtttttgtcgtcgcctgaacaccaaaggattcccggattttaagttacacctggcacagagcttggcgaatggtacgccttatgtaaatcgtaatgtggaagaaagtgacagcgtcatgtcttataccagcaaaattttcgaatcggtgatggccaatctagaaacggttaaaaataatctggatattgcggccattaaccgtgcggttgatctgctgacacaggcaagaaaaatctctttttttggattgggtgcatcagccgcagtagctcatgatgccatgaacaaatttttccgctttaatatccctatcacctattttgacgatattgtcatgcagcgaatgagctgcattaacagtgctgaaggggatgttgtagttctaatttctcatacaggccgaaccaaaaatctggtagaaatcgccagattagcccgtgaaaatgacgcaactgttatcgccatcacctcaacgggctcaccgctggcacacgaagctaccctgcccattttgctggatgttcccgaagacacggatatttatatgcctatggtttccagaattgctcaacttaccatcattgatgtactggcaacgggctttacattacgccgaggctcaaaattcagggataacttaaagagagtcaaagaagcgttacgcaattctcggtttgataagtatgagtaa

SEQ ID NO: 1098 - DNA, 1443 bp, Xenorhabdus bovienii
  Coding DNA location: Contig name=SeqID_16853; Position on contig =37616..39058bp; Strand=+
atgtccagacggctcagaagaacgaaaatcgtcactacgctaggccctgcaacggatcgtgacgacaatttagagaaagtcatcaatgcgggagccaacgttgtccgccttaatttctctcatggcactgcggaagatcatgttcaacgtgctaataaagtgcgggaaatcgcagcccgtttgggctaccacgtggccatcctcggcgatctccaagggcctaaaatacgcgtatccacttttaaggaaggcaaaatattcctgaatattggagataaattcctactggatgccaatcttggtaagggagagggagataaagaaaaagttggtatcgactataagggattgccgtctgatgttacgaccggtgatattctgttactggatgatggacgcgttcaattgagagtcctggatgttcagggcatgaaagttttcacggaagtcactgtaggcggtccactttccaacaacaaaggcatcaataaacaaggtggcggtttgtcggctgaagcgctgacagaaaaagacaaacaagacatcattacagcagcaaaaattggtgttgattaccttgcggtttctttccctcgctcaggtgaagatctgaattatgcccgccgccttgcccgtgacgcaggttgtgaaacccaaattgtcgccaaagttgaacgcgcggaagctgtcagcagcggcgatattattgatgaaatcattctagcatctgatgtcgtcatggtcgcccgtggtgatttgggcgttgaaattggtgatcctgagctagttggtgtccagaaaaagttaattcgccgcgcccgtcaactgaatcgtgtcgtaattaccgccactcaaatgatggaatccatgatcactaaccctatgccaacgcgggcagaagtgatggatgttgccaatgcggtacttgatggcactgatgccgttatgctttcagccgaaaccgcggcgggtcaatatcctgcggaaactgttgcagcaatggcgcaagtttgtctgggcgcagaaaagatgccaagcattaatgtgtccaaacatcgattggatattacattcgacagcattgaagaggccatttcaatgtcaaccatgtatgcagccaatcatctgaaaggtgtcaaggcgatcattgccatgacggaatcaggtcgcacagcacgcatgatgtcacgcatcagttccggtctgcctatattctccatgtcacgccatgaatccaccctgaaccggaccgctctctaccgtggtgttacaccagtttattgcagcacccacactgatgggatctccgccgcaaacgaagccgtcaatcgcctgcgcgataagggttatctgacttctggtgatgtggtgctggttactcagggcgatcaaatgggaacgattggtagtaccaatacctgtcgagtgcttgaagtagagtaa

SEQ ID NO: 1099 - DNA, 969 bp, Xenorhabdus bovienii
  Coding DNA location: Contig name=SeqID_16853; Position on contig =39115..40083bp; Strand=-
atgaataaagagaaagatacagatagtaaactgggatatgtcccaacgtttcatctatcctatttgcatcctcgttattgggggctttggactggtgtgggagtattggcgggattggcttatgttccggtaaaatggcgtgatccactgttagccaagatgggtatttgggcgggtaagaaagcgaaaagtgcccgtcgcagggcgaaaatcaacctggtttattgctttcctgagctacaggaacagcaacgtgaagcgttgattgacaaaatgtttgcaaccgcgcctcagtcttttgtcatgctggcggagctttgtctaaagggcgctgaatcaacgcttcagcgcacccggtggcatggtgaagaaatacttcactcgttaaaagcacaaggtaagaatgtcattttactggttcctcatggttgggctattgatattcctgctatgctgttggctgcgcgtgaccaaaaagtggcaggcatgttccatcatcagagcaatcctgttgctgattatttatggaataaagttcgtactcattttggtggccgcctgcattcccgtgaagcagggattaaaccgtttattgcgtcgatccgtcaggggcacttgggctattatctgcccgatcaggatcatggtgaagaacacagtgaattcgtcgatttttttgctacttacaaggcgacactacccgcgattgggcgcttgatgaaagtcagtagggcagccgttgtcccgttatttccggtctataattgccagactcatcagttggatatttatatccgtccgccgatggatgatattgaagggcagaatgacacttatattgcccgtcgaatgaatcaggagctggaggaattggtgcgtcctaatcctgaacagtatacgtggatactgaaactgcttaaaacacggaaagtaggggatatagagccttataaaaggaaagatctctga

SEQ ID NO: 1100 - DNA, 1251 bp, Xenorhabdus bovienii
  Coding DNA location: Contig name=SeqID_16853; Position on contig =40208..41458bp; Strand=-
atgcttggttctctgacgttagtcaccttagctgtcgcagtgtggcggccagttgcttaccatgaacaagaagaaagaacaggcagtattattctgagtaccccaaataatatctcagatgcgaccgacgattcgataggcgatatcgatgagcagctccctgatgaaggaattggcgatgacgagggtggttcggatacaactgtaaattttccccaccaatatgttgtctccggtggagataccttaagttctattttgacccagtttgggattgattcatctgatgtggctttattagccaatcagtataagtcgttgcgcgatttaaacattgggcagtcattatcatggacaatcgatgataatggtaatttaaaaacgttaacatggggtatatcacggcgtgaaacccgtatttatacccgtgaaggtgatgtctttaaagaaacaagtgcatttcagaaaggggagtggaaaaatacgattgtcaaaggcaaaatagatggcagtttttctggtagtgctctttccgctggattaaccagtggcgaagcaagagatatcacaaaagcgctgcaatggcagatagattttcgtaaattgcgtaagggcgatcgcttttctgtgttgatgtcacgtgaaatgctggatggaaaaagtgaacagagtcagttaatgggtgttcgtttgcatagtggcggaaatgattattatgccttccgcgcagatgatggccgcttttacgatagcaatgcgtctggtctggaacgtggcttcctgcgctttccgactatgaaacaattcagattatcttcttcttttaatccccaccgtttaaatcctgttactgggaggatcactgcacataaaggtgtggattttgccatgcctgtggggacacctgttctggctgtaggggatggggaagtcattgtctccaagtttgatggtgccgcaggtaatttcattgccattcggcacggtcgccagtataccactcgatacatgcacttaagaaaattgctggtgaaaccaggccagaaagtgaagcgtggtgaacgtattgctctgtcaggtaatacagggcgctcaactggcccacatttacactttgaattctggaataaccagcagccagtaaatccacttactgctaaattaccacgctctggcggattaaacggtaaagagcgttcggaatatatagctaaagtcagggatatcaagcctcaattattgctggattga

SEQ ID NO: 1101 - DNA, 699 bp, Xenorhabdus bovienii
  Coding DNA location: Contig name=SeqID_16853; Position on contig =41542..42240bp; Strand=-
atcggtccagatatggaaacatttctggcgaagccgataaccaaaattgcgcagaacaaacagttggcgcttgctcaattatccaccattaaaccattactattgaaaaataatgaagatgaaaatgatttagaagaatcgagtcagcctaaacatgacgctgatcacgaacatcaccatcacggtgaatataatatgcatatctggctttctccggagattgcgaagcaggtggctcaggcaatatatattcaacttgtcgagcagtatccgcaacaaaagcggcaattagaagtaaacctacgtaaattcaatggacagcttgtacaaactgacaaaaatgttgctagtattctaagacctgtgcaagggaagggatatttcgtttttcatgacgcttacggttactttgaaaaacattacaagttggctccgttaggtgtgttcacggttaatcctgagatacagcccggcgcacagaaattacattatatacgaacacaattagttgagcagaaagccacatgtatttttgctgaacctcaattcaggccagccgttattcataccgtagcaaaaggtactgatgtacgtacgggaacactagacccattgggaagtggcatagtattaaataaagacagctatatgaaatttataactcagttgtctgaacaatacgcgagctgcctgaattag

SEQ ID NO: 1102 - DNA, 396 bp, Xenorhabdus bovienii
  Coding DNA location: Contig name=SeqID_16854; Position on contig =119..514bp; Strand=-
gtgatttgctcgcttagtaatcgaattgccttcaaaaacgtgatctacattcgttcgtgcgcttgccctgggagtagagcagtattagtttttgtgctgttctggcttaatggcgctatccatcagcgtataaatcgcagatgtcagctcgacactttttcctgtcgtgtaattcggccacggtatgaaaggtttacttgtatcgcccagcagagcgaagccttgagggcagcgccactcagtcggttcatttttctctgcgagttttacaaccatcattccatcgtcacattgtgcgtcgctgattttggtcatcgcactgagataggggttttccgccggaaccgccggaatttccgaaaagctaaaacgtggaataaaataacctgtacgtaa

SEQ ID NO: 1103 - DNA, 120 bp, Xenorhabdus bovienii
  Coding DNA location: Contig name=SeqID_16854; Position on contig =561..680bp; Strand=-
atgtggataagtctatttcttgtactatataatcaattattcctcttacgtcctgattttattttggttctgtccgggttcttcggtggaacccgaggtagagccagggcgagaacatga

SEQ ID NO: 1104 - DNA, 711 bp, Xenorhabdus bovienii
  Coding DNA location: Contig name=SeqID_16854; Position on contig =741..1451bp; Strand=+
atggcttacactgatgcattaaagcgtcttgagtttttagttagtgaggcgaaaggcgcagatagagagctacttgataaggcaaatcaaatgattagccaatcactcgaattgcagaaagaagcgttcagtgtgattggtaaagcatatgattctgcctgtaatgataaccaggaacttgaggatgatattctaagccaatttatgttcatgaatgattttgacgaaattgaaaaagagagtcagaaagaagaagaaaagaaagaacatgagagagagtgtgaacttttgaaaataagccgtcttgatccctcttgttttactgaaaccaataaggcactacacgactgtgctggggagattgttaaaaaggcgagagcactgtttaaatcagaacctgtaatagctcaggtatggtcatatcgttatggtggctatgacatgatttcatgtgaccttttttcagcagatcgcacgcttagtatgcctgtcactatttccgctgttgccagacagatgcttgaatattttgatgagccggaggttttcgatatggcagaggctgttcatctcgcagggctgattacaaaggccattgatgcaaaggttattgttggtttggggcgaaatgaagttaactctgatgtacttgcaaaaccgctaggggaaggtcacaccaatggtgaaattaatctctggaagcaggagtga

SEQ ID NO: 1105 - DNA, 117 bp, Xenorhabdus bovienii
  Coding DNA location: Contig name=SeqID_16854; Position on contig =1921..2037bp; Strand=+
atgtcagttttctccgagtttgctggcaaattaggggtcagtttggagaacggaaatcattgtacgtttatgtgggatataactattttgtcacaccacatttggcgggatgactga

SEQ ID NO: 1106 - DNA, 96 bp, Xenorhabdus bovienii
  Coding DNA location: Contig name=SeqID_16854; Position on contig =2030..2125bp; Strand=+
atgactgagctcggtttaaccctcaaagtttacagaattggggattgttccacagaacccctatatggatgcgctggatatcgacattcgttataa

SEQ ID NO: 1107 - DNA, 165 bp, Xenorhabdus bovienii
  Coding DNA location: Contig name=SeqID_16854; Position on contig =2094..2258bp; Strand=+
atggatgcgctggatatcgacattcgttataatacctccgtcgcagacagttctgttattgaatccatcagcaaaacgctggaaaaggtactgctaaaagttatgaatgagctgttagagggacaccaacactcgagtcatctcacagacaattcagaggggtaa

SEQ ID NO: 1108 - DNA, 588 bp, Xenorhabdus bovienii
  Coding DNA location: Contig name=SeqID_16854; Position on contig =2264..2851bp; Strand=+
atgtcagaagaacctatggctaaatttcatcaatggtggagtgaatacaaacgtgatgttgctcccgctcacccgggggcggtatgcgtatcgacagtgtcaaaaaatggcgcacccagtgctcgctttgtcggtttgaaatctgctgatgataatggatttgtattttgcacctggtttgattctcctaaaggtcagaatttggccagcaacccacatatcgcgttaacattctggtgggaagaaaaaggcaggcaggtaagggtggaaggcacggttgaacacgtcagcgagcaggaatcgaaagaagaatgggcctcgcgatcgcgtgatgcacagcttgctactctctgctttaagcagagccagccgctggactccgaaaatgacctgcatgcaaattacagtcatactcaggccgatactgcaggctggcctattgaaaaacctgcgcgctggggaggttacagggtgataccaacgtcgattgaatttttaactttccgcgaaaatcgtatgcatttacgcgaatacttccgccggaatgacccgctttctggctgggaaaagacattacttcaaccgtga

SEQ ID NO: 1109 - DNA, 123 bp, Xenorhabdus bovienii
  Coding DNA location: Contig name=SeqID_16854; Position on contig =2808..2930bp; Strand=+
atgacccgctttctggctgggaaaagacattacttcaaccgtgaattaaattatatatcacgaattgagaccttgtttaagattttgtttaatcgccacttccgattaaacgtgaccgcctaa

SEQ ID NO: 1110 - DNA, 1038 bp, Xenorhabdus bovienii
  Coding DNA location: Contig name=SeqID_16854; Position on contig =3140..4177bp; Strand=+
ttgtgcctcgagcatctattttataagtctaatcatggcgatatctcctgtgtctctgacaaagaggataaccttatgtctgataacatcgtagtcggtattgatatcgccaaacacaaatttgatgtcgccgtttgggcaggcgaaaatcattacaaaaggaagcattttccaaatgaccttaagggattcgacgccttcattaattggcttaaacccgcctcaaattaccatttttgcatggaagcaacaggaatttatggggatccgctcgcactttatctttcggataaggggcttcttatcagtgttgtcaatccggtacaaatccatgcctttggtaaagcggaattactccgcaataaaaccgataaaattgacgccaaactgatagcacgttattgcgccagtcagcatcctccggcatggcagcccgcgccgctttgtgaatgccaattactggctttagtccgccatcgcaataagctgaatgaaatgcttttgacggaagaaaatcgcctctccgtggcggatgaagttgtttgtgattctcatgcaaagataatcaccctgctaaagcaagaactcaaagacaccgaattgaaactaaaaaagcacattgatgactcgccttcgctgaagaaaaataaggggttactggaaagtattcccggtattggcgaacggttgagcgcaacactgctggcttatattggtgatggttcacggtttcatcatagtgggcaagtggtggcttacgctgggcttaatcctaaattacatgaatcaggacaactaaaagggcgggctcatctctcgaagcagggaagtgccgagctgcgaaaagcactttatatgcctgcgctggcagcgatcagttgcaataaagtagtgaaaaagcagtgggaacagctgacagcacgccataaaggggggaaagtcggtgtttgtgcagtgatgcgtaaactcttacgattagcctatggcgtgatgaaatcaggcacattatttaacgcagaaataccgcttgcagtttaa

SEQ ID NO: 1111 - DNA, 102 bp, Xenorhabdus bovienii
  Coding DNA location: Contig name=SeqID_16854; Position on contig =4149..4250bp; Strand=-
ttgacaaaaactttgatcgtacctcaggcactgagttcccttcttaagcaaacctcagataccgtctcagtcattaaactgcaagcggtatttctgcgttaa

SEQ ID NO: 1112 - DNA, 849 bp, Xenorhabdus bovienii
  Coding DNA location: Contig name=SeqID_16854; Position on contig =4280..5128bp; Strand=+
atgtctaatttagaagaactttactgctgcgtcgatgacttttgccaaaaatttattcctctctggcatcaacagttaattgaaaatggcttgctcaaacgtcgtcgcgaagcttccctttctctcagtgaagtgatgacgctcctcattttattccacatgagccattatcgtgattttaaaacgttttatattcagcatgtcaaacactaccttaaagccgatttccccaggttggtcagctacacccgtatgttaaccttaaagcaaagggcgctcattcctctatgtgcttttttttcgtcacgcaaggctgaaacccaggggatcgcctttattgattcaaccaaaattgctgtttgtcacaacctccgcattccccgtcatcgcgtatttaagggcgtcgcacagcgagggaaaacgagtacaggctggttttatggctttaaacttcatttggttatcaatgattgtggtgaacttttagcggttaatctgacctcaggaaataaagatgatcgtcatcccgtcaaagcacgggtgcaagggttaacagggtgtttgtatggcgataaagggtatttgtcacaggccttgtgcgatgaactggaagcagaaggaataacgttaatcactcatgtccgtagtaacatgaaggcaaaagcgttatctctctgggataaactgatgttaagaaagcgatttttgatagaaacggtcgtggatcagctcaaaaacatttctcagatagcgcattcaagacaccgtagtcagctcggttttttattggaaatcgtcgctggcttaattgcttatacattccaacctaaaaaaccgagcttgaattaa

SEQ ID NO: 1113 - DNA, 1086 bp, Xenorhabdus bovienii
  Coding DNA location: Contig name=SeqID_16854; Position on contig =5227..6312bp; Strand=-
atgagcggagcgtcagtgatcctgttcagtgcaggcatcaatatttcttctggggtgcgtagtcatcccagaattgatgaagatgcagaatcgatactgccgctgataaacggccgggaaaccattattatttacaaccatcagggagactactttaagggtacagcagaatccaccccctggcttgcatcgctgctgagcgagcgtttgcagcaacatgtgagctattttcctgaatgcgtgggggctgcagcacaggaatttattgccaggctgccccgtggcggaatagcacttatgggaaatacgcgctgctacgcacaggagcagcagaatgactcaacgtttgctggcgaactggctcgccctggcgaccgtctggtgataggaggtttttccaagttacaccgaaaaaatgcgtcgaactgtgccattaagtctctcattccctggtgttactcacagggtgtaatgacgcagctgcaggagcttgagcgcatacattctgtactttatagcaacagaccgaccatattgctgctgggaggcaacaagaaagagaagctgcagtttctttttcaccacccccgcctccgtcacgttgaccgcgtcattgcgggaggcgctgtactcaacagcttattaaaagcgcgcggtgtcagggtgggtaagtctgactgtttccccctgccggctaatgcatcacttcagctgccgctatacataccggagaccgtaattgttgctgacgtcggcggaagaatggtgcgacgcccgctgccgcagattcgtgacagcgaccggattgtggatttcatctttcagaaggaatttctggcagacattacaacgcctagcgcctgttcattttttgctgctggccctctcagtctgccacaaagtcagtacgcgcatgcggcataccgggaactgagccgacagggcattgaggggctctttatgggaggtgacacgctaacagaaattgaaattttttcattcaaatcatccggtggtggtgctgtgctgcacttcttctcatcgggctacgacgacatcatatttcaggaaacttatggaaggtaa

SEQ ID NO: 1114 - DNA, 1299 bp, Xenorhabdus bovienii
  Coding DNA location: Contig name=SeqID_16854; Position on contig =6309..7607bp; Strand=-
atgtatatgtatccgtttaccggctatcagccagatgttcccaaggtcactcatggaaaaggaatatggctttttgatgaaaacggcaagggttatatcgattccacatccggccccatgaccgtaaatttaggccattgtcaccctgacattatcgcggccatgcaggatcagattaagcggctccattttgcttaccgctttcatttccgcagcgatgaggcggagcggttagcagccaggctggtagcgctatctgatgataataaaggctatgccttttttatgaacagcggttctgaggcatcagaagcagcctaccgcattgccatggattactttcggatcaagggcaataacaaaaaaacgcttgctctggggcggcgcatctcaaaccacggcaacactattcagtctctgacttatggcgatgaccgcgcacgtaaggtcaacctgctaaacaaagtaattgatcctgctgtaagcgatttacggctgccgccttattatgatctgcacaagcctgccagctgttcatcggatgaatggctgcgggtatgtctgagcgaaacatttgaaacgattgaccgagttggcgctgaacatatcgcgtgcatcttcgcagaacccattacggcttcttcaggcggcgtgctgattccgcaccctgactacttcagggagctgaaagcaggcctcagggctcgtgatattctgctgattgctgatgagattgtcaccggcctgggtcgcactggcgaatggttcaacatgagaacgtgggagacagaatctgatatcaccatcatcggtaaaggattaggtgcaggctttacccctatttccggtgtgatgatttcaaaacagattggtgattcactggcatcactgtcaccacctcatttcgtcggacatacctattccggtaatccgttgtcggcaggggtggcacttgcagtcctggacacgctggaaaataaaatcggaatggcgtcaatcagagccagaggctcttactttgggcgactgctccaggaaatgctgggcgatgcagacattattgccgatatccgagggcagggactgctctgggctgtggagacgacacttggccgtcagcgtgcagaagaatttgtgcaggccggacatcagcagggaattaatctctacccgtgtcggttatccggtaaggacggtgatgccctgacctttttgttcactccgccactggttatctccgaatccgagatggatgaactggtgggtcgcttcagtcgtgtactgagtcgcatggcatga

SEQ ID NO: 1115 - DNA, 2154 bp, Xenorhabdus bovienii
  Coding DNA location: Contig name=SeqID_16854; Position on contig =7674..9827bp; Strand=-
atgatcaaaatagcaatcgtgggcggcggcccaaacggcatgtattttcttaatggtctgcatagtgtttttaaggaactgaatgtgcgcgacaatgtatctgttacactgtatgatagacatggctattttggttccggctggcctcattctcctgcgcaggctaaaaccagtatgcttaacaggatcgttggtcagctttcttttgcgccggacaaaaccaatacttccagccattttttttctaagagtacgcgcgtaactttcagcgagtggctggaaaaaaaatatcaggccacgcacagtgaaagatacaagctgaatgccgatgactttccgacccgtgaactctatggcgaatctctggttgagatctgtgacgcgcttgtcaatgaagtcagacaggctggaatcggtgtaacacttattaaagacaccattaaacgtatcagtaaatcacacggaaaatatcagctgacaggtgaattttatcctgaaccggctgagtttgatatggttcttcttgctaccggtcatcaggaatcaaaagataacttctatctggctgaatccttgaaaaagatcaccgaatactacaactttgcctacccactgtttgacgtccctgattggcagcacaagagcatcgccgttattggtatgggactgacagcgattgatacactcctttactacactgaaaacaaaggtggcaggtttcatcgcgataaagggaagctgcgttatgaggccagcggtaatgaacccaagaaactctatgcgctgagtcgctcaggctatttcacctacagccggccacacaatgccaaagaggtcgatctggcaaaatatgagcatcagggttatttcttcacgcgctctcttattgaccagatgcggcagcaactcggagagcctgcgcatccggatagctcacctgaaaaccacgctttgcagcttgattttgacgtccacgttttccctcttctgatgctcgaacttcagctgtgctactaccgtattctgtttggtcctgaagtactagcccttatgaaagcagagagctgccctttggtcgagcaattcattgccggtaaccgggcggtaaacttacagaaagaaagcgcaatcaactggctgacgcaggccacagaacggctggcgtgtgaggccatttttcttgtacgccgcttccttaatgacgggattacctcttcttttcacggggtaccggttgaaactatcgtaaaacgctatgtctatgtcatcagcgcacaagaggcaggaccggagctaaatctgcaacgattttccctgtctgccctgtccgcccccagcccgtgggcacataaggccgatcctgaagctcatctctttaactgggatatggtcgttgaccccatcagaaacatggatttttcacccgaaacaccgtggcgtgagcggttacttgcattcatgcactgggatcgccgccagtctgagcagggcaatctgtataatccttacaagggtgcgtgtgatgacgtgtttcgtgatttaagacaaacagtagtatatgccattgattttggaggaatttcccccgcttcttataacaacatgctcaaagatttttatgccgtgcataaccgggcggccaacggcaactgtattgcgctgatggaaaaaatggaggcgttaattgaggctgatgtcgtggatgtaacttatgcccagtcgaatattcagattcaggacgaccaggtctggcttcacagcctgagccatgccggaaaatatacccgcgttgatgccatgatcgatgccaaattacataatttcagcgtcaagaaagcaaaaaatagtcttttccgcgatcttattgacgccggaatcgccagttactgggtgcataaagatcggcgcggcgttgagtgcgctgcttcaggatttaatatcacccgtaattttcagtttattaaccgtgacggcaaacgtgaactttttttctgcgtgggtcaaccttcagaagggatcatgttctttcagaatggttctatccggcctaacgtcaatcatcatgttgctaacgacttactggcctgcatgactgcagttaaaagcgagttacaggtcctgctgctgcaggaagatgccaccctgactcactga

SEQ ID NO: 1116 - DNA, 867 bp, Xenorhabdus bovienii
  Coding DNA location: Contig name=SeqID_16854; Position on contig =9919..10785bp; Strand=-
atgcaagaggtaactatgagcattcagcaacgtctggcccgcggtgaatatacacagtttatggaagcacataatggtcttagcgcaaaaatcgttgaacatgccggatttgaagcaatctgggcgtcaggcctttcaatcagtgccgcaatggggctttcagacaggaatgaggcgtcttggtctcaggtaatcaatgcccttgagcagatggccgataataccaatatccctattctcgtcgatggagattcaggttttggtaattacctgaacgttatgcgctttgttaaaaaacttaagcaaataaacatctatgccatgtgtattgaggacaaaatgtttcctaaagtaaattcatttatcggtgaaaatcaggcgctggcacccgtaagcgagttctgtaataaaatcagagcggctaaagatacaggcggtgacgattttaccgtggtcgcacgtatcgaggcgttgatttcgggacatcccatggaagaagctcttgaacgcgcagaggcttataaagaagccggggctgatgccattttaattcactccaaaaaatctgacgctggtgaggtgtttacgttttctgaacgctggcgtgggaaattgccgctcttcgctgtgcccaccaaatactataatacagaatatcaggagtttgttaatcacggcattagcaatctcatatgggcaaatcaccttatccggagttctgttcgcagcatgaaagaaactgccgatcgcatctacagggaaaaatcacttattaatgttgaaaaaaatgtatcttccctggatgagcttttctcgttaacaacagaacgttatatggatgaactagaggcgaaatataaccagtag

SEQ ID NO: 1117 - DNA, 969 bp, Xenorhabdus bovienii
  Coding DNA location: Contig name=SeqID_16854; Position on contig =10799..11767bp; Strand=-
atggaatctaaagataaattgcttattgttgatccggtacatgaaaaacttctttcttttttaaaacgtaattatgatgtcacggtaaaacatccgataagtcgagaagaactcatttcgcaaataggccaatatgacatattggtactaagaagtggagctcaggtggatatggaactgctgaacaaagcgaaaaaaatccacacaataataagagcaggtactggcacggataatattgaccttgaaaaggtaaatgaaaaaggaattctcttctataacacaccgagtacgaacgccagagcagtagcagagctgagtttcagcatgatgcattgtttatatcggcacatctttcgtgcaggaaatgaaatcagggagaatatctgggataaaaaatcacttttaggctttgaactttcctataaaaaactgggactggtaggttttggcagtattggtaaagaaattgccgacattgccagcggttaccacatggatgttcactgtacggtatctgagtattcttgtgatcgcgtgaaggaattgagtaatcagaatataactttgcacagcaacttaagcaccatgttcagtcattgcaatattattgttgtctgctgtccatataaccagtatacgcgtgaccttattggcgctgaggagctttcacatctcggtcagcgtgctgttttaatcaatgttgctcgcggtggtgtggtaaatgaaaccgatttgtataacgttttaaaagaaagatttttttttggcgcagcaagtgatgtatttgagcatgagagacagccttcgccgctttttactcttaataattttatcggaacaccacacattggtgcgatgtcccatgagtctcaggaaaaaattgccgacctgattattgactatcttgagcgtcagttgagcggtaatggttcggagatttcacgtaatcgtgagtttataatctga

SEQ ID NO: 1118 - DNA, 1068 bp, Xenorhabdus bovienii
  Coding DNA location: Contig name=SeqID_16854; Position on contig =11757..12824bp; Strand=-
atgaaattaattgcttatgtcattggtgccacgggctggacaggtgcagagatcattcgcctacttgcgtaccatcctgagattggggaaatatattcaatttcgcgtgaagcggacatccccctggaaactattcatcccaacctgacgggggtgaataaaaacacatggtctctggaatcccttcctggcatctgcccagacgtagtgtttatttcactgccttcaggaaaagctcaggaagttgctgcccgctttgcaggagggaaaacccgtatcattgatctcggcgctgatttccggtttgctgatcctgaacagttcggacgaatttatggaaagccacatctggcacctgcacttcagaggaagtttcagtatggctatcctgaggagttccgtgaaaatatctcaacaagtcattatatcgccaatccgggttgttacgtgaatgcagccctctgtgcactgttgccgcttatcaaacgcaatatcttaaaaactcagaatatttttataagcgccgtgaatggaacatcaggcgcgggtagcagctccaagcgagaactgctgcattacaacatgacgaataatatgctggcctactcccttaatggtcaccgtcatacgcaggaaattgaagaaattattaaaattgttaccgataaaaacgcggacgtttccttgatcacttcacatggcaactttgcccgcggcatatttatggttatagccgcgaaacttgaagaagacattcctacagacagagagaatatactgaatattctcagtgaatattattctgataacccgttcgtatccataatcggacaagaaaaaggttcagttgggatagaaaaagactacggtatttatccgcagctttccaaagtaattggttctaatgcatgccatatctcggttgatattgtatctgagaaaagggaactacgcattgtcagtgttatagataatctcatcaaaggcgcagcaggaacggcaattcagaatatgaatatcatgatgggctttgatgaagagacagggctgagtcgttatggaatctaa

SEQ ID NO: 1119 - DNA, 495 bp, Xenorhabdus bovienii
  Coding DNA location: Contig name=SeqID_16854; Position on contig =12821..13315bp; Strand=-
atggggcttctgagcgccatcttctgccgcgaagaaaaagacatttctgaggtaacactcattgataaaactccttcacgatgcgagtttgcccgtacgcttggtttcagagccgaaactgacatgtcagacatagcagactccgacgttgatattctcgtcatagccggcggggaagccctgaacatcgataactatatcgcgctactccgtccgggggctcaggtggtgctcatttcctattttgatactcatgtgaacatagatatgaacatgttagtcagaaaagagataacgctgcgcggctcttttctgagtgaccggagagacctggctaaagccatacaaattattcagcagtccaccactacaaaagattctgctctcaaaaagataataacagacgttataacattcgctgagcttcgggacttcatgctgaataaaaccagtaagggcaaagttcttataaatgaaccaggagtattgtcatga

SEQ ID NO: 1120 - DNA, 471 bp, Xenorhabdus bovienii
  Coding DNA location: Contig name=SeqID_16854; Position on contig =13369..13839bp; Strand=-
atgttttactctctgatgtgccacggtaaacgtaaccaggcgtatgaacccgaagttattccccagatgcctccgggtttcttacaggtagagatcgttaaagccgcaatctgtggttctgatcacatggtgttgaaccagactcacccgtataagcagtacccggcaattctggggcatgaatttattggacgggtcaccaatgctgccggaatcagcgcatttcatgaagggcagtgggttacaggcctctcttatggtgcctgcggtagctgccccaactgtaaacgtgagctgagtaatcactgcctgaataaagtgacttacaacacggccggaagcagcggagcatttacccggaccatgacagtacatcacagttctgttctccccctgcctcaaaataggacagctgaagataatgaatatgtactttctgaacctttaagcattggtggttcatgctcttaa

SEQ ID NO: 1121 - DNA, 1155 bp, Xenorhabdus bovienii
  Coding DNA location: Contig name=SeqID_16854; Position on contig =13842..14996bp; Strand=-
atggctggtgaatcggctctttctgttttggataatttcagttttgcattgcctgtgcgtatcatttttgaaaaaggtgctctcagacgtctcactgaatatctctctgcagcagataaaagtaatactttgcttgtgatgagtaagtcagcttctgagcgattttgcgttatgaaaaacctgattgaagaaaggggcgggcttgttaaatacaccccatggattcttgaaagtgatttcaaagcaacaactgaatcgctctgcgctattcagaatcacctgcggaatggtaactacgattcaatcgtctcgatcggtggcggaaacattattgattttacaaaagtagcagccatttgtctggacaactcggtagatatttctgatgcggttggaaaaacttttgacaaggttattaaaaaaatttttcacattgctgtccctaccacttttggtacgggttcagaggtgactaagggcgctattatttttgataaaaagaaaaacattaaagatggcgttcgcggagattctatttttcctgacgttgcactgattgacccttccctaggtagtacaatgcctgatgctgttctgcgcgagacacttttcgacagctttacacacgctatcgaagctctgcactcagttaaatttaaccctgttacagaatctctcgctgttgaatcactgaagcgtattaacgccaatattgaacggtatgccgcgggtgaacttgatgaacacttttatactgaagccgcttacagcgctttactgggtggcatctgcgtctgtcacaacagtacctgcctgcctcaccgcttcgaacaagcctttgctccattctattcgttttcccacggcagaggtttagccgcgatctacccctactgggtacgggcgctgatgacttacggcaaagtttctcctcagctcgttcagattaccgaagacctgagtgcatcagagtacgtggcatatgtgatacgcaaactgaaactggacagtgctgcacagcagctcgcatccctgaagctgtcaggcgaggacataaggaaacgagtgacgggaaatatcgtcaacgatccgcttgtgagtgaatcagatcatgacatcatcgccacacttctgaccgaaatcactggagcataa

SEQ ID NO: 1122 - DNA, 165 bp, Xenorhabdus bovienii
  Coding DNA location: Contig name=SeqID_16854; Position on contig =15460..15624bp; Strand=-
gtgtactcatggttaatcaactcttatgatggaatggtggggcattattattgcacgaaatttctcatgacgacaccatctagagtcatgaccaaaaatgtgagatctcgccctgtcttggaggtgactcacaccttaatcgcaacaataagtttcattatgtaa

SEQ ID NO: 1123 - DNA, 477 bp, Xenorhabdus bovienii; identical to SEQ ID NO: 1065
  Coding DNA location: Contig name=SeqID_16854; Position on contig =15615..16091bp; Strand=+

SEQ ID NO: 1124 - DNA, 354 bp, Xenorhabdus bovienii
  Coding DNA location: Contig name=SeqID_16854; Position on contig =16028..16381bp; Strand=+
atgccggtcagaattgttattacaagcggtaccacagcagattgttcacaagcggagaccttaattaaagggctcgatgcagagcatctattggcggacaggggctatgatagcaacgcaatagtagaaaaagcagaacaacaaggcatgcaagtccatatccctagccggaaaaatcggaaggccgccagagaatatgatcgtgaactctatcggtttcgccatttggttgaaaatgctttccttcatcttaagcgctggcgtggtatagccactcgctatgcaaaaaatagcgcgtcttttcttgccgcagtgcaaatccgttgccttgttctttggctgaaaatatcatga

SEQ ID NO: 1125 - DNA, 234 bp, Xenorhabdus bovienii
  Coding DNA location: Contig name=SeqID_16854; Position on contig =16397..16630bp; Strand=-
atgcagtcctggcggttctgcggatacaggagaaaaaaaacaccggtaggccgagttccgctcagtgtagcggaactgcgtaagctgttgtcaaagcggatggaaaaagcgggaaagacaatcgaacaggttttacattggtcagactggcgacgatggcatcaataccgagcacaacaatgtcattatcgtcgccgggcaaatcatcggcttacagagcaattacggctgtag

SEQ ID NO: 1126 - DNA, 588 bp, Xenorhabdus bovienii
  Coding DNA location: Contig name=SeqID_16854; Position on contig =16548..17135bp; Strand=-
atgggatgccggtgtgccctgtcgctgggtgaccgccgtctgagggtctggctggagtcccgataccagccctttgtgttagccattccctgcaatacccccttatggtggcaaggacccaagtatctccgtgctgaacggattgccgatacgttgactgccgctgactggaaaacacggtcagcgggaacggggacaaaaggtgagcgtgagtatgactgggctgtcgtgccgttatggcgtttacagataagtgaagaggaccggcgttatggtcattatctgttggttcggcgcagccgggataacagacaggagcggacttactatgtggtgtatgccctgcgagaacaggcggatcttaatacgctggttcaggtggcgggttgtcgctgggaaatcgaaagtggctttgaggaaaccaaaggggaatgtgggcgggatcactacgaagtgcggcgatggcagagttggcaccggcatattaccttgtcgttactggcccatgcagtcctggcggttctgcggatacaggagaaaaaaaacaccggtaggccgagttccgctcagtgtagcggaactgcgtaa

SEQ ID NO: 1127 - DNA, 375 bp, Xenorhabdus bovienii
  Coding DNA location: Contig name=SeqID_16854; Position on contig =17093..17467bp; Strand=-
atggcccgcgatatcctgcgggattatgtgactgaacatttgggcgatgaacagggggttctcatccttgatgaaaccggtcttatcaaaaaagggacacattctgccggggtacagcgtcagtatagtgggaccgccggacgggtagaaaacagccagataggcgtatttctgtgttacgctggccacggcgggcatgcctttattgaccgggccttatacctgccccgccagtggaccgatgaccgtgcccgctgtgaagccgcgggtatcccggccagtgtcacgtttgcaacgaaaccccagttagccaggcagatgctggaacgaacatgggatgccggtgtgccctgtcgctgggtgaccgccgtctga

SEQ ID NO: 1128 - DNA, 255 bp, Xenorhabdus bovienii
  Coding DNA location: Contig name=SeqID_16854; Position on contig =17437..17691bp; Strand=-
atgccatcccctgccaaaatctgggaacaggcgctacaggcattacatgcccgtctggctcccttatttcactctaccggcccacgacaacgcagtctcgcttatctccgaggcttgcttagtgatgttgaacgtaaaaatagctggcaactggctgaatggctaggggaaagcacccccgatggcattcaatatttgctggaacgcgctgattggatgtcgagatggcccgcgatatcctgcgggattatgtga

SEQ ID NO: 1129 - DNA, 108 bp, Xenorhabdus bovienii
  Coding DNA location: Contig name=SeqID_16854; Position on contig =17649..17756bp; Strand=+
atgcctgtagcgcctgttcccagattttggcaggggatggcatgtgacatcttctttgatttaaggaagaagagccccatcatggcacaatatgtgctacagccgtag

SEQ ID NO: 1130 - DNA, 123 bp, Xenorhabdus bovienii
  Coding DNA location: Contig name=SeqID_16854; Position on contig =17926..18048bp; Strand=-
atgctccgaaacaaaatcaaacaattaaataaattttcagtctctttttgcttttatttcatgatgacagctttgtgtgttcgcggtcaaatgaaatcgattacagaaaacgacagggtttaa

SEQ ID NO: 1131 - DNA, 192 bp, Xenorhabdus bovienii
  Coding DNA location: Contig name=SeqID_16854; Position on contig =18025..18216bp; Strand=+
ttgtttgattttgtttcggagcatacgaactcccctctgcagaagctgtcttggccatgtaagataagggcgatgcccgaggctgttttccgaaaggctgagagtatggtgaggcagcaggttgtgttaatatcccttgcaggaaatgaaaagatcctgaaaagatattatgctaataactctattaaataa

SEQ ID NO: 1132 - DNA, 603 bp, Xenorhabdus bovienii
  Coding DNA location: Contig name=SeqID_16854; Position on contig =18247..18849bp; Strand=+
atggacattgatatcctcagctttatgccggcattattgcctgtagcgctttctcccggagccagcttcactcttgtcatgagcagtgcgctggctggcggacgaagcgggctcctgcggacgcttgccggtaccgctgtaggtatatacagccatgcacttctaattggacttggcattaccgctatcattatttcgttaccgggggtgtataacgttctagaagttgtgggaacaatttatcttctttggttagggttcatgctcatcagaagcggcataaaatctaagccagacaacaccgtcagcagcccgcattccatcacggcagtagatgctttcattactaacatattaaacccaaaggctattattttttacctgaccgtcgtttcccggtttgctggccagcaaggaggggtaggcagttatctggtattagcttccgttcacgtggtggtgatgagcctctggcttgtcatcgtaagccacatcctgatcttctctgctaaaagcagtaatccggtattacttaaaaaatatgtcaacatctcaggagggttgctgctgtgcgttttctctctgtgcagtcttttcaaataa

SEQ ID NO: 1133 - DNA, 210 bp, Xenorhabdus bovienii
  Coding DNA location: Contig name=SeqID_16854; Position on contig =18831..19040bp; Strand=+
gtgcagtcttttcaaataacgcggaccatacggttctgtcgcattaattgtaacggctcgcaatcgaaaacggtcggactcgcatttatccggtttttcggctcacgctcattgcaaatgaaaaccgtcacggactcacattacctgcaaatgagcttgcatttatcttttccggctcgcattccatttcatccggctcacaataactga

SEQ ID NO: 1134 - DNA, 441 bp, Xenorhabdus bovienii
  Coding DNA location: Contig name=SeqID_16854; Position on contig =19053..19493bp; Strand=-
atggaagaaatcggataccgcacagatattttcacgctggacgggatcaccggcagccaacgggaatacattcagtggttgcttaaaaccagtatgggtaaagggaaaacgcaagacatactgacaacagatgccattgatttactggcgatgaaactccgtactccattacaggtccagttgcatctgacgctggccatggaagcgggttatcagaccggtgaaaaacccataacggcgacactgatagaatcggtactctcgcgacaacttgatgatctggaacccacattaacacgccatggttatcgtctgaaagatatggtggaacaatttgatgccaaacccgctgaaatcagggcattgtttaacaatcagctcgatccggttcgcacggcagagttgcgcgacagaatgttggcggttgggttgccgatatga

SEQ ID NO: 1135 - DNA, 105 bp, Xenorhabdus bovienii
  Coding DNA location: Contig name=SeqID_16854; Position on contig =19526..19630bp; Strand=-
atggcaagaatgatacaacgggtgagaccaaagaggcactacccacggaaatcgatgaaacccagaacacgatggaattcttttgatgctccgataaggatttaa

SEQ ID NO: 1136 - DNA, 120 bp, Xenorhabdus bovienii
  Coding DNA location: Contig name=SeqID_16854; Position on contig =19664..19783bp; Strand=+
atgttttttatcttaccttgtattagcagagggagatgtttgacgataaaaaacaaacagttttttgaattcagcttctgttttttacccaggctcggcacaaagcggactgccagttaa

SEQ ID NO: 1137 - DNA, 597 bp, Xenorhabdus bovienii
  Coding DNA location: Contig name=SeqID_16854; Position on contig =19849..20445bp; Strand=-
atgtcacgagtttttgcttactgcagggtgtctacccttgaacagaatacagaaaaccagcgtcgtgaaatcgaggcggctggatttgctatcagacctcagcgactgattgaagaatatgtaagcggatctgttgcggcgggtgagcgaccgggattcacgcggctgcttgaccgtatggaaaacggagacgtgctgattgtcacgaaacttgaccgcttaggacgtaacgccatggatatcaggaaaacggttgagttactcgcagactcagaaatccgcgttcactgcctggcattaggaggagttgacctgacaagtcctgctggaaaaatgacgatgcaagttatctctgcagtagccgagtttgagcgtgatctgttactcgagcgtactcatgctggtattgcgcgggctaaagcatccggaaagcgttttggccgcccgccgatcctgagtgacgaacaaaagaagacggtatttttgcgtataaacgagggaaagagtatcagcgcgattgcacgcgaattcagcaccacgcgccagacaattctcagagtaaaagcggcaatggaagacattgacgctcctacgtga

SEQ ID NO: 1138 - DNA, 171 bp, Xenorhabdus bovienii
  Coding DNA location: Contig name=SeqID_16854; Position on contig =20457..20627bp; Strand=+
gtgtacgaaaatgatgtactaattatagcttatgtacgaaataaaaaacacttactttcgtacagtgtcgctgcaggttgtccgaaaccgaccgttttagtacatgatatttgggcatacataaatgtcacattccgtttgttaattttcgaaagttggatttatatttga

SEQ ID NO: 1139 - DNA, 624 bp, Xenorhabdus bovienii
  Coding DNA location: Contig name=SeqID_16854; Position on contig =20716..21339bp; Strand=+
atgaatgaatcttttttgagtcacttaaaggaagtatatcaagatcgtgaacgagatctcgttacattaagtgtgcgtgtcagtgttgaggagaatgcggccattcaggatttggtagattcagttggctgtaaccggcaggatcttctttatgaactaataaaaaaatacgcactcagtgaatgggaggtgatgagaaacgaagaactggatgccgaactcagtggcggaggtgcatctggtgataaccatacgaagacctattttctgcttaacacaaacaaagccaatagtgctaaggatcaccaatttatgattgaaaatggctttgctgctgcatttgaagaaggttatatccagaaaatagaaaaaatccatgaaggagatactgtctttttgtatgagtcaggcgtaggtattgttgcttacggctcagcaacgggtagggtactgaaaacagatcatctcggtgtgaaaaataaaacctattatcaaaaactggatgggtttcatgttctggataaaccactgcctgccaaaaaaatttgtactctgcttaagaggaaaattcctttcgtacaaacacttatcaggcttaaagatggtgaaaagcttctgaaataa

SEQ ID NO: 1140 - DNA, 135 bp, Xenorhabdus bovienii
  Coding DNA location: Contig name=SeqID_16854; Position on contig =21455..21589bp; Strand=-
atgtcagagccagagcgttttgaagatagcccagaattcgaagagtgggttgaaggaactggtgaaagaggtgaagagaaatctggttattataacgattggcatcgtagggttttaaaggttctgtcgcattaa

SEQ ID NO: 1141 - DNA, 129 bp, Xenorhabdus bovienii
  Coding DNA location: Contig name=SeqID_16854; Position on contig =21567..21695bp; Strand=-
ttgaatagacttacccagtcgcccacgctggcccctacaaccccatttagatcattgagacaaaatctgcattattatgaatggaataatttagggataaatcataatgtcagagccagagcgttttga

SEQ ID NO: 1142 - DNA, 1362 bp, Xenorhabdus bovienii
  Coding DNA location: Contig name=SeqID_16854; Position on contig =21874..23235bp; Strand=+
atgaagagtctgtaccaacaagcgagaatgagtagagacgcaaggtttgatggcaaatttttcatctgtgtaaaaacgactaagatattttgcaggacaatttgcccagcaaaattgcccttagaaaaaaacgtgatttatgttactgacagagagcaagccatagggcttggcttcaggccatgcctacgctgtaagccagaatttgcgcctaactacagcgaaattagtaaaggtagcttgctttataataaagcgtctcaaaaaataataagcggagaatggttaagcctttttatcccagaaatagccaaaaaattaaacacgtcacagaggaatttaaataaaattttccgaagtagtacaggcatgagtgcaaaagaataccaaaataaccataaaagtatcttggcaaaagcgctactgcaaaattcaaatttaagtctaaccgacatagcaagtacttgcggttactcgtctctcagttcgttttattatttaatcaataaatatttgagagtaaatatgaaatctataaaaaccaacaagcaagattgcagtgtgaagaaagtcataacctaccccctaagccacccgtatgactgggatcacttcttatcatttcaacaaaagcgactcgttgaaggaatggaatggattcgcggtgaaacatatgggcggacttttaacacactaaattgcaaagggcactttgaagtatgccccgcaaaaagcggactatcgatatccattcaaacaaataatatgggttcttttgggtgtatataccaaagaatcattaaaatgtttgatttggatgttaatttaacatacatagaagattttctttctaataagtacccagaaataaaaatatcaaaaggtttaagaattcctggggtgtttagtgaatttgaagcgggtttaagagcaatttgcggacaacaagtcacagtatctgcggcgaccaagttgttcaaccaggtcgtgcataattttgggtgtacggatactaatggtcttgtttatatgcctttaccaattgacatcgtagatgatagcaacttggctatattaaaaacggtaaacagcaaaaaaaatactatccttgctttggcaacgtggtttgcagaaaatagccctgagtcacctgaatatgacataagtcatatattgtcaataaaaggtattggcccttggacactagattatataaaattaagagcaaacaaagatccaaatatatggatgggttctgatttaggaattaagaaggcgataaaaaaatataataattttgatcatgtaaagtcgcatccctggagtagttatttatctatccaattatggaatataacctag

SEQ ID NO: 1143 - DNA, 513 bp, Xenorhabdus bovienii
  Coding DNA location: Contig name=SeqID_16854; Position on contig =23318..23830bp; Strand=+
atgagtgaatttagctacttatctgctccaaaatcgagcagagacagattaggtatatataggttttggtatgatgtttaccatgaagaaatgaaaaggaaaattacagatctcgatcattctaaaaaaataatatatgactactttgagccggaatccgacatattcgtaattgaatctaacaataaagtaattgggtcggtacggttaagtacaaggagccatttttttaaaaccccctacgcaccaatgctggggaatatttctcaatttgatttttacttcttatcaaaagtcattatccaaaaggagtacagaaaaacagggctagctacaaacttacttaatatcgcagttgaacatgtaaaaagtaaatcgtgtgataggattttattagattgcagtgattatatgatcccatattttataaaaaaagggtttaatctgttgttagatgaaacaacccaaagcatacactatggtgatgtttatttaatgtacaaggaactataa

SEQ ID NO: 1144 - DNA, 933 bp, Xenorhabdus bovienii
  Coding DNA location: Contig name=SeqID_16854; Position on contig =23830..24762bp; Strand=+
atgagcataaaattagcagccgaaataaataatagcctctatgaaaaaagaataaatagaacaatgccttttttgggagtagatgaggttgagcaaaaaatagcacaagaaaaattagcgggttcgaccataggtattgcaggggccggaggaattggcggtgcaatggcggtgagacttgcacgatttggtgtaaaaaaaataaaaattgcagatcctgacactttcgattactcgaatataaatagacaacttggtgctaacatacccaatattggtaaaaataaagcacaagtcgtggcagaaatggctttcgatatcgggcaagatgttgaaattgaggtttttacagatggcataacacgagaaaatgccagcgagtttgtttcagggtgtgacctggtattagatcaggtcgatttttctctgattggtgaaaagtatgctttacaccgtgcttttagaaatgaacctaagtgtagatgtatattggcctgctcagtaataggatggtcggctcacctctataagtttacgaaagacagccttcccatagaagaatggtacggaatagaagatgaaacttcaatagccagcttggctgacgaaataagtaaaactgaaaaattgttaaatttatggtcgccaaggtttccactatttccgtcaaaagaaagccttttaaagtggattagcgataatgataccttacccatatttgctggatcaccgccagttgccgagggtctactcacgcaaagagcaatattgtgcctaattgacaaagagcaccctccttatgcagcaacgctacctcctatccctaatatttatatctatgatgcggcacaactatctgggtcggtttatttttctgatggagaaataaaaaataagctggaaatagaaaactttaataacttaaataagtga

SEQ ID NO: 1145 - DNA, 891 bp, Xenorhabdus bovienii
  Coding DNA location: Contig name=SeqID_16854; Position on contig =24767..25657bp; Strand=+
atgagaaacgataaaacccaccaagacattatagagagcgcaagcataacttctctcatgcgataccttctttcatctgatgatgaggcggttcctaaccctgataactatgggaagtattttgtaaacggaaagtgggaaggataccttaaagatgtagattctgcgaaactagaattacaacgcaagttacccggctgtatgtattatcacttgattagaactttaaagtttgacgatagtttaattaagtgggcgagtaatgagaaaaattctcaaattgttattttaggtgcaggttttgactcaagagcaatgaggtatagtaaattgctcgacgagcataatgtttctgtctatgaaatagatttatcagcaatgcttgattttaaaaaagaagttattgctaaatataaattacaacactgtgtgggctaccaccatatcccttgcaactttaatgacaaaaatttatccggttgtatgttagatggagggatttctaaaaataaaaatactttagttttgtgggagggcgtcacttatttcttaccggatgaaataatccagagcactatagtagaactcagagaactctttaaggaaaagcttcagataacgttagactatgcgtttagggactatattgaaggtgatttaaacttttatggggctaaagagctacacgatgttctagtggaaatttcagagccacacttttttggcctgaatttcaacgaaagtgaaaaatacttcgcaaatcttggttttaaaaccactgagaacctaacagcattaatgctagagtcaaaatatttaagggatggcttcggaaaatccgcaggacttcctcacgtttttaatgcaatgacagatatagttagaggataa

SEQ ID NO: 1146 - DNA, 786 bp, Xenorhabdus bovienii
  Coding DNA location: Contig name=SeqID_16854; Position on contig =25662..26447bp; Strand=+
gtgaaatatagcaaattatttaaagacctacattcaaaaagtaacttttttgtattaccgaacgcatgggatgtcccatctgctaagttttatgagtcgcttggctacaaggctgttggtacgtcgagcgcggcactttcatatctaaatggaaaaagtgatggtgaaaatattccattttcagcagtcttgtctcatgcaaagaaactactatccgagattaaagtaccactatcaatagatattgaaaaagggtacgcctcttcggcaaaagaaatcgcagtaaacgttctaaaacttgcagaacttggttgctcaggggtcaatatagaagactcacttaaaagcggagatcttttacccgcatctgactttgcaaaaatactcgaaagtattaaatcagaactaatcgcgagcggctatagtgattttgtattgaatgccagaactgatacatatttaagtggttctgttggagaaaagattagagagacaatcaaaagagaaaacgtttaccgtaactgtggagctgactgcttgtttgtaccagggctagtaagcatagaagaaatgcaggatatttctaaagtcacggagcttccacttaacgtaatgaatatgcctagtatagctaatataagtgctttggcagaaagtggtgtaaataggtttagcttaggtaactcagtttttgatgatgtgtactcctatttccagagtgtggcatcaagatcactgaaagacggtaatttttcagcccactataatcacccagctcttaactag

SEQ ID NO: 1147 - DNA, 96 bp, Xenorhabdus bovienii
  Coding DNA location: Contig name=SeqID_16854; Position on contig =26467..26562bp; Strand=-
ttgagttcggtgatcgcattgacggtcactactaagaaaaggtatttacacaaaatggtatacaggctctctcaggttcctaaaagtggcctttaa

SEQ ID NO: 1148 - DNA, 705 bp, Xenorhabdus bovienii
  Coding DNA location: Contig name=SeqID_16854; Position on contig =26528..27232bp; Strand=-
gtgctaaaagtccgtcaggacaaccgcgtcatcaataaatccgtctttctcactctgggtatcaatattgaggggcagaaagagcttttagggatatggttagccgagaatgagggcgctaagttctggttgaacgtgctaacagagcttaaaaatcgcgggctgaatgatatcctcattgcttgcgttgatggtctgaaaggctttccggacgcgataaacgccgtttacccagaaacgcgcatccagttgtgtattgtccacatggtacgtaatagtctccggttcgtggcctggaaagattacaaagccgtcacgcgagatctgaaaacgatttatcaggccccgacagaagaagcagcccttcaagcattggaagcgttcagtgaaacctgggatcaccgctatccgcagataagtcgcagttggcaggctaacgggaataatttatccacgttcttcgaatatccaacggaaatccgtaaggttatctatacaacgaatgccatcgaatcgctgaatagcgtcatcagacacgcgataaagaagcgtaaagtattcctaaccgatgactccgtgaaaaaagtgatctggttggcaatccaagccgcctcaaagaaatggacgatgccacttcaagactggcgaatggcgatgagtcgttttattattgagttcggtgatcgcattgacggtcactactaa

SEQ ID NO: 1149 - DNA, 462 bp, Xenorhabdus bovienii
  Coding DNA location: Contig name=SeqID_16854; Position on contig =27252..27713bp; Strand=+
atggatgaaacctatatcaaagtgaaaggccagtggaaatacctttaccgggcggtcgataccgacggtcagacgattgactgcctgctgaccgctcgccacgatgcaacggcagcccggcgttttttccgtaaaacgatacgccagcacggcagacccgccgtcgtgactctcgataaaagtggggccaataccgccgcgctcaccctcctcaatgcggaaggtgagcctcagcaggggattgaaatccggcaaaataaatacctgaataaccgcattgagcaagaccctcgccatgtcaaacgtcggatacgacccatgttaggctttaaatcgtttcgccgggcccaaacgattttagcgaggatagagcgcgtttcgatgcggcgtaaagggcaatacttacaatcagaagataagacattggcaccggcagagaagttttatcgattgactgcataa

SEQ ID NO: 1150 - DNA, 150 bp, Xenorhabdus bovienii
  Coding DNA location: Contig name=SeqID_16854; Position on contig =27660..27809bp; Strand=-
ttgctttgctgggagcagcattttttaaagaggaactgcaaggggttctgtcgcattaacaaagaaagtttgtacggaggtgggaatgatgactatttatgcagtcaatcgataaaacttctctgccggtgccaatgtcttatcttctga

SEQ ID NO: 1151 - DNA, 207 bp, Xenorhabdus bovienii
  Coding DNA location: Contig name=SeqID_16854; Position on contig =27826..28032bp; Strand=-
atgacgctttcactttggcgatgggccattgcaatggtctgtgttttgccattcgcctggaaacctatgtgccgggattatcggctgtatctgacccataagtggctgattatcagactatcccttttcggagtggtggcgtttaattcactggtctatgtcggactacatcaaacctcagcatcaaatgcgctgctgcttaactga

SEQ ID NO: 1152 - DNA, 219 bp, Xenorhabdus bovienii
  Coding DNA location: Contig name=SeqID_16854; Position on contig =27932..28150bp; Strand=-
atggatcctcgtgcgagaaaaccattcatttctccagcgctgctgttgatattactgcctcctttgttctgggccggtaattttatcaccggtcgcgctgttcacaacatcgccccccatgacgctttcactttggcgatgggccattgcaatggtctgtgttttgccattcgcctggaaacctatgtgccgggattatcggctgtatctgacccataa

SEQ ID NO: 1153 - DNA, 786 bp, Xenorhabdus bovienii
  Coding DNA location: Contig name=SeqID_16854; Position on contig =28226..29011bp; Strand=-
atgcctgcgagcagcattacgcccgtggtgcccgcccgcttcattttcttcttctgggcggaaatgcaggactggccgttgcttatgccggacaccaaactgggggttcctgtcagtgttgttgtgcctgaatccacatcagagcgcacccgtcatctgctgggtctggaaggagctgatgtcaaagtacacggaaaaacctgggcagaagcgaatgaactggcactgtcactactgaacgataatgatgcgttcattcatcctttcgatgatccacttctctgggaaggtcatgcgtccatgatcgacgaagtggtggctgaaggtttacgtcctgacgcggttatcctctccgtaggaggtggcggtcttctcgcaggtgtcgatgaaggccttcgccgcaacgatctgaacatccctgtctttgtggttgagactgaggggatgtcatctttccacgctgcattactagctggtcatccggtatctctgcctgaactgacgggagtggcgacctccctcggtgctcgtcaggtgtgtcagcaggcttttaacctcgcgagtgaacgggaaattatttccttaacggtgagtgataaacaggcggtgggtgcctgcctggccttcctggatgaccaccgtactctggttgaacctgcatgtggtgcatctctggccgttctctatgatcagaaaatcgatgccagtggaatgaaaaacgtgctggtcattgtttgtggtggttcaactgctaccaccacatctctgcaaggcttccggggctaa

SEQ ID NO: 1154 - DNA, 93 bp, Xenorhabdus bovienii
  Coding DNA location: Contig name=SeqID_16854; Position on contig =29033..29125bp; Strand=+
atgagccggagggttgcattgcctccatcttcatccagacgcgggtattattcaggcgacccagtggcagtgactccagcaggggagtattga

SEQ ID NO: 1155 - DNA, 315 bp, Xenorhabdus bovienii
  Coding DNA location: Contig name=SeqID_16854; Position on contig =29219..29533bp; Strand=-
atgcacccgccggaaaaaccaatgaaaaaatacgccagttccataccctttccgttttcacgcgctgtcgaagctaacggattcctttttctgtcagggcaattatcgatgaatgataagcgggagcctgttcagggctccgtggaagaacagacccatctcgttttacaacatgttgatgcagcgctgaaaacatgtgggtcttctttcgacaaaattcggtctggctgtccgaaatgggtcatttccaggcgtttaataacgcatatcgtactcattttcctgacggatttccggcgcgtacaaccgtcgtga

SEQ ID NO: 1156 - DNA, 723 bp, Xenorhabdus bovienii
  Coding DNA location: Contig name=SeqID_16854; Position on contig =29533..30255bp; Strand=-
atgtttaacgttggtcatgttatgaacgtttttgatgaacaaaattatgccgaggacatgattaacatgctgtcggcaactgtacgtgcactgggtagcgtactggcaggtaatgccgaaattgtccttcatgacctgcgggatccgaccttttcaatagccgagattgttaacacaggtgtgaccgggcgcaaaaaaggcgattcggtactggccggtatgcgtaccgaccgcgcgtttatcagtgcaatggagaacagaaacgaacctgtttctttattgctggattacgaaacgctcactcgtgacggtaaggcattacgaagtagcactgcactttaccgcgaccacaccggcaaaccttacgctgcactctgtatcaatgtggataactcaggcattgatgaggctctcaggcttctccagtcactggcgggtatccggccagacgtgcagcctgccacgcaggaagacgcttcgtctgaggccagtcacgacaacattgaagatctgatgcgagacatcatcagtaccacgactgcactcagttccggcagcagccgaacggataccaaacgagccaatttaatggcggtaaagaatatgcaggaaaaaggcctatttcttatcaaaggtggtgtggagaaagccgcagccgcactcggggtcacccgctataccatttataactatctggatgaacttaaaagcggtgatgaataa

SEQ ID NO: 1157 - DNA, 108 bp, Xenorhabdus bovienii
  Coding DNA location: Contig name=SeqID_16854; Position on contig =30254..30361bp; Strand=+
atgttgttgaataacaatatcagtaccagaccattaaatcaacaaagtgttgatcatgaaatgacagctatttccaaacgaacagcaatcgatggagactgtttgtga

SEQ ID NO: 1158 - DNA, 135 bp, Xenorhabdus bovienii
  Coding DNA location: Contig name=SeqID_16854; Position on contig =30358..30492bp; Strand=+
gtgacagaatcacccaatgtaaaactggaaaagccgaggataaccagaaaagcgcaccctaaagtagtggagctgcgcgggcagtgtcgcgttaacggcggcaagttagcaaaagtggtgttgccggttatttag

SEQ ID NO: 1159 - DNA, 309 bp, Xenorhabdus bovienii
  Coding DNA location: Contig name=SeqID_16854; Position on contig =30543..30851bp; Strand=+
atgttgatattgccctttgcgtatcatgtgaatcagttcgatgccggccaggagcgtctgtgcccggcgaaacaatttgaaccccagcatctgtcgtatccgacgtttgatactacggtgatcttgctcaaccaggttattcagatacttgctttgcctgagggtgatgttttcctcttcaggtttgtcggcattgagcgtggccagagccgcagtattggcgccgcttttattgatcgtcaccctttcaggttcgctgtggtgaggcccagtgggagcgaagctacaaaatgcgacatttggctttaa

SEQ ID NO: 1160 - DNA, 435 bp, Xenorhabdus bovienii
  Coding DNA location: Contig name=SeqID_16854; Position on contig =30848..31282bp; Strand=-
gtggtcagtcggttggatcggctggcgaggtcgactcgagacctactggaactggccgacatttttcaacatggcaatgtgggtctgcgttccttggctgaaccctgggctgataccacatcaccatccggcaagatggtattcacgatatttgcaggcatagctgagtttgaaagagcgctgatctctgaacgaacccgggcaggtcgacatgcagcgaagatgaaaggagtacgcttcggtcgcccgacgaaattaagcatcgagcagatcgctttggggcgaaggttgatttcagaaggtagctctgttcgagatactgcccggattcttaactgtcaccatgcaacgctttatcgttcgctcaacaatgctgcgggtctactcgacgacgagttagaaaacgaaaaaatatttggtaatacaaaaagttaa

SEQ ID NO: 1161 - DNA, 342 bp, Xenorhabdus bovienii
  Coding DNA location: Contig name=SeqID_16854; Position on contig =31120..31461bp; Strand=-
atgacgatgctgatcggttacgcacgcgtttcaaccgatgaccaacatttggatggccaacgggctgctttacgtgcagcgggtgccaactcatttatgaagaaaagatatcaggagctaaacgaaaacgtccagagctcacgcgcttacttgagcatttacgtgaaggagatgtcgttgtggtcagtcggttggatcggctggcgaggtcgactcgagacctactggaactggccgacatttttcaacatggcaatgtgggtctgcgttccttggctgaaccctgggctgataccacatcaccatccggcaagatggtattcacgatatttgcaggcatag

SEQ ID NO: 1162 - DNA, 108 bp, Xenorhabdus bovienii
  Coding DNA location: Contig name=SeqID_16854; Position on contig =31421..31528bp; Strand=-
ttggcgcaaaagtatggtgcgaaagtttatattaacaatacatatttacgacagatttacttgaggtatgacgatgctgatcggttacgcacgcgtttcaaccgatga

SEQ ID NO: 1163 - DNA, 705 bp, Xenorhabdus bovienii
  Coding DNA location: Contig name=SeqID_16854; Position on contig =31602..32306bp; Strand=-
gtgggaaatagatttgtaacaaaaacagctttactcggaagtgatgtaaactttgaagtgaccattctacaagccgaatccgccgctcgatgcgttctcttcgttacagggcttggagggaatccattgcgacacttgggccttttgcagacctttgccgagcatgggatttcggttgtcgcgccgcatttcgagatgttggcgtcttccatcccgacaaaagccgaactattggagcgtagccgaaggctcactctggccgcgaaaacatattgctcgcccggtatatcaatcgcaggtgtcgggcattcaattggaactgtgatcttgctgatgcaagtcggagccgaagcctcaaccttggcgggagatcgactgaaattaggaagggagctaactcttgatcggttggtgcttttcacaccacctacagatttcttcagacgccccggctctttgacatccgtaaacgtgccgattcaagtttgggcggccggcaaggacgcgatcacgcctcctgcgcaaactgtatttctcaaggaaacgattggggaccaaacccaaattgatgttcatttggttgaagatgctggccattttaccttcatgaacgagctgcctccatatgtcactgacccgcatcctgatcgcagcgctttccttctatcgctgggtgatgaagtaagccgttttttgacaacatga

SEQ ID NO: 1164 - DNA, 108 bp, Xenorhabdus bovienii
  Coding DNA location: Contig name=SeqID_16854; Position on contig =32368..32475bp; Strand=+
atgacgctccctctctggacgaaacaagtgtcgcataatttaggatttatgcggaaatggatgactcagcatacgtttacccattttgcctcggacatcaggcggtaa

SEQ ID NO: 1165 - DNA, 387 bp, Xenorhabdus bovienii
  Coding DNA location: Contig name=SeqID_16854; Position on contig =32465..32851bp; Strand=-
ttggcagagttgggcaaagccattaagactatcttcctttgtcgttatttgcacgatgagtccctgcgttgtgaaattaatgccggactgaacgtcgtggaaaactggaacagcgctaatgattttattttctatggtgagcacagtgagttcacaacaaaccggacagaagatcaggaactctcgatgctgtcattacatctgttgcaaattagcctcgtgtatattaatacgctgttgattcagagtgttctgtctgaaccgacatggcgtagccgtatgacagaagaagactggcgtggactgacccccttgatatatcaacatattaatccgtatgggcgtatcgagttggatatgaatcagcgactggcacttaccgcctga

SEQ ID NO: 1166 - DNA, 198 bp, Xenorhabdus bovienii
  Coding DNA location: Contig name=SeqID_16854; Position on contig =32761..32958bp; Strand=-
atgaaattatcaaatatacagtcgcactcaggattggtacggctgaatccgaggccatattacggcgtttcactcgtaacaatgcacaacatccaacatataaggcattggcagagttgggcaaagccattaagactatcttcctttgtcgttatttgcacgatgagtccctgcgttgtgaaattaatgccggactga

SEQ ID NO: 1167 - DNA, 2226 bp, Xenorhabdus bovienii
  Coding DNA location: Contig name=SeqID_16854; Position on contig =32969..35194bp; Strand=-
gtgccattctcatcccttgatatctatcctcttcaaggccggcaggctcaacgacatcgccaaagtattcgccattatttgaaagtcagactacctaataaaaccgataccgcacggcttactcattggttagtggagtttactctcccgttaaatccgcaggctttgcatggtagagatattgtgactgactggtgtcatgagcaattgattgagcctcctgcgtttgaccatctggatcggattattcgctctgtcgttcgccgatttgaggctgaacaacaagaaataatctttaaccgactctcgatggatagcaaaatcgctatcaatcatttactttctggagagggatccggctcagctaaaacttcaagtgtttcgttcagcgggctcaaagccgatccaggaaaacccagccttgaaaacgtccttactgtcatttctcagctcaaatttctcgatgacatgtccttacaaccgaatacttttcaggggataccccataaatttatcatgcagttccagcaacgatgtgtaagcgaatcaatcagagagctccgtcgtcatccctcagccattcgttacagtatggtcgccatgttttgctggcgttgccggcaacaactgattgatgcgttgattgagatgttaatggtactgatccataacctcggtgcccgtgcacaaaagaaggtggataaaaagcagtttgctgcgtataaaaaagtacgaggtaaggctcgcctactgttccgcatggccgaagtgacagttgatcagccgaatggtgtcataaaagacgtagtctatcccgttgttgcacagaaaacgttgcaaaacctggtcaatgaattcaaaaccctgggggttaatacggaacacgaagtgcatgaatccatacgttcttcttatggctctcactaccgacgaatgctgatgccggtgttggatcggctggagtttaaatcagggaatacgctgtatcgtccggttattaatgccattcaggttattaaagcccagcgggacagcaatcagtatttctatgatgtgggtgacgtgcccgttgacggtattattcagaagacgtggcgggatattgttatagtaaaaaataagctcggagaagaacgagtcaaccgtatcaattatgaaatctgtgttttacgtgctctacgtaagagtctgcgcaacaaagaaatttgggtggagggtgccgatcgataccgtgatccggctgaggatcttcccgcagattttgccatcaaccgtgagcattattattccatgctacaggtgcccactaatgcgtcaacattcatcggccacattaaggatacgatgcgtcaatggctcagtacgttgaataacggtctgccagaaaatgccaaacttcgcctccgagaacagggtaagaacagaatccacctgacgtcactggacaaacaggttgaaccacccaatacatcggcattaaaacgtgaaatcggccaacggtgggccgatttggagttaatcgatattcttaaggaagtcgacttacgtgaaaacttctcatcgttatttcgaacatcagccagtcgggaagtccttgaacctaaaatattacaacgtcgtatgctgttatgtttgtttggccttggcaccaacgtgggactaaaacgcgtaaccagccagcaacccagtgtcagttatgatgaactgcgttatgtcaaacgacgatttattcagaaagatgcactacgtaatgcaatttcacacatcgttaatggcactttccatattcgtcaccccgccatctggggcaatgcaaccacgtcctgtgccgctgactcccgtaaattcggggcttatgatcagaatctgatgacagaatggcatgcacattatggcggacggggtgtaatgatttactggcatgtcgatactcactcaacgtgtatttattctcaactacgtcgctgttcatcatcggaagtatcggccatgatggaaggagtgcttcgccactgtaccgacatggagataaatcaccaatatgttgacagtcatggacagagtgaggtggcttttgctttcagttatgttctggactttgacttgctgccccgcctgaaaggtactgcccggcaaaagctgaatttgtgcggaaaagaggatgctgccttgtaccctaatctgacaccgattttaacccgagtgatcgactgggaacttatttag

SEQ ID NO: 1168 - DNA, 96 bp, Xenorhabdus bovienii
  Coding DNA location: Contig name=SeqID_16854; Position on contig =35182..35277bp; Strand=+
atgagaatggcacttcgacttgttcagcgatatatcgaacaatgtctgggggtatttcgtctattgactctgggtatcggccttatatctgtctga

SEQ ID NO: 1169 - DNA, 135 bp, Xenorhabdus bovienii
  Coding DNA location: Contig name=SeqID_16854; Position on contig =35264..35398bp; Strand=-
atggcgtcgctgggtgagccacttggtaatagggatatttggaccctgctggatgacgaacttttcttacttcctcggatgactgataaaggccgcttaggatttgctattcagcttaaattcagacagatataa

SEQ ID NO: 1170 - DNA, 108 bp, Xenorhabdus bovienii
  Coding DNA location: Contig name=SeqID_16854; Position on contig =35465..35572bp; Strand=-
gtggcatggtcgaccccaatgccgcgctctgccatcatctcctcgagattggctcagtgggagcgaagctacaaaatgcgatatttggcttttttgacctgcgtctga

SEQ ID NO: 1171 - DNA, 276 bp, Xenorhabdus bovienii
  Coding DNA location: Contig name=SeqID_16854; Position on contig =35535..35810bp; Strand=+
atgatggcagagcgcggcattggggtcgaccatgccacgatacctcgctgggtgttacgtttggtgcccctgctcggcaaggctttccgacctcgcaaaaagctcgttggctcccggtggcggatggatgaaacttatatcaaagtgaaaggtcagtggaaatacctttaccgggcggtcgataccgacggtcagacgattgacttaacctgcggaaggctcaccccctcctccaaatgcggaaaggtgaacctctcgcccccggggggggggtga

SEQ ID NO: 1172 - DNA, 132 bp, Xenorhabdus bovienii
  Coding DNA location: Contig name=SeqID_16854; Position on contig =35891..36022bp; Strand=-
atgcagtcaatcgataaaatatctctgccggtgacaatgtcttatcttcgggttgtgagtattgccctttacccagcatcgaaacgcgctctatccccgctaaaatcgtttgggtccggcgaaacgatttaa

SEQ ID NO: 1173 - DNA, 633 bp, Xenorhabdus bovienii
  Coding DNA location: Contig name=SeqID_16854; Position on contig =36146..36778bp; Strand=+
atgcttatttccagccttatggctattgccgcggttctgattatgggggttataagccctgggccgagttttatttatgttgcccggaatgcagttgcgtactcccgtcttcatggacttgtcacagctctgggcactggtgtaggagctgcagttttttccttggtagctatgctcgggctacagaaattattaaatgcagttcctgaattatttattggcttgaaagtggcgggaggtgtttacttgttatggcttgcattcaaaattttcaagagtgcatctcaccccctgactttagctctacatgggcaaaaaggatccgaaaaaactttgtggatgacgtttagagatggtcttttgacgcaattgagcaatcctaaaaccgcaatcatttttgcatctatatttagtgcgcttctcccagaaaatatcccagtggcattttacttcgcagtccccctgatgagtttcctgattgatgcaggctggtattcccttgtatcgctcctgctttcggctgaaaaaccacgtcagatttacttacgcattaagtgtgccgctgacagagcatccgcgactgtattaggagttttaggtatcaagctaatttactcttcaatcggcaagtaa

SEQ ID NO: 1174 - DNA, 120 bp, Xenorhabdus bovienii
  Coding DNA location: Contig name=SeqID_16854; Position on contig =36783..36902bp; Strand=-
ttgctgttatcccagactccgtatgtaacttttccgcgagtcgctagcgctcaccgaagccgaacgagcgcagcggaatatcatcggctcctgcattatttaatgcaggtcggcaagtaa

SEQ ID NO: 1175 - DNA, 714 bp, Xenorhabdus bovienii
  Coding DNA location: Contig name=SeqID_16854; Position on contig =36915..37628bp; Strand=-
atggaattatttaagaatgaatttggtcagttaataggtttttctgtttctgattggcatggagctgatctccccgatggtaatactctgactggtgagtattgccagctaataccaatggatataaataatcatggggatgaactttataagtgtttctgtgagccatttaactttagcgactggacttatttgcctgggccagcaaagcctttcaaagacaaaatggagtttatttcttatttgagaaacatatctaatggtgttgatccgtatcaattttctatcattgatatccgttctggcaaggcggttggctctattgcgatgatgcggattgataaagataacggcgttatagagattggctatgtgatattttctaattttttgaaaaaaacaagaatggctacagagtctgtatatttattaattaaatatgcatttgaagatctcggttatcgtcgagttgagtggaagtgcaataatctaaatgaggcatcaaaaagaagtgcgctacgattcggttttacatttgaaggtgtttttagacaagcagcagtaattaaagggcacaatagagatactgcatggttttcaatgttagatcatgagtttatgaagattaaacctaattttgaagcttggttgtcagttgaaaacttttacccagatgggaagcaaattgcctcgttagatacaaaaaagaagtaa

SEQ ID NO: 1176 - DNA, 150 bp, Xenorhabdus bovienii
  Coding DNA location: Contig name=SeqID_16854; Position on contig =37615..37764bp; Strand=-
gtggaagaaccctcgaaaatgacgagtgacgtaccagtttgtttttatggtctcctgaacccgtccggagtggtgcgccaaaacggatattatggtaaatatatgtggatttatctaaataggaagagtgaaaattatggaattatttaa

SEQ ID NO: 1177 - DNA, 177 bp, Xenorhabdus bovienii
  Coding DNA location: Contig name=SeqID_16854; Position on contig =37736..37912bp; Strand=-
atgaaatcaggacaatcgcagtatctcagtttttttgctggtatttctccgcagctaaaaggcctgttcataggtaatagaagaaagggatcgcaaagggaacgacgagtgtcagactctgaccttcttactgtcttagagggggcctgtggaagaaccctcgaaaatgacgagtga

SEQ ID NO: 1178 - DNA, 135 bp, Xenorhabdus bovienii
  Coding DNA location: Contig name=SeqID_16854; Position on contig =37935..38069bp; Strand=-
ttgcggatttgcgttaatttcattgattgctccagtgattcatctgattttgaggctcagccactgcgtttggtgttatcgggcagggtggctgcgagtggctttactataagaggaggaagggataagccgtga

SEQ ID NO: 1179 - DNA, 780 bp, Xenorhabdus bovienii
  Coding DNA location: Contig name=SeqID_16854; Position on contig =38047..38826bp; Strand=+
atgaaattaacgcaaatccgcaatgccactctcgtactggaatatgccggtaaaaaattccttatcgacccgatgctggcagaaaaggaagtctgggatggatttgccgggaatgctcgcccgcacctgcgtaatcccatggtcgccttgcccgtgtctgtggaagatctactggctgttgatgccgttatcctgacccacacgcataccgaccactgggatgaagcagcgcagcaggctgtacccaaagacatgcttatttatacgcaggatgagagtgacgcggcgctgatccgttctcagggctttcttaacatccgcgttctgaaagaggaaaatcattttgttgacggactgacgatttataaaactgacggccagcacggcagtaacgaactttacgccgatgcccaatggggtgaactactgggtgatgcatgcggcctggtcttcacacatcatgatgaaaaaacgctttatatcgctggagataccgtctgggtcaagccttatgcaagaagcctgcagcgcttcaaaccggagattgtggtactgaataccggctatgctgtcaacgacctttacggtccgatcatcatgggcaaagaagatacgttgcgcacgcttaagatgttgccgaatgcgaccatcgtggcgtctcacatggaatcgatcaatcactgcctccttacccgcgcggagttacacgagttctcacttgaacacggcattgaagataaggttcttattcctgcagacggtgaaacaatagctttctga

SEQ ID NO: 1180 - DNA, 120 bp, Xenorhabdus bovienii
  Coding DNA location: Contig name=SeqID_16854; Position on contig =38890..39009bp; Strand=-
gtgaaacgggctgaatccggccgtggcaatcacggcgaccgtcaatgcagacataacgttaaccttaccgtaaagaagagccaccggaccaccggcggcaaaattgttaatatcaactga

SEQ ID NO: 1181 - DNA, 975 bp, Xenorhabdus bovienii
  Coding DNA location: Contig name=SeqID_16854; Position on contig =38956..39930bp; Strand=+
atgtctgcattgacggtcgccgtgattgccacggccggattcagcccgtttcacttttcagtaccctgcattattttcggacagtctatgccgcagccggatttattctgcgtggaaatctgtgctgaaaaatcgggcgtcgtcctgtctgatattggcctgtcaatcaacgtggaacatgaccttaagctgctcgaaaccgcagacattgttatcgttccctactggaatcatccggaagaaagaccctctcaggcactgctggatgcactgataggcgcatggcagcgcggcgcagaagtggtggggctttgcctcggcgcttacgtgctggcgtattccggcttgctggatcagcaccgggccgcaacacactgggagttcgaacaggacttcattgaacgatttcccgccgttcgtctggacagcaactcgctgtataccagcgatgaacgccttattacctctgccggcaccgccgccggtattgactgctgtctgaatattatccgggatcattacggttcagcggttgctaaccgtgtagcaagaagaatggtggttcctccttatcgggaaggcggccaggcacagtttattgaacgtccggtcccggtatcaacgcgggataataaaatgaacgaactgattgaatatttgcggagaaaccttgataagccgcacgatctcgactcactggcgggatttgtcagcatgagcaggcggacacttacccgtcatttttttaaggcaaccgggacaacgctgggtgattggctaaacgctgaacgtcttcagagaagtcaggagctgctggaaactacggacagtagtattgaaagcgtgtctgacatggccgggtttcagtcaccgatctctttccgccagagttttaaggcaaaattcagcgtcagtccaagcgaatggcgccgggcattccgcggtcctgtacctgttgatcacgaaaaggcctga

SEQ ID NO: 1182 - DNA, 384 bp, Xenorhabdus bovienii
  Coding DNA location: Contig name=SeqID_16854; Position on contig =40015..40398bp; Strand=-
atgcgggccgctacacctaataccgcagatatgatccacattgtggatgcctgctttaaaaaggggatcgccatacgttttctggagaacggcctcagtaccgaaggaactatggggaaaatggtgatacagattctggccgccgtggctgaggcagaacgggaacgcattcttgagcgtaccaacgatggccggctgatagctatggctgctggcgttaaattcggacgaaaaccccatagtaaatctgtgattgccctgcaatttatacatcaaaaaatgacggctgaagccgtgatgaacaaaacggggatttcgcgggcaacctattatcgtttgaaaaaagtagccctgaatccttttgaaatcgacgttaaagaatga

SEQ ID NO: 1183 - DNA, 186 bp, Xenorhabdus bovienii
  Coding DNA location: Contig name=SeqID_16854; Position on contig =40474..40659bp; Strand=-
gtgctttccagacaacttgatgatttagagccgacgctaacacggcatggttatcgtttgaaagatatggtggaacaatttgatgccaaacccgctgaaatcagagcgttgtttaacaatcaactcgatccggttcgaaccacagagttgcgcgacagaatgttggcagttgggctgccgatatga

SEQ ID NO: 1184 - DNA, 399 bp, Xenorhabdus bovienii
  Coding DNA location: Contig name=SeqID_16854; Position on contig =40668..41066bp; Strand=-
gtggccttgttcgttgatgaggctcatgatcttaacgggcatattttaactggactcaaacgactaatggaagttgtagaagacggtggaggccgcttatcggtggttttagccggtcatcccaaactgcgtaatgacctgcgtcgtccaacgatggaagagattggataccgcaccgatatttttacgctggatgggatcacgggcaggcgacgggaatacattcattggttacttaaaaccagcatggggaaaggaaaaacggaagatattctgacgactgatgctctcgatttgctgacgatgaaattgcgtaccccactgcaagttcagttgcatctcacgttagccatggaagctggttatcagactggtgaaaaaccaatcatgtcaaactga

SEQ ID NO: 1185 - DNA, 96 bp, Xenorhabdus bovienii
  Coding DNA location: Contig name=SeqID_16854; Position on contig =41080..41175bp; Strand=-
atgggtctaccccataaagacaatgcaatgagacagtttttgtgtcttattagggttgtttttgtctcatccacatgctacgtttcattcatctaa

SEQ ID NO: 1186 - DNA, 246 bp, Xenorhabdus bovienii
  Coding DNA location: Contig name=SeqID_16854; Position on contig =41317..41562bp; Strand=+
atgtgggctaaaaaagcggataaatgcaagcccgaccgttttcgattgcgggccgttacatttaggatgacggaaatacccgagtatcgccaatcgcctggagccgttttcgttccattgagcggtgcgctgggaaaagctgcacttatcggtcatgactccaaagcgttaacctggtattcttatgcttttttaaggggatctcaaaatgacggtgacgatagaagttgcttgccggtattgtaa

SEQ ID NO: 1187 - DNA, 279 bp, Xenorhabdus bovienii
  Coding DNA location: Contig name=SeqID_16854; Position on contig =41525..41803bp; Strand=+
atgacggtgacgatagaagttgcttgccggtattgtaaccaaaccgaaccggtacgcaaacatggagcaggtaaagccgggtttcctcgttattattgcaagggttgccaaaaaaccttccaactcaactctcgttacaatggccataagccgggtatgaaagaaaaaattgtcgatatggcgatgaatggctccggtgtgagagacacgggacgtgttttaagtatcggtatcaatacggtaatgcgtactttaaaaaactgtcgccaaaacaggtaa

SEQ ID NO: 1188 - DNA, 135 bp, Xenorhabdus bovienii
  Coding DNA location: Contig name=SeqID_16854; Position on contig =41806..41940bp; Strand=-
atgggctatgacctgcttcctttttgtatcaaaagcatatcaaagccaatgacgttgttttttgttgcccacaaaagacccctgttcatccagttcacaaatgagggtgacatcatcataagcaacctgccttga

SEQ ID NO: 1189 - DNA, 117 bp, Xenorhabdus bovienii
  Coding DNA location: Contig name=SeqID_16854; Position on contig =41989..42105bp; Strand=-
atgccgttcgatacgttgggtcaaaatttttcccaccaaatgcttttctggctcgacttctctggcgtaacttccccaaccatcggtcgtgatgaaacgaatatgaaaaggggctaa

SEQ ID NO: 1190 - DNA, 168 bp, Xenorhabdus bovienii
  Coding DNA location: Contig name=SeqID_16854; Position on contig =42070..42237bp; Strand=+
gtgggaaaaattttgacccaacgtatcgaacggcataatctcaatctgcgcatccatatcaagcggctggcaagaagaaccctttgttattcacgctcaatagaaatccacgaaaaactcattgggacatatattgaaaaatatcattataacgctttggagtcatga

SEQ ID NO: 1191 - DNA, 129 bp, Xenorhabdus bovienii
  Coding DNA location: Contig name=SeqID_16854; Position on contig =42234..42362bp; Strand=+
atgaccacttcatccatcactttgttcagattaatacgtcgcacactactggcaaactttattgtcttttttcgttcttgtgggcgagctttattgttcctgcacatttgtgcatgcacaagattttag

SEQ ID NO: 1192 - DNA, 417 bp, Xenorhabdus bovienii
  Coding DNA location: Contig name=SeqID_16854; Position on contig =42374..42790bp; Strand=-
atgaatgacactcaaaaaattacagccgaagacgtttctcaatttcttaatcagttcactcgcagaaaaaaggtattgcgcggtatgactgctgatcagatcaacatcctaatttccgatgcgaaagcagttttggaagatgtaatagctgatgaagatatcaaaaaacggcaggaagcagagagacaaaccaaaatcagagagacagcaaaactactaaaaaatgaaggtattggccttgatgatttagagaaacatatggtaggtagacgttccccgactgtagaaccaaaaatatatttgattaacggaaagaagattatctataaggggtctggaagaatgaataaggcgctaaaaacaatagtagacaaagaaggtcatgatgccctcgaacaatacttagttcgtgagtaa

SEQ ID NO: 1193 - DNA, 429 bp, Xenorhabdus bovienii
  Coding DNA location: Contig name=SeqID_16854; Position on contig =42800..43228bp; Strand=-
atgagtaaaatcaaatcaaagcaggaagaacagaagaaaaataaaatagtcaatttgctaaccggcttttcaagggtaaaaagtgatattgcaaaaatcactgctgagcatgtggttgatgatattccagcgccggaatttggtgacgggaaaatcacaactcagatttaccgtaataaaaatattttcgctaagatagataacaaaattaaacaggttttaccttattacacagcgctttacgcaattgtaataggaactaattcagaaccagtaccagtgctcatttcgcaagaacccaatgacatttctgacggattccctcttgttgatgctaaaacgttccaacgtctaagggttgaggactgcgatttttatgtgctgcaaggggatgattttgtccctatagcgaagccattttctaagtag

SEQ ID NO: 1194 - DNA, 132 bp, Xenorhabdus bovienii
  Coding DNA location: Contig name=SeqID_16854; Position on contig =43176..43307bp; Strand=+
ttgactattttatttttcttctgttcttcctgctttgatttgattttactcatcgctcatttaccaaaaccaagtttagttaattttgacacagtttttttatgccatcaaattgcatgtatgctaatctaa

SEQ ID NO: 1195 - DNA, 630 bp, Xenorhabdus bovienii
  Coding DNA location: Contig name=SeqID_16854; Position on contig =43348..43977bp; Strand=+
atgagaaaattaatattggcctctttattttcttctttttttattccccttccaagttactcgtttatgggctgcttcataagtgccggacaacagtatggcgtatcaccactattgatccaggctatcgcggaaggtgagtctaagtataacaatcgagccataaacttaaaaaactcagatggaacaactgacgccactatgatgcaaattaattcttggtggcatgataagccagttttcataaaaaacaagcttagcagacaaaaactaatgaaagatccgtgtcttagtataaattttggggcatgggtacttgctggaaatttttctatcggtggtgttaattggaactccgtgggtgcctataacgctggctgggacaaaggcaaggcaaccgcaaggcaaaactacgttaatagaattaaactcatttatgagcgtttgaagcgcgagtctggtgtctcgccatcttcatcagaaatgaatgattcaaatttaggtactcttactgctgaattatcctttccttctccgatgcatgacaaatcaaccccaagtacagaactcgtaactaaatcatttttccattcaagaaatagcgatatgaaactagtgggtgacatgtga

SEQ ID NO: 1196 - DNA, 405 bp, Xenorhabdus bovienii
  Coding DNA location: Contig name=SeqID_16854; Position on contig =43977..44381bp; Strand=+
atgaacgataaatcattacttttatatttcgcatttcctattgtcgttagtttaaataaaatatttggactcattactattccaacaggtcttttgatcttcttaaatctcgtcaatgttgtccttcttcattttattttacggcgaatttttgtaacgacttggaaattcggaatctatctacatctatgtacgcttctacttttagccgcaaccttaaccattcaaacaaacggaagtgattcttcgttactcttaaaatcattttggtttgagttcacaatttttagtggtgcctggttgttgctcttctattccctgttcactgagcctgaaatcaagacaaaaatgagtatcgatttagtgcatgcacaaaaacatgataaaggtaacaacgatgaatag

SEQ ID NO: 1197 - DNA, 306 bp, Xenorhabdus bovienii
  Coding DNA location: Contig name=SeqID_16854; Position on contig =44344..44649bp; Strand=+
atgcacaaaaacatgataaaggtaacaacgatgaatagtatctttctaggttttctacttatagcctgtggcgctggctttctagcattgattgggtactttgtgaatagcaaggatcaagtgtccaaaggcagtaaaaatatccgaacatccttacttcctcccgacttagaaaaaaaacgcatgatagaacgcgaacaaaccgcctctcttgtctcggttcctgaagaaccttatgtgcctacaacacactcggctgattcagcatctgacaccggaaccactccagacagtatccccgactaa

SEQ ID NO: 1198 - DNA, 204 bp, Xenorhabdus bovienii
  Coding DNA location: Contig name=SeqID_16854; Position on contig =44668..44871bp; Strand=+
atgaagcttaatgtatctatatcagtagcatgcgaaccattacaaatccccgttaaacaggcaattataagtatggatcggcatctatattctttttatatatgtgctgttttatggatttttacctttatgataatattcagagtcaccaaggaatttcgaggtcgccatataaaaactcatggcagttataatcatgggtga

SEQ ID NO: 1199 - DNA, 528 bp, Xenorhabdus bovienii
  Coding DNA location: Contig name=SeqID_16854; Position on contig =44849..45376bp; Strand=+
atggcagttataatcatgggtgatacatcaacactaaaatttatggttattgcctttattgtgatttttgttgtaatttttaaacgaaaaaaattcaatcgtcacaaggttaaaattgatagtgcaaaaactgttataaacaagctatttacatttagcaatgacggacaaagaatggcctaccttaaaaaaattgatccttatgtttttgaagaattagttctatttggctttgagtatcaaggccatacaatagaacgcaataaacgttacagcggtgatggaggggttgatgggcgtatttggattgggcgtcaattgtacctgattcaagcgaagcgttataccggagccatacaaaaacagcatgtgatagattttataagtctggttaactctcatggttgcaagggagtattttgccatactggtacaacaccagatagcgtaaagaaaatagttaaagaatcagattgtattgagctaataagtggtagtcacctactcaatttaatttcaattagttaa

SEQ ID NO: 1200 - DNA, 1794 bp, Xenorhabdus bovienii
  Coding DNA location: Contig name=SeqID_16854; Position on contig =45421..47214bp; Strand=-
atggcattagaccacggagttttaaatattccactccataaacgtggaaatatcgacagggacattgataaatggaaagcggaacagaccaaggaaaagagaaagcggctggatgaaattaactatcaacgcgaacaggagcggaaagaagctgggcggttatttaaattggttgatagaaaactgatgtgggcggaggctaacacaggtcataaaaatttactacgaacggtcgggaagtcgattgcagagcaccaagaatataaagttcatgcctttagtaccaataatacagggataaagcagatgaaagaggatggtatgaagaatgccatgtctattttctttcacatggatcgaatcgagaaaagcatcgccaagggtgaaccgctcaagggacgtaggcaactttggtatgtagaaaacgtatcaacattaggggcagaggaaacactacgcttacagcgattggcgcgcttctctggggcaaggttgattatggtggcagataaaaatgaaaacgcactgtcctggggggctgtaccgacactacttaaccatcatggtatgcatacggttaactttaatgctgtagttatggcccacaatcccgaaattaataaagcttcagatgccttagtgaaaggccaaatagaagattctctcacggcattatcaccaatggttcatgaaattgatagccggataacggcagaggcgaaaacagcgcgtattggcgtggttaaagacacataccttaatctcagcattgaggaacgtgaacaaacagcgattattctacccgatcatcatatacggcatgcagtaaacagcatgataagggacggattaaaggcagaaaaatcacttgtcgatgatgggattgaaactactgtttatcgccaggttatgttagatccatttgagaaaaaagaagcgagattctataaagcagacatggtattggaagcggaatcaaccacgcaaaatggaatcaaaggcgacaagttcacgattgtggatgtggataagaagaataatactttagaacttaaatctttatctgatgataaatcgttaattattaaaactaaggatataccaacaagtaaggggaatgggtttatttcatatgcagtggaaagtagagaaatagttaagggtgaaaaaattagactaactagagcttttccgttgccaaagaaaaagggggcaaataaaggtggttatttacctaaaaatgccgaagctatagtgaaggatattaatataagcacaggagatttgacgctgacattaaagaatggacagcagatcacattaaatacacagcaatggaaacactatgaatggggatatacgcataatcactatcaggtgaaagattctgcatacaaacaagttattaccatcatggaatcatggaagaagcactttgctacgcagaatgctttacataacacgttaactcgctctacccacaatcttactattatcacagataataaagaaaagttatttgatacgttgagaacaaatactggttttcagaaaatggctttagataataaaaaagtttctgtaactaaaactgatattaaaaaatttgatgagctatgggggaagtcacttaatccatttgaaaagagcattacacgtttagagttagccgttaataaggctgtttcgaaatttgtagatataacagctaagaaagagattaacactcctgaatacccaaataataatcaacaaatagaacaatctaaaccaactaaacaaaggtcattataa

SEQ ID NO: 1201 - DNA, 135 bp, Xenorhabdus bovienii
  Coding DNA location: Contig name=SeqID_16854; Position on contig =47150..47284bp; Strand=+
atgtccctgtcgatatttccacgtttatggagtggaatatttaaaactccgtggtctaatgccatcttcacaccctcgctgttactgttgtttattttctgttgtttttttggaaagttaactaaccaactataa

SEQ ID NO: 1202 - DNA, 309 bp, Xenorhabdus bovienii
  Coding DNA location: Contig name=SeqID_16854; Position on contig =47303..47611bp; Strand=-
atgtcaattaagaaaaaaaatcaatctttccacgtcatagataaattatctctttctcgtcagcgtatcactgttattgtatgtgaacttaatgctgggttgggatttcatttttgtaatcattatttgttaagtggtaataataatgatttatggtggccgctatctgaaagagaaaaactttttactgaaattgaaaaagcgatggttatgaatcatgtagcttataatgtaacctttattaacaaacttaggcattgcaataaggctactgattatgaagtgatatataacatgattgaaaagtaa

SEQ ID NO: 1203 - DNA, 240 bp, Xenorhabdus bovienii
  Coding DNA location: Contig name=SeqID_16854; Position on contig =47743..47982bp; Strand=-
ttgcggtgtgttctggtgcaattaaggtttagcagggcggaggaggggttatgggattatctgcttgttcccctttttgcgtcgtcggataacgttcgggtgccttctgaaactataacgtgcctcctcttatgcgctacgcgcatcaaaacccaaaccccgcagtgtttgagtcaggctaattttaggatgttcagggattgtctgaaaatcgctaaaggtacagtcatgtcacgctga

SEQ ID NO: 1204 - DNA, 156 bp, Xenorhabdus bovienii
  unsure (1)..(156): unsure at all n locations
  Coding DNA location: Contig name=SeqID_16854; Position on contig =48076..48231bp; Strand=-
atgcgctatcagaaaaaggaaatcccccatttagcgcaatgtaaaaatcacaaaagcgctagaattaaaacttcactccacaggggcttaatgagtccccttttttttattntcgtaaaagagttaaaaaaatatattcttaatacaaaaatttag

SEQ ID NO: 1205 - DNA, 93 bp, Xenorhabdus bovienii
  Coding DNA location: Contig name=SeqID_16854; Position on contig =48188..48280bp; Strand=-
atgagccagctttcagaagaagtggggatgtctagagaagggctttatcatgcgctatcagaaaaaggaaatcccccatttagcgcaatgtaa

SEQ ID NO: 1206 - DNA, 129 bp, Xenorhabdus bovienii
  Coding DNA location: Contig name=SeqID_16854; Position on contig =48284..48412bp; Strand=+
ttggctcttgctatatcacccaatgcggaaagccccaaagcaggatcgccatcctctaaaatttcgttaagatacatttgcattctttcctcgctatttaaatgctccgccaatatcgtattcttttaa

SEQ ID NO: 1207 - DNA, 348 bp, Xenorhabdus bovienii
  Coding DNA location: Contig name=SeqID_16854; Position on contig =48377..48724bp; Strand=-
atggtaacggtattaacgacagatatttttgatgattggattgatgcccttaaagatttaagagcaaagacaaaaatacaagcgcgtattaggagaatgaaaaacggaaattttggtgatatagaacccgtaggagatggattttcagagattagaatacatgaaggaaaaggttatcgagtatatttgaaaattaagaacaatgtgattgtgattttgttgtgtggaggcgataaaacaacacaacagaaagatattaataaagcaaaattaatttataaagaaattgaggggggaattatgaaaatgaaattaaaagaatacgatattggcggagcatttaaatag

SEQ ID NO: 1208 - DNA, 183 bp, Xenorhabdus bovienii
  Coding DNA location: Contig name=SeqID_16854; Position on contig =48836..49018bp; Strand=+
gtgattttttgtcgttcttcctttgccaagtcaataaaaatttttaagtcctttacttgcatcaatgggaaagtaaattttttcccctttgcaaatgctcttgctgctgctatcattttttctgacataaattttacctctcgtaatttagtgtcttggtgttgggttgttggagcaacctaa

SEQ ID NO: 1209 - DNA, 108 bp, Xenorhabdus bovienii
  Coding DNA location: Contig name=SeqID_16854; Position on contig =48994..49101bp; Strand=+
gtgttgggttgttggagcaacctaacacctcatttaactgtcaattttacctctctgttattaactcaccgcagcccactcggaaatgagctggagttaattatttaa

SEQ ID NO: 1210 - DNA, 186 bp, Xenorhabdus bovienii
  Coding DNA location: Contig name=SeqID_16854; Position on contig =49098..49283bp; Strand=-
atgaacgaacaacaaaaacacgcgattcaatctgtgataaatttatatggtagaatatggaaatctaaactgctgaatcattggatgaactcaaaatatccctattcgctgtccagtgtcagtggaacattgcaacaaattagaaatgaactcggccctagttggttatccaaattcaaggtttaa

SEQ ID NO: 1211 - DNA, 618 bp, Xenorhabdus bovienii
  Coding DNA location: Contig name=SeqID_16854; Position on contig =49475..50092bp; Strand=-
ggcagtattgtacgttcgcgttggaagcctattgatcaagttatatcgttgaaggaaatttcccagcgtaaaaaggatattgaacagaccaaacaactagctgaattacttattcgtaaatctcctgaatttgcagaattagaaacttatcaagctggagaaaacaaacaggtgcttgcggttagaaatatcagcaaaattctgaaactgcatttcaatggcgtgaaattttcggtcaaaagacgtagccatgattctgtttatgtgagttgggaagatgggcctatgcaagaggagataaaggctattataggccgttttcagaatggatgtcttgataagacgaccaattcttacgaatatggatataaatcatttaatgatgtttttggtggtattaaatttatttatatcgagcgtaattattccgataaattgatcacagaagttatttctatgctatctcaagagtacgaagaagatattatcagtcatgaacatacaccagaggcatatagaaaaggtgatcttctggctgtaggtaaagatatatttattaatggtctgcaaggtgaaataagccgaagagtacaacaattaaataaatattataaataa

SEQ ID NO: 1212 - DNA, 1311 bp, Xenorhabdus bovienii
  Coding DNA location: Contig name=SeqID_16855; Position on contig =11..1321bp; Strand=+
atgccggttttctcatggaccgtactgtgtaccaacgtactgattattgcagcattcccaatcctgacagccactgttgcactgttaactctggatcgttatatgggcacccatttcttcaccaatgatatgggcggcaatatgatgatgtacatcaacctgatctgggcttggggtcatccagaagtttacattctggttctgcctgtctttggtatcttctctgaagtcacagcgaccttcgcgaaaaaacgcctgtttggttatacctcgctggtatgggcgacgattgttattaccattctgtcgttcgttgtatggctacaccacttctttacgatgggctctggtgcgaacgtcaacgccttctttggtatcgccacaatgattatctctatcccaactggggttaagatcttcaactggctgttcaccatgtaccgtggtcgtatcgaatttaaaaccccaatgctgtggactgttggcttcctcgtcactttctccattggtggtatgacaggtgttctgctggccgtacctggcgcgaacttcgttctgcataacagtttgttcctgattgctcacttccataacgttattattggtggtgtggtatttggctgctttgcaggtaccgcttactggttcccgaaagcgtttggtttcacactgaacgaaaaatggggtatccgtgcattctggttctggatcaccggtttcttcgtagcctttatgccactgtacgcgttgggcttcatgggcatgacccgtcgtttgagtcaagatatcgaccctgcattccacactatgctggttgttgcagcgggtggagttgtcttaatcgctcttggtattctgtgtcaggttatccagttctacgtcagtatccgtgaccgtgaacaaaaccgtgatctgactggtgacccatggggtggccgtactttggaatggtcaacttcatctccgcctccgttctataactttgctgaagttcctcatatccagactcgcgacgcatggtgggatatgaaagagaaagacactgctcataaacgtccggctaaatatgaagaaattcatatgcctaaaaacacaagtgcgggcatcattatcagtgcgttcctcctggtcttcggctttgccatgatctgggatatctggtggctggctatcgcaagtttcgccggtactatcatcacttggatcgtgaaaagctttgacgaagatgttgattactacgttcctgtagctgaagtcgaaaaaactgaaaatcagcattacgaagaactgagaaaggcaggtgtgaaataa

SEQ ID NO: 1213 - DNA, 612 bp, Xenorhabdus bovienii
  Coding DNA location: Contig name=SeqID_16855; Position on contig =1321..1932bp; Strand=+
atgtcgactcaaacccttaacaacacagccgcccatgagcatcatgggcaccatgacgtaggctccatgaagatatttggcttctggatctacctgatgagtgacttggttctgtttgcaagcctgttcgccacttatgcagtactggccaacggcacggcaggtggcccatccggtaaagatatttttgaattgccatttgttctggtcgaaaccttcctgctactgttcagcagtatcacctatggtttcgccatgctgagcatgaacaaaggtaaaacgggccaagttaacctgtggctgttcattactttcttgttcggcctcggcttcgtttcgatggaaatctatgaattccataaactgatttcagaaggttttggccctgatcgcagtgcatttctgtcatccttctttgctttggttgccactcacggtatccacgtaacttgtggcttgatctggattattatcatgatggttcaggttgcacgccgtggtctgactgaagtgaatcgtactcgtctgagttgcctgagcctgttctggcacttcctcgacgtagtatggatttgtgtatttactgtcgtttatctgatgggagctatgtaa

SEQ ID NO: 1214 - DNA, 378 bp, Xenorhabdus bovienii
  Coding DNA location: Contig name=SeqID_16855; Position on contig =1887..2264bp; Strand=+
atggatttgtgtatttactgtcgtttatctgatgggagctatgtaatgagtcatccaaatacttctcattccggtgccgaccacggcagtttcaaaacctacatgattggttttatcctgtcagtcatactgaccgtaattccattctggatggtgatggatggcagtgcttcccagagcacaatcctgcttacagttatcggcatggccgtgattcagatctttgtacatttcgtctgtttcctgcacatgaacacatcgtctgaagaacgttggaacctcgtcgctttgatattcacattgcttgtcatcgctatcgttgttgtcggctctctgtggattatgtacaacctgaacatcaatatgatggttgattaa

SEQ ID NO: 1215 - DNA, 885 bp, Xenorhabdus bovienii
  Coding DNA location: Contig name=SeqID_16855; Position on contig =2278..3162bp; Strand=+
atgattaagcaatacctgcaagtgaccaaaccaggaattattttcggaaatctaatttctgtggttggaggttttctactcgcttccaagggcgtaatagattacccattgttctttgctacgatgctcggggtatcgctggtagttgcatctggttgtgtatttaacaactatatcgaccgcgatatcgaccgaatcatggagagaacaaaaaacagggtccttgttaaagggcttatcgatccgaaaatcagcctgatttacgcctcagtgctaggtattgctggcatagtgctgctctatgtagcagccaatgccttagcaatgcagttagccctcatcgggtttgtgatttatgttggggtttatagcctctacatgaaaagaaaatctgtttatggcacgctggttggtagtttgtcaggtgcggcacctccagttattggttattgtgcagtaacagggcagtttgacacaggggcattgatactgttgctaatcttcagtttatggcaaatgccccactcttacgccattgctatttttcggttcaaagattatcaggccgccaacattccagtattgccagtaattaagggtatttctgtggcgaaaaaccacatcaccctgtatatcttggcctttatggttgccaccttgatgctgacaatcagcggttacgcaggttacaaatacctcatcgtagcagcagcagtgagtatctggtggctgggtatggcattatcaggttataaaactgctaatgatcgtatctgggcccgtaagttatttatgttttctattgtcgctatcatgtctttgagcgtcatgatgtctgtcgattcaacagcatctccagaaacgctgctgacttacgttcggtaa

SEQ ID NO: 1216 - DNA, 1368 bp, Xenorhabdus bovienii
  Coding DNA location: Contig name=SeqID_16855; Position on contig =3360..4727bp; Strand=+
atgaacgataataaaatgactccgcttgaacttcgagcaacgtggggcttaggttccgttttttctctgcgcatgttaggtatgttcatggttttacctgttttaacaacctacggcttggagttacggggatccagcgaaaccttgatcgggattgctattggcatctacggtttaacacaggcaatatttcaaatcccattcgggttgctttcagacagaatcggtagaaaacccctaatcatcggtgggctgctcatctttgtactaggcagtattattgcggctttgagcgactctatttggggtattatcatcggcagagccttacagggtgctggtgcaatatctgctgcaatcatggcattactttctgatcttacccgcgaacagaatcgtacaaaagctatggcattcattggcattagctttggtattaccttcgcctttgctattgttgtcggccctatcatcacgcaccaaatagggttaaatggtctgtttggagcaataacgatcttggccagttgtggtatcttgatcaccttgttcgctgtaccgtctgcgcataaacacatactgaatcgcgagtctggaattgcccgtggcagttttcgacgtgtgctctctgatcctcagctactaaaactcaattttggcattctcagcctgcatactttattaatgtcgagttttattgccctccccctaatcatggaaaaagccggctttccaccacagaaacactggaaagtttacttaattaccacactcatttcttttattgctgttttacccttcattatctacgcagagaaaaaacgccgtatgaaacaggtatttttactttgcatcggactgttattcatcgccgaattagttttatggtcagtgggttcacacctttggggaatttttgcaggtattcaggtgttctttctcgcttttaatatcatggaagccattttaccatcactcatcagcaaagaagcgcccgctggttacaaaggtacggcgatgggggtttactctaccagtcaattcctcggtgtcgcattgggaggtttcctcggtggaatgctctatgaacagcaaggcgcatcattggtatttatgggaggtattgtgctaaccgcactctggtttattatcagcctgacactacgtcaaccaccttatgtcagcagcatcaggattgtcttacctgagcaattgaataatcctgacatcttagaaaagaaaatattgtcacaggcgggtgtgaaagatattgtcatcgcattagaagaactcagtgcgtatgtcaaagttgatacaaaacagaccaatcgagaacaattagaacaacttgtgctgtctcataaataa

SEQ ID NO: 1217 - DNA, 1497 bp, Xenorhabdus bovienii
  Coding DNA location: Contig name=SeqID_16855; Position on contig =4836..6332bp; Strand=-
atgtcaaagttaactcagttggatcctctcagtgaagaatcttaccgtttagatcattttattccggcaacagaaacaacaaaatttagttatacatctggaagagttgctttacccgtttataataaatataacgttaaaaataaacctaaggtcataggttattatactgactggtcacaatatgatagccgcctgcaaggtaatcaaaccccttcagcacggggaagaggtattgatctacaacacttgcttgataaccctttcgcctatgataaattgattatcggtttctgtgggatagtaggtgatcaaggtgagaaaaaagcgttaatttctcgggcagcaccgaagtttggtcgttacaataatggcgaagtcacatttaccgatgaatggggcgattgtcaatcttatgtaaactgtactttccctaggtggcaagacgttcagatgcccagagatttcaatcaggacaaatctatgggagtgctaggtgggttggcaaaaatacaggatgcagcaagggcgcaaggccatgaactggtaatgtcattcagcgtcggtggttggaccatgagtaatggtttttacaatatggtcagggacagccaattgaaatccaaatttatttccagtttgatcgatatctttaaacgcttccccatgttcactgaagtagatattgattgggaatatcctggagcgaaaggaaatgataacccgcacgactcggaggatggtaaatattatattgacctaatccgtgatttatcttctgcatttaagaacgcaggacgttctgatattaaaatcagcatcgcttgctctgccgtaccagatattatggaaaaatccaaaatacctgaattattaaaggttggattatatggtatcaatgtcatgacctatgatttctttggtactccgtgggctgataagttaaggcaccatactaatttgcgccgttatccgggcagtgaaaatagtgtggaaaaagcggttgagtatctactcagtgttggtgtgccatctcaagctatcaatattggttatgctggatattctcgtaatggcaaaaatactaatattaccagttattcaccattatcgggcagctatagtcctggaacgggtacgactactgggacatttgagtccggctcaacagaatggtatgacacgatatataattatctgaatctagaatctcgtcaagatagaaatggttttaccctttatacagatgaagttgcggatgcagactatctttataatcaaaacagtaaattgtttatatcactggatacaccgcgtacagtgaaagccaaagcaaaatatgcattggaaaaaaatctagggggagtattcacttggacagcagaccaggacagagggccattggtgaatgcagctcgtgaaggtctggggtgcccattgttgattaagaaaattgacatggagcctttctattataaaggcaaaaccaacaaataa

SEQ ID NO: 1218 - DNA, 492 bp, Xenorhabdus bovienii
  Coding DNA location: Contig name=SeqID_16855; Position on contig =6618..7109bp; Strand=-
atgccatcatttgatattgtttcagaagttgatatgcaggaagtgcgtaacgcagtagagaacgcacagagagaattaaccaatcgctgggattttcgcaacgtcaatgcgagttttgaattaaacgagaagaacgaatcagttaagattgcgagtgaatctgactttcaagtcaaccaattggttgacatactccgtgaaaaatttgccaaacgtggaatcgatggttcggtgcttaatgttgccgaaaatatggttcacagtggtaaaacctatagtgtagaggcaaccttcctgcaaggtatcgatacaccattggcgaagaagattgtgaagctgatcaaagacagcaaactaaaagtgcaggcacagattcagggtgaacaagttcgggttacgggcaaagcgcgggatgacctgcaaagtgtgatgacactggttcgtggtgcagagttggggcaacctttccagtttactaatttccgtgactaa

SEQ ID NO: 1219 - DNA, 1191 bp, Xenorhabdus bovienii
  Coding DNA location: Contig name=SeqID_16855; Position on contig =7043..8233bp; Strand=+
gtgcgttctctactgcgttacgcacttcctgcatatcaacttctgaaacaatatcaaatgatggcattaccagtcacctcctgcttatcaataagttggcatgataaccgctttccattattggcaaaagatctatactcgggaggttctgcgatcttttggcatttacgctactttttaaggtcgtttgatttgagatcgtttgatttaaggccgtttgaaatcagcattgtttcgaggttctccataaaagcgcctctcatctcaaggaagtatatgaaaatcaccgttcttggctgtggtgctataggtaaactgtggcttgtggccttatcccagcaaaatcacgacattcaagcatggataagggttccacaaccttttgtctcggttcgtatcgataatttcaatggtaaggtatttgatcaacaattttctgccaatgacgaaaagcatctcgccgaaagcgaattgttgctcgtttgtttaaaagcatggcaagtttctgatgccatcaataacctcgcccctaaactttctcctcattgtccgatcctgttactacacaatggaatgggatcacaggaagaatttttacctttgcccaaccccattttacttggtgtgaccactcacggctcctatcaggaaaatggcattgtttaccacaaatcgcaaggtattacccatattggttccgcaacggctaacgccgataaattcagttttctggcggatgtcttacactatgcactgcccgatgtggcatggcacaatgaaatccacaccatcagttggctcaagcttgccgtcaactgtattatcaatccactcacagtaatttatgactgcaaaaatggcaatctattgcagcatactgcgcaaatcgatttactgtgcgacgaaattcaccaagtgatggaacgcgataatctacatacgaccaaacaaatgcttgttgattatgttatgaatgtgattgaacagacttctgaaaattactcatccatgctacaggatatacgagcacaacggcatacagaaatagattacattacaggttttttactacgccgagcccgtgcttatggactgtccatcaaagaaactactattatttatcaatgtattaaacgaaaggaggaggaatatgaacgcctcagccctcatctgcctggctcacggcagtga

SEQ ID NO: 1220 - DNA, 660 bp, Xenorhabdus bovienii
  Coding DNA location: Contig name=SeqID_16855; Position on contig =8130..8789bp; Strand=+
atggactgtccatcaaagaaactactattatttatcaatgtattaaacgaaaggaggaggaatatgaacgcctcagccctcatctgcctggctcacggcagtgaagaaaccgaagccgttatcactattgatttactggttcgagcagagattgatgttaccgtagccagtgccgcaacagatggtgccctcatactaacctgttcacgtggcgtcaaaatcgttgccgatacacctttggttaatgttgttgatgaagattttgatgccattatcctatcaggaggaataaaaggagcagaatgtttccgtgatagcccgttagtggtagaaaaaattcgaacagcacacagccaaggcaaaatcattgcagcaatctgtgcatctcctgccatcgttctggaatatcatcaactctttcctatcggaaatatgacaggttatcccagcatgcgggataaaatcgcgccggaaaaatggatcgaccgtcgggtctactttgatgaaagggtcaatttgctgaccagtcaagggcctgctaccacttttgattttgcactgaagctgattgaactgctgaaggggaaagagaaggcagcggaggttgctgcacaactagtattgccacctggcgtcaataattaccagcatcagcaataa

SEQ ID NO: 1221 - DNA, 1449 bp, Xenorhabdus bovienii
  Coding DNA location: Contig name=SeqID_16855; Position on contig =8859..10307bp; Strand=-
atgaagtttatcattaaattattcccagaaattacgattaagagccagaccgtccggttacgttttattaaaatccttgccagcaatatccgcaatgtgctgaaaacattatcagaggagattgctgttgtccgccactgggataatatcgaagttcgggctaaaaatgataaccttggtgctgaaatttgtgatgcactaacacgtattccgggtattcaccatatcttgcaagtagaagaacgagattttcgtgacttgcatcatatcttcgaacaaacctacgaagcctatggccatttgctgcatggaaaaacattttgtgtgcgtgtaaagcgtcgaggtaagcatagcttcacttccaatgaagtcgaacgatatgtcggtggtggcctaaatcagcatattgaatccgccaaagtgaaattaacgcatccggatgtaacggtaaatttagagatcgaacaggatatactgattctggttaaagcccgccatgaagggataggtggttttcctatcgggacacaggaagatgtactgtcgttgatttcaggtgggtttgattccggtgtttccagttacatgctgatgcgccgtggctgccgcgtacactactgtttctttaatcttggcggtgctgctcatgaaattggcgtgaaacaggtcgcccattatttgtggaatcggtttggtagttcccataaagtccgttttgttgctgttgatttcgagcccgttgtcgcggagatcctcgaaaaagtggatgacggtcagatgggcgttgtactgaaaagaatgatggtcagggcatcttccaggattgcggagcgctacggtgtacaggcaattgtgaccggagaggctttggggcaggtatccagccagactttgactaacttaagactgattgataatgcttctgatacgctgatcctccgtcctctgatttctcacgataaagagcacattattaaattggctcgtgagattggcacggaagactttgctcgtaccatgcctgaattttgtggcgttatttcaaaaagcccaactgtgaaagcggtgaaagctaaaatcgaagcggaagaagccaattttgattttgagattctggatcgcgtggtaagtgaagctcagaatctggatatccgccagattgcacagcaggcctgtgaacaggttgttgaagtggaaactgtcactgaattttccactagtgatgtgctactggatatccgtgcgccagatgagcaagatgatcgcccattaagtgtggatggaatcgaaattcagtcattgcctttctataaattgggcactcagtttggtgatctgccaaaagagaaaaattacctgctttattgtgaaagaggcgtgatgagccgcttacaggctctttatctgcgagagcaaggttttgagaacgtgaagatttatcggccttga

SEQ ID NO: 1222 - DNA, 108 bp, Xenorhabdus bovienii
  Coding DNA location: Contig name=SeqID_16855; Position on contig =10304..10411bp; Strand=-
gtgagattggtgttatactctacgccctatctaactgaacacttaagaacaatcattgatattgattgtgatagttcaacattgaatgactactatatcttactatga

SEQ ID NO: 1223 - DNA, 102 bp, Xenorhabdus bovienii
  Coding DNA location: Contig name=SeqID_16855; Position on contig =10443..10544bp; Strand=+
atgatttatttcttccagtgtagtagggtactctgcaattctgtagcgaacttgcttgactgtaattcgttaaataatcataccttaaatcattatgtctaa

SEQ ID NO: 1224 - DNA, 258 bp, Xenorhabdus bovienii
  Coding DNA location: Contig name=SeqID_16855; Position on contig =10537..10794bp; Strand=+
atgtctaaagcaaatcaaacatcagaaatcgaacagacaccagcgtttgaaacttccctgaaagagctggaggaaattgtcactcgtctggaatcagggaaacttcccttagaaagtgcattaaatgagtttgaacgcggtattcaacttgcaaggcagggacaaaaaaccctccaacaggcggagcaaagagtgcagattttattgaatcatgatgcacaatcgccacttgatgaattttcgcctgacgctgagtaa

SEQ ID NO: 1225 - DNA, 966 bp, Xenorhabdus bovienii
  Coding DNA location: Contig name=SeqID_16855; Position on contig =10751..11716bp; Strand=+
atgcacaatcgccacttgatgaattttcgcctgacgctgagtaaatttatgtctgaacaatataagactccttttgaagagcaattaagcgcttgtcagcagcatgtcaatgacaagctgatagcaacattttcttcattaccttttttggacagcccattagcgacagctatgctgcatggcgcggtactaggcggcaagcggttgcgcccatttttggtttacagcgtgggcgaaatgtttggcctttccagagagagtcttgatgctcctgctctcgccttagaatgcattcatgcctattcactgatccatgatgatttgccggcaatggacaacgacgatttacgccgtggtcaacctacctgccatatcaaatttggtgagagtctggcaattctggctggagatgcattacagtcattggcatttgagatactggcaaagcaagatatgccaaatattgccttatccgatcgccttgcaatggttgctgaactggcaacagcgagtggtcttgctggcatgtgcagagggcagtcactggatttggaagccgagggaaaacagatcgaccttgctgctctggaacaaatccatcggcataaaacaggcgcattaatacgtacagccgtcaggcttggggcttacagtgctgggcaacgtggccgtgaagtactccctttactggatcaatatgctcaagccattggcctcgcatttcaggtacatgatgatattctggatgtcattggcaatacagacgttatcggcaagcggcaggggaacgatcagcaacttggtaaaagcacttatcctgcgctattaggtttggaacaagccaagaaaaaagcgagggatctctatgaagaagcgctcgccgcactcacggaactggaaaaacaatcctataacaccgtgatcttaaaaaaactggctggttttatcatcgaaagaaacagttaa

SEQ ID NO: 1226 - DNA, 1866 bp, Xenorhabdus bovienii
  Coding DNA location: Contig name=SeqID_16855; Position on contig =11913..13778bp; Strand=+
atgagcattgatatagcgaaatatccaacattggcattggcggaaactcccgaagaacttcgcctgctacccaaagacactttgccaaagttatgcgacgaactgcgtcaatttttgctaaacagtgtcagtcgctccagcggccactttgcttccggcctcggcactgtcgaattaacagtcgcacttcattatgtttataaaacaccgtttgacaatttagtttgggatgtcggtcatcaggcctatccgcacaaaatattgaccggacgccgtgatcacattaacactattcgtcagaaaaatgggctccaccccttcccgtggcgagatgaaagtgaatatgacaccctatgtgtcggccattcatccacttcaattagtgctggattgggtatggccattgcggcaaaacatgaagacaaaggtcgcaaaaccgtctgcgtcattggtgatggagctatcactgctggcatggctttcgaagctatgaaccatgccggggacatcgatcccgatatgctggttatcctcaatgacaatgaaatgtccatttctgaaaacgttggcgctttgaataaccacctggcgcatcttctttcaggcaaattgtatacaaccctgcgtgaagggggcaaaaaagtcttttccaacctgcctcccatcaaagagttactgaagaaaaccgaagaacatctcaaaggcatggtcgttcccggaacgctgttcgaagagctagggtttaactacatcggccctgtcgatggccatgacgtattggctctgacccagaccctgaaaaatatgcgtgagctgaaagggccgcaattcctgcatatcatgaccaaaaaaggccgtggttatgcccctgcggaaaaagatcccatcggttggcatgctgtccctaaattcgatccggctacaggttccttgccgaaaagttcagatacccgcccgacattttccaagatcttcggtgactggctgtgtgaagaagctgcccatgataaaaaactgatggcgatcacccctgccatgcgggaaggctcaggtatggttcgtttctcccgtgaataccctgaacaatactttgacgtggctattgccgaacaacactctgtcacttttgcggcagggctggctattggtggttacaaaccgattgtggcaatttactccaccttcctacaacgtgcttatgatcaggtgatccatgacgtcgccatccagaatctgcccgtgctgtttgccatcgatcgtggcggcattgtcggctcggacggacagactcatcaaggtgcattcgacctctcattcctgcgttgtatcccaaatatggtgatcatggcacccagtgatgaaaatgagtgccgtcagatgctgcatactggccatcactatcagaacggcccggcggctgttcgttatcctcgtggaaccggaacaggtgctgaactccagccactggaggcattgccaatcggtaaaggtatcgttcgccgtcagggagaacgcattgctatcctgaacttcggaacgctgctgccagacgcattgcaatccgctgaagccttgaacgtaaccgttgttgatatgcgctttattaaaccactggataaccaactagtgctagaaatagcagccagccatgatatgttggtcactctggaagaaaacgccatcatgggtggagcaggcagcggcgtcaatgaactgctgatgcaaacaggtcagcctgttccggtattaaacctcggtttgcctgatcactttatccctcagggaacacaggaagagatccgagctgatttagggttagatgccactggaattcaacacgctatcgaaaaatatctggctaaataa

SEQ ID NO: 1227 - DNA, 117 bp, Xenorhabdus bovienii
  Coding DNA location: Contig name=SeqID_16855; Position on contig =13745..13861bp; Strand=-
ttgaaaaattttgaagttgaaaaggaaagagcagaagaaaaaaggatgcgttgctgcaaagagcacacatccttttttgaagattatttagccagatatttttcgatagcgtgttga

SEQ ID NO: 1228 - DNA, 135 bp, Xenorhabdus bovienii
  Coding DNA location: Contig name=SeqID_16855; Position on contig =13803..13937bp; Strand=+
ttgcagcaacgcatccttttttcttctgctctttccttttcaacttcaaaatttttcaaaaaactaatcagttatatcaatcttcaatataaccatttcacaactgtcttctcatttttgaaatcactacattaa

SEQ ID NO: 1229 - DNA, 1170 bp, Xenorhabdus bovienii
  Coding DNA location: Contig name=SeqID_16855; Position on contig =14041..15210bp; Strand=+
atgaataattccaatgccctacctcattcacaacaattcctttttaatcctaatgaaaattggcttgattggcgctggcagcaaaaaaacgccttacgtgatgaggccgctttacgttccgcctgtggtggatggagtgaagaaatagccttacgtatccaacaaaatttacaggggcaaaaaatgcagatcaccccctactacctccgtcaaattttagccaccaaccaatctgacgacatcacggcaaacccactctggcgacaagtagttccattctggagtgaagaggaactgaacggctacgatggagaaacagaaaactgggaactcaatgatgagatgaaaactcccatctgccagcataaatatgataatcgggtcatattgcgcatggtcaatgcctgtaactcctactgccaattctgctttgaagctctgcgaaccttgaaagtggattccggcaaatccaatgcaggccgaagctctttccaacaatcccttgaatacatcaaaaatacgccttcagtagaagaagtgatcctgagcggcggcgatcccttaatgctgacagataacaagctggatgaatcattggccgccatccgggaaatccgcgatgacctgttaatccgcattcattcccgcgccttgaccttcaacccttaccgcattacagatgctctgatagaaacattgaaaaaataccgcatcaatgccttcggtgttcatgtctgtcatccatttgaactcagcgaagaatttcaaactgccgttcgtcgcatccaaagtgccgtaccgattgttttttccaacatgcctttcctgcgtggcatcaatgacaacgaagaaacactccacaagctatttatcgatctgtatcgcatgggcgtaaaaccctactacctctaccactttatgcctttctcaccaggttcttctgaatataaagcctcgatcaacgatgccatcgctatcatgagtaaactcaaacgtcgcatttcaaatatcgccttaccggaatacgttctgccgcatatgaaaggcaaatttactgttcctctgtttactcatccgcaagagatgccctattttgaaaccctcaatggcaaacgttattaccgctttatcaactggcaaaacgaacaatgtgaatggctggataactag

SEQ ID NO: 1230 - DNA, 1374 bp, Xenorhabdus bovienii
  Coding DNA location: Contig name=SeqID_16855; Position on contig =15277..16650bp; Strand=+
atgaaaccaaacgccattttatttgttgatatcgatgatgccgaaatcacgcgatatacctatcgggagccacactttgccgcagcaaaagaaatggggctgctttgcctgaccgcagcactgcaaggacgccagcatacagagcgacttttcgctgatagtgacgaagctttttatgtagaatcaatgacattggatgccttacgggatctcgttagcaccttactggatacctacaacctgcgtgctattttatgccatgcaggccatgcatctgccagtgggcaagtcggctgtattgttgccgaaatatgtcaggaaatagagttaccgcactcttcttcccgtgccattgccacctgtaacaacaaattcctgatgcgtcagacattacagcagcatggtgttcgatcaatacgtcatgcactgtgtaataacgaagaagaactgtgttcacaagccaatttgattggctatccgttaatcgccaaaccaccgttcggggcgtgttcagtctttatcaaaagatgcaacaactgggctgaattactggctcattaccaagcatttacagcccattacgcgcactctaactacaccgattttatgggcaatcaacaagaatgtgtgacgcctaaaggtgaaaaatacgttagcattccaggaaaaagcctactgttggaagaatatattgatggcatagaaggtacgattgagtgcgccattaaccagcacactatatatccagtcttgatcaatgaaaaattgattctgacagagaaaagcaacaccgtgctggaaaacctactcattactccacctgtgtcattttcaccatcagaacaggaacaaatcaaaaactacgctatagcttgcctgaatgccgttggtttaaacaatgcaattgctcaccttgaatttcgtatgacttccgaaggccctgtcattattgaaataaacccacggctcggagggctgtttgtcaactcggctttccgtgatcttgcaggcctgaacccttatcagctttatctttccatcctcatacaagatcaagaagttgatttccaacttacccaagcttgcaaacaagcagaacaagccacacaacattactcaatgattgttatgtatccagatacaaacggtcattttaaaggcatcgaaaaccttcactatctcaaaaatcaaccatgcatactcgaatgtgtgtcttacaccaatgactgctatatcaacgcggaaattgaagagcattatctgattaagtgctgggcaaaagtcgaaggagcatcccatgcccatacgttgcacagcaatatgctagaaaacgtcaaacccatcattattccagaatctgatctgacttcatga

SEQ ID NO: 1231 - DNA, 354 bp, Xenorhabdus bovienii
  Coding DNA location: Contig name=SeqID_16855; Position on contig =16663..17016bp; Strand=+
atgaacattacgaatatctcagcaaatttaataaacgaacattattgccatattccacatttcagtgaattgatttcctgtgattcagaagcaactaaaacgtttaaaggccattgggataatctggttctagatcagaatttcaaagactatacccacagggagaggcgtattctgcgttaccactatcgccccggcacagaaatctccttccagctcaatcaagatactgaatatcgatcatcagtaacctatgacattgaatacaaaaaaggtgccaatcaactcagttatgctgaagatacatttatttttccatatgaaaggtttaaaaccacggtctttagacggtga

SEQ ID NO: 1232 - DNA, 213 bp, Xenorhabdus bovienii
  Coding DNA location: Contig name=SeqID_16855; Position on contig =16916..17128bp; Strand=+
atgacattgaatacaaaaaaggtgccaatcaactcagttatgctgaagatacatttatttttccatatgaaaggtttaaaaccacggtctttagacggtgactttgactttaattctttgacctatgcgcgtttacgaggtgcgtggttcgacgactttcagtcgtcggcaccgaagtgcgctaacccacctacttcagtaggtggtagttaa

SEQ ID NO: 1233 - DNA, 402 bp, Xenorhabdus bovienii
  Coding DNA location: Contig name=SeqID_16855; Position on contig =17143..17544bp; Strand=+
atgcagcatattctttcaatggatattgctattttaggagatcgattaataaaaggttgccactattcgattgatattcatcaatttcgtgttaaagcgtttgcggggaaagaaagcccaacgacttcaggtattcatcaggacgggcaggattggatctttatgcactttatccaaggccataatatcgcacctgtaatttccgaagttcacgcaaccgcagatgaagcacctcctttgctacataccgcgatggaacagtttctagaaacactcgcaataaatgacagacaactttatcatcgagcgagcaatgttggacaaatatctcctacaatcacggcatttcgggatctgttgctggtgactttccggcaacgccctgaacaacaagagagctaa

SEQ ID NO: 1234 - DNA, 1227 bp, Xenorhabdus bovienii
  Coding DNA location: Contig name=SeqID_16855; Position on contig =17547..18773bp; Strand=+
atgtcaagccaggaaattagtttgaatttgcgttggtctggtctaaatgccttgctgatcgtcagtgcacgattcgtatctgattttggcgcattcctgaatatggttgcgctatccacctatgtttacctgcttagtgatagcgtcatgcacgtcagtatttttctggcctgccgtgttgcaggcgggatcatcgctagcctgataggtactccattcttcaggcgatttgccggacgctggccactggtctgtttcgatttattgcgggtcattctgctatccctgttattggtgataccagcttcacagcagttactgatcttaccgatgatcgcttttggcattggcttaggcaactcgatgtttgccatcgggctgaacagccaactcccatactgggtacacgcttcccaacgcatatcaaccaactcctggctaacatccgtcgccgctacaggcgcagtacttggcagtttggtatccggtttgttggtcgccagcagtggttatgaaatagtctttatcgtcaatatcattacctacctgctggccgcattcttgattattcctttgcgtttcctcacccatcctgaacagaaaacatcacgggaacggggtaacgaatggcgtgagttaatccgcggcttacgtggtactccgatgctggcaggaatgctgttcctcagtttggccgacaccctcggcagcgccgctcataacgtgggatttcctgtcatttctaagttacttacgccagataacgccagtaccacaatgggcttactgctggcgacatgggcggtgggaaaattcagtggagcgcgtctgaccagctacctgctacgcaaccgcaatttattgaagatggagaaactcttttttctgggcgttgcgttgatatcgaccgggtttatccttactttccaacaaaccagccagctttggctactcgtatttgcagtctgggcaggtatcggagacggaatagcagaagtcagcctgatttcacgggcgcaaagtgaaccggaaagtttacgcttgccgattttcagtttgctgacactgatgcaaatgacgggattcggtataggcatgttgctggtcgcacctttttacgtctggctaccaccttctgtcgtgatcctgatattccacggtttgccgcttactgtgctagttatcatcctaatatggatgcgacgttttactacaagtaaagcgtaa

SEQ ID NO: 1235 - DNA, 123 bp, Xenorhabdus bovienii
  Coding DNA location: Contig name=SeqID_16855; Position on contig =18951..19073bp; Strand=-
atgttttggtggatgtacttatcttcatcttataaaggtattttgttttattataaatttagatggatttacataataagtgcaacattgttatacggaattggggattttacacggatttaa

SEQ ID NO: 1236 - DNA, 744 bp, Xenorhabdus bovienii
  Coding DNA location: Contig name=SeqID_16855; Position on contig =19429..20172bp; Strand=+
atgggggaacaaagtatgcagcaagccatcaatttctggccactgatcgggattgccgtcatcatgatcgggtttatccttcgttttaatcctgttctggtcgtaacggttgcagggctagtcacagggctagccgcccatatgccaatcaccgaaattctggaaaaactcggctccggatttcttaataccttgaatctgttactgacaattctgtttcctttggtcattgttggccttctggaaagacatgggttaaaagaacgagcccagcgctcaattgcccatatcaaaactgccacaaccgggcgtttactaattgtctatctgttcatacgagaaacgtctgccgcgctagggctgaccagtttaggcggccatccgcaaatggtacgtccattactggcaccaatggctgaaggggcggcagagaaccaatatggtcatttgcccgatcatgttcgccaccgtattcgcgccatgtccgccgcaactgataatactgggctgttcttcggggaagatatttttgtcgccttcggtgccattattttcatgcacaatttcatgctggaatctggtggtatccagactgaacctctgcatattgccttgtggggcattcctaccgccatctgtgctttcctgatccactcggttcggttatatcgccttgattaccatcttgcccgcgaaattacttccctgaatcacatgaaattgactagcaaggaagcaaaataa

SEQ ID NO: 1237 - DNA, 1017 bp, Xenorhabdus bovienii
  Coding DNA location: Contig name=SeqID_16855; Position on contig =20172..21188bp; Strand=+
atgtttcagttacagtatctctactatctggcgggattcattctgctcattgtcgccgtgatgtcgtggcgcgatcgagccaatcctcgccgcttgaccacaggcctgttctgggggctgtatggcctcatcttcctgataggaaactggagctaccaattgatggctatctggataagcgacgaagctcaagcccagaaaatcgtccatatcagtgttggtgtactggtgatcatcatagcgttattggcgggatttggtggagtacgtgtgggaaactaccatcagcctacaacggaacaaaaacagaaaagtgcagagcgcctcggcaatcggttatttttgcctgccctgctcattcccgttgtcacgatggtgggtgtcctgctgtttaaccatattccgggactacagcaaaccgttttcggtgcaggcaatcattcaacgttggtgacgttattttccattaccttcggttgtctggctgggttaatcatcgcattgcacatgaccagagaaaacatcatgcaaccgatacaggaaacacgccgtctattggattctatcggctccgtgttcattctaccgcaaattctggcaaccctcggattactgtttacggcagcaggcgtaggcaccgtcatttctcatttaactgaaaattatctggctgtcgataatcgatttatagcggtgatagcctatgtgctcggcatggctctactgactatgatcatgggaaatgctttcgctgcctttcctattgtgacagccggtattggtattcctattttgatcttgcaacatggcggtaatccagccgtaatggccgccatcggtatgttctccggctattgcggtacgctgatgacacccatggcggcaaatttcaatctcgttcctgccgctctgctggaattacctgatcgtaatgccgtaatcaaggctcagatccccaccggatgcaccttactgattactaatgtgtttttactctattttttgatgttcttataa

SEQ ID NO: 1238 - DNA, 648 bp, Xenorhabdus bovienii
  Coding DNA location: Contig name=SeqID_16855; Position on contig =21209..21856bp; Strand=+
atgaaaactattttagtcactgcttttgatcctttcggtggtgaagctatcaatccatcgtgggaagccatcaaaccattacaaggtagccaagtttctggtgcaaatattgaaatttgccagcttccctgcatttttgatacttctttagaacacctttatgcagccattgataagtaccagcctgaactggtgatttctgtcgggcaggctggcggtaggacgaatatcaccgtagagcgtgtcgccattaatatcaacgatgccagaattcctgataatgccggcaatcagccgattgatacccccgttattgttgatggccctgccgcctatttttctcgcctgcctattaagacaatggtgaatgcattaaatacagcaggtattccggcgtcagtttcccaaactgccggaacctttgtgtgtaatcatgttatgtatggcttattacattatctggctcagaatacctcctctgtgcgcggggggtttattcacgttccttatttgccagaacaggcggcaaaatatgccaatcagccaagtatgacgctggaattgatgacgttggcgttgaaaacagccattgaaacagcctggaaaaatacatcagatattgctgttacaggtggggctacgcactaa

SEQ ID NO: 1239 - DNA, 513 bp, Xenorhabdus bovienii
  Coding DNA location: Contig name=SeqID_16855; Position on contig =21949..22461bp; Strand=-
atgatcagacggagggaactcatggatgatgcaaaacgtcgcttaaggatgcgtaatccgtggcatttgctggctacgggtttcggtagtggcttatcgccgattatgccgggtacgatgggctcattggcggcaattccgttctggttgttgttagtgcagttacctgaatggggcatttggttggttattctgctgggaacggtgattggctgcgtgatttgtcagaaagcggccgatgccatgcaggtggaagatccgggttgtgtggtctgggatgaattcatcggcatatggatcacattgatggcaattcccgtcctcaactggcagtgggttttggtggcttttgtggtgttccgtatcttcgatatgtggaaaccgtggccgattcgctggttcgaccgctacgtaaaaggtggaatcggcatcatgctggatgacattattgcggcaattttcgcagttattgttatttggttgctgaatttctgcccattattgcctttctaa

SEQ ID NO: 1240 - DNA, 1083 bp, Xenorhabdus bovienii
  Coding DNA location: Contig name=SeqID_16855; Position on contig =22433..23515bp; Strand=-
atgtgctcatcgtcagtcactttttggaattctattatggcatgtggtgaatttgacctcattgcacgttatttcaatcgccatgtcatccgccgacgtgatgtgaatctaggaattggtgatgactgcgcgctgatgaccgttgcagagaaacaagaattagcggtgacaaccgatacgctggttgctggtgttcatttcctccctgacatttccccggaagatttggcttataaggcgctggctgtcaacatcagtgatctggccgcagttggggcagatccggcttgggcatcgctggcgttaacgttacctgacgtcaatgaggattggttaaaacggttcagtgatagtctgtttgaacaactgaactattatggcatgcagttgattggtggggatacaacaaaaggccccatgagtctgacgctgacggtacatggtctggttccggctggcagggcgttacgccgtgctggtgcgaaaaacggtgactggatttatgtaaccggaacgttgggtgacagtgctgcggggcttgcactgttgcaggatcgctttgctgtggaagatagcgccattcacaactggctggtcaaacgtcaccttcgtccccagccccgggttttacaagggcaggcactgcgtaatctggcctcttccgcgattgatttgtccgatggtttgatttctgatctcagtcatattctgacaaccagccaatgtggtgcgcgtattaatctggatgcgctgccttattcggaggctgtgcagaaatatgccacaccagagcaagcattaacatgggcgctgggggggggagaagattatgaattgtgcttcaccgtacctgaacttaaccgtggtgcactaaatatggcattggcacatactggtgccagtttccgctgtgtcgggcaaatcaggccggaatcagaaggtatccgctatttcaacaacaatgaagaaattgagctggatctgaaaggcttcgaccattttaagaccgaaaaaaaaccgatagaagactgtcaggcattacaacaggcacagaatgatcagacggagggaactcatggatga

SEQ ID NO: 1241 - DNA, 111 bp, Xenorhabdus bovienii
  Coding DNA location: Contig name=SeqID_16855; Position on contig =23466..23576bp; Strand=-
ttgccaggagttccccattataactcgatgatttcatacatgaggccggtttcccggcctcatgtgctcatcgtcagtcactttttggaattctattatggcatgtggtga

SEQ ID NO: 1242 - DNA, 417 bp, Xenorhabdus bovienii
  Coding DNA location: Contig name=SeqID_16855; Position on contig =23581..23997bp; Strand=-
gtgaaacctgctgctcgtcgtcgtgctcgtgagtgtgctgttcaggcaatttattcatggcaattatccaaaaatgacattgctgatattgaatttcagtttttgtcagagcaggacgtaactggtgttgatatcacctatttccgtgaattgctgactggggtagcggtcaatgctgcaaaattggatgctttgatggctccttacctttcccgtcagcttgaagagttaggtcaggtggaaaaagccatcttgcgcgttgcgatgtttgaactaagctttcgtgatgatgtcccctataaagtggctattaatgaaggtatcgaactggcaaaaacgtttggtgctgaagatagccataaattcgtgaatggggtgttggataaagctggcccggcagcacgcaagaaaaagtga

SEQ ID NO: 1243 - DNA, 471 bp, Xenorhabdus bovienii
  Coding DNA location: Contig name=SeqID_16855; Position on contig =24027..24497bp; Strand=-
atgaacgtaatcaaaggtgttgttgcagctccagaagcccgcatcgccattgcgatcgcccgctttaacaacttcattaatgacagcctgctggaaggggccgtggatgcgctggaacgcatcggtcaggtttcttcagataatatcactgtagtctgggttccaggtgcttatgaattaccgttaacggttaaggctctgactgagactcaaaaatatgatgcggttatcgctttgggaaccgttatccgtggcggtacagcccattttgaatatgttgctggtgaatgcagctctggactgtccagtgtagcgatgtccagtgatattcctgtggcatttggtgttctgacaaccgaaagtattgaacaggcgattgaacgcgctggcactaaagcgggcaataaaggcgcggaagcggccttgaccgcattagaaatgatcaatgtaatcaaagccattaaaggctga

SEQ ID NO: 1244 - DNA, 165 bp, Xenorhabdus bovienii
  Coding DNA location: Contig name=SeqID_16855; Position on contig =24421..24585bp; Strand=+
atgaagttgttaaagcgggcgatcgcaatggcgatgcgggcttctggagctgcaacaacacctttgattacgttcatagccttccttataccttattcatatccgcaggggcgcggatcttatcacattctttttctctgcgtcttgatttatgtccaaacttga

SEQ ID NO: 1245 - DNA, 1110 bp, Xenorhabdus bovienii
  Coding DNA location: Contig name=SeqID_16855; Position on contig =24587..25696bp; Strand=-
atgactctcgatgaaaaatatatgtcccgtgcgctggaactggcgattcagggacgttttacgacatccccaaacccgaatgttggatgtgtcatcgttcagggtgatcacattgtcggtgaaggtttccatttatgtgccggtgaacctcatgcggaggtacatgctctccgcatggccggagacaaggcaaaaggggcaacggcttatgtcacccttgagccgtgcagtcaccacggtaagacgcctccctgtgccgatgcgttgattgcagccggtatcagtcgtgttgtggccgctatgcaagatcccaatccgcaggttgcagggcgtggtttgtataaattgcagcaggcaggtattgccgttgagcatggcgtgttgatggcgcaggcggaagcgctgaataagggatttctcaagcgtatgcgcacgggattcccttatttgcaactgaaaatgggcgcgtcactggatggacggactgcgctggcatcgggtgaaagtaagtggattacgtcgccagaagcccgtcaggatgtgcagcagttgcgggcgcaatgtagtgccattctcagctccagtgccacggtattggcggatgatccttcattgactgtccgctggcatgaattggaggccgaaatacaggcgatttatcctcaagagcaagtacgtcagccaatccggatcattgttgatagccagaatcgcgtaacaccacagcatcaagttgtacagcaggcggggcaatgttggttagcacgtactcacaccgatgagcagcagtggcctggcaatgtcgatcatattatattgcctgcctacggcgggggtgttgatctggttttgctgatgatgcaattgggtaaacgtcagataaattcggtttgggctgaatgtggacctgttttggcgggagcattgttatctctggggctagtggatgagttaatcctctatatggcgccaaaagtgctgggaaatactgcccgtgggctatttgctctccctgagctacaaaaattatcggatgcgcctgaattcacgctgtttgatgtccggcagattggtcctgatgtgcgtcttcgcctgcggccagcgtattga

SEQ ID NO: 1246 - DNA, 450 bp, Xenorhabdus bovienii
  Coding DNA location: Contig name=SeqID_16855; Position on contig =25751..26200bp; Strand=-
atgcattgcccattttgcgcagccgttgatactaaagttattgattcccgtctggtaggagatggctcacaagtgcgccgtcgtcgtcagtgtctcgaatgtcatgaaagattcaccacgtttgaaatcgcagaactggtgatgccaagagtgattaaaagtgatgacattagggagcctttcgacgaagaaaaattgcgtcgtggcatgttgaaggcactggaaaaacgtcctgtcagctctgatgatgtggaaacagcgattatacatattaagtcacaagtgagggcaacgggagagcgagaaatcccatccaagatgatcgggaatttcgtgatggatgcgttgaaaaagctcgataaagtagcttatatccgttttgcatctgtttaccgcagctttgaagatgttcgcgaatttggcgaagagattgccagactacaagattga

SEQ ID NO: 1247 - DNA, 111 bp, Xenorhabdus bovienii
  Coding DNA location: Contig name=SeqID_16855; Position on contig =26172..26282bp; Strand=-
gtgagtacttacttacagggtgtttttcattatcacttcaaggtaaactgtcttcccgttcggttaactgtcaggaaacaatatgcattgcccattttgcgcagccgttga

SEQ ID NO: 1248 - DNA, 912 bp, Xenorhabdus bovienii
  Coding DNA location: Contig name=SeqID_16855; Position on contig =26324..27235bp; Strand=-
atgcgctgggacaacgttgcctttgggatttcgttactgttgttggtcgcttccatcattacgatgggtgtccgtgggtttaactgggggctagattttaccggtggtacagtaatcgagattaacctgagtaaacccgccgatctggataagatgcgcgaaagcctcacgaaaaacggttttgccgatccgctactgcaaaactttggcagtagccgtgatgtgatggtgcgtatgccgcctgtgacgggcaatgcagggcaggaactgggtaataaaattatctcggttatcaacgcgaatatcgacaaagatgcagtcgtcaagcgtgttgagtttgtcgggccaagtgtgggaggcgagttggcgcagacgggagcaatggctctgctggctgcgttaattagcatcctgatttatgtcggtttccgctttgaatggcgtctggcattgggagctgttatcgcgctggcgcatgacgtgatcattacactgggtgtactgtcgttattccacattgaagttgacctgaccatcgtggcatcgttgatgtctgttattggttattcattgaacgacagtattgtggtatcggaccgtatccgtgaaaacttccgtaagatacgccgtggcacatcgtatgaaatcatgaacgtttccctgactcagactttgagccgtacgatcatgacttcagcgacaacgctgctcgttgttctgatgctttacatctttggtggtgaaatgctgaaaggtttctcactggcgatgttaatcggggtttccatcggtacaatatcttctatctatgttgcttctgcactggccttgaaactgggaatgaagcgtgagcatatgattcagcagaaagttgagaaagaaggggcggatcagccttccattcttccttaa

SEQ ID NO: 1249 - DNA, 1815 bp, Xenorhabdus bovienii
  Coding DNA location: Contig name=SeqID_16855; Position on contig =27303..29117bp; Strand=-
atgctgatcgctgcgatcctcatcggtttgctttatgcacttcccaacctatatggtgaggatccggctgtacaaatcactggcgcgcggggcatcgccgccagtgaaaaaacgctggaccaagtccgtaatgttttagaaaaagaacaaatcaagagcaagtccattgcactggaaaatggggcaatccttgctcgcttcaataattctgatgttcaacttcgtgcccgtgaagcattggtttccgcattaggagaacaatatgtcgtggcattgaaccttgcgcccgcgacacctctttggctaagtaaagtgggtgctgagccaatgaaactggggcttgacctgcgtggaggcgttcacttcctgatggaagtggatatggaaactgcgctgagtaagctacaagaacagaacattgatagcctgcgctctgaattgcgtgatcaaggcatcctttattcctctgtccgtaagcttgataactatggagtggaagtccgttttcgcgataatgatgcacgttccaaagcggaaagttatctcgaaccccgtcaccgtgatttagtcttctccactggcgcgaatagtacgctgaaagtcgttatgagtgacgatcgcctgcgtgaagctcgtacctatgcggtacagcaaaatatcactatcctgcgtaatcgtgttaaccagttaggtgtagcagagccgctggttcaacgtcagggtgcagaccgtattgttgttgagctgcctggcattcaggatactgcccgtgccaaagaaatcctcggtgcaacggcaacgctggagttccgtctggtaaacagcaatgttgatcagaatgccgcaatatctggacgtattccgggtgattcagaactgaagtatacccgtgatagcaacccagttgtgctgtacaagcgcgtgatcctgaccggtgaccatattacggattccacttccagtactgatgaatacggtaatccgcaggtgaatatttcgctggatggtgctggcggtagtgcgatgtctaacttcaccaaagacaacttgcaaaagccaatggctacgctgtttgtagaatataaggacagtggcaagaaagatgccaatggccgttcggttctggtgaagcaagaagaagttattaacatcgccaccattcagtctcgtttgggcaatagtttccgtattaccggaattggtaacccgaatgaagcccgtcagttggcgctgctgttgcgtgcaggtgctttgatcgcacccatccagattgttgaagaacggactattggaccaacccttggcttacagaatatcgagcaggggctcgaagcctgtctgtggggcttgatctcttctatcctgttcatggtgatttactaccgcaagttcggattgattgcgagcagtgctctgctggctaacttagtgctgatcgtcggtgtcatgtccttgttaccgggggcgacgctgacgatgccgggtattgcgggtatcgtattgaccctcgccgtggcagtggatgcgaacgttttgattaacgagcgtatcaaagaagagctgcgtaacgggcgtacggtgcagcaagcgattcatgaaggctacaaaggtgcgttctccagtatcattgacgcaaacctgactacgctgattactgctgtgattctgtatgcagtgggaacgggttccatcaagggcttcgcgatcacgaccagcattggtgtggcgacgtcgatgttcactgccattgtgggaacacgcgctgtcgtgaacctgctgtacggcggtaagcgtatcaataagctgtcaatttaa

SEQ ID NO: 1250 - DNA, 438 bp, Xenorhabdus bovienii
  Coding DNA location: Contig name=SeqID_16855; Position on contig =29179..29616bp; Strand=-
atgtgtagcatatcgggctggtttttgatcgagccactgtcgattttcgataacaatatttttgacaacaatgttttcgataacaatgagggaaatttgatgagtttttttatttctgaagctgcggcatctgctggcgcaccagcgcaatctcagggaagcccatattctctgattatcatgctggttgttttcggtttgattttctatttcatgatcctgcgtccacaacaaaaacgcaccaaagaacataaaaaactgatggattccattgccaaaggtgatgaagtgctgacttctggtggtttagtgggtcgtgtctctaaagtgtctgaaacaggttacgttgtaattgccctgaatgacaccacagaaataactgtcaaacgtgatttcgtcgctgccattttgccgaaaggtacaatgaaggctatttaa

SEQ ID NO: 1251 - DNA, 1125 bp, Xenorhabdus bovienii
  Coding DNA location: Contig name=SeqID_16855; Position on contig =29642..30766bp; Strand=-
gtgaaatttgagttacaaaagacggatgggaatgcccgccgtggccgcctgatttttgatcgtggcgttgtggaaactcctgcatttatgcctgtggggacttacggcacagtaaaaggcatgacaccggaagaagttaaggaaactggtgctcagattctgttggggaatactttccatttatggctgcgccccggtcaggaaatcatgaaactgcacggtgacttgcatgattttatgcagtggcacggccctatcctgacggattctggcggttttcaggtcttcagccttggtgcgatgcgtaaaatcaaagaagaaggcgttcatttccgtaaccctatcaatgggacgcccgttttcctcagcccggaaaaatccatggaaatccaatatgatttgggttccgatatcgtcatgatttttgatgaatgtacgccatatcccgcagattgggattatgcgaagcgttccatggaaatgtcattacgctgggcggcacgcagtcgtcagcgttttaacgagttaggcaataaaaatgccctgtttggtattattcagggcagtgtgtacgaagatttgcgcgatgtttctgtgaagggactggtcgaaatcggttttgacggttacgcggtgggtggtctggccgtgggagaaccaaaggaagatatgcatcgtattctggagcatgtttgtccgcagatcccacaggataagccacgttatttgatgggcgtcggtaaaccagaagatctggttgaaggtgtccgtcgtggtattgatatgtttgactgtgtcatgccgacccgtaatgctcgcaatggacatctttttgtgacagagggtgtgatcaagattcgcaatgctaaacataaggaagatacttctacgctggatgagcattgtgattgctatacttgtcgccattatagccgtgcatatctgcatcatcttgaccgctgtaacgaaattcttggtgcaaggctgaatacaatccataatttaaggtattatcagcgtttgatggccggaattcgtaaagccattgaagagaacaaactggaacagtttgttgaagagttttatcagcggatcggcaaacccgttccgccgttaaatatataa

SEQ ID NO: 1252 - DNA, 1068 bp, Xenorhabdus bovienii
  Coding DNA location: Contig name=SeqID_16855; Position on contig =30837..31904bp; Strand=-
atgcgtgtcgctgattttacatttgaactgccagaagagctgattgctcactatccccagccgcagcggagtggttgccgcctgcttgcccttgatggcgaaaccggagggctgacgcacggtattttcactgatgtgttggataagctggaagccggtgatctgctggttttcaataacacgcgagttattcctgcgcgtctgtttggtcgcaaggcgacgggtgggaaattggaagttttagtagaaaggatgctggataataagcgagtactcgctcacgttcgtgcgtccaaggcactgaaagaaggtgcagagcttctgctgggcgaagatgaaagcatcagggcaacaatgctggcgcgccacgatactttatttgaaatccgttttgatgatgatcgtgatgtattgaccattttggatgaaattggtcacatgccgttgccaccgtatattgcccgccctgatgaagaatcggatcgcgaattatatcagacggtctacagtgaacgtcctggtgccgttgcggcaccgactgccgggctgcattttgatgaacccctattggccgcactgcgtgaaaaaggcatcgatatggcttttgttaccctgcatgttggcgcagggacgttccagcctgtgcgggtggagaccatcgaagaccatattatgcatgctgagtatgcagaagttccgcaaaatgtcgttgatgcggtattggcgtgtaaggcgcgtggcaataaggttgtagccgtgggcacaacgtccgtccgttcattggaaagcgcggctcgtgctagccaaaatggccttatctcgccattttttgatgatacccaaatttttatttatccgggatttgagtatcaagtcgttgatgcgctgattaccaatttccatttgcctgaatccacgcttatcatgctggtttctgcatttgcgggttataaaaataccatgaatgcttataaaaaagcggtagctgaaaagtatcgtttctttagttatggtgatgcgatgtttattaatcgcaaccctatggcagcgaaagagaaagtatcgtaa

SEQ ID NO: 1253 - DNA, 93 bp, Xenorhabdus bovienii
  Coding DNA location: Contig name=SeqID_16855; Position on contig =31941..32033bp; Strand=-
atgaagatgtgcgagaaaattcatagcgagagtataccggaaatagtgaaactaatatgcttctttcttgcacccttgcgcgtgcggcactag

SEQ ID NO: 1254 - DNA, 624 bp, Xenorhabdus bovienii
  Coding DNA location: Contig name=SeqID_16855; Position on contig =32010..32633bp; Strand=+
atgaattttctcgcacatcttcatttggctgcattatcggaaagttccttactaggcaatttaatggcggattttgtccgtggctctccaaaaggattattcagccccgatattgtagaaggtattcgcctgcaccgtaggatagacagcctaacggacagccatccattggttaccgaagcacgcacactgtttcgtagcgagtatcgacgcgtagcttccattacccttgatatcatctgggatcatttcctttctctgcattgggacaaacttgaaaaaaattactccctgcctgaatttgtacatcttgcccgtagtcagatagaaccgcatcttaccgtcacgcctgaaaaatttcaggagttgaacaaatatctctggtcagaaaatctacttatccgctatgccgatatgtcatgcattgccaatgtactgaaaggcatggctcacagacgccctaaattatcggcactggcaggatcgtatcaagatatcgaaatgcattatcttgattttgaagcgctattttggaaattctatccacacatgatggcactggcgacaaataagcgactgcttgagcaagatatttcgccagaaccttgcactttttccaaatag

SEQ ID NO: 1255 - DNA, 183 bp, Xenorhabdus bovienii
  Coding DNA location: Contig name=SeqID_16855; Position on contig =32590..32772bp; Strand=+
ttgagcaagatatttcgccagaaccttgcactttttccaaatagctttatcttatctaggctaaaaggaattaaaagcaaattattgataggcaaaacctattatatcaattggtattttatcctttattgctttaccctaattccttatgctgtaacccgtttctacataccccctttttaa

SEQ ID NO: 1256 - DNA, 603 bp, Xenorhabdus bovienii
  Coding DNA location: Contig name=SeqID_16855; Position on contig =32790..33392bp; Strand=+
atggttctagtaacccgccaagcccctgactttacagccgcagcggttctcggtaacggtgaaatcgttggtaatttcaacctgaaaaaacacctgaatggtcgtccagccgttatcttcttctggccaatggacttcacttttgtttgcccttctgagctgatcgcgtttgatcaccgttatgaagaattccaaaagcgcggtgttgaagtcatcggcatttctttcgactctgaattcgttcacaacgcatggcgtaaaaccccaatcagcgaaggtggcatcggcgaagtcaaatacccaatggttgctgacatcaaacgtgacatcatgaaatcttacggcattgagcacccagaagcgggtgttgccctgcgtggttctttcctgatcgacaaaaacggtgttgttcgtcatcaagtcgttaacgatctgccactgggccgtaacatcgatgaaatgctgcgtatggttgacgcactgcaattccacgaagagcacggcgaagtttgtcctgcacagtgggcaaaaggtcaggaaggtatgggtgcatcccctgaaggcgtcgcaaaatacctgaccaaaaacgctgacaaactgtaa

SEQ ID NO: 1257 - DNA, 1764 bp, Xenorhabdus bovienii
  Coding DNA location: Contig name=SeqID_16855; Position on contig =33625..35388bp; Strand=+
atgttaaaagcatggaaaattccttttgtcgctgtatcgctcttagtttcctcctccctctatgccgcttatgaacctgccgttgaagccaaacaaggcgtggtagtcagttcacaatacttagcttcacaggttggcgtcgatattcttaaaatgggcggaaacgccattgatgccgcagttgccgttggttatgctcaggcagttgtcaacccctgctgtggcaacattggtggcggtggtttcatgaccattcatctggcaaacggcaaagatactttcattaacttccgtgaaacagcacctgctgcggccagcgccaatatgtatctggacaaagacgggaatgtcatcaaaggtgccagtctgtatggctataaatctattggcgtccccggcacagtgatgggattagatgccgcactgcacaaatacggctcaatgacccgcgaacaagtcatggcaccagctatcaaacttgcgcgtaaaggctacattttgactcgtggtgatactgatattctggacaccaccgtcaaacgctttactcaagatccagaggctgcccgtattttcttgcgcaaagatggtacacctttccaacccggggataagttagtccaaaccgatttggccaatacgctggaactgattgctaagaaagggccagatgtcttttatcatggcaaaattccccaattagttgaagagtcatcgaaaaaatcggggggaattatcacagcagcagatttcgccaactataacatcacagaaacaacaccagtcacttgcagctatcgcggttataaattcatctcttccccaccacctagttctggcggcgtcaccctatgcgaaatactgaacattgttgaaggctatgatctcaaatccatgggattcaactccgcagcttatatccatacattgacagaagccatgcgccacgcctacatggacagaaatacctatctgggcgatcctgaatttattaaaaacccacttgatcggctgttaagtaaaagctacgcagaatctatcagaaaagagatcgaaccaaacaaagcgacaccttcaaaaaatgttcagccgggcgttggtccccatgaaaaaccagaaacgacccattactctgtcgtagataaagatggcaatgccgtatcaaccacttacacaatcaacgggcgttttggtgccgtcgtgatcgcaccgggaaccggctttttcctaaacgatgaaatggatgatttcacgaccaaaattggtgagaaaaacctgtatgggcttgttcagggagcgaccaattccatcgcccccggtaagcgcccactatcatcgatgagcccaacactcgtgactaaagataacaaaatctttctggtattgggttctccaggcggatcacggattatctccatcaccttacagactgccttgaatatccttgattttggcatgccaccgcaagaagctgtcaacagcccgcgcattcaccatcagtggctgcctaatgaagtctactatgaacagcgtggcctttcgaaagataccctgaatgtgctggaaaaaatggattacaaaatggtagaacagacaccttggggcgcggcggaactgatcatgattggattgccgggcgctgtcggtgtgtctcccaccaactcatcaggcaatgactcagcggtatcaggcgtggttcgtgaaggctatatctatggctccaacgatgtccggcgacctgctggtgcagccattggctactaa

SEQ ID NO: 1258 - DNA, 1341 bp, Xenorhabdus bovienii
  Coding DNA location: Contig name=SeqID_16855; Position on contig =35482..36822bp; Strand=-
atggcataccgtttatcatctaaggatatttgggcattaggctttatgacttttgccttgttcgtaggcgcggggaacatcatttttccgcccatggttggcttgcaggctggtgagaatgtttggatcgctgcgctaggttttttgcttacggctgttggtctaccggtcatcactgtgattgctttggcgaaagtcggtggcgggattgaagcgctaagttcccctatcggtaaaacagcaggtttgatactggctactgtttgctatatggctgttggccctttatttgcaatacctagaactgcaactgtttcctttgaggtcgggattgctccgctaatgggttctggcagacttccgttgttcatctatagtgtcgtttatttttcactggtgatcttggtttctctgtatccggggaaattactggacagtgttgggcgcgtgctggctccgatcaaaattctggcactgggcattttaggaattgctgcggtgttgtggccagcaagtgatcccatccctgccattcaaacttataaagaaattccgttctcaaatggttttgtgaatggctatttaacgatggatacactgggtgcgatggtgttcggcattgttattgtcaatgcagcgcgctccagaggtattgaatcttcttcactattgactcgctatacgatgtgggcaggtctgattgcagggttgggcttggtactagtatatctatctctgttcaagctgggagaaagtagtggcacattggtgccgaaggctgaaaatggtgcagtgattctgcatgcttatgtacagaatgtctttggtggttatggcagcttcttccttgcggtgttgattttcgttgcctgcatggtaactgcggttggtttgacctgtgcttgtgctgaatttttcagccgttatttgtcattgtcttatcgtgcgctggtttttatcctcggaaccttctctatgttggtctctaatcttggattagaccacttgattaaattctctattccggtactgacagcaatttatccgccttgtattgtgctgatcctgttgagtttcacaatacgctggtggaataattacactcgcattctggcgcctgctatggtagttagcctgttgtttggggttttggatgcggccaaatcgtctgagtatctgtctcacttactgccggcatggacaattcatctgccgttggcagagcaagggctggcatggctgttgccaactgtagtggctgtggttgtgtgtgctctctacgatctcatcgtaggagaaagcaaagtcccaaagcataaagtgcagcaggatcaaggctga

SEQ ID NO: 1259 - DNA, 213 bp, Xenorhabdus bovienii
  Coding DNA location: Contig name=SeqID_16855; Position on contig =36831..37043bp; Strand=-
atgcttgccttttggcgctataaaagttttacttgtgggcagttgttggcgattctagctgtaattaccactatcattctgtatttcccgattaccagtgattattacgttgatcacttattgtcaaatcagaatccggtttcgccagtgaaaattcaagtatttgcaatactgactattgcacatgcaattcttttgacaacaatatattaa

SEQ ID NO: 1260 - DNA, 1314 bp, Xenorhabdus bovienii
  Coding DNA location: Contig name=SeqID_16855; Position on contig =37204..38517bp; Strand=-
gtgcttgaacgtttatcctggaagaagttggtattggggcttgttcttttttgtctgcctgcggtcattttgtctttctttatcggatacttaccgtggctgctggttattgcgttatttctggcactggtatggcatggctacaatttattgaaattatctgactggttatggctggatcgcagtatgttacctccagcggggcgtggcggatgggagccgatcttttacggtatttatcagttgcagcagcgtaaccgtaagcggcgccgggaactggcattattgatcaagcgctttcgcagcggcgctgagtcattgccggatgtgattgtgatgatgacgacggaaggcaatattttctggtgtaatcgtcttgcccagcatttgctaggcttccgctggccggaggataatggtcagcatatcttcaatttgcttcgttacccagattttagtcgctatgttacggcaggtcatttttcccgtcctttatctattgagttgaataatggccgtatggtggaattccgggtgatgccttattcagaagagctgctattgatggttgcccgtgatattacgcaaaaacgattgttggaaaatgcccgccgggattttttcgctaatgtcagccatgagttaagaacgccactgacggtactgcaaggttatctggagatgatgcaggagcaggaactgaacgatagggcaaatcagaaggtgctcagtacgatgcaggagcaggtacggagaatgaacggtctggtgaagcaattattgcatctctccaggattgaagccgggccgcaagtggatatgaacgaggtggttgatgtgcctgacttattggtgctgttgcagcaggaagcgttggcattggcgaataaccagcaggatatcgtgtttaatattgatgaaaaattgaaagttttcggcaacgaagaacaactgcgaagcgccatgtcgaatctggtttataacgctgtcaatcatactccaccgggaacgcgtattgaggttagctggagtaaatcgtctcagggagcagggtttaaagtgcaggataatggtttggggatcagtgctgaacatttaccgcgcctgactgaacgcttttatcgtgttgaccgtgctcgttcgcggcaaacagggggaagcgggttggggctggcgatagtgaaacatgcactgcatcattacaatacccagcttgaggtttcgagtacggtgggaaaaggttccacattcagttttttattggctcccgggcttattgtttctgccaaaccgaatttaattaaaaaacaataa

SEQ ID NO: 1261 - DNA, 702 bp, Xenorhabdus bovienii
  Coding DNA location: Contig name=SeqID_16855; Position on contig =38579..39280bp; Strand=-
atgggattaaccatggctaaacgcattttggtagttgaagatgaagtccagattcgtgaaatggtttgtttggtgttggaacaaaacggctatcagaccgttgaagcagaagactatgatgttgctgtcgggcgcttgtcggagccttatcccgatttggtgttattggattggatgcttcccggaggttcaggaatacagcttattaagcagatgaagcgtgatagcagcaccagagatattcctgtcatgatggtaacggctcgtggagaagaggaagatcgcgttcgtggtcttgatgtcggagctgatgactatatcactaagcctttctctcccaaggaattggttgcccgtatcaaagcggttctgcgccgcacttcccccatgtcggcggaagatattatcaatatggatgggctgatactggactcttcctcccaccgtgtttccagccaggggcaaaatgtggaaatggggccaacggaattcaagctgctccattttttcatgacgcatccagagcgtgtttatagtcgtgagcaattgctcaattatgtgtggggcactaatgtctatgtggaagatcgcaccgtcgatgtgcatatccggcgtttgcgcaaagcgttggaagtagggaggcacgatagaatggtgcagacggttcgtggtacagggtatcgcttttctactcgttattaa

SEQ ID NO: 1262 - DNA, 123 bp, Xenorhabdus bovienii
  Coding DNA location: Contig name=SeqID_16855; Position on contig =39384..39506bp; Strand=+
ttgcatagaatttatgagtgctttgtcatatttcattatgattgcgaacccgctcgaaaattcgtgaacaaagtcagaatttcacacgacagacctcaaacactcattataattagcgcttga

SEQ ID NO: 1263 - DNA, 1215 bp, Xenorhabdus bovienii
  Coding DNA location: Contig name=SeqID_16855; Position on contig =39545..40759bp; Strand=+
atgcgaatcattcatacgtcggactggcatcttgggcaatatttctttaccaaaaatcgtgccgcagaacatcagcactttttgcagtggcttattgagcaaatcatacggcatcaggttgatgcattggttattgccggcgatatttttgatactggctctcctcccagctatgcccgtgagctttataaccagttcgttgtggagctacagcccactggctgccagcttgtcattcttggcggaaaccatgattccgtcgccacgctcaatgaatcaaaatcgctattctcttgtctgaatacgacagtaatagccagcgcaggcaccgacatccagcagcagataaaagtattgaatcaccaaaatggcgaagcgggagccattctctgtgccattccttacctgcgtccacgggatatcatgaccagccaggccggtcagtcagccacgcaaaaacagcaggcattgcagaatgccattactgaacactatcaccaactttatcagcaagccgatacattacgggaacaactcggccagccattgccgattattgcaaccggacacctgaccacagtgggcgcttctacctcggattctgttcgagatatttacattggtacgttggacgcattccccgcacaagcgttcccacctgctgactatattgcattagggcatatccatcgcccacagatcatcgctaaatcagaccatatccgttacagcggctccccgatccccctgagttttgatgaagtcgggcaagaaaaaagcgtctgtctggttgattttaaagaagacaaatttgataacgtcactcttttgcccatcccaaactatcaaccaatgcagttgatccgtggaaatctgcaacaaattgaggctcaattgcagacattcaaaacatatcaaggagaacgtcctgtctggctggatattgaagtcgcgactcaagattacctgcctgatatccaaaaacgcattcaaaccatgactgcgaatctgcccgttgaaatcattctattacggcgcagaaaggcggcacgccaaatctccctgtctgaaacaaataaagagacgctcaatgaactcagcgtacatgaagtcttcgagcggcggctggcactggctgaaattgaagatcagcctcagaagcaacgcctgacaaccctgtttaagcaaacgctggatgatatttctcagcaataa

SEQ ID NO: 1264 - DNA, 3681 bp, Xenorhabdus bovienii
  Coding DNA location: Contig name=SeqID_16855; Position on contig =40778..44458bp; Strand=+
atgaaaattcttagcttacggctgaaaaatatcaactccctgcaaggtgaatggaaaattgattttacggcagagccttttgccagcaatgggttattcgccatcacaggcccaacaggtgcaggaaaaaccaccttactggatgccatctgccttgccctttaccacgaaacaccacggctcggtactatttctgctacccagaatgagttgataactcgtcatactgcggagtgcttggcagaagtggaattcgaagtcaaaggcgtagcttatcgtgcattctggagccagcaccgcgcccgtaaccaagctgatggcaaactccaacctccaaaaggcgaattggtggacaaaaaaacgggcaagattttagccgataagatccctgataaaaaagaaaagatcgctgaaataaccggacttgatttcaaacgttttaccaaatccatacttctgtcacagggtgattttgccgcatttttaaatgcagatgataaagatcgggctgatttgctggaagaactgacggggacagaaatttacggcattctgtctcaggaaatttatcaacgtcataaacaagcccaaactgaactgaatattcagcaggccaccgcttccggcattgagttattaaccccagagcaaatagaaaaataccagaacgaacagcagcaacttattgcgacagaaactcaactcagccaacagattaaggcttttcaatctgccgaacagtggctcacccggcaagatgagttacaacaatcaataaccagcagcactgcacttttacaacagactgagcgaaccatacaagacgctcaacctcaattacaacaacttgccgccagcgaacccgcagaaaaaatccgttcactatgggatacgcaaaaccgagcctttagcgaaaaacaacgagttactgaacagcgtataaaaatagaacatgatcgccagcaacaactttctttgttacagccagttcaacaacagcttaccgatttggaaaaaacgcagggagaacaccagcagaagcaagtccaacaggaaaaactcatcacagagcagattatgccactcgatcacaagattgatactcaatcaaaagatctgcttaccctagagaaggaaataaccgggcaaaaccgtgagctggcagaaatttccacccaataccaagtagcacaaaatcgcaaagatacgctgcataatgaacaaaaaacgctggaaacatactacgatcagcacccttattgccgtaatttagacagcaaactccctgagtggaaacagctattttcacgtcaaaaagagaagcaaatacagatagccaaatttacacaaaaaacacagcagattagcactgaattagctcgtataacccatcacttgagtacattaaatacagagttagccaaacagacagagcaaaaccagctactgcacgacaatctgatacttaccgaaaaacaactgactgatttgcagaaaagtcatccaccggaacaattgcaaaaacagttatcaaactatcagcaacaactgaaatcacagaatcaacttgagatattattgcctcagatccggcaattacagaccacaatctcaatcaatcaaacccagtcagcacagtatcaggcattactggaacccttgccgatgcagatcagcgtactagatcaacagctaacggagaaacagcagcattatgaagatcttactgatcgaattcgtttggaacagcgaatcaccagcctggaacaggagcgttcacagttaaaagaaggcgaagcctgcccactgtgcggttccacacaacaccctttagtcgctgaataccagaacattgccctgtcacaatcagaagaacgcttaaaatctctacgtcatcaaatagagcagctacaaacaaaccgttctgccctacagcagaaacagcagattcaacagcaaaataatcaacaattacagcaaaatacggctcaattaaccgagaaactgacagaaacaacgcaacagtggaagcaccactgccaacagttacaagccgctgaattaccgatggaaacggaacccgtgaacaatttcattggtcaacggcaatctgccgctcaacagcatcaaagacaatacgaagcattattacaagcagaaaaagcacaccaagcggcggaaaaagcgctatcggccaaccgtgaacagcacaaagcatctgaacaaactattgagctggaaaaggtcaaattggattcacaccaaaaacaactggcagaaaatacggcggatcttcgacagtcagaaactgaatacacaaccacgacagagctattagtcagcgatttacaacatacgccttttgctctgccctctctgcaagaagtcacaatctggctgcaacaacgcgaaactgagttaaaaacctaccatgattcacgcgaaagatggcaacagttgcagcaagaacaagcggctctgcaaagtcaatcgaatgaattagagaagcaaaaaaccaagctgacagtccaccttcatgccctgaacagaaaacagcagcagcaaaaacagttactggagcaaacaactcaggaacgtcatcacttatttggagaacaatccgttagcaccgttcgtcagacattacagcaaaaaactaatgagctgaacatcgcttgcaaacaggctacttcacacctgcaacagcgacaaagcgtgatgaatcaactcactggtgcagctagtgaaattgaaagaaacagcaataccgccgaaacacaatgcaaacttgccgccagcgctttccaaagcggattggaacaacagggatttgccgatcaatctgcctttgaacaggtcctgctggaacctgaacaacgggaaaagctgcaacaattgcaagagcagcttacacagcatcatttgcaagccaaaacacggcaccatgaatcagaaaccgccttacagcgacatactgaaacacagccccaattacttgaacaatatgaaccgacgcaagtatccgtgatattagctaacattagtgaagaattgaaacataacaatcaacagcaaggtgaagtcaaaaccatactgaacagtgatgctatgcgtcggcagaaacaacaaacactcctggcacaaatttcccacttacaacaaaactacgatgactggagttacctcaataacctgattggttccgcagacggtgctaaattccgccgctttgctcaaggattaactctggatcacttaatccatctggcgaatattcgactggaaaaattacatgggcgctacgatttgcaacgcaaagatgatggagggctggaattgcaaatcgtcgatacttggcaagcagatgccgttcgggataccaaaaccctctctggtggcgaaagcttcctcgtcagcttagcactcgcactggcgctgtctgatctcgtgagtaacaagacccagatagaatccctattccttgatgaaggctttggtactcttgatccggaaacccttaatatcgctctggatgctttggatcacttgaatgcgtcgggaaaaacaattggggtcatcagccatgttgaagcaatgaaagaacgtattcctgttcagatcaaagtagaaaaagtaaatggcttgggggttagtagactggcatcagaatttcgggtttaa

SEQ ID NO: 1265 - DNA, 153 bp, Xenorhabdus bovienii
  Coding DNA location: Contig name=SeqID_16855; Position on contig =44427..44579bp; Strand=-
atgcttattttttccaatcacatcgttatctatgcttttgggaatttatacactcaccatcgcgctgcaactcgaaatccattgggtatggatgattcaccaagccttaaacgattagcgtttaaacccgaaattctgatgccagtctactaa

SEQ ID NO: 1266 - DNA, 1623 bp, Xenorhabdus bovienii
  Coding DNA location: Contig name=SeqID_16855; Position on contig =44654..46276bp; Strand=-
atgaataaaatcacaataaataaaaagataaaaatactttcttgtgctattgcgatgatgttgggaaatattgcattgtcccatgctgcggttgttcctgatggtataaaattggcctctaagcaggaggttgtgcgtaaccatgcttcagaacctgcttcattagatgtacacaaagtttcaagtaatgttgaattcaatatcattcatgatttttttgatgggttagtttataccgacagaaaaggtaatatagagccgaaattggcagagcgttgggaaacccgtgataacaaaatatgggttttccatcttaggaaagatattaaatggtcagatggcacaccaatcactgctaatgatatcgtgtttagttggcggcgcctggttgatcccgatattgtttctccttacggtagttatcttgagaatgcggctattgtaaatgcaaatgatgtgctcagaggcaagaagaaaggtgaggagcttggagtaaaagcattggatgatatgacgttagaagtcagtctggataaaccgatgggggattttttacagatattgacccatcctgttatggttccgctcaatgaaaaagtgattaaaaaatatggcaataaatggacaaggccggagtcttttgtcggtagcgggccatttaaattgtctgaatggatggtgaatgaaaaaatcatcggtatcagaaattcccattattgggatgataaaaatacggtgattaataaagtgacttatcttgttataggttcagaaaaagctgctttgaatcgctatttagcaggagaagttgattttaccgaaactattccattggattcttttgaatcactcaagaaaacaatcaacgatcaaatctatatatctcctcaaacaggcgtttatttttacgaaattaataataaaaaaccaccgtttgataatatgaaggtgaggcaggcactgaatttagctgtagatagagaagtgattgctaataagatattgggtcaagggcagaagccggcttatacgattgttcctcccaatgttggagggtttaaatttacagaacctgattatgcttcatggactcaggctcagcgaattgaaaaagctaaaacattattgaatgaggccggatttaatcagagtaatccgctcagatttaacttactttataacacctcagaagcgcataagaaaattgccattgcggttagctccatgtggaaaaaaaaccttggtgttgatgcgactttgcagaatcaagaatggaaagtgatgcttgataatatgcatcaaggtaaattcgatgttatcagaagagcatggattgccgattataatagccctatgacatttttaagtatgtttatgtcagggcaaattaaaaatacttcactatatgaaaatgataattacgatgctttaataaaaaaagcaggagagactaatgatagatcgtattatcaacaaggattagatgtcatcaccacagattcacctgttattcctatttattattatgttaatgcgaaaatggtaaagccttatgttggtgggttttatgtcaatcccatggggtatatttcgacaaaagatctttatattatccagcactaa

SEQ ID NO: 1267 - DNA, 1647 bp, Xenorhabdus bovienii
  Coding DNA location: Contig name=SeqID_16855; Position on contig =46349..47995bp; Strand=-
atggtgaataatatgaaaaaaaataaaatagagttaataacgaaaaaagcgattaaattattatcctgctccatctctattattatgggaagtatagttttgtctcatgccgctgttgtcccaccgggtacgcaactggctgataaacaggaaattgtgcgtaataatggttcagaacctgcatctctggatgtacataaagtcgaaagcgatattgaatttaatattattcatgatttttttgatggtttggtttacaccaataataaaggtgacatcataccaaaattggcgacaagttgggagacgaaagataatcaaacttggatttttcatttaagaaaaggtgctaaatggtctgatggctcatctattactgcttatgatgtggtatttagctggcagcgcctgcttaatcctaaaatgggttctccttatggcagttatctggttaatgccaatgtagttaacgcgaatgatatacttacaggtaagaagcctgcggaagatttgggtataaaagcgctggatgattttacgctggaagtgaagttagacaggccagtaggcgactttttacagatgctggctcacccgattatggtgattgttagtgaaaaaacaattaaaaaatatggcgataaatggacaaaacctgagtattttgtcggtagcgggccatttaaattgtcagaatgggtcgttaatgaaaaagtcatcggtgtcaggaatcctcaatattgggatgataaaaacacggttattaataaagtaacttatcttcctctctcttcagataaagcagatctaaatcgttatttcgcaggagaaattgatatcactctgactattccattggaatcctttacatcattaaagaaaaactcaggtgaacaaatttatatttctccaaggctgggcgtctattattatgaatttaatacacaaaagccccccttcaatgatgttagagtcaggcaggcactgagtctggccgtggatcgggacattatcgccaataaagtcttgggacaaggccaaagacctgcttatacactccttccaccgaaaaccggtggctttgatttccaacagcctgattatgcatcctggacacaaaaacagcggattgaaaaagccaaatcattgttgaatgaggccggatttaatcaaaataatccgctcagatttaacttactttataacacctcagaagcgcataagaaaattgccattgcggtcagctctatgtggaaaaagaatcttggtgtcgatgcagtattgcagaatcaagaatggaaagttatgttggataataaatatcaagggaagtttgatgttgccagatatggatggattggcgattacaacagcccgatgagttttttaaatatttttatgtctgatagcacgcaaaattcatcaaaatattctaatcaaaatttcgacaaactggttttaaaagcaggggagacgaataaaaaagattattatcaacaggctgtagatattttcactgacgactcgccagttattactatttattactatgtcaatgcgaaaatggtaaaaccttatttgggtggagtttatattgatccaagaggttatgtctcgacaaaagacctttatatcattaagtattaa

SEQ ID NO: 1268 - DNA, 1650 bp, Xenorhabdus bovienii
  Coding DNA location: Contig name=SeqID_16855; Position on contig =48047..49696bp; Strand=-
atggagatggtaaaaatgaaaaatatcatagctaagtttataaaaaataaaacaaccaaaatactcacctgctctatagcgattatattggcaaatatcgcacaatctcatgcagcagtagttccgcccggaacccagttagccgataaacaggaaattgtgcgtaataatggttcatttcctgcctctttggatgtgcataaagttgaaagtaatgttgagttgaatattatccatgatttttttgatggtttggtttacaccgatagcacaggcaatattgtgcccagattagcggaaagctgggaaacgaaggataaccagatttggatcttccatatcagaaaaggcagcaaatggtctgatggttcaccgattacggctcacgatgtggtttttagctggcaacgcttacttgatccagagataggatctccttatagcagttacctcggctccgcttttgtggtcaatgcaaacgatatactgtcaggcaagaagaaaaaacaagaactgggtgtaaaagcgacggatgatttaaccttggaagtcaaattagagaagcctgtcgcttatttattgcagatgttgacccacccgattttggtgcctatcagtgaaaaagccgttaaaaaatatggtgataaatggatgcagccagacgtttttgtttctagtggcgcttttaaactgtctgaatggaaagtgaatgaaaacgtggttggtgtcagaaaccctcagtactgggatgataagaacaccgtaatcaataaagtaacttatctttctcttgtatcagaaaaagcagatttaaaccgctatctcgcagacgaaattgatatcacccagtctactgcattggattcttttgcgtcattaaagaaaaaattgggcgatcaggttcatattgctcccatgttgagtacttactattacgtcttcaatactaaaaaaccgccatttgatgatgttagggtgaggcaggcattaagtttagccgtagatagagacgttattgctaataaagtattgggacagggtcaacgacctgcctatgatattattccgccaaatacggggggattcaatttaataccacctgaagctgcctcttggacacaagaacaacgtattaaaaaagccagagcattattgaatgaagcgggctttaatcaagataatccactgcaatttaacctgctttataatacaagagaagcgcataagaaaattgctatagccgttacttcaatgtggaaaaaacatcttggtgttcaagccaacttgcaaaatcaagaatggaaggtgatgttggataatatgcatcaaaacaagtttgatgttgtcagatacgcatggactgcggattataatagccctatgtctttcttggatacgttcatcacaggaagtagtcataacgtacccttatatgaaaatagcgattttgatcagatggtgattaaagcaggtgaaaccaatgatataatctattatcaaaaagccatgaatattttcaccaatgatatgccaatcattcctatctactattacgttagtaataaattggtaaaaccgtatgtaggtgggctttacattaatccaatggattatatttccacaaaagatctgtatattattaaacattag

SEQ ID NO: 1269 - DNA, 1650 bp, Xenorhabdus bovienii
  Coding DNA location: Contig name=SeqID_16855; Position on contig =49810..51459bp; Strand=-
atggagaatatcaatatgcagaattttatggtgagcttaataaaaaataaaattgctaaagtattaacctgtattgtgagtcttatactaggaagtgtaacttactcttatgcagccgttattccttctggtacacaattggccgataaacaagaaatcacgcgtaataatttttcagaacccgtctctttagaccctcataaatccgacagcagcagtgaatttgatattctgcgtgatttttttgaacggatggtggctatcgataaaaaagataaaattattcctgccttagctgaacgttgggaaaccaacgataataaaacgtgggtgttccatttaagaaaaggtattaaatggtcagatggttcacccatcactgctcatgatgtggttttctcttggcggcgaatggtcacgcctgacactatttctccttatggtagctatttggttcaggcaactgtggtgaatgcatatgatgtgttatcgggcaagaaaaaacccgaagaactcggtgtgaaagcactggatgatgcaaccatagaagtcactttggaaaggccaaaagcggatttattgcaaatggtagcgcatccggcaatgtctcccattagtgaaaaggttgtcaaaaaatatggtaataaatggacacaacccgaattttttgtcagcaacgggccttttaaactctctgaatggatagtgaatgaaaaaattgtgggtgtcagaaatccttactattgggatgataagcacacggtgattaacaaagtcacttatctgccattgtcagactataaagctgatctcaatcgttatatggcaggagagcttgatatatccaacggtggcccatcggatttctttccaacactcaaaaagaagtttggcgatcaattccatatttcgcccataatgagtgtttattattatctttttaatacgcaaaaaccgccatttaatgatgttcgggtcaggcaagcactgactttagcgttggacagagccattattactgacaaggtattggggaatgggcaaaaacccgctttcgatgtggtttatccaggtagcgggggaatttatttaaaacatcctgattatgcctcatggacgcaagaacagcgtgttgcaaaagccaaagcgttactgaatgaagccggttttaatgaaaataacccgctcaaatttaccttgttgtataacacttcagatggccataaaaaaattgccattgcagccagttcgatgtggaaaaagaacctcggtgttgaagttgttttacaaaatcaagaaagcaaatcactgtacgataccatgtctcaaggaaattttgaggttgtcagatacgcatggaatgcggattataatagcccgacatcttttttagatatttttaccacaggaaataccaataacataccgcaatatagtaataaagaatttgatcaatgggtattaaaggcggatgaaactaacaacaaaatatattatcagcggacacttgatatcctcactcaagattcacctgctattcctgtttattattatgttcgcactaaattagtaaaaccttatgttggcggggttcatattagcccgttaggggatattccaacaaaagatctgtatattattaaacactag

SEQ ID NO: 1270 - DNA, 1632 bp, Xenorhabdus bovienii
  Coding DNA location: Contig name=SeqID_16855; Position on contig =51718..53349bp; Strand=-
atgcgtttttttaaactattgcctatcgttctggcattgacggcggcgggatgtgcaactaaacccgctgatgacacagcaaatagagtcgatgttcgagtactggccttgaatgactttcatggcgccctgaaagcacccggcccaaatcagccggggggtatcgaacatatggcaacactactgaaagaactgaagcaagagaatccgaataatatcgtggttgctgcgggtgacatgataggcgccagcccgctgctctcttccatgttccatgatgagccgagcattgaagccctgtcccttgctgggttggaagcgacttccgtgggcaaccatgaatttgataagggtaaggatgagttgctgcgtaaacaaaatggcggttgccacccagtaaccggctgtcaggggccaacgccattcaagggcgctgaattccagtatttgtccgctaacgtcaccgtcgataagacgggcaaaaccctattccctgaatatgtgatcaaagaatttgacggaattcctgtggcctttattggcttgacgctggaaggcacgccagccatcgtcaccccgcagggcacagaagggctgagttttgccaatgaagtcaaaactatcaacgcgttggtgccggaattacagaaaaaaggcgtaaaagcgattggtgttttgatccatgaaggagcggctcaaaaacgtgaaggtggccggattgacgttaacgcctgtaatgacgtgacaggcaaagtgctggatatcgtcaatcatttggataaagaagtggatttcgtcatcagcggtcatactcatcaggcgtataactgcgtgattaatggtaaatccgttacttctgccgaatccaatggcgcgttgatcaccagattggatctgaaattggataaaaccaccaaagatgtggttgatttcaaggcgaaaaacatctgggttgataatcgtaaatatgccaaagatccgcaaattaccaatttgttggctgcctatgaaaaaattgccactccgctggcaaaccgcgtgattggcaaactggaaagcaatttgactcaacagacaacccatggtggagaatcctcgttgggtaaagtgattgctgacgctcacttatttaccaccgcgccaaaaaaggcgggcggagcgcaacttgcgtttgtgaatggcggtggtatccgcgccccgatggacgccggcgatgtgacgtacaatgcaatttataccgttcagccgttctcgaatatgctggtgaccaaaacattgactggcgagcagatcaaacgtctgctggaacagcagtgggatcgttcacggccacaaattctggcgatatctcacagttttgaatacgcatgggatagctcaaaacccgtgggagaacgtgtcatggtcagctcaatgaaaatcaatggtaagcccgttgacttaaaagcgaaatatcgcgtggcggccaatgaatatctggcaacgggaggcagtaatttctctgtatttaaagagggaaccgatcctgtttacagcgtccctgatatagaggctgtcgttaactacttcgctaaaaagtctccgattatttatccaaaacaggatcgcatcgttgatataaatagaaaataa

SEQ ID NO: 1271 - DNA, 1953 bp, Xenorhabdus bovienii
  Coding DNA location: Contig name=SeqID_16855; Position on contig =53418..55370bp; Strand=-
atgaagaatgtgttgaagatttcaacattggcaatgctggtggcattcaatgtgaatgctgcaacagtcgatttacgcgttatggaaacatcggatattcacagcaatctgattgatttcgattactttaaagataaacctactgagcagtttggtttggttcgtaccgcgaacttaatcaaagcagccaaagctgaagcaaccaacgcggttctggttgataacggtgacctgattcaaggcagtccgctggcagattacatggcggcaaaaggccttaaaaaaggtgatgtccatcctgcccacaaactgatgaataccatgggctataccgtaggtaactttggtaaccacgaattcaactttggtctggattacctgaaacaggccatcgcaggtgccaaattcccttatattaatgccaatatcatggatgccaagacaggcaaaaactactttacgccttacattattgttgataccccagtcaaagatcgtgaaggcaaagaacacaccattaagatcggctatatcggctttgtgccacctcaaatcagtatttgggataaagcaaatctggatggcaaagtggtggtcaacgatatcaccgagactgcgaaaaaattcgtccctcaaatgaaaaaagaaggggcagacttggttgtcgccatcccacattctggcttttcccaagagccttacaaagcgatggcggaaaactctgtttactatttgagtgaagtttccggtattaacgccatcatgttcggtcatgcccacggtgtcttcccgagtaaggaatatgctggcatcaagggcgtcgatgttgccaatggaacggtcaatggcattcctgccgtaatgccgggtcagtggggagatcacttgggcgttgttgatctggtgatcaataacgacagcggcgaatggaaaacggaatcagctaaggcggaagcgcgcccaatttacgacaaagcccacaaaaaagcgcgggttgagcgggataacaaactggctgccattattgagaaagagaatgaaggaacccgtaagttcgttggcaaacttatcggtaaagcctctgcgaatatgtatagctatctggctctgatccagagcgatccgaccgttcagatcgtcaatgatgcccagattgattacaccaagcgtttcattcagggagatcctgatctggccgatctgccggtattagctgccgcagcgccatttaaagtgggtggacgcaaaaatgcgccggctgattttgtcgaagtggaaaaaggggatctgactttccgtaacgctgccgacctgtatctctacccgaatactctggtggtagtgaaagcgagcggcgctgacgtcgttcagtggctggaatgttcagcgggaatatataaccagattgatccaaactctgccaaaccgcaaaatttactgaactgggatggcttccgtacctataacttcgataccatcagtggcgttgattataagattgacctgactcagcccgcaaaatatgacgttgaatgtcagttgatcaacaaagaggcgaatcgaatcaaagaggtaacctatcagggtaaacccattgatccgaaagcaactttcttgattgcaaccaataactaccgtggttacggcggtaaatttgctggtacgggtgataaccacatcgccttcgcttcacctgatgaaaaccgtactattctggcctcctacatttcccgaatcaccaaagagaagggcatagtatcaacgcaggctgaaaacaactggtcattcctgccgatcaagacggataaaaaactggatgtgcgctttgaaacgtctccaaccgagaaagccgcaatattcatcaaatcgcacgctcaatatcctgtgaaatacctgaaaaatgatgatgttggttttgctatctatcaaattgatctgacagagaagaaataa

SEQ ID NO: 1272 - DNA, 1152 bp, Xenorhabdus bovienii
  Coding DNA location: Contig name=SeqID_16855; Position on contig =55436..56587bp; Strand=-
atgaaaagtatgaaaccgttagccgctttaatgggtttattagttatttctggcagtgctaattccgccactgtatacaatgacaaaggaactcagatggagctgagtggacagttccgtctaaaagcacaggtaaccagtcaggatcgtgatatcagaatgcgtgatgatggcagccgtattggtatctctggcagccacgaactcaccagggctattaaagcctttggcaaaatggagtggggttctgatacccagaaaaccaatagtgataactttgaaactggctttgatatgtttaaccgtgtcggttatctcggtttttctcatcgggattatggccagatccaatttggccgaacttatattcctatcgattgggtgaaaaaatccagctatggctatggcaacacgggtgcattttatttcagcgatgtattgggacgcgctacaggtaatgagaaaaacggtgttggtagaaacaacttcatgacccgtctgccacagaccatttttgtcgaaaccaatcgttatgagggcttcaaggtcgcagcgacctatagtggtaaatccggttctgataaggagcgcaagcctggagatattcgccatgcctattctgtcgttggtttttataaatcagactttggtctggaatttgatggcggctattctgcggcaacaggggaatcgcaaggagattcggcgaaatcgccccaagatagcctcttggctttcggcatggagtattacttcccagggtgtgaattctcgattggtctggactacggtatagcgcgctccaaaaattcaggcctgatttataaacaaggcggggcagaggcactcaagtcgaactccgtgaaaggcgattggaaagcaaacctgtatggtctgggtgtgaaatggcactgggataaaatcgaaagcggaatgtatgcgggttattacctacgggatggggataccaatacatttaactatcaaaaacagacttatgcggttggtgtagataaacgctttgccgtttctaagtacaataacctgcgcctgtttgttgaaatggcatatgatgatgcccgcagtgataatccggtttacaaagataaaaaacaaaccattttggaaacaggggcacgtttgtatttctag

SEQ ID NO: 1273 - DNA, 180 bp, Xenorhabdus bovienii
  Coding DNA location: Contig name=SeqID_16855; Position on contig =57340..57519bp; Strand=+
atgctagatcactttcttactcctcgcaccgcgaggagtaagagggcttcaagcgctaaatacattactattatgaaaaggcatttatttaaaaaattaattttagctatatataatgaaagctcaaaatcggttcggcggtacaggatgcatggggtattttacgggtttaataattaa

SEQ ID NO: 1274 - DNA, 909 bp, Xenorhabdus bovienii
  Coding DNA location: Contig name=SeqID_16855; Position on contig =57717..58625bp; Strand=-
atgcgtataggtattgatctcggtggaaccaagattgaagtgatcgccttgggcgatcagggtgaggcattgtttcgcaaacgggtggatacgccccgcaacgattatcagcaaacactggcagcgattgccgggctgattgccgatgctgaacaggtaaccggccagcggggaacggtgggtattggcatccccggagccatttctccttttaccggaaaagtaaaaaatgctaattcagtctggatgaacgggcagatcctggataaggatctttctgccttgctggggcgtgaagtgcgggtcgccaacgatgcaaactgtctggcagtgtcggaagcgacagatggagccgcagcgggtaagccaatggtgtttgctgtcattattggaacgggctgtggttcaggcattgcctttgatggcaagatacatgcgggaggaaatggtctggcaggggaatggggacataacccgttaccgtggatggacgaggaagatcgggcatatcaagaagaagtccgttgtttctgtggtaaaccgggttgtaccgaaatgtttgtgtcgggaacgggattcatgacggattacttccgcttaagtggggttcgtaagaaaggtcatgaaatcatggaagcgctggtacagggggatgagatagctgaattggctatacgccgttatgaaagacgtctggcacgggcgttggcacaagtcattaatttacttgatcctgatgtcattgtgctgggaggaggcatgagtaacgtcgatcgcctttaccagaccttacccggtttagttcaagagtgggtttttggtggggagtgcgcaacgccgatcaaaaaagcactgcatggtgactccagtggggtacgaggtgccgcttggctgtggcctcataaataa

SEQ ID NO: 1275 - DNA, 972 bp, Xenorhabdus bovienii
  Coding DNA location: Contig name=SeqID_16855; Position on contig =58792..59763bp; Strand=+
atgcccccttacgttttaagatgttctttgtcacgatgcgcaaaaatatggggtagctgcatgttatggttcaaaaatttaatgatttaccgtttaaaccgagaaatatcactttctgcggatgaactggaaaaacagttaagctcattggcgttcaccccatgcggtagtcaagatatgatgaagacaggctgggttcctccgatgggcgctcacggtgaagcgctgactcatgccacaggtaatcagatcctcatctgtgcgcgcaaagaagaaaaaatgctgccttctccggtgataaaacaggaactacaggccaaaattgcccgtctggaaggtgagcagcaccgtaaactgaaaaaaacagaaaaagactcactgaaagatgaagtgatccacacgctgctgccaagggcgttcagccgtttcaatcagacgtatatctggatagataccgtcaacaatctgatcattgttgacgcagccagtgcaaagcgcgctgaagataatctggcattactgagaaaaacgctgggatcactgcccgtcgttcccctgacattcaccgatcctattgaattgaccttaaccgaatgggtacgttcaggcgatttgcccgccggttatgctttgatggatgaagctgagttaaaagccattctggaagaaggtggcgtgatccgctgtaaaaaacaggcattggtgtctgacgaaattgcgacacatattgaatctggcaaattcgtcactaaactggcattggattgggaagaacgtatccaattcatgctgtcagatgatggttctttcaaacgcatcaaattcagcgaaacactgcgtgatcaaaatgacgatatcgaccgtgaagatgttgctcaacgattcgacgcggattttatcttaatgacgggtgaattaagtgcacttatcaaaaacaccattgatgcgttaggcggtgaagcagaaaggtaa

SEQ ID NO: 1276 - DNA, 1146 bp, Xenorhabdus bovienii
  Coding DNA location: Contig name=SeqID_16855; Position on contig =59857..61002bp; Strand=-
atgataaaacacaacgcaatagcaatggtaattccggctctcctcatcgctggcacagtaaatgccgctgaaatttataataaagacggtaataaaattgatttatatggcaaggcagatgttcagcactattttgccaaatcagggaataaaaagaatggtgataattctgtcgctcgtctggggatcaaaggagaaacccagattacggatcagttgacggggttcgggcgttgggaatacaacatgggcgcaagcgggtctgaaaccgaaggtgctaagaataacagaacacgtctggctttcgccgggttgaaattcggcaagtacggctcactggattatgggcgtaactatggtgtggtatatgacaccaacgcatggacggatgaattgccattctttggtggtgactccatagctgcgaccgataatttctggatggggcgttcgacagggttattaacataccgtaatactgactttttcggattggtggacgggcttaagtttgccctgcaatatcagactaaaaatgacagcagcaccattaatggccgtgatgatattttgagacaaaatggtgatggttttggtctttccagctcctatgatttcggtaatggtatcagtatggctgcatcatatggcaactctaaccgaacttccgcacaaaaaaatgggactgaccaaacgaaggttgtcgccaaagggagcaatactgaagcatggctgatgtctgtgaaatatgacaaaaacaatgtttacctggcagctatgtatggtgaaggccgtaatttaacccgatttggtaaactcgataattatgttttgttcgcaaataaaactcagaacatcgaactgaccgctcagtatcagtttgattttggtctgcgtccatcaataggttatgtttattctaaaggcaaagatttggctggagacagtgagactaacgtgctggctgctaaaagctctgaagatttagtgaattacgtctctgtcggtgccttctataatttcaacaaaaatatgggcacttatgctgaatataagatcaacctgatgaaagacaatgacttcaccaaaaaagtgaacatcaatacggataatgttctgggggttggtttagtttatcggttctga

SEQ ID NO: 1277 - DNA, 195 bp, Xenorhabdus bovienii
  Coding DNA location: Contig name=SeqID_16855; Position on contig =61290..61484bp; Strand=-
gtgatcctattaaaaacaaacattacttatttacataaaaatgaacttaaatcaaatctcaccagttacaggacttacagtcagttgtcaatgatgtcaaagatgattactacggaatctatcgtaattagcaatgagaaaatagatttattaatgatagagattactttttgttactttctttattatttctaa

SEQ ID NO: 1278 - DNA, 150 bp, Xenorhabdus bovienii
  Coding DNA location: Contig name=SeqID_16855; Position on contig =61447..61596bp; Strand=-
atgaattttctggcgtatttcttgttcaggaattgtggggcgacctcgtgggcgtggatatttttttccattttagcaccttatgaattgttaatatttgtactttattggcgtgatcctattaaaaacaaacattacttatttacataa

SEQ ID NO: 1279 - DNA, 519 bp, Xenorhabdus bovienii
  Coding DNA location: Contig name=SeqID_16855; Position on contig =61645..62163bp; Strand=+
atggatgtggttgcccaaaaagccggtattgcaaaaaaaacactctatcgttttgtcaaaaatcgagaagacttgcttgagcaaattgtactgcgctggacagatagctgtacccctacttttgagaaagatgccagtagttttaaacaggcaatgaaattattagaaaaacatttgagagaaatagctcagaaattactgtctacagatgccgtggggttattcaaattactgcaatctaatttcccttttcgggaagtgctactagaaaaatatcaaaaaagtgtttttgaaagagacaaaataattttggccaattggctggagcgccaatatcaaaaagggttactgagaaaattgaattataatattatcagtgaattagtcctttcaatggtcattgcagaaccactcagacaaatggctctgggtatcacgccacctctgccagaaacagatattactcctcaccttgcagcagcaataacgttgcttgaactgagtttggtaaagaaataa

SEQ ID NO: 1280 - DNA, 123 bp, Xenorhabdus bovienii
  Coding DNA location: Contig name=SeqID_16855; Position on contig =62189..62311bp; Strand=-
atggttatcgtggctggaagctcgcttgtctgcttgattccgtttcatcagaaaatgcaggttggctgggaaatgggcgctgagagcattgatatttcagcgccaatggtgttattgccataa

SEQ ID NO: 1281 - DNA, 909 bp, Xenorhabdus bovienii
  Coding DNA location: Contig name=SeqID_16855; Position on contig =62275..63183bp; Strand=-
atgagcatatatggttatggagaaaggggcgaacctgctcattcttatccggagcagggaactgattctcagagtggggattatgccgcggtggcagataagaaacccagacaatttcatgcagacattccgcaaaacagcagccagcctattatcgtccaccaccactactatcaccataatggtgatgtacatcatcattaccacggcaacgaacaaatgccagaatttgatgtgcctgtatctgaccgttgccaaaagcagatgctgcaaattgaactggatgtattaagccagaataatcacattgcagagtgcaaccgccggtactttaccctccaccatattttggcgctgaatctgatatctagcccaggctcaggtaaaacaacactactgatggccacactgaatagattacgggataaagttgcctgtgctgctattgagggggatcagcagacgagccatgacgctgaccgtattcgagctgtgggaattcaggccgtccaggtgaatacagggaagggatgttaccttgatgccgaaatggttcgtgaagctacccggcaattgaagccggccgaacacagtttattatttattgagaatgtcgggaatttagtatgcccagccagttttgatcttggcgagcagcataaaattgttatgttgtctgtcactgaaggagaagataagccgttaaaatatccgatgatgtttgctgaagctgaattgatgatcatcaacaaggtcgatctcctgccttatctcaatattgaattggaggcctgtattcaagccgcccgctgcattaaccccgatatcgacgtgattgcactgtctgcgtccacaggagaagggattgaccaatggttatcgtggctggaagctcgcttgtctgcttga

SEQ ID NO: 1282 - DNA, 162 bp, Xenorhabdus bovienii
  Coding DNA location: Contig name=SeqID_16855; Position on contig =63374..63535bp; Strand=+
atgacaaacaaaaaacgtttcagtaataataaaaataagactagccgcaaattaacatgctgtctattcacattcatgataaataaaatgattatttcattatggcatcacatcaattacgttaagaaaaaatcattaatcaatatcagaaaaacaaaatag

SEQ ID NO: 1283 - DNA, 2430 bp, Xenorhabdus bovienii
  Coding DNA location: Contig name=SeqID_16855; Position on contig =63896..66325bp; Strand=+
atgaaattccccttgcgccatctactattgctcaccactttgacctgtagtttttcatcaatggctgtttcaacgaaaaatcttccccttatgccgtggccacaacagatttccgtgcaacaagggcgttttgatctcagcggacaactgaatatcgaaataaccggagatgacatgcaggatgccatatccctatggcgaggccggattgaagcccaaacaggttggatcttgccacccaataaccgtcttccttctatcagggcagtccattccgttgcctcttcgttccccaccatcaaaatcatcatcaccaataaaatgcccccgattccccaacccgacagcgatgaacgctaccaactgatcattgataaccgaggggctactctgcaagcagagagccgatttggtgccatgcgggggatggaaaccttactgcaattgctgcaaaacgatgccagaggcacttacctgccgttggtcaatattaccgataatccacgtttttcatggcggggcgtgatgctcgattcagctcgccattttttgcctgtagacgcgataaaacgtcagttggatggtatggcagcagccaaagtgaatgtctttcattggcatttaaccgatgatcaaggctggcgttttgcttctgactattaccctaaattgcaacagctcgccagcgatggcatgttttacagcaaaacccagatgcgtgatgtcgtcgctcatgccgcccgcttgggcatccgggttgtacctgaaattgacttccccggccacgcttctgccattgctgttgcctatccagaattaatcagcgctgacgggccttatcagatgcagcgccaatggggagtccacaaacccacacttgatccgagcaatccacaagttcatcagtttgccgatcgattaattgctgaagtcgccgacatcttccctgatccttatattcatattggtggtgatgaagtgaatgcctctcaatggcaggcttccaccaagatacaggcattcatgcaggaaaaaggcctgaaagatcctcatgccctacacgcatggttcaatcaagcgttggaaaagatccttgagaaacatggccgcaagatggtgggctgggatgaaatctatcatccggcactgcctcatatcatcgtcattcaatcatggcagggacaggattcgctggggaaaaccgcagatgatggctatcaggggatcttatccacgggattttatctcgaccaaccgcaaagtacggcatatcactaccgcaatgaaattttacctcaggtactccgtattgatgagcgcgtgaaaaaagaggaaacggcgcaaagctggtcattcaatatgccccgtttaaaaggcaacccgattacgggcagttttactttgattgaggatggccaaggtcaatggcgcggttttattgattttacggggaaatcgcgtcgtgccgtcaatgacattgtctggcaagggaacgtcgtcaggtttacgctggatagttggatgggagaaactacgccagtgatggatctcaatcaaaaacagaaaaccgcagacggctatattttggtgggcaatgtgcgctatccggtcacaggagaaaagctggacagtgttccaacgggtcaacttcctgtcgtgccagaaagtcgccatcagacaaatattctgggggctgaagctacgttgtggtcagagaacgtgaccgctgaagtactggacattaaactctggcctcgcacctttgccatcgccgagcgactttggtctgccaagaatatcaccgatgaaaagaacatgtaccaacgcttgcaggcgatagatacgtggacaaccgtttctgtcggtttgcagcagcaggcaaatagccagcggctgatgacccgtttgacaaacagtacggatattacaccattgcagattttggctgaggcggtggagccggctcagtattactcccgccatcatgccaaatttcaggccggtaattaccatcaatatgaacccatttaccgttttgccgatgcactggggccagaaagtcataccgtcagggaaatagatacgctgatcgatcgtctattggcgaataagcaagatcaacaagcagagcttgcattacgtgatcactgggttcgttggcagaataatcatgattctgtaatgaaaatcgtcaaatcgaattatatgatgcgtgatctggttccggttgccaacgatgtcagcgccatcgccgggcttggattactcatgctggatcacctgaaagcgggaaaaaccttgacgctcaaacagcggcaggatgcgcgaaatttgttagcacaaggcgcacagatgcgtgatgaagtaataatacgggcagtatatcctctagaaaaactgcttaattatctggatcgccaaactgattga

SEQ ID NO: 1284 - DNA, 150 bp, Xenorhabdus bovienii
  Coding DNA location: Contig name=SeqID_16855; Position on contig =66359..66508bp; Strand=+
atgaaaaaggctgagaaaccctgttctcagccctgtttttaccgtctgatgaagaaatattttttatttcaacatcttttacttcaacatattgtattgcgatgccagattatcaagaaaatccaattggctgttgatcaggctggttag

SEQ ID NO: 1285 - DNA, 1053 bp, Xenorhabdus bovienii
  Coding DNA location: Contig name=SeqID_16855; Position on contig =66437..67489bp; Strand=-
atgtctgaaaatatcatctcacaaaaagaaatcgtgtatccagaaatcaatataaaagccctgaatcaagcggtaaataatatctggcgtctggcgcaacgacaaacatcgggtattgcaattatcgaggaaaaaaccaagcggataagtctttattgccgtgatttcgatgaagctgtacgcagttctctatcgcaattggaacccactctaagacagttggccacgcaagaatattttcaaacgattactgaaattgatgaggctttggcagaccccgatctgaatgatgacgatcgcagtgctctgctggaagaacgcgagcaattgattcagaatttggcgaaagatatcgatcatgttatttccaatttccgtgatgaaacgaatcaactgactggcaaaattaacgacattcgcaatatggtgatttcagagcggctgggagaccttctggcgcaagctcaatcacaaaaaaaggaattgcagagcgctatcgagcagaaagccgcagaacaaaataaactggatgcggatcgggctaaaattatcgaaagtcaggatgttatccgccagaataatattgcggatatgtttaaagattttatccccagcggcaatgacatcgataaattggatttcacccagcctaaaaaagaagccatcaaacaggcgattaaacaaggtgtggagatagccagaaaaatactgggcaaagtctccgaagggctgaaatatgcggagctagctgacgctcgagttaaactcagtgaacaaatagatcagttgaccaaagaatctgacactctgaaaaccacgttacaggaaacagagcaacgtctttctggcataacagacacgatacaaatcgacgaagagcgcacaattctcctcgctgaagcggtcaaactggaacaagcgtggaatttattcgccaatcaactacgaaatttatcgggcagccaaatcaatcagaaagatctaaccagcctgatcaacagccaattggattttcttgataatctggcatcgcaatacaatatgttgaagtaa

SEQ ID NO: 1286 - DNA, 1227 bp, Xenorhabdus bovienii
  Coding DNA location: Contig name=SeqID_16855; Position on contig =67532..68758bp; Strand=-
atggagaacgatatgtcattaagtcagttttcagcagaaagtacgataaatggagcagagcttcctgccatcaccttaaaattattgacgagccaaatcgacggtgcagcccgtcctggtggaatctttactaaagaagaccttattagtattaaattatatgttaaacacagtttgtcactcccttttactttggaaaccgtaaagagttatatcggttacaatgatattgatatcgctggattgaaacccgcagatattaccgatttgtttaaagaaattcataaccatgcacttagctggagcggcgtggaagagaatgttcagcagcagagtatcaacctggaaagtgcgggaaaacaaattaccggaacgggagaagatataatcagcattattaacgagatgccgattattcaacgtgtaaaaacgaagctgggagatttaacagagaagcaattggctgaaataacttataccaatgacgataaagaaatatcagtcgaattggggaatatcctcaatagcatggcgaaagatattgagagtcaacaggtaaaaactcaacaggtcaaaacagcagtatctgattttaagcgcacactgattggtggcacgttatcaaacggcaagaaagctgatggattacagccacaggtcaataataagaaaaaactgatggaagataataatctttctatcacgatcaaagatttgaataagaaaattactgagaaaaataatgagattgatcaactcaaaaaagactacgataaatacgttggcttatcattttccggtgcaccgggcggtattatcgggctggctattaccggcggcatttttggtgacaaagcggaaaaagcccgtaaacggaaaaatgcactgattgatgaagtcagcggtttgcaagatcaagttaaaggtaaaagcgcattacaaacgtctattcaaaatttggtcttacagtttggtgacattgatatccgtatgctggatgcggaagttgctctgaaccacctggactttatgtggagcaacatgctgactcaaattaatacctctaaggataagtttgccgaaattaatgatgcactgaaactcacctctttcgtgacagcatttaaacaagtgattagtccttggaaagaagttcaaggttctgcggcgcaattagttaaaactttcgatgaagccttggcagaatataaaaagctcaatagctaa

SEQ ID NO: 1287 - DNA, 183 bp, Xenorhabdus bovienii
  Coding DNA location: Contig name=SeqID_16855; Position on contig =68930..69112bp; Strand=+
atgagtatttacgttgccgttaatgcgaaaaggcagtccttttatccacaaatatactttaatctggtagttttattttatttatctttattaagtaagcatatcaatataaataaaattagatttatttattattttcttaacaggaattattggtttattttattaacacacaatttttag

SEQ ID NO: 1288 - DNA, 114 bp, Xenorhabdus bovienii
  Coding DNA location: Contig name=SeqID_16855; Position on contig =69128..69241bp; Strand=-
gtgcatcaattcgagggcttctttttgggcatctgtcagagtaattttcatgggcgcgatcttgatctgatacgaatgaaaaatcaagtatcttcaattacgatgggtatataa

SEQ ID NO: 1289 - DNA, 1038 bp, Xenorhabdus bovienii
  Coding DNA location: Contig name=SeqID_16855; Position on contig =69191..70228bp; Strand=+
atgaaaattactctgacagatgcccaaaaagaagccctcgaattgatgcacgatacgactcgtgatgggcgcgtacgtgaccgcatcaaggccgtgcttttggcctcagaaggctggactgcccagatgattgcccaggctttgcgtattcatgaaagtacggtgagtcgccatctgaaggattacgtctctgaggaaaaactcgcccctgaaaatggcggctctgaaagccgtttatctgccgaacagacgacagaattagtggagtatctgacggcaaatttgatgcacactaccgcgcaaattgtggcttgtgtctgggcgcgctggcaggtgactttcactgtggctgggatgacaaaatggctccaccgccaagggttcagctacaagaagccgatgggaacgcctcataaatccgatgtgtataaacagcaacactttattaagacctacaacgcgttgaaagctgaatgtggccaaaatgcgcctattttgtttattgatgcgatgcatcctacccagtccacaaaattaagttacggctggatgaggcgcggaagagagcatgtcaaagtggtcgaaaccacaggcagccggacccgccttaacatcatgggcgcactcaatttgcaacggattgaagagaccattattcgtgaatatccgacgattaacgcgaaaaatgttgtcctgtttttcggctcaattcgagaaacctatccgctttcacaaaaaattcatctcattctggatggagccggttaccaccgcgctgaaatagttcaattttttgccgaggtcctgaatatcgagttgcattatctgcccccttacagccctaacctcaacccgattgagcgattatggaagtatgcgaatgagcaggtacgaaacaatatctatttctcggaggcaaaaacattccgtgaaacgctgcatcacttttttcatgtcacattgccagaaaaagcgaaagaactcaccacccggttgacagataatttccagactttaattcctgcatcttcaagttaa

SEQ ID NO: 1290 - DNA, 141 bp, Xenorhabdus bovienii
  Coding DNA location: Contig name=SeqID_16855; Position on contig =70220..70360bp; Strand=-
atggaattgaataattctttattggaaaaattattctatatccttatatcgaggtattattttactccttacctatattatacccactttaactatatggaaattgtgagttataacccttattatacgcaattaacttga

SEQ ID NO: 1291 - DNA, 120 bp, Xenorhabdus bovienii
  Coding DNA location: Contig name=SeqID_16855; Position on contig =70489..70608bp; Strand=-
atgaaattaaactgcccgaatagtgatatcgggcagtttaatttttttattcagaattcagaattcagattaagtcatcatgacttttatattataaaaatttattggttattaaattaa

SEQ ID NO: 1292 - DNA, 426 bp, Xenorhabdus bovienii
  Coding DNA location: Contig name=SeqID_16855; Position on contig =70633..71058bp; Strand=-
atggcgatacgtcttaatgaagatttggacgatagcggtgaattgcatgagattaacgtcacgccatttattgacgtgatgttggtgctgctgattattttcatggtggcagcacccttggcaacggtagatattaaggtaaatttaccggcatcgtcagctaaaccacaaccgcgaccagagaaaccggtctttctgaccgtgaaagcggatcatcagttatatgtcggtgagcagttgattgagcgtgacaagctctcttcagtattggatcagacaactcagtccaataaagaaaccacgattttcttccaagcggataagacggtggattatgaaaccttgatgagtgtgatggattccctgcgtaaagcgggctatctcaaagttggcttggtaggaatggaaaccgttgccgctcaataa

SEQ ID NO: 1293 - DNA, 993 bp, Xenorhabdus bovienii
  Coding DNA location: Contig name=SeqID_16855; Position on contig =71065..72057bp; Strand=-
atgcgtaatttgacagcttctattctattagcactcggattaaccggttcagcatgggctgatacagtacccgtcacaacagcgatttcgccagaaaatcaggcagccgtccaggtagccgcaccggcaacaccagcacccgcactttctactgctccgcaggtagatgttccaaaaactgaagcacagcaaacgggtgaaccgaaaactgatgcccagaaagctgatgctcaacccgcgactgaaacgaaatctactgaacctgtggacgagtctgaaagcctgtccggtggttttgcaacggatctttccgtttggggcatgtatcaaaatgccgatgcggtagtaaaaaccgtgatgttggggttggtgatcgcttctgtcattacatgggcgctctttttctccaaaggtactgaacttttaattgctcgtcgccgtttacgcaaggaacaatgggcattggctgatgcagccaatctggatgtggcagcgaaaattgcttcagatttcggcaagcaaagtatcagccgtctgttgttgagtgaagctcagtctgaacgcgctctgtctgctgcaagcactgacaaatcaggcaccaaagaacgtacttcattccgcatggagcgtgcggttgctgcaatcagccgccatatggggcgtggtaacggctatctggcgaccattggtgccatttcaccgtttgtcggcctgttcggtacagtgtgggggattatgaacagcttcatcggtatcgcccactcacagaccactaatttggccgttgttgctccaggtatcgcagaagcattgctggcgaccgcactgggtctggtggcagcaatcccagcggtagtcatctataacgtttttgcccgtgttatttcgtcataccgtggtcaagtaggggatatggcggcacaggcaattttgttgctgggtcgtgatcttgatctggctgacagcaaagcagaaaaagcagaagcaaggtaa

SEQ ID NO: 1294 - DNA, 102 bp, Xenorhabdus bovienii
  Coding DNA location: Contig name=SeqID_16855; Position on contig =72095..72196bp; Strand=-
atgtctgatatcatttgcgtcggactttttcccctcgtaatgagaagcctgattcagggcatattaggattagcaagatgcgtaaatgcaattcattgctaa

SEQ ID NO: 1295 - DNA, 129 bp, Xenorhabdus bovienii
  Coding DNA location: Contig name=SeqID_16855; Position on contig =72157..72285bp; Strand=-
atggaaacagaagaacactttgatgaaattattcctttaattatcacttttttgttaaatagtaatgataattactatcaaatcgctcaatgtctgatatcatttgcgtcggactttttcccctcgtaa

SEQ ID NO: 1296 - DNA, 1194 bp, Xenorhabdus bovienii
  Coding DNA location: Contig name=SeqID_16855; Position on contig =72406..73599bp; Strand=+
atgaccgaaaagaaactggagaccttattggtcagtgcaggcagaaagaaaaaatatacccaaggtgctgtcaatcccctcatccaacgcacttcatccatcattttcgacaccgtcgaagacctgaaacatgcgttgaaaaaccgggctaagggtgagttattctatggacgccgtggcacgctgactcatttcgcctttcaggaagcgatggcggagctggaaggcggcgcaggctgtgctctctatccttccggcgcggcagcgatcacccatgcgattctggcctttgtggcaacaggcgatcatgttctgctgacagggagtgcttatgaaccgacgcaagatttctgtaatcacattctcaaaaagatgggcatttccactgattattttgacccgatgatcggagaagggattgcatcactgattaagccaaacacaaccgtcgtctttcttgaatcccccggctccctcactatggaagtgcaggatattccggccattgtgcgcgctatccgccagatcaatcctgagattgtcattatcatcgataatacgtgggcggccggcattctctttaaggcgctggattttggcatcgatatttccatccaatcggccacaaaatatatcattggccattcagacggcatgctgggaacggctgtcgctaatgcacgctgctgggatcaactcagagaaagttcgtatctactgggtcaaattgccgatcccgatacggtttatacggcaacccgtggattgcgtacactggcaattcgcttaaaacatcatgaagagagcagcctgcacatcgccaaatggctcgcccagcggccagaagtcgccgaagtttatcaccccgctttgccttcttgtccggggcatcattatttccagcgtgatttcaccggcgccagcgggctattttccttcctgctgaaagtcgaactaacccctcaacaattcgctgagtatctggataatttacatcatttcaaaatggcattttcatggggcggatttgaatccttgattctgggtattcagcctgacatgctcactgcgctgcgtcgatacaatcccctcaaaaagacgggaacattattccgcgtgcatattgggttggaaaacccacaagacctgattgatgatctgtcagccggttttgcccgtattgcacctctttag

SEQ ID NO: 1297 - DNA, 114 bp, Xenorhabdus bovienii
  Coding DNA location: Contig name=SeqID_16855; Position on contig =73559..73672bp; Strand=+
atgatctgtcagccggttttgcccgtattgcacctctttagccccaaaagaccgtactccagaaatctttacaaaaatcatggctgtctttctattgcagatagccacggttga

SEQ ID NO: 1298 - DNA, 135 bp, Xenorhabdus bovienii
  Coding DNA location: Contig name=SeqID_16855; Position on contig =73704..73838bp; Strand=+
atgctgaatcaaatcaactccccttccgcgtttttgcggtacactggttggcatgtatttttaatgactcgcagaaattacaggataaataatggaaaagttaagcgagatcatgcatgcactctggcaacatga

SEQ ID NO: 1299 - DNA, 672 bp, Xenorhabdus bovienii
  Coding DNA location: Contig name=SeqID_16855; Position on contig =73795..74466bp; Strand=+
atggaaaagttaagcgagatcatgcatgcactctggcaacatgattttacccaactcgccaatcccgaggtcatctggattatttatggtgtcctctttgtcactctggttctggaaaacggcttgctgccagccgcttttttgcccggcgataccctgttggtactttctggcgccctgattgccaaaggcgtcatgagcttcatccctacggttatattgctgaccatcgccgccagtctgggatgctggctgggttacttacaggggcgctggctcggccatacccgaattgtcaaaaactggcttgcccagcttcctgtgcaatatcgcgagcgtgcccacgtattatttgctaaacatggcttggccgctttgcttatcggacgctttttagcctttgtccgcactctcctgccaacatttgccggtatttctggtctaaatagtaaacgttttcaattttttaattggttaagtggcttcttatgggtcatgattatcgtgagttttggctatatcttgaatcagatccccttcgttaaagcacatcaggatctggtcatgaatattttgatgatcctgcctgtcattctgttgttcagcgggcttttcgcttctctgttgatgtactggcgtcacaaaaagacatcatcaaaaaaaagtaagtaa

SEQ ID NO: 1300 - DNA, 111 bp, Xenorhabdus bovienii
  Coding DNA location: Contig name=SeqID_16855; Position on contig =74449..74559bp; Strand=-
atgatgactgacaaccgaaatatggttagtgaaataggtaaattttttggctatatcgacagtattttaaatagaggtaagcgacaagtatgtttacttacttttttttga

SEQ ID NO: 1301 - DNA, 840 bp, Xenorhabdus bovienii
  Coding DNA location: Contig name=SeqID_16855; Position on contig =74655..75494bp; Strand=+
atggatcagcagacaattattaagctcgttgatggcaatcttatgccacaattggggctaggcgtttggcaagcgagtaatgatcaggttgttaaagctgttcgcactgccctggaggttggctatcgttccattgatactgcggcgatttatcacaacgaaagcggagtcggaaaagcattaaaggaaatcgacatcccgcgtgaagaaattttcgtcaccactaagctctggaatgatcgccaccaagatgccaaagcagcattagaagaaagtttggataagctgcaacttgattacatcgatctctatttacttcactggcctgttcctcatcaggatcaatatgttgaagcctggaagcaacttattgaactgaaagaatctgggctggctcgtagtattggtgtatgtaattttcacattgaacacttacagaaattgatgtcagaaacgagcgtcgttcccgcaatcaaccaaatcgaattgcaccctctgatgcagcaaagacaactgcattcatggaatgcaactcaccatattacgactgaatcctggagcccattgtcacaaggtggaaaaggcgtctttgacaacccattggttcaacatctggccattaaatatcaaaaaacccctgcgcaaatcgtgattcgctggcaccttgactgcggcatgattgctattcccaaatctgtcacgccttcccgtatcaaagagaactttgatgtatttgatttcagattggaaaaagaagatttaacggctatggctgaattggatattggcaaacgcatggggccaaaccccgatacttatactggcgatcacgtcaaataa

SEQ ID NO: 1302 - DNA, 300 bp, Xenorhabdus bovienii
  Coding DNA location: Contig name=SeqID_16855; Position on contig =75824..76123bp; Strand=+
atgacttacatcataatttctttattaatgctgatcccttttttctttttggtgaaacggttcctattatcaaatcatgttcatcataatgtatctggcattattctgacggtagttgcgattgctattcatatgtatatctttcgcttcgatagagtcccgattgtcagcgtttccattcccaatatcgtcgcttacggctctatcgtgattgcactgttacatggcatgatctattccgtctgctttagactgtattttgacaagggatcttatgatgagcattcaaggagtgattaa

SEQ ID NO: 1303 - DNA, 3225 bp, Xenorhabdus bovienii
  Coding DNA location: Contig name=SeqID_16855; Position on contig =76206..79430bp; Strand=-
atggcaaaacgtactgatattaaaagtatcctgatcttaggtgcgggtccgattgttatcggccaggcttgtgaatttgactactccggcgctcaggcttgtaaagcgttacgggaagaaggctatcgcgtcattctggtgaactccaaccctgctaccatcatgactgatccggaaatggcagatgcgacctatatcgaaccaatccattgggaagtggttcgcaaaatcattgaaaaagagcgtccagacgcaattctgcctactatgggcgggcaaactgccctgaactgtgcactggaactggaacgtcagggcgtactgacagaatttggcgtgaccatgattggtgcaaccgctgacgcgattgataaagcagaagatcgtcagcgttttgacaaagcgatgaaaaaaatcggtctggatactgcgcgttctggtattgcccacacgatggaagaagcgctggcagtggcagaagacgttggcttcccttgtatcatccgtccttctttcaccatgggcggaagcggtggcggtattgcttataaccgtgaagaatttgaagaaatttgtgagcgcggtctggatctctccccaaccaacgaattattgatcgatgaatcactgattggctggaaagagtatgaaatggaagtggtgcgggataaaaatgacaactgcatcatcatctgtgcgattgaaaacttcgacccaatgggtatccatacgggtgactccatcaccgtagcgccagcacaaacactgactgacaaagagtatcagatcatgcgtaacgcttcgatggcggtattgcgtgaaattggtgtagaaactggtggctcgaacgttcaattttccgtgaacccgaaaaatggccgtttgattgtgattgagatgaacccacgcgtatcccgttcatctgcgctggcttccaaggcgacgggcttcccgatcgcaaaaatcgcggcaaaactggcggtgggttatacccttgatgaattaatgaatgacatcacgggcggccgtacaccggcatctttcgagccttctatcgattatgtcgttaccaagatcccgcgtttcaactttgaaaaatttgttggcagcaatgaccgcctgacaacccaaatgaaatctgtcggtgaagtgatggcgattggccgtacttttcaggaatctctgcaaaaagccctgcgtggtctggaagttggcgtgacagggttcgatcctaaagtcaatctggatgatccacagtcactgaccaagatccgcagcgaattgaaaagtgccggtgctgaacgcatctggtatgttgccgatgctttccgcgcgggtatgtctgttgatggcgttttcaatctgactaacattgatcgctggttcttggtacagattgaagaactggtgcgtttggaagagcaggtggaagaacagggcattaatggcctgacgtttgatttcctgcgtcatctcaagcgcaaaggctttgcggatgcacatttggcgaaactggtcggtgtatctggcaaagagatccgcaaattacgtcacgattacagcctgtatccggtttataaacgtgttgatacttgtgcggcagaattttcgaccgatactgcttacatgtactccacgtatgaagacgaatgtgaatccaatccgaaccatgacaagccgaaaatcatggtattgggtggcggcccgaaccgtatcgggcaaggcattgaattcgattactgttgtgtacatgcgtcactggcactgcgtgaagacggttacgaaaccatcatggtgaactgtaatcccgaaaccgtttcaacggattacgacacttccgaccgcctctattttgaacccgtgacactggaagacgtgctggaaatcgtccgtgttgaaaaaccaacaggtgtaatcgtccagtatggcggccagacgccgttgaaactggcgcgtgagctggaagcagccggtgtaccgattatcggcaccagcccggatgctattgaccgtgcagaagaccgtgaacgtttccagcaggctgttaatcgtctcggtttgaaacaacctgcgaatgctaccgtctccaccatcgaacaggcggttgagaaaggtaatgggcttggctatccgctggtggttcgcccatcctacgtgctgggtggacgtgcgatggaaatcgtctatgacgaaactgacctgcgccgttacttccagaatgcagtcagcgtatccaatgacgcccccgtattgctggatcgcttccttgatgatgcggttgaagtcgatgttgatgctatctgtgatggtgagcgtgtcttgattggcggcatcatggagcatatcgaacaggcaggagtccactccggcgactcagcgtgttcactgccagcttacacgttgagccaagaaattcaggacgtgatgcgccagcaagttgaaaaactggcctttgaattacgtgtccgtggcttgatgaatgtacagtttgcagtgaaaaataacgaagtgtacctgattgaagtgaacccgcgtgcggcacgtaccgttccctttgtttccaaagcgaccggtctgccgttggcaaaagtggctgcacgggtgatggcgggtcaatctctgctgaaacagggcgtcactaaggaaatcattcctccgtactactctgtgaaagaagtggttctgccgttcaataaattccttggtgttgaccccattctggggccggaaatgcgttctacaggtgaagttatgggtgttggccgtactttcgctgaagccttctccaaagcgatgctgggcagcagctccacgatgggcaagaacggccgtgccctgttgtctgtacgtgaagaagataaagcgcgcgttgttgatttggccgccaaactgctcaaacagggctttgaactggatgcgacccacggtacagcgattgtgttgggtgaagcggggatcaatccacgtctggtgaacaaagttcatgaaggacgtccgcatattcaggatagaatcaaaaacggtgaatataactatatcgttaataccaccgcaggccgtcaggccattgaagattcaaaactgctgcgtcgtagcgcactgcaatataaagtgcactatgacaccaccctgaatggcggttttgcgactaccatggcactcagcgcagatcccactgagcaggtgatttctgtacaggaaatgcacgcaaaaattaccggataa

SEQ ID NO: 1304 - DNA, 1275 bp, Xenorhabdus bovienii
  Coding DNA location: Contig name=SeqID_16855; Position on contig =79448..80722bp; Strand=-
atgcgcgcaatttgccaaaattttgacaaaaatcatcaattggcattgattcaatggattatttctgcattaatatgcatcggatgcgacttgttattcattctggagggcgttttgattaagttagctatattggttctcgaagatggaacccaatttcatggtcgcgccattggtgcagagggtgtggctgttggagaagtggtcttcaatacctcaataaccggatatcaagaaatacttaccgacccttcctattcccgccaaattgttactcttacttatccccatattggtaataccggcatcaatgccgctgatgaagaatcccccgctattcaagcccaaggcctggtcattcgcgatttacctttagtgaccagcaacttccgcagtgaagaaaatctgtctgattacctgaaacgccacaacattgttgccattgctgatattgatacacgcaagctgacccgcctgttacgggaaaaaggtgctcagaacggctgtatcattgcgggtaatgaggcagatgctcaggttgctctggaaaaagcgaaagctttccccggcttgaaaggcatggatctggcgaaagaagtgaccaccgcacaatcttattcgtggttacagggaagctggacattggcagacgggctaccggaagctcgtaaagagcaagaattgccgtaccacattgtggcttatgatttcggtgtcaaacgtaacatcctgcgtatgttggtggatcgtggctgtcgcgtaaccgttgttcctgctcaaacacctgcggatgaagtgctgaaaatggcaccggatggcattttcctgtctaatggccccggcgatccagagccttgtgattatgccattgaagcaatccaggctttcctgaataccgagatcccagtatttggtatctgtttggggcaccagttactggcgctggccagtggtgcaaaaacggtaaaaatgaaatttggtcatcacggcggcaaccatcctgttaaggacttggagaacaatgtcgtcatgatcaccgcacaaaatcacggtttcgccgttgatgaaagcactttaccagcgaatcttcgtgtgactcataagtcactatttgatggcacactgcaaggtatccatcgcactgacaaacctgcattcagttttcaggggcatcctgaagcaagccctggcccacatgaagccgcttccctgttcgaccacttcattgaattgattgaacagcatcgtcagaaccacgttcagaacaccaagtaa

SEQ ID NO: 1305 - DNA, 150 bp, Xenorhabdus bovienii
  Coding DNA location: Contig name=SeqID_16855; Position on contig =80674..80823bp; Strand=-
ttgttctttttaggtgtgttcactcaatgtagggctgagatttgtaaaaaagccaataaaaaaggtgttttttgtagacaagcccctctctcatcattagaatgcgcgcaatttgccaaaattttgacaaaaatcatcaattggcattga

SEQ ID NO: 1306 - DNA, 822 bp, Xenorhabdus bovienii
  Coding DNA location: Contig name=SeqID_16855; Position on contig =81045..81866bp; Strand=-
atggctgatacagatattcgcgttgctgttgtaggcgcaagtggccgtatggggcgtcatctcattcaggcagtccagcagttagatggcgctacgcttggtgcggcgctggagcgttcaggttcttcattggtgggaacagatgcgggagaactggcaggtatcggcaagaatggtattaccatcagtgatgatctgcatggtgttattgagcattttgatgtcctgatcgattttacccgaccagaaggtacactcgcttacctcgcaatctgccgccagtatcgcaaggcaatggtcatcggcacgacagggtttgatgacgcaggcaaacaggcgattgaagacgcttctcgtgatattcctatcgtctttgccgctaatttcagtgtcggtgttaatctggtgctgaaactactggaaaaagccgccacagtgatgggggagtatacagatatcgaaatcattgaagctcatcatcgtcataaagtggatgctccgtcaggaacagcgctggcaatgggcgaatctatcgcccatgctttagggcgtgatcttaaaacctgtggggtctatgcccgcgaaggtcatactggtgagcgtgacccgaaaagtatcggatttgcgacggtgagggcgggtgatatcgttggagaacataccgcgatttttgcagatattggtgagcgtgtagaaataagtcacaaagcttcaagccgtatgacctttgctaatggagctattaaagctgcaatatggttgaatgctaaaaacaatgacctttatgatatgaaagacgtccttaatcttgaaaatttataa

SEQ ID NO: 1307 - DNA, 99 bp, Xenorhabdus bovienii
  Coding DNA location: Contig name=SeqID_16855; Position on contig =82053..82151bp; Strand=-
atgaccaactggcttatattggtaattcttttattttattgggatagtgaccgggaatatagtgaaaagcggctaaagaggtatcacctgagagtctaa

SEQ ID NO: 1308 - DNA, 1389 bp, Xenorhabdus bovienii
  Coding DNA location: Contig name=SeqID_16855; Position on contig =82667..84055bp; Strand=+
atgagtaatagatacaaaacagttgttgttttaggtgctggtccaattggactattttctgcttttaaaatattagaaaataatttttcagaaaatgtattaattttagataaacggttgaactctgctcatacccttaagggatgggcagaaagatcaatggttgtacaattccatagaaagcttttttctctatcttaccttccagaaataatgcaaaagtgccctcatggagtgcttaaagaagattatgaagataatcggaagaaatatagtgacttagatcacatgagcataaaaaacatccaatcaacaatactcgaaaatatagaaaagaattataaaaatcgtttttttatgatgggtttaaaagatatatccactgataatgatattatttcaatttctatttcttcagatgactatgagagtaaccaaattttaagtaatttaagtccggaattaattgtagatgcaactggctatcattccattttaatgaataaaacaataggcgttcattttgaaagcgagtatgaatatggttcggctctaaaaataacttggccagaacatgaaatgactcatattgaaaataaagaaactgagtttcatgattgtcatgaaaacacactcttttttagcgaaggaaattcatcagtagctgagttttcatatccctctgataaattcagtaggttttttgaagaatgtgggtattctataaatcacatgagcactaaattaccctttctaaaatttgacacaacacctttttcaataaaattaccaccattcttagaaaaaataacatctcttaagaagaacgattttctatataaaagagcagttgatttattcaatacgattagaaaaaataaacttgctggtattaatggattagaattcattaattatttgcaaggtttcaattggtcagaggcagacaatcttgctttagtcattcgtagaataatagataaaagagtgactgtagaaaacacatatactgaccttgaagaaaactttttagatttaacgaaaattagagttacttttgtaccttctagagccgagagatggctatcaacaaataaagtaacaacaaaaattaatcttatattttcgaatgataatggtaagttacataatcaagtttgttcagtaacagcttgcgctgtcggagatagtctagctaacacagactttagacatggtcttggcatcaatcgaggatttcacacagcaactagattatttcaagataaaacagatccagaatcagtaaggcttgaattgataaaaaacagctactctatgctagatgttataaatgataattcaatatttagtagagctatttcgtgcagagattggcttaccctatag

SEQ ID NO: 1309 - DNA, 795 bp, Xenorhabdus bovienii
  Coding DNA location: Contig name=SeqID_16855; Position on contig =84252..85046bp; Strand=+
atgtatatagatatattaattataatatctgcatttgttggaagtatcctatctgggctctttggtgggggggcgggcttgatttttacacctacaatttatttatttttatcttataccaacccaaattccagttatatcatgcaaactagcatcacaacgatgatagcttctttaatgatatctggtctagttgctattgttaaacatcacaaatacaaacatattgattggaatgttctaaaatggtctgctccactaattataatggggtcaatactaggttgttttactataactgttgcttcaagtcaatcggttatatatatcttttctttagcaacaataattttggcgattaggtcaacacgaaaattaatttctaataatccacaaaataatacaaatagagatcttggttggtcattccgttatattggtggttttttactaggattaatatcaactttatccggatcagcttcatttgctgttccttattatgagagcatcggtttaaatattaaaaaatcaatagggacaacaactgttgtagtctggttgtattctgtatttgtactaatatttatgatatcactcggtctaaataaaaataatttaccacctggaaatataggttttttaaattataattacctctggttattcataataccaacaataccaggagcattgttaggcgcaaaattagccaatgttcttccggaaagaaagctaagaatttcctttacagcactattgtattttattggattaagtatgttattttcataa

SEQ ID NO: 1310 - DNA, 93 bp, Xenorhabdus bovienii
  Coding DNA location: Contig name=SeqID_16855; Position on contig =85041..85133bp; Strand=-
atgaccaaaaacatacactctcaccttgttgcaattatatataggtttgctaatgcccaagcttacaggttatcaaaagtagatgcattatga

SEQ ID NO: 1311 - DNA, 570 bp, Xenorhabdus bovienii
  Coding DNA location: Contig name=SeqID_16855; Position on contig =85139..85708bp; Strand=-
atgtataactcatataaactcagtgaaattaattttttgaacgataagcattatgccctttatcaggtaggaaaaccacggcagacttgggactgtgaattgaactggaaattggttgccaatgatctaatccccgaacgtttgcgcgatactgctgttactgtcgccagtctgtcagacaatgtagaaatacttggaatggaaaatgcggcaggactgttattacaatccaatgatttttttctaaaaatagggcttgctcaagcagttaatgacgaagcccgtcattctgaattgtttgctaaatatgccattctagccaacggaaaaattaaagatttgtctaggacaagagacatctatctcgagcactttgcggagctgaagacttttgaagatatagatgtctttataatagccaggataggagaaaaatcggcgtattttttcagtttcatgttgatatctcacattgatattaatcaaaatagcaagcttgtgagatgtcaagaattattaaaccacaacaattttagggtgggagtatacgtttatcaatatttaatttaa

SEQ ID NO: 1312 - DNA, 1086 bp, Xenorhabdus bovienii
  Coding DNA location: Contig name=SeqID_16855; Position on contig =85701..86786bp; Strand=-
ttgaatgccgaacctcttcagttaggaattcttggtgcatgtttttctttacctttcctcttttctagttatttatttggggaagcttttgatagatatgaaattcgacagttcagaatattgttgtttgcagttaatgtgtgtgtaatgccatccataggtttagggcatagtattctcgtactttatgctgcagcttttattaaaactgcggccaggtgtggaattaatatttcaaatacaaaactgaataagaatgatgaagaaactagccggttttatgaaatctatggatatttaattaatttcagtaggataattattccattgattgtcgtcggcacatatggtctttggggaatatggtttgtcatcggactctccgtcatcttaaatttgctagcagcgctaagttcattttttgaccaaacacaatatcactgctcagaaatttctcagattaccaaacagtcagaatcatattcatttttagaaatgatattgaaaaagcagaaattgagtattcttgttaccgcatatacgatttcgaatctagctttttatctcagtaatgacatgttgggaattttctttaaagcaatagggcagaatgaaaacagtattggtgttatcatttctttaatggggcttggcggttttgcaggaactaaattggcttcatttctgatcaaaaaaataatggcaaaatcagttctactttcctccatttttaccaatgttgtagcgtttacttgctttggtttcttatcttcaaataccacttctgttttagttttttatgtggccatagtgctagtagggatatcatcgggaattactttttttgccgtacgttatggtgtcagaaacatggtgggttacgaaaacgtagggaaagcaacaggtataattcagatgttatccgctgtggtagcaataattatgccgattaccggaggttttattgccaattattatggcatagacacaactttccgtataaccagtattattctcggtattaccttagtttatttcattttattcaacaaaaaaaataataaaaggaagcatagatatgtataa

SEQ ID NO: 1313 - DNA, 141 bp, Xenorhabdus bovienii
  Coding DNA location: Contig name=SeqID_16855; Position on contig =86747..86887bp; Strand=+
atgcaccaagaattcctaactgaagaggttcggcattcaataaatagcaataatattaaatattgcatagtccagatatgtgtcaagttcattagcgcctatgccaatatattttatcatttttggatttccattatttaa

SEQ ID NO: 1314 - DNA, 102 bp, Xenorhabdus bovienii
  Coding DNA location: Contig name=SeqID_16855; Position on contig =86941..87042bp; Strand=-
atgagttgcctatattataatttaccttgcaagaaaataataatcttactatctctggataggagggaggatattatagattgtcaaccattatgtgcttaa

SEQ ID NO: 1315 - DNA, 777 bp, Xenorhabdus bovienii
  Coding DNA location: Contig name=SeqID_16855; Position on contig =87545..88321bp; Strand=-
atgagagtgtttactgtcaactatataagtaagcttaatgaccaatggagagagattgattacataattgatttggcagatgaacacatatataaccatattgatacatataatagtctatgtcgttcggctatggtattatgtgtatcacatatggaaaatttttataaggaattagttaaaaacttcatttcagatatagaaaaaatggattttaaactacttcccaatgcaatgaaaagacaattctgcaggaattttattggatacgaagaaaatgaggaaaataataaaaaggtggaaatattaattaaagaattagaacaacatggtaattttaaattatcttacgatgcttttttaccaagcaaaaataaaaatccaaaaccaagaataattgaatcaatatgtgacaacttaggaacaaaaaaaatattcaaacaactgaatggaacgatatttgataacgtattttctatgacagataaggaaatagaaaaattcggaaaaatcatagatatatccgtaaagaaaaggttatcaaaacaagagaaattagatacctttgcgttaacaaaaaaaacacagttaatacaatcaaaagacagaagtctttgggagtcattttttgataatatcaatagaaaaagacatgatattgctcatggtaatgtttttgaaaattcaacatccacatcagaattaagagtaataaagaacaaatgtaaaatttttcaaaaaatttgtattatcattatattttcaaatcttaactaa

SEQ ID NO: 1316 - DNA, 102 bp, Xenorhabdus bovienii
  Coding DNA location: Contig name=SeqID_16855; Position on contig =88321..88422bp; Strand=-
ttgtttaacgatcctggctacgtagatgcgtgctctggaagttataacgatatatcaaaattaagaactagaatgattaaagctacggagttatataaataa

SEQ ID NO: 1317 - DNA, 630 bp, Xenorhabdus bovienii
  Coding DNA location: Contig name=SeqID_16855; Position on contig =88446..89075bp; Strand=-
atgaaaaataaataccctttatctggattagaggtattatcctcattaaatgatgcttactataaagatttacctgcgttcttaataagaagattagaagaaagaaccattaaatgtctaagaatagattcaactattgattctcaagtaaaatatgatatatttgaaagacttaatacaggtgcattaaaactagaatcacaagaactaagaaatgccatctatagagggccatttaaagatctcctcattgaattatgctcaaatagtgattttaaaaacacaacaaatttgagcgataaaaaaatagcaaaaatggatgatcaggaaatcattcttagattcttttcgttacattacaaagatggatataaagaatataaaggcggatttaaaaaattcctaaatgataaaatggaggtttttaacgggttaagtgaaaatgatctaaaagaaatgaaaagtaaatttgaagaaacattcaaaagaattgcaaatagcaacattgaaaaaccattttcaaactggggcaataaaaaaacaatcggtgaggtgaagaaaaaatcaaacttcaatgttgctgtatatgacacagtttgcaaaatatattttttaggagataaaaaataa

SEQ ID NO: 1318 - DNA, 219 bp, Xenorhabdus bovienii
  Coding DNA location: Contig name=SeqID_16855; Position on contig =89544..89762bp; Strand=+
atgaacacgatcaaacactacctcacttccgataaccgggatttgtatatcgaactcttgaaaggcattcgcgactctatagcgaaatcgaagatctcgtcacgggttaaccggatggttaccggaaatttcggtgatcataaaccttgtagagagcgtgtctgggagcttcgcgtagatcaggctattgaatgtctgaaggactatttgaagaggtga

SEQ ID NO: 1319 - DNA, 369 bp, Xenorhabdus bovienii
  Coding DNA location: Contig name=SeqID_16855; Position on contig =89735..90103bp; Strand=+
atgtctgaaggactatttgaagaggtgattatgaccaaagcacgtttacatgatgatacaatggtgcagcttctccgtgaagatactgagtttgcacagcattatttgcatcaggcattcgttgatatggatgaagaaggcggacaggaagcactccttatggcattacgccatgttgtagaagcgcgaggaggcatggcgcagattgcagataaagcgggcgtttcacgtgagacgctatatcgaacactgtcgcctaagggtaatccgacattgaaaactttgcgtaattgggattcagacccctcatacgtcagagcagaagaagttaaaatatattcttattctatctgttttatccatgattaa

SEQ ID NO: 1320 - DNA, 186 bp, Xenorhabdus bovienii
  Coding DNA location: Contig name=SeqID_16855; Position on contig =90041..90226bp; Strand=-
atgttccttgtacgtaccaccaaaagctacaaggccaggattacatctcaacaccctgattatttcatcgtagagaacgtcgatcttaacaagcatacttttacacaaaggacaaaggcagacttaatcatggataaaacagatagaataagaatatattttaacttcttctgctctgacgtatga

SEQ ID NO: 1321 - DNA, 123 bp, Xenorhabdus bovienii
  Coding DNA location: Contig name=SeqID_16855; Position on contig =90452..90574bp; Strand=+
atgtttgaaaatctcacagcagctgcaagtgagctaatccctggaaatatagacagttatgtgactggttcaggtgaacacagccaactacgccgcaatttgaaagatgaaggacatacataa

SEQ ID NO: 1322 - DNA, 843 bp, Xenorhabdus bovienii
  Coding DNA location: Contig name=SeqID_16855; Position on contig =90611..91453bp; Strand=+
atggcaaaacaggaaaacgtaaaagaatacaccaatttttttcatcttaaagaattcggtggattggaaatgcttaaggcaagctaccataagcaggttttctcccgtcatgtccatgaaactttttgtataggtgttatagaagaaggggcacaacgtttccaccgtacaggcacagaacatatcgctcccaaaggcgatattattctggttaatgcagatgaaattcatactggttcttccgcgggagtggcaggctggtcatatcaggcaatctatccaccacctgatttactgctttcattatcacgtgatttaaaacatgctgatggcgctatcccttggtttccctctgctgtcgtgcgtgatcccggcttggccgaacaattacgtatgacttttgatatattggcacaaaatagcaatatgttgcttaaggaaacaatgctgctatcttcactttcctggttgataatgcggcatagtcagacgcgtattacaacacaagagctgccttccgctgaacgacaaatatttatgaccaaaaaatatattgatgcttatgcagaaaatgatatttctctcagtcaattggcagagatggctcagcttagtcaatggcattttctacggcagtttaagaaaaccatcggcgtcactccccatgtttacctgatttttgcccgtttacgcatggcgagaaggttgttattggctggccactccatacttaatacggctatccgctgcggattttctgatcaaagccatttcaatcgtcattttaaacatgcactgggtattactcccggcatatttgtacgctccctgcaaacaccttag

SEQ ID NO: 1323 - DNA, 156 bp, Xenorhabdus bovienii
  Coding DNA location: Contig name=SeqID_16855; Position on contig =91401..91556bp; Strand=+
atgcactgggtattactcccggcatatttgtacgctccctgcaaacaccttagtcagcatcttttattaacctatttggtcagtattttaccatatcctgacaacatatttttttatcgcaattttattcaatactcctgcactctctattcgtaa

SEQ ID NO: 1324 - DNA, 735 bp, Xenorhabdus bovienii
  Coding DNA location: Contig name=SeqID_16855; Position on contig =91605..92339bp; Strand=+
atggaaaaatcattaactgatacagaaactgtcgtccagccagccattccatcttggcgaagttttttgtctggcatgtatcatatgttaccactttgcctgtcagttattccctgggggatccttgctggctcggttgccgtacaatcaggattaacgctagggcaaagcatcggcatgtcagccatcctgtttgcaggagctgcacaattagttacgcttgggttactggcatctggtgccagtgtattcactattattatttcggtcttttttatcacagcccaacattttctctatggtttaactttacgggaatatgttgctatcttaaaagctcgctatcgattacccattggctttttgctcactgatgagttgtttgcgctaagttgcgctcaacaaaataaatcctctttaactcctagttacttaattggggcaggattgtgtttttatctatgctggaatctctttagtttactggggatcgtaatggcttccaccattcccgatctggcgaaatatcatctggatttttcaattgttgccacattcattactatcgtcattccgatgattaaaaaaatcagcatattttgtggtgtctgtttttcattgactttgtccatgctgttatcttatttacatgttgaaggcgcaattatcattgcgggtgtcagtggcatgttcttttctgtacttatcgccaaactggctaaggagtcaacatga

SEQ ID NO: 1325 - DNA, 327 bp, Xenorhabdus bovienii
  Coding DNA location: Contig name=SeqID_16855; Position on contig =92336..92662bp; Strand=+
atgagctggaccttgatttttgttttagccagcattgtattttttaaccggtatatttttctagaacctaaaatgccggtaaagttacctagaatattaaatgaatccctaaaatattccgcaccttgcttacttattgcaatatgtggccctattattttaatggaacaaggagaattaagagaattcactaataatccttatttatggggagcattactaaccactatttttgctttttttatccgaaacctcgtcgtatgtgtcattatcagcctaatcggcgttttatatcttatccgctattttatagataggaggacataa

SEQ ID NO: 1326 - DNA, 1158 bp, Xenorhabdus bovienii
  Coding DNA location: Contig name=SeqID_16855; Position on contig =92662..93819bp; Strand=+
atgaagacaggcattgatttttatagtgagtctactaccatccggaatacatacaaaatattaccctttcaaggattatggagttggttaacaggaaaagatattcctaacaggaaatcattatggaaatctagttctattgaaatgatatgttggtctattagttgggttgtggtcggcactctagttatttatttcgcacttaatagtgaattgaagttacctgttaaaattataatttatttaattggtgtattattttccacttcaggtgccagatatattgttgcaactatcattcaccaaggtgtacatggaaatttactctcaactcaaacacgcaataaaattatatgtgaaattttatctacaatattaataacccagccttatagttcataccgtcaattccatatctatgagcatcatggcaaagatttttcaacaatagaagataaggatctcgcagcaatatataaattgggatttacgcctggaaagtcaaaaaaacaactctaccttaatttacttttaaccctattcagcccctattttcatttgtcatacctttatggccggattaaatccaacttaataggcgttcctgtttaccgattcatcatgacaatcactcagtttctatttttgggttacctggcttggtttattggtatcataccttttgtgctgtttatcatcgttccctacgtgattgtgtatcaaatagcgtcactattacatttaataactgaacatgtttggttattacgtcagaagaaagaaactgttcgtgatagccatattaataactctctagggcgtttctgtggctcaccttgtcccaaaagttttgcattaagatattggctatcttggataatatgggctatcaaacacttattctatcatttacctgttcgaatgctggtattgcaaggttcactgatttgtcacgactggcatcaccgcacaagtagcattaaagaatggtatgactacacagtattaagggaagctaacgcagaaaaactggccaaagaaggtaaatatgactacattgagttctggggtttccacaactgcctgaattacgtgttaacaatgatcagtaatgccgaacctgtagaagttagcaatttaaaataccgacttaattaa

SEQ ID NO: 1327 - DNA, 954 bp, Xenorhabdus bovienii
  Coding DNA location: Contig name=SeqID_16855; Position on contig =94003..94956bp; Strand=-
atgcaaatattgctggctaatccccgtggtttctgtgccggtgttgatcgtgccatcagcatcgttgagcgtgcgttggaactgtatggcgcaccgatttatgttcgtcatgaagtggttcacaatcgctatgtcgttgacaatctcagggaacgtggcgctattttcattgaagacattgcagaagtccctgatggtgcgattctgatcttttcagcacatggtgtttctcaggctattcgtgcggaagcccgctctcgtaatttaaccatgctatttgatgccacttgcccactggtgacaaaagtgcatatggaagtggcacgggcgagtcgcaaaggcaaagaagcaattctgatcggtcatgcaggccatcctgaagtggaaggcacgatggggcaatacaataaccctgaaggcggcatgtatctggtggaatcaccggcagatgtgtggaaactgcaggttaaggatgaaaataacctctgctttatgactcagacgacgctttctgtggatgacacatcagaagtgatcgatgcgctgaatgcacgttttccgaacattgttggcccacgcaaagatgatatctgttatgccacgactaaccgtcaggaagcagttcgtgacttggcatcaggtgccgatgtggtcttggtggtaggctcgaaaaattcatcaaattcaaaccgtctggctgaactggcacagcgggtaggtaaacctgcttatttgattgattcggcggatgatatcaaatcagagtggatcaaaggtgtgaacgccattggtgtgactgcgggagcatctgcgccggatatcttagttcagcaggttattgaacgtttgaaggcctttggcgcggataccgtcaccgaactgcatggccgtgaagagaatattgtctttgaagtgccaaaagaattgagagttgaggtgaaagaggttaattaa

SEQ ID NO: 1328 - DNA, 471 bp, Xenorhabdus bovienii
  Coding DNA location: Contig name=SeqID_16855; Position on contig =94937..95407bp; Strand=-
atgtcaacgcaggtgcaagtgcacagtgcagttttattacacttcacattaaagctggatgatggctcaacggcagactctacttacagtcaaggtaagcctgcgttattccgcttgggtgatggtagcctctctgagccattggaacagcagcttcttggcttgaaagtgggtgataaacatcaattcacgctggcgggagaagccattttcggcaaacccaatcctgatttggtgcaatattttacaccccgtgattttgccgatgccggtattcctgaagtgggaaccatcatgctatttactgccatgaatggcagtgaaatgccgggtttagtcaaagaagtggctgaaggttccatcatcgttgattttaaccatccgctggctgaccaaaacatcacttttgacattgaagtgctggagattgaccctcagttggaggaaaatcatgcaaatattgctggctaa

SEQ ID NO: 1329 - DNA, 120 bp, Xenorhabdus bovienii
  Coding DNA location: Contig name=SeqID_16855; Position on contig =95426..95545bp; Strand=-
atgacaagaaaacagcatcgaaatcacaataagaaatcagccccggtcaatggtactggggctgataatttcatctatacccaatcagtttcaacgggtatatgtgcaatcattttttga

SEQ ID NO: 1330 - DNA, 510 bp, Xenorhabdus bovienii
  Coding DNA location: Contig name=SeqID_16855; Position on contig =95514..96023bp; Strand=-
atgaataaacccatttgttccactggtctccgctggctttggctggttgtagtggtattgatactggatttaggaagcaaacagttagtgttgcagcatttcacactgtatgaatccactccattgataccttatttcaatctgacttatgctcagaatccgggggctgcattcagttttctcgctgataagggcggctggcagcgctggttctttgcattggtggctatcatcatctctgctgtactgctggtgatgatgtaccgctctagtgccaagcagaaactgagtaatgctgcttacgccttggtgattggtggggcattggggaatttgttcgatcggctggtacatggctttgttgtcgatttcatcgacttttacgtcggggaatggcactggcctacttttaatattgcagattctgcgatctgtatcggggcagctttcatcatcatagagagctttatcagcccggatgacaagaaaacagcatcgaaatcacaataa

SEQ ID NO: 1331 - DNA, 2814 bp, Xenorhabdus bovienii
  Coding DNA location: Contig name=SeqID_16855; Position on contig =96023..98836bp; Strand=-
atgagtgactataaagacaccctgaacctaccggaaacagggttcccgatgcgcggggatttagccaagcgcgaaccagatatgttgaaacgttggtacaaagaaggtttgtatcaggcgattagaaaagctaaatcgggtaaaaaaacatttattttgcatgatggccctccctatgcaaacggcgatattcatattggtcactcagtcaataaaattctcaaagatattgttattaagtccaaagggttgtcaggctacgattcgccttatattcctggttgggactgccacggtttgccaattgagctcaaggttgagcagattattggcaagccgggggaaaaattttccgccgctgaattccgtgctgagtgccgcaaatatgcaatgagccaggtcgaagtacaaagagcgggtttcatgcgtctgggggttctgggcgactgggataaaccttatctgacaatggatttcaaaaccgaagccgatatcattcgtgcgctgggtcgtatcatcggtaacggtcatttgctgaaaggcgttaaacccgttcattggtgtactgactgtggctcctcccttgcagaagccgaagttgaatattacgacagaacttcgccttccattgacgttcgcttcaaggctgttgatgcggatgcggtgtatgccaaatttgatatacagtcgcttggcctgccgatctctctggttatctggacaaccacaccgtggacattgccagctaaccgcgctatttcgctgaatgctgaaattacttatcagttggtcaaaatagaagacgaatgcctgatcctggcggccgaattggttgaatccgtcatgcagcgtgcgggcatgacttcatggcaagtgctgagtgactgtactggtgcggatctggaactactgcgcttcaaccacccattcatgggcttcgacgttcctgcaattctgggcgatcacgttacgcttgaagccggtacaggtgcggtacatactgcgggtggtcacggtccggacgattactccatcagcctgaaatatggccttgaaattgcgaacccagtcgggccgaatggctgctatatctctggtacttatccttcactggatggcgtatttgtcttcaaggcgaacgatattatcgttgaactgctacaagaaaaaggcgctctgctgaacgtagcaaaattacagcacagttatccttgctgctggcgccacaaaaaaccaatcatcttccgtgcgactccacagtggttcatcagcatggatcagaacggtctgcgtgaacaatcactgaaagagatcaaaggcgttgagtggataccgggctgggggcaggcacgtattgaatcaatggtagaaaaccgtccggattggtgtatctcccgtcagcgtacatggggcgtaccaatgtccctgttcctgcacaaagaaacgcaggagttgcacccacgtacacaagagttgatcgaagaagttgccaagcgtgttgaagtcgatggtattcaagcatggtgggatctggacaccgcagaattactgggcgctgacgccgctgattacatgaaggcaccggatacgctggatgtttggtttgattcaggaagtactcactcctctgttgtagatgctcgtccagaattccacggcaactcagcagatatctatctggaaggctccgatcagcaccgcggctggttcatgtcctcattaatgctgtctacagcgattaaaggcaaggcaccttaccgtcaagttctgactcatgggttcaccgtggatgagcagggacgcaaaatgtccaaatccattggtaataccgtcagcccgcaagatgtgatgaacaaactgggtgcggatattctgcgtctgtgggtggcatccactgattattctggtgaaatcgcggtttctgacgaaatcctgaaacgctctgccgatgcgtaccgccgtattcgtaataccgctcgtttcctgctggcaaacctgaatggttttgacccggaacaacatatggtgaaagcggaagatatggtcgcgctggatcgttgggcagtgggtcgtgctcaggcagcacaggctgatatcctcaaatgctatgacgaatatgatttccactccgtcgtccaacgtttgatgcagttctgctccgtagaaatgggttcattctatctggatatcattaaagaccgccaatacaccgcgaagagcgatggtctggctcgtcgtagctgccagagcgccctgtaccatattgcagaagcactggtgcgctggatggcgccgatcctttccttcaccgctgatgaagtctggaatgaactgccgggcaaccgcgcccagtatgtctttactgaagagtggtacgacgggctgtttggtctggaagatggcgcagatatgaacgatactttctgggctgaattgctggaagtacgtggtgaagtgaacaaggttctggaacaggctcgtgctgataaacatatccgcagttcactggaagccgcagttaccctctatgctgacgaagcattggcaggaaaactcaacaaactatctgacgaattgcgttttgttctgctgacttctcaggttgaagttgccacttatgccgcagcaggtgacgatgcacagcagagtgaacttaaaggcttgaaagttgctttccgcaaagcggatggagagaaatgtccacgttgctggcactatgctaaaaatgtggggctggtggcggaacacgcagaactttgcggccgctgtgtgactaacgttgccggtaacggtgaagagcgtaaatttgcctga

SEQ ID NO: 1332 - DNA, 945 bp, Xenorhabdus bovienii
  Coding DNA location: Contig name=SeqID_16855; Position on contig =98863..99807bp; Strand=-
atggagctaattcgcggtgtacacaatatccgggcgcgtcaccatggttgcgtgctgacgattggtaattttgatggtgtccatcgcgggcatcaggctttattgaaacatttgaaacaagaagggctgcgttccgggttaccgacgatggtcatgattttcgaaccgcagccattggaagtttttgctgtcgataaagcgccagcccgcctgacacggctgagagataaaataagatatctatcccagtatggcgttgattatctgttatgtgtgaaatttgaccgaaatttcgcaactaattcacctgaagcctttgtttcacggctgctcgtggaaaaactgggtgttaagtttctggcaataggggatgatttccgttttggcaaaaatcgcctcggagattttcactatttacaacaagcgggtaaacaatacggttttgatgttgccagcacagacagcttctgtgacagcggtctgcggatcagcagtaccgctattcgtcaggcgctgcaagatgatgatctggcgttggcagaaacattattggggcatccttacagcataagtggcagagtcgttcacggtaaccgcttgggacgtaccattgggtttcctacggcaaacttaccgttgaaacgtctggttgcccctgtaaagggcgtttatgctgtggaagtttatggattgggcgataaacccttaccgggtgtcgctaatattggtaatcgacccacagtttcgggtctgggccagcaacttgaagtgcatttgattgatacccaaatggatctgtatgggcgtcatattgatgtggtattacgcaaaaaattgcgtgatgaacagcggtttgcttcgcttgatgcgcttaaacagcaaatcgcaaatgatgtggttgctgcaagggattatcttttgcagcgatccgagtcatgtatctag

SEQ ID NO: 1333 - DNA, 138 bp, Xenorhabdus bovienii
  Coding DNA location: Contig name=SeqID_16855; Position on contig =99823..99960bp; Strand=+
gtggaaattgccggattataccttgtacagcgcacaaggttaacccacgatcacaaagggtttttaattaataacctgattcttacaataaaaacaggccagatgcccgaaaaatatttaatttatctcacttcttag

SEQ ID NO: 1334 - DNA, 117 bp, Xenorhabdus bovienii
  Coding DNA location: Contig name=SeqID_16855; Position on contig =99940..100056bp; Strand=-
ttgtacagcgacgctgattacgttgtgatgggacaggattttatcagcttactgaaagggaatacagtctttcgcaacaaaaaactcaatgaatcactaagaagtgagataaattaa

SEQ ID NO: 1335 - DNA, 186 bp, Xenorhabdus bovienii
  Coding DNA location: Contig name=SeqID_16855; Position on contig =100196..100381bp; Strand=-
atgacgtgctgctttatttttgtggatcagacctttgcaggaatgacgatcaacaattggttgcatgtcattgaatgctttctgtgcagcttctttatcgccagaagcgatagctacgtatactttcttgataaaagtacgcaccatagaacgacggcttgcattgtgctgacggcgtttctctga

SEQ ID NO: 1336 - DNA, 915 bp, Xenorhabdus bovienii
  Coding DNA location: Contig name=SeqID_16855; Position on contig =100486..101400bp; Strand=-
atgcgggtttcacatttaaactttaaccacctttattatttttggcatgtctgcaaggaaggttccgttgttggagcagcagaggcgttatacctgacgccacagaccattactggtcagattaaggctttggaagaacgtctgagtggaaagttgttcaagcgtcaagggagaggattggttccgtctgagttggggcaattggtttttcgttatgcagataaaatgtttatgctcagtcacgaaatgctggatatcgtcacttacagccgagaatcaaacctgctgtttgatgtgggtgtagcagatgcgttgtccaagcgcttagtcagcaaagtgctggaaaccacagtcgtggagcatgagaaaatccacctgcgctgttttgaatcaacccatgaaatgctgctcgagcaactgagccagcataagctcgatatgatcctgtcagattgcccggttgactcttctcagcaagaagggctgttctcagtgaaactgggcgaatgcagcgtcagcttttactgccgtcagccgatcccagaaaaaccgtttccagaatgtctggaagagcgccgtttactgatccccggtcgccgttcgatgctgggcaggaaacttctgacatggatacgcaataaaaacctgcaagttgaagtgctgggtgaattcgatgatgctgcgctgatgaaagcgtttggtatgtatcacaacgctattttcattgcgccttctttctatgccagtgacatcttcgttgatagcgatattgttgaaattggtcgattggatgccgtgcaggaagaatattatgtcatttttgcggagcgcatgattcagcatccggctgttcaacgagtttgtaacaaggatttttctgcgttattcagtgcgcccctcaaaaaatatcactga

SEQ ID NO: 1337 - DNA, 1197 bp, Xenorhabdus bovienii
  Coding DNA location: Contig name=SeqID_16855; Position on contig =101412..102608bp; Strand=-
atgactgcaatcattcgccagtttttaaagttagaagcagcgggaggaattatcctcattatcgctgcgattgttgcactggttttggcgaatacgccattgcagggtatctatcaccaatttctcaaccttccagttgcggtacaatttgccgcattggaaattaacaaaccgctgttgctctggatcaatgatggcttaatggccgtatttttcctgattgtcgggttggaagttaagcgagaattaatggaaggttcgctggctggccgtgacaaagccgttttccctgcgattgccgcagttggaggcatgatcgcaccggcgctggtctacctgttgtttaacggtggtgatgaaatcactcggcagggttgggctatccccgccgccacggatattgcatttgcgctgggtgtcatggcactgctgggaaaacgtgtgccaacagcattaaaagtctttttgcttgctctggcgattatggatgacttgggtgttatcattattatcgccctgttttacaccaaaaccgtttcgttaactgctctcggcctggcaggggctatgatagcgcttctggtttggatgaactggcgcggaatagctaaaacatctgcttatctgatggtcggtgccgttctgtgggtttgtattctgaaatccggtgttcatgcaacattagctggcgtcatcgttgggttcatgatccctttgcgttgcaaaaaaggtcattcaccttctgaatcccttgagcatggtttgcatccgtgggtagcttatttaatcctgccattatttgcttttgccaaagcgggcgtctcgttacagggggtaacattgaacgggttaacggggatgttgccagtggggattgcacttggtctgtttattggcaagcctctgggtatttttctgtttagctggatctcagtaaaactgggcgttgccaaattaccggagaaaattgatctgaggcagatctttgccgtctcggtactgtgtgggatcggttttactatgtctatctttatttctggcctggcatttgaaggtttaaatgacgctttcagtacttactcccgcttgggcatattgattggctcaacagccgcagctgtcattggttatgggctattgaatatacttttgccgaagagaaaacatcgccaaacgcagatgaatagattaatttag

SEQ ID NO: 1338 - DNA, 102 bp, Xenorhabdus bovienii
  Coding DNA location: Contig name=SeqID_16855; Position on contig =102681..102782bp; Strand=-
atgataaaaacagcttttgatacttatatcaatatacccatcacagaaaaaatgttactttctcaatgttataattcgattataccgattcatatcgcataa

SEQ ID NO: 1339 - DNA, 846 bp, Xenorhabdus bovienii
  Coding DNA location: Contig name=SeqID_16855; Position on contig =102815..103660bp; Strand=+
atgacaactttcctattattatctgtacttgctgccgccttgttacatgctagttggaatgctttagtcaaaatcagtgctgatcgattcttgggtatttcaattatcgtcttttttgccggtctgatttcgacatccggattgttctgggttggattacccacacccgcctctctaccgtggttaatactatcttccatcctgcatattggttattgcctgttcctgagccgctcttacgccactggagatttaagccaggtatatcccatcgccagagggtgtgcaccgctcattaccatcttattgagttggataatattgcaggaagtattaccgccctttgccaggttgggcgtcggtttaattatcgcaggggttattttgatcgcatttcctcacggtaaaaaatccatccggatggatcgcaggacattaatcgcagcactcacaacctcaatatttactgcctgctataccttatctgatgggattggctcccgtgccagtgataacgccttaacctatatcttgtggttattcgctattcatggctggtcaatgggcgtgattatttatttcaaataccggaaaacggctggacaaaatgtccgtcaatactggaaacaagggttattaggtgggctaatgcagttgttgagctatggtattgtcatttgggcgatgagtcatgcttctattgtgatagtagccgcactacgtgagactagcgtactgtttgcagtgctattgtctgtctttattctgcaggagccatttagcaaaatacgattattggcctgtgtcgtgattgtggcagggattatctgtactaaattggggtaa

SEQ ID NO: 1340 - DNA, 1137 bp, Xenorhabdus bovienii
  Coding DNA location: Contig name=SeqID_16855; Position on contig =103749..104885bp; Strand=-
atggcaaaaaaagattattacgaggttttgggcatttccaaaaccacagaagagaaagagataaaaaaggcctataagcggctggcgatgaaatatcatcctgatcgcaatcagggtgataaagaagcagaaagtaaattcaaagaaattaaagaagcgtatgagatcctgacggatgcacagaagcgcgctgcttatgaccaatatggtcatgctgcctttgaacaaggtggtatgggtggtggagcaggtggtttcggtggcggggctgattttagtgatgtctttggtgacgttttcggggatatcttcggtggtggccgtcgtcagcagcgtcctagccgtggctctgacctgcgttacaatatggacttgacactggaagaagctgtccgtggtgtgaccaaagagatccgcattccaactctggaatcctgtgatacctgtcatggcagtggtgcaaaagcgggcaccagcccagaaacctgctcaacctgtcagggtgcagggcaagtgcatatgcgccaagggttctttacggttcagcagccgtgtcctcagtgtcatggacgtggaaaagtcatcaaaacgccttgtggcaaatgccatgggcatggccgtgttgagaaatacaaaaccctgtccgttaaaattccagcaggcgtcgataccggtgatcgcattcgcttgggtggtgaaggtgaagcaggtgaacacggtgcaccagcaggtgatttgtatgttcaggttcaggtcaaggcgcatcatatcttcgagcgtgatggcagcaacctttactgcgaagtaccgattaacttcgcaattgcggcactgggcggcgaaattgaagtcccaacccttgatggccgtgtcagcctgaaaatccctgcggaaactcagacgggtaaattgttccgcatgaaaggcaaaggcgtgaaatccgtccgtggcggcgctcagggcgatttactgtgccgtgtcgtggtagaaacgccagtgaagctgaacgacgaacagaaagacttactgcgtaagctgggtgaatctttgggcggcaagagtggcgaagccaatagcccacgctccaagagtttcattgacggcgtgaagaagttttttgatgatctgactaagtaa

SEQ ID NO: 1341 - DNA, 1905 bp, Xenorhabdus bovienii
  Coding DNA location: Contig name=SeqID_16855; Position on contig =104990..106894bp; Strand=-
atgggtaaaatcattggtatcgacttgggaactaccaactcttgtgtagcaattatggacggcacaactgctcgtgtgcttgaaaacagcgaaggtgatcgcaccacaccttctatcatcgcgtatactcaggatggtgaaactctggttggtcaaccagctaaacgtcaggctgtaactaacccgcaaaacacattgttcgccatcaagcgtttgattggccgtcgttttcaggacgaagaagttcagcgtgacgtttctatcatgccatataaaatcattggcgcagacaatggcgacgcatggctggaagttaaagatcagaaaatagcccctcctcagatttctgctgaagttctgaaaaaaatgaagaaaacagcagaagactatctgggtgagccagtgacagaagcggttattaccgttcctgcctacttcaacgatgcacagcgtcaggcgaccaaagatgctggccgtattgctggtctggaagttaagcgtatcatcaacgaaccaacggcagcagcgctggcctacggtatggacaaagaagtcggtaaccgcaccatcgcagtttatgacttgggtggcggtacttttgatatctctatcatcgaaatcgacgaagttgacggtgaaaaaacgtatgaagttttggcaaccaacggtgatacccacttgggtggtgaagacttcgacagccgtttgatcaactatctggtagatgagttcaagaaagagcaaggcttcgatctgcgtaacgatccactggcaatgcagcgtctgaaagaagccgcagaaaaagcgaaaatcgagctttcttctgcacagcagacagacgtgaacctgccatacatcactgcggatgcgaccggtcctaagcacatgaacgtcaaagtgactcgtgcaaaactggaatcactggttgaagatttggttaagcgttccatggagccgctgaaagtcgccctgaacgatgctggcctgtctgtatctgacatccaagacgtgattctggttggtggtcagacccgtatgccaatggtgcagaaaacggttgcagacttcttcggtaaagagccgcgtaaagacgtcaacccagacgaagccgttgcaatgggtgcggctgttcagggcggtgtactgtcaggtgaagtgaaagatgttctgctgctggacgtaacgccactgtctctgggtatcgaaaccatgggcggcgtgatgactgcgctgatcacgaagaacaccactatcccaaccaagcacagccaagtgttctctactgcagaagacaatcagtctgcggtaacgatccatgtattgcagggtgagcgtaagcgttccggtgataacaaatctctgggtcaattcaacttggatggtattcagccagcacctcgtggtatgccacaggtcgaagtgactttcgacatcgatgctgacggtatcctgcatgtttctgcgaaagacaaaaactctggtcgtgagcaaaaaatcaccatcaaggcatcttctggtctgaacgaagaagaaatccagcagatggtacgtgatgcagaagcgaacgcagaagctgaccgtaagtttgaagaattggtgcaaattcgtaaccaagcggatcagctgattcacggtactcgcaagcaagttgaagaagcaggcgataaactgactgcggatgacaaagcagggatcgagaaagccgtttctgagctggaagttgctgtaaaaggcgaagacaaagctgaaaccgaagcgaagattcaggcactggttgaagcttctaagaaacttctggaaatcgcacagcaacaggctcaggaaggtgctgctgaagcgggcaccgcgaaaaaagatgacgacgttgtagacgctgaattcgaagaagttaaagacaaaaaataa

SEQ ID NO: 1342 - DNA, 99 bp, Xenorhabdus bovienii
  Coding DNA location: Contig name=SeqID_16855; Position on contig =107156..107254bp; Strand=+
atgcgccgccctttacggtttattggcgctgtcagatgccataaagcctttttaatatcttgttttatttgttttttccagaggaaatatgcattctaa

SEQ ID NO: 1343 - DNA, 573 bp, Xenorhabdus bovienii
  Coding DNA location: Contig name=SeqID_16855; Position on contig =107244..107816bp; Strand=+
atgcattctaatcagttggcgaatccaggcccgttgggtttgatgggctttggcatgacaacaattttgttgaatttgcacaatgcaggttttttcccattggcatctgccattttgagcatgggaattttttatggtggtttggctcaggtgctggctggcattattgagtacaagaaagggaatacctttgccgcaaccgcatttacctcttacggtatgttctggctgagtctgatcggtttgttgttcctgccagcaatgggtctggcaggcgccaccagccatgaattcctcggtgtttacctcgctttatggggtattttcactctgttcatgttctttgggactttgaaagctaaccgggttctgcaatttgtgtttggcagcctgacgctgctgttcgcactgctggcaattggcaatatcacaggcaatgccagcctcctgaccttcgcaggttatgaaggtattgtctgcggggcaagtgctttctatctggctatggctgaggttctgaatgaacaatatggccgtactgttctgccgattggcgaagtgaagcacgcctga

SEQ ID NO: 1344 - DNA, 1272 bp, Xenorhabdus bovienii
  Coding DNA location: Contig name=SeqID_16855; Position on contig =107891..109162bp; Strand=-
atgtcgcaacatcataatcgtgcgttaaataaacaagattacaaaactctgtctttggctgctctaggtggagccttagagttttatgacttcattatatttgtcttttttgccgttgtgctcggcgagctatttttccctgcggatatccctgtgtggctccggcaactccaaacctttggcatttttgcggcaggttatctcgcccgtcctttgggggggatcatcatggcgcattttggtgatttgattgggcgtaagaaaatgttttcgctcagtatcttgctgatggccttaccgacattgatcattgggggattgcctacttatgatacgattggcattgctgcccctgttttattattactgatgcgcattatgcagggagcggcaatcggcggagaagtgccgggtgcttgggtatttgtggcggagcatgttcctcataaacgcatcggttttgcttgcggaacgctgactgccgggctgaccattggtattttgcttggctcgctggtggctacgatcattacctccatttataccaggcaggaagttttggattgggcatggcgtctgccattctttattggtggggcttttggcttgtgtgctatgtatctgcgtcgctggttacaggaaacgcccgtcttcagggaaatgcaggaacgtaaggcactggcagaagggctgccactgaaatctgtgatcttgaaccataaacatgccatcatcgtttccatgttgctgacatggctgctctctgcgggcattgttgttgtcattttgatggcaccgacctatatgcagactgttttccatctggagcagtcactcaccctgaaagccaacagtctggcgattatcatgctggcaatcggctgtatattagccggtcatttatgcgataaatggggcgccagtctggttttagtggcaggctgcgctctgctcgctgtagcttcatggtttttctaccataatatcagtgatgaaccgggcagattattcagtgcttatgctgtggcggggttctccgttggcgtgcttggagccgtgccttttgttatggttcagagctatccgccggaagtgcggttcagtggaatttcattctcatacaatatgtcttacgccatttttggtgggttgaccccgattttcgtcaccctgttacaggcctatacccagtttgcgcccgcttactatgttctggttttatctgctgtaggcatactcttggggttacatttgcgcgtcaggaaaaagtga

SEQ ID NO: 1345 - DNA, 126 bp, Xenorhabdus bovienii
  Coding DNA location: Contig name=SeqID_16855; Position on contig =109217..109342bp; Strand=-
atgactctccggattaaaacaaatatgaattcatgtgttatcagaataaaatcaatgacaagcctcagaataaatatcttaaaatatcgaataagtcttatttttatctgctttaaagtctggtag

SEQ ID NO: 1346 - DNA, 576 bp, Xenorhabdus bovienii
  Coding DNA location: Contig name=SeqID_16855; Position on contig =109436..110011bp; Strand=-
atgaaatatgatgaaactaatcaaaaaataaaaccgaggattttaattggagccacgggatcagtcgatattgttctccttcccagatatctttcggctattaaggcggcgattgactgtacattgacggtattgatgacaagcagcgctatcccctttttgccagcggaaaccgttgccctctatgccgatcgggttatcagcggagaaaaaccacaggattggccaaccgataagccttctcgcattgtggctgatcatgatctcatggcagttctacctgcaacggcaaacacgatggcgagtgctgctcatggtgcgactcccaatcgtttgacgacggtcattctggcttccacgtttccggtactgttctttcccgtaatgggtagcgtcatgtgggaaaaaaatgcaacacgtcgtaatatcagtcagttgaatgatgatggctatcacgttattgaacctgtttggcatgaaaactttgacgcatcactgcaaaagatggttgggcatccttccctgccggatattgaaactgtgatttcactgctgaagcaatatttgcctaaataa

SEQ ID NO: 1347 - DNA, 843 bp, Xenorhabdus bovienii
  Coding DNA location: Contig name=SeqID_16855; Position on contig =110065..110907bp; Strand=-
atgctgttggctgtcagtgacttacatgtatcccatgcagcaaatcgggcgatagtcgattcattcagaccatcgacaccggacgattggctcttgttggtgggtgatattgcagaacaggagtcagactttacatgggtcataagtacactttcccaacggtttgcacaggtaatctggacgccgggaaatcatgaactctggtgcagtcccagagatcctgtgaaattacccggagtactgcgttatgagcatctggtaaacatctgccgacagcacaatgtgctcactccagaagatgaattccatcgttaccctatgggggatggtacatttgtgaccattgcccccatatttacgctatacgattattcattcagaaatgcgatcgattatacggcagatcaggctatagaacgcgcccgtcgctgcggcatcatcagttccgatgagttcttcctgaaaacctatccccataaaaatattatcgaatggtgtcgggaacgtatccaatataccgaaaaacgcttgaatcacattcaggatggtgaaggcattgtgctcatgagccactttccgattatccgaaaaccgaccgaatccttgcgcaataccgaattttctatttggtgtggcagtgaaaaaactcgccagtgggcatcaagaaaaggggtacacatggtggtatatggtcatttgcacattcccaatatcgaatatattcatggtgttgcccatgtggaagtctctttgggatacccacgggaatggcaggagcgtggcagacatttctgcctggtagcgctggatgagtggctggaatatgccagtgaatatcgctaa

SEQ ID NO: 1348 - DNA, 504 bp, Xenorhabdus bovienii
  Coding DNA location: Contig name=SeqID_16855; Position on contig =110943..111446bp; Strand=-
atgacgacgtcattcatgtattcatatgagaggtatgttatggcaaatgaaaagccaaccttattcgaatggatggggggcagagagaaactcatgcaccttatggaagtcttctatgccaaggttgaaaaagacgaactgcttgaacccctgtttaaaaatatgaaagccgatcaccccggtcatgttggcatgtggctggaagaagtgctcggtggagaaagtcgctataccgatgagcgcggtggtttcaaagtcatgctgagtcggcacaggggcagaagcatccagcctgagcaacggacgaggtgggtagaattactgatgaagtctgccgatgaaatcggtcttccgtcagatcctgagtttcgttcagcctttgcggcctatatcgaatggggttcacgcagggcagaggccaattcccagccggacgccgcaccatcacgccgcgaaactgtaccaaaatggggctggggggaagcacctccgggaacgccctga

SEQ ID NO: 1349 - DNA, 921 bp, Xenorhabdus bovienii
  Coding DNA location: Contig name=SeqID_16855; Position on contig =111475..112395bp; Strand=-
atgttcgtctccgcatttataccgcaatattgttggaaggatatattggatatgagtgagaagagcaacaacaagtgtgtatttaagagggtaacggcgagcgaatggcgctccactatctttcattgggcgaatactgaacagtggaatatggtcgagagtgatatttcacgcttctttaatgtcgatcctcatggcttctttattacttaccgtaatgggatgcctatttcatccatgtcaatggtgaattattcagatacttatacacacgctgggcattatattgttccccctgaattccgtaatcatgtctgtgcaggaaaaatatggaaatcgagtattgcctacgcagaacaccgcacaattagctgcgatgggaacagccatatctcatcattgtatgaaaaaagaggatttgttcctcactatcgtactttcagaatgtctggtgtcatcattcaaccggttattcaaccagcagaggcattaccgataacccaggcgaatattgctgatgtcattaagtacgatgctgaatgtacgggtgtttgtcgtgggagattgctgacagactggttctggggagaaggacgatatggcttctgtacccgttcagatacaggggtcactggcattattgggatacgcaaatcgacagatggatatcggcttgggcctttccatgcagataacgtcgatgtactggaaacactttttagggctgcgctggcgcaagtaccggcaggtgaagctgtgacatttgatgcacctgaaaccgataacaatcaatttatcccgctggcaaaagagtatgggctacgggaattgttttacacattcagaatgtacaagggcaatgtcataccaaagggacatttggagaaattaagagccattgcttctctggagttgggttaa

SEQ ID NO: 1350 - DNA, 120 bp, Xenorhabdus bovienii
  Coding DNA location: Contig name=SeqID_16855; Position on contig =112341..112460bp; Strand=-
atgggtcatcattcaaataatgagcacttggttaatgaatatacggatgcacgggtagataaaagatgttcgtctccgcatttataccgcaatattgttggaaggatatattggatatga

SEQ ID NO: 1351 - DNA, 1137 bp, Xenorhabdus bovienii
  Coding DNA location: Contig name=SeqID_16855; Position on contig =112467..113603bp; Strand=-
atgcgtattgagattgataatttcgacgattaccggaaatcttgtcgtgaatttcttgaacgtgagatcgttcctgaacatcaggcttgggaagataatggtttgatggaacgttctttttgggagaagttgggtcagtctggcttgttgggcataagtgtcagccccgaatacggtggcttgggaaaacatgattaccgttttgccgtgattctgacggaagaacttatcagagctggcgttaccgtaccggggatcgtcgcccataacgatattattgccagttacatttttgcccttggcagtggagagcagaaacaaaagtggctgccggaattatgccttgggaagcgagtcgcagccattgccatgactgaacccagcggtggttctaatacggcagatatcaaaaccgtggccaagcggcagggagatcactatctggtcaatggcggcaaaacctatatcaccaatggcatcaatgctgatctgatcgttgtggcggtaaaaacagagcagggtcagcaaggtcaggggatcagcctgttggtgatagagcgggatatggccgggttctccagaggagagccaatgaagaaaattggctggaatggcagcgacacggctgaactgtttttccatgattgcaaagttcctgttaccaatctgattggccgtgaaaacctcggtaactattacttcatgtcggcaatgccacgggaacggctcagtatctcagcggtggcggttgccagcgcagaacatattttacagagtacgctggcttacgtgaaagaaagaaaagcgtttgaccagccgattggctcctttcaatacaaccgttttatccttgcacagttggataccgaagtaaaaattgcccgcgtctatcttgataacgccgttgagcaatttagcaagggtcttttcagtttggtggatgctgcccgcatcaaatggtggacaacggaactccagatgaaagtagcggatcgctgcctacaattacatggcggggcaggttatatgcgtgattctgttgcgggtaaaaactggctcaatagccgcgctcaaactatttatggtggaactagtgaagttttgcaggaaatgatcagtaaatcgatggggctttaa

SEQ ID NO: 1352 - DNA, 738 bp, Xenorhabdus bovienii
  Coding DNA location: Contig name=SeqID_16855; Position on contig =113629..114366bp; Strand=-
atgaacattaattgcagacgggtcatttacgcttttccacatgccggggcgacaacggccatttatcgtccctggctgaatgatctggcggccacgaaagccgcgatcttgcagcccgtggcgatccccggtcgggggtatttagccaaagagcctgaagtccatgagttggggccgttgattgatcggctggcctcagatatttgggcggattttcagcagaagcaggtgcaggggatcacggagtggatcacattcggtcacagttttggtggtgtactcagtgttgcggtaggtcaggtactgcacgagcgttacgggcttacccctcagtttggtgtggtgtcctgctctgtgccacctcaacttcaaccgtatgatgagcggcatgaatggacagatgaacaattgattcagaaaaccagagaagatcagggaacgcctgaggcgattttgaacgaaccggcgctgataaaacccatcatcaggcaattacgcaatgattatctcatacgtagccaatttcctcagcttggcaacattcaggtggattatccactggtgctggtttcagccagccaggacatacatgtcggtttggcagatatgcaggcttggaaaaatcacacttctcacaagacctcactcatccgtattgaaggggatcactttgccgtctaccggcactgggatgtcattaagcaaatactgctgagtgacagtggaacgcaacaataa

SEQ ID NO: 1353 - DNA, 1632 bp, Xenorhabdus bovienii
  Coding DNA location: Contig name=SeqID_16855; Position on contig =114356..115987bp; Strand=-
atgaccaagacatacgattacatcgtggtgggtggcggttcggcggggtgtgtggctgcatcgcgcctgtctgagaacggtacgaaatcggtgctgttgcttgaagcaggtcacgcatctgatgttaatgacccggccagcccgctccgggatgcgtcaaggctggtgctggaggggtataactgggattacgaagcgaatgtacgcagtgaagatcggttcgccgatctcatttcgccttctcattacctgcaagaagaaaaaaaacaagagcgcaaacaccggggaagaaaaccgttcaattatcgtgtgggaaaggtgctgggtggttcttctgccgttaatggcgccattgcctttagaggatttcccagcgattttgaacaatgggtgaaaatgggctgccctcgctggtcttgggaacaagttctgccgtggtttaaacatctggagaatgatgtcgatcgcacgggtgatgataaccacggttcactggggccaatgtgtttgcgcagaccgcaacatgaggaaatccatccccttgacatggcttttgcccgtgcttgtgagcagtctggtgttccctatgtggatgatcttaatgccggagaggcccccgctgtggggcctgtacctgccaatgtcatcaatggggcagaaagagtggatgtttatcgctcataccttgaacctgttcttcatagaaagaacctgcacgttatgacggatgtgctggtggcccagatcatttttaacggaacggcggcgtccggcgtaaaagtgattcaggccggggaagaacaagtttatcacacagaacacatcgttctctgtgcaggcgcaattggttcggcaaccctgttacagcgttcaggtgtcggcgatcccgaacatttgcgtgctttgggcattccggtgattgcggaattgcccgccgttggccgaaatttgactgaccacgcatcagtcgtgctctggtcattaccgaaaactggcgtgtgtacaacgggcttgccgtggcggcaaattgctgcccgcatcagcagtggctatgacacaaaagttgatgtgcaaatcgggctattgaacaatgttgccagtgagacggtaccgggattcaaagatcgtgtcgcttatcccatgctggttggggcttccgtgatgctgatgcgtccacaggctctggggcgtgtttttatcagcaccgccgatcctactgtgctgccccagattgacctgccactgacccgcaatcctgcggatatcgcccgtcttgtcggcggagttcgtaaaatatgggaagccctgcggcacccggaagtcgatgcgtttctggatggcatccagttttggtctcactccatgatttacaacgatgaaatcatgaacagcgcgattaagaacctggtcaatccgggctggcatgcttcaggaaccctcagaatgggagccggctctgatcctgactgcgctactcaagaggatggacaagtgcatggcatcactggcgtgaccgtagccgatgcatcgctgtttcccactattccttcgatgccgaccaatctgacgaccatcatgacggctgagcggattgtcagctttctgatagcgcggagggaaaatgaacattaa

SEQ ID NO: 1354 - DNA, 1014 bp, Xenorhabdus bovienii
  Coding DNA location: Contig name=SeqID_16855; Position on contig =115984..116997bp; Strand=-
gtgactggatccctatcgatctgcctgagcggattccgggaaaatctgcccaatacggcgatcatcagtcttggtggcgcaaccgaaggttctatttggtcgatatgctatccaattgaagatattgataaaaattggaaaagtattccttatggcaagccattggcaaaccagaaattccatgtcctgaacaattggctttcaccttgtcccaactgggtgaccggcgaactctatattgggggagagggcgttactttgggttatctgggcgatctcgaaaaaacggcgcagcgattcattacccatcctgttactagcgagcggttatacaagacgggagatctgggacgctatatggctaacggcctgatagaaattctgggtcgtgaagataatcaggtgaaaattaatggatatcgcattgaattaggtgaaattgaagcctgtctcttgacccacgaaaacgccggtcacgtggttatggatgcccccgtccatgccaaaaccggtcagcggcatatcgtggcctacgtggttccctctgctgcggatacgtcagaagagcctacccattttcaggaacagttgagggaaattgcccgcaatacactgccgtcctatatggtgccgagctattacgtgttgctggctcatatgccattaaccagcaacggcaaaattgaccgtaaggcgctaccacttccttgggctgatagcgaagaacacacagcaatcgccgtcgatccggccaatgagatagaaacgaaaattttacaactctggcaggcacagctccagcatgatgacttcgatgttaccgatggcttcttcgatattggtggcgactcactgcatgccgttggtctgctcagtgctctgcgacaggaatttaatattactcccgccggagagcaggacattatcgaagggttgttcatgaattccaacattcaggcattttctcggattatcgggacgattatgcaatctcaagcggtgagtgacctatga

SEQ ID NO: 1355 - DNA, 2517 bp, Xenorhabdus bovienii
  Coding DNA location: Contig name=SeqID_16855; Position on contig =116879..119395bp; Strand=-
atgcaacattttctcagggcattgcaagagtctggattacaagtttctctttcttcttctgaattagctgaactagaaaataaaaatacagaagcgggaatatctcatctcacacagcagattcacgaaatgctttgcagtgtattgccactgaatatgactattcccaaaacgttatttacaaaagagtcgacaacagacgattttccactgacggatattcaatatgcttacctgatcggccgtaatcctgggttggaactgggcgggcggacgagttgcctgtataccgaatgggatgtcaaatccttagatatcaaggcactgaatgacgcactcaacaaggtggttgaatatcatcccatgctgcggactgcgctatcttcagatggtcagcagcgggttttgtctgaatcattgacctatactatttctattcaggatggcagagcgtggccggcatcagaaaaagataaacagctggcagatattcgtcagaaaatggaaacacagttattacccgtggataaaatcccgtcatttgatatacgcgcaacgatactcagtgatgaaattatccgtttgcacctctattttgatttgatgttcatggatcttcatagcgtcagattggtattgcgggactgggggcgggtttatcaaggctgcgaattgcctgaattagatgacgaagcgaattttcaaaattatatcaaggctgaacgttatctacagggacaaccacaagggcaatatgataaagcttattgggaacaacagttcgataacttaccgccatcccctgaattgccattgaaaaacgcccctgaattgatttctccaccgatgttcaagcgttacagtcggaaaatagcgacagaaaccttatccgctcttaagaaaaaagcagagcagcaaaaactgacgcttgaaacgttgttgttgggagcctatgcagaagttctccgtcagtggtcaaaacgtcagacttttacattgaccatcacacaacttggtcgtcgtccctattttgcagaggttgaaaatattgtcgggaacttcctgcaacctacattactggcaatacaggggacagaagacgatagtttcaatgatcggttagtacagcttcagactgatttgctgatgaatcgttggcattcttcctacaatggcgttcaggtcttgagggagctgactcgtcgcagtcatggcagccgcgcagtttctgcaccggtggtattcagcaatactctgacagccaatttagacgatgttgttacggatatggactgggctggcacggtgcaggtttatagcagtaatcaaacccctcaggtatggctggaaaaccaaatcgttcgccttgatggcatcgtccagattaactggaatacggttaatgagctgttccccgatggtatggttgaagccatgctggatagttatatggcgctcctcatcgcctgtgcagaagatgattctgtgtggggcaaaaccggatcattggtaaaacttcctgcgtccgatatggcagaacgtgccaaggctaatgcaacggatattgatcttgctccccaacttctgcatgaaatgattttgcaggccgcagagaaattcccccattccattgcccttgtgcagggcgaaaaacactttacttatgccgaaatggtcaagggcgccagtgaagttgcaaaatctcttcgtgcctcagtccagattcatccaaatgatattgtggcggtttccctgccacaaggccctgcattggtgcttggggtattggggattctcatgtcgggagcggcctatgtcgccattgatcctcagcttcccgcagagcgtcggatgaacttgctcaggcgctgctccaccaaaggtatcgtcactgagagcagcctttttaacgagggtgaattggctgatttattccggatcaatctggatgagtgcctgatgtctgaggcaatggatacagaacagaaggtctctgctcatttctcttccgtgcaagcgttggatgatttggcatatgtcatctttacctcgggttcaacaggggaaccgaaaggggtcatggcttcccatcgcaatgcagcgaacacggtactggatatcaatcgcaaatttcatgtgacagaaaaggacacggttttatccgttgcacctgccggatttgacctgtccgtatatgattatttcggcgtactgggggcaggaggaaaggttgtcttttcaacctctgaaacggctaatgatccgaaaatctggtttgaaacgctggttaaacatcagattactatctggaacagcgtgcctgctcctgtcaaggttttggtagaccgaaatggtgccgatctggctcagacacaagtaagactgatactgatgagcggtgactggatccctatcgatctgcctgagcggattccgggaaaatctgcccaatacggcgatcatcagtcttggtggcgcaaccgaaggttctatttggtcgatatgctatccaattga

SEQ ID NO: 1356 - DNA, 498 bp, Xenorhabdus bovienii
  Coding DNA location: Contig name=SeqID_16855; Position on contig =119967..120464bp; Strand=-
atgaatgaaggactggagttgattgttcgttcggtattgatcggggctggtgcaacggttgtgatggatctttgggcggttttcataaaacgcagctttggagtgccatcactgaattattccatggtaggtcgctggattgggcatattccaaaagggatatttgtccataaaagcattgtacaggctgagcccgtgaaaggtgaaactgggattggctggttcgcccattacctgattgggattattttcgcgggacttttattattgatttgggggctggattgggcgaaaaatcccactttgatccctgcattgattgttggtgtcgttactgtcgtcgcgccttattttattatgcagcccggtatgggaatgggaattgcagcatccaaaacccccacgcctaatatcgccagattaagaagcctgatggcgcacacgtcttatggtgttggtctttatttagctgcactcttcctgacattattttcttaa

SEQ ID NO: 1357 - DNA, 123 bp, Xenorhabdus bovienii
  Coding DNA location: Contig name=SeqID_16855; Position on contig =120501..120623bp; Strand=+
ttgaatcacttatctgacactcgcagcgtccaaaaaactttgatattattgcattcaatgaatttattgaatgtaataatattggaagccaaatgtcaatgtttgataaacaactctcgttga

SEQ ID NO: 1358 - DNA, 207 bp, Xenorhabdus bovienii
  Coding DNA location: Contig name=SeqID_16855; Position on contig =120564..120770bp; Strand=-
ttgaggtgctgtagatgctgggaagtgttggcaacagacaggccggataaatccgacagacgttcgacggattgctcggtatcggccaaacattcaagcagtgtcaggcggtgggtattccccagtactttggcaatttccgcgatctcaacgagagttgtttatcaaacattgacatttggcttccaatattattacattcaataa

SEQ ID NO: 1359 - DNA, 552 bp, Xenorhabdus bovienii
  Coding DNA location: Contig name=SeqID_16855; Position on contig =120682..121233bp; Strand=+
ttggccgataccgagcaatccgtcgaacgtctgtcggatttatccggcctgtctgttgccaacacttcccagcatctacagcacctcaagcgcgtgggactgcttcagtcccgcaaagaaggcaagcatgttctttatcggcagggagaaggcccgataacagatattatctccgcactcctgcaatatgctgaatttaaccgcacagaaatgcgcaggctgatcgatgatacaaataaccaggaatccatttcatgggaagaactgctggatcggatcaaagaaaaaagcatgacattgcttgatgtcaggccaaaagaggaatttgaacaaggccatttgccgaacgccatcaatattccggtcgatgaattgggaaacagactggacgaactttctgccagtcaggaacttatcgcctattgtcgaggcccttattgcgttctctctgccaatgccctcgaattgctgcgtgctaaaggcgttcgcgcccgccgctttaaaaaagggttctcaggctggaaagatgcgggaatgcgtatcgaagtatga

SEQ ID NO: 1360 - DNA, 102 bp, Xenorhabdus bovienii
  Coding DNA location: Contig name=SeqID_16855; Position on contig =121469..121570bp; Strand=-
atgacattggtatccaaccatgtgccaatcaatacaacggtcatttcacctaatgagtatgaaggtcacttattcctttggcgagaaagatgcttacaatag

SEQ ID NO: 1361 - DNA, 174 bp, Xenorhabdus bovienii
  Coding DNA location: Contig name=SeqID_16855; Position on contig =121527..121700bp; Strand=+
atgaccgttgtattgattggcacatggttggataccaatgtcattgcggatacgtctttccctttacggaaatatttggttgattacctaattttgagtatattgatacgacaaactacccagatttcaaacacaaaccactacacttatctgaatcctcatattaaactctag

SEQ ID NO: 1362 - DNA, 822 bp, Xenorhabdus bovienii
  Coding DNA location: Contig name=SeqID_16855; Position on contig =121759..122580bp; Strand=+
atgaaaaatgaaagaagacattttctgaaacaggcaggggttactggtgcagtattttcattattacctctgcttccagcaggagctctcgcctcttcacctagtcaactaaagaaagaggatggtattggtatcggcatttgcgagatgaccccagaggaaatgtcaggtccatattttataaataacaaactgctgagaaggaatatcacagaggatgaacaaggaatacctcttttattgacaatgaaagtcactgattctgtaacctgtaaacctttagatgatatccttattgatatatggcattgtaatgcaatgggaaagtattcaggttggaaatacataaacccagacctcgaagctccatctgataatataggaacgatttcacgaacggatgaaagcacatttcttcgtggggcacaaaggacagacaaagaaggcatagtcagattcaccacgattttccctggattttatgccggaagagctatacatatccatttatcagcaaggagtgcgaatgtacaaaaaagacaggaagataaattctattttgtaggccaactctatttccctgaggatatatctaaagaagtcatgattaatgatatgtattctccaagggagattaataggcttaaaaatgaagatgattctatcttttctggagttaaaaatagagctgcaattttgacagtaaaaaaaataggtgataatccattggatggattacatggaaagatagttttatctattaataaagaccatgtgtccaagaaaataacccctaaagacttggctaaatacactgtgtag

SEQ ID NO: 1363 - DNA, 93 bp, Xenorhabdus bovienii
  Coding DNA location: Contig name=SeqID_16855; Position on contig =122645..122737bp; Strand=-
atgagactctgtttttcggcctcaaaagcggttctaaatatcgaatttttactatttttagagcacaaagtcttttttcgataccgcctatag

SEQ ID NO: 1364 - DNA, 243 bp, Xenorhabdus bovienii
  Coding DNA location: Contig name=SeqID_16855; Position on contig =122859..123101bp; Strand=+
atgatgtccctgactcgagaagcgctcaaacgcctgcattatcctgttgatatcatcgctcagtgtgtttgttggtatctggcctacgcgctgagcctgcgtaatctggaagaaattctggctgagcgtgggattgccgttgatcattccacgctctcttgttggtcatgtattcaatatgtgtattgtaagttttattgtgttgagcaaattgctgcttataacactaaaatcaccttatga

SEQ ID NO: 1365 - DNA, 135 bp, Xenorhabdus bovienii
  Coding DNA location: Contig name=SeqID_16855; Position on contig =123098..123232bp; Strand=+
atgatcttgatcgtagataatgctggaatcgccaagttcaacatattaaatacacaaccaaaaaatgaaattttaaaaatgacctgtcagtctaagtcagaaatctcacacgtaatgttttatattaagatataa

SEQ ID NO: 1366 - DNA, 159 bp, Xenorhabdus bovienii
  Coding DNA location: Contig name=SeqID_16855; Position on contig =123285..123443bp; Strand=-
atgattttagttttgtatacaaagcacaggcttctaaataagcctattcaaataatgaaaaatttgggtatgcaattgaggtggtatttgggggttttgaagaaagcgtccatgctgttaatatatttatcgaccatgatctcaaggttaaacttataa

SEQ ID NO: 1367 - DNA, 867 bp, Xenorhabdus bovienii
  Coding DNA location: Contig name=SeqID_16855; Position on contig =123403..124269bp; Strand=-
atggaaaagaaagataaagccattaaaacacacagcgtattcgattcagataaatcaacactttcagaagaagaaaatattcatcatggtgagaaccccatttccctttccccaaatgagtctgatgttatcttgatcgatgacgcagaatctctcgaaaacgatacatcccctcacgcttcctatttcattaaagacacacatggacgtacactctgtattgatgatagagacaagaaggttctttattttgaggttgatgaaaaacctgcctttatgggatcggaagattattctgctaactttatcatgttacaactgcgggataaaaaaattccggaaaactcaataaagatgataggtgaatacaacgataagaagtacgtcatgtatgcctatgacaattctatagacctcacttcaactaaattatactggcatactcgtaatcccagcatagatgataggcaaatatcattcaacaaagagtatgtcaaaacagaaaaggggttaaagcaatataggctcgtttggaataatcagggaacagaaatgtttttgtacagtcattcccatgatgagtcgcggtccttgctaaccgaaaatcataaaaaatacagcttatttactctgcatgctgattttattaaggaaaaacttatacagcccttagttaaaaaaacctggccgaatatcaaattaaggttatcaacgtttaggattctggatccattctacaaattagtttcagacgaaaaagtaaagaaaatatacaaagaatcagggctgaaaaattttaaatatagaaaaaattcctttgattgtgatgattttagttttgtatacaaagcacaggcttctaaataa

SEQ ID NO: 1368 - DNA, 123 bp, Xenorhabdus bovienii
  Coding DNA location: Contig name=SeqID_16855; Position on contig =124520..124642bp; Strand=-
atgctaatccaaaattggcatcttgctatgagtcgttttatgattgaatttactgaggaaaaacaattaacaccgtcattcactgacagttttcaaactcaaaatccattttttgaatattga

SEQ ID NO: 1369 - DNA, 621 bp, Xenorhabdus bovienii
  Coding DNA location: Contig name=SeqID_16855; Position on contig =124816..125436bp; Strand=-
atgagcgatattttctctctattttttctgttaattgaggttcgtatgaatgtactgcgcattggcctcgtgtctgtttctgatcgtgcttcaaacggtgtctatcaggacaagggcctccctgcattggaaacatggttggaaaaagcgattaccacgccttttagcgtcgaaacgcgtctgatccctgatgagcaaatcctgattgaacaaaccctgtgtgaattagtcgatgagcggggctgccatttggtactgacaacggggggaaccgggccagcgcgccgcgatgtgactccagatgcaacactggcaattgcagatcgtgaaatgcccggctttggtgaacaaatgcgccagatcagccttcaatttgtgccaaccgcgattttatcccgtcaagtaggcgttattcgtcatcaagcgttgatcctcaacctgcccggtcaaccgaaagccattgcggaaacgttggaaggcctgaaagatgccagtggcaaagtgctggtgtcaggggtttttgctagtgtcccttactgcatccaactgttggatggcccttatgtggaaactgatgaaaaggtagtcgccgctttccgaccaaaaagcgcccgtcgttaa

SEQ ID NO: 1370 - DNA, 954 bp, Xenorhabdus bovienii
  Coding DNA location: Contig name=SeqID_16855; Position on contig =125510..126463bp; Strand=-
atgaccgataaactgacttccctgcgtaaactgacaacagtcgtagcagatactggggatatcgcggcgatgaaactgtatcagccgcaagatgcaactaccaacccttccttgattttgaacgcagctcaaatccctgaataccgccaactgattaatgaagccattgaatgggcgcgtggtcagagcgattctcgtgagcagcagattattgatgccggcgacaaattggcagtcaatattggtctggaaattctgaaactgatccctggccgcatttccaccgaagttgatgcccgtctttcttatgacaccgaagccagcgtagcgaaagcaaaacgtttgatcaaactgtataacgaagcgggtatcagcaatgatcgcattctgatcaaactggcttctacatggcagggtatccgtgcggcggagcaactggaaaaagaaggtatcaactgtaacctgaccctgctgttctcttttgctcaggcgcgcgcttgtgcggaagcgggtgtctacctgatttctccgtttgttggccggatccttgactggtacaaagcgaatggcgataagaaagaattcgcaccacatgaagatccgggtgtgatctctgttgctgaaatttaccagtactacaaagaacatggttataacacggtggttatgggcgcaagtttccgtaattccggcgaaatcctggaactggctggctgtgaccgtttgactatctctcctgcgctgctgaaagaattgtctgaaacagcaggtgaagttgagtgcaaactgggttatgaaggcgaaatcaaagtgcgtccagctcgattgacagaagctgagttctactgggaacaccatcaagatgcgatggcgaccgaaaaactggcggaaggtattcgtaaatttgccgtagaccagggcaagcttgagagcatgatcgctgatctgctgtaa

SEQ ID NO: 1371 - DNA, 132 bp, Xenorhabdus bovienii
  Coding DNA location: Contig name=SeqID_16855; Position on contig =126533..126664bp; Strand=-
atgattttgttccgatatgattttgtttcgaatcgttttccccataatgcaggctttctcaactttagcaaaaacaaactgaaaagggcgaataacagcgataagattttcctaccttacagcagcgcttga

SEQ ID NO: 1372 - DNA, 837 bp, Xenorhabdus bovienii
  Coding DNA location: Contig name=SeqID_16855; Position on contig =126603..127439bp; Strand=+
ttgagaaagcctgcattatggggaaaacgattcgaaacaaaatcatatcggaacaaaatcatgcttattactatttcacctgcaaaaacactcgattatgaaagtccactcgcaacagagaaatatagtcagcctgcattgctggaggaatccaagcaattgatcgatgtctgccgaaccttaacgccagcgcaaatcggcagtttgatgggtatcagtgataagctggccggcctgaatgcggctcgttttggtgaatggcaaccgaatttcaccccggaaaatgcccgtcaggcgatcctcgcctttaaaggtgatgtctataccggtatgcaggcagaaaccttctcagacgccgattttggctttgcccaaacgcacttgcggatgttatccggcctgtatggcgtattacgccctctcgatctcatgcggccgtatcggctggaaatgggtatcaggctggagaacccgcgtggcaaggatttgtataagttctggggagatctcatcactgaaaatctgaatgctgcgctggaacagcaaggtgatgatgtgttggtcaatctggcttcagatgaatatttcaagtcggtgaatactaaaaagctagcggctcaaattatcaaaccaatttttctggatgaaaaaaatggcaagtataaagtgatcagcttctatgccaagaaagcgcgtgggctgatgagccgctttatcattcagaatcaactgactgatcctgcccggctggtggaattcaatctggaagggtacgccttcgatgaatcgctctccaaaggcagtgagcgggtatttaaacgccctgaacagcattga

SEQ ID NO: 1373 - DNA, 1293 bp, Xenorhabdus bovienii
  Coding DNA location: Contig name=SeqID_16855; Position on contig =127486..128778bp; Strand=-
atgaaactatataatttaaaagacagtagcgaacaggtcagcttttcacaggcggtcaaacagggattgggcagacagcaggggctgttttttccgcaggacttacctgaattcagtcgtgacgaaatcgacgaattattgaaactggattttgtcagccgtagccagcgaattctctctgcctttattggtgatgaaattcccgcagaacaattggtggctcgtgtcaaaaatgcctttgcctttcctgccccggtgacaggcgtcgaagacgatatcgcttcgctggagctgtatcatggaccgacactggctttcaaagattttggtggtcgtttcatggcacaaatcctcgcacaaatcgcgggagaacagccggttactattttgactgcgacttccggtgataccggggcggcggttgctcatgccttctatggcttggacaacgtacaggtggtgatcctctatccagaagggaaaatcagcccattgcaggaaaaactgttctgcacactgggggggaatatccacactgtcgctatcaagggcgattttgatgcttgtcaggcgttggtaaagcaggcttttgatgatgaagaactgaaacgtgcactgtatctcaactctgccaactcaattaatatcagtcgcttattggcgcaaatctgctactactttgaagctgttgcccagatcccagcagaaaaacgtgaacagttggtgatttccgtgccaagtggcaacttcggtaacttgacagcggggttgctggcgaaatcgctgggactgccagtaaaacgttttattgctgcgacgaatgtcaatgacaccgttccccgttatctgtctgaaggcgcatggcagccacatcagaccgttgcgactctttcgaatgcaatggatgtcagccagccaaataactggccgcgcattgaagaattgttccagcgcaaaggctggtcactcagtgaattagccaatggtgtggtggatgacagcaccactcaggccacaatgcaagaactggctgccaaaggctatatttccgaaccccatgccgctgttgcctatcgtgtactgcgtgatcaattacaggcaggagaatatggcctgttcttgggaacggctcacccggccaaattcaaagaaagtgttgaagtgatcctcggccagccgctgccattgccacaggaattggcagagcgtacggatttagccctgttatcccactttctgcctgctgactttgcgagtttgcgcgaattcttaatggaaagagcgccgaaataa

SEQ ID NO: 1374 - DNA, 951 bp, Xenorhabdus bovienii
  Coding DNA location: Contig name=SeqID_16855; Position on contig =128781..129731bp; Strand=-
atggaaattgggggtttaatggtggtcaggatttatgcacccgcctctatcgggaacgttggcgttgggtttgatgtgctcggcgcagcggtttctcctgttgatggctcgttgcttggagattgcgtctctgtctgtgaagctgaacgtttcagtttaagtaatgaagggcggtttgctggcaaattgcctgctgatcccaaacacaacattgtttaccaatgctggcagcttttttgccagcgtctgggaaaaaagctgcctgttgccatgacactggaaaaaaacatgccgattggttcagggctgggttccagtgcttgttcggtagttgctgctctggtggcattgaatgagtatgctggctgtccatttgacagcaaccaattgctggacatgatgggcgagttagaggggcgtgtttccggcggtgtgcactatgataatgtcgcgccgtgctacttagggggattgcaactgctccttgcgcaggaaaatgccgtttgtcagtctgttcctatttttgatgattggttgtgggtgatggcttaccccggcatcaaagtttcgacatcagaagcccgtgccattctgccggcaaactactcccgtggggatatgattaatcacggccgttattttgcgggatttattcacgcctgccatacccagcaatccgaactagcggctaaattgatgaaagatgttgttgctgaaccttatcgcacacaacttttacccggatttgccaacgcgcgtaatggagtaaagaaactgggtgctctggtgtgcagtatttcgggttctgggccgacattatttgcgatctgcgatgacatggctgtagcgaaagaagtcgcacagtggctgcaacaacattacgtacagaatgatgaaggttttgtgcatatttgccgtctggatctcgcaggcgcacgacaggtagggtaa

SEQ ID NO: 1375 - DNA, 2460 bp, Xenorhabdus bovienii
  Coding DNA location: Contig name=SeqID_16855; Position on contig =129713..132172bp; Strand=-
atgcgagtactgaaatttgggggcacctcagttgcaaattaccagcgtatactgagtgttgctgatatcgccgaaagtgaactatcccttgggcaagtggctctggttctttctgcacccgcaaaaatcacgaaccacttggtggcgatgatagacaaaacggtggcagggcaggatattgtttccaacatgagcgatgtgtcccaaatctttgctgatttgctgtcgggcttaaaagaacatcagccgaatttcgattatgaatacctgaaaggcattgtggaacgtgaacttgcctacctgaaacagaccttgcatggaatttcgctattgaagcagtgtccagacagcattaatgctgctctgatttgttgcggtgaaaaactgtccattgccattatgggagcggttttacaagcgcgcggtcataaagtgacagtcattgatccggtcaaaaacctactttctcacgggcattatcttgaatctaccgttgatattcacgaatcgtccaaacgcattgcggcgctgaacatcccggctgagcatatcattctgatggcgggttttactgcgggtaacgataacggtgaattggtggtgctggggcgcaatggttctgactactcagcggcagtgctggctgcgtgtctacgagcggactgctgcgaaatctggactgacgtagatggcgtttatacttgcgatccaagggctgtacccgatgcgcgtctgctaaaaagcttgtcatatcaggaagcgatggagctttcttatttcggtgccaaagtccttcatccgcggacaatcgcgcctattgcccaatttcagatcccttgcctgattaaaaacacggcgaatcccgatgcgccgggcacctttatcggagaagggcataaagacgaaaatttgcctgtcaagggcatcaccaacctgaacaatatggcgatgatcaacgtctcaggccctggcatgaaaggtatggtcgggatggcggcacgggtgttttccgtcatgtctcgcaaaggcatttctgttgtgttgatcacgcagtcttcatcggagtacagcattagtttctgtgtgccgcaaaaagagctgacaaaagcacagaaggcgctgaccgaagaattttatctggagctgaaagatggtgtacttgatcccattgatgtgatcgataacctttccatcatctctgtggttggggatggaatgcggactcagcgaggtatctctgcccggttcttctccgcactgacccgcgcgaatattaacatcatcgccattgcacagggatcatctgaacgttccatttcggctgtgattgacaatgataccgctaccacagcggttaggctctgccaccaaatgttgttcaacaccgctcaagtggttgaagttttcgtggtgggtgtgggaggggtgggtagtgcattgattgaacagatccgccgtcagcagtcatggctcaaacaaaaacacattgatctgcgagtgtgtggcattgccaattcgcgggcgatgttgacggatatgcagggcatcggtctggataattggcaacagtcgctgtcagaagcgaccgagcctttcagtttgagtcgccttatccgtcttgaaaaagaatatcatctcctgaatccggtcattgtggactgtacttcgaatcagtcgattgcggagcagtatgccagctttttaggcgatggttttaatatcgtgacaccgaataaaaaggccaatacgctgtcaatggcctactatcgtcaaattcgtcaggcagccgaaaaatcgaagcggaaattcctgtatgacaccaacgtaggcgcaggattaccggttatcgaaaacttgcagaatctgctcaatgcgggggatgaactggtgcagttcaacggcattctgtccggttcgttatcttatatcttcggcatgttggatgaaggcatgacgctttcacaagcgactctgctggcaaaagaaaagggctttaccgaacctgatccacgggatgatctctccggtatggatgttgctcgcaaactattgatcttggctcgtgaatctggctatgaactggaattggaaaatattcacgtagagccagtcttgccggccgcgtttgatgccagcggtgatgttggtagcttcctgcaacgtttgccacaactggatcaagaattcactcatcgtgttgctgatgccgcagaacaggggaaagttctgcgttatgttggcatcattgaacaaggccgttgtagggtgaaaattgccgcagttgatggcaacgatccgctttataaggtcaaaaatggcgaaaacgcactggctttctatacccgttattatcaacccattccgctggtgctacgtggctacggtgctgggaatgatgtcacagccgccggggtttttgctgatatattacgtactctgtcatggaaattgggggtttaa

SEQ ID NO: 1376 - DNA, 216 bp, Xenorhabdus bovienii
  Coding DNA location: Contig name=SeqID_16855; Position on contig =132147..132362bp; Strand=+
gtgcccccaaatttcagtactcgcattagcatttctctcctgatttatgtccaaaaaaaagcccgtatcttgtgggatacgggctttttattattttatgtgtacgcgtcagcccgccccgtaactcatagttccggtggtaatcgtcgtagtggtttctgtagtaaccttatttttcgggctgatatggcgcatgatttcctgtctgtcttttaa

SEQ ID NO: 1377 - DNA, 117 bp, Xenorhabdus bovienii
  Coding DNA location: Contig name=SeqID_16855; Position on contig =132884..133000bp; Strand=-
ttgctacctaaaatcgctaaaaaaaacagaatctgtatgacgcaagctgttattattaaaagaaaatatgctgatcttgttctgaattacagaaaacgcagctcatgtccaaaatag

SEQ ID NO: 1378 - DNA, 717 bp, Xenorhabdus bovienii
  Coding DNA location: Contig name=SeqID_16855; Position on contig =133003..133719bp; Strand=+
atgcaaaccccgcacattttgattgttgaagacgaaattgtcacacgcaataccctgaaaagcatttttgaagctgaagggtatgtcgtttatgaagccactgatggctcagaaatgcacaacattctgtcagataacgatatcaacttagtgattatggatatcaatctgccaggtaaaaatgggttacttcttgcccgtgaattacgtgagcaggcaaatgtcgccctgatgtttttaacagggcgtgacaatgaggtggataagatccttgggcttgaaattggcgctgatgattacatcaccaagccatttaacccacgagaattaaccatccgtgcacggaatctgctttcccggactatgaacctgagtcattcaggtgaagagcgccgtcaggttgaaagctataagttcaatgaatgggaattagatatcaacagccgctctctggtaagcccaatgggagatcagtacaaactgccacgcagcgaattccgtgcgatgctccacttctgtgagaatccggggaaaatccaaactcgtgcagaactgctgaaaaaaatgacagggcgcgaactgaaacctcatgatcgcaccgttgatgtcactatccgtcgtattcgtaaacacttcgaatccacaccagatactccagaaatcatcgccaccattcatggtgaaggctatcgtttctgtggcgatttagaagactaa

SEQ ID NO: 1379 - DNA, 477 bp, Xenorhabdus bovienii
  Coding DNA location: Contig name=SeqID_16855; Position on contig =133799..134275bp; Strand=-
atggtaacaatcaagaaaatagtgatagcggctgccttgatcttttctcctgtgatcttgcatgctgaggagatcggttctgtcgataccgtgttcaaactattcggccctgataacaaaatagtgatagaagcttttgatgatcctgatgtcaaaaatgtcacctgctatctgagcagggctaagacaggtgggatcaaaggtggattggggttggcagaagatacttctgatgccgctatatcctgccagcaggtcgggccgattgaattgagcgacaaaatcaagacaccccccaaaaaagggcaggttgtcttccaaaaacgtacatctttggtgtttaaaaaacttcaagtggttcgtttctacgaccctgaacgtagttctctgatttatttaacctattctgataaagtcatcgacgggtcgcctaaaaatgcgatcagtgctgtgccgattatgccgtggaaagagtga

SEQ ID NO: 1380 - DNA, 111 bp, Xenorhabdus bovienii
  Coding DNA location: Contig name=SeqID_16855; Position on contig =134566..134676bp; Strand=+
atggttgtgaaaatgaacatagtgatacctattgttaatgaatttaacaagataactcttgacaaattatcgattaagctattaatttattccaagaaaattcttgtttaa

SEQ ID NO: 1381 - DNA, 117 bp, Xenorhabdus bovienii
  Coding DNA location: Contig name=SeqID_16855; Position on contig =134830..134946bp; Strand=+
atgtttttttaccttttgggaatggtaggtgttaattctcgaccaaactgcataacagttgcattcagaaaaacgttttggtttttcaaaatagtaagttgttgtacatttgtatga

SEQ ID NO: 1382 - DNA, 882 bp, Xenorhabdus bovienii
  Coding DNA location: Contig name=SeqID_16855; Position on contig =134980..135861bp; Strand=+
atggatcaaaccaacatcattcgagatttgctgcattggatggataataacctagatcgtccactatccctcgataacgttgcagcaaaagcaggttactccaagtggcacttacagcgcatgttcaaggatgtcacaggtcaggctattggttcttatatccgagcaagacggttatccaaggccgcagttgcattgcgtttaaccagtcgccctattctggacattgcattgcaatatcgttttgattctcaacaaacgtttactcgggccttcaaaaaacagttcaaccgaacgcctgcttcctaccgccgaagtgacgagtggtgtgctacggggatttgcccacccattatgttggataacaaaccgttgccagcacacaaatatgtcacgctggaagatcagctgcttatcggtactgagcatacttgttcttatactctggagcagtggtcaagtgcctgcacagagatgcgtcacggtttctgggtgaactatctgcaacatgctaaaacacttccccccaggctgtatggattgcatcattccgatctcagtgcagagcatgaagatgagcagactgttttctataccacagcaatagagccagaatatgccacatttgatacgcaagacaacaggcctgttgttctacctggcggtgactatatttcattcagttattttgggggcaaagaacaattaaaagagttcctctttacagtttatggtatctgcttgcctaaattaaacatcactcgcaggaagggatacgatgtcgagcgatactaccttactaaccttgaatggaaaaaccttgaggatgagtctcaaagccacgttgtggaatttgagtacctcatcccaattgaacgttag

SEQ ID NO: 1383 - DNA, 648 bp, Xenorhabdus bovienii
  Coding DNA location: Contig name=SeqID_16855; Position on contig =135858..136505bp; Strand=-
atgttacaggtctatcttgttcgccatggcgaaaccgaatggaacgtggctcgccgtattcaggggcaaactgacagtcccttgactgaaattggcctgcgtcaggcacgcttggtagcacagagagtaaaatcacaaaacatcacacatgttatcaccagtgaccttggtcgaacacgtcaaaccgcagaaatcatcgcgaaagcctgtgggtgtgaagtgctgctggaaccccgtttgcgggagttaaacatgggtgttctggaaaatcgtgaactgaattccctgactcctgaagaagaatcctggcgtaaaagtcttgtcgatggtacaccaaatgggaagatcccagaaggtgaatcaatgaatgaattgtcagctcgtatgcgggcagcactggaaagttgccttggcctgccagcaggtagccgcccgttgttagtgagtcacggtatggcattagtctgtttggtcagctctatcttggggcttcctgccaactcggagcgccgcctgcggctaagaaattgctctatctcaagagtggattatcaagatagcccgtggctggcttcgggctggattgttgaaactgcaggcgatatcacacatctggatatgcccgcattggatgaattacagggctaa

SEQ ID NO: 1384 - DNA, 534 bp, Xenorhabdus bovienii
  Coding DNA location: Contig name=SeqID_16855; Position on contig =136560..137093bp; Strand=+
atgtaccacgttattgctgcaacaactaaccctgcaaaaataaaagcgattagccttgcattcgatgatgtttttggccccggcacttaccgcatagaagatgtcaacgtagatagcagcgtcccccaacaacccattggcaatactgaaacccgtaccggcgcccgtcaccgtgtgatggctgcccgtcaggttcggccagaagccgatttttgggttggagtcgaagctggaattgaagatgacatgacgtttgcctggatggttatcgaatacaagcagattcggggtgagtcgcgctctgccagtctgatgctgcctgaaaaagtattggaaggcattcgtgaaggacgcgagcttggccatgaaatggcttatttgaccggcgtcgataatatcaagcaagaaggtggcgcaatcggcttttttaccaatggtattctgacccgcaccagcgtttatcatcaggcactgatattggctctcgttcctattcatcatgaaatttacaaagagttgaataaccaaccttaa

SEQ ID NO: 1385 - DNA, 333 bp, Xenorhabdus bovienii
  Coding DNA location: Contig name=SeqID_16855; Position on contig =137142..137474bp; Strand=-
atgataccaaatcacttgattgatccggcactcaccccggaagatagcgatgactggctcacttttgtgggattgttacagtcagcatttgaacaaaatttgcaacatcctattttgcagctattattgactcctgatgagcgcacggctctgtcaactcggattcggattattcaggaattgatgcgtggacagatgagccagcgtgagttgaaaaatgagctcaatgtgggtatagcgacaattactcgtggttctaacagcttaaaagcagcgcctgcccctgtcaaagcatggttagaagcacaattattaaaagataataacgattaa

SEQ ID NO: 1386 - DNA, 1920 bp, Xenorhabdus bovienii
  Coding DNA location: Contig name=SeqID_16855; Position on contig =137531..139450bp; Strand=-
atgaataaatggcggcattttacgatggctgtgggtctggtttttgttgctggggcagcacatgcggattctttggacgcccaacgtgagcgatatcaaacggtaaagctggcgtgggaggcgaaaaatatggcggaagttgaacgattgatgccaacgctgaaagattatcccctatatccttatctcgaatatcgccagttaactcaagatttggatattgccacgcctcagcaaatccgtcactttattgatacttatccgactttaccatcggcgcgttctctgacatccaaatatatcaattcgctggcaagcaatggagactggtctggtattttggcattcactccaaatgcaccaaaggctgctatgacgcgctgcaattattattttgctaaatgggctactggaaatcagcaggtagcatggaaaggtgcccaagaactgtggttgagtggcaacacattgcccggcagttgcgataagctgtttgatgtctgggaacaggctgggtacttatctgcaaatttaattttgcagcgtatggaattggcgattaaatcaaataacactcaattggttaattatcttattaagcgcttgcctttgagctatcggagcttgagtgaaaatttactgaaattgcaaagtgatcctgccttcattgagcattttgcccaaacgtccacatcaacggattttacccgctccgttatcatgacgactttttctcgttttgcccgtaaagacgcagaagttgctagacacagtattccggccattgttcgggtgcagaaaatgaatgactccgagcatcaattgttaaaagatgcagtggcatggaatttgatgagcaatgtcacaccagagcaggcgaaatggcgggatgacgtcatacgagattcgcaatctaccaatctgcttgagcgacgcgtccgtttgacactgcaagatggcgatgaaaaagggctggtacagtggttgtcattgcttcccaaaagtattctgcaaaaaaaagaggagtggcaatactggagtgccattgtcttgcttaatgaaggtaagcaagcagagggtgaagcaatattgcacaaccttaaggaaaagcggggcttttattcaatggtggctgcgcagaaattaaatatcacttatccattgatgattgatagagcagaaaaaccagatgattcgattgcaaaaatgcgggaaataaagcgtatccatgagttgatatactggcatatggataatctggcgaactcagagtggaataactttgtttcttcacaaagtccgttaaagcagcaacagttggcacgttacgctcttgaacagcattggccggcactcagtgtacaggccaccattacaggtaatatgtgggatcatcttgaggagcgttttcctctggcatggcagaaggaatttgcgaattttactgccgataaaaatatttcacaaagttatgcgatggcgattgcccgacgggaaagtgcatggaatccccaggctcgttctgggaagggagctagcggattgatgcaaatcatgccaaaaaccgccgagcataccgtgaaggagcagaagattcagggttattccagcagcagtcaattaatggagccagctatgaacatcaaagtgggtacagcttatctggacttggtttaccagcgttttggcaataaccgcgttcttgccagtgcggcctataatgctggccccagaaatgttgatcgctggttggcgaatagtgctgatcgtattgacgcgatagcttttattgagagcattcctttcggggaaacacgcgattatgtcaaaaacgtactggcttatgatatgtactatcataattttatgggaatacattcaaatgcgttgactaacgcagaatggcaaaggcgttattaa

SEQ ID NO: 1387 - DNA, 186 bp, Xenorhabdus bovienii
  Coding DNA location: Contig name=SeqID_16855; Position on contig =139388..139573bp; Strand=+
atgtgctgccccagcaacaaaaaccagacccacagccatcgtaaaatgccgccatttattcattgctacatgctcctccaaaggactaaacggataaccaccaatacaaaaatgctattcaattataatcatattattgacatgattgattacaacagtgaattcataacgataagatttttataa

SEQ ID NO: 1388 - DNA, 156 bp, Xenorhabdus bovienii
  Coding DNA location: Contig name=SeqID_16855; Position on contig =139637..139792bp; Strand=-
ttgcgtttatggggcttggatggggcattttaccctaaattttacgtatcgtgttgctacctgatcagcattagttcaagcatccaattaccgcaaccggtaaaaatcatttgtgcggaacgtgtttttatgagtacgggcctcgttcctgtctga

SEQ ID NO: 1389 - DNA, 1647 bp, Xenorhabdus bovienii
  Coding DNA location: Contig name=SeqID_16855; Position on contig =139856..141502bp; Strand=+
atgcatcgggttggcaaaattgttccccctaaaaggcatattctgaaaaatatttctctgagttttttccctggagcaaaaattggtgttctcggtctcaatggtgcgggtaaatcaaccttactgcgcatcatggcgggtatcgataaagatattgaaggagaagctcgtccacaacccggcattaaaattggttatctgccgcaggaacccaagctcaaccttgaacataccgttcgcgaagctgtggaagaagcagtcggcgaagtcaaaaatgcgctgatgcgtcttgatgaagtctatgctgcttacgccgatcctgatgcagattttgacaagctggcaaaagagcaaggtcaactggaagcgattatccaatcccatgacgggcataatctggataaccaactggagcgagcggctgatgctctgcgcctgcctgcatgggatgccaagattgaacatctgtcagggggtgaacgtcgccgagtcgcgatttgccgcttgctgctggaaaaaccagacatgctgctgctcgacgagcccaccaaccaccttgatgccgaatctgtcgcatggctggagcgcttcctgcacgattatgaaggcaccgtcgttgcgattacccatgaccgttacttcctcgataacgttgctggctggattttggaacttgaccgtggcgaaggcattccatgggaaggcaactactcttcatggctggaacaaaaagacgcacgtctggcacaagaagcctcctcagaagctgcccgccgcaaatccattgaaaaagaacttgaatggatacgccaaaatccgaaaggacgtcaggcaaaaggtaaagcgcgtctggctcgctttgaagaactcaataacgttgattaccagaaacgtaatgaaaccagtgaattatttatcccaccaggcccacgtctgggtgataaagtgctggaagtgaccaacctgaccaaatcttatggcgatcgagttttaatcgacaacctgaacttctctctgccaaaaggggcgattgttgggataatcggcccgaacggtgcaggtaaatcaaccctgttccgtatgctgtccggtcaagagcaacctgattctggtacagtctctctgggtgaaaccgttacgctggcttccgttgaacagttccgcgatagcatggatgataagaaaactgtttgggaagaggtttccggtggtcaggacatcatgcggatcggcaactttgaaattccaagccgtgcctatgttggccgctttaacttcaagggcgtagatcaaggcaaacgtgtcggcgaattgtctggtggtgaacgtggccgtctgcatttagccaaactgctgcaagttggcggcaacatgctgctacttgacgaacccaccaatgatctggatatcgaaactctgcgagcgctggaaaacgccctgttggaattcccgggctgtgcgatggttatttcccatgaccgttggttccttgaccgtattgcgacacacattattgattatcaagatgaaggtaacgtcgctttctttgaaggaaacttcagcgaatacgaagattataaaaagcggacaatgggggctgctgcactggagccacaccgcattaaatataaaaaaatcagtaaataa

SEQ ID NO: 1390 - DNA, 213 bp, Xenorhabdus bovienii
  Coding DNA location: Contig name=SeqID_16855; Position on contig =141402..141614bp; Strand=+
ttgaaggaaacttcagcgaatacgaagattataaaaagcggacaatgggggctgctgcactggagccacaccgcattaaatataaaaaaatcagtaaataaacctgatagcgaaaacggcctgatatcaggccgtttttccgagttgacttatccccttcatctttcaagttgctgctttgttggctgcaacttgaagtttattgggatataa

SEQ ID NO: 1391 - DNA, 726 bp, Xenorhabdus bovienii
  Coding DNA location: Contig name=SeqID_16855; Position on contig =141618..142343bp; Strand=-
atgaacttaaatcaatttaaatcgattgaggttatcaatatttcatatggtttgactgataattcagttaatcatgaaatgatttcagatatcacattttctattataccaggtgaaattactttgataacaggaccgaaagcatcgaccaatagcacattgctatcgattgcatcgggtatgttacaaccagatcaaggagatgtattaattaataataacaagttgaaactaatgaatgatatcgaattgggaaagtttcattatgaaagtagtgggtttatttttcatgactttaatttatccaataaactgacgctcttagataacttgttattatcaacttcttatggattaacactttctagtgagcaagcgacaaaaatcgcgcagaaatcattggatattgtcaaattgggtcataagagccgttattaccctggcgagctatctgaaaatgaaaaacagctggctgcgatggcaagagcaatagtcagaagacctgaatatctatttgccgatgatccgacgcgtaacttgggccataaggagtttcagatgttcgtcgatatctttaaatttattgcgcacgaacaaaaaggtacggttgtgattgcttctcaagataaccgcctggttcaatacgctgatagcatgattacgttagaaagggggaaggtcgttaagacttatgaatcctttcaagaaaaaagagtgatggtgtag

SEQ ID NO: 1392 - DNA, 120 bp, Xenorhabdus bovienii
  Coding DNA location: Contig name=SeqID_16855; Position on contig =142370..142489bp; Strand=-
atgagtatatccttatcaggatgtttcacatataaactatttttatttgtacaatgtctaatagatattagtagtatcacaaatgaatctaggcagcatatgttaaggaaaaagctttaa

SEQ ID NO: 1393 - DNA, 1227 bp, Xenorhabdus bovienii
  Coding DNA location: Contig name=SeqID_16855; Position on contig =143014..144240bp; Strand=-
atggggcaatttgactacttgaaagaagctattaaacaggcgagttacacattgcagcaagtggctgatgcctgtggaatgacaaaaggctatttgagccaacttattaacggcaaaataaagagtccgagtgcgcagaaactggcatctattcatcaatatttaggattagcgtatcccatggaaaagaaaaccgtcggtgtggtgtttggtaaattttacccgttgcatactgggcatatttatttgatccagcgggcatccagtcaggtcgatgaattgcacgtcgtcctctgttatgacgaattgcgggatcgtgaattgttcatcaatagttctatgtctcagcaacccacagtcagtgaccgcctgagatggcttttacaaacattcaaatatcaaaaaaatatccacatccacgtttttgatgaacatggcatggagccttatccgaatggctgggaagtatggagccggggagtgaaggcattcatggcagagaagagcatcaatcctgaatatatctattccagtgaagcgcaggatgtagcatgttataaagaatatttcgatattgaaactatccttattgatccacaacgttcattcatgaatatcagcggcagccagatacggcaggcaccttttcgctattgggaatatattccaacagaagtgaagccattttttgtgcgcaccgtggcaattctgggtggtgagtcgagtggtaaatccacactggtaaacaagttagccaatatgtttaacacaaccagcgtatgggaatatgggcgagagtacgtgttctcccacttgggaggggatgaaatggctctgcaatactcagattacgataaaattgcattgggacatgcacaatatattgatttttcagtcaaatatgccaataaagttgcttttattgacactgatttcgtgacgacacaggcattttgcaagcgttatgaaggaaaagagcatccctttgtacaggcgatgattgatgaatatcgatttgatctggtcattctgttagaaaacaacaccccgtgggtggctgatgggctgagaagtttaggtagtgaacgggaacgtaaagagtttcagcagttacttgagagtttgttgaagaaaaataacgtcgattatgtttgtgtcaactcagcggactatgatcaacgttttctgcgctgtattgaattagttcaacacatgttaatggcgtaa

SEQ ID NO: 1394 - DNA, 105 bp, Xenorhabdus bovienii
  Coding DNA location: Contig name=SeqID_16855; Position on contig =144626..144730bp; Strand=+
atgaataaaaatatcactcaaaatttcgcatatttatttgagtcggatgtaaaaactgaatttcctaaaaaccaagatattagaaaaaaatgggacagttattga

SEQ ID NO: 1395 - DNA, 1431 bp, Xenorhabdus bovienii
  Coding DNA location: Contig name=SeqID_16855; Position on contig =144794..146224bp; Strand=-
gtgagttttctggccgccaaaggcagccatataagggagtacagagtggcaaaagcagtaaaaagggcatttgtctgtaacgaatgtggcgcggattatccccgctggcaggggcaatgtaccgcatgccacgcatggaataccattacggaagtgcgtttggctgccgcttcatcttcccgcagtgagcgtttcagtggctacgcgggagaggtcagtatcagcaaagtgcagaaactcgctgaaatcagtctggaagagttgccgcgattttcgaccgggtttaaagaatttgaccgtgtgctgggtggtggcgttgtacccggcagcgcgattttgattggcggtaatcctggtgcggggaaaagtactctgctattacagaccatgtgtcagttatctgaacagatgaaaacgctgtatgtgacaggggaagaatcgttgcagcaggtggcgatgagggcacatcggttgggattaccgacggataaattgaatatgctgtcagaaacgagcattgaacaaatttgtctgattgccgaacaggaacagcctaaactgatggtgatcgactctattcaagtcatgcacatggcggatattcaatcttcaccgggcagtgtcgcacaggtcagagaaactgcagcttatttgactcggtttgcgaaaacgcgtggtgtggccattatcatggttgggcatgtgacaaaagatggctctctggcggggccaaaagtgctggagcactgcatagattgttcggtaatgctggatggtgaggcggattcccgttttcggactctgcgcagtcataaaaaccgttttggtgcggtaaatgagctgggtgtgtttgccatgaccgaacagggattgcgggaagtgagtaacccttcagcgatttttttgagccgaggagatgaggttacgtcgggaagttccgtgatggtcgtatgggaaggtacccgtcctttgctagtggaggttcaggcgctggttgatcactccatgctgtccaacccgcgtcgcgtcgctgtagggcttgagcaaaatcgactggcgattctactggctgttttacatcggcatggtggtttgcaaatggctgaccaagacgtctttgttaacgtcgttgggggggtgaaagtgacagaaaccagtgctgaccttgcgttattgctttctttggtttccagtttccgtgatcgccctttgcctcgtgatctggtggtatttggtgaagttggtctggcaggggaaatacgccccgttcccagtggtcaggaacgcatttcagaagcagccaaacatggctttaaacgcgctattgtgcctcacgctaacatgccgaaaaaagcattgccagagatgagagtgtttggtgtcaaaaaattggcagatgcactatctgtgttggatgagttggatgactga

SEQ ID NO: 1396 - DNA, 984 bp, Xenorhabdus bovienii
  Coding DNA location: Contig name=SeqID_16855; Position on contig =146226..147209bp; Strand=-
atgttcatgtctaataatctggcctaccgttacctacccgatgagatccataaatggccgggattaccgttatccctcagtggcgacgaagtgatgccgctggactatcgcgcaggggatagtggctggttactgtacggccgcggtttggataaacagcgtattagcgattttcagcaccgtctgggaattgccattgtcgtggtctcatcatggcgtattgataattatcaagttgtccgcattgccggcagcccttccccacgtattaaacggttggcagatgagtgcagccttgatgtcgttcctctggggcagatcccacgcctgcgttcaccaggtctgttagtgatggatatggattcgaccgccattcagattgagtgcattgatgaaattgcccgtctggcgggcgtcggtgataaggtggctgccatcacggagcgcgcgatgcagggagagctggacttctcagaaagcctgcatgaacgggttgctcaactggcaggtgcagatgcatcaatattgcagcaggtgatggaaacccttcccctcatgccagggctgacgagtcttgtccgcaagttacagtcgctggattggcatgttgcgattgcatcgggaggttttaccttctttgcggataatcttcgtcagcagctacgtctgtttgctgcggttgctaatcagcttgaggtcaaagatgacaaattaacgggcaaggtcaaagggccgattgttgatgcaaaatacaaggcaaccacgttggtacggctggcaaaagaactgggtatcccactgagtcaaaccgtggcaattggggatggggctaacgatttgaaaatgatccgcaaagcggggctggggattgcctatcatgcaaaacctaaagtgtatacgcaggccaaagtaggtattcgccatgctgatttgatgggggttctgtgtgttttgagcggtggtttaaaacacgaagagcgttaa

SEQ ID NO: 1397 - DNA, 663 bp, Xenorhabdus bovienii
  Coding DNA location: Contig name=SeqID_16855; Position on contig =147320..147982bp; Strand=+
atgatcaaagcaaaactaaaatttcggctgcacaagacggcgattattttaatatgtatagcactgctggtattactgctgcagggtgtctcctatttcagtcgttctcagcaacaggctcaggtaaatcagtttgaagatctggcgaagactctggcaaaacaggtagcatacagcttgtctgattatatggagaatggcagcaaagatcttaataataagaagattgtagccagtctgaactatctgaccagcaaaagtcgcattttggatgccagtgtttatctggaaaatggcacccagatcgcgcggagcggtgagccaatttctgttcgtgaccggttatcgttagatggcaaaaaatcaggcagctatttcaatcagcagctcgttgtccccatacccggcaaaaatgaaccaaaaggttttctccgcctgacactggatagtcacaggctagaaacagaagccaagcaggtggataatacgacgaatttactcaggatcatgatcctgctggcattggcgattgggtttgttctggcacataacttactacaactcactcccagtcgctggcagcaatcaccttatctcttgaccgccaataccaaatcctctgatgaggatcgagaaaataaaagcgacacctctcgacgctaa

SEQ ID NO: 1398 - DNA, 210 bp, Xenorhabdus bovienii
  Coding DNA location: Contig name=SeqID_16855; Position on contig =147942..148151bp; Strand=+
atgaggatcgagaaaataaaagcgacacctctcgacgctaaccttcttccccaattcatcatttcatctgaattcagcataaccactgaattcagatggtcttctttcctgttttttctgcataaccccctattttcacagataaatgactatgtatttttatcatcacatcatttattactaaaccctgatgttgcagtctgtgaataa

SEQ ID NO: 1399 - DNA, 105 bp, Xenorhabdus bovienii
  Coding DNA location: Contig name=SeqID_16855; Position on contig =148112..148216bp; Strand=-
atgatgtttgacacagtatttgactccttacgattatcaaagatgcctaatatgattcttgctgattattcacagactgcaacatcagggtttagtaataaatga

SEQ ID NO: 1400 - DNA, 144 bp, Xenorhabdus bovienii
  Coding DNA location: Contig name=SeqID_16855; Position on contig =148215..148358bp; Strand=+
atgcaaaaaagtaattacttaacccactcggagattgaaatactactcaaagagttgggaaaacaccctcatgctgaacgaaatatatgcatgatatttatgggctttattcatggttccgggtttctgaattgcttggactaa

SEQ ID NO: 1401 - DNA, 456 bp, Xenorhabdus bovienii
  Coding DNA location: Contig name=SeqID_16855; Position on contig =148301..148756bp; Strand=+
atgcatgatatttatgggctttattcatggttccgggtttctgaattgcttggactaaagctttctgatgcggggggtcaactgatacgccagtggcttgcccaacgtcagaagtacaaaaacagtgagcagaatgactggttattcttgtcgcgcacaggggtacggatgtcccgccagcagttttataaaatcatccgacaaacgagtttacaggccaatttagcggtttgcgcgaatccgcacatgctacgacattcctgcggttacgcgctggcggacaatggcgtggatacccgcttgattcaggactatttagggcatcggaatattcgccatacggtacgttatactgcgagtaatgcgggtcgtttcgggactatctggcaggaaagaggaaaacgaaaattgtctacaattagtaccaaactgttaactgaagatgattggtcctaa

SEQ ID NO: 1402 - DNA, 168 bp, Xenorhabdus bovienii
  Coding DNA location: Contig name=SeqID_16855; Position on contig =148920..149087bp; Strand=-
atggcttttttttgccagaaatacccatcagataatacgtggcctaaatacggtatttggttaacaattagtaccaaactgttaacccgtcaattatcctactttttgcaatccgtttattctcatttcatccgaaagaatcaaagtaatagattgattacaatgtag

SEQ ID NO: 1403 - DNA, 102 bp, Xenorhabdus bovienii
  Coding DNA location: Contig name=SeqID_16855; Position on contig =149024..149125bp; Strand=-
atgaataaatcgagaagtcaaagccattcctgttcggaatggcttttttttgccagaaatacccatcagataatacgtggcctaaatacggtatttggttaa

SEQ ID NO: 1404 - DNA, 279 bp, Xenorhabdus bovienii
  Coding DNA location: Contig name=SeqID_16855; Position on contig =149143..149421bp; Strand=-
atgcgagtcagtatgctggtaggaaaacgaatccaaatgaaaaggaaagaagctgggatgacagtagcagagctggcggacagaatcagcgttagccaacagcaattgtcgcgttatgaacgaggaaccaataaaatcagtctggaacatttggttgatgtttccattgctttgaaaacgcctgctgattggtttttggaagattgcttcaataaaacccaagtccatgttaagagtcaatatgcttttgtggcggaaacaattttggacttatattga

SEQ ID NO: 1405 - DNA, 837 bp, Xenorhabdus bovienii
  Coding DNA location: Contig name=SeqID_16855; Position on contig =149439..150275bp; Strand=-
atgcgccatattaagaaatcactgatgaagttcgtagcattgttgtttttcttaagtgcctcatatgcctatgggggcgcttatgttatggcggttgatactcaaccattaggtaatcaggctgtcacgaccatggaaattattgcctggacagaggaagaaggaataccaaacccttgttatggcagcagtcaatgctatgtcgggcctgatgttttttataataatggcaataaaccaggtatgtatggttcctgccttggagcaggtgcgtgtttggatgatgcaaatcgataccttacaactgcagatgtaatgcgggcttataaaaggaaactgggtattccttttagaacaagatttaccatcatgagtaaggaagctgattgtgtagggttgttttactcctatggaacatctccaggttatggttcagcggaaaaatttcctaattccacttgtggtaagttaccccccccaaatcagaattgctctatttctgtgccttctgaaattgcttatggcgcattaaaagcatcagatgtcaataatgcgacgcgttcgatcacggggcaggtgaaatgtgctcttgagggaagcttccgattagaaggtttctcaacgaatagagaagcaaaaatttacttggattcgaacagacagatgtataccacactgcagattaatgggcgggaagcaatggaagggatgaatttgaaagcgaaaggaagaaatcaaccggaaaacttcacactgacatccatattgcgtacgagcacaccaccaaaagccggtaaatatgaaggaatcgcagtagttttattaagttataattaa

SEQ ID NO: 1406 - DNA, 564 bp, Xenorhabdus bovienii
  Coding DNA location: Contig name=SeqID_16855; Position on contig =150342..150905bp; Strand=-
atgagtccgttaaatatgaagctatccaaatatgtactgccagccctgtttattttcggcattggtggtcagaaaagtgcctatgcacaagatagtctgcgccagaatgtcaaaattacgctgactgtactcgctgctccctgtgtgattaagacagaagataaagcgatggaggtgtatttgggccgtattcttaaccgtgacctttatcagaaccatcgcacttcaggccagcatttcgaactgcatctggaggagtgtgatccccgtgtcgcgcaaagcctcaagatcaggtttatggggccagagagtcgagcactgcccggattgctggcattcggtgctgacagccgtgcttccggtgccgctattggtatggagagcatcgatggcaagccacttccttttaacaaagtcagtaaatttccgctctctcgtaccagtagcagtaatgtgatcccgtttcgagcgtatgtacaagctgaaccccgcgctatccaacaaaataggattggtgctggtgcattcaatgcaattgcgacctttgaagtcagttatgagtaa

SEQ ID NO: 1407 - DNA, 759 bp, Xenorhabdus bovienii
  Coding DNA location: Contig name=SeqID_16855; Position on contig =151015..151773bp; Strand=-
atgaaaatgaaaaaaattctaatggtaaccgctataacggtgacaagcctgatgccagcttatcaggcaatggctgcgatggcattggatcgtacccgggtaattttcaatggggatgtcaagtccgttagcttgaatattgaaaaccagcatgtcgatttgccttatctggcacaggcgtggattgaagatgacaagggaaataagattaatggcccgctcgtggtagttcctcctgtacagcgtgttgaagcaggagcgaagagtcaggtcaaaattcagacattaccgacaatagccgaattgcctcaagacagagaaagcctgttctatttcaatttgcgtgaaattccgccacgcagcaataaacctaatgtgctgcaaattgcgttacaaacccgggttaagttgttctatcgcccggaagccgtcattgctcgccgtatcgaccttgataacccatggcaggaaaaactcactttgacccgtcaggcaaatcaatatctggtgagtaacccgacatcttattacatcaccatttcggaagcctctaataaggttaatggtaagaatatcgatggttttcaacctttgatgctagcacccagaagtagtgaaaaactcgggggagacctcagtgcgctgggcaatgcgccagtactgacctatgtcaatgattatggcgggcgtccacagctaacattcagctgtaatggcgatatctgcacggttgcgaaaaccacagttgaagaaaactga

SEQ ID NO: 1408 - DNA, 2661 bp, Xenorhabdus bovienii
  Coding DNA location: Contig name=SeqID_16855; Position on contig =151899..154559bp; Strand=-
atggctttgttttcaaattccatgaatcatcatttttcagctattaatataaaaaacaacattaataaagagaacgtcgctaataaaaaaataatcgataataaagcgaaagtcgttaatagaataaaagcagtccgcttaaaaaatagaattaaacctctttcggcattggtattgtttgcactggcgggtatgcaaacagcatattctaatccatcaattgaattcaatatcgacgcgctggatgtcggtgaacgtgccaatatcgatttggataaattctcccgcgcaggctatatcatgcctggtaactatattatgggtgtccggatgaataaaaatgaatttccggacatgtattcgattgattttaccccacaacccgatgaccctaaaagcagcgaagcctgtatatcccctgaactggtgaagcaaatagctctgaaacaggagtgggcagaaaaattaggctggcagaatgatggaaagtgtcttgatctcggcagtttgccaggcatgtcagccagaggggatctggcaacttatactctgtatttaattgttccgcagatctatctggaatatgacttaccggattgggatccgccttcccgctgggataacggtgtacctggagtattgtttgactataacgtcaatgcgcagacatctaaacccacccatggcagtagcaaccagcaggtgagtgccaacggaacagcaggtatgaatgcgggcgcatggcgttttcgggctgattggcaggctaattataaccggacaaaaaaaaaggataataagcagggagcttctggagaaagagagcgtgactgggattggagccgttactacctgtatcgcgccatacctcgccttcaagctcaattgacttttggggaagattatctgaattctaatatcttcgatagtttccgttatacaggggttagtttggtgacggatgacaatatgctgccgccaaacttgcgtggatacgcccccgaagtttccggagtcgcgagaaccaatgccaaggttactgtgcgccagcagggacgggtgctgtatgaaactcaggtcgctcccggcccgttccgcattcaggatctcagtgatgcagtaacgggaaatctggatgtcagagtagaagaacaggatggtggcatacaggaatttcaggttaatacggctacagttccttatctgactcgccccggacgcgtgcagtataaattagtcggtgggcaatcgaccaatgacaaacatcgtcgggaagggcccgcgtttgggttgggcgaattctcctgggggattaataacggctggtcattgtatggcgggttgctgggagcaggggattacaacgccttgtctctggggatcggtcgtgacttgatgatgtttggtgcgctgtcttttgacataacggaatcaagggcaagactaccgaaagagaataaaacctttacgggtggttcatatcgtctcagttattcgaaacgtttcgagcaatacaatagtcaggtgacctttgcggggtatcgtttctccgagcgtaattttatgagtatggcgcaatatatcgaccgccgttaccgcgatgttaactctgatagtggaaaagaactttataccctgattttcagtaaacaatttaaggatcttggtcttaatgcccatcttaactatagccatcagacctactggaacagaccaacaaatgatcgctataacatctcgctgtccaaatatttggatattgggcgttataagaatatcaatgtgaacttatccgcctatcgcaacaattttgacaataaaaaagatgatggcgtgtatctgaatctgtctattccgtggggagagagcggaacacttagctataacggtttggccaatcgtcagggtaattcgcatatggctggttatttcaaccgcattgatgaacgaaataactatcgtatctctgcgggtagcagcatcggtggtaaggctgccgcagatggttattacacccattatggtgataaaacgttgctgtctgccagtgccagttatcaggatggcgggtatacctccgcagcacttggtcttcaaggtggagtgaccgtgacagcaaatggcgcagcattgcatcgtatcaatcttcctggcgcaactcgcctgatggtggatacggaaggggttagtgatgtgcccgtcaggggatttggctctgttgttcatacaaatcactttggtaaggcagtgctagtggatgttaatcactattaccgcaattctgcaaacatcgatttagacaatttgccggataacgtagaagccctgcgttctgtgcaacaggcaaccctgacggaaggcgcgattggttatcggaagttccaggtgatgtcaggatttaaagcgatgaccattatccgtttgcctgatggttcattcccacctttcggtgcttctgtcatgaacaccgctcaacgggaaattgggattgtcagtgatgatgggtatgcctatctgagtggaatgaatgcaggtgagaaattgcaggtacattggaatggcggggctcagtgtgaaatcactgtaccgcaagaaatatccgaagcatctttgacttcatttttactaccttgtcagtttttaaaaggtgaacatcagtaa

SEQ ID NO: 1409 - DNA, 135 bp, Xenorhabdus bovienii
  Coding DNA location: Contig name=SeqID_16855; Position on contig =154729..154863bp; Strand=+
atgtcctgcttatccgtaatatctcacgctttctcttctttgtgctttactgattttaccgtacagcgggaagtagaggaaaaatgtcactacaggtatgccattaaaattacattaaaatggctaaaagcctga

SEQ ID NO: 1410 - DNA, 546 bp, Xenorhabdus bovienii
  Coding DNA location: Contig name=SeqID_16855; Position on contig =155166..155711bp; Strand=-
atgaaacttaataaattggcgatggttctgggttttggtgtcgctttgacggctggtgcggcaagcgcagttaaccaaggtagcggaacagttaaattcagcggttctattattgatgcaccttgttcaatcaaaaacactaatattgatgttaatctgggcgcggtttctagcaatatcctgaaaggtggtggccgttcagaatcgaaagcgttcaaaattgaattacaaaactgtactgctaaaactcaaaacggtgtgaaaacaacctttactggtgcagaagctgatgagaaaggtttattaggcattgaaggccctggatctggtgctgcaattgccattaccaatgcgggcggtaaaatcattcctctgggtacagaatcagataaattttctctgcatgaaggtagcaatgctctgaatttcgccgcacacttgaaaggccttaccacagcacaaggagtagatggtaaaaatcagcacagtgaaatcaaaccaggtacattcactgccatcgcaaactttactttaaactacctgtaa

SEQ ID NO: 1411 - DNA, 717 bp, Xenorhabdus bovienii
  Coding DNA location: Contig name=SeqID_16855; Position on contig =156441..157157bp; Strand=-
atggctaccccacatattaatgctgagatgggcgattttgctgatgttgttctgatgccaggcgatccattgcgtgcaaaatacatagcggaaacttttttagaagatgctcgccaggttaacgatgttcgcggcatgctgggtttcaccggtacttacaaaggccgcaagatctctgtcatgggtcacggtatgggtatcccatcctgctctatctatgctaaagagttgatcaccgaatttggtgttaaaaagattattcgtattggttcttgtggtgcagtcagccacgatgtcaaaatccgtgatgttgtgattggtatgggagcctgtactgattccaaagtaaaccgcatgcgttttaaagatcatgatttcgcggcgattgctgactttgatttggttcgcaatgcagtcgatgcagctaaggcgaagaatatcaacgctcgtgttggtaatattttttcagtcgatctgttctatacaccagatccacaaatgttcgatgtgatggaaaaatatggcgttctgggcgttgaaatggaagcggcgggaatttatggtgtagcggcagaatttggtgctaaggcattagcaatttgcaccgtttctgaccatatccgtacgggtgaacaaacctcggcagaagagcgtcagacaacgttcaatgacatgattgaaattgcgcttgaatcaattttattaggtgataattaa

SEQ ID NO: 1412 - DNA, 1224 bp, Xenorhabdus bovienii
  Coding DNA location: Contig name=SeqID_16855; Position on contig =157231..158454bp; Strand=-
atgaaacgtacgttcatcatggtattggattcctttggcatcggtgcgagtgcagatgcagagaaatttggtgataagggatctaacactttggggcatattgcagagcagtgtgcttgtggtgaggctgatatcggccgcaaagggccattgcagctgccaaacctgagccgtttggggttgggtaaagcaaccgaggaatccagcgggatcttcccgataggtttggatcaggatgctgaaattattggggcctacggttatgcgagtgaactttcttctggtaaagacacaccatcaggccactgggaaattgcaggtgttccggttctgttcgattggggctatttccaggaattagacaacagtttcccacaagaattgctggataaactggttgaacgcgctaatctgccaggctatctgggtaactgtcactcttccggtacggtcattctagataacttgggcgaagagcacatgaaaaccggtaagccgattttctacacctctgcggattccgtgttccagattgcctgccatgaagaaacattcggcttggatcggctgtatgaactctgtgaaattgctcgtgaagagttgaacctaggtgattataacatcggccgtgtcatcgcccgtccatttgtgggtgacaaggctggcgatttccagcgtaccggcaatcgtcatgatttggcggttgaacccccagcgccaaccgtactgaaaaaactggttgacgaaaaacagggtgaagttgtttctattggcaaaattgcagatatttatgctaacgtcggtatcaccaaaaaggtcaaggcaacgggaattgatgcactgtttgacgcttcactggttgaaatggaacaggctggggataacaccatcgtatttaccaactttgttgattttgactcctcttatggccaccgtcgtgacgtagcaggctatgcagcggcgttggagttgtttgaccgtcgcttgccagaaatgctgaaaatggttaaagaagatgacattctgatcctgacggccgaccatggctgtgacccaacctggccgggtacggaacacactcgtgagcacattcctgtactggtttatgggctgaaggttaaacctggctcattgggacatcgcgaaacatttgctgacattggtcagaccgtggcgaaatatttcgacctgacgccaatggattacggtaaagtgatgttctga

SEQ ID NO: 1413 - DNA, 120 bp, Xenorhabdus bovienii
  Coding DNA location: Contig name=SeqID_16855; Position on contig =158414..158533bp; Strand=+
atgccaaaggaatccaataccatgatgaacgtacgtttcataattttctcctgcgtcagtcaattcacgctatcaatgcggaaactgtcggctgttaaaatctattttcattattcatga

SEQ ID NO: 1414 - DNA, 1206 bp, Xenorhabdus bovienii
  Coding DNA location: Contig name=SeqID_16855; Position on contig =158538..159743bp; Strand=-
atgaccatttatttccatgatatgacgatggaagagcgtgtggcactgactttggcaatgtgcgattccggtacggttctggattggaaaaaattgaatttacatggcccgatcgtagataaacactcgacgggcggtgtcggtgatgtgacctccctgatgcttgggccgatggtagccgcctgtgggggctacataccgatgatatcaggacgtggtttggggcataccgggggaacgctggataaattggaatccatccccggttttgacatctttcctgatgaacagcgcttccgtgacattatccgagatgtgggtgttgcaattatcgggcagaccaattcgttggcacctgcggacaaacgtttttatgcgactcgtgatattactgccaccgttgattccatccctttgattacggcctctattttaggcaaaaaactggctgagggattggatgcgctggttatggatgtgaaagtgggctctggagcattcatgccgacttatgaacagtcagaacaactggcagaatccatcgttagcgttgctaatggtgcgggttgcaagacaaccgcgttgttgacggatatgaatcaagttttggcctccagcgccggcaatgcgctagaagtgcgtgaagccgtccagtttctgactggagaataccgtaatcctcggttatttgaagtcactatggcattgtctgcggagatgctggtatcgggtaatctggcggcagatcgtgccgaagcacgccgtaaattgcaggcggtgctagacaatggcaaggcggctgaaaccttcgagcgtatggtggcagcacaaaaaggcccgatcgattttgtcgaaaattatgctcgttatctaccggctgcctcttttagcaaaccggtgtttgctgggcaaaatggcataattactgaaatggatacgcgggcattgggaatgtccgtggttgcattgggagggggtcgccacaaggccactgatcccattaattacagtgtggggctgagtgatattgttgcacttggtgcagaagtgaacgcagatactcctctggcaatgatttatgccaataacgaaaatgattggcaggaagcggcggaggtcgtgcgtaagtccatcgttttgggaattgatgtgagtaccgaaacaaaagccgccacaccgatggtttaccgccacattgatggctaa

SEQ ID NO: 1415 - DNA, 174 bp, Xenorhabdus bovienii
  Coding DNA location: Contig name=SeqID_16855; Position on contig =159726..159899bp; Strand=+
atggaaataaatggtcatcgccagtgctgcgatctgcccttcagaaacggtattatcacgaactccgttaataaagaaacggatctcttcttcactcaaccggtgaccgtcacgttttttgcggataatttcctgtgccagaaacaaagcgacctcccaatcatcattatctga

SEQ ID NO: 1416 - DNA, 780 bp, Xenorhabdus bovienii
  Coding DNA location: Contig name=SeqID_16855; Position on contig =159957..160736bp; Strand=-
atgaccgatttaaccgcagctgctcagcatgcgctgagtttgatggatttaacgacactcaatgatgatgatacggatgagaaagtggcgatactttgtcatcaggcaaaaagcccggtgggtcatactgccgctatctgtatctatccacgctttattcctgccgcacgtaaagtattgcgtgaacagggtactccggacattcgcattgctacagtgaccaacttcccacacggcaacgatgatatcgatattgcactggctgaaactcgtgcagccattgcttatggcgcagatgaagttgacgtggttttcccctatcgcgctctgatggcaggtaatgaacagattggcttcgatctagttaaagcctgcaaagatgcctgcgttgcatctggcgtctggctgaaagtgattattgaaacgggtgagttgaaagaagagaatctgatccgtaaagcctctgaaatttcaatcaacgcaggtgcggattttatcaaaacctcaacaggtaaagtccctgtcaatgcgacactggaaagcgcagaaattatgctcagtgtgatccgcgacatgggggtaggtgaaactgttggctttaaacctgccggaggcgtacgtacagccgaagaagccgcacaatatctggcactgtctgcgcgtatcatgggagacaaatgggccgacccccgtcatttccgttttggtgcttccagtctgttgggcaatttgttgacagtgcttggacaccaaggccaaaagcaaagtagtggttattga

SEQ ID NO: 1417 - DNA, 198 bp, Xenorhabdus bovienii
  Coding DNA location: Contig name=SeqID_16855; Position on contig =160788..160985bp; Strand=+
ttgaacgattgttttgaacgattagtgagttcgtttgttggcgagcggacttggttccttgaagatgttgccatagttatgcacaacagcaacagtagagttccttctctccgcactatactttcttcagcttttactgccccggcgggcaccaacttaatccatgaagccttggcacatcattatttgaacatgtaa

SEQ ID NO: 1418 - DNA, 1278 bp, Xenorhabdus bovienii
  Coding DNA location: Contig name=SeqID_16855; Position on contig =161143..162420bp; Strand=-
atgcaactcattatgagcctgatagggatggtagtgctgatttttatcgcagtacttttctccagtaattaccgagctattaagatccgcacagtcttgggcgcctttttgattcaggttgctattggggcatttgtactttacgtaccagcgggtaaagacgttctgattggaatgtcaaaaggcgtttccaacgtcattgggtacggtcagaaaggaacggattttatctttggcgggctggtttccgacaaaatgtttgaactgttcggcggcagtggttttatctttgctctgcgcgtcctgcctgttatcgttttcttctcctcacttattgccgtcctgtattacatcggcgttatgcagattgtgatcaaaataatcggtggtggcctgcaaaagctgctgggaacatcacgaactgaatctctgtctgcgaccgcaaatattttcgtcggccacactgaagcgccgttggttgtccgtccttatatttcgtccatgactcaatctgaattgtttgctgtcatgtgtggtggtctggcttctgtggcaggttcagtattggctggctacgcatcgatgggcgttccattggaatacttgattgccgcttcattcatggctgcaccgggtggcttgctatttgcgaaactgttagtgccggaaacggaaaaaacacgcgacaccgatgatgtcatgtcgctgattgcggctgaagatcgccctgccaatatcattgatgctgcggcatcaggtgcggcatcgggtatgcaactggctctgaacgtgggagcaatgctgctggcattcaccgccttgattgccttgctgaatggtatgctgggtggtatcggtggctggttcagctatcctcaattgtccatggaactgattttgggctggatgttctcaccaatcgcctacctgattggtgtaccgtggaatgaagcgactattgcaggttctttcatcggccagaaagtggtcgtcaatgagttcgtggcgttcatgaactttggcgaatatctgaaaccgaacgaggtagttcaggccgcaggtctgcaagtgctttccgatcataccaaagcgattatttcctttgcgctgtgcggcttcgccaacttgtcttctgtcgctattttgttgggtggtttaggcggtatggcgccaaatcgtcgtggagacattgcacgttttggtctgaaagccgtactggccggttcactctctaacttgatgagtgcaaccattgctgggttcttcctcgcgttataa

SEQ ID NO: 1419 - DNA, 102 bp, Xenorhabdus bovienii
  Coding DNA location: Contig name=SeqID_16855; Position on contig =162454..162555bp; Strand=+
atgaaaaaatatgccagttatattgtgagttcctaccggcattgtgcgaggccgattatacctagtagtaaaaaagaacaagcaactaacatcacaaattaa

SEQ ID NO: 1420 - DNA, 108 bp, Xenorhabdus bovienii
  Coding DNA location: Contig name=SeqID_16855; Position on contig =162666..162773bp; Strand=+
atgagtaaagaagaccaattaaggattattaatatttatttaatacgaatgctcacttcctgttaccctaaaaaaacatattatttctgtggttataagtcagcttaa

SEQ ID NO: 1421 - DNA, 771 bp, Xenorhabdus bovienii
  Coding DNA location: Contig name=SeqID_16855; Position on contig =162765..163535bp; Strand=-
atgtttattgatacacattgccattttgattttcccccctttgcagggaatgaacaaacgagtctgaaacaagccaggcaagcgggggtggacaccattatcgtccccaccgttagtcaaatgaattttcagcgggttgctacgctggcatatgactatccttccatctatgctgcgtttggtctgcatccactgtatatcaatgagcatcaagcttctcatttggatgagttggcgcagaagctgaaggaaaaaaatcccaaatgtgtggctgtaggagaaatagggcttgacctttatatgccggagccacagtttgagaaacaaaaaagggtgctggaagcgcagttagcgttggctaaaaggcacgatttgccggtgatactccactcccgaaaaagccatgatcaactggccaccatactgcgaagacatgacttaccacgcacaggagttattcatggctttgctggtagcctgcctcaggcacaggtttttattcgtttgggattttacattggtgtcgggggaacgatgacttacgcgagagcacaaaaaacacgcagtacaatttcccaactgcctctgtcgtcccttgtgttggaaacggatgcgcctgatatgccactctctggataccaagggcagccgaaccgaccagaaagagtcgcacaggttttttctgtgttgtgtgaattgcgtcgagaatctcctgatgaaatggccgaccagatttatcacaacagcatggcactatttgcgttaagctga

SEQ ID NO: 1422 - DNA, 1116 bp, Xenorhabdus bovienii
  Coding DNA location: Contig name=SeqID_16855; Position on contig =163536..164651bp; Strand=-
gtggggaaacatattccaataacgttgggtaacatagaacctttagcttataaatcacagatcaagccaggaaaaattgcacttgtttgtgaaggtggtgggcagcgggggatttttaccgcaggtgttttggatgaattcctccggcttggctttaatccgtttgaattgttccttggaacttccgcgggtgcccagaatatctctccctatatttgtggtcagcggggctatgcccgcagagtgatcaatcgttacacaaccgcacccactttttttaatccgctgcgttttgtccgtggcgggcatttgatcgatctggattggtatattgatactatatctgaacaattaccgctgaatacctctgttgcgatgcatcagtttgatgctggccgtgaattctacatgtgtgcctgccgcgcagataactttgaacctgattattttcaccctaatgaacataattggatggagatcttgaaagcctccagcgccattccggggttttatcgcaatggcgttacccttggtgacacagtttatcaggatggtggcatttgtgacgcgattccggtacaagaagcttatcgccgtggcgcagatacgattgtcgtgatcaggacagtgccttcacagctttattataccccgcagtggttcaagcggatggagcgctggttggaagccagtagcctgcaaaagatggtcaaaatgatcaatctccatgctaagagttacagccggacgcagcaatttatcgaaaacccgccggatgatgtgcaggtattcgaaatttatccccctgcgccattggctacgatggcattgggaagccgaatcagtgcattaaatcaggattaccatttggggcggcgttgtgggcgatactttttggctaccattgggcataccttcgttggtgggaaatttgggctggaaaagcgtaaaagttatggtgtctgtcgcagtggtttaaataatgatgaggttaatcacgatggcttcaggcgatatagcttgctggacagcataaatcgtccggtaatcgaagtgcaggaagagggtatgacaccgctgacaggcgccattatgttggatgacgtggataagtag

SEQ ID NO: 1423 - DNA, 183 bp, Xenorhabdus bovienii
  Coding DNA location: Contig name=SeqID_16855; Position on contig =164660..164842bp; Strand=-
gtgggaaaacgattcctcagggggattttactttccttttttcataatatagcttcagtatttgtggtacgctctatttttcactatttaacgaaaattttacaaacgtattgtttgaacaacaatatactgatagatagtcattattcagattactctatgacactgtcattgattttttag

SEQ ID NO: 1424 - DNA, 105 bp, Xenorhabdus bovienii
  Coding DNA location: Contig name=SeqID_16855; Position on contig =164878..164982bp; Strand=+
gtgaaatgtaaagtaccgaagtgtagctatacacgaacgggactttacatacctaaaagtattttacccgttataaaagtgcttaaccaagtagcagtagcatga

SEQ ID NO: 1425 - DNA, 120 bp, Xenorhabdus bovienii
  Coding DNA location: Contig name=SeqID_16855; Position on contig =165001..165120bp; Strand=-
atgtttttttctcaccgaagatataaatttattgatgtaacgctaatatttttagagttcattgtcttaaaaattattttcggaaaatgccttctttttttctttttcttgtcattataa

SEQ ID NO: 1426 - DNA, 171 bp, Xenorhabdus bovienii
  Coding DNA location: Contig name=SeqID_16855; Position on contig =165280..165450bp; Strand=-
ttgactgggtggctgctaataggccactctttttattgttactgttttatatccattaggaatttatttatattttctgcttcagaattaaatctccacttatcaataaataatataaatataggtcgaatttttggtattaaattaagaattaaaattcgtaatctttaa

SEQ ID NO: 1427 - DNA, 387 bp, Xenorhabdus bovienii
  Coding DNA location: Contig name=SeqID_16855; Position on contig =165460..165846bp; Strand=-
atgacggaaggtgataggatgaaacacataaagtttacacattcactactggctattgttttaggttcagttctgataagtagtaacgcactggctgcattaacatctccagctagcacattggaaagtgtaagcagcaaagttgacaactctttgaaacacgcagacgcttatgtaagcgatagcagtattactgcgcaagtaaaagcggatttactgaaaactaaaggattagatagcaatgatatttcagtgaagacggaaaaaggtattgttcatctttcaggttttgtcaaaaacacatatcaggctaaacaagtagccaaaattgttcataaagtgcatggtgtcaagtcagtgaaaaacacattaaaggttaaaaaataa

SEQ ID NO: 1428 - DNA, 1590 bp, Xenorhabdus bovienii
  Coding DNA location: Contig name=SeqID_16855; Position on contig =166031..167620bp; Strand=-
atgtcaaattttccattccagcaggaagtcgcgaaacgacgaacctttgcaataatttctcaccccgatgcgggtaaaaccaccattactgaaaaagtattactgttcggacaggcgatccagaaagcggggacggtaaaaggtcgcggctctaaccagcacgctaaatcagactggatggagatggaaaaacagcgtggtatctccattaccacctctgtgatgcagtttccttatgatgattgtctggttaacttactggatactccagggcacgaagacttctccgaagatacttatcgtactctgacggcggttgactgttgcctgatggtcattgatgccgcgaaaggtgttgaggatcgtacccgtaagctgatggaagtcacccgtctgcgtgacactccaatcctgacattcatgaataaactcgaccgcgatatccgtgatccgatggaagtgatggatgaagtggaaaatgagttgaagattgcctgtagcccgattacatggccaatcggctgtggtaaatccttcaagggggtttatcatctttaccttgatgaaatttacctgtatcaatccggtcaagggcataccattcaggaagtccgtgccattaaaggattgaataaccctgagctggatgcggttgttggggaagagttggcgaatcaattacgtgaagagctggaactggtaaaaggggcatcacatgagtttgatcaggaagcctttttacagggtgagctaacacctgtatttttcggcacagcgctgggtaacttcggcgttgaccatatgctggatggccttgtcaaatgggcgccaatgccaatgcctcgtctgactgatgcgcgtgaagtgacagcagaggaagaaaaattcacaggttttgttttcaaaattcaggccaacatggatccgaaacaccgtgaccgcgtggcattcctgcgtgttgtttccggtaaatatgaaaagggtatgaaactgcgtcaagtccgcctcaagaaagacgttgtcatttcagatgcactgaccttcatggcaggagatcgctctcatatcgatcacgcctatgcgggggatattatcggcttgcataatcatggcacgatccagattggtgatacctttacccagggcgaagaactgaaatttaccggtattcctaactttgcgccagaattattccgtcgtatccgactgcgtgaccctctgaaacaaaaacaattgctgaaaggtctggttcagttatcggaagagggggcagtacaggtatttcgtcctctggctaataacgatctgatcgttggggcggtgggtgtgcttcagtttgacgtcgttgttgcccgtttgaagagcgaatacaacgttgaagcattgtatgaatccgtcaatgtttccaccgctcgctgggtagagtgcaacgatgcgaagaaactggaagagttcaagcgtaagaatgaattgaacttggcactcgatggtggtgataacttaacttatattgcaccaacaatggtcaatttaaatctaaccagcgaacgttatcccgaaatttctttccgtaaaacacgcgaacactaa

SEQ ID NO: 1429 - DNA, 135 bp, Xenorhabdus bovienii
  Coding DNA location: Contig name=SeqID_16855; Position on contig =167755..167889bp; Strand=+
atgattatctggctgagtgctatcatctttttcactcatggcgcggcgaactcgttcaacgacttcaggagtgacagacccctcggccagacaggaaaagtcgcatattttctgacaacacaaagcaaacgatga

SEQ ID NO: 1430 - DNA, 507 bp, Xenorhabdus bovienii
  Coding DNA location: Contig name=SeqID_16855; Position on contig =167908..168414bp; Strand=-
atgacttatcccttgacgggaatgcaaaacgctctctttggcaacaaatttaccattatgaagaatatttctctattaactcccgctgatcttcccgcagcatttcaaatagaacagttcagtcatgcattcccgtggagtgaaaaaaccttttactccaaccagggagagcgttatctgaattataaaatcacgctgaatgaccagattatcggctttgcaatcatacagtgtgttgtggatgaggccacgctatttaatatcgtcatccactctgagcatcaatcgcaggggaatggaagagcgttgttgactcacctgatcaatgtgctgccagaaaagcagattaatacgctatggcttgaagtacgaagttcaaatacatcagcgattggtttgtatgaagatctgggtttcaacgaagtttctatccgtaagaattattacccaacggcgacgggaaaggaagatgccattattatggctttacctctgtttgctggttga

SEQ ID NO: 1431 - DNA, 411 bp, Xenorhabdus bovienii
  Coding DNA location: Contig name=SeqID_16855; Position on contig =168326..168736bp; Strand=-
atgacgaagcgtgacagattactcgcccaattggggatcacccagtgggttgtgcgcagcccgagggccttgcaaggtgaattgtctgtcctcatccctgactcaactcgtctgttgatcattacccatgatcatattgatttaagtcattcattgtttgctgatatttttacagccatggggattgatgcctcatcggtttattgcatcacgacaaaagatgttgagctgctttcagaatcaatccattgtccatgctggctgttgggggttgatattaccttatcaatacaagggatttctttgagaagcccagcattaaatgacttatcccttgacgggaatgcaaaacgctctctttggcaacaaatttaccattatgaagaatatttctctattaactcccgctga

SEQ ID NO: 1432 - DNA, 99 bp, Xenorhabdus bovienii
  Coding DNA location: Contig name=SeqID_16855; Position on contig =168825..168923bp; Strand=+
ttgccctccgatgtttatacttggataaagatttataaggagctatacatagatgtcagtattaaccccggccagcgaagttatcctgcgccaccatga

SEQ ID NO: 1433 - DNA, 913 bp, Xenorhabdus bovienii
  Coding DNA location: Contig name=SeqID_16855; Position on contig =168877..169789bp; Strand=+
atgtcagtattaaccccggccagcgaagttatcctgcgccaccatgagcaattcatcaaccatcacctgctgcttgccggtgatcttcaggacaatctggcaacggaaatcgaagccggaagtgtgcgagtacatactaaccaatatcaccactggcaatccctgatccgtcaactgggtgacaatgcctcttttggcctcgttgcggacagcgcatttgtcaaagggtgtgatacattgatttattactggccaaaaagtaaacatgaagcgcgcttccagttacgcagcctgttttccattctgccgcccggaaccggtgtttttgtggtcggcgagaatcgcactggtgtacgcagtgttgataaattaatggaaggtattgtgactttccagaaagtggatactgcccgccgttgcagtctcttctatggtcaactggaaaatcaggttcaatttgatcaaaataattggtggaacagctatcaggtaggtgatgtcaccgtcaacacgctgcctggcgtattcagccaagatgatctggatgtcggcagtcgtttgttgctttctacttttgatggccctgtttctggtagtctgctggatatcgcttgtggctcaggcgtattggcagcggttctgggtaagaaaaaccctgatttgacactgacactgagtgatgtcaatgccgcagccataacatccagcaaggccacactgaaagccaataaactggaaggcaatgttgtcaccagcaatgtgtattccgctattgaggaaaaattcgactggatcatttccaatccaccattccacgatggtttaaaaaccaatttagccgcggctgacgacctgatccgcatggcgccaaactatctgaagtctggcggtaaattgcggatcgtagcgaacg

SEQ ID NO: 1434 - DNA, 138 bp, Xenorhabdus bovienii
  Coding DNA location: Contig name=SeqID_16856; Position on contig =490..627bp; Strand=-
gtgctacttttcggagttatgcgtgtctggggtgtgatcgggcaggtcgctgcattggggataggcgttgtactcgttgcggtcttggaatggtgcgccgctgcttcctccgttgtatgtatggtggtctcgcggtga

SEQ ID NO: 1435 - DNA, 285 bp, Xenorhabdus bovienii
  Coding DNA location: Contig name=SeqID_16856; Position on contig =652..936bp; Strand=+
atgcgacataaaccgtgcgcgcttatctcccgccgggacaaaggcgtatgggaagaactgcttgaagaactcatctttgaacccgatttcgaatggctgatgattgacgccagtcatattaaggttcatccccacgccgccggcgccgcaggaggcaatcaggatatggggcgcacaaaagggggctcaatacaaagatacatctggccgtggatgcgcatggtatccgatcagagcgcttattcaagcggtccacagcggatgctccaagctgaggccttatga

SEQ ID NO: 1436 - DNA, 321 bp, Xenorhabdus bovienii
  Coding DNA location: Contig name=SeqID_16857; Position on contig =351..671bp; Strand=-
atgacgggtcgctataccccgggggggttggagatgagacaggaaatgtttcgggtggggggcgtggggcgggagggggcccgaggggatctgggcgagggggccgaggtttgggggcgggggtttggggggggatgccgggggggtcgggtggacggggggggggatggggggaggggcacaaaggggggaagagaaacggggcgcacccccgggggagggggagagcaggaaggggggggcgaaggggggggtgggggggcactagcgctaaagcgggcatgccaggcgggaacacggccagatgtatctttgtattga

SEQ ID NO: 1437 - DNA, 285 bp, Xenorhabdus bovienii
  Coding DNA location: Contig name=SeqID_16858; Position on contig =88..372bp; Strand=-
gtggatgcgcatggtatgccgatcagagcgcttattacaagcggtcccacagcggattgctcacaagctgaggccttgattgacggaatagatgcagaacatttattagcggatcggggctatgacagtaataccgttgttgaacaagcagaaaaacaaggcatggcagcgcaaattcccggccgaaaaaatcgcaaagtgaaacgagaatatgatcgggaacttagtggacttacccggttagccgggaatgctatactccccttgttcgcttgcgaggtatag

SEQ ID NO: 1438 - DNA, 492 bp, Xenorhabdus bovienii
  Coding DNA location: Contig name=SeqID_16858; Position on contig =294..785bp; Strand=-
atggatgacttaaccatgagcacacccgtacaccgccgtcacgatatttccgatcatatttggagtttgcttgaacctcacctgccgggacgtaagggagcctgggggcgtgttgcttatgataatcgattatttattaatgccgtgttctggattttacggacaggcgcaccctggcgagatttaccgcccgattatggcgactggaaaaatacgcatcgccgtttttgtcggtggcgggacaaaggcgtatgggaagaactgcttgaagaactcatctttgaacccgatttcgaatggctgatgattgacgccagtcatattaaggttcatccccacgccgcaggggcggcaggaggcaatcaggatatggggcgcacaaaagggggctcaatacaaagatacatctggccgtggatgcgcatggtatgccgatcagagcgcttattacaagcggtcccacagcggattgctcacaagctgaggccttga

SEQ ID NO: 1439 - DNA, 315 bp, Xenorhabdus bovienii
  Coding DNA location: Contig name=SeqID_16859; Position on contig =301..615bp; Strand=+
atgtgcccaataggaactgagagaattagcaaggatggctatgtttatataaaagtggacagacctaatatatggagattgaaacaccgtatgatatgggaagagcatcacggtaaattaccagcaggcgctattgttattttcaaagatggtaatcagaaaaattatcagattgataatctacttatggttacccgccgggaaaatgtaattttaaataaattttaccccaacacacctgctgagtataaacaaaccactacgtatttagcgcgtataatgatagcaattaataataaagagagagtgatatga

SEQ ID NO: 1440 - DNA, 186 bp, Xenorhabdus bovienii
  Coding DNA location: Contig name=SeqID_16859; Position on contig =612..797bp; Strand=+
atgaaagtcacaatcgaagtaccgaacaagaaagaccttgatatggcatttggattagtcacagatttcttgaagcaaaaagataggaaagtaaatgaatctgcgttctttactattaacaatgaacgctcgggacgaatcagggaatcacataaaggcaatatcacgtgtcgcatccatgactaa

SEQ ID NO: 1441 - DNA, 2197 bp, Xenorhabdus bovienii
  Coding DNA location: Contig name=SeqID_16860; Position on contig =1..2197bp; Strand=-
atggattgctactgcatattcgactgttatttaaaccccctgcatataagcttttataaattcttccgcaaccggtgcgacgatggcatttccgtaggcgcggaggcgtcccattctgttggtaatcccatcaattgccttgccataattggctggtatgattctaattttctcatctgctccctggttgggttcccattcattccaaacgtgtgtacccatcaccagcgtaatgagaattcgccctattcttgggaatacaatgcattgggacaagccgtttgtataactgaccgtatgcaacgccagaaccgctatcaatataactccgaaggacatttagtacagattgagaatgccaatggtgggcgttatttgctgaaccgtgatgcggaaggacgtctgattgaagaaattcgtcctgacgataccttaatccagtatgaatacaatatggctggtttgttaagtgttgaaaaacgcatgggcgaccgtgtattccgacaacctgttcattcgatttattttcattacgatgctgcgggcaaccttatcaaacgagaaaccagtactgatagctaccagtaccaatgggataaaatggggcggttgttgaaagccagtcgtgaccctaatactgctggaaaacaactagggctgctgccgaatacgattagttttgaatatgatgagctgggacgggttattcgggaacaaaatgacaaaaatgtactccagtttaatcacgatgaaatggataatctgacagagctaactttgccgcaaggtgataccctgcgctggctctattatggctccggccatctcagtgcagtgcgctataaccagcaaattatcactgaatttgaacgtgacaatttgcaccgtgaaatcagtcgaacacagtgcaagttatttcagttccgtgaatatgatccattggggcgccgcattagccaatacagtgtcagggataaatcagcgtctattggacagggcaaaccgtggcgagcatggcactatgatgggcaggacgaactgtctctgatggaagatcattatcgtggctgggtggaatatctgtatgactcagaaagtcgcctgaaaaaagtcaccagcgtggacagctttgaagaaatgctgtggtacgaccgtgcagacaatttgttggaacgtccacaatccatgattgagcatgaatcgaaagagagcaagcatctgacaccacaaggtgacaggctgatacagtggaaccagtggagctacaaacatgatgagcatggtaatgtcatcatgcgtggaacaagtagagggaacaggcagacgtatcgttatgatggggataaccgtctgactctttcggaaggtggtggcatgaaagctatctaccattatgatgcccttggtcggcgtattcgtaaggtggtcactacatggcccacaggcataccacagcaagagcaaacagaatttgtttggcacggacagaaattattgcaggaacacaatgttaatatcggtaaaacccacacatattgttacgagtctcatgaaagttatacgccgttagcctgcattgttgctagtggaagcatccgtgagtatttctggtatcacgcggatatcaatggagcaccactggaagtcacggatgaagaaagaaagattgcgtggtcaggaaagtatgatgcatttggggcggtcaatagcactacaatggcgtattttaccgatacggaacgttcatcaaagagttttgaccaaaactttcgctattcagggcagtattttgacaaagagacagggttacactttaatacttatcggtattatgcaccggagattggaaggtttataacaccagatccagtaggattaagtggtggattgaacctatacgtttatgcaccaaacccaatgagttggatagatccttggggtttagctaaagataaaacctacactgttactcgaaatatgaatgcaacagaagcagaaaaaacaaaaaatgcgggaggattagttccgggtgagacaaatggaaaacctgatagaagagccaaatgggttagcattgacggagccaattatgatagaacgacaactccaaggccaacacatcaagccactattgaggtaacaaaagatgggtatgatatgttgaataacaaagatattgttgaagctggacaggaat

SEQ ID NO: 1442 - DNA, 273 bp, Xenorhabdus bovienii
  Coding DNA location: Contig name=SeqID_16860; Position on contig =2232..2504bp; Strand=-
atggcatgggaagttgacgacagtcgtgctacatggaaacaaataccacctgcggccgaacgtaaatatgaagaatgggtgagaactataacagcaagtaatagacacccacgtgacgctgcagaggatgtaggtggctgtaattttaaaatgttgggcggtacatcgagtggtatagaacaatacaccatcagacttagtaaggatcacagagttttatttacaatagagggtgaaatagttaatgttcgccaagtgggtggacatacttga

SEQ ID NO: 1443 - DNA, 255 bp, Xenorhabdus bovienii
  Coding DNA location: Contig name=SeqID_16860; Position on contig =2618..2872bp; Strand=+
atgagcaataatttgattgagaaaataaatacaacattggaatcagccgaggaatttaaatcggaaggtgccagtataataacattagatttggatgtctatattacaatattaaaacgtctggccgaatatgaaaatatggagccaattgccatatataatttagctgatggtgagatttataaaagcattaatgatataggcgatggaaaaagcgtattcgcagtaaatctataccctcaccccaacaaatag

SEQ ID NO: 1444 - DNA, 99 bp, Xenorhabdus bovienii
  Coding DNA location: Contig name=SeqID_16860; Position on contig =2882..2980bp; Strand=+
atggatattatcgacacagctaacgatgccgttgagttgacggtagataaagaatatctattcgatattggcaatgaaaaattgaggaaaatagcatga

SEQ ID NO: 1445 - DNA, 225 bp, Xenorhabdus bovienii
  Coding DNA location: Contig name=SeqID_16860; Position on contig =2977..3201bp; Strand=+
atgaagaataaattggaagatttgaataaccatttgttcgttcaattagagcgactatctgacgaaaatattctgaatgaacaattggaaaaagaatttcgccgtgcaaaatctatttcagacattgccatccagatagttaacaatgggaaactggcacttgatgttaaaaaagccatcggtaatcaagacgtagattctctacctaaatttctaggtgggtaa

SEQ ID NO: 1446 - DNA, 582 bp, Xenorhabdus bovienii
  Coding DNA location: Contig name=SeqID_16860; Position on contig =3204..3785bp; Strand=+
atggctcagtttaaatacactgataaaatgaaaaattggatgaggatttattacggtttaccagtgcaagaactgactgctaaattcaatgagcatttctctgttaattactccagtaaatcaattcacggattcagaaggcgattagggttacgcaccgggcgaacgggacaatatccaaaagggcatatttctcataatgcgggaactaaagggttaatgaagcgtaactcaggctcattcaaatcaggaagttcaccccataatatgtgcccaataggaactgagagaattagcaaggatggctatgtttatataaaagtggacagacctaatatatggagattgaaacaccgtatgatatgggaagagcatcacggtaaattaccagcaggcgctattgttattttcaaagatggtaatcagaaaaattatcagattgataatctacttatggttacccgccgggaaaatgtaattttaaataaattttaccccaacacacctgctgagtataaacaaaccactacgtatttagcgcgtataatgatagcaattaataataaagagagagtgatatga

SEQ ID NO: 1447 - DNA, 306 bp, Xenorhabdus bovienii
  Coding DNA location: Contig name=SeqID_16860; Position on contig =3876..4181bp; Strand=+
atgaatctgcgttctttactattaacaatgaacgctcgggacgaatcagggaatcacataaaggcaatatcacgtgtcgcatccatgactaacgaattcgagaacggaagacggcaggtggcaagggagtgccgaagcgaattattcaaaatcaagaaacgcaccgaccagcaaaccgcaacaatactcactcagtacctaccccgatttgaaaccgctatgtcgccacatcaaaagagcaaattcttgcctgtgatgtggctgcgatactacgtagatatgattgataaggagatgaagcaatga

SEQ ID NO: 1448 - DNA, 402 bp, Xenorhabdus bovienii
  Coding DNA location: Contig name=SeqID_16860; Position on contig =4178..4579bp; Strand=+
atgaggctcatcactgataataatgagatagaaagcataactttatccagaaagaaagcggcagcgctcatagggattgatgtggacacattatccctatggtgtcagataggtaaaatagcctacaccaagaagaaccccaccaagccaaactcaccttatttatttacacgcgccgcatgtattgcagcaatcaacaatccgatccaaactgtgcttgtgagcgcggtagatgcgacagagaaaggagataaacaatgtcaatcttccgtagaggaaatacgtggtatgggaactacacgacgccaagcggcaaaagaattaaggaatctcttgggacaacggacaaaaagcaagctcaggagttgcacgaccgaagaaaggccgagttatggcgcatag

SEQ ID NO: 1449 - DNA, 1158 bp, Xenorhabdus bovienii
  Coding DNA location: Contig name=SeqID_16860; Position on contig =4435..5592bp; Strand=+
atgtcaatcttccgtagaggaaatacgtggtatgggaactacacgacgccaagcggcaaaagaattaaggaatctcttgggacaacggacaaaaagcaagctcaggagttgcacgaccgaagaaaggccgagttatggcgcatagaaaggttgggtgatttccctgatgtgacctttgatgaggcgtgcttgcgatggatcgaggaaaaagctgataagaaatcactggatgatgataaaggccgcatggcgttctggttggaatatttcgaaggagtaagactaaaggatatcaccgaagccagaatttatacggcaatcagcaagatgaggaaccgcaagaccaaacagcgctgggaaagtcgagttaaagccgcccagaaaaaaggaaaagaagtccctgcatatacagaagtttccgtctcggtagcgaccaaagcaaagcacttagcattgatgaagtctctgctaagggcagctgaacgggattggaaatggttagagaaagcacccgtgatcaaggttccagccgtcagagataaacgtgtcagatggttagagtctcatgaagcccaaagattagttgatgaatgccccgaacctttacagtcaatcgtcaaatttgcactggcaacaggattaaggcgctcaaacattatcaatcttgaatggtctcaaattgatatgcagaggcaagtagcatggatacacccagaccaaagtaaatcggatagggctataggggtatccctaaacgaaactgcttgcagggtgttacgtgcccagataggaaatcataataagtgggtgttcgtccataccaaaccatcaactaatcccgatggaatggtaatgcctaatatcagaaagatgcgtgttgatgataacacagcatggaattcagcattaaggcgagctggaatagaagatttccgattccatgatctgagacatacttgggctagctggctgattcaatccggtgttccattatccgcactgcaagaaatggggggctgggagtcaattgaaatggtcaggcgatatgctcatttagcgcctaatcacttaagcgagcacgcacgtaaaattgatgagctttttggaaatctagtcccaaatccgtcccattcgggaaaaattgtagttgcaaaatag

SEQ ID NO: 1450 - DNA, 93 bp, Xenorhabdus bovienii
  Coding DNA location: Contig name=SeqID_16860; Position on contig =5682..5774bp; Strand=-
atgcaaagcctgcttgcaatgatgagagcagaaaacaatcaggcaaacagaggaaaaataatacgggggtataatagggggtgcagcagttaa

SEQ ID NO: 1451 - DNA, 102 bp, Xenorhabdus bovienii
  Coding DNA location: Contig name=SeqID_16860; Position on contig =5753..5854bp; Strand=-
atgataaaagaacggataggctatcttgaagttatcattgcatttttagcaatttttatttcattgatgatatttttgcaatgcaaagcctgcttgcaatga

SEQ ID NO: 1452 - DNA, 984 bp, Xenorhabdus bovienii
  Coding DNA location: Contig name=SeqID_16860; Position on contig =6286..7269bp; Strand=+
atgacctataaacaactgaccgaaacagaaagatatcagattttcagcttgaaagaagccggtttttcacaacgggagatttcaacgtcactcaatcgaaacccatcaacgattagccgggaattgagacgaaatcgggaggcaaagaaatatgcgcctgaacaggctcagcttaaggccgtagtgcgccgacattgtgctacaaaagcagtaaaagtgaaaccagagatagaaatgtggatcaaacagttaatttggcaagatttaagtcctgaacaaacagtcggttatctcaaaagggaaaatataatatctttgcatcatgaaacagtttatcgattgatttataaggataaacttaatgggggtgatttatggcaacatcttaggattgcgaaaaaaccgtatcgtaaacgctatggaagttatgagcgcagaggaaaaattaaaaacagagtcagtattgataagcgccccaaacttgttgataaaaagcagcgtattggtgattgggaaggcgatactatcgttggtaaagatcataaaagtgcattattaacattagttgaacgaaaatcgttatttactatcataattaaacttgaagataaaacagcagaaggggtcgcaaaagcggccacaagacatttatcactgataaaacataaaattaaaacaatgacctttgataacggcctcgaatttgccgaacacgaactgatcagtaaaaatttagagacaaaaatttattttgctcacccgtattccccctgggaaagagggataaatgagaacacgaatggattaatcagagattacttcccaaaaggaactgattttaataaggtatcagagctggagattaaccttgtggcaaaccgattaaataatcgccctcgtaaaacacgagattaccaaacaccgaatgagttatttaaaggaatacccactcatttacttcgttcattacggtgttgcgcttaa

SEQ ID NO: 1453 - DNA, 264 bp, Xenorhabdus bovienii
  Coding DNA location: Contig name=SeqID_16860; Position on contig =7252..7515bp; Strand=-
ttgaaacgttgtcaaagatcaccagcattctcagaaataaaaaaagagataaaaaaatatgctaaagatatgaataagtggtgggggaatttgcagcattattcaattgcggaatggtcattaataattggtatagggtgttgggggatcccaaataaaaacgctcaaatgattactttcctacttagcttgatgttcttctttgataagcttttttccattagttataaatcttggattcacatattaagcgcaacaccgtaa

SEQ ID NO: 1454 - DNA, 282 bp, Xenorhabdus bovienii
  Coding DNA location: Contig name=SeqID_16860; Position on contig =7628..7909bp; Strand=-
atggaaggggtagcagtaatgaataatgttaaaaatgattggcatcaggccgatataattgccgcattacgtaaacgtggtacaaccttagcggctgtttctcgcgaggccggactgagttcatctacactggcaaatgcattcagtaggccgtggcctaaaggtgaatggataatcgcggattatcttggaatccacccttcagaaatctggcctagccgctattttgatatgtacggacagctcattgagcgcaaggttcgcaaagtttctactgaatag

SEQ ID NO: 1455 - DNA, 174 bp, Xenorhabdus bovienii
  Coding DNA location: Contig name=SeqID_16860; Position on contig =7884..8057bp; Strand=-
atgatcaacccactggtaggaaatttctaccagtgtgcctgttatcgccctttcaatggtggttcaggtagggaaggcattgccttgccggaatggttgatctccggtccgcgaaccctgtctgaatcgccaccatcaatattaattaatggaaggggtagcagtaatgaataa

SEQ ID NO: 1456 - DNA, 147 bp, Xenorhabdus bovienii
  Coding DNA location: Contig name=SeqID_16860; Position on contig =7987..8133bp; Strand=-
ttgagtaagctaaaacaatcagttaaagtaatcccgccattggcaaaatccaatggtcaaggcgtcgcggccttgaatgatcaacccactggtaggaaatttctaccagtgtgcctgttatcgccctttcaatggtggttcaggtag

SEQ ID NO: 1457 - DNA, 900 bp, Xenorhabdus bovienii
  Coding DNA location: Contig name=SeqID_16860; Position on contig =8151..9050bp; Strand=-
atgttgtcaggtataagcaaggggaagccaatgagccgattgattaaagaattaaaattttttgcctgtcagggtggtggcagtcataaaacctgccatgaccgtattcggattgcgggacgtttgggggcgttgttattgagcctgaatattcaggttaaaagtctcagccatttgaaagccaagcatgtagaacattacgttgatacccgtttatctcagggtgttgctaaacgaacggtgcagaatgaaatgtccgcgctacgcaatattttccgcatggcaggcagggagaaactggaaacttctccgcgtttgagcaatcaggcattgggattaagcggagccagccgcgccggaacgaaacaggcgatccctgatgccacatttcaggtcgtttatcagaaggcgcttaaacgtgatgccggatttgctgtcacactgaaacttgcccgtttgatggggttacgttctcaggaagcggtgcaatgcagtgcttcattgaaaagctggcggaaacagttagaacaaccagagccgaaactgcatgttgttttcggtacaaaaggcggcagaccaagacaaacccgcgtattgaatgttgctgctgtaaaagaagctgtcgatcaggccattgctattgcagagcaacgaggcggcaggttgattgaaaaacccgatcttaagcaggccatgaactattggcggacacacaccacaaggattggtttagtaggttgtcactctcctcatagcctgcgctatgcgtgggcgcaggatgcactgaatttttaccaacagaatggttttagccgtcaggaagcaagggcgctggtttcaatggatttaggtcatggtgatggtcgtgggcgttacgttgagcgagtttatagccgttaa

SEQ ID NO: 1458 - DNA, 93 bp, Xenorhabdus bovienii
  Coding DNA location: Contig name=SeqID_16860; Position on contig =9049..9141bp; Strand=+
atgcgatctctggcgcgcgacagaacggacaaaacaggcaatgcctgcttcgtccttgacggatatctgtgcgccagagtgaacgcaggttga

SEQ ID NO: 1459 - DNA, 180 bp, Xenorhabdus bovienii
  Coding DNA location: Contig name=SeqID_16860; Position on contig =9275..9454bp; Strand=+
gtgcggttaatcagacgtgagcctgttagggttgtactgtcctttggttgcggcgtcactttcagcggtaaaccggcaaaaagtgacgccttaagtcccgtaaatagtcagcaaacgttgtgcacgttgaaataccatcagttacagcaaaacgccgcaagattcagtgtcaaacggtag

SEQ ID NO: 1460 - DNA, 210 bp, Xenorhabdus bovienii
  Coding DNA location: Contig name=SeqID_16860; Position on contig =9613..9822bp; Strand=+
atgttcactacacttgattggcaatataaaaacaccttttgggtgtatttttttagtttaagaaaccttcatcatcagacaaggggtttatgtctggcaatacctacttccaaaggtgcgcaggtgtaccgcaatgcttgctctccctttcaggctacgggagttttgtttcgccaccctaaggcgagcctgacaggcgatggatcatga

SEQ ID NO: 1461 - DNA, 474 bp, Xenorhabdus bovienii
  Coding DNA location: Contig name=SeqID_16860; Position on contig =10111..10584bp; Strand=+
atggctgatgttcattcacctacagttcgtagtaacaatatgaaagctatccgtaatcaaggtacaaccattgaagtaaaactagcagccattcttgacaatttaggcttagagtttagcaagcaggtaaaagagctggctggcaaacctgattttgtgattgataaatatcgtaaaataatatttacaaatgggtgtttttggcatcaacatcaatgttacttgttcaaggttcccgcaacgaggaccgaattctggatagaaaagactaggcagaatgcattacgggataaaaatgtacataaaaaactcaaaaatgatggctggaacattatggttgtctgggagtgtgctatgagaggtaaatttaaattatctattcaagaattatcagaacgaattgaagaatgggtttgtgcaggggattattttgccgaaattgataccagagggatacatagtgaaaatgcttga

SEQ ID NO: 1462 - DNA, 135 bp, Xenorhabdus bovienii
  Coding DNA location: Contig name=SeqID_16860; Position on contig =10618..10752bp; Strand=+
atgatatattttatcctaattaatacaataaaaattgtattaattaaacaattagttacgtcaatttttcatccaaattacggattaattactacttcgacaggtattgtcaatgattcctatgggacttcataa

SEQ ID NO: 1463 - DNA, 1506 bp, Xenorhabdus bovienii
  Coding DNA location: Contig name=SeqID_16860; Position on contig =10993..12498bp; Strand=+
atggattttttatccctttccaaactaaccactcgtataatagatgtcataccacatgctgcatcactaatagaaggacatagagatttcggctataacctcgaaactgctctggcagatattatagataattcaatatcttccggtgctacatgtataaacctttatatagatgtaacaactgaaaaaccgtggatagctctatctgatgatggatgtggaatgactgagccggaacttatagaagctatgcgtctcggtacaaaaaaccctaccgatgaaagagcagctaaggaacttggtcgatttgggcttgggctcaagagtgcaagtttttctcagtgtcgctgcctaactgtgctgactcggcgtcacaatataatttcttgtgctcgttgggatcttgatcgtattgcaaatctgaatagctggacactagaactacccggtgatgtggaaaaaatcagtggttacgaactgctaccaggaacaggaacagtagttatctggcaaaaacttgatcgcctaagtgacggctatatggatgacatagcaaaacgtattactcatatgaatgctgaattctcaagagctgagcgccacttgagacttgtattccatcgctttattgagggttctaagccgaaattaaggcttttactaaacggtcgccagcttagaccactagatccaatggtatcatttcatccttcaactcaacgagcccccgaagatataatctcacttccaaaaggtaatgttcgtattcgatgctatacgcttccccatcataggaaaatggcaaaagatgagtgggaagaaataggcggtccagaaggtcatctcaaatctcagggactatacgtatatagggaaaatcgcctaatcattgcaggtagttggttgggactaactaagcaaacagagcttacaaagctatgccgtattgcaattgatattcctaactcaatggattctgaatggaaaatagatgtcaaaaagtcatctactcagctaccgtcaatagttcgagagcgcttaaagagggttattgagagatttattggaacatctaagcgtacttatcgcagtagaggtcaaaagttggtcgataccacgttgtatccaatttggaatcgaatccaaaagaatgatcaaattatcttccggccaaatcttgaacatccattatttctctcgtacctagagaaacttccagaaggactacacgaaggcttcaagagttgtttgcgtctcgttggttctggtttacctatcgaaacccttcatgcagagcttgttggaaatccagagtcagttatctcagactcggcaatggaatccgatttgaagcaggcggtgaacgatttagcaaaagtattaatagctaatggtgtagcaatagataagctttcagactcaatgcaaagctaccatttgttcagaactaattggaatctggtgaagaaacttattaatgactttgtaaaggagcaagttacatga

SEQ ID NO: 1464 - DNA, 2757 bp, Xenorhabdus bovienii
  Coding DNA location: Contig name=SeqID_16860; Position on contig =12495..15251bp; Strand=+
atgattaacatagaacgtgttaagaattgtgttatgaatatggtcgaaacagcactatttaatattccgtccaaaaaaacagaagaggaactccgcacatttatccgcaatgttgcctccattactcctcttgaagcaggcgaaaggaagttagccgaacaagagatagaacagatagcgcgtgaaattgagactaagcagggcattaaagctggtttaggagccttcatagataaggaagacttcgaaccatggctagataatgcgaaatcacatattgaaccgttttactggaacagatatcgccagcttttgttacaaactggactcccaaaagacgtcgtaattgcaaccgacacagtaacagacaagatccttagccgccttggagacccgaacaaacaaactccttgggatagacgaggtatggtcgtgggccacgtccagagcggtaagactgcaaactatataggcctaatttgtaaggctgcagatgctgggtatagattaattatcgttattgcaggcatacatagtaacttacggaaccaaactcaagctcggattgatgaaggattcattggtcgtgatactggcaaatcacagaaaaagaaaagaggagaagctaaaaatagtattggagtagggctctttgactctaataaaacccccgtaagccttactaacactttaagagatttcaataaaggaacagcatcaacaaacaccagtgagatagattcttacaacgttcctgtagttttggttataaagaaaaatcatcgaactctaactaatcttttggagtggcttaaagacaacagtgcccgaggagatcgggagatgatagatcaacccatgcttctgatagatgatgaagctgacaacgcatcgatcaacacaaagtacaacaaaaaattagtcacaacaataaatcgtcaaatcagggagttactgaacacgttccaccgaagctgctatataggatatacagcaactccatttgcaaatattttcattgatccggatcaagaagatgaaatgtacaatgaagatttattcccccgagattttatcattggattggacgcccccagtaattatttcggtccctcgaagatcttcgtcagagatttacagggtgaaggtgaatcaacttggcttagaaatataactgataatgaagatatcctgccaattattcacgagaactatcgtgaaatccatacattacctaattcgttgatcaatgcattgcgtacctttcttattgccagagcgatcagaaaccttcgaggacagataaaatctcattgttctatgctcgtaaatgcgagtcgttttaccgctgtacagggaaagattagaaaccgtttgtatgaggttttggaacacatacaaaatgcagtaaggataaatgcaagcaggaaagctgaagcgctgaaagatccggagattgctgctttgtactcagtttgggagcaagaatattccgatgcagaacctgattggttcaaaattcaggctatacttcttgatacaatcgcctcagccaaagttgttgaagtaaatagtcgcatcaatgacctagattacacaagttccgacgaacgtgggcaaacagtgatcgccgtaggtggcttctcactatcacgaggacttacccttgaggggttaactgtaacttggtttctccgtaatactaagatgtatgatacgcttatgcagatgggacgctggtttggttatcgtaacaactatgaagacctatgtcgtatttggatgcctccagagggtattagctggtattcatttatagcagcagcagcggaggaattgcacgatgaattacgtacattggaacaggcaaaagcaacaccaaaaatgtttgggttggccgtacgaaaacatccagcaacgcttcttgtcactgcacgaaataaaatgggttcaggtaggcctgtaacaatgcaagtgggtttatccagaaaatttatcgaaacatctagggtaagcgccaatctaaaagaccttaatatgaataaggagttagctaaacgtcttatccaaaatctgagtatcggtaatttcgaagaaacaaaaccatctgcaggtacatgtgtaatgcatgtcccatttgaaatggttgagcaatttctttctggttgggggaatgctgaacaaagcataacaactgacccagatcttgttttaaagtatatccgggcaaaaaaaaatgatcatgatgaactagaatactgggacatattgatttccggcagacaatccggtgaagtaaaccatgaacttggtagagaaattatcccaattagaaggtcggttgaaccatcagaccttttaaacaatttcatatcattcaatgggcaacgaatgagaattgctgatgctagctttgaaaaagcaggattaagtgaggatgagatttctatagcagaagcaggttacagtattaatggtaagcagaaaaattatccaggccatatctatcggtcagtcagaaaacgcccattgctgataattatgctggtagaaacattcccgatgaaaggggaagaacagaaactaggtgccgaattaatacctcttgaacctattatagcgtggggaatcagctttcctgaatctaagcgcccaaatgaaagcgtcgaatatatcgtaaacactgtacgataccaagaaattttcggcacagaagacgaagacgacgatcaagaggaagaactttgtgagcagtaa

SEQ ID NO: 1465 - DNA, 957 bp, Xenorhabdus bovienii
  Coding DNA location: Contig name=SeqID_16860; Position on contig =15241..16197bp; Strand=+
gtgagcagtaatccatggaataagctaggtatagataatgctcgtcgtatcaatagcgaaggacattttgatttcttctgggttgttcttgaggcaggtataccagggctcatgctcaagcttccggtagtttctcagcctattttccggcttcctaaactgaaaaacctcattgcatcgtttaggcctgtggctaatggctgggcatttgttcttggattaaaagaacgaagccagatcgaactctttgaaatactctgtcgcgatgtagtagctgcaggtgaggcggcagagagctgtgaagactctcttgcaagaactatccaacgcacacaacgttggcatcatctcttgcggggaggccgctctggaggactgtcagtagaagagcaacaggggcttgtaggagaacttgcctttcttcgagaacttgtgtctgcattcggagaaaaaacagcaatcgagtcttggactggccctatgggagcagccaaagatttcgaatttattggatgttatattgaagtcaagacccgccggatagcagctaaaccgtttatagcaatatcttcggacgaacaactagccgctattgataacagccgcttgttcctccgggtaattaatatagcatctgccgtgcttccgaaaggtatgagcctccatgaacatgtccgtattactgcagaattgtttgaaaaaagtggtgatgtttttgatgtttgggaagatgcactttattcgactgggtacgatcctgagaacggttatgacggaaagtgctggcaactcagttcaataacagactacgaagtaattgaaggctttcctagaatctcacctcctcttccagttggagtccagaatgttcgctactcaatatcccttgatgcttgctcaccgttcgagcttgaaactgacttaattgatagtatccgggagaaccttgacgtatga

SEQ ID NO: 1466 - DNA, 2091 bp, Xenorhabdus bovienii
  Coding DNA location: Contig name=SeqID_16860; Position on contig =16194..18284bp; Strand=+
atgaatgagctatttgaatttcatcaacatttgattgccgatgttcaaggggatgctgatgctcttggactggtgaccgtagaagcatttttcgaaaaggttggtgagctccttactgaggcaggagaaatcgatggggcaagtcgggcttatttggaaggcaactattcacgggctactcttcagctagatggatatgggggagatcccagagacagtgacggaatccttagcctcattttatgtgatttcgattcgaacaagggtcttcgtgaacttcataaaaagcatattcaaaaactgtcccaacgactatacaattttttgagctctagcttaaaatccgacttccgggatcaactagaagaaactagtcctggattcggagtagcagacctaatttgttccacttggaatgctattgataaaattaaattaattattgtcacgaatgccattttccggacaaggacagattcggttaatgtcgaagagttgtatggaaagtctgttacagtcagcgtctgggacttggaacggcttaagcgatttatggagcaaggccaatcaagagcaaacccggttatcgatttcgagcaagattttggtggggcgattccctgtttgcctgcttctcgaggagataaagccctcgaaagctaccttgtggtaattcctggtaaacaattggctgcgatctatgacaagtgggggccaaggcttctggaagcaaatgtgagaagctttcttcagattcgaggtaaagttaataaaggcatccgagataccattcgcgatgaaccacatatgttcttttcatacaacaatggactgagtgcaactgcagattcgatagaaataaatcaaaccagtacaggtctctacttaactcgcgctgataatctacaaattgtgaacggtgggcaaacaacagcatcgttacatgccgcaagaaaaatttttgcggaacagcttacccaagtttatgttcaattgaaactcactattgccccgcgagagcaatcagaaatagtggtacctcgcatatctgaatgtgctaatagccagaataaagtgaacacagcggacttcttcgcaaatcatccttttcatatccgtacggaagagctatcacgccgtattcttacccctgccggaaatgataattatcgcgaaaccaaatggttttacgaacgagctagaggacaatatgctgatgagagaaaccgtcgtacccaagcagaaagaaagaaattcgatgcagagtttcctcgatcacagttcttcactaaaacagaccttgctaagtacgaaaatacatgggcatgtttgccacatattgttagccttggtgctcaaaaaaacttcgcagaatttgctaaaactataggaagacgatggggttccgatggtgtttcattcgatgatctctggttcaagcgcatgattgctaaagttttaatattcagagctacggagaaattagtctctaatgcagattggtatgaaggaggctacagagcaaacatagtcacttatgcaattgccaaactagtgagtgatgcaggtgcttacgaaatgctaatagatctcgatagtgtttggcgctatcaaaaggtttccgatgagctgaaaacagctcttcttatggctggtcatgaagcacaaaatgttatcactaatcctcctaatggaattcgcaatttcagtgaatgggcaaaaaagcaaacatgttggcagtcgctttcggagagaaaattgccctacacaaaaacgttcacccagatgctcatttctccagaattagcagaagaaaaagtacgagaaacacaagctaataaggcattacagaacagtgtggaagccgagttaaaagttttccagctgggagcttcgttttggtcagacgctcggaattgggccagagaaagaggactgctctcacctaaagagatcagcataattgaagcctgtgctgcaatacctcacaaaatgccctcaagtaagcagtgttccattgcaatttctgcacttaagaaactccaaagtgaaggattttcagcaacagagattttcaaagattccaattaa

SEQ ID NO: 1467 - DNA, 150 bp, Xenorhabdus bovienii
  Coding DNA location: Contig name=SeqID_16860; Position on contig =18296..18445bp; Strand=+
atgttaaattcagctcatattaatatgtatgagctaatacaaaccatactaaccaatatggtaaactttatattcagatttattgttacattaaaaaaacttgggcttgcatatattttgcaacaagcccaattcatatttagagaataa

SEQ ID NO: 1468 - DNA, 1536 bp, Xenorhabdus bovienii
  Coding DNA location: Contig name=SeqID_16860; Position on contig =18652..20187bp; Strand=-
atgaaaacaggcgaaattcttgttattgatttatttgcagggccgggaggcttgggcgaaggcatttctttttgtcgtcataaaaatggtaactatccatttaaaattggtgtatcggtagagaaagaatcatcggcacataagacgctcacgacaagagctttctatcggaaaattaaagataatccctcttcacttaaagactattttttatatcttgaaggagagcttagtcgccgggagttgttccaacgctatcctactgaagcaagtaaagctcacaatgaaacacttgataaacctcgtgctctgggagaagacaatatactgattcatgagcgaattagggagttaacagaaaaacataaaggtccaaaggttgttatcggaggtcctccgtgccaagcttactcacttgcaggcagaacgcgaaatgcaggaattaaagattatagagcggaaaatgatcaccgtaatttcctgtacaaggaatatcttgaagttttgtcaattgctcaacctgatgtttttgtgatggaaaacgtaagaggaattttgtcagcaaaagttaacggtgaattgatctttcctaaaattctcgacgacttaagagagccaggaaaaattactaatcgtttaggggtgaaggggtataagatttattcattggttaaagaagatcgagacttgatcaatcctaactatacggattttgacgattttataattaaatcagaacaatatggtattccgcaggctagacaccgtgtaattttgctgggagttagagatgatattaagcaagtcccacaaattcttactccggtagaaaaaatggtgacagtagaacaggtattgtctgatcttcctccactgcgtagtggtttttccaaacgaaaagatgatgagagagagtggagaaatatagttgaggccaatgctcagaaggtacaagaatatttagaagacgtatttggctggaatgctgttagcacattggaaataaaaccatttaagggattgaagcggtcagaaaaggagaaaacgactaatctaagctctaatataccagaatatttacaagagtggtatttgaaaaatgtgcctcggattgtattgaatcatgaaacacgcggacacatggaaggagatttggtgcgttacgcattcagttctgcctacacatacttaaataatggagtctctccgaaatctcgagatttcccaaagaacttagctccagctcatgaaaattggaatacgggtacacatactgacagattcagaactcaggctgctaataaatgtgcaacgacggtaaccagccatatttcgaaagatggtcattactttattcactatgatccaagacaatgtagaagcttgacagtacgtgaagctgctcggctacagacatttcctgataattatgtttttgaaggaaacagaacacagcaatatgtacaggtcggaaatgcagtgcctccctaccttgcaaggcagattggtgagattgttctaaatttattagaatga

SEQ ID NO: 1469 - DNA, 135 bp, Xenorhabdus bovienii
  Coding DNA location: Contig name=SeqID_16860; Position on contig =20184..20318bp; Strand=-
atgcaacgaaaatggaactatttgtggttcctatgtgtccgaacacgaactatatgttttatattaaaatcattgtctagaaaaagtagcctggtattatgcctatattggctaatggtaagtgttgaaatatga

SEQ ID NO: 1470 - DNA, 153 bp, Xenorhabdus bovienii
  Coding DNA location: Contig name=SeqID_16860; Position on contig =20321..20473bp; Strand=-
atggaggttattgatgagcccactgtttattgtcctgtcggtggtttagcaaggtgcattggtttgggttggtgtactgttgagcgacgtggcaggcatgatgaatcagggcgtggaaccagtcagacaatcagcaggggggcggggaaatag

SEQ ID NO: 1471 - DNA, 885 bp, Xenorhabdus bovienii
  Coding DNA location: Contig name=SeqID_16860; Position on contig =20571..21455bp; Strand=+
atgtataatttagaagaactttactgctgcgtcgatgacttttgccaaaaatttatccctctctggcatcaacaactcattgaaaatggattacgtaaacggcaccgtgaggcatccctttctctcagtgaagtcatgatgatcctcattttatttcatatgagtcattatcgtgattttaaaacattttatattgaacatgtaaaacaatatcttacagccgattttcccggattagtcagctatactcgtatcctcaccctgaagaaaagggcgcttattcctttatgcgcttttctttcatcacgtaaggcgcaaactcaagggattgcttttattgattctaccaaaattgctgtttgtcacaatcttcgtattccccgtcatcgcgtatttgaagggatggcacaacgaggtaaaacgagtacaggctggttttatggctttaaacttcatttggttatcaatgattgcggtgaattgttagccgtgaaactcaccgcaggaaaccaggatgatcgtcagccagtcagagcgctgacaaaaggactaacaggatgtttgtatggtgataaggggtatttatcccaggctttatgcgatgagttagaagcggaaggcgtcacgttaatcaccaatgtccggagtaacatgaaaaccaaagcattatctctctgggataggttgatgttaagacggagatttttgatagaaacggtcgtcgaccagctcaaaaatatttctcagatagcgcattcaaggcatcgcagtcagctcggttttttgttggaagttgctgccggtcttattgcttatacattccaacctaaaaaaccgagcttgaatctacgggataatgagatcgctatctttaaacgaagctga

SEQ ID NO: 1472 - DNA, 2439 bp, Xenorhabdus bovienii
  Coding DNA location: Contig name=SeqID_16860; Position on contig =21960..24398bp; Strand=-
atggctgatacacagtctaaccaaactcaccctaaatttacacattcagataatacaggcagccaaaatccacttgacctgatccagaccgtgaaaaaatcggccatgtatcattgggaaaatctgctgcctgcttgtagcatcgatattccagcaaagggcaaacatggtgcttgtcctgtctgcggcggcactgatcgttttcactttatcgacgatcaccaccatggcaattggcactgtcgccagtgtgatgctccaaactatggtgacgggctggatttagtggcaagaaccaaaggtatttccaccactgaggcggcaaaagtcattgcagatgcgctggcgttaccgttgccagaacccaagccagccagagaaaccattcaaactacgcagtcaattgccgaaaaagtggcatcactaatggcacaagctgttgccgggcaatctccttatctggctgcaaaagggctggatttccctaatcagcggttattgttcaataattcgactttgttgcccatggcaacactggataaaaaagtaacaggtgcacaaatcatcaagccggatgggacgaaaaaattactgtccggtagccagaaaaaaggtgcgtttattcccgtctcagagctggaagatcaatccgacccggtggtcattaccgaaggttacgccacagcgctcacagttaacttgctctataaaggcactgttttggcggcattagatgcaggcaatttgtattctgttgcaaaagccgttcgggaacgttggtcagacacaaaaattattttcgcagcagataatgactggcatcatcccgacgaactggataagcacggcaagccgaaagtgaatatcggcagggtcttagcagaaaaagcagctcttgcggttaatggttgggttacgttaccacctacagagtacaaaaccgactgggacgattaccgccaacaacatggtgtggaaatggcaaagctggccttttctcagggactttatcaaccggtatcaaccaagaaaaaatcagccattcagcccaataataatgaactttcaaaactgacattatgtcagatgggagccagccagcgtggggaagtattactggcgcgttatgacggtgatttagcattggatggcgcttcggaaaccgttcatcactatgatggtattgtctggcgtccggtcagtgaccgcgatttaaagcgggaaatggtggcagcctttatggaagaaaaactgccttactcaccgcatggcatcagctctgccgtggatgctctcaaattacagcttcccatgatgcagccgccagaacgtcacttaatcggattcagcaacggagtgtttgacctgaaaacgtgccagttccggcctcatcgtaaaaatgactggctgctgcttgccaatgacgttgaattcaattcccctatttcgggggaaactctgaaagatcatgcaccgcagttctggcaatggcttaaccgagcaacagccaactgtgagaacaaatttgatcgggtactggcagccttgtttatggtgctggcgaaccgttacgactggcagctttttctggaaatcactggtgccgggggcagcggaaaaagcatctttgccgaaatctgctcaatgctggcaggtaaaggcaataccgtttccgccagtatggccgcactggaaaatccacgggaacgggcgctgattgtgggatattcgttgattatcctgccagaccagactcgctatgtgggtgatggttccggcatcaaagccattacaggcggggatggagttgctatcgatccgaagcataagcaaccctattccacccgtattcctgctgtggtgttggcggtaaacaataatgccatgagtttcagtgatcgcagtggtggtgtatcgcggcgtcgagtgattttcaacttttccgaagttgtgccggaaaatgaacgtgatccactcctgcgggataaaatcgcggcagaattgcctgtgattatccggcatctgctgtatcggttcgctgatccacaggctgcgaggagtttactggcagaacagcaaaaatctgcggaggcgctggatatcaagcgtggcacagatccattagttgatttctgcggctacctgattgcgtctaatgaaactgacggcctgttaatcggtaatgcggagattatgccgtttaatccccataagtacctctaccacgcctaccttgcttatatgaaaggcaacaacctgaataaacctgtttccgtaacacgatttggtatggatatgccgggcgcactggctgagtacagccagcattacctgcgcaagaaaagcaaatacggcattcgtagcaatctgaacctgaatattgatactgctattgagtggatgccaaaactgacaaggaatgaccagccagaagaataa

SEQ ID NO: 1473 - DNA, 165 bp, Xenorhabdus bovienii
  Coding DNA location: Contig name=SeqID_16860; Position on contig =24354..24518bp; Strand=+
atgtgtaaatttagggtgagtttggttagactgtgtatcagccatatcgtaagtctcctttacgttgtggtcagacgcctcaaacgtgttcgcgcacactggggcgttgtttttttatgttacgtttcttatgtcatgcttttttctatgttatgccgctcgtga

SEQ ID NO: 1474 - DNA, 201 bp, Xenorhabdus bovienii
  Coding DNA location: Contig name=SeqID_16860; Position on contig =24504..24704bp; Strand=-
atgacagcaccgaaggaaaaccttattcgtttgccggaagttcaacgcagaacgggttatagcaaagcgtggatctacaaattgattagtgccggagaatttccgaaacaagtcaaactcggctcccgctccattgcttttattgaatcagaaattgataactggattgcccaaaggatcgcggaatcacgagcggcataa

SEQ ID NO: 1475 - DNA, 195 bp, Xenorhabdus bovienii
  Coding DNA location: Contig name=SeqID_16860; Position on contig =24794..24988bp; Strand=+
atgaacagcgttaattgtttttccgatttgttgaatttatttttttggaacttataccttttcatcggcattctgtataaaaatcatactttgttggcagtgccaacaaagtatgaaaaatcaccacttctttacgcccttttgccaaattttccgatcagcacattttcgcctcgttccagcatctccatatga

SEQ ID NO: 1476 - DNA, 1215 bp, Xenorhabdus bovienii
  Coding DNA location: Contig name=SeqID_16860; Position on contig =24925..26139bp; Strand=-
atgaagctaacagcccgacaggtggacactgcaaagccgaaagaaaaaccctataaacttgcagatggtggcggattatatctattggttaaccctaatggctctcgctattggcggttaaagtatcggatcgtaggcaaagaaaaattgctcgcattaggggtataccctgaaatctcccttgcagaagcaagagccaagagaaatgatgctcggcggacattatcgagtggtaatgatccgatagaggaaaagaaagcggagaaggcagccaaagtatttgcggtcagcaatagttttgaatctatagctattgagtggcacgagtataaacgcccaaactggtcacaagggtatgccgaagacattctggaatatctgaaaaaagatatcttcccatatattggtaaacgtgccgttaccgagattaaacccgctgaaatgctggctgtgctccgaaaaatggagcaacgcggtgttttggataaattgaagaaaaccaggcaggcctgtcggcaaattttcacctatgccgttattacagggcgggcagagttcaatcccgttactgaccttgccagcgcactgaaagcccccaagcaaaaacacttcccacaccttttagccgatcaactacatgattttcttatcgccttgagtggttatagtggcagccaagtgacgcaatcagcaacacgtatgctgatgctgaccggagtacgtaccattgagctgagagaatcggaatgggctgaattcgattttgataacgatctctggcaaatccccgccgagcgaatgaaaatgcgccgccttcatatcgtcccactgtcaaatcaggttaaagctattcttattaaactgcacgagattacagggcgcgggaaatacgttttccccggtcgtaacgatgcgggtaagccaatgagtgaggcagccatcaatcaggttattaagcgtattggttatgatggacgggcaacaggccacggcttccgccataccatgagtacaatcctgcatgaacaaggctataacacggcttggattgaaacccagcttgctcatgttgacaagaatagcatccgtgggacttacaaccacgctcagtatctggatgggcgcttggaaatgctgcaatggtatgcggatcatatggagatgctggaacgaggcgaaaatgtgctgatcggaaaatttggcaaaagggcgtaa

SEQ ID NO: 1477 - DNA, 105 bp, Xenorhabdus bovienii
  Coding DNA location: Contig name=SeqID_16860; Position on contig =26304..26408bp; Strand=+
atggtacgccctacaggattcgaacctgtgacctacggcttagaagggcaaaaacctttgatttcactctatttcttacaatttcacttggtttcattattttga

SEQ ID NO: 1478 - DNA, 1218 bp, Xenorhabdus bovienii
  Coding DNA location: Contig name=SeqID_16860; Position on contig =26506..27723bp; Strand=+
atggctagtactttattgactgacagtaaaatccgaggcttgaaacccaaaaactcagcctattatacatggcaagcagcagcaacacgaggaactggaaggttaggagttaaaacatatccatcgggaagaaaggtctttgtctatcgttactttaagaatggaaaagaaaagttcataaacctaggtgatttccctgctctttctttggcagaggcattatccaaatcacgagatgccgccgccaatgtttcagctccagaaaaagccatcataaatcacgccacaattgaacagctattcagtgactatattgccgaccagaaacgccgtggcaagagatcttatgataaaacccaatacaggctaaatcaggtattagatagccagcacattgagagaaatactccagcaaaagatattaccccagaacatattaaaagggtattagctgaatttatctcacgcggtgctgttgctggctcaaataaggttcgtgcaaatcttcatgcagtatttaacttcggtctattcgcggacaatgatcctgccaaactgaacgagaaagttatttatggtcttgaccgaaaccccgtgaccatcgttccacgccaagagggagcagataaggcgttggatagatttttatcttgggatgaaatgaaagagattctaaaactatttcgtatttcgtcgacagtattcccaatccatcctgattatggccggttaatattgctttgcatcttcacaggtggacaacgcccctgggaaataatgaccaatacaaaagataactgggataaaaagaataacactctgacagtcccacctcatatttcaaaaaacggtgattaccacgtaattccattgtgtgaatctgcaactgaaatattagaatgccaagccaaacaatatccaggctcagaattcctgtttcccggagagactaaagaaggtcatttactcactgctgaatatgccaagcagatccgcaaattttgtgctcgctatgattttgaaaaatttacaccaagggatattagacgaacctttaagacgctggcaggagagatggggatcagttctgagatgagagataggttgcagaatcataaaaaacccggtgtctcaaccaaacactatgatcgctacgactatctgaaagaaaaacgggaaattatagcgcaatgggaaagtaagttactatcactatag

SEQ ID NO: 1479 - DNA, 234 bp, Xenorhabdus bovienii
  Coding DNA location: Contig name=SeqID_16860; Position on contig =28102..28335bp; Strand=+
gtggttcgatatactaatcacatacgctatctaagaatattatttttcaacagcaattattttaactttttacgctgctattgtcggatgtcattttttatttcactttatttaatttggcctttactccttcgttatttattattgccttcattttatttatcacggatcagccgatatattcggacaacaaagtctcttcaaattatcgcaaaacaacctattgcgtcctga

SEQ ID NO: 1480 - DNA, 216 bp, Xenorhabdus bovienii
  Coding DNA location: Contig name=SeqID_16860; Position on contig =28264..28479bp; Strand=-
atgttcttctttattgacatgatgtgtctccctgagatgatggaacgttatgtaataggcatcccacctgataacaacgcaggccataacattcgggtacaagatttaaatctaactcacattgtctccgacaaattggttaattcaggacgcaataggttgttttgcgataatttgaagagactttgttgtccgaatatatcggctgatccgtga

SEQ ID NO: 1481 - DNA, 2187 bp, Xenorhabdus bovienii
  Coding DNA location: Contig name=SeqID_16860; Position on contig =28460..30646bp; Strand=+
atgtcaataaagaagaacatcaataaattgaagaaaggacaagcccttgttcagcaggggcaagaggctgttcagaaagcgaaacaggttgcaggcaaattaggcggcggcattacaggaacggcaggcttacttccgggtggtggttttactggagggataggcggcaattcaggcagcagcatgtcaggcacagcgggcttaatcccgggtggcggttttaccggtggaaaggggctggcagaacgcgcagccggtgggcagaatgcggccaccaaagcgctggaaaaagccgctcagatgctgatgggcgggcgtgacccgagtggcctgcaatttaccctgaccgcaggcggcttaccgccgcagacgtttgtagtgaccaatttcacgctgaacgaaagtttttcccagccgttcagcctgagtgtgggactggcgagcgccgacccggctatcgattttccggcagtactggatcgcaccgccacgctgaccattctgcaaaacggtatcgaacaacgcagcatcacggggatcgtttcccgctttgagcagggtaataccgggttgcaccagactacctaccaaatgactatccgccctgacctgtggcgtacgaccctgagacagaactcgcgcattttccagcagcaggatatcgccaccatcctcaccactctcctgaaagaacacaacatccgcgatgtgatcttcagcctgcgccatcctcacccggcgcgcgaattctgcgtgcagtatcaggaaagtgactttgccttcctgcaacggttaacggcggaagagggcattttctacttcttcgaatgcagtaacgggcgcaacacgctggtctttgccgacgactgcggttcagtcccgccgggcatagtgatcccttatcagcccggtgaagtcagcaccgggggtgaacctgccatcagcagcttgacatgcagcgcacaggtgcggccggcgcaggtccagcttaaggattacaccttcaagaatccagcgtggccggcggaatttcaccaacagatgcgggacgaaaatctgcaacaactgtactacgagcactacgactaccccggtcgcttcaaggacgaagcacatggcaaggattttacccgctaccggctggaagcgctgcgtagcgatgcaatgatgggacagggcagcggcaatgcgataaccctgcagccgggcaagctgtttatccttgataaccatccccgggcagacctgaatcagtcatggcagaccgtctccaccagccacagcggcagccagccgggtgcccttgaaacgaaaaccggcgacagcggcaccacgctgcacagccacttctatttcatccgtcagaatcagaactggcgcccggctccgctgcccaaaccggtggttgatggcccacaaatcgctaaggtggtcggcccagccggtgaagaaatcttctgtgaccagtacgggcgcgtgcgcctgcaattcccgtgggacaggtacggacgcagcgacgaccaaagctcctgctggatacgggtcagccagccgtgggccggtcagggctgggggatgctcgccattccgcgtattggacaagaagtggtagtggatttcctgcacagcgaccccgaccagccgatagtgaccgggcggacttaccatgccagcaacatcccgccgggtaccttgccgggcagcaaaacccagatggcgttccgctccaaaactcacaagggacagggctacaacgaactgctgtttgaggatgccaagggcagcgaactgctgtcactgcacgcgcaaaaggatatgtacaccaaggtgctcaacaaccgcgatacccatgtgctcgccaaccacagcgaaaccgtggagaaaaaccagaccatcaaggtcaatgagaacaaagaggaaactgtcacgctcaacagcacggaaacggtgaaggaggtgcgcaaactgatcactggcaaggactacattatcgaggtcggtgcgcataaggccgagaccatcaccaatacccttgccatcaacgtcggggatgtgattgagctgcgctgcggtctgagtgtgttgcgcatggacagtgccggacgtatcacccttcagggcagtgagttcaagtttgaggccagcggggcggtgcaaatcaccggtaaagacattgacctgaactaa

SEQ ID NO: 1482 - DNA, 1227 bp, Xenorhabdus bovienii
  Coding DNA location: Contig name=SeqID_16860; Position on contig =30662..31888bp; Strand=+
atggaatttcgtaacctgaccccctttgcggtgatgaattactcgatgcttgatgtcgacgataccgaacatcacgtggcggtgatgaaaatcggctaccagctcttgcccaccgggccgggagaatacagtgccgaactgctgcctgcaccgcccttgtgtttgcaggatgaatatcgcagggcaatgaatgcctcgccgatattgcaggaaagtgatctggcgccgtttaaaccgcgctgtgatgtgattgtcaacggcacggcgtatgcgccggaaggtaagccctgtaccgaattcccggtgcgattgcaggtgcagagtaagcaggggcagaccttgatcgataaaaccctgaccgtgatcggcgaacgggagtttattcgcgatgcgggtggcaactggcaactgaccgagccgaaaccttttgcaacattgccgctggattaccgctatgcctttggcggtcagtgcaaaatctatgctgacgaagaagccagtcagcacctccaagaacgtgaccggctcactcccgaacaacgccagcagcacccggacggagaaaacgcaccggttgctcacgccacctgtgaaaccaatccgctgggaacggggtttatcactccgtggtacgccaacgcgaagcagctcacccgttaccctgcgccgcgtattatccggccagatgctgagttcactgcccaacattttgcagctcaactagggggaacactgtctgccgataccccagcctgccaaccacagggcatgggatttatcgggcgtccgtggctgccccgccgtcagcttgctggtacttacgatgccgactggcttgcccaccgtcacccttatctgcccaaagacttcgacttcagatactggaacggtgcccccaccgatcagcaaattgactggcctgacactgatacctcgctgagcctgcagggtatgacacccagcggcaacctgcacgtcaccctgccggggcatcggccgtttattctgctgcggatgcacgaaggagggttgctccccgtgccgatgcgcctcgatacgctgatcctcgacagcgatgccctgaccctgcatatcacctgtcggctgaattttaaaaccagcctgccggttcgggtggcggaggcgcggtttgaaatcgatccggatgctccgttactcaaactcgccccccctgaacctgaaaaggagaccgcccatggcggataa

SEQ ID NO: 1483 - DNA, 408 bp, Xenorhabdus bovienii
  Coding DNA location: Contig name=SeqID_16860; Position on contig =31827..32234bp; Strand=+
atgctccgttactcaaactcgccccccctgaacctgaaaaggagaccgcccatggcggataactacattgcccgcactgcgggcgaatggctgatagtcggcatcttgccggacgtatgcaaaaccccgatgggcgcgtcaaccccgcccattccgtacccggtcatcgccaaactggcgggcagcgatgtgccggttaaatcggtgcgggccaatggacagccagtggtggtcttcgcccagagttttgtgccgcaaaccctcggcgaccagcccggggtggccaacggcgtgaaaagcggcaccgtgggcgcaaaatgccacccgaaagcgcatacccaaaccgtccgggccggtaacaaactggtgctgcgccatggggatgaattctggatgaatggagcataa

SEQ ID NO: 1484 - DNA, 4662 bp, Xenorhabdus bovienii
  Coding DNA location: Contig name=SeqID_16860; Position on contig =32247..36908bp; Strand=+
atgggagaaacgattagcattaccggtggccgtgatgaaaaagtattttgtgaagcttacaatatccgaaccttggctgaggcggaagcgatccaaaaacacatacccgccctcatccaacaagagactatggataatagtttgctcaccgccggggatattgaatatattacagaagctgagggccggcttgccgtcaaggtcattgataaattcaaaagcggggaatttccgttagaagaatggaagcatactccccctgaacccaatgagcctctgcccgccaaatcccgcgatgacagtccgagcggtacgggcaacacgataggtaaaattgtcggtcaggccccacaggccgcgcagccgccgcaggaggcgaatacggccgtcacaccggaaaccgagcaagaaaaagggtttttggaccaggccggagaattgtggaataagaccaaagaaggcgtcacaaaatggggggaagaagccggagagaaactgagtgcggcgtgggataatccgggaaaggccgccatcggtgccgcaaaaggggtgtggaatacggtacctgatgtgggtgaattcgtctttcgaacgacagcaggtatgcctgctgccatgatgtcctcttctggtacggtattgaaatacgcgggcgctgacgcgttaggcgatacagctcttgccgccgccgatgcatggaataagcaggttgtcgataaggccgttgagttgagccatgtggatgccatccggttcgacatcacggataaggcggaacaagggggggcgctgatttttgatggcgtcagcctggctacgggcgtgggcgggctgatcagaggtgcggccagacaaggcacgaaagcgacggctaaagccactaaacctgcacccggcgccaaagtcaaagaaaaaccccaggacgcgccggacgcgaaaccccagaaagtgccgcccaaagatgacgccacaccgtccaacaaaaaagacggcaatgacaatgggctatcgaccaaagagggcgacccggtcgacatggccaccggcgacttcctgcaagtctggccggtgctggccataccagggttattgccgataagcctcaaccggacctaccgctccaccgcggatttacacgggctgttcggtcccaaatgggcggatgactggtcacgacaattggttatcggtcacggggaagtgcactatacccatgcagatggtgtggtctacgactttgccaccccggacaaccgggtcttgtcccgtaaccgccatcttcctcactgcctgctgacgggcgacctgatgggcgcgctgtgcctgaccgaccgccgcgcccagttgacgtaccatttcagcccgagttcaggcagcgcgcagaaattgtccgccatcactgaccgccgccagaaccggattgatttcagctacgataaacacgcccggctgattgaagtcacccgcaatgacggcctgcggttaagcctgcattatcgggacaggcagctccacacgctcaatatgcatgaaacccgcgatgaccagtccatcaaacaacgcctgctgacctgccattatgacccacaggggtatttgaatgagtgtgacgccttccagcataaccacctgtggcatgagtacgacattcaagggcggatgatccgctggcatgacaccgaccagaccgacctgatgattagctacgacgaccgcggccgggtactcagtaccacctcacctagcggctactggcatgaccgcttccgctacgatgacaactcccgcatcaccacctatctggacggtgaaggaggcgaaacccgttaccattacgactcgaacgggctggtgatacgggaagttgacccactggggcgcgtcacccgccgccagtggcgacacagcctgctgatgtgggaaagcgatccatcagggcagatgaccacctttgattacaatgcggacggagaattgaccgaggtggtattgccgacgggagagacctttgtctatgcttatgacgaacacggacaactgaccgaaagccacctccctactggcgaacgctggcagtggcattatgacgaacagggcaacctgaccgcgctgactaacccgctcggccatcgggaagaataccagtatggtctccacggtgaattgcgccagcgcttgctgccggacggccagacgtggcactatgcctatgacgaacaccagcgccttgccgccgtgatgatgccgaacggcgaaaccacgggactggagctggattcactgggccgcctgcgccgtttcaccgatgcactgaaacaggaaacccgctaccggtaccgccccgaccatgccagcctcattcatggcagcctgagtgaaatcacccttgccgatggcatcacccaaaaactggactatgacagcgagcggcgcgtggtggcggtcaccgacggcgaaggccgtaccactcgctacacttacggcgcgtttgacctgctcaatcaggttacccgacctgatggcactatcttgctctttggctatgaccgtctgacccgtctgaactcggtcaccacctccacgggtgaaacttatcgctataagcgtgatgccgctggccagatcatccgggaaaccgattttaccgggcggacgctggcgtatcagtacgataaactggggcgccgcatacagactagctatcccgatggtcagcaacttcgctggtgctattccactgcgggcttgctggtcaaacaggaaagctggcaaccggaagaaaaccaactggtgttgaaagacatcacgacttacgaatacaacaaacggtatcaattggtgaaagccactaatgccgatgctatcgttgagtacgagtatgacaaaaccactgggctgcccacctgcgagcgtatcaacggtcgggaaatcacccgcgaatgggataacctgaccggacgtccagtcagtgaaagtgtggatggcaataccctgcacttcggttataacctgccgggaagtttaaatcactttcagctcaaccagcatgcaccactgacattccagcatgatgcactgggacgggaaatgatgcgggaaagtgccaatggctttattctcgccagccgctacaccgcgaccggattgctgacgcatcagtcagcgggacaggccacccaatttttcagggaaacgctggcacagaatgacccacactttcctccgcaagcctctgcggtcaaccggagctggcaatatgaccgagctcataatgtgcgagtgattgacgacagccgctgggggcaaacccgttaccgttacaatgccaacgaccaaatactgcatactctgttcgaaggtgcacgtccgcatgaagaacaattcagctatgatactaacggtaacctgagccaacatttaccgaccgatgcacggggagcggtggaacaaattattcagcgtcagaaagccgggcgtgtggtgcagcaggggaatatccgctacgcttacgatgacaatggccgtttggtagaaaaaactgaacagcgtgacggcttccgcccccaaatctggcgctaccgctgggatacgcaaaaccagctcacccacttcgagaccccggatggctcacgctggcattatcgctacgatgcttttgggcgacggatccgtaaactgaaagttcatgatggtaaactggcagcggctaatttacagttgtggctaagtggtaagccggatttagcacccagagccgatgccatcatggggcaggattacctgtggagcggcgaccagcttatcgaagaaacacctgtttatgccgatggtacaccggcggaaggtcaacgtgtccgttggttatatgaacccggttcattaacgccgtcggcacgccttgaaaaaggcaagttacactatattgtcagtgaccatcagggtacgccacgcgaaatgttgtccgaggaaggggtactggtctgggcacagcggctgacgacatggggcaaatcggaacgttttcaggtcatcgcttccaataatccggattatcatgttggctgtaacctgcggtttatggggcaatttgaagacgaagagtcgggtttattctataataggtttcggtattattcgccggagacggggcagtatatatcaccagacccgattggattgcagggcgggtttaatccttattcttatgtacataatccgacaaagtgggtagatccttacggtctggcaggcggggttgggaataaaggagaacctatccaaaaatcgccatcagactttgctagaagctggcaaggacaaggcgattatcccggcgttgatcgtttccgagatatcacagtcaagaaaggcacaatattgatggcaggtgcaccaggccaaggaagtttctacacaaccgttagagcggttgagaggagcggatattctaaagaaggtgtgtttaaaggattacaggtaatacctcataaagatttcggatataggccaggtatgacagcctatagagttctggaagacacacctgctgcctttggtatagtgagagctaacccccatgctggtcccggtggactaccccaaatagttattgaaaaatacgatgggattttagaacctttatattcggtgaagttaaaatga

SEQ ID NO: 1485 - DNA, 429 bp, Xenorhabdus bovienii
  Coding DNA location: Contig name=SeqID_16860; Position on contig =36905..37333bp; Strand=+
atgatatacgctaatggtaatgtgaacttaaatggaataataattaatccattaattaaaaaagatattttcctagaaaaaacatcagagcttaatccagaaaaaatttatatttttgaaaatagaatccgttattctatagataatgtattgtttttaaatttaaaatatattgtcagcgctgtttttcaggatgaatttctcatttatattgaattgcttcctttcgataaggagatagaaaataaaatcaatgtatttaccaatgaaaaccaaatgagaaataaattaatcaatgatgatttattaaaatcactatttggttcatcagagaaactttattttccatggggaagtattgagtctatagcagatactagatcaggtatgtcatacatatctatttcttataaaaacagtaatcactga

SEQ ID NO: 1486 - DNA, 378 bp, Xenorhabdus bovienii
  Coding DNA location: Contig name=SeqID_16860; Position on contig =37327..37704bp; Strand=-
ttgcaaggtaagtttttcaaatttaccttcgtagaaccctcgatttggtggccattctttataccacatgaagtctttaaaattagaggattctctggctgccttactatctgccaaaatggctgttcacgttgggtcggaatatgcaacgtgctgcaacaaaatgataaggccagtgctccatccacgatacacctgaaaggtcaatggattaaggcgctacactcaccgtcaaaattatggatggctgtctgtgctgacccccgacaagaccagctcactgaggtcaagctgaggatacgggaactgatagggggttatcataaaaagccggaggatcacgaggatcttcccggctattcatatctaactcagtga

SEQ ID NO: 1487 - DNA, 360 bp, Xenorhabdus bovienii
  Coding DNA location: Contig name=SeqID_16860; Position on contig =37636..37995bp; Strand=+
atgtggtataaagaatggccaccaaatcgagggttctacgaaggtaaatttgaaaaacttaccttgcaaccggatacaagacttgatcgatatagtacggattatggcacatttgtttctccagaaggtattccatatagcgcaagggcgctgaagccgggaagtgatggcagaccttatactgtttttgtagttaaaaaaccaataactgccgatgctggtgaaattgctccttggtttggctatccaggacgtggcacacagtacgacttgcccgcgaaggtaaaagaattaattgacaatggttcattggaaaaagtgtcaaaaacattaaaagggaaacccataccgttagattaa

SEQ ID NO: 1488 - DNA, 243 bp, Xenorhabdus bovienii
  Coding DNA location: Contig name=SeqID_16860; Position on contig =38007..38249bp; Strand=+
atgaataaagaagaactgagaaaacgtttaaaagagaataagatctcatcatcatactattcattagaaggaggtgctcccgatgataggatctgccttagttatgaggatggatattggttagtctatcatgcagaaagaggtgcgcgtagttgggttgaatcgtttgaaaaagaaggagatgcatgccaacgtttctgggagtatgtttctgatataaaaagatgtatggataaaacataa

SEQ ID NO: 1489 - DNA, 114 bp, Xenorhabdus bovienii
  Coding DNA location: Contig name=SeqID_16860; Position on contig =38301..38414bp; Strand=-
atgaaatcatatttatccccatcatgcattaacactggtttttttttgataattcatcatcttccctctccatacgtcacggaatttataaaagcctctaagggcagggagtga

SEQ ID NO: 1490 - DNA, 114 bp, Xenorhabdus bovienii
  Coding DNA location: Contig name=SeqID_16860; Position on contig =38386..38499bp; Strand=+
atgcatgatggggataaatatgatttcatttacaaaaaaaatcatatcaattgcccaatttgtagaagtgatatttttttagtgtatacaactccgatgattttgataagttag

SEQ ID NO: 1491 - DNA, 228 bp, Xenorhabdus bovienii
  Coding DNA location: Contig name=SeqID_16860; Position on contig =38508..38735bp; Strand=+
ttgcaagacaacttggctaaaaacgtagcgtgtttagttaaaaatgagaatgaatgtggacatagatacacatacaaaagacttgctctacgtatcaactatactaaatgtgaacttggagggcatgattttgcagtgatatttacttttggtgaaatacaaaataccagatatgggtctcacttattaggtgtttttcaagtaactaaagaaaaattagatcaataa

SEQ ID NO: 1492 - DNA, 381 bp, Xenorhabdus bovienii
  Coding DNA location: Contig name=SeqID_16860; Position on contig =38971..39351bp; Strand=+
atgaacttcaaaatgaataatctgaagaaaaaagaaatgatttatgatggtcttgaagacggattttatgaactaaatcatacgattcaatgcccatattgtgatgaaaaaataactgtcagcgtttcaagtctaaaaaacttaagtgagttagatgaacatttgcgagtagcaataaaagatagaattacaggtatcaaagagtttccgttatcaacaatcatgattcacaactatgatgatttatcagccatgtatggcatatatgattgcaagatacaaaacgtaaaattattagccatttttgctgttggcgaacgacaaccagcaagatatcaggtaattttattaggaatttttaaatatcctgaaatgaattaa

SEQ ID NO: 1493 - DNA, 141 bp, Xenorhabdus bovienii
  Coding DNA location: Contig name=SeqID_16860; Position on contig =39382..39522bp; Strand=+
atgattttccaagttgttcaagcccatgtaccagaccgcatagcgaatgctgcctatgcgcgtgcaaatctggataatataggtaatgcccaatatattaaaacgactgacctaaataaagcacaatttaaacctaaatga

SEQ ID NO: 1494 - DNA, 312 bp, Xenorhabdus bovienii
  Coding DNA location: Contig name=SeqID_16860; Position on contig =39570..39881bp; Strand=+
atggaaagattaatcgttaacgtcaaagttaattgggtttctgaagatcaagatgggaaatctaatttaccactcaatatattatattatgtcattacggagccaatgaaaggcaagattggtgaaccaacatattggagcttagtattagacataaaaagtaactcttatgatgcaggagaagaggagagagtaggtttaggaaaagcttattttctagttgatgatgctcctgattttttacttactcaaggatttactttaaatgtatatgaaggtcctaagtttgttgccgtagttgaagttctttga

SEQ ID NO: 1495 - DNA, 129 bp, Xenorhabdus bovienii
  Coding DNA location: Contig name=SeqID_16860; Position on contig =39884..40012bp; Strand=+
ttgttaataaatagtaattggttaattttttatttaaactcaaacaggaagaactatgcgagcttccagtttggtctttccctaatatctatcttgccccgtaattaccaattaatcctcgcatcctga

SEQ ID NO: 1496 - DNA, 126 bp, Xenorhabdus bovienii
  Coding DNA location: Contig name=SeqID_16860; Position on contig =40181..40306bp; Strand=+
atggaaatatgggtaactataatagtttataccaatttaactccaagatgcaggcttgttatgattatttattctataaaatcagtattatatgaatttttaatcatgcatcttcaagtttgttga

SEQ ID NO: 1497 - DNA, 414 bp, Xenorhabdus bovienii
  Coding DNA location: Contig name=SeqID_16860; Position on contig =40335..40748bp; Strand=+
atggacgtcaatgaaagaaaaatcaaaataataataaatggtaaaatggaagaagctgaattgcatttgattacatctcctgataggcattgttgcttaaaaatatttcataataacaatcagttggcagaatcaaatgacactgattatttttcatgctttatagatttaagaaaccaattaaaagatatagtttttctttgcaaaggggcaaaaataaatgtgtttccatctgcaatgcagagggatatgggtttaggtataggagcttatgaaactaaattaggtcagtatggcttacccgaaaatcaggttcatatatttgattttgaggataaagatgttgatgtttccccagaagaacaacgaaaatttcattatcaatggtttgaatcattacggaaaaataactga

SEQ ID NO: 1498 - DNA, 165 bp, Xenorhabdus bovienii
  Coding DNA location: Contig name=SeqID_16860; Position on contig =40784..40948bp; Strand=+
gtgatcttccggcttattgctatacactgggcacagagccataaaggtgatattcgatcgtggactcaatttattaattttactacactatcagcaattgaaaagtcttacacggcgcaggcgggtctcaggtcagattctgtcatcaacataattttgccatag

SEQ ID NO: 1499 - DNA, 354 bp, Xenorhabdus bovienii
  Coding DNA location: Contig name=SeqID_16860; Position on contig =40891..41244bp; Strand=-
atggaacttaaattttctactgaagacgctgcaaaaccggaatgtgtgttaagtggtgacgatatgcagcagatgggatttacgcccaataccctgtttcttatccagcaatataacaacgggctgatgttgacgttggcgaagcctgacgatgatccggctaccctgttccacgcagtggaagatgatccgaaacagggcatcgattgggtacgtgacaatggtgagctgtatctggctggcgattggttaacggaaaccggtttgctggataaccccgttcaagttgttttcggctatggcaaaattatgttgatgacagaatctgacctgagacccgcctgcgccgtgtaa

SEQ ID NO: 1500 - DNA, 330 bp, Xenorhabdus bovienii
  Coding DNA location: Contig name=SeqID_16860; Position on contig =41384..41713bp; Strand=-
atggctgacacgcattctactgcaggcacccgcatttacaaaatttcccaaccggaacgttatcagaaagtggtttaccgccccaagggggttaaccgcacgatccctgccatcaatttaagcggaaaatggctgctggaagccgggttctctattagtgatccgttaaaaatcagagtgatgcctggttgtttgatcatcacggcccaaaattttcatgaactgtggcattgcttaaaaagcttgaatgaaggcgaatgggatgatatcgccgtggcacgctggctgcagcaatttcccggaaaattaagtaaaaagctaccaggataa

SEQ ID NO: 1501 - DNA, 93 bp, Xenorhabdus bovienii
  Coding DNA location: Contig name=SeqID_16860; Position on contig =41679..41771bp; Strand=+
atgcgggtgcctgcagtagaatgcgtgtcagccataataactacgtccttagttgttgtggttagcggttttatcgtgttcctagcacgttaa

SEQ ID NO: 1502 - DNA, 162 bp, Xenorhabdus bovienii
  Coding DNA location: Contig name=SeqID_16860; Position on contig =41873..42034bp; Strand=+
atgtattccatttctattgactatcggctcgggatagctgcctcatgccgggcatcaaagagaggtaaacccaacagccgtattacccgccgccatttgggtaaatggaaaagcgaacaaactttgcactattattcatattgtagtaatgtacctatatag

SEQ ID NO: 1503 - DNA, 255 bp, Xenorhabdus bovienii
  Coding DNA location: Contig name=SeqID_16860; Position on contig =42059..42313bp; Strand=+
atgaccatcacgaccctctccagccgagagctgaatcaggacgttacccgcgcgaaaaaagcgaccaagaacggccccgtattcatcaccgatcgcggcaaaccggctcatgtgctgttgagcatcgaggaataccggctgctgacaaagcaacatcgtaacattgccgattctctggctatgccgggcgttgcggacattgagtttgagccgcagcgaatgactatcggaacccgcccggctgatttctcatga

SEQ ID NO: 1504 - DNA, 432 bp, Xenorhabdus bovienii
  Coding DNA location: Contig name=SeqID_16860; Position on contig =42310..42741bp; Strand=+
atgatgtacatactcgataccaacgtggtgtccgagctacgaaaaattcgggcagggaaggccgatccgaacgttgcgaaatggactgaaaacatcaatgccgccgacctctttgtgtccgccattaccatcatggagttagaacttggcgttttgctgattgagcgtaaggacgccacacagggggccatgctacgggcgtggctggagcaacatgttttgccggagttctccgaacgaacattgcccgtcgatacagccgtagcacaacgctgtgcccggttgcacgtaccagacaggtgcagcgagcgtgatgcgctgattgcggcgacggcgcttgtgcatggtatgacggtagtcacgcgtaacgtagccgattttcagtctacaggggtgacaatcctcaacccgtgggagtcaaacccatcatga

SEQ ID NO: 1505 - DNA, 2631 bp, Xenorhabdus bovienii
  Coding DNA location: Contig name=SeqID_16860; Position on contig =42767..45397bp; Strand=-
atggaaaagcagcctattcagggcaacaaaggtggcagccagcatccgcgcatcccggtggaagcacctgactctttgcagtccacctcctataccaagatcctccttgccctcggtgaaggggaatttgcgggagagctggatggcagacgtatttttctggataacacaccgcttatcggtgccgacggcacgcccaattttgaaggggtcaaatgggaattccgtcccggcacaccccatcaggcgtatatccccggtatgcctgcggtcgaaaatgcccgaaccgtcagcgcggaactggtcagctcgtgggtcacgacggtcaccaatactcaactgtcagcggttcgcctgcggttatcgtggccccagttgcagaggcaaaaagataacggagatacagtaggttatcgcattgaatatgccattgatctcgcgacagatggcggtgctttcaaggagatcctgaaaactgccgtagatggtaaaactaccaccaaatatgaacgttcccatcgggtggatttacccactgcctattcgggctggcaggtgcgccttcggcggttgacgccaaaagaaaacagcaaccggatcgctgatgccatggtggtggaggctattaccgaggtgatcgatgccaaattaagctacccggaaactgccctgttatttgttcagtttgatgccaaacagtttcgcaatatcccgcagatcacctgtgagccgaagatgcgcatcatccgtgtgccagccaattataacccggatagccgccgctattatggcagttgggatggcaccttcaaatgggcatggagtgacaatccggcatgggtgctgtatgacttgatgataaatgaccggttcagcatcggcacccgggtgaaaacggaaaacctgaatctggcaaaatgggatctgtatagcatcgctcaatattgtgatcagactgtgtcggatggcgaaggcggcgaagaaccacgtttcacttgcaatgtctatattcagtcacaggaagacgcttgggccgtgttgcgtgatattgcagggatcttccgggggatgacgttctgggccaataacaacatgaacgtgctggcggatatgccccgtgacatggattatctctttacgggtgccaatgtgcgtgacggcaaattcacctattccagtgccagcgagaaaacccattactccacggccatggtgagctggtccgatccgcagaatggttatcaggatgctattgagccagtgtttgaacatcgcctgatacgccgctatggtatccggcaggccgacttcactgccatcggttgtacccgccagagtgaagccatccggcgtggtaaatgggtgctgcacaccaacgaacacgaccggacagtcactttcaccgtcgggctggagggacacattcccctgccgggttaccttattggcgtgtcggataacctgctgtcagggtcggggatgagcgggcgtattcaggccatgcggctgcgatacattatcttggatcgggtgccatcggcaaaagtaggggactggcttgtcatcaacctgccttcaggtaaggcagaaagggatctcattacagcgattaacggacaggagatctccgtgagtaaccgtggctatgcctattcagatccacctgaggtaggcgcagtctgggccattgaatctagctatgtagcggagcaacccttccgggttatgggtataaaagcgggggaggacggcgtgtcgtttgacatcacagcggttgagcacaaccccgacaagtatgctcttatcgacaaggacacccgtattgacgaacgccccgttaccgtcattccgcccagcgttcagccggcaccgaagaatgttcttatcgacagttattattcgcttaatcagggtataatctccaccacgttgcggatcacatgggatgccgccgacagtgccgtggcctatgaagtcgaatggcgcaaagacaacggtaactggataaccgctccccggactaccgcccggagtcttgaggtgccgaacgtcgatgacggacgctatcaggcgcgggtcagggccacgaatgcagcggcaatatccagtatctggatgaacacgcaggataccctgctgggaagccgaaaagaggctccgtcggcaccgcagtccctccgaaccacatcgctactttttggtatccggctggactgggactttgccaatccgacggatgtcctgctgaaaacggaaattggctacaacaaaaacggagaggatgacgatacgctgcagttcgccgatattgcctacccgcaacgcactcatactttacaagggctggcggttggggagaagctctacttccgagcaaggctggtggacaaatcgggtaacgcctcggcgtggacatcactggtcagcggtaccgcgtccaatgataccggctggatagtggaggccagtcaggatcattttctggacgcaggaaccgggcggtgcttacaggagcaactcaatgagcaggctaaagccgacgcgcgtcacaagcagtctattgcggaaaacacacaggccattgagagattgaatgacatgctgaaggatctcaagcggcgcatacagtaa

SEQ ID NO: 1506 - DNA, 576 bp, Xenorhabdus bovienii
  Coding DNA location: Contig name=SeqID_16860; Position on contig =45415..45990bp; Strand=-
atgaacacattacgaaccgtacggctttacggtgtgctgggggctcagttcgggagagtgcataagctggctgtctctaccccacaggaagcgatccgtgcattatccgtgctgattaaaggatttgaacgcttcctgctgaccgctaaagaacaggggctgacctttgccgtgtttaacggaaaacgcaatatcagccgggaagagctggtgttttccgggcaggacgatatccgcattgccccgatgattatcggcagcaaaaacgccggtgttttccagaccattctgggcgcggtgctggtggttgctggcgcgtttttgtgggcgaccccgtttggtgcgccgatggtcatgtctggggttggcatgatgctgggcggcgtagtgcagatgctttctccgatgccgggcgggttggcacggcgcgaagatcccgacaacaagccatcctatgctttcggtggtccggtgaacaccgttgcgcagggaaatcctgtgcccattggctacggtagacgccgtattggcggtgccatcatttcagcgggtatctacgctgaagatcaacaataa

SEQ ID NO: 1507 - DNA, 747 bp, Xenorhabdus bovienii
  Coding DNA location: Contig name=SeqID_16860; Position on contig =45987..46733bp; Strand=-
atgaagatactgagaaaatcgaccacctgtgccatcatggctcatgcccaagccgcttacccagatgagtgctgcgggctgatcattcaacagcgtcaccgacagcactatcttccctgtcgcaataccgcatcgttacccactgaacagttccgtattcacccggaggattatgctgctgccgaagaccaaggtgcgattgttgccattgtccacagccaccccgatgcgacgacacaaccgagccagttggatatcgcccaatgtgacttgtcacaaattccatgggtgattgtttcgtggccgggaggggatatccgtaccttgatgcccatagcaggtattaagccattaattggtcgcccgttcgtgcacggtatttgggattgttatgccatcgtacgtgattggtacaaactggaacaggctattgaactccctggttttgaacgtaccgatggctggtggaatcggggcgaaaatctgtatatgaaacattatgccgctgccggatttgtcgtgtgtcgcggtgaattacaggcaggggatgtgattattatgcaggtacaggccaatgaacccaaccatgccagtgtttatctgggtaacggcctgatgttgcaccatctgtacgggcagctcagtaagcgcgaaccctattatggctactggcaggaacgcaccatcacaaccttacgtcactcatccgcttcggcggattttttgtttaggggagtcacatcatga

SEQ ID NO: 1508 - DNA, 738 bp, Xenorhabdus bovienii
  Coding DNA location: Contig name=SeqID_16860; Position on contig =46736..47473bp; Strand=-
atgaccatcaatgctacacttcagcggcttgagccgggaagtaaaatcgtattatttgttgttgatggctcggtatttggcgggcctgtattgtactttcataatcatccgatcccttataccggagccgaactggaaaataccggaaatttaccggtgaaatccctctggtggcagggcgtcgaatacaaaccttggcccgtcagcatcgaagggctggaagtcaccggcgatggacgggcagtgacacccactctcaatgtggccaatctggacggcacgctcagtgcattgtgtttggcttaccaaaacatggtgcaagcgcgtgtcacgatccgcatgacctttgctcactatctggatgcccgtaatttcctcgacggcaacccgcaagctgatccgacgcaggaaaaaatcgatgttttctacatcgacagcaaaactcaggaagataacgaaagcatccagttttctctctcttccccagccgatttacaggggattaaaatcccgacccggcaaattcacagcctatgtacatggtgtattcgcgggcagtaccgccaatcaccgtgtggctatatcggcacccgttattttaatgaaagaggcaagccgaccgatgatccggcctctgatgcttgcgggggattaatgagcgattgtaaaaaacgctttggtgacacagagcaattgccctttggcgggtttcccggctcggcattgctgaggcgataa

SEQ ID NO: 1509 - DNA, 333 bp, Xenorhabdus bovienii
  Coding DNA location: Contig name=SeqID_16860; Position on contig =47485..47817bp; Strand=-
atgataaaaacctttgattttcctgcaagggtgggcgcggtcggggagtttgaacctattgtgcgttccgtccagttcggtgatggttataaacaaacgtccggcgatgggatcaacacgcagcgcgaaagttggcctttgtcttttgtcggggcactgtctgacatacagcctatcatagcttttctgcgtgagcatcagggctggcgcccattcaaatggcgtaacccgttatttgaactgggattgtatcaggcggggaaattcaatattcaagctaatggcgcttatttcactctttccgtgaccttcaccctcatctatcatccataa

SEQ ID NO: 1510 - DNA, 3336 bp, Xenorhabdus bovienii
  Coding DNA location: Contig name=SeqID_16860; Position on contig =47817..51152bp; Strand=-
atggctaatttatcgacattgacggtcggcttgctggttaatgccacctcgtttaaatcccggatcatggatgcctatcgttatgccgggcgggaatcagaacgttttacggataaggcgggatcggatgccaagaaactgaaaaagacctacagttcactggcatcacatattaaatccgtttccgggcaactggcgttactggcaggcaccggcttttcactgaatacggttatctcccatacccgtaaatacgggcaggcgttatctgacctgtccgccattactggtgcaacaggcgagcagttaaagaaactggatggaaatgcccaacggatcgggcgtaccacggaattcggcgcaacccgcattgctgaggcgtttaaattgatggcctcagcaaagccagaactgctgaaaagtaccgaggcactgacgctggcaaccgagaaagcggtgatactggcgcaggcgtccggtattgatttaccggatgcgactcgtgcattggcgttatcgcttaatcagttcggtgccagtgcagaacaggctgaccgctttattaacgtactggcggctggggcgaaatacggttcttccgaaattaacgaaacggcgcaggccattaaaaatggtggcaccgcagcggcacaggcagggatcagctttgaagagttaggcgcagttatccagatactggcggaacgcggcattaaaggcggcgaggcaggcactgccattcgtaacgtgatactggcgctggaacgctcgacagacaaaaatctgaaaccttcggttgttggtctgtcgtcggcattgggatccctgacgggcaaaaacctctcgaccgcacaggcggtgaaattattcgggcgggcgaatgtcagtgcggcgtctaatttagtcaccgggcgggaaaaactggaagaactgacccaagccctgaccggaacgcaggtcgcttatgaacaggtcagtgcgcgtgctaataaccttggggctgatctggatgtgctgatgagtgcctttgaaggcatggctttgaaaatcggacagagtgctgacggctcattacgtaccggggtgcagggggcaaccaatgcgattaatgcgttgtccgaaaactttaatctggttgccagtgtggcattgcatacgttaattcctgtgatggcgactaagctgactgcgggattacgtgaaaatattacggcatggcgcgccaccgaaaaagcagctcgtgatgttgctaaacagcaggcagaaaccgcaaaacagacaattgaacaggccaatgccacgctgcgttcaacggaagcacagggcaggcacattcaatatctggaaagaacaaaccgtttgcacggtctttccgtcaattatgcaaaagaaaaaagaaccctgatccgacaggaaactgaagctctcaaattgcaaacacaggcaaccgggcaacttgaagcggctaaccgccggctttcttattcctatcgggcattatctgccgccgggggagttacccgtggcgcacttgccatgattggtgggccatttggtgcagcgatgttggcgggttcagccttgtatggattatataaccatagcgttcaagccagagaggggttgcggcacttaaaggatgaaaccgttgatacggtggctgagctgcaacgtctttccagaattaaggtggaaatcgagcttgataaaactgacgatgatatcaaccacctgaaagaagaactcaagcagattgatagccaactggaacggtattctcaaactcgaatcaagcgattacaaaatcgtcaaaaagggttcttgaattttctttatgaagagccgaaagaagttgaaaagcaaggtcgggtattactcagtcgacgagaagatatcctcaaagggatagaaaataaaacagcaagaaagaaaaacctacaggcaacatcggtagcgggtatctttgaccaaccaccgccggagctgtcaaaacccgaggggaacggcacgggtaatccgtggacaggccaagatcccatcaaagaagagaaacaaggcaaacaatcacttaacctttatcagcagttacgtaaggaaattgagcagacccatgccaccagcttggatcgcatccgattcagagagaaagaaatgctgggtaaaatctatgaagtcggcaaatcgggtatggcttcggaaagtgagcttcaacgtttaaaaatcctcaatgccgaaaatcaccaaaagcagcgactggaactggcagataaatattctccggcagctgcattgatccgacaggaaaaagaagccagcgaagaactgaaagccctgtacagcgaacggttgctaagtgaacaggagtatttatctgccagcaggacgttatatcagacctcggtaaaagataaattagctgaacaggcgaagcaaatttccaccccgcatctggatatggcgggtgaggtcgatccttttgtgcaactgcaaaatcagctcacagaacaagctgcactttacgacacctactatcggaacggacttatcagcaaggaacgtcatgaacagttaatgatagccgctgcttatcgttccaaagatgcgcaatttgctgccgctaagaatttatacgcatcacaaggcgatttccagaaaatgcaaatgggtctgctggatgtggtcgagcaacgtacgggtaacgcgttaaccggcatgttgacgggcacaaaatccttttcggaatccatgcgggaactgtcggcatcactggcgcaatccattattcaggatctggtccgtattgcggtgcaggcgctgataaccaaagcgctctccggtttctttgggggcgcgatgggaagcatgggtgccagctcattgtcttcggcgggaggcggcctgtcttcgatgggttctggcacagcaatgaccccggatgtctggaagagtcccatcatgaatgcgaaaggtggcgtctatcaatctgcggatttaaatcagtatagcgggcagattgtcagtcaaccgactctgtttgcttttgccaaaggcggcggtgtgatgggggaagcaggaccggaagcgatcttacccttaaaacgcggtgctgacggtaagctgggtgttcagaccacaggcagtactggcaaccagaccttcaacaccgtccatattgtgatctattccgacggtaaccacgacacgaaaacatcccgtggtgcagagtcggcaggacaggatatcgcgaaatttgtcgatcagcgattcaaatttttgctgcataaaagtttaagtcaaggtggtgaactcagtgctgcgattagaggaggcagatga

SEQ ID NO: 1511 - DNA, 153 bp, Xenorhabdus bovienii
  Coding DNA location: Contig name=SeqID_16860; Position on contig =51156..51308bp; Strand=-
ttgtccttgcctgcgtccacgctcaacgagtggcaagcctattaccgactgaaaaaccgccaacagccagacagtccgcctgctgcatccgtatctgctccgtgtgatacggtccgggcacagtgtgatgctgtcatgaaattattgggttaa

SEQ ID NO: 1512 - DNA, 348 bp, Xenorhabdus bovienii
  Coding DNA location: Contig name=SeqID_16860; Position on contig =51380..51727bp; Strand=-
atgaaagcactgaaagcggccttactcactccgcatccgcagattaaagcggtggaactgttcggtactcaaatcaacctgcgccggatgacggcactggaactgctggagctggaagaaaaagctgaaaagctgagtgaagagggagacgggcgtggggcctcccgcctgaatgttcagatggtattggattgtctggtggatgataagggtaaatctattcccgccgattatctgcccaccgcagaagaattgatgatcgtccatgataacgccaccctgattgaagccatccagaccgtgaagcgtcattccatcggcacactggaggaggccgaaaaaaactaa

SEQ ID NO: 1513 - DNA, 462 bp, Xenorhabdus bovienii
  Coding DNA location: Contig name=SeqID_16860; Position on contig =51724..52185bp; Strand=-
atggcaacgtcccctgaatacgctgtattgccggtaggtactttggtgaaattcggcaagcccggcgatagcgtggagcagatgaaaccactcatcaactgtaaggccttgggcgcaacagggctgaccggcagttttgtcgactgtaccaccctgattgataccaataagcagtttatttccgatatgccggaaggcccggaaaaatccctcggttttatcgatgatccggcgaacgaagatttcgtctctttcctgaacgcggctgaaaagcgcgaaactgtgcagttttacattgctctgccgaataaacgtaccgccacgatggtgctagcgctttccggatgggaaatgaacgatattaacgccccggcgagtgaagtgattcagctcaccgttaaaggcaagcaaaacaacctcgtttgggggatcgctgacataaaaacaggagttatccaatga

SEQ ID NO: 1514 - DNA, 405 bp, Xenorhabdus bovienii
  Coding DNA location: Contig name=SeqID_16860; Position on contig =52205..52609bp; Strand=-
atgatcaccgtacaaactacgggatgggcggagctggggagcaaattgcaggagctggatgtcgcacttcagacggacattatgcgaaaagccggtaaagcggcgatgcagattgtgcaggaagatatgcaggtccatgccggttacgacaagaaaagcaacgccgtgcatctgcgggataatatccctatccgcaccgcaaaatccacgaaatatcagggtggcgtgatgatcacggttggcccggtgaaaacacaccgaataaaagcactggcgcaggaaacgggtaccatcaaacaagtggcaaaaccttttatccgtccggcgctggattacaacaaacaagtcgttttaaaagtgctggcgcaggaaatcagagccgccttatcggcttatagtaaataa

SEQ ID NO: 1515 - DNA, 399 bp, Xenorhabdus bovienii
  Coding DNA location: Contig name=SeqID_16860; Position on contig =52606..53004bp; Strand=-
atgtgcgtcatgattgaacccgaactcaaagctgatttagaacggttaacaagcctgcctgtttatccgctgatattgccctctacggtattagagggggtaacctatcagcgcatcagcgatccccgattcaataccgggctggcggcttcgctgttaatcgaagctcgtttccaaatcagcattatggtgctgaacgattacaccaaagccctgcggctggaagcgaaaatccgttccgcatgggaatctgtgcagcatggcctgctaggaggttatccggtacaaaccgtttcacgcgggattttgcatcaggaggcggaagagctgactgaaaaccgcaagcgttaccgtatcacacgggactttatcatcacttacacggagaacccggtatga

SEQ ID NO: 1516 - DNA, 321 bp, Xenorhabdus bovienii
  Coding DNA location: Contig name=SeqID_16860; Position on contig =52988..53308bp; Strand=-
atgaaagcaggggaactgcgttatcgcatccggttacttcgtccggttatcagtcgtgatgagctgggttcagaaatgatcagtcatcattatgttgccaccgtctgggcgaaagccgaagccatgtcaaaccgaaagatccgtactgctgaccaacaacaggtgatagaggtacagcaatttaccgtcagatcccggcgtgatatcgaaccgggctggctgattggacatcagcaacggcggttcacggtacgcgccgttgaccgtaaccttgttgattgcacgattatcaccacggaggcggatgtgcgtcatgattga

SEQ ID NO: 1517 - DNA, 303 bp, Xenorhabdus bovienii
  Coding DNA location: Contig name=SeqID_16860; Position on contig =53318..53620bp; Strand=-
atgccttttcccactcttgatctgcttcggcaacaatgccgtatcgacagtgataattccgccgaagatgacttattaaacacctattcccgtgccgccatcaaacgggcagaaagctacctgaaccgtcgcctgtatgagaacgaggtgccgaaggatgatcctgatggcctgctcgttaccgacgatgtggcactggcgattatgttaattgtagggttctggtacgacaaccgggaggcccagtcattaccgatgggctttcaggcattgctggaaccctatcgttttattccgttatag

SEQ ID NO: 1518 - DNA, 1212 bp, Xenorhabdus bovienii
  Coding DNA location: Contig name=SeqID_16860; Position on contig =53644..54855bp; Strand=-
atggcgattgaagtcaaagatgtacaacaggttgcgcaggaaattcagcagcgtttcgacgagttcagacagaagaacgatcagcgtattgaggcaatcgaagctcagaaaggtaagttgtccgagcaggtggataccctgaatggcaaactgtctgagctggacagcttgaaatccgcgctggaagaggagctggtggggctgaaacgtccggcaggcggcagcaatacgccagcggtgagcgagcacaaagccgcgtttgcccagtttatccgcaagggcaaagaagacaggctggcagagttggagcaaaaagcgatgcagaccactgccgatcctgaaggaggctatgccgtcccagaggagttggatcgcaatattatcagcgcgttgaaagaggaagtagtgatgcgtgctgagtgtcacgtggtttccgtaggcagtccgaacttcaagcgattggtgaatcagggcggggttaacagtggctgggtgggcgaaacggatgaacgtccagaaactaaaacaccgaagctgatgcccatcgagccgacatggggcgagatttacggcaatcccgccgcgacccagaccatgctggatgatgcctttttcgatgtggaagcctttatctcatctgaactgacacaagagtttgctgagcaggaggagagtgcttttacccacggtgacggcaaaaacaaaccgaaaggtttgctggcctacggcagtgatgtgcaggaagacaaagaccgtaaatggggtaagttacagcatctgctgctgaaaaaaccaaccgaggtgaccgcggatgaagtcatgcaactgatctacaccctgcgtaaaccgtaccgcaccggagcgaagttcatgatgaacaacaaaatgctgtttcaggtacgcactctgaaagacagtcagggcaactatctgtggcagccgggtctacaactggggcaaccgtcttctctgctgggttacggtatcgcggaaaacgagcagtttactgatttgagcacaggtgccgtgccgatagcgttcggtaacttcaaacgctgctacaccattttggatcgcctcggggtgcgtatgttacgtgatccgtacacgcacaaaccgtttattcacttctacaccactaaacgggtgggttctctgctggtggacagcaacgcagtgaaactgctgaaagtagcagaaggtaaggcctaa

SEQ ID NO: 1519 - DNA, 657 bp, Xenorhabdus bovienii
  Coding DNA location: Contig name=SeqID_16860; Position on contig =54868..55524bp; Strand=-
atgccgatgataaccaagcaacggcttgatatgcccctgagaatcaaatcggtcagcgattccggtgagtttgagggttacggctcagtgttcggactcaaagacagcgctgatgacatcgttttacccggtgcgtttgccaatacgctgaagcaatggggtgaaaaaggtggcctgcctgcgctgctctggcagcaccgaatggatgaacccatcggtatctataccgaaatgaaagaagacgagacagggctgtatctcaaagggcgactgctgattgatgacgatctgctggcaaaacgtgctcatgcccatatgaaagccggatcactctccggtctgtctatcggctacatcctgaaagactgggaatatgaccggacaaaagaggcttttttactgaaagatctcgatttatgggaagtgagcctagtgacctttcccgccaacgaggatgcccgggtgagcaacgtgaaatcggcctttgcccgaggtgatatccccaatcccagtcgtattgaacgggtcctgcgtgatgttggactctcccgttctcaggccagggcctttatggaggagggctacggagccttgtctttgcgtgatgctgagaccgtctcggcattaactgcactggaatcattacattttaactaa

SEQ ID NO: 1520 - DNA, 1233 bp, Xenorhabdus bovienii
  Coding DNA location: Contig name=SeqID_16860; Position on contig =55496..56728bp; Strand=-
atgtttttccccggattatttcgcaaatccgccgactccatgacctcccgtgacttaagtgaactgatcggcctgtcttatgatacctacagcgggcggcgagtcagtccacagttagcgatgcagctcaccgctgtgttcagttgtgttcgggtgctggcggaatcggtcggcatgctgccctgttcgctgtatgagcaactggatcgcggcaataaacggacaacccgtgaacgactgcataaactgctatcggtaaagcccaataactatatgacgccgcaggagttctgggagctattaattgcttgcctgtgcctgcgcggtaacttctatgtctacaaagtgaaggcgctcggcgaagtggtggaattattgcccctcgatccgggcagtgtcagcagcaaattaacccgtgactggcagccggaatatcaggtgaccttcccgaacggagaaagccggacactgacacaggatgacctttggcatgtgcgcatcttcaccctggatggccagaccgggttaagtccgattgcctatgcgcggcaggcgatagggttaggactggcgactgaagagcacggttcacggttattcggtaacggggcagtcaccagtggcgtactgcaaacggatcaggcactgaaagacgaggcgtatcaccggctgaaaacggattttgaagcccgtcatcaggggctggtcaacgctcataagccgatgatcctggaaatggggctgaaatggcaccaaatcagcctgtccgccgaagacgcgcagtttctggaaactcgtaaatttcagcttgaggaaatctgccgcatcttccgagtgccgttgcatatggtgcagaacaccgaccgcgccacctttaacaacatcgaaaatctggggatcgggtttattaattactcgctggtaccttacctcacccgcattgaacagcgcatcaatgccgggctggttaaaactgctaaacaggggcggttttatgccaagttcaacaccggggctttgttacgcggggacatgaaatcccgctttgaagcctatgccaccggcattaactggggcatttatgcaccgaacgaatgccgggagctggaagaactcaatccccgcgagggcggtgatatttatctcacgccgatgaacatgaccacgaaacccgaacaagccccgacaaaagaggaagaaccccatgccgatgataaccaagcaacggcttga

SEQ ID NO: 1521 - DNA, 177 bp, Xenorhabdus bovienii
  Coding DNA location: Contig name=SeqID_16860; Position on contig =56728..56904bp; Strand=-
atgaaaagattaatgattgctgccctgttggttgggctggcaggcggcactttgctgtcttatggtgcatggctgctgctatcggccgcaggatttatggttgccggcagcctgtgcctcggctggtcgtatctggtctcacgtatgttgagccagaaacccgataaggagacctga

SEQ ID NO: 1522 - DNA, 1731 bp, Xenorhabdus bovienii
  Coding DNA location: Contig name=SeqID_16860; Position on contig =56914..58644bp; Strand=-
atgagccgtaaatcttacctcaatgtcaatgcggccagccagtacgcccgtgatgtcgtgcgcggcaagattgacgcaggccgccatgtcaaagacgcctgccggcggcatctggataatctgagtcaggaaaaggcgaccgcgtttaagtaccggttcgataaagatcgggctgaacaggctgccaaatttattcaattgttgccccacaccaagggggaatgggcgtttaaacgcatgcccatcacgctggagccgtggcagttatttattgtttgttccgtgtttggctgggtgcataaaggcagccggttacgccgctttcgggaagtgtatactgaaattccccgtaaaaatggcaaatccgcaatttcagcgggggtggcactctattgctttacttgtgatgacgaattcggcgcagaagtctattccggcgcgactacggagaaacaggcgtgggaagtgttccggcctgcccgtctgatgtgcaagcggactccgctgctacttgaggcattcggcattgaagtgaatgcttccaatatgaaccgcccggcagacggtgcccggtttgagccgctgatcggcaatcccggagatggccagtcacccagttgtgcgattgtggatgagtatcatgaacacgataccgatgatctctacaccaccatgctcacgggaatgggagcacggcgacagccgctgatgtgggcgatcaccacggcaggttacaacattgaaggcccgtgttatgacaagcggcgcgaagtgattgaaatgctgtccggcaatgtgcctaacgaggaattgtttggtgtgatctataccgtggatgaaggcgatgactggacctcaccggaggtattacgcaaagccaatcccaatatgggcgtctcggtgtatgccgatttcctgctgagtcagcaacaacgcgccctgaataacccgcgtttagccagcgtatttaagaccaaacacctgaatatttgggtttctgcgcgggaggcttacttcaatatggtgaactggaaacagtgcgaagatacttcactgacgctggaacagttcgagggccagccttgttttctagcctttgatctcgcccgcaagctggatatgaacagcatggcacggctttttgtccgtgagattgacggcaaacgccatttctacagtatcgccccacgtttctgggtgccgtatgacacggtctacagtgtggaacagaacgaaaatcggcgcagtgctgagcgttttcagaaatgggtggaaatggatctgctgaccgtgacggaaggtgctgaagtggattaccgctacatccttgaagaagccaaactcgcctgtcacctgaacccagtcaatgaagccccgattgatccctttggggcaactggcttatctcactcactggcggatgagggtattaaccccatcatcattacccagaatttcactcacatgagcgatccgatgaaagagctggaggccgccatccagtccggtcgtttccatcatgacggtaatccgattatgtcctggtgtatcggcaatgtcgtcgggaaaacgatgggtggaaatgatgacattgtgcgccccatcaaagagcataaagacagcaaaattgatggcgcggtagcgctgattatggcgatggggcgggctattttgcacgaagaacccagtctctcagatcatttgatctcccacggtgttcgctcactctga

SEQ ID NO: 1523 - DNA, 495 bp, Xenorhabdus bovienii
  Coding DNA location: Contig name=SeqID_16860; Position on contig =58641..59135bp; Strand=-
atggctggaacggcgggcagatcaggtcgtcgccccaagccgacggcacgaaaagaactggcaggcaatccgggtaagcgaaaactgaaccgggatgagccggcctttaccccgttgacgggcgtttcgccgcccgattggtttgttgagcatgaaatgccgttggcggtggtgatgtgggagctgaccagcaaagagctgtgcgcacaggggctgttgtgtgtgactgacctgacggtactggagcgctggtgtgtggcgtatcagttctggcgcaaggccgttatcaatattgcccaacagggtaacacggtaaccggcgcgaccggggggcccattaaaaacccggaactgaccgccaaaaaagaacagcaatccgaaatggatacgaccggctccctgctggggctagatcccagcagccgccagcgtctgatgggcgccgcgggcaaggccaaaactgacaaccctttcatgaggatgatctcatcatga

SEQ ID NO: 1524 - DNA, 93 bp, Xenorhabdus bovienii
  Coding DNA location: Contig name=SeqID_16860; Position on contig =59138..59230bp; Strand=-
ttgggtcttttttcatacccgcgaaaaatgaaatttaaatcgggaggctttttatccctctggccctgtttttttgaatacgggaggttctga

SEQ ID NO: 1525 - DNA, 108 bp, Xenorhabdus bovienii
  Coding DNA location: Contig name=SeqID_16860; Position on contig =59215..59322bp; Strand=+
atgaaaaaagacccaaggcggcagtccttgggagcgagagaggtagcgatttgccccgcccctccctctataacgatggcatgtgcaatgattgcaattagaaattaa

SEQ ID NO: 1526 - DNA, 351 bp, Xenorhabdus bovienii
  Coding DNA location: Contig name=SeqID_16860; Position on contig =59337..59687bp; Strand=-
atgccaccccgcattccccgcgcctgtcgcaagcaaggctgctccaagaccacctccgatcgcagcggctactgcgctgaccatctgcacacaggctggcaatatcaccaacaaggcaagagccgacatgtcagaggctatggcagtcaatgggataagctgagtacccgagtcaaacaacgggataaccatctgtgtcagcattgcttacggcaagggcgagtggttacagggacaaccgttgaccatatccaacccaaagcccacggtggcaccgatgtgttgagcaacctgcaattgttgtgtgaagcctgccatcgacagaagaccgcgacagagcgattacgataa

SEQ ID NO: 1527 - DNA, 153 bp, Xenorhabdus bovienii
  Coding DNA location: Contig name=SeqID_16860; Position on contig =59782..59934bp; Strand=-
gtggttttgtatctggattttacgcagtcggagagcttaatttcaagcccttcgctatatcagataatcacgcttattttcatttgcaataagttatcattgtctatcggtattagctatgacatgtctccttttcatcgagcgtacagatag

SEQ ID NO: 1528 - DNA, 702 bp, Xenorhabdus bovienii
  Coding DNA location: Contig name=SeqID_16860; Position on contig =59997..60698bp; Strand=-
atgtcctgctttagcgctgcagcaaaaggcaaagctgtaaatgaagattatttcttgcctcctacttgtgataatgattcaaatattgtatttgcagtagctgatggagttggttcgactgaacaagcggatttggcatcaaaatatgcaatacaggcaattcaaaaagcattaacagagccgaactttagcatagagaaagcgttttcacaggctaagaaggctatcgataactttgattttagcgttgcaaccacactaacaatcgtacatgtagtggatactaaggtttatatagggcatgtaggagattgtcggctttactttaaaaatgggaataagttagttcaattaaccaaagatcatacaaaattccaagaactcttagattctggtgagcatagtatgcgtaacttgaagaatcacaaagagagactttccactattcttacatctgccttatctaatgacattgaattacattttgatatcatagttaaagacatcaaagatattagtagtgggaatgatgtcattctggcattaatgtcggatggtgcatataagcactgggagtcaagacctaaattttcagaaagaacaatggcgttaccgtcggcattttctgcaagtttaaggcgtcgaatagagaaagatattattgacgattatacctttttgggtgttaagctaaaaatatag

SEQ ID NO: 1529 - DNA, 780 bp, Xenorhabdus bovienii
  Coding DNA location: Contig name=SeqID_16860; Position on contig =60713..61492bp; Strand=-
gtggatcgatgtggtaattattttattgaggacttgaaaagactcggacgtggtggtttcggtgaagtgtatgaagttaatgtatacaatctaacaaagactcactcgcgaaggtatgctagaaaatatttctcgccttctcctgagaataataaaacagccataaaggaaattgctgacttaagagagaggtttctggttgaaattaaaactcaatgtacattgaacctaattgattatgactctatagcacctatagtgctttttagtaccgcaggagacaaaccttactttattatggagaaggctgaagataacttattagaatccattaagagtggtatgtctgcggaagaaaaaattatggcagtgcgacaaataattaagggtgttaaaacaatacacgacaatagttatgttcaccgtgatttgaagccagctaatattctgaaatacagtgatggaagatacaaaatcagtgactttggattagtgaaagatttaaatcttgtcagagctgaagtaaaaacaaaatttcaaccaaatgggatgggaagtgacggctatagagctccagaaataacagagagtgggttgttttccaatcagtctgatatttttgctataggtcaggtcattagtgatgtgtactcaaaagaccttccccataagttaaaaaaagtcatatcaacatgtagagcgcattggcctgaagatagatatgcagatgctaatgaattattaattgatttttataaagctatgggggtaacaccgtga

SEQ ID NO: 1530 - DNA, 102 bp, Xenorhabdus bovienii
  Coding DNA location: Contig name=SeqID_16860; Position on contig =61524..61625bp; Strand=+
atgagagctatttccattcagagctataaacaatcagaaaaaataatatttatgaactgtagttttatactactaggcttagtgagtgtaaagaataattaa

SEQ ID NO: 1531 - DNA, 453 bp, Xenorhabdus bovienii
  Coding DNA location: Contig name=SeqID_16860; Position on contig =61707..62159bp; Strand=-
atgaaactcaatttcacctccggcgttgttattgcattgattatttcatcagccgcagccttcttataccgctctggttacaagaggcagctcggtatcaatagcgaccaaataaccgaaatccagcaactgactgacaccatcacctaccagaacacgcatattgaaatactgtatgagctggataccaaacacactcaggaaattgccaatgctaagactgaaatcgacattcttcgggctgatgttgccgctggtcatcgcaagctgcgcatccaagccacctgtcctgtgtctgaaaccactgcctccggcagcgtggtcgatgcaaccaccgtcgaactcactggagaagctggatcaactattctcgatatccgagaaggtgtcatcaacgatcgggcaaaattaagatatttgcaggaatatattagaacggagtgtttgcggtaa

SEQ ID NO: 1532 - DNA, 435 bp, Xenorhabdus bovienii
  Coding DNA location: Contig name=SeqID_16860; Position on contig =62156..62590bp; Strand=-
atggaaatcagcgataaaggccttgagtgcatcaagcagtatgaaggcctgaaactaaaagcctacccagatcccgcaactggtggtattccgtggacaattggttatggacatacaaaaggggttaaaaaaggagatgtgattacagaacagcaggccgaagcattcctgcatgatgatctccaacctatttacactacattaaggcaattgattaaagtctctttgaatcaaggccagttcgatgccttgtgctcgtttatcttcaattgtggcagcggtaacttttcggggtccactttattgaagaaactcaatcaaagtgattatacgggtgtagcgggagagttttcccgatggaataaagcagcaggcaaggttatgcgtgggctggataatcgccgggcatctgaacgccagatgtttttatcatga

SEQ ID NO: 1533 - DNA, 447 bp, Xenorhabdus bovienii
  Coding DNA location: Contig name=SeqID_16860; Position on contig =62574..63020bp; Strand=-
atgaataatcaatctagattgattattcaactttttctattacctaactcacaggggggaacctatttcactcctccacggatacccattgctctaatcgggtggaatatgaagatgaaagaaaatcctgatatttgggtacatctcggtgactggcttgtttcaataaaagaacaaggtattggggctgtactcgccggaacaatggcatttctccgaggccgctataacggcagcggttggttaaaagtctctatcgatgcctttatatgtgccatgttcgcctggttcattcgtgatgtattaaatctgtttggtctgaatcctgatttggcctacatcggcagtgtggtgattgggtacttgggtacggactttatcggtcaattgctgagtaaggcagcaaagaaaagagcgggaacatcttctgatggaaatcagcgataa

SEQ ID NO: 1534 - DNA, 231 bp, Xenorhabdus bovienii
  Coding DNA location: Contig name=SeqID_16860; Position on contig =63083..63313bp; Strand=+
atgactatatttagtaaatgtcctgtatgtgatacccctttggatccattaccgaagaaaggcggggccgaagaatattcttgcacgaatcatggaagcatcaaaatttctgacacagttatcgatatctataatagaagcgatgaaaaaatccgtgatgaatatagaaaaaaaatagcatcaaagattgagaacggagaaggaggcaatataacgtcttacgacttataa

SEQ ID NO: 1535 - DNA, 96 bp, Xenorhabdus bovienii
  Coding DNA location: Contig name=SeqID_16860; Position on contig =63308..63403bp; Strand=-
atgtgtttaatcaaaattttcaagctttgtatggtgtttgaaaatgcacgattaacgatagagcctcaagtaatgatgaggctctttgttttataa

SEQ ID NO: 1536 - DNA, 1035 bp, Xenorhabdus bovienii
  Coding DNA location: Contig name=SeqID_16860; Position on contig =63429..64463bp; Strand=-
atggatttacgctctgtcaccttagtcaaagacgactccctgaaatttatcaaaaccctgccggataactgcatcgacttaatcgccactgacccgccgtattttcgcgtgaaagattgtagctgggataaccagtggcaagatgtcacggcctatcttgcatggctggatgaactgcttgctgagttctggcgggtactgaaacccaacggcagcctgtatatgttttgtggttcacgtctggcctctgatactgagctgctggtgcgggaacggtttaacgtgctgaaccatattatctgggcgaaaccgtcaggtccgtggcgcaggcagaataaagaaagcctgcggatgtattttccggccaccgaacgcattatttttgccgaacattaccaaggcccctatcacccgaaaggcgatggttatttcaaacaatgccgggagctgaaacagtcggtgtttaaaccgctggtcgattattttcgtgatgctcgtaaagcgttaggcatcacggcaaaagacatacacaaagccaccggaaagcagatggctagtcattggttcagcgatagtcagtggcagttacccagtgaaactgactaccaaaagttgcaaggactgtttgaccgtatcgccaaagaaaagcaccagcgtggtgaactgaacaccccgtatcctgagctggtggcgtctcatttaaccctgtcgcgtcagtatgatgaattgcggcaggaatacggtttaatgcgccgctcgttcacggtgacggcagacgtgccttataccgatgtctggcattttgcaccagtgcagtattatccgggaaaacatccttgcgaaaagccggctgatttaatggcgcatattatccaatccagcagccgggaaggggatttggtggcagatttttttatgggctcaggggcgacattgaaagcggcgttaaaattgaatcgtcgtgtgttgggtgtggaactggaagaggaacggtttaaacagactgaacaagaaataatggtaaccaccgaatag

SEQ ID NO: 1537 - DNA, 93 bp, Xenorhabdus bovienii
  Coding DNA location: Contig name=SeqID_16860; Position on contig =64435..64527bp; Strand=+
ttgactaaggtgacagagcgtaaatccatccgcttttttcctctcgacgctggctgttctcaggaaagtcacaacacgaaaggccggcattaa

SEQ ID NO: 1538 - DNA, 201 bp, Xenorhabdus bovienii
  Coding DNA location: Contig name=SeqID_16860; Position on contig =64564..64764bp; Strand=-
atgctaaaacatgaagatatgacaataacagccgcctgtgttttagacgccgttcctttgtatacgtggttttctgtttctgaagtttctaaattaatggggctgcctgaaccccgttgccaattactgttaacgcaatttcgtctggcgggtttaatggaaagccgagatgatgacacgtttttcaaacgttctccctga

SEQ ID NO: 1539 - DNA, 96 bp, Xenorhabdus bovienii
  Coding DNA location: Contig name=SeqID_16860; Position on contig =64763..64858bp; Strand=+
atgataaatttaattctccggtcagtttttgtgcataaacacacatgtaactctgacccatcacaacagcaagtcttatgtttatttcaggcgtaa

SEQ ID NO: 1540 - DNA, 141 bp, Xenorhabdus bovienii
  Coding DNA location: Contig name=SeqID_16860; Position on contig =64844..64984bp; Strand=-
atgtggctgcttgtaaaaataaatctttacgatcgtaaaagcggtgctattgtgataaacgtgattgtaaagtcacaaggcttattaataccagacattttaaaccttgccccgtgcaaggtttttttacgcctgaaataa

SEQ ID NO: 1541 - DNA, 405 bp, Xenorhabdus bovienii
  Coding DNA location: Contig name=SeqID_16860; Position on contig =64969..65373bp; Strand=-
atgcgtgatattcaattagtcatggaacgctggggtgcatgggcggctgataatcgcgacggggtttactggtcatccattgcggtgggcttcaaaggattaatcccgaacagagtgaaatcccgcgtacaatgttgtgatgacgacgccatgattatcgccagttgcatggcaaaactgaaccagaagcatagtgatgcccatgacctgctctttgattattacgtctttggtaaaacatttatgcaattatctcgtgatcatcattgttctgatacgcatatcgggaagcgattacaaaaggccgaaggagttattgaagggatgttaatgatgctggatatctcactggaaatggataaagacatcccgttagagcaacacccattatgtggctgcttgtaa

SEQ ID NO: 1542 - DNA, 1362 bp, Xenorhabdus bovienii
  Coding DNA location: Contig name=SeqID_16860; Position on contig =65389..66750bp; Strand=-
atgaacgtatatgatttggaaatggccgtcatcagtggcttgttatcaggcggggcgacaccggacgcttacgacgtattagcgattctgccagatgacgcgttcagctccgttcatctgcgccgggtgtacggggaaatcaaaaagcaggccctgagcagtgccattatcgatccctttttcattgcggattcaatgggtgaagaacggggtattctggctaacttgctggaactggccaaaaccccggtctggcaggcaaacctaaaaggctatgcggaaaaagtcatgagttattggcgtgtacgtcaggtcactgacctgattaaccgttatcagaaggagattcaggcctgcggcaatcacacgcaagctgaagcactgatcgaggtttttgcgtcccagtttaatgaattatcccagagcgatagtagcttacagcccgtggtcatcggtacattgctggatagatacgttgaaacactggaagcgcgcaatcagggcaagacaggcatgatcctgacaggcattgagccgctggacgaattgaccgggggatttaacccgactgacctgattttgctgggcggacgcccgggcatgggaaaaacagaactggccctgtgcatgattgacggcatgacccgtgacggtggcggtgctttattgttttccatggaaatggcggcgcaacaaattgccgaacgtatggtggcaggttcggctgcaatgcccgtttctaaactcagaaactgtgaactgtatgacgatgattggggacgcattggaaatgcactgggttcactcatcgatcgggatattcatgtgctggatgccagcgacctgagcgtcgaacaaatctgcgccatcagtgaaacgcataagcgccgccacccgaacttaaagggcattttcgtagactatcttgggttgattagaaaaccccgggctgaccgtcacgatctggctgttgcagaaatatcgaaggcactgaaaggattggcgaaacggctgcatacgccggtcacggccttgagccagctatcaagggaagtggataagcgccccttgcatcagcgtcgcccgatagctgctgacttacgtgattccggctcactggagcaggatgcggatcgcattctctttacttaccgggatgcggtgtataacccactcagctccgccagccagtacgcggaaattattctggagaagaaccgccacgggcaaaccggtacgatttatcaggcattcaggcacggacattatttgccgactgatcagatatcggctgctgaagtttgccggatgcaacgacaaaccaaacaaaaagaacgccgttatgccgacagggcactttaa

SEQ ID NO: 1543 - DNA, 585 bp, Xenorhabdus bovienii
  Coding DNA location: Contig name=SeqID_16860; Position on contig =66747..67331bp; Strand=-
atggaaacaatcgatctgggcatattgaaaattgttccccgctttgcgcaggccagctttgctacttacctaccgcagagcctgatggcagaaaccaacctgaaaacctgtcagggctacgtccagacgtgggaggaacgcaagcgggcaggggaaggcatgatcctgtgcgggcgtcagggcacgggcaaaacccaccttgccgtcgccctctgccgcgagattgccacagggggtgatgaagcggtttttatcaccaccgcgtcacgcatcatccgggcttttcgtcgttcgtggaatagcgaaggggagatgagcgaatttgacacactgaaattttacagtgagctggatttactggtgattgacgaaatcggcgtgcagtacggcacggagtctgaacgcaatattctgtttgaggtgctgaataatcgctatgaagacctgctgcccaccatcctgatcagtaatttgcctgtgactgagctggctcagtttttgggtgaccgaacgctagatagattgcttcagggcggcacggtattggcctttgactgggaaagctacagaagggaaatcgcatga

SEQ ID NO: 1544 - DNA, 744 bp, Xenorhabdus bovienii
  Coding DNA location: Contig name=SeqID_16860; Position on contig =67347..68090bp; Strand=-
atggtaaaggcaatgagtatccgggtaggtaatcccctgagaaaactggtgcttatcaaattagccgacaatgcaaacgacaaaggggagtgctggccctcatatcagcatattgcagatcactgtgaatgcagcaaaagcgcagtgcgaagccacattgatgccctaattaagatgggcttgcttatcaaggaaaaccggctcggtaatcacaacgggaaagggaatgcctcgaatgtctattatctgaatttatccgctgaccctgtgtcacccaaaagcataccccctatgccacctgctggcagctctgtgtcatctgctggcacccctatgccgcctgatgacatcccccctatgccatcagatggcaccagaaccagtcactcttttgaacccgtcaaggaaccagtcaaagaacctataaaacccaaaggggccgggcaattcgatcccctgactgccaaaccggaaaacgtcagtgccgaaacgtgggcggattgggtgaagttcaggcaggaaatcaggaaacccctgacggaaaccagttgccgccagcaggccaagcaattggcaggatgtaccaatcctgatgaggtgatttgcacctccattgccaacagctggcaagggttatttcctgacaaaccgagatccgggcgtccaccacaaaccaacacccatactggatttaagcacaagcgttatgaatcacatggcgcgaattggacaaaaaatctttaa

SEQ ID NO: 1545 - DNA, 168 bp, Xenorhabdus bovienii
  Coding DNA location: Contig name=SeqID_16860; Position on contig =68078..68245bp; Strand=+
ttgcctttaccatcagactcatactcatgctgtttctccctgttaccgtacattaaaccccatccccatgttcatcccggacgcacctcaaacacccggcatcatccgccaccagtggtaattggaaatttatttaggggttttgttcaggtggcgggaaaacagtag

SEQ ID NO: 1546 - DNA, 231 bp, Xenorhabdus bovienii
  Coding DNA location: Contig name=SeqID_16860; Position on contig =68211..68441bp; Strand=-
atgaaaaacagtgtgataaaaaaagtgatagatatcgcaggcagtcaggccaaattggctcaggttctggggtgtgcgcaatcgctcatcagtgcatggttgtacagaaaaaaacgggtttcggtatcacgggtccccgatattgtggttttttcaaacggggcggttcaggctcatgaattgcgtcctgatctgcctactgttttcccgccacctgaacaaaacccctaa

SEQ ID NO: 1547 - DNA, 666 bp, Xenorhabdus bovienii
  Coding DNA location: Contig name=SeqID_16860; Position on contig =68569..69234bp; Strand=+
ttgggcttatcacctgtatttcacgtaaatacgggaaccactcatgaggcacttatgacgcttgctgatagattaaaagaagccatggcagataaggggctgacccaatctgctctggcaaaaaaaaccggcatggcacaatccatgatatggaaattactttccgggaacgccgtcaaaacaggccgactcgttgatttggccaaggcgcttgacgtgcgcccggaatggcttagtgatggcagtggtcataaatcgcagtccggtgatactgattttgctgtcaggtatgacaaccgttatgcaccggtaaaaatttatgaagcagaacaagaaaccccagagttcttcatggtgccggccttttctgaacagcaaacctcgtttgaatcctgccgggcttatcgcatcacccaaaataccggctgctctgaagcgccggaagggacggtgattgtagtggatacacaggaagagatcgccaatgatgatttagtctatacacgcatcggagaacattattcagtttatcgttataaacaagggggggctgccaattttttatctgttgatgactcgcgtatccccttgataaccctctctcctgccatggaaatcgtcggtgtgattgtttatttatttcgtaatatgaagcgaaaacgataa

SEQ ID NO: 1548 - DNA, 132 bp, Xenorhabdus bovienii
  Coding DNA location: Contig name=SeqID_16860; Position on contig =69444..69575bp; Strand=-
atggtgatagcatttttttgttttgttgccggtttcttgatgatggcagaaatgaaggtacgcataaatcctctcgctgattatagtagtgattattcctatcactttgatgccgctaacattatcacttaa

SEQ ID NO: 1549 - DNA, 399 bp, Xenorhabdus bovienii
  Coding DNA location: Contig name=SeqID_16860; Position on contig =69511..69909bp; Strand=+
atgcgtaccttcatttctgccatcatcaagaaaccggcaacaaaacaaaaaaatgctatcaccattaatggcattgttgccaatattgcacaaacaaacagcctgcatacaggaacaacacatatcacttttttggcagatcaatatcatcagggcaaaacccagaatcacggcatggatatacaaaataaagatgaatttaaacatcatatcttaacaacgtatcgagtcagcccaaaacatacagagcctgttccttgctataatttagaactgattgtcgattacggttatgcactctataagcggagaggacgatatatgcatttaattgatatcattcctctgattaaagcagacaagaaaacacagccaataataaaaatagccacacaataa

SEQ ID NO: 1550 - DNA, 204 bp, Xenorhabdus bovienii
  Coding DNA location: Contig name=SeqID_16860; Position on contig =69978..70181bp; Strand=+
atgtttcactctaaattcagaatagttacatacaagaagagaacacgaaagaagtctgttatatggaaactgcaaataaaatggctcaaatggagccagaaaaatatcatcttacatctttatattgggcacaaacaaaacactgagcaatgcatatcagtaatcaaaacaacaagagatacgccctgctggtactacagatag

SEQ ID NO: 1551 - DNA, 180 bp, Xenorhabdus bovienii; identical to SEQ ID NO: 70
  Coding DNA location: Contig name=SeqID_16860; Position on contig =70237..70416bp; Strand=+

SEQ ID NO: 1552 - DNA, 876 bp, Xenorhabdus bovienii
  Coding DNA location: Contig name=SeqID_16860; Position on contig =70746..71621bp; Strand=+
atgtcagcaaaaattattgatgggaaaacgattgcgcagacaatcagaagcgaagttgcagaaaaagtcaggcaacgagtcgccgctggaagacgtgctccaggtcttgccgttgttttagtcggagaaaatccggcctcccaaatttatgtcgcaagcaaacgccgtgcctgtgaggaagtcggttttacttcccgctcttacgacctgccagacatcaccagcgaagccgaattactctccctaattgataacctgaacgaagatccggaaatcgacggcattttagttcaacttcccctgcctgccggcattgataatgtcaaagtactagaacgcatccatcctgataaagatgtggatggtttccacccttacaatattggccgcctgtgccagcgtgctccaaagctgcgcccctgcactcctcgcgggatcgtgacgctgcttgagcgctgcaatatcaacacctacgggctgcatgctgttatcattggggcgtccaatatcgttgggcgtccaatgagccttgaactgctgttggcgggctgtaccacgacggtgacgcatcgttttaccaaaaacttacgccagcatgttgaacaagctgatttactggtcgtagcggtcggtaaaccaaatttcattcccggcgaatggattaaaccaagtgctattgtgattgatgtcggcatcaatcgtttggaaaatggtaaagtcattggcgatgtggatttcgatagtgcatccgaacgcgccagttggatttctcctgttccgggaggagtgggcccgatgaccgtcgcaacattgattcaaaataccttgcaggcttgcgaggaatatcatgatgtagataaaaccaaaggatactga

SEQ ID NO: 1553 - DNA, 213 bp, Xenorhabdus bovienii
  Coding DNA location: Contig name=SeqID_16860; Position on contig =71621..71833bp; Strand=+
atggaaattttttgtttagatggacacccttatgtagagctgtgcgatctactgaaacttcaagggtggtgtgaaagtggtgctgcggcaaaagcgatgattgcggaaggtttggttaaagttgatgaccaggttgaaacccgcaagcgctgcaaaattatcgctggtaaagcagtggcctttaacggccaatcggtgcgcgttgaagcgtaa

SEQ ID NO: 1554 - DNA, 96 bp, Xenorhabdus bovienii
  Coding DNA location: Contig name=SeqID_16860; Position on contig =71802..71897bp; Strand=-
atgtataaaacattgagggtacagtttttcagaagagcattaacggtgatgcaatatcacgaaattacgcttcaacgcgcaccgattggccgttaa

SEQ ID NO: 1555 - DNA, 99 bp, Xenorhabdus bovienii
  Coding DNA location: Contig name=SeqID_16860; Position on contig =71987..72085bp; Strand=-
atgaatctactatttccccgtctcatattgctgtggtatttattcttgattttgtattttctggggtttttattttatttattctggatcttaatctaa

SEQ ID NO: 1556 - DNA, 237 bp, Xenorhabdus bovienii
  Coding DNA location: Contig name=SeqID_16860; Position on contig =72211..72447bp; Strand=+
atgttaagtaatagagctgcaagacggttgttgggtatgcctcataaattgagtaattccaagcgtaaggtaataatttctcttcttaatctcaccaccagtgatagtaaacaccaaatcccagaacacctgagacattcttcttttgtctgtatgaaaaaagatgcttattcaggaataataacctatcacccaggaaatacattttattctgaacatttgaatacccgtcgatag

SEQ ID NO: 1557 - DNA, 1383 bp, Xenorhabdus bovienii
  Coding DNA location: Contig name=SeqID_16860; Position on contig =72583..73965bp; Strand=-
atgctaaaaattttcaatactctcagtcgccaaaaagaagaatttaagccgatccatgaagggaaagtgggcatgtacgtgtgtggcatcacgatttatgatttgtgtcatatcggccacggtagaacttttgttgcatttgatgtcattgcccgttacctgcgctatctgggctatgatttgacctatgtccgtaatgtcactgacgtggatgacaaaatcatcaaacgtgccacagaaaataatgaaagttgtgatgcacttaccacacgtatgttgtctgagatgcatagcgattttgatgcgctgaatatccagcgtccagacttggagccgcgtgccactcaacatatgcctgaaattattcagattactgaagaactgatcaaacgcgggcatgcttatgtggctgcgaacggcgatgtgctgttctcgattgataccaattctgattatggcctgctgtcgcgtcaggatctggagcagttacaggcgggagcgcgcgtcgaaattgctgatgtaaaacgtaatccaatggattttgtgttgtggaaaatgtccaagccgggtgagcctagctgggaatcgccgtggggtgctggtcgtccgggctggcatattgagtgctctgctatgaacggcaaacaactgggacatcattttgatattcacggtggtggttcagatctgatgttcccacatcatgaaaatgaaattgcgcaatctacctgtgctcacgatggcccttacgtgaattactggatgcattctggcatggtaatggtcgataaagaaaaaatgtccaagtcattgagcaacttctttaccatccgtgatgtactggaatattacgatgctgaaaccgtgcgctacttcctactgtccggccactatcgcagccagttgaactacacggaagagaatctgaaacaggcacgtactgctcttgagcgcctgtacactgcattacgcggcacagataaatcggcccagcctgcgggtggcgaagcatttgaagcccgttttactgaagcaatgaacgatgatttcaacacaccggaagcctattccatactatttgacatagctcgtgagatcaactgcctgaaaactgaaaatctggcagcggcaaacggtctggctgctgaactgcgtaaactggcgggaattctggggctgctggaacaggaacctgaacagttcctgcaagggggggctcatgtggatgatgatgttgcccaaatcgaagcattaatcaagcagcgtaacgatgcccgtacaaacaaagagtgggcgctggcagatgctgcgcgtgatcagttaaacgcgatgagaattgagttggaagatggcccacagggaacgacatggcgtcgcaaataa

SEQ ID NO: 1558 - DNA, 162 bp, Xenorhabdus bovienii
  Coding DNA location: Contig name=SeqID_16860; Position on contig =73892..74053bp; Strand=+
atgcccactttcccttcatggatcggcttaaattcttctttttggcgactgagagtattgaaaatttttagcatcggtgggttttccgtaaaaagtgacgtacgtgtaataaaagcgaacgaatccgctgattataggcttctttatcagcgatataaataa

SEQ ID NO: 1559 - DNA, 168 bp, Xenorhabdus bovienii
  Coding DNA location: Contig name=SeqID_16860; Position on contig =74062..74229bp; Strand=+
atgaaaagccagatgagatatttcaccttgatatgcaacgctttgcaagcgccgcgagcgaccttgttcaccgacgcttgcagagtactgactcgagatcacagatatgatataacagcggatgttccgaacaccctagaaaatagggtcaatcaaaactattattag

SEQ ID NO: 1560 - DNA, 495 bp, Xenorhabdus bovienii
  Coding DNA location: Contig name=SeqID_16860; Position on contig =74240..74734bp; Strand=+
atggtgacttttcataccaactttggcgatgttgtgattaacactttcgctgataaagcgcctgtaactgttgaaaacttcttgaattactgccgtgaaggtttctatgacaatacgatttttcaccgtgtcatcaatggcttcatgattcagggtggtggttttgaacccggtatgaagcagaaaacggtcaaagcacctatccaaaacgaagccaataatggcctgaaaaacacccgtggcactctcgcaatggcacgtaccaatgatccacactctgcaactgcccagttcttcatcaacgttgttgataacgattttctgaatttccgttcagaacgtccagacggatggggttactgcgtattcgccgaagtggtagaaggcatggatgtggttgaaaaaatcaagggcgtttccactggccgcagcggtatgcaccaagatgtaccaaacgaagatgtgatcgttgaacgtgtcactgtcagcgagtaa

SEQ ID NO: 1561 - DNA, 723 bp, Xenorhabdus bovienii
  Coding DNA location: Contig name=SeqID_16860; Position on contig =74746..75468bp; Strand=+
atgtgtacgctgtttattgcagatcttcatctcagtgagcaagaaccggcaattactgccggttttctgcgttttttacgtgaagaggctatttatgctgagagtttatatatcctcggtgatttttttgattactggattggcgatgatgaccccaattccctgcacaatgaaattgcccaagcactcaacgagctgaaacaaaaaggtatttcctgctatttcattcatgggaatcgtgattttctgcttggctcccgatttgccagagagagcggtctgatcctgctgccacaggaaaaggtgctagaattatacggtaagcgtattctgatcctgcatggcgacacgctatgcacagatgatacaggttaccagcagtatcgtaagcgggtacacacgccgtggatacaacggctgtttttacttcttcctttgtttatccgactgaaaatcgcagccaaaatgcgtgcaggaagccaatacgccaatagccagaaatccgaatcgatcatggacgtcaatcaacaggcggtgattgagcattttgaaaaatatcaggttgattggatgatccacggccatactcaccgtcctgcaatacatgatattcaaatcgcggataaaaccgtacatcgcggtgttttgggcgcatggcatcatcaaggttcaatgttcaaagtgacggaaacgtcgattgaactgatgtttttccccttctga

SEQ ID NO: 1562 - DNA, 546 bp, Xenorhabdus bovienii
  Coding DNA location: Contig name=SeqID_16860; Position on contig =75604..76149bp; Strand=+
atgacgacccgccctgatcccgcaaccgctatttctgcaacttcaatgcaacaccacgccaaaatcgccattgtcatgggttcaaaaagtgactgggcgacaatgcaacatgccgccgatattttgacgtcactcgatattccctttcacgttgaaatcgtttcggcacaccgaacgccggataaactttttcattttgccgaacaagccaaagaaaacggttatgacgtgattatcgcaggcgcaggcggggcggcacatctaccgggtatgctggcagccaaaacattggttccggtctttggtgttcctgtgcaaagtgccgcactcagcggagttgatagtctctactccatcgtacaaatgccaacaggcatccccgttggtacgctggccatcggaaaagctggggcagcaaatgcggcattactggcagcgcaagtgctggcattacatgatgatgtactgtttcagcgtttgtcagactggcgttcagcacaaacacaagatgttttgaataatccagatccacgggaggatgcatga

SEQ ID NO: 1563 - DNA, 1068 bp, Xenorhabdus bovienii
  Coding DNA location: Contig name=SeqID_16860; Position on contig =76146..77213bp; Strand=+
atgaagccagtctgcgtattgggcaatggtcagttgggtcggatgctccgtcaggcaggcgaaccattggggatcgctgtctatccggttgggctggatgccgagcctgaatcagtgccataccaaagcagcgtcatcaccgcagaaattgaacgctggcccgaaacagcattaacccgcgaactcgcccatcataaggctttcatcaaccgtgatattttcccccagctggctgatcgcctgccacaaaaacagctcatggatagtttgggtttggcaacagcaccgtggcgattactgtccgatcccagccagtggccgcaactgtttgcggagttaggtgattttattatcgtcaagcgccgtactggcggctacgatggacgtggtcaatggcgcattcgaccgggtgatgaagcggaattacctgccgaaatttacggtgagtgtattgtggaacaaggcattccgttttcaggagaagtttcactggttggcgcccgcaatgcgcaaggtcaatccgtattttatacactgacgcataatctgcaccaggaaggtattttgcgcaccagcgttgccttaccaaacgcagataatcagttacagcaacaggcagaaaaaatgctgtctgccatcatggatcacctgaattatatcggtgtcatggcgatggaatgttttattgttgacgataacttgttgatcaacgagctggcgccccgagtgcacaatagtggccactggacacaaaatggcgcttctatcagccagtttgaactgcatctgcgtgcgatccttgatctgccgatgcctcagccagaaataatggcgccatctgtgatgatcaatctgatcggtacggagctcaacccagaatggttcggtttgcctctggtgcatttgcattggtatgaaaaggaagtgcgtccagtgcgcaaagttgggcacttaaatctgtctcatgctgacaaaggcgcattgcaaacaacgttacaggcattgatctctctactgcctgcggagtaccaaagcggtttggaatgggcgaaaattaaattaagttga

SEQ ID NO: 1564 - DNA, 612 bp, Xenorhabdus bovienii
  Coding DNA location: Contig name=SeqID_16860; Position on contig =77300..77911bp; Strand=-
atgtatacaggaattgtacaaggtaaagagagtgtattgtcactcaataaaaataatggtttcagcacactgaccgtaagtaattatcatcgtttttttgccggtgtttctgtgggcaccagtgttgccatcgatggtacttgtctgaccgtcaccgagttcaccgatgaccgggtttcttttgatatctccgattttaccgctgagagcacaacgttaaaattgctcaccgttggggatgaggttaacgttgaaagatcacatcagatgaatcaagaaaatggtgggcatagcctatatgggcatgttgaagggatggccgaagtcattgaatttacgccaacaggtgaaacttatcggttggttatccgaattcctcaagacaacattaagtatttcttcctgaaaggtttcattggtcttcatggttgtagtttaaccatcaatggcattgatgaagagaataaaaccgtagccttgaacctgattccagaaacattaagaatgaccaatttcaacaagatcaaagcgggagatttcctcaattatgaaatcgaccaaatgacaagaaccattgtagatacactagccagaacgttattgaagaaataa

SEQ ID NO: 1565 - DNA, 135 bp, Xenorhabdus bovienii
  Coding DNA location: Contig name=SeqID_16860; Position on contig =78101..78235bp; Strand=-
atgcttttattaaggttatttagcaacgtaggattctatattttatatttaattcatggtattcataagaatatatatttaattagaattgatattaataatataattaaatttaaatattttcatattttatga

SEQ ID NO: 1566 - DNA, 813 bp, Xenorhabdus bovienii
  Coding DNA location: Contig name=SeqID_16860; Position on contig =78418..79230bp; Strand=+
gtgccatttttaaggaaacgggaagcaaacaacattctaaagccgatgacagcaacaacggtcggtttatctgcaatctctttattcttcctttttaccgttcccgctcaagcaagcgatttcgtcaattttcaatccattgacaccagcctttacctgcaattcgaaaataaagtcgccccccagaaaacgatttctcccatcgtagaagcatttggtgattacaagattggcgatatgtatgtttacagcatttggcaaaattcgctgcaacatgactatcaaggcgataaaaacacctattactataaattcgtccccagactcagcgccagcaaaataacgaggtatgatctttcctatggcccattaaaagatgtgctgtttgcccagtggattgccaaaaccaaaaacgtaaaatacgattatttccccggtatcagccttgactggcaagtccctgggtttagctggctgcgtaccctgttttattttgaaaataatgcaaaaggaaattggaacgatcaacgaattcatattgactatgccattcctttcaataatcaattgggggattttcggatcgtagggacgttagattatacgcttgggttacacgataatcctgaaatgctggagttcaagccagaattgcattatgacttggggaaaaaactgggctatcaatcagggcatttatggacaggccttgttctgaatacaaccaagaataagtacaaaataaaagatacaccgtactatcgcacgaaccaattcagctatggcgtgtttattcgatacagctttttctga

SEQ ID NO: 1567 - DNA, 1278 bp, Xenorhabdus bovienii
  Coding DNA location: Contig name=SeqID_16860; Position on contig =79285..80562bp; Strand=+
atgtccattcaacacgacaaattcgggcgtacttatcagtggtttttgctggtacttttaggtatggtatattttttatccacagcaacaacctttacgtcattgggcgttgttctgcccagcatgatcaatgagctgggctggaactggacaagtgcgggtttgggattctctctgcttggcctgacctgtggactttccagttttctgccaacattgttcatccgcaagattggtgtccgcttcaccctattcattggtctgctgatttttcttgccggtttctaccatctgtataacacccatgtcatttcatcttattttatcggaacagccttattgggtgtcggttttacctttttagccacagttcccggcacttatgtcatttcacggttatatgaaaaacagtcccttgcctttggtttctatttcaccatcggtgggctggggggcgtcattggcccgtggatctattttctggccacccgtgtctggggaacgtggcgtatgcactggatgatttccgccattgttctgaccgtattcgtacttctgactatttttatcctacaagaaggcaaacgggaagttgcccatgccaaggccgttaatcaaaagcacaatagccagaaccccctgaaaatttatcgcactaaacagcgctggacagcacggagagcgctgcgtacatggcaattctatgccattgccgccacttacaccgcgtttttgtggtgtggcattacagttaacagttttgccgttgcccacattatcgagaatggcttcagtgaagctatcgccgcagggctgctgagttcaatggcctttatcaatgctttttcaagattggccgggggcgcggtaggcgagtggcttgatccgaaaaaattgctgattggcagcctgacggtcatcattattggcttgatcgcgctgagtatcgcgtcttcatggcctttcttgattggattcacactatttgtcggtatgggctatgggatgactttcctcgcctccagtgtcctgctggccaactattttggacgtaagccttatctggagttgttttcggtcatgaacctgatttctactctggcttgtctggcgcctttttttgccggggcgatcaaagattattcaggcagttttacttcggctttcctcattattgccatccccgtatgtgttgttcttgtcgtaacattgatgatgaaaccgcctgctcaaaaaatgaaaaagcgtttagtcgacaattccccattcaccgaatag

SEQ ID NO: 1568 - DNA, 1056 bp, Xenorhabdus bovienii
  Coding DNA location: Contig name=SeqID_16860; Position on contig =80606..81661bp; Strand=+
atgtcaaagaaagagttcggtgtattcctgcccatcgctaaaggtgggtggatcatctccaaaaacacgccgccactggatgcgtcttatcaacaaaaccgggaggctgccattctggccgatcagattggccttgatttcattatgtccatgggtaaatggcgcgggtttggcggggaaacagaccattggggtagctcgctcgagtctgtcacgatgatggccggtattgctgaggtcactcaccgcgccaagttgatcgccacggttcatgcggggctgcacaatcccgcagtgacggccaaaatgatcgccacgctggatcatatcagtcagggacgtgcagggctgaatattgtttccggctctttcaaagatgagtttgaacagatgggcgaatgggatggcagcctggatcatgaccagcgctacgccatgacggaagagtggacacaattgatcaaaaggctctggcgtgaaaaacacgttgatcatgaaggaacctattttcacctgaaacagtgtgtttcggaacctaaacctctttcactgccccgtccttatctggtttgtgccggccaatccgaacgtggcctccatttcagtgtgcgtcatactgatgtctgttttatcgggggcaaggatgaggcagaaacccgcaaaattagcttaaccgccaagcgcattgcatcagagtgcaacacaaccaccaaaactttctgcatgtgtacggtcatttgtgccgaaaccgatgcctatgctgaaactctcgctcagttttatcgccaaggtttggatgtagaagcggtcagaaatatgatgcacagttttggtgtcgatgtagatggcaaaaacaatgccatggttgaacgatcacaaaatgctttcatgacccataccgccattggtacgccagacacctgctacaagcaactgtcagatttactacgcacctgtgaactggatggcgtgatgttaatcttccctgattatattaagggattgaaaatattcggcgatcagatcctgcccaaattaagggctgagtttggctga

SEQ ID NO: 1569 - DNA, 2433 bp, Xenorhabdus bovienii
  Coding DNA location: Contig name=SeqID_16860; Position on contig =81758..84190bp; Strand=-
atgatctggcgctggttttggcgtgaatggcgtacaccatcgctattaattatctggctgtccctgacgttggccgtggcctgtgtgttggcattagggagcatcagcgatcggattgaccagagcgttcattaccagagccgtgattttctggcgggtgacctggtattgcaggcttcttatcccgttgatgaatcttggctgaaacaggcagaggaacgagggctgacattgagccgccagatctcattttcgaccatgacctatgcgggagacgttccgcaactggttcaggtgaaagcggctgatgaacattacccgctgtatggtgaattggagaccagtccacagggattgaaaccggaaaaaggttcggtgctggtcgcaccccgtttactggtgttaatggggattaaagtaggggatagccttgacgtgggcgatgcggtattgaagatccgtggtgagctgcttcaggaacctgatagcggcttcaatccattccagctttctccgcgtattttaatcaatattgaagatgccaaagcgacaggcgcgatccaaccgggaagccgcctgacttaccgctatatgttttccggctcatcagagtccatacaagcattccagcaattgatcgacccacaattaaaagcggatcaacgttggctcacattgaaacaggacagcggcgcactggctcagtccatcgatcgcgcacagcaatttttgctgttgtcggcactgttaacgttgttgcttgcggcggcggcggtagctgtttcgatgacgcactattgccgtagtcgtcataacctgattgcgatcttgaaaacactgggggcagggcgttgggcgttgcgtcagtggatcgttgggcagtggctggtgatattgctcgctgccattgttgtcggctccattttaggtttggtttttgagtccgctttgattcggattctggcggcgatgttgcccaaaatgttaccggaagcgggtatgtggccgtggatgtgggcgataggttcgctgttgggtattgccctgctggtgggaattcgcccttatcgtcagctaatggcgacgcagccatcacgggtattgcgcagtgatgtcactgcggcgatctggccgttacgttactacctgcccaccgtggcgctgattatgacgggagggttggtactactggcgggcactaagccgctcttatggtcattgctggcgggagtgccgatggttgctttgctactggcaattttgggctggggcggcttatggctgctgcgtcgcatgacatttcgccagcttagtttacgtttggcggttaatcggctgctgtgccgtccgttccagaccatgacgcaactggctgcattttcgctgtcattcatgttactggcattactcgtgatggcacggggcgatttattaagccgatggcagcagcaattgccaccggatagcccgaattatttcctgatcaacatgactcaggcgcaaattccaccagtgaatgacttgctggcgaaatatcaagtgaagccgactgagttctatcctgtggttctggcgcgtttgacggaagtgaatgggcagtcggcgattgaatgggctgacgaaaggcatcccaagagcacaacagtgcgtcgcgaactcaatctgacatggaaggccgaattacccccctttaatactctcgtggaaggaacgtggccaccgaaaccgaaggaagtttccattgagcagggcgtagcagaacagctgcacattaatgtgggagataaactgacatttacgggtaatacacagatatttcaggtcagtgtgagcagtattcgtaaggtagattgggaaagcctgcatccgaatttcttctttatcttttccaaagagacgctggataatcagcctcagacatggttgactagttttcattatgaaggagatggacagcttctgacggaaataaatcgtcatttcccgaccattagtatgctggacattgggactatgcttaaacagatacaggggatcttgcagcaaatcagtcaggcgctggaaattatggttgttttggtaatgatttgtggtgcgctgcttctgctggcacagattcaggtaggcatgagccaacggcagcttgagctggtggtttatcgtaccttgggggcgagcaagaaactgctgcggcgcacattgtggagcgaatttgccttgctgggtttcatggcgggtttggctgcggcatttggtgcggaagtggcactctggttgttgcagacaaaagtgtttgagttcccgtggcaaccgcaatggcagatgtggttcctgcttcctatcatcagtagcctgctgctttcattgtgcggtagttggttagggattcggttgctgcggggtaaagggctgcaccgacgtttgccggaataa

SEQ ID NO: 1570 - DNA, 687 bp, Xenorhabdus bovienii
  Coding DNA location: Contig name=SeqID_16860; Position on contig =84187..84873bp; Strand=-
atggctgtagaaagtattcttaaagttcatcatctcactaaacatgttggtcagggggaacaggtaattaatatattgcaaggtgttgagctggttgtcgagcctgcgcagacaattgctttgattggtgaatcggggtcagggaaatcgacccttctgggtattattgcggggctggatgatggcagcggcggtgaagtccacttattggggcaaaatattagccgtatgaacgaagaacaaagggcgcagctgcgagcggaaaatgtgggttttgttttccagtcatttatgttgatcccaactttaaacgcgctggaaaacgttcagctacccgcactgcttcgcggtgaatcagaaaatcaaagtcgtcagaatgccattgaactacttaaacagttagggttggggcaacgcctgaaacacatgccagcccaactttcgggaggagagcagcagcgagttgccttggcacgggcattcagtactcgtccaaaaatcctgtttgccgatgagccgaccggcaatcttgatcgccaaacgggtgatcgcatcgcggatctcttattttccctcaatcacgattacgccaccacgttgattttggtaacccatgacagccagcttgctgcccgttgccagcgtcgtttacgtctggtggatggaatattgcaggaggaagtatga

SEQ ID NO: 1571 - DNA, 648 bp, Xenorhabdus bovienii
  Coding DNA location: Contig name=SeqID_16860; Position on contig =84829..85476bp; Strand=+
atgtttagtgagatgatgaactttaagaatactttctacagccatgtatgtttccttttattgttagtgctatgcagcgccagagcaaccgcagcggataccctgcttatcttgggtgatagccttagcgccggttatcgcctgcccgttgagcaatcatggccgactctcatggcaaaagaatggcagcaatccggcaataaaacggctatcgtgaatggcagtatcagcggcaataccactgcacagagtcttgaacgcttgcctgaattgttgaaacagcacaaccccaagtgggttctggttgaactcggtggtaacgatggattgcggggtttttccgttcaacaaatagaacaagatctgcaaaagataattactttgattaaacaggcaaacgctcagcctttattaatgcagattcgtatttcgccaaattatggaaaacgctacacccaatctttcgctaagatttatccttcattatcggagcgtaatcagattccgctgctaccctttttcatggaacacgttgctatcaagcctgaatggatacaagatgatggcctgcatcccaaccaactcgcacaaccttttattacccattggatgtctgaccaactatcggcatacatcccctttaagtaa

SEQ ID NO: 1572 - DNA, 777 bp, Xenorhabdus bovienii
  Coding DNA location: Contig name=SeqID_16860; Position on contig =85539..86315bp; Strand=+
atgcaaaaagcggttcttattaccggatgctccagcggaatcgggctggtcgccgccaaaatccttcatcaacgtggctaccgagtatttgccgcttgtcgcaaacccgctgatttagcacatatgcgcgagttgggattagaacccatagaattggatctggatgataaagaaagtgttgaacgcgccgccgaacaagtcattcaattaacccatggacgtttgttcgggttgtttaataatgggggatttggcgtttatggcccattagagagcgtttcccgcgaactgatggaaaaacagttttcaactaatttatttggtactcatcaattgacctccctattattgcccgccatacgcgcttatggtaaagggagaattgttcagaccagttccgtattgggattaatctctacgccaggccgtggggcatacgcagccagtaaattcgcccttgaagcatggtcagatgcattgagaatagaactggcagacacgggaattaaagtcagcctaatagagcccggctcaatcacgacgcgttttacagaaaatgtgaaccaaacacagcgcgatcaccctgtcgaaaatccaagtctggcaaaccgtttcagactcacacctgaggatgtggtcactaagttgattcatgctctggaagcccccaaccccaaactacgttatccggtaacattattgtcccatgccatgacaattctgcggcgcatattacccgcgatattaattgataaaatcgtgaagtggcaaagctga

SEQ ID NO: 1573 - DNA, 879 bp, Xenorhabdus bovienii
  Coding DNA location: Contig name=SeqID_16860; Position on contig =86392..87270bp; Strand=+
atggaatcgataacgaacactaataaccatactgcccatatcattcatatcaatgaatctaatattgccccaatgattcagcattcactcactcagcttgtcgtgttctatttttggtctccacagaacctgcattgccatgaattggaagagacccttgataagctggcgcatgagtatgccgggcaatttgctctggccaaagtcgattgtgaccaattacctaatatcgctgcgcaatttggtgtacgtactgcgccaaccgtgattttcgtacaagaagcccgccctgttcacggttttgaaggaattcagacagacgaaactatcagaaaaatgttttctcaatttctgactcaacaaaaaaaatcactgttagagcaagcaaatgaacgacttgcggaagggaaaaatcaggaagctttgtctttactgaaagaagcgcatcagaccgagccaaaagagattgagattacattactattagctcaggtatatatttcgctcaatcaccttgaagacgcccagaacatcttggatacccttccattagaagaacaagatcaacgctacaatgatttgctggcaatccttgagtcacagaagcaggcggcaaattctcctgagattcaacaacttcagcaagcgttagaaattcagccagaaaatgctgaacttgctgttcaacttgccacgaaactgcacgaagttggccgcaatgaagaagcactggaactgctattcagttttctgaaaaaagatctttctactgctgatggtgcagtgaaaaaaatgctgatggatattatttccactctcgaaaccggagatacgctagcatctaaataccgtcgtcatgtatactctttactctattga

SEQ ID NO: 1574 - DNA, 930 bp, Xenorhabdus bovienii
  Coding DNA location: Contig name=SeqID_16860; Position on contig =87318..88247bp; Strand=+
atggatttactctctttgggtactgtacccattcttatcattattgcagttgtcatcgtctttacttgtgtaaagaccgtttcacagggctatcagtggacggtagaacgcttcgggcgctatacccgcacactgacgccagggctgcatatcatcatgccatttgttgatcgtatcggccgtaaaatcaatgtgatggaacaggttctggatatcccgtcacaggaagtgatttcccgtgacaacgccaacgttaccattgatgctgtctgctttattcaggttgtcgatcccgtgcgggcggcctatgaagtcagcaatctggaactggccatcattaatctgaccatgaccaacttccgtaccgtgctgggggcaatggaactggacgaaatgctgtctcagcgcgatttaatcaacagccgcctgctgactatcgtcgatgaagccactaacccatggggcgtgaagatcacccgtattgagatccgcgatgtgcgtccaccgaaagagttggtctctgcaatgaacgctcagatgaaagccgagcgtaccaagcgtgcagatatccttgaagcggaaggtattcgtcaggccgccattctgaaagcggaaggggaaaaacagtcacagatcctgaaagcggaaggtgagcgtcaatctgcgttcctgcaagctgaagcccgtgaacgtgccgcagaagcagaagcgcgtgcaacaaaaatggtatctgacgccatctctgacggtaatattcaggcaattaactacttcgtcgcccagaaatataccgatgccctcacccgtattggtgccgccgataacagtaaagtcatcatgatgccgctggaggccagcaacttgatgggcgctatcggtggtattgcggaattgattggcgaaagcaagaagagcaaacaggataaatag

SEQ ID NO: 1575 - DNA, 462 bp, Xenorhabdus bovienii
  Coding DNA location: Contig name=SeqID_16860; Position on contig =88250..88711bp; Strand=+
atgattgaacagattgccactcaacccgtctggttctggctctgttttggtggcctgctgctgattgcagaattgctgggaacggggggatatctcctgtggacgggaacagcggccgtcgttgtcgccttgatcacatggattttcccagagatgagctggaaactgcaaggcattctgtttgcggttctgacattgctgtctgccattgcgtggcgtagctggctacgctatcgtccacgcaaaaatagcgatgagatgctcaatcaaaaaaaccagcagttaattgggtttcatgcccgcttaaccagcgctaccgaaaacggctatggccgggtcaaactagccgatggcagttggcgtgttcattgtgacagggaacttccagccaatatggaagtggaagtgatcgccgtcgacgggatcacgttgaaagtgaaacccgtcgcaaatcaaccgtga

SEQ ID NO: 1576 - DNA, 405 bp, Xenorhabdus bovienii
  Coding DNA location: Contig name=SeqID_16860; Position on contig =88702..89106bp; Strand=-
atgaatatcagcgaaattgctcagaagaccggtttaaccagcaaagctatccggttttatgaagaaaaagatctgatctccgcgccgaagcgcggagataatggctatcgttattaccagcacaagcatattgatgaactgactctgttgcgtcaggcgaaagaagtggggtttacgcttgaagaatgccgtgagctattgcggttgtttcacaatcctcgtcgccatagtgcagatgtgaaaacagcgaccctgcaaaaagtggctgaaatagaaaacactatggtgaaattgcagaaaataaggggcaaactgctggcattggcggcggaatgtccgggagatgatggggcagattgccccatcattgagcaattatccggctgttgtacgcatcacggttga

SEQ ID NO: 1577 - DNA, 2748 bp, Xenorhabdus bovienii
  Coding DNA location: Contig name=SeqID_16860; Position on contig =89255..92002bp; Strand=+
atgtccacaactaccattcttgcacttcaggggttaacctgtatgcactgtgttggcagtgtcaaaaaagcattggaaaatgtatccggtgttgaacagactgatgttacccttgattatgccaaagttatcggaaatgtatcccccacagtcttaattaccgcgattaccgatgcaggttatgaagccgtcgtcgccactcagcccgatattgagttacaactttcaggcttaagttgcatgaaatgcgccggtaaaacccaaaaagcgctggaggcggtagaaggggttattacggccaaagtcgatactcagatcgcaaaaatttacggcaaagtagagagtaatactttagttaaggccgtcgaacaagccggatatcacgctgagttagcggcaggtataaccttcccaaaaactgagccgctgacaatatcttccttacaagtaccagagtttttagcagcggcaggaaacgcaactccggtcagaaatcccgaaaatacagttcttcatgatactcccaataatgacaatgacagtattcagcttctgctggatggcatgacctgtgcaagttgtgtcagcaaggtacagaaagcgctgcaatccgtcgatggggtagaaaatgccagagtgaaccttgcagaaagaagtgcattagtcacaggtatagcctcccccaacgccttggtggatgcggtcatcaaggcaggttatggcgcggaagtgattcaggatgaaaccgaacgtcgcgagcgtcagcagcaagttgcacaggccaatatgcgccgtttccgctggcaatcagcttttgccttagttgtaggggttccggtcatggtttggggtatgttgggtgacaatatggtactcactccctcaaatcacgctatttggctgaccattggtttggtgacactggctgtcatggtattggcaggcagccatttttatcgcaatgcgtggcaaagcctgaaaaatggcagtgcaaccatggatacgctggtcgctctgggtacaggcgtagcctggctctattctatcagcgtcaatttatggccggagatttttccacctcaagcccgtcacctttattatgaagccagcgctatgatcatcggtttgatcaacctcggccatgctctggaacaacgcgcccgccaacgctcttccaaggcgcttgaacggttgctggacttaacgcctccgactgcacgggtgatcaccgaaaaaggtgaaaaaacgctgccattggcggatgtgaaacccaacatgatcctgcgtctgaccaccggagatcgcgttcctgtcgatggtgaaattattcagggaacagtctggctggatgaagctatgctgacaggcgaaccgatccctcaacaaaaatcaacgggcgagggcattcatgcaggcacagttgttcaggatgggacggtgttgttcagagctgccgcggttggcagccagacgacactggctcggatcatcaaactggtgcgtcaggcacaaagcagtaagcctgaaatcggccaattagcagacaaaatatcatcaatatttgttcccgtcgtcgttgccatcgcgctaattgctggtgctatctggtatttcatcggccctgctccacaagtcatgtactcgctggtcatcatcactaccgtcctgattatcgcctgcccctgcgcccttggattggcgacaccgatgtccattatctctggcgtgggacgcgcggcagagttaggagtgctggtgcgtgatgccgatgccctgcaacaagccagtcaactggacacccttgttttcgacaaaaccggtacgttgacagaaggtatgccacaagtcactgaaatccatacttttaacggtttcaccgaagaacaggtattgttatgggctggcgcgttggagagtggctcaaatcatcctctggcaaaagccattgcgctgaaagtggaagggcagaaattgccagaagtacagcaattccgcacattggccggattgggaatacgtggagaggtgggagacacaacactgctgttagggaatcagagcttgcttgagcaaaatcaggttgaaacggcggaattaaaaaccttgatgtcggcacaggcagaaaaaggcataacacccgtcattctggcggccgatgggaaaatcgctgccctgttttccattcgtgatcctctgcgtcaagataccttttctgccctgcaacgcttgcatcatcaaggttatcgtttagtcatgctgacgggggataatccggtaacggccaatgctatcgctaaagaagcagggattgatcaggtcattgccggtgttttacctgatggtaaagcggcagccattcaaacactgcaatctgaaggccggaaagtcgccatgatcggtgatggtatcaacgacgcacctgcactggcgcaggcagatgtaggcatcgcaatggggggtggcagtgatatcgccattgaaactgcggcaattaccctgatgcgccatagccttcacggtgttgctgatgctgttgcgctttccagaggaacattgcgcaatatgaagcagaacctgtttggcgcatttgtctacaatacattaggcatcccgattgcggcgggtatcctgtatcccttcacagagacgttgctaaatcctgtggttgccggggcagcaatggcgttgtcttcgattacagtcgtcagtaacgctaatcggttattgcgcttcaaacccaagcattga

SEQ ID NO: 1578 - DNA, 108 bp, Xenorhabdus bovienii
  Coding DNA location: Contig name=SeqID_16860; Position on contig =91999..92106bp; Strand=+
ttgaatttcagaataaagtctacaaaagcttattattcagcccacgacaagctaaacagaacggagtttagcttttcgtctataacaatcttcccactttcttgttaa

SEQ ID NO: 1579 - DNA, 813 bp, Xenorhabdus bovienii
  Coding DNA location: Contig name=SeqID_16860; Position on contig =92157..92969bp; Strand=+
atggggaaattgatgacatatctcaacaatgtattaggactgaattcccaacggcattatccctatcctgcttttgacatcaccctgccacaaaataggcatttgcacatcgtgggtagcattcacatgggcacagaaaacatgtttccactttctgagatactactggaacaactggaacagtgtgatgccctcatcgttgaagcggacatcacgcaacccggatctcccttcaaagaaaaatttccagaacaagttgcgctgtcactgcgtttatcacctgaacattttgaccgtttaacgcattactgccatgaaatccagcatcctctaaaggcactggattcattaccctcatggcaaattgctttgatattacaagcagctcaagcccaatatttgggattacgccctcaatatggtattgactgccaattgctggatagcgcaaaagccatcgataagaccattatcgagctggaaggaacggatacccaggttaacttacttaccagcctgccaaatgggggactttcactgttggaagatacactcatccattggcataccaatgcgcgtgctttacagacgatgattagctggtggatgaattacaaacctgcacagccaaaccaaacgctgccgcagaccttctgtgaagagattcatcagacattgatggccggacgcaaccaccaatggagtgagcaattacatgctttgccggcaggcaagtatctggttgccgtaggggctctgcatcttcatggtgaaaacaatctgctacagatgatggaaaggccacaaggataa

SEQ ID NO: 1580 - DNA, 477 bp, Xenorhabdus bovienii
  Coding DNA location: Contig name=SeqID_16860; Position on contig =93021..93497bp; Strand=+
atgactcccgccgttattttactggaaaaacaccagattaacttcaggcttcatccttatgaacatgatacgaatgaacatagcttcggtgatgaagtcgttaaaaaactcggtttggatgctaaacaggtttttaagacactcttggtttcattgaatggtgatcccaaaaatctcgctgtcgcagtcacacctgttgcaggacagttggatttgaaaaaagtcgccaaagtattcaaggctaagaaagcagagatggcagatccccaactggcacaaaaggtgactggctatctggtaggcggcattagcccactagggcaaaaaaaacgtttgcccaccattatcgatagtcaggctcaaaccttaccaaccctatttatttctggaggcaagcgagggttagatattgaattggtaccaaccgatttatgtcaactacttaattgttcctttgccgatattgctaaagtctga

SEQ ID NO: 1581 - DNA, 261 bp, Xenorhabdus bovienii
  Coding DNA location: Contig name=SeqID_16860; Position on contig =93455..93715bp; Strand=-
atgacaatttgtctgaaaaatgatgaagtggccatttttatctccttttatttaaatttattaaattacataaataagttatacgaaatagtaaataacatgacttctggtttgaggacagtatatcggcattctagaatagaacaatataggactaagctctgctttcaagaaaacagagccagctcgaaaaattcaatggtaattgcagtttgttttcagactttagcaatatcggcaaaggaacaattaagtagttga

SEQ ID NO: 1582 - DNA, 168 bp, Xenorhabdus bovienii
  Coding DNA location: Contig name=SeqID_16860; Position on contig =93681..93848bp; Strand=+
atggccacttcatcatttttcagacaaattgtcatcaccgatccaaaagcaataaaaatgctgagaaaggctaataaacgaaaacctaaagaaaatttcaaaaaaatagatattgaagcagaacaaatcgaggcaatagaaatattaaaacgaaaattctcactctag

SEQ ID NO: 1583 - DNA, 201 bp, Xenorhabdus bovienii
  Coding DNA location: Contig name=SeqID_16860; Position on contig =93778..93978bp; Strand=-
gtgacatctgccaattcaaacctaattgattttaaatgtaaaaatgattctacatcgtggtttgatgggcaggagaaggacagtaagtattcttttgttctttctctgccaagaaccgataatacatttcctagagtgagaattttcgttttaatatttctattgcctcgatttgttctgcttcaatatctatttttttga

SEQ ID NO: 1584 - DNA, 408 bp, Xenorhabdus bovienii
  Coding DNA location: Contig name=SeqID_16860; Position on contig =93965..94372bp; Strand=+
ttggcagatgtcaccagaacttacccaattctgaatgaaaaaggagttattcttgcctatttttctttaacttacaaggaactatcaacacaaaatttttccatttcaaagacaaaaattaaaaaacttgacggtataagtaaaagcgcaaatacaataaaagtttacttgattggtcaagtagctaaaaatttctcattagttataaattcaataaatttcagagaaatttttctttatataaagaatattatcactacagtaaaaacactaataggaggaagaatcattgctttagagtgtaaaaacaatctaaaactcatagaattatatatgaaacatgggcttaaaaaattaccaacaaaaggagaaatcaatccattaatcactatgatttttaataattag

SEQ ID NO: 1585 - DNA, 1659 bp, Xenorhabdus bovienii
  Coding DNA location: Contig name=SeqID_16860; Position on contig =94507..96165bp; Strand=-
atgaaattttcgttcaaaacaccagcatgtgcccttgtcgtttctttatcattattaccgataagtgcaactgcttgggaaaagaataaaacttacgatattacaatcctgcatactaacgatcatcatggccacttctggcagaacgatcatggtgagtatggcctggcagctcagaaaacactggtagattctatccgtcaggaagttgccaaaaaaggaggcagtgtgttgttgttatcgggaggtgacatcaatactggcgtacccgaatcggacatgcaggatgctgagccagattttaagggaatgaatttagtgggttatgacgcaatggcgttggggaatcatgagtttgataaacctttaaacgtgttgcatcagcaggaaaaatgggccaatttcccatttctgtctgctaacatttatcaaaccagtactggcaagcgtttatttaagccgtatgtgatgtttgatgagcaaggcgtgaaaattgcggtgattggtttgaccaccgatgatacggcaaaagtaggcaatccagccaacttccctgatgtcgaattccgagtaccggccgaagaagcgaaaaaagttattgatgagctgaaaaagaacgaaaaaccggatgtgatcattgccgcaacccatatggggcattataacgatgggcatcatggcagcaatgcgccgggggatgttgaaatggcacgcagtttgcctgcgggttatttaaatatgattgtaggggggcattcacaagatccggtctgcatgtcaacagaaaacaaaaactacaaacaagtggattatgtaccaggaacaccttgctcacccgatcgccaaaatggaacatggattgtgcaggcacatgaatggggcaaatatgtcggccgtgctgatttccaatttcgtaatggtgaattcaaattagttcactatcaattgatccccatcaacttacagaaaaaagtaaaaaacgaagatggcagcacagggagtgcttattacactcatcaaattactcagcatcctgaaatgctgaaactgttgacaccatatcaggataaaggcagccggaaattaaatgtccaagtgggcgcagtagatggaaaattggaaggtgatcgcagtaaagtgcgtttcgtccagaccaatatggcgcatcttgtactggcggctcagatggaacggacaaatgctgattttgccgtgatgagtgggggtggtattcgtgattctatcgaagcaggggatattacttacaaagatgtcctgaaagttcatccatttgctaaccaactggtttatgtggatttcaaaggtagagaagtcttgccatatttgacggccgtggcaaatatggaaacggattcaggtgcttacgggcagttttataatgtcagttttgtggttgatggcaaaaaaatcagtgatgtgaaaattggcggcaagccgttagatcctaataaaacttatcgtatggctaccctgaactttaacgctatcggaggtgatggctatccacgtgtcgataacttacctgggtatgtggataccggttttgttgatgctgaagtgttgaaaggctatatcgagacgcattctccattgaaagttgccgattatgagccgaaaggtgaaatcgttcataagtaa

SEQ ID NO: 1586 - DNA, 111 bp, Xenorhabdus bovienii
  Coding DNA location: Contig name=SeqID_16860; Position on contig =96252..96362bp; Strand=-
ttgattggaaaatatatcctagcacctaggtgccatcattctattctggtgttggattcgagcctgttccggcagaggcactgttgtataaacattgctgtcgaaaagtag

SEQ ID NO: 1587 - DNA, 132 bp, Xenorhabdus bovienii
  Coding DNA location: Contig name=SeqID_16860; Position on contig =96445..96576bp; Strand=-
gtgttgctttgttcactcatattggttgtctcatcaatccagcctgtgttgtatggcgttgaattgttgtttaattgttacactttaatacatattagaccgctaataaaatttttacttaccttgatataa

SEQ ID NO: 1588 - DNA, 1230 bp, Xenorhabdus bovienii
  Coding DNA location: Contig name=SeqID_16860; Position on contig =96557..97786bp; Strand=+
atgagtgaacaaagcaacacagaacaattgcctgattcatcaagaaaaacacatcagactgttttttcaattctcggtgcaatcagcttatcccatctgcttaatgatatgattcaatcgctgattttggctatttatccattattgcaatctgaatttaccctaagtttcattcaagttgggatgattacactagtttatcaggtaaccgcatccctgctacaacccctcattggtctgtatacggataaatatccacagccctactcactgcccatcgggatgggattcaccctgtctggactgcttctactggcttatgccgaaagtttccctatcatcttactggccgctgcactggtcggtacaggatcatccgtctttcatcctgagtcatcgcgggttgcgagaatggcctccggagggcgtcatggactggcacaatccctgtttcaggtaggcggcaatctgggaagctcactggggcctctgctggctgcaattttcatcgctccttatggcaagggaaatctcgggtggttttctctggcagcactgctggcaatcgtcattctgttgcaagtcagccaatggtataagatgcagcaccgagcttctaaatccctatcatccactcatatttctcagccgaatttccccagaaaaatgattgtgcgttcttttgccattctgctgattctgattttctcaaaatatttctatctcaccagtatcagcagctactacactttttatctgatccagaagttcgacctttcagtacaaaatgcccagatccatctgttcatttttttgtttgctgtagccgcaggcaccatgattggggggcctatcggggataaaataggccggaaatatgtcatatggggatcaattcttggcgttgcgcctttcactctgcttttaccttatacatcactattctggacggggccccttaccgtagtcattggcctgatattagcatctgcattttctgctatcctggtctacgctcaagaactcattcctggcaaaacgggaatgattgcaggtttgttctttgggctggcgttcggcatgggaggtatcggtgcagccgtgctcggttatgtagcggataaaaccagtatagaattagtttacaaaatctgtgcttttctaccacttcttggcatttttactctattcctgccaaatatagaaagaaaaccacacgaaaaaccatga

SEQ ID NO: 1589 - DNA, 1701 bp, Xenorhabdus bovienii
  Coding DNA location: Contig name=SeqID_16860; Position on contig =98016..99716bp; Strand=+
atggagcattcgacacctcttatcacgaccattgttggcggttttgtactcgcctatctgcttggcatgcttgcccaacgcctgaaaatctcacctctggtaggataccttgcggcaggtgtacttgctgggccttttaccccagggtttgttgccgatacttcgctggcacccgaactttcagaaattggcgtgatcttactgatgtttggtgtcggtctgcatttttcccttaaagatttgttagccgtcaaatcaatagccattccaggcgccatcgctcaaattgcagtcgcaaccttattgggtgtgggattatcaacgctgcttggctgggggctgtttactgggatcgtctttggactctgtctatctactgcaagcacagtcgttctgctcagagcgctggaagagcggcagcttattgatagccagcgggggcaaattgctattggctggttaattgttgaagatctggctatggtactggcgctggtattactgcccgcagccgcaggtatactggatagccagaatgccaacatcggtcaattgctgttagaacttgctatgaccattggcaaagttgtggccttcattttattgatggtttttgtcggtcggcgtctgatcccctggattttggcaaaaacagccagcacaggttcccgcgagttatttactctggcggtactcgccattgccttaggtgtcgcttacggagccgtgaagctgtttgatgcctcatttgctctgggtgcatttttcgctggtatggtactgaatgagtcagaactaagccatcgggcagcacaggataccttaccgttaagagatgctttcgcagttctgttctttgtctctgtcggaatgttgtttgacccaatggtattgttccagcagccacttgctattctgggaacccttgtcattattattattggcaaatcattggcagctatgcttctggtcaaaatgtttggtcattcacgacgtacagccctgacgatttccgtcagtctcgctcaaatcggggaatttgcctttattctggcagggcttggcgtcactttaggattgctggatggagaagcacgtaaccttgtgctggctggtgccattgtctcaatcatgttgaatccgattctattcagtttgctggatcgttatctggaaaaaacagaaactattgaagaacaattattagaagaaacgctggaagaagaaactcagatcccggttgatatctgcggccatgccattatcgtgggctatggccgagtcggccgtcttctctgccagcggttgcaagaaagaaatttcccgttggttgtccttgaagatacacgtgcccgatttgaggaattaggggaaatgggcatcagtgctgtgatgggcaatgctgccagcaaagatatcatggctctggcacggctcgattgcgcctgcacgttatttctgactatccccaatggctacgaagcaggtgaaatagttgcgaatgccagagagatccggccagatatcaatattatcgcgcgtgctcactatgatgatgaagtgacctatattatggaacgtggtactaaccacatcattattggtgaacatgaaatagcaagagcgatggctgatgcactctctatgtatgagccaacttgcccgatagagccaccaccgtcattttcgacagcaagttag

SEQ ID NO: 1590 - DNA, 144 bp, Xenorhabdus bovienii
  Coding DNA location: Contig name=SeqID_16860; Position on contig =99725..99868bp; Strand=+
atggtgtatcccgctgatttcagggggatactccagaacaaaccataccaacgttgttgcatcgttaacgtagtatcagcgttcccagtaagattcttccaaactatcttctttctctggcaacccacgcatcaggcgaggtga

SEQ ID NO: 1591 - DNA, 1311 bp, Xenorhabdus bovienii
  Coding DNA location: Contig name=SeqID_16860; Position on contig =99800..101110bp; Strand=-
atgaaattccctggtaaacgtaaatctaaacactattttcctgtcagcctgagagatcctctgctccagcccatcaaagaaatgatagatactgaaaataaccgagcctatatcgttggtattgatcaaacactggtagacattgaagctaaggttgatgagagttttatccagcgttataacttgagccaggggcattcactcgtcattgaagatgatgtcgccgaggcactctacaaagaactgacagacaataatttgattagtcacgaatttgcgggtggaaccatcggtaatactctgcataattattctgttttggctgacgataagtccgtattgcttggcactatgtgtaataacatccagatagggagttatgcatattgttatctttgcaatacatccagccgcatggatttgaatcatcttcagggggttgatggcccaattggccgttgttttaccctagtgactgaaaacggtgaaaggacattcgctatcagtccgggattaatgaaccaactccgtccggaaaatatccctgaacatattattgcggaagcatcagcactggtgattaccgcctatctggtgcgttgcaaatcgggtgatccgatgccggaagcaacgatgaaagccatcgaatatgcgaaaaagcataatgtgcctgttgtactgacattgggaacaaaatacgtcatcgctgatgatccgcagtggtggcgcgatttcttggcagaaaatgtttctgtggtcgccatgaatgaagatgaagcccaagagctgacgggctttagtgatcctctgctggcagcagacatggccttaaattgggtggatttagtgttatgtaccgcagggccggcgggactgtatatggcaggttataccgaagaagaacataaacgtcagacttcacatccattattgccgggtgctattgctgaatttaatctctatgaatttagtcgggtgctatgcaaagccgattgccagaacccaatgcgagtctactcccatattgagccttatatgggggggcctgaaaaaatcatgaatactaatggggctggcgatggtgcattgtctgcattgctacatgatattacagccaatagttatcaccgaatgaatgtgcctaactccagtaagcatatgcgctcttatttgacgtactcgtcattggctcaggtatgtaaatacgcgaatagagtgagttatcaggtattgagccagcactcacctcgcctgatgcgtgggttgccagagaaagaagatagtttggaagaatcttactgggaacgctga

SEQ ID NO: 1592 - DNA, 96 bp, Xenorhabdus bovienii
  Coding DNA location: Contig name=SeqID_16860; Position on contig =101107..101202bp; Strand=-
atggcgctacgttttttgttttgctacggtattgcgctacaccgtattgtgctaacatgccgcatattttggctctatagcatcaatcaattatga

SEQ ID NO: 1593 - DNA, 114 bp, Xenorhabdus bovienii
  Coding DNA location: Contig name=SeqID_16860; Position on contig =101148..101261bp; Strand=-
gtgctttactcgttaacgtttgacagccaatgctctaatagcattggctgtcaaacgttatggcgctacgttttttgttttgctacggtattgcgctacaccgtattgtgctaa

SEQ ID NO: 1594 - DNA, 1107 bp, Xenorhabdus bovienii
  Coding DNA location: Contig name=SeqID_16860; Position on contig =101276..102382bp; Strand=-
atgagtaataaaccgattaaacaccccgatttttatgaagagaattcaaactattatcatcctaagcaggaagatgagattgatttatttgaattattctccgtaattttccgatcaaaatatttaattatcgcaatatcctttgtttttgcggtgattggcttcggtattgcgtcatttttaccacagaaatggacaagtacagcagccgtagtgaagccgacattggaacaatttcagccattgaaaaatgcactaacggatttgcaagttttgagtcttgatccgaaagtgacagaagcatcgttatatcagcgttttgtcgaaaactataactcgcgtgtattgcgtgaagactatttggtcagcactgactacttcaaggcgttgcttgctaagatggatgatggcgcgatacagggaaaacgaaagctgattgagcaggttgtaaataaaaatatctccatttctttacctaaaaaagataatgaaggagatgatgaaagtgtactttctttcagtgcgggtacggcggaagattcttacaacttgttgactgggtatatcaattttgtctcttccgttgttcgtgatcaggtgaaagatgaattgaatgatatggtgcatcagaaactggtcttttcacaaaagtcgtatgaaattgatctggctcgtattcgcaatatgcgtggtgttgatatcgaacgcttgaagtatgcgatctccattgctaactctgcgggtgttaaaaaacctgtttccaatggtggcgctatgatcaaggatgacccggattattcgattgcgctgggtgcggatgcactgcaacgtaaattacagattaccgaagagattaccgatccaactcagatagatgcagatcttcgtaatagactgttatatatagaaaatttaaaattagtaaatattgataagattgatttcgagccattcaggtatatgcagcaaccttatgaacctacagcgaaagattcacctaaacgtctgctgattctgattggtgctggttttatcggctttatcttatctgttatatttgttctggttcgccatatggcacgcagccgtcagaaacaagaagcttaa

SEQ ID NO: 1595 - DNA, 966 bp, Xenorhabdus bovienii
  Coding DNA location: Contig name=SeqID_16860; Position on contig =102593..103558bp; Strand=-
atgagtagcaataagtatggtgtcttactggtgaatcttgggacgccggatgagccaacacctgtagcaataaggcgttacctggcgaaatttctgagtgaccgaagagttgtggatatccctccgtttatctggaagccgctgttgtacggcattattcttcctttccgttcttctcgtgttgctaaactgtaccaaggaatttggacagaagagggatcacctttgctggtttatagtcagcgccagcagacattgctaaatgaaagactgacggatatccctgtcgttttgggaatgagttacggtttcccttccttgcctcaagctgtaggtaatctgctgcaacaaggtattgaccacctgattgtgcttcctctttatcctcagtattccagtacgacatcggccgcggtatttgatagcatcagcaaaatattgaagggatatcgcaccataccccatctgcatttcatccgtagttatgctacacatcctgcttatattgctgccttaaaagcaacaatcgagcagagttttgaaaaacatggtttgcctgatcgtttgctcctttcctaccacggtattccagaacggttggcaacgataggggatatttatccgcaggattgcagggcaactacggagcttttgatacaggcattggattatcccgcagataaaattatgatgacttttcaatctcgttttggtcgtttgccatggttaacgccctatacagataagacaatggcattattgccagaacaaggtgtggaacatgttcaggtattgtgtccgggattttcatcagactgtttggaaacactggaagaaatccaacagcaaaatcaagcgattttcctgcatgcggggggtaaaaagtttgaatatatttctgcacttaatgataatgaggcacacatctcattgcttgaacaattggtaaataacgccatgaaataa

SEQ ID NO: 1596 - DNA, 645 bp, Xenorhabdus bovienii
  Coding DNA location: Contig name=SeqID_16860; Position on contig =103717..104361bp; Strand=-
atgcgtattattttgctgggcgcgccaggcgccggtaaggggactcaggcgcaatttatcatggagaaatatgggatccctcagatttcgacaggtgatatgttacgtgccgcagtaaaagcaggtagcgagttgggtttgaaagcaaaagaactgatggacaacggtaagctggtgactgatgaactggtcattgctttggtcaaagagcgtatcaaacaagatgactgccgtagtggattcttgttggatgggttcccacgcaccattcctcaggctgatgcgatgaaagaagcgggtatcaaggttgattatgttctggaattcgctgtttctgatgcaatcattgttgaacgcattattggccgtcgtgtacatacgccatcgggtcgtgtttatcacatcaaatttaatcagcccaaagtagaaaaccgggatgatgtgactggcgaagaactgagtattcgtaaagatgatcaggaagatacagtgcgtaaacgtctggttgaataccacgcacagactgcacctttggtttcttactatcagaacgaagctcaggcagggaacacaaagtacttcaaacttgatggtacacgtcaggtcgctgaagtcagcgaagaattggtcggcattctgggctaa

SEQ ID NO: 1597 - DNA, 123 bp, Xenorhabdus bovienii
  Coding DNA location: Contig name=SeqID_16860; Position on contig =104396..104518bp; Strand=-
atgataatagaccacgcttcaacggaaaattgggcgtggtttatttttaggtcaatacgaaaacgtttacctgttttcttgagccataccccattcaaatggtatggtggcctgttttattaa

SEQ ID NO: 1598 - DNA, 1878 bp, Xenorhabdus bovienii
  Coding DNA location: Contig name=SeqID_16860; Position on contig =104532..106409bp; Strand=-
atgaaaggtcaggaaacccgtggatttcagtctgaagtcaaacaattattgcagttgatgatccattctctctattccaataaagaaatttttctccgtgagttgatttcaaacgcatcagatgctgcggataaattacgcttccgtgcattgtcaaaacctgaattgtatgaaaatgatggtgagttacgtgttcgtcttgcttttgataacgagcataaaaccatcactattagtgataatggtatcggtatgtcccgtgatgaagttattgataatctaggaacgattgcaaaatccggtactaaatcattcctagaatcagttggttctgatcaggtaaaagacagccagttgattgggcaattcggcgttggtttttactctgcctttatcgtggcggataaagtgactgtgcgtacccgtgcggcaggtaccgcggccgatcaaggtgttttctgggaatcaacaggtgaaggtgattacaccattgctgatcttgaaaaaactgagcgtggtacagaaatcactttgcatctgcgtgaaggggaggatgaattccttaacgactggcgtctgcgttctatcatcggcaaatattctgatcacattgcgttgccagttgaaattgaaaccaaaaacgaagaagacgataccgtcacatgggaaaaaatcaataaagctcaagcgctgtggacacgtggtaaagccgaaatcagtgatgaagagtaccaagagttttataaacacatttcccatgatttcgctgatcctctaagctggagccacaatcgcgttgaaggtaaacaggaatacaccagcttgttgtatattcctgctcaggcaccgtgggatatgtggaaccgtgaacataaacatgggctgaaattgtatgtacaacgcgtattcatcatggatgatgccgaacagttcatgccaaattatctgcgttttatgcgtggtctgatcgattccaatgacttgccgctgaacgtttcccgtgaaattctgcaagacagtactatcacccgaaatttacgtaatgcgttgaccaaacgtgtattgcagatgctggataaactggcaaaagacgatgcggaaaaataccagaccttctggcagcagtttggcttggtattgaaagaagggcctgctgaagacggttcaaacaaagaagctatcgctaaattactgcgattcgcaaccactcataatgacggctcggcacaaactgtttctctggaagattacctcagccgcatgactgaaggtcaggagaagatttactacatcactgccgacagctatgccgcagcgaaaaatagcccacatctggagctgttccgcaagaaaggcattgaggttctgttgctgtctgaccgtatcgatgaatggatgatgagctacctgactgagtttgatggcaagtcattccagtctgtcagcaagacggatgaatctcttgacaaactggctgatgaaaacaaggccgagcaggaagaagaagataaaaaactggagccgtttattgagcgtgtgaaaacgctgcttggtgaccgcgtgaaagaagttaagctgacccaccgactgactgatacacccgcgatagtgacaacgaatgccaatgaaatgagcacccaaatggcgaaactatttgcggcagcaggccagtctgcaccagaagtgagctataactttgaactgaacccagagcacaatctagtgaaaaaagcggctgatattcatgatgaagcccagtttgcggattggatagaactgttactggatcaggcattgtttgctgaacgcggcacattagatgatccaaaccaattcattcgccggatgaatcaattattattggctgaaaaagcttaa

SEQ ID NO: 1599 - DNA, 129 bp, Xenorhabdus bovienii
  Coding DNA location: Contig name=SeqID_16860; Position on contig =106472..106600bp; Strand=+
atggggataactcccaacaatttcaagttagggcaatcagaagaatataaaattggtttgatgaatgtacagatcagctgtggatggtggcgttatccgcagcaccatccattggaatttcccatttga

SEQ ID NO: 1600 - DNA, 126 bp, Xenorhabdus bovienii
  Coding DNA location: Contig name=SeqID_16860; Position on contig =106545..106670bp; Strand=-
atggcacaacgctgtcccattcacttgcgggtcgccaaagaatcactgatttgtgatcgattacccaatttcaaatgggaaattccaatggatggtgctgcggataacgccaccatccacagctga

SEQ ID NO: 1601 - DNA, 579 bp, Xenorhabdus bovienii
  Coding DNA location: Contig name=SeqID_16860; Position on contig =106615..107193bp; Strand=-
atggagtcattacgctgtttacccggcgtaggccccaaatcagcccagcgaatggcatttcatctgttacaacgggatcgcagtggtggcatgaggcttgctcaggcattgactcgtgccatgtctgaaattggtcactgtcaggactgccggacatttaccgaacaggaacaatgcacgatttgcggcaatccccgtcgtcagcagaatggtcagatctgtgtggtggaaacgcctgcggatattcacgccattgaacagaccggccagtttgccggtcgttattttgtcctgatggggcgcttatcgccgctggatggtatcgggccaatggatattggtttggatcgtttggaagaacggctatcttccgaaaccctgtcagaaatcattctggcaaccaacccaactgttgaaggagaggcaacggcaaactatatcgcggaaatgtgttcgcagtatggtgtgatagccagtcgtattgctcatggtgttcccgtggggagtgaacttgaaatggtggatggcacaacgctgtcccattcacttgcgggtcgccaaagaatcactgatttgtga

SEQ ID NO: 1602 - DNA, 117 bp, Xenorhabdus bovienii
  Coding DNA location: Contig name=SeqID_16860; Position on contig =107136..107252bp; Strand=+
atgccattcgctgggctgatttggggcctacgccgggtaaacagcgtaatgactccatcagggattcaagaagagggctggtttgcatcagaatggcatcttaaagccaggcggtaa

SEQ ID NO: 1603 - DNA, 348 bp, Xenorhabdus bovienii
  Coding DNA location: Contig name=SeqID_16860; Position on contig =107257..107604bp; Strand=+
atgccgttggaaacgccggacattttttctttctgggtttcttcaatgcgacgggctgcatcattgaacgcagcggcaatcaggtcttccagcatatctttgtcatcgtccatcaagcttggatcgatttcaacacgacgacagttgtgtgcaccattaatagtcactttcaccagacccgcaccagattcacctgtcacttccagatttgcaatttcttcctgcactttctgcattttttcttgcatctgctgggcctgtttcatcaaattgcccaaaccacctttaccaaacataattatctctcttcgctatagccacagtttaaatatatattgtagcggttaa

SEQ ID NO: 1604 - DNA, 1977 bp, Xenorhabdus bovienii
  Coding DNA location: Contig name=SeqID_16860; Position on contig =107601..109577bp; Strand=-
atgagctatcaagtactcgcccgtaagtggcgcccacaaatattttctgatgtgattggtcagcaacatgtgctgactgcactggcgaatggtcttgagcaccagcgcctccatcatgcctatcttttttctggcacccgtggtgtgggaaaaaccaccatcgcgcgtctgttggcaaaggggctgaactgtgaaacgggaatcacgaagaccccatgtggtcaatgtgcgaactgtcttgaaattgagcaggggcgttttgtcgatctgatcgaaatcgatgccgcctctcgaacaaaagtagaagatacccgtgaattactggacaacgtgcagtatgcacctgcccgtggccgtttcaaagtttatctcattgacgaagttcacatgctttcgcgccatagtttcaatgcgttactcaagacattggaagaaccgccagaacatgtgaaattcttgctggcgacgacagatccacaaaaactacccgtgacgatcctttcacgttgtttacaattccatctgaaggcattgaacgtcgatcaaatcagtggtcagttggaacatgtccttaatgcagagcaaatagagagcgactcccgtgcgcgccatcttctggcccgtgctgcggatggcagtatgcgtgatgctctgagcctgaccgatcaggcgattgccctcggtggaggtaaactgaccgccgatatcgttagccagatgttgggcacgctggataatgatcagcctttggaaatgattgaatggctggttcgggcagatgggcagcagcttatggcactggttgagcaaatcgcatcccgtggcgtggattgggaacatctgttggtcgaaatcttgtcattgctgcatcgcattgccatgctccagttattgcctcagcaacctgataacgatccctcttcaacggaagggcgtttgcggttgctggcaagatcaatttctcctgccgatctacaacttttttatcaggcattgctggtcggacgcaaagatctcccttatgccccagagcgccgaatgggcgttgaaatggcattattacgcgctttggcgttccaccccaaaactatcattgaagaaacgccagcgtccggtggagaaatcccggtagcaccgcaggtatctgcacctgcacagcgccatccggtttcacctgtacaaaaccatgcggctggtgaacgctctgagaaaggttctgaacacagttctccgcaatcaatgagtacagagcctgtagtcagcagtccaacggcaaaattgctgcaagcgaggcattcgcttactcgacaagggaatacgcccccaaaaaagtctgagccggcagagcctgtgaaggcgaagtcggcaagctcggcgctggaacgattagcagccgtggccgaacagcggccacaatcttatattcccaaagcccgggagccaaagcccataaagcaagaagcttaccgctggcggacaacgaacacgagtgttgaggaaaagcaagtttgtgtcacgacgccaaaagcgataaaagcggcacttgagcacgagaagacaccggaactggcggaaaaattggcggttgaatcgaaacagagagattcatggtcagcggaaattgataaactgaatattccaaaactggttcagcaggttgcattgaatgcgtttaaagaacagattgatgaaagtcggctttgtcttcatctgcgttcaaaacaacgtcaccttaattcagcatcggcacagcaaatgttgtccgaagccttaagtgaattgcatggaaaaccgattgatctccgtattattgaagatgataatcctgcggtaaaaactccgttggagtggcggcaagccatttatgaagaaaaattggcacaagcacgccaatccattatttcggatagaacgattcaaacacttcagcagctgtttgatgcagaattggatgaagaaagtatccggcctgtttaa

SEQ ID NO: 1605 - DNA, 93 bp, Xenorhabdus bovienii
  Coding DNA location: Contig name=SeqID_16860; Position on contig =109541..109633bp; Strand=+
gtgggcgccacttacgggcgagtacttgatagctcattaataccgaggaaattgaacatgactgtgtatcatgctagcacagcctcaccatga

SEQ ID NO: 1606 - DNA, 552 bp, Xenorhabdus bovienii
  Coding DNA location: Contig name=SeqID_16860; Position on contig =109675..110226bp; Strand=-
atgaccgctaatgcgcaaaaactgcaatttattaaagatagtatcgaaacgatccctgattacccaaaagtcggggtactttttcgtgacatcaccacgctgctggataatcccgttgcctaccaagctacgattgatctactggtagaacattaccaagaaaaaggcatcaccaaaatcgttggtacagaagctcgtggtttcttgtttggcgcccctgttgcactacgtttgggagttggtttcattcccgttcgcaagaaaggcaaattacctcgcgcgacgttaagtgaaacttacgatctggaatatggtactgataccttggaaatccataaaaacagtatcaaagaaggggataaggttctggtggttgatgatcttctcgcaacaggtggtaccattgaggcgaccgtaagtttgattcgacgtctgggtggagaggtttctgaagcggcattcatcattggtctgcctgatttaggcggtaccgagcgtttgaaaaaacagggtattgagagctacacgctcatagagttccctggtcactga

SEQ ID NO: 1607 - DNA, 108 bp, Xenorhabdus bovienii
  Coding DNA location: Contig name=SeqID_16860; Position on contig =110277..110384bp; Strand=-
atgcttaactattttgtaacaataatgtttgatgtgataggtgccaagcttgaccaaaatcaacaaaaacaggctgcaatttgctttgcagttgcttttttccgatag

SEQ ID NO: 1608 - DNA, 549 bp, Xenorhabdus bovienii
  Coding DNA location: Contig name=SeqID_16860; Position on contig =110427..110975bp; Strand=+
atgctgatgagcatacaaaatttattaggcgcacttgaaaaacagatcagtatgctggaaacagagcttgagtcactccccaagacacctttttcagtcgcccgttttgatcaagcattattccaccaacacagcaataaactgggtggatatcttaatgaaattaaaaaaaatatgtcacaattaaagacctgtgtgaaagataatcgtaccgagcaggtcagatttctttctgaacgtttagtgacgcaaattgaagcactgaaacgcgaaatatcaacacagccactgagaaagcaagaagagaaatttgaacatcagtcacaagaacgggatttttaccatcgtctagccgaacatcaggattatgagcgccgtttaatggcaatgattaatgatcgggaattacagttaaataaacaagttatactgacaaaccaatataaactacaaaaagaaatcgcagcgctggcaggaaggctcgctcgttgtcgccaagcattgatgcgtatcgaaagagcgatagagaagcaagaaaattcagattag

SEQ ID NO: 1609 - DNA, 165 bp, Xenorhabdus bovienii
  Coding DNA location: Contig name=SeqID_16860; Position on contig =110997..111161bp; Strand=+
atggatctcgaacaagcaccacctgaagtgcaactcgcggtagaccttatttatctactcgaatgcaatgaaatttctcccgatatcgcactggctgcgttagagatcgtcaaagatgattttcaaggaaagctgaaaaaacaggctcagcagcctaaggaataa

SEQ ID NO: 1610 - DNA, 3459 bp, Xenorhabdus bovienii
  Coding DNA location: Contig name=SeqID_16860; Position on contig =111196..114654bp; Strand=-
atggttccatttaaccgatacttgggtatttttctcaataagcgggtcttatgcgataaaaggcccgatacattatattttcgttttgttttcacggcgagcctgtttttccttctgttatttttcttttctcctgcaatggcagcatttagcagtgaaacaccaacccgcaatgatattcaaaatcagcttaagatcctgacagagcgtaaggaacacacagttgaggagaaaacatcgatagctgatttggaaaaggcgctctatttctttgacaaaatagatcaagttaagctggattccgatttacttaaaaaaaacttacaggactctccgcagaaatcacgtcaaatcacggccggattggaaaatctgaaaaataacgcccagcaggatgagaatgattataaacaaacgctggaaacgttgtcgctgaagcaacttgaatccaaactgaacagtacactgaatagcttgcaacgagctcaggaaaatcttgctagctacaatagccagttaattgggctacaaacccagccggagcgggcgcaaaatctactgttccacaatgtacaaagattgcagcaaatccgtaatcagctcaacaatgagctgacagagctgccagaatcgcgttatccccagcttgatttattgcgtgtagaacaatcttttctgatgcagcaaaatgaattacaaagggcatctctacaggcaaatacacaactacagacgcttttgcagcagcaacgtgattacacttctttccaaattgatcaattagaacgttatgttcaatttattcaaaatgtggtgagcggaaagcgtttgattgtttctgaagaaacagcaaaagaagcgcagaattcagatgatactaattctcatattcagtctaacccgttggttaaggaagaaatccagaccaatcgcgaactcagtgagcggctgattgctgaaacgcgggagagtaaccaactggtacaaaaaaatattcgcgttaagaacttcttggatagagccatccaatctgaacgtaatcttaaagagcaggttaaagtattacgtggcagtttattgctgtcgcgtatcctgtttcaggaacagctcaaggtaccgcaaaatgttctgacaaaggatttgccgataaaaattgctgatctgcgtttggagcaatttgaaattaaccagcaacgcgataagctttaccagcttaatgattatgccaatcagttattgaacctacattcagatgagataaaacatgaatctaaggaagcagtaggtgaaattcgtaatgctatcgaacaaattctggaaattcgccgtgagcttttgaatcaactcaataaccagttgggaaatcaaattacacacgccatcaatttacagatggatcagcaacaattgctggatgtcacccaatcgctggaacagacgcttgtccaacagatcttttgggtcaacagcaataaaccaatgaacctggcctggttgaaatctttgcctgatttaattcaggaagagctgagccatctgaatattcatttgactctcagtggccttgccacaggattaaagaattccattcactttgtcattccccttttgctggtcggcctgtttttacgctggcagacaaaaggcattaacgagcagttaaagaaaatttctgatgaggtggggcaactgcgtcgggacagccagttgcacaccccattagcattaattctgacattggtaaaaacattaccacttgctcttttaattttggcgataggctactggtattcgaaatcaggggatgatttaggtgatttaatatggagcttttcgcgacaattggcgcttttctggattatgtatcgatgtagttaccaaatcctcgccaaagatggaataggagagcaccatttttcattgaacagagcggattacactctgttccgcaaaaatcttgtgcggttgtcgattgtattgctgccgatactgttttggataactttgggggtcaaacacccgttacgtttgtctgatgatgtgattggtcagtgcacggtgttaatttgcctgctcttcgttttcatttttatttttccattctgtcgtcaggtatggcgtgtgaaaagttcacatatgatccgaaccatggtggtgacggcattgacttttgcacctcttgttctgatggtgcttatggtatccggttatttctatacaaccctgcgtttggctgaacgttggctctacagcctttacctgctgttcctctggcatatttgttatcaggcttgtttacggggattgggaattgccgcccgccgcattgcctatcgccgggcaattgcccggcgtcaggctcaggcgaaagaaggggcagaaggagacgtagtggaagagccgccaatggagctggagcgcattaaccagcaatcattgcgtttgaccacgatggtgctgtttttgatttttttgggcgcgttttactgggtttggtctgatttggtgacagtattttcctaccttgatgggattaatctgtggcagtacagcacgacaacagagctggggaatgtcctgcaacaggttaccttgaaagatttggggatttctatggcaatgctggtgatttcatgggtaatgatgagaaacttgccgggcttattagaagtgttggtattgtctcgtttacagctacagcagggttcttcttatgcgattaagacgactctgacttacttgatcattggcgtcggtgggatcagtgcattgggaaccttggggctttcgtggaataagttacagtggctggcggcggctctttcagtcggtttaggttttggtttacaggaaatctttgccaatttcgtatcaggtctgatcattttgttcgaacgtcctgttcgtattggggatactgtgacgataggcacttactctggctcagtcagtaagatccgcatcagggcgacgacaattacagattttgaccgtaaagaagtgattatccccaatcgtgcttttgtcacggagcgtctgattaactggacactttctgacactatcacacgtattatcattaaagttggcgttgcgtatggctctgatctggataaggtaaaagaagttctgcttaaagcggccaaagataaccctcgtgttatgaatgaaccgataccacaggtttattttatgagttttggcgccagtacattggatcatgaattgaggctatatgtgaaagagttgggagatcgtagccatactgtggatgaagttaaccgcaatattgataagctatgtcgggaaaataatatcaatatcgcattcaatcagttggaagtgtatttgcacaatgggcaaggcaatagtctgcaagaggtacagaaggcattgaacggtgggagccaccattcagatgggcaggtatctcctggcgatcagccacttttaccttaa

SEQ ID NO: 1611 - DNA, 147 bp, Xenorhabdus bovienii
  Coding DNA location: Contig name=SeqID_16860; Position on contig =114724..114870bp; Strand=-
atggtcttattgatacactcaaatatagccaccacttgcgatgtaacgaggaaaataagttttaaatcacaggagcaaatgtcgatggaatctattcttagtgttatcattttaaaattgacgctatcaggaaggtctgaaccataa

SEQ ID NO: 1612 - DNA, 699 bp, Xenorhabdus bovienii
  Coding DNA location: Contig name=SeqID_16860; Position on contig =114806..115504bp; Strand=-
atgtatgtaaatcagcctcaagtcaaaaacaaagtttatggcacgaaaatggcacgaaaaactaaacaacaagcaaaagaaacccgccaacagattatagaagccgcgataaaggtattttctgaacgtggagtttctgcaacttcattgtcagatatcgcgattgcagccggtgtgacgcgtggcgcaatttattggcatttcaaaaacaaaatcgatctgctttctgctgtttgtaaaatgcacgaaaataaaatcgacgagttagagaaagagtatcaagcaaaatatccgaataatccactccttgcattgagatctctgttgatttttctgttaaaaatgatgattgatgattctaggaatcgactactgatggaaatttttttccacaaatgtgagtttgttggagaaatgattttattggctgagaagcttagaggattatgtatttccgattataaaaaaattgaaaatattttgggggcttgcattcagtcgggagaattgcctcatgatcttgatctcaggcgttctgccatcatgctgaaagcgttgatgacaggagtactggaaaactggtcattcgcaccggacagttttaatattcaggaacaatcgacgtatctggtggatggtcttattgatacactcaaatatagccaccacttgcgatgtaacgaggaaaataagttttaa

SEQ ID NO: 1613 - DNA, 1200 bp, Xenorhabdus bovienii
  Coding DNA location: Contig name=SeqID_16860; Position on contig =115610..116809bp; Strand=+
atgcgaaaaaacagaggggttttgcctctggccacactactggtactttcaggcagcttcattctctcaggatgtaatgacaacaaaaattctcagcaaggggctgctggcgagcatgcttctgaagtgggtattgtaacgctgaaagcagaacctctgactgtgatcacagaattacctgggcggacttctgcttatcgtgttgcggaagttcgtccccaagtcagtggcatcattctgaaacgtaactataaagaaggcagtgatattgccgcaggtgagtcgttataccagatagatccagcaacctatcaggcagactacaacaaagccttggcaaatttatccagggtacaagccaatgagaaagtgtctcgttcaaccgttgaccgttataaatcattactgggtacacaatatgtgagtaagcaggaatttgataaagcaaattctgagcatgctcaagcagccgcagaagtgctgtctaccaaagctgcgctggaaagtaccaaaatcaatctagcgtataccaaagtgacctcacctatttctgggcgtgcgggtaaatccactgtcactgaaggagctttggtttctggcgggcagccaaccgccctgacaacggttcaacaactggatcctatctatgttgatattacccagtcaagcgatgactatttacgtcttaaaaatgaaatagccaaaggaacagttcataaagaaggtggtaaaaccaaaactcgcctaatcactgatacaggtaaagagtacagtcaggaaggctaccttgagttttcagatatcacagttgatgaaacaacaggctctatcactatgcgtgctgttttcccaaaccccaatgaagagctgcttcctggcatgtttgtccgtaccaaactggaagaaggcgtgcgacaaaatgcgattttggttcctcagcaagcaattaccagaacacctcgtggccaggcaactacgctgattgtcgataaggataacaaagtagaattacgcaatatcaatgctgttcaggcaatcggtaataagtggctggtcacagaaggtttgaaagccggagatagagtaatagtcacaggattgcagaaaattgctccgggagtcaccgttaaaccaacggaaactgatctggatgctaagctcacagccaatcaaactgagcctgctaaaaagcctcaataa

SEQ ID NO: 1614 - DNA, 3150 bp, Xenorhabdus bovienii
  Coding DNA location: Contig name=SeqID_16860; Position on contig =116825..119974bp; Strand=+
atgcctaagttttttatagatcgaccaatctttgcgtgggtaattgcgattatcaccatgctttctggtctattggcgataatgaaattacccgtggagcaataccctgcaattgcaccaccttctatttccatttctgcggtttatccaggagctgacgcaacaacggtacagaatacggtaacccaggttattgaacagaatatgaacggcatcgataatctggtatatatggcttccaacagtgattctgctgggcgtatgagtattacgttaacttttgaagcgaacacagatccagatatcgcccaagtacaggtacagaataaactgcaattggcaatgcccctattgcctcgggaagttcaacaacaaggtattagtgttgataaaacaaccaactcattcttaatggtggcaggtttcatttctgaagatggttccatgactcaggatgatatcgccgattatgttggagccagtgtcaaagacccattgagccgcgtcagtggtgtgggtgaaacgatgttgtttggtaaccagtatgctatgcgtatttggctcgatcctgacaagctgctcaactataaaatgaccacacaggatgtcatcactgccattaaagctcaaaacaaccaagttgcagccgggcagttaggaggaaccccacctgttcctggacagcgtttaaatgcctcgattattgctcagacccgtctgaactctcctgaagaattcagcaatattctgctgcgcatgaagcgcgatggttcacacattcgcctgaaagatgtcgctgtcgttgaacttggagctgaaagctacagcatcattggtcggttcaatggtaactcagcggcagggatcggtatcaaactggctaccggcgccaacgcgttagatacctcaaaagccgtcaaaaaagcactggctgagatggcaccattcttcccacatgggttgactgtcgtgtatccgtacgacactacgccattcgttaaaatttctattttcgaagtggtgaaaacgttagcagaagccatcctgctggtgtttgtcgtcatgtacctgttcctgcaaaacttccgcgccactttaatcccaactatcgcggttccggttgtattgctgggtacatttgccatccttgccgcatttggttactccatcaatacattaaccatgtttgccatggtacttgccatcggtctgctggtggatgatgccattgttgtcgtggagaacgtcgaacgcgtcatgcaggaggaagggttaccaccaaaagaagccaccagaaaatcaatgggacagattcagagcgctctggtcggtatcgcgttggtactttctgcggtttttgtgccaatggcattcttcggtggagcaacaggcgcaatttatcgtcagttctcgatcaccattgtctcagcgatggtactgtctgtactggtggcgttaatcttgactcccgcactgtgtgccacaatgctcaaacccgttgctaaaggtagccatggtattcaaacgggtttctttggctggtttaaccgcctgtttgaaaagagcacccaccattataccgatagtgtaggccgcatgctgcgtggtactggacgctacttgttgatctatattgtattgatcgcaggtatggcctttatgtttacccgtatgccatcttccttcctgccagaagaagatcagggtgtattgcttgcgatggttcagctaccacctggttcaactcaggatcaaacacaaaaagtattggatgaaatcaatgattacttccataccaaagaaacggaaattgttaaatctgtattcaccattaacggttttagtttcagtggccaggggcagaattcaggtttagtctttgtcagcttaaaagactgggatgagcgcaaagactacaaaaacaaggtgccagccattgttggccgtgcgaatgcacatttctcacaaatcaaggaaggtatcgtatttgcgtttaatattccttcgattgtagagttagggtctgccagtggttttgacttccagttgattgataaagggaaccttgggcatgaagcattaacccaagcacgtaaccagttgcttggcatggttcaaagccaccctgatatgctcacgagtgtccgccctaatggtcagaatgatacgcctcaataccgtatccatatcgataaagaaaaagcggaagcactgggcgtttccaccgaaaacatcaactcaacactaagtacgatgtttggtggagcttatgtcaatgactttattgaccgtggccgcgtcaaaaaagtctatattcagtctgatgcacttcaccgtatgttgccaggcgatatcagtaagttatatgtccgtaaccaccatggtgaaatggttccattctctgcattcatagacatatccaaagatccgtgggtttatggttcaccgcgtttggaacgctataacggtttgccatcaatggaaatcgtgggtgaagctgctaaagggaaaagtaccggtgatgcaatggctttcatggagcaacttgcgtcacaactaccaagcggcattggctatgactggactggcatgtcttatcaagagcgtctatccggcaatcaggctccagccctatatacgctgtcattgattgtcgtgttcctctgtctggcagctctgtatgaaagctggtccattccattctctgtcatgttagttgtcccgctgggaattgttggtgcattgctggcaacgtcaattcgtggattggacaatgacgtctactttaaagttggtctgttgacaacaataggtctgtcagcgaaaaacgccatacttatcgtagaattcgccaaggatctgatagagaaagaaggcaaagggctgatagaagcaactctagatgctgtcaaaatgcgtttacgcccaattctgatgacttctttagcctttatgcttggagttatgcctctagtattgagcaatggtgctggctctggtgcacaaaacgccgtagggacaggcgtattgggcggtatgattgcagctacatcgttagcaatctattttgtcccagtattcttcgttgtcatcaaacgccgtttcagtaaaaaaagtgaggatgtcgaacatatttcgacccatcactaa

SEQ ID NO: 1615 - DNA, 369 bp, Xenorhabdus bovienii
  Coding DNA location: Contig name=SeqID_16860; Position on contig =120576..120944bp; Strand=+
atggatgaatattcaccaagaagacatgatattgttgaattaaaatacttatgtgaaaatttaattcacgaggcattttcagtgctaaatcgcgctgataatcattggattaacgatctgacttccgaaaaaagcttaaaactaaacgaattgatcgagcacattgcagcgttcgtctggagttttaaaattaaatacgcagataactacaatctcagtaccttaattgatgaatatctggatgaaacatataatttgttcgggagtgataagataagcttttttgaacttacaaaatggcaaaaaacaaacgaacacttaactaacattctgttgcatgatttgaatgcctgtttaagcaaaacctga

SEQ ID NO: 1616 - DNA, 204 bp, Xenorhabdus bovienii
  Coding DNA location: Contig name=SeqID_16860; Position on contig =120992..121195bp; Strand=+
atgactaaaactgactatctgatgcgtttgagaaaatgcacttctattgaaacactggaacgtgtaattgaaaaaaataaatatgagctttcggatgatgaacttgaattgttctactccgctgctgaccaccgcttagctgaactcactatgaataagctttatgataagatcccatcatctgtttggaaatttgtccgctaa

SEQ ID NO: 1617 - DNA, 132 bp, Xenorhabdus bovienii
  Coding DNA location: Contig name=SeqID_16860; Position on contig =121263..121394bp; Strand=+
atgaattcaaaacgggtgagggctctgccagcgacaccccggcacacacatcccctgctatggctgcttctttccagatctgaccaagttaacaagttagcgttgcgggagaaccaacagagcccccattga

SEQ ID NO: 1618 - DNA, 129 bp, Xenorhabdus bovienii
  Coding DNA location: Contig name=SeqID_16860; Position on contig =121586..121714bp; Strand=+
atgttgtttttctgcttatcagtgttatattcgatttcttcaacctcgttaagaacccacgacaatcctgctactatggcaaatcagacacatagcatacgaaccatcaataggcaaaaatataaataa

SEQ ID NO: 1619 - DNA, 102 bp, Xenorhabdus bovienii
  Coding DNA location: Contig name=SeqID_16860; Position on contig =121772..121873bp; Strand=-
atgatattgttattgttttttgtcattgatttttatgcttattttttgtttttttggttcatggaaggacgactttatgatttatatgtgttggttttttag

SEQ ID NO: 1620 - DNA, 117 bp, Xenorhabdus bovienii
  Coding DNA location: Contig name=SeqID_16860; Position on contig =121982..122098bp; Strand=+
atgaaaatttattatttattattgttccttaatgtactgttgttgttttatacgtttttaaccgctattaccaaagcaaaggcacattatgagtcaggcattacaaaatttaattaa

SEQ ID NO: 1621 - DNA, 276 bp, Xenorhabdus bovienii; identical to SEQ ID NO: 420
  Coding DNA location: Contig name=SeqID_16860; Position on contig =122182..122457bp; Strand=+

SEQ ID NO: 1622 - DNA, 252 bp, Xenorhabdus bovienii; identical to SEQ ID NO: 421
  Coding DNA location: Contig name=SeqID_16860; Position on contig =122506..122757bp; Strand=+

SEQ ID NO: 1623 - DNA, 255 bp, Xenorhabdus bovienii; identical to SEQ ID NO: 422
  Coding DNA location: Contig name=SeqID_16860; Position on contig =122634..122888bp; Strand=+

SEQ ID NO: 1624 - DNA, 111 bp, Xenorhabdus bovienii
  Coding DNA location: Contig name=SeqID_16860; Position on contig =122961..123071bp; Strand=-
gtgttcaaaactttcttcaggagtttgaaaagaggctgtcatgtagaaaataggcttaccattctgtattgcactgactcggcgagcgctgaaacttctcccatcacgtaa

SEQ ID NO: 1625 - DNA, 552 bp, Xenorhabdus bovienii
  Coding DNA location: Contig name=SeqID_16860; Position on contig =123030..123581bp; Strand=+
atgacagcctcttttcaaactcctgaagaaagttttgaacaccagtgttccatgcctgaagtacctcctcctgaagagttagcatctcagcaagaaattgctaaaaatatctttcatctactccccagtaagctaaaagatgctttttcagttctacctcctctggaagtgaaacctattaaattctatagtcctttcaataagtcaccagaagagcccgttcgttatgtctggttccgcagtaatggaaaaatgccggaggatccgttcattcatcattgcctactgggctatgcttcagaccttaatttcctgcctacgtcattacagcctcatggtattgggttcatggaaaaagatattcagatcgccacaattgaccactctatgtggtatcaccgtccattcaaaatggatgactggctactctattccatagaaagcccatcagcatcaggagcgcgtggttttgttcgtgggcatatctatacccgtgaaggagtactcatcgcgtctgccgttcaggaaggggtgatccgcaaacgaaaataa

SEQ ID NO: 1626 - DNA, 1293 bp, Xenorhabdus bovienii
  Coding DNA location: Contig name=SeqID_16860; Position on contig =123639..124931bp; Strand=-
atgaaaaaacaacttttatccataaccagcatcattgcggggattatcgctagtgcaccttcttttgcgtttgctgcgggaagtactttcgataaagctgatactgtattcatgctggtaaatacggtacttgtgctctttatgactatacctggcatagccctgttttatgggggattgctgcgtcgtaagaatgttttgtcattaatgtcacaggtgattgttagcttttccttagtctgtgtgctttgggtagtttacggttatagcatgacttttggaacgggtaatcgtttttggggtgggtttgagcaggtcatgctgaaaaatatatcgataactgatttgaatggcagtttttatcaactgattcatgtcgtttttcagggggcatttgcctgtatcaccgtagctttggttgtcggggctttatgcgaaagagttcgtttttctgcactgttaatttttagtgtgttatggctgacagcttcctatattcctatggcgcatatggtgtggggaggaggctggcttgctcaggatggtgcattggattttgctggaggaactgtcgttcatattaacgcagcggttgcaggattggtcggtgcttatttacttggaaggcgctcaggatttggtaaggaagcttttaaacctcataacttaccaatgacttttattggcactgcgatcctttacattggctggtttggttttaatgttggttctgctggtgctgtaaatgccatcgcagcactagcccttataaatacgatggcggcaacagcaggcgcggtattgtcatgggttttttctgaatggctattccgtgataagccttctcttttgggagcatgttctggttgtattgcgggtttggtggcaattacacccgcagcggcaacagttggtatcggtggtgcgcttatcattggactgattgcgggggttgccggtttatggggcgtggtggtattaaaacgctggttacgtgttgatgatgtctgtgatgtttttggagtacatggcgtatgtggcattgttgggtgtttattaacgagtattttcactgcatccgctttagggggcactggatttccagaagatatgacaatgctaagacagatcggcgtgcagatcattagtatattggtttgtattgtctggtcagctgtggctgcttatctgtcattcaagattgctgatctggtggttgggttgcgtattagcgttgaatctgaaagggaaggcttggatattacttctcatggcgaaagtgcttataactga

SEQ ID NO: 1627 - DNA, 375 bp, Xenorhabdus bovienii
  Coding DNA location: Contig name=SeqID_16860; Position on contig =124947..125321bp; Strand=-
atgttccttgcaaacacagcaaaaagcgggggaagtatgaaactgattactaccatcataaagccatttaagttagaagaagtacgtgaagcgctttccgatattggtatacaaggggtgacggttacagaagtaaagggatttggacgccaaaaggggcactcagaactttatcggggagccgaatacagcgttaattttttacccaaagttaaaattgatattgctacccatgatgagcgagtagaagaagttatccatgtcatacagcaatctgcattcactggcaaaatgggggatggcaagatttttatctttgagttgcagcatgctgtccgcatcaggacgggtgaaacgaatgatgcagcattgtaa

SEQ ID NO: 1628 - DNA, 99 bp, Xenorhabdus bovienii
  Coding DNA location: Contig name=SeqID_16860; Position on contig =125374..125472bp; Strand=-
atgaatctatgcacgcttagtgtgcataagaggagtgactactctagtcactccttttttactttcctttcccagctattttctctgataacaaattga

SEQ ID NO: 1629 - DNA, 1893 bp, Xenorhabdus bovienii
  Coding DNA location: Contig name=SeqID_16860; Position on contig =125453..127345bp; Strand=-
atggcacggttgcgcagcaaggcccgcacaaacaacttattacacaatccggttggtattctgatatgtaccattatcagcaacttgaagccgaattggatggtgaacatgactaatcatgatatgcataagcccagtgtgcgcaagctatggccatcattaaagcgcttgttgtcttacagtaagaattatcgcaagccaattttgctggctgtactgatgtcatgggttgctgcgttagcagaagtcagtgggccactgcttgtgagctattttattgacaatatggtagcaacgggcaatcttccgcttgatgttgttagtgggcttgcggttacttttttggtattgcagtttgttgctgctgccttgcactactttcagttcctattattcaatcaggcatctgtggggatagttcagaagcttcgtactgatgtcatgaattcggcattgcgccagccgttgagcaccttcgatagtcagcctgttgggcagctaatatcccgcgtgacgaatgatactgaagccattaaagatctgtttgtgaatgtgatccctacagtgtttcgctgcatttcgttgatcggggcaatgctgatagctatgtttattttggattggcgtatggcatgtgttgctttgacaatatttccagcagttttgctggtaatgataatttatcagcatttcagtactccaattattagacgggttcgtagttatctggctgatatcaatgacggctttaatgaaaccattaatggtatgacagtgattcagcaatttcgccagcaagctcgttttggtgagaaaatgctggcgactaatcgtgaacattatcagtctcgcatgcaagcgttgcggttggatggcattttgctgaggccgttactgagtttgttttctgctgccatactgtgtggcctgctattgttatttggcttcaaaggaacggaagtgattggcgtgggtgttttatacgcattcgtcaattatcttgggcgcctgaatgaacctctgattgaactgacagctcaacaatctttactgcaacaggcggtagtttcaggggagcgggtttttgagttaatggatagcccacagcagcaatatggcactgatcagcaggcgctgacgagtggtagaattgatattgaaaacttaacttttgcctatcgtaatgacaaagttgtgctgagtgacatcaatctgcatgttcctacacatgggtttgtggctttagttggtcatacgggaagtggtaaaagtactctgactaatttgattatgggatattatccgtggcaagacggtgaaatttatcttgatggtcgtcccgtatcttccctttctcatgcggttctgcgtaatggcgtagcaatagtacagcaagatcctgtagtgcttgcagcctcatttttcgacaatatcacattggggcgggatatcagtgaagataaaatttggcaggtgttggagatggttcaattggctgaatctgtccgccgcttaccagatggtctgaattcagtactgggagagcaggggaataccctttccgcagggcaaaaacagcttttggcaatggctcgggttctggtacaaacgccgcagattctcatcttggatgaagcaacggcgaatattgattcgggaacggagcaatcagtacagcaggcattgcggatgatccgtaaacagacgactttggtggtcatcgcccatcgtctttcaactattgttgaagcggattccatattagtgctacatcgcggtgcaatagtggagcaagggcagcatcaacagctactggctaagcgtgggcgctattatcagatgtatcaactccaacaggtcggtgagactttgaatgaatctatgcacgcttag

SEQ ID NO: 1630 - DNA, 1749 bp, Xenorhabdus bovienii
  Coding DNA location: Contig name=SeqID_16860; Position on contig =127230..128978bp; Strand=-
gtgagattattttctcaattaagttggtattttctcagcgaatggcgccgttattttggtgccattatcttccttgttatgattgcgatgctgcaattaattcctccccgtttggtcggaattatcgttgatggcatcagtgcaaaaacgatgtcatccagtcaattattgatgtggctaggcatcatgctgctcattgcgctggcgatatacggtctgcggtatgtttggcgcgtatggctatttggggcatcttatcggctggctgttaaactacgtagtgatttctaccagaaattgagcagccagaaccctgaattttatttgcgccatagaaccggtgacttaatggctcgtgcaaccaatgatgttgatagggttgtttttgctgcgggtgagggggtgctaactttagtcgattccttagtgatggggtgtgctgtccttatcgtgatgagtgtggaaattagttggcaattaacgttgttatcactgttacccatgcccattatggcgttggtgattaaacgatatggcgaacagcttcaccatcgtttcaagtctgcacaaggagcattctctgctcttaataaccatgctcaggaaagtcttaccagcatccgtatgatcaaagcatttggtctggaagatctgcaatccagtcaatttgaagaagtcgctactgatgctggacgtaaaaatatgcacgttgcgcgcgtagatgcacgttttgaccccaccattttcattgctattggcgttgcaaacctattagcgattggtggagggagttggatggtcgtgcatggctctatgacactgggtgaattgactagctttgttatgtatctgggattgctgatctggccaatgttggcattggcatggatgtttaacattgttgagcgtggcagtgcggcatatacacggatccgcagcttgttacaggagccactggtgattgatgatggttctcagtccttattagttgagcgcggtacattacaggcaaatatcaataccttcatttatcccgcaaatgatagatctgttttacatgatgtccgttttcaattatcaccaggtcagttattgggggtttgtggtccaactggtgcaggaaaaagcactttgcttgccttgttacagcggcaatttgatgtcaccgacggtgaaattctttttcagtcacgacacgtttctacacttagattggaagaatggcgatcacgattggctattgttaatcagactcctttcctgttttcggatacagtcgctggcaatatcgcgctaggccggcctgatgcaactcaagaacaaattgaagaagttgctcgtctggcgaatatgcatgatgatattttgcggttaccgcagggctaccaaacggaagtgggagaacgtggcgtaatgctttctggcgggcagaagcaacgtatctccattgcacgtgctctgttattggatacggaaattttgattttggacgatgcactttctgccgtagatggtcagacagaacatcaaattatgaagaatctcagccagtggcggcagcagcgtaccgttattatcagcgcccatcggctgtctgctttaacggaagctgataacattttggttattcagcatggcacggttgcgcagcaaggcccgcacaaacaacttattacacaatccggttggtattctgatatgtaccattatcagcaacttgaagccgaattggatggtgaacatgactaa

SEQ ID NO: 1631 - DNA, 462 bp, Xenorhabdus bovienii
  Coding DNA location: Contig name=SeqID_16860; Position on contig =129046..129507bp; Strand=-
atgctagataaaatagaccgcaagctactggatctgctccaacaggactgtagccgatccttgaatgcactggccgaagccgttaatttgacctctacaccttgttggaaacggctaaaacggcttgaagatgatgggtacattgtcggaaaagttgcattgctaaatggcactaaacttgggcttagtctgaccgtgattgtgatgatcaaaactcaacagcacagtagtgaatggtatgaacagtttgtggcttttataaaagagatgccagaggttttaacattttatcgaatggctggggaatatgattacttgatgcatgtagaagttgttgatatgaaaagttatgatcggttctacaaacgcatggttaatggagtttctggtttgattgatgtcacctctaactttgcaatggaaaaaataaaatatacaacagcgttaccaataccggattag

SEQ ID NO: 1632 - DNA, 1053 bp, Xenorhabdus bovienii
  Coding DNA location: Contig name=SeqID_16860; Position on contig =129630..130682bp; Strand=+
atgtcgtcttcatgggctacaaatgccattaaagccatccaagctgattatcaacgaagtgctgatacacacctgattcgcctcaatctccccgtgttttcagggattcacctttatctcaaagatgaaagcactcatccgacaggtagcctgaaacatcggcttgctcgttccttgttcctttatgcactcagtaatggctggatcaaggaaggaaccccaatcattgaagcctcatccggcagtaccgccgtttctgaagcctattttgcccgcttgcttggcttaccttttatcgccgtgatgccctcctgtacagctaaacgcaaggttcaggaaatcgaattctacggtggtaaatgccactttgtggaacactcagcccttatttatgacgagtcagaacgtctggcaaaaaagctgaatggccattatatggatcaatttacttacgctgaacgagctactgactggcgtggaaacaataacatcgcagaaagcattttccgtcaaatgcaactggagccatttcctgaaccaaattacattgtcatgagcgcaggaactggcggaacatcagcaacgctcggtcgctatatccgttatcagggatataacaccaaactgattgttgttgatcctgaaaactctgttttctacgattgttatcaccaaaatcgccgtgatatccgcggaatcaccagcagtaaaatcgaaggaattggccgcccacgtgcagagccatcctttatcccaactgttatcaatgacatgctgcaagtccctgattgtgccactatcgccaccatttattggcttgaaaaattaattggcagaaaaactggcgcatcaacaggaaccaacgtttggggagctttacagctagccaaacagatgcatgagaacaaccagcagggtgcaatcgtgacattgctgtgtgatagcggcgaacgctatcttgatacctattacaatccagaatgggttcgcaataatatcggtgacatcacactgtatctcacgcaactacccaagctagacggttatgagtaa

SEQ ID NO: 1633 - DNA, 699 bp, Xenorhabdus bovienii
  Coding DNA location: Contig name=SeqID_16860; Position on contig =130715..131413bp; Strand=+
atgaaacgagccgttgttgtattcagtggtggtcaagattccaccacttgtttaattcaggcactccgtcaatacgatgaagttcactgtgtcacttttgattatggtcaacgtcaccgcgctgaaattgacgtggcttgtcgtattagcaaagaactgggtgccgctgcccacaaagtacttgatgttactttattgagtgagcttgcaatcagcagcctgacccgagacaacattcccgtgccggatttcagtgaaagtgaaaaaagtggcctcccaaatacatttgttcctggccgcaacattttgtttttaactctagcggcaatttatgcctaccaagttgaggctgaagccgttatcaccggtgtttgtgaaaccgatttttctggctacccagactgtcgcgatgaatttgtcaaagccctgaataaagcagtttgccttggcatcgcccgtgatatccgttttgagactcccttgatgtggttgaacaaagcggaaacttgggcattggctgattattatcaaaaattgaacttcgtccgtacccagactctcacatgttataacggtatccaaggcgatggctgtagtgagtgtgcagcctgccaccttcgggctaatggattaaacctttatttaaataatactcaatccactatggaagatatgaaatccaaaacgcatctgagctaa

SEQ ID NO: 1634 - DNA, 399 bp, Xenorhabdus bovienii
  Coding DNA location: Contig name=SeqID_16860; Position on contig =131472..131870bp; Strand=-
atgcgtacaattattaaggtcaggggctatcatattgatcttttccagcatgtgaataatgctcgttatttggaattcatggaagaagctcgctgggatttactgacagaaagtgacacactgacgtggttaaaaactaataatgttggttttgccgtagttaatattaacatcaattaccgcctgccggcagtgttcggagatgagttggaagtgaggtctagcctcaaggaattacgtaataaaagtggtgtattttttcaggagattatacgcagaagtgataataaagtactcaccgatgctttgaccacatttgcctgtattgatttgaagactcagaaggcattaactttagagggggatatacaggaaagattagaagcatttaaagtttaa

SEQ ID NO: 1635 - DNA, 93 bp, Xenorhabdus bovienii
  Coding DNA location: Contig name=SeqID_16860; Position on contig =131907..131999bp; Strand=-
atgctaatcgcatcaagagtcaagagggctgtgatattgatcaagaataattcattaaatactattgtaattaaaatgttttgctattgttaa

SEQ ID NO: 1636 - DNA, 576 bp, Xenorhabdus bovienii
  Coding DNA location: Contig name=SeqID_16860; Position on contig =132025..132600bp; Strand=-
atgatgccgagattaagatggggcagattgaataaaattgcgaagcttctcgcaactatttttgcaaaacaacaattgaaaaaggccactttcgtggcctttcgcatatttgaacctttcctcttgtccagaaattctgttatggcaagctttcctccgtcaacaaaacacggaggaatttatatgaaatatttaaggacactatttaattcacttgttatggttttttgtatcagtattccgttatctcatgcaattgcagcggatgaatcacctgataaagctgtgaaacaatctaccaatcaacacaaagctgttattgaaacaagtgacgtgaaggaggggaaagaattagtctcagaaaaggaaatacagggaaaaggaagcatcaatatcaatacggcgaatgctgaacaattagtgaaggaactcaatggcgttggcgccaaaaaggctcaggcgattattgaataccgtgaaaaatatggccaatttacggcaattgagcagttgcaggaagttcagggcattggccctgctttaatagaaaaaaatcgggataaattaacctattga

SEQ ID NO: 1637 - DNA, 1872 bp, Xenorhabdus bovienii
  Coding DNA location: Contig name=SeqID_16860; Position on contig =132566..134437bp; Strand=-
atgatggacaacctacgcacggcggcaaacggtcctgtgcttaaaattgtattggctctaattatcctgacctttgttttgactggtgtaacaggctacctgtcaagtgaaggtggtaattatgctgccaaagtgaatggtcaaaccattagtcgtgctcaattagagcaagcatttcagcaagacaaaattgcgttgcaggataggctgggagatcaattctcaactctgttaagtgatgagcagaaagtacaacaaattcgacgcaattcactggatcgcctcatcactgttgttctatcagatcaatatgcgcgtaagctgggcttgtcagcaagcgatgaacaggttaaggaagagatccgtaacctaccttttttccagacagacggtaaatttgataacaataaatatctgaccttgcttaccggtgcaaacagaagcccagatagctttgctgaacaggttcgtcaagatctcattaaccgtcaattgatgtcgatattgacgggttcagaaattgctttgccgacagagatcaaacaggaaacagcgcttgccttccaagaaagaacggttcgtttcgctacacttgagctgaaatccattgaagcacagcaaaaagtgacagataaagagctgaaaaactattatgacgttaatagcaagagtttcaccgtgccagaaaaggtgaaagtcagctacatcaagatggatgctgcggatgaattgaaaagtgtcaccgtatctgatgctgatattgaaaaatattataaaaacaatctgccacagtatacacagatcgagcaaaaaaaatacagcctggttcaattggtgtctgatgctgaagctaaatcagttttggatgaattaaagaaaggtgctgatttcagcaaattggcggcagaaaaatcgacagataaattttctgctcaaaagggaggagatctcggttggatggaagaaagctccctacctgatgagattaagtcagctaatttgatagaaaaagggcagctttctggcgtcatcaagctatctggtggatatgctattttccgtttagatgatattaaacctcagataataaaatcactggtcgatgtgcgttcggaaatagaaaaaatcgttaaacaggaaaaagcggttgatgcattctatgcattgcagagaaaagtaagtgatgccgctaccaatgataacgaatctttggctgcggcagaaaaggcagctggttataaggccgtgacgactgactggtttgatcgtgaccatattcctactgaaataaatttcgattcggtggttcagactattttctctggaaatctaatcgatgataaaggggcatcaggaactaactccgatgttatttctgtggatggtgacagagcctttattgttcgtgttgatgatatcaagccagaaactatccagccttacgagcaggccaaaactcagattgccgaattagtaaaacgccagaaagctgaaaagcagttgcagcttgaaagtgaaaaactgctggctgttttgaaagaaggtaaaggtgagcaggcattgaaagcagctgggattcagtttggtgtctccactgtgatcaaacatttatcacaaactaatcaggctactaatgtagcatttactctgcctcatcctaaagatggcaagtctgagtatggtttagcccaagatgggcttggcaacgctgtgcttatccaattggataaagttgtccctggttctgtttcagaagaacaggttaaacaatacatagcggagtatcagtatcaaatcggtactttcatgctggaatcattgatgattaatttgcgtgatgatgccgagattaagatggggcagattgaataa

SEQ ID NO: 1638 - DNA, 99 bp, Xenorhabdus bovienii
  Coding DNA location: Contig name=SeqID_16860; Position on contig =134531..134629bp; Strand=+
atgcgcttatattctaacctatcaaccccgccccgtcagtttaagtttaactgtaatggccaaagcgagggaggatgtttcatattcattactcattaa

SEQ ID NO: 1639 - DNA, 309 bp, Xenorhabdus bovienii
  Coding DNA location: Contig name=SeqID_16860; Position on contig =134605..134913bp; Strand=+
atgtttcatattcattactcattaacagcatctttcagtccctttcctgcgcggaaagcgggtacttttgctgctgcgattttgatttctttgcctgtctgggggttacgccctgtacgagcagcacgctcacgtacagtaaaagtaccgaaccctaccaaaacgacatcatcaccgtctttcaatgcatcagataccgaagaaatgaatgcatctactacacgcccggcagctgctttggaaatatttacatcagcagcaattttgtcgatcagttgtgacttgttcactcttatcatccccatttag

SEQ ID NO: 1640 - DNA, 114 bp, Xenorhabdus bovienii
  Coding DNA location: Contig name=SeqID_16860; Position on contig =134900..135013bp; Strand=-
ttgctgttccatgattttttgctaatactggaagggattgatataacggcatggctgtcgcgttatccgttagagatcggtatttgttacgatagtgaaactaaatggggatga

SEQ ID NO: 1641 - DNA, 528 bp, Xenorhabdus bovienii
  Coding DNA location: Contig name=SeqID_16860; Position on contig =135135..135662bp; Strand=-
atgttaacgattgaaacagccagcgtgccaggtaaaggaaaactgacctatacgggttcgttgggtgaagtgatgcaagaatccattcaggcagccttgactgtggttcgggctcgtgctgataaactgggcattagctctgatttccatgaaaaacgtgatattcacgtccacgtacctgaaggtgcaacaccaaaagatggcccaagcgcgggtattgcaatgtgtactgcgttggtttcctgcctgacaggtaatccggttcgtgccgatgttgctatgacaggcgaaatcactctgcgtggtttagtactgcctattggtggtttgaaagaaaaactgctggcagctcatcgtggagggatcaaaaccgtcttgattccagatgaaaataaacgagatctggaagagatccctcagaatattattcaagatttggagatccatcctgttaagcgcatagaagatgttttgtctattgctttacagtctcctgcgtttggagcagaagcagtatcactaaagtag

SEQ ID NO: 1642 - DNA, 168 bp, Xenorhabdus bovienii
  Coding DNA location: Contig name=SeqID_16861; Position on contig =345..512bp; Strand=-
atgcaagaacaacgcacgttagagctggactgcattcgtactcatacaaaaattatcaatgattatcaggagctggaaagtatacagctctatccggtcaaggttcgcaaactgatacgccgtttacgccgcatccgagtcgaccgattaattagccgcatactgtaa

SEQ ID NO: 1643 - DNA, 1041 bp, Xenorhabdus bovienii
  Coding DNA location: Contig name=SeqID_16862; Position on contig =2130..3170bp; Strand=+
atgtctgcctgtcaatttatccaattaaaagcgttcaacacgtttggtatttcagtctgtgctgatcatatttctaccgtaacttcagttgaatcactgttgtctgcatggcaagaagcggaggaaaaagagcatcccattttattacttggtggggggagtaacgttctttttaccgaaaattttaaaggtactgtgatattgaaccgtattcttggtgttgatatacaagaatcggatacagcatggcatatccatgttggcgctggtgaaaactggcatcagctgattgttcatcttcttcatcaacagatctatggcttagaaaatttagcgttgattccaggaaatgtggggtcagcaccaattcaaaatattggtgcatatggaattgaatttaaacatgtctgtgaatatgtcgatctaatagagttgaaaactggcaaactgattcatcttatggcaaatgaatgccaatttgcttatagagatagtatctttaaacatcaatataaagatggctatgctataacagcagttggcttgcagttaaataaggtttggaaaccaatattaacttatggcggcttaacacagttctcatgtgaagacgtaacaccagaacgcatattcaatgctgtttgtgaaatgcgtcagagtaagttacccgatcctgttattatcgggaatgctggcagtttttttaaaaatccaattgtacctattgaattggcgcaaaagatcaaatttgattatccagagtgtcctcaatatcaccataatgaacataatgtaaagatagcggcaggttggctgatagatcaatgtcacttgaaaggctattgtattggtgacgctgccatacatatgaaacaggcactggtgttaatcaataaaggtaatgcaacgggtcaggatattactgctttggcgacttatgtacgtaaaaaagtagcagaaaaatttaatattttcttagagcctgaagtacgtttcattggtagtgagggtgagatagatgcagtggaatgtatttcatga

SEQ ID NO: 1644 - DNA, 960 bp, Xenorhabdus bovienii
  Coding DNA location: Contig name=SeqID_16862; Position on contig =3167..4126bp; Strand=+
atgaaagatattagtatcccattaaaattaattaaagtgttatccgatggcgaagttcattccggtcagcagcttggtcaagaattaggaatgagtcgtgcgggaataaataagcatattcagaccattcgtgaatggggcgtagagattttaactatcccgggtaagggttatcgtttccctgcatcaatgaatctgctggataaagagcttattgcaggttacctgccaaatgatcgtctcgaagttatacctgttatcgattctaccaatcagtatttgctggagaaattgtcagaactcgattcaggtgacgcttgtgtcgccgaatatcagtatgctggaagggggcgccgtggcaggcagtggatttctgcttttggtagaaatttatatttgtccatgtattggcgtttggagcaagggccagccgcagcaataggattaagtctggttgttgggatagtcattgcggaagtgcttaaccgtcagggtgctgaaagagtaaaagtgaaatggccgaatgatctctatctggatgataaaaagctggcagggatattagttgaattgataggaaaaatgggtgatgcggctcagattgttatcggaataggcatgaatatttcaatgagtagtgaacagcagaaattgattaaccagcagtggactaatctacagcaagcgggaatagttgttgaacgcaataaattaatttctgaaattattcttgagcttaaaaaagcgttaattcaatttgaaaacgaagggttatctccatttcttttccggtggttaaaattagatcattttatgaatcgttcagtaaagctgattattggaaatcaggaagtttatggaacggctcgtggaattgatcagcaaggggcattgctgcttgatataaatggtgttattacgccgtatattggtggtgaaatttctctcagaggttgttga

SEQ ID NO: 1645 - DNA, 930 bp, Xenorhabdus bovienii
  Coding DNA location: Contig name=SeqID_16862; Position on contig =4159..5088bp; Strand=-
ttgacgactccatatttacaatttgatcgtgaacattgggcaacattacgtgactcagtgcctttgacactcacagcagaagagattgctgctttaaaagggattaatgaagagatttcaatagaagaagtggttcagatctatcttccattgtcacgtctactcaatttttatattagttccaatttgcggcggcaggccgtccttgaacaatttttagggactggtgggcaaaaaataccttacatcattggcatagcaggcagtgttgctgttggaaagagcacaaccgcgcgtttattacaagcattgttaagccgctggcccgaacatcgccgcgttaaactagtaacgacagacggttttttacactctaataatgtattgaatgaacgtggcttaatgaaaaaaaagggcttccctgaatcctacgatatgcgcaacctagtgaaattcgtcgctgatataaaatcaggcgccgaaaaagttacagcaccagtatactctcacctcagctacgatattgtccccaatgaacaactaattattgagcgtccagatattttgatccttgaaggactaaacgtgctgcaaagtggtatggattatccacatgaaccacatcatgtgtttgtgtctgattttgtcgatttttctatttatgtcgatgcgtcagaagagttgctcgaacaatggtatatcaaccgttttcttaagttccggcaaggtgctttttctgatccagactcttatttccacaattattctaagttaactaccgaagcagcgataaaagttgcatcagatatttggctggaaattaatggattaaacttacaacaaaacattttaccaactagagagcgcgctagcctaattatgactaaaggagcgaaccacgctattgaaagtgtcaggttgagaaaataa

SEQ ID NO: 1646 - DNA, 762 bp, Xenorhabdus bovienii
  unsure (1)..(762): unsure at all n locations
  Coding DNA location: Contig name=SeqID_16863; Position on contig =237..998bp; Strand=+
gtgatcgcggtatgcgctgtcattgctggggctaacgcctggactgatattgaacagtacggtcaactcaaaaaggattggctgagttcatttcttccgctcaaagagggtattccgtcacatgatactttccggcgctgtttcagtttattaaacccgagcctctttgaacatcatttttatcaatgggtttctcgtgacctctcttcagaaaaacgggctatcattgcgattgatggtaaaagtttacgtcattcgtttgataagaaaattgaccaaagcgcattacatatggtgagtgcattcacggttgagaaagggcttagcttatgtcaatgtgccgtagacggaaaatcaaacgaaattaaggccattccggcattattatcgatgctttcattgaaaggccatctcgtgacgatggatgcgatgggttgccaacgcacgattgctcagcaactacgcgagagtgaagccgattatattttgtcgcttaaaggcaatcaggggaaaaccttttcggaagcggttaactattttcaacaacaacagataacccaaaaaccttaccttaaacctgaccatgatgaattcgatgatggccacggacgtaccgtcagacggcgcggatgggttctgccactgacatcagaaacaaaacacttaaggtcttggccagatattcaagctcttctggtaacagaaacgatacgacaagaacactattctgacacggtgacttctgactacnnnnnnnnnnnn

SEQ ID NO: 1647 - DNA, 901 bp, Xenorhabdus bovienii
  Coding DNA location: Contig name=SeqID_16864; Position on contig =2..902bp; Strand=-
atgattgcccaggctttgcgtattcatgaaagtacggtgagtcgccatctgaaggattacgtctctgaggaaaaactcgcccctgaaaatggcggctctgaaagccgtttatctgccgaacaaacgacagaattagtggagtatctgacggcaaatttgatgcacactaccgcgcaaattgtggcttgtgtctgggcgcgctggcaggtgactttcactgtggctgggatgacaaaatggctccaccgccaagggttcagctacaagaagccgatgggaacgcctcataaatccgatgcgggtaaacagcaacactttattgagacctacaacgcgttgaaagctgaatgtggccaaaatgcgcctattttgtttattgatgcgatgcatcctacccagtccacaaaattaagttacggctggatgaggcgcggaagagagcatgtcaaagtggtcgaaaccacaggcagccggacccgccttaacatcatgggcgcactcaatttgcaacggattgaagagaccattattcgtgaatatccgacgattaacgcgaaaaatgttgtcctgtttttcggctcaattcgagaaacctatccgctttcacaaaaaattcatctcattctggatggagccggttaccaccgcgctgaaatagttcaattttttgccgaggtcctgaatatcgagttgcattatctgcccccttacagccctaacctcaacccgattgagcgattatggaagtatgcgaatgagcaggtacgaaataatatctatttctcggaggcaaaaacattccgtgaaacgctgcatcacttttttcatgtcacattgccagaaaaagcgaaagaactcaccacccgggaaatgcaggcctgcaggcatgcacagcaattgc

SEQ ID NO: 1648 - DNA, 189 bp, Xenorhabdus bovienii
  Coding DNA location: Contig name=SeqID_16865; Position on contig =570..758bp; Strand=-
gtgtctggcagtgccctactctcacatggggagaccccacactaccatcggcgctacggcgtttcactgctgagttcggcatgggatcaggtgggaccaccgcgctatggccgccagacaaattctgttttcaatcccgaacaagctgctgtctttcatctgaaactccgtctctctctcaccaaaaca

SEQ ID NO: 1649 - DNA, 1647 bp, Xenorhabdus bovienii
  Coding DNA location: Contig name=SeqID_16865; Position on contig =879..2525bp; Strand=-
atgaaaaaaatcgtattgtcagcgatgctgctattttccacactctttcacaacttggcacaagcggatgccatttcaggcaatgtagaagaacaacccttgaatattcaagctattgtcatgtttctattattcgttgggttcacgctttgcattacttattgggcttcaaaacgaacgcaatcacgttcagattattacaccgctggtggacgcattacagggttccaaaacggaatggccatcgctggtgactatatgtcagccgcctcttttctgggaatttccgcgttagtctatacctctggttatgatggactgatctattcgatcggcttcctcgttggctggccaattattctattcctcatcgctgaacgtctgagaaatctagggcgttacacgtttgctgatgtcgcctcttatcgattaaaacagcgccccattcgtactctgtcagcaacaggctctttagttgtcgttgcgctatatttgatcgctcaaatggttggggcaggaaaactcattgagctgctatttgggttgaattatcacatcgcagttattttagtcggtattttgatggtgctgtatgtgctgtttggtgggatgctggcaacgacatgggttcagattatcaaggcaatcctgttactggcaggagcaacattcatggccctgatggtcatgaaagccgtaaatttcaatttcaatactctatttaaagaagccatcgctgtgcattcccgtggtcaggcaatcatgagcccaggcggattagtgtctgatcctatatcagcactctctttaggactggcattgatgtttggtactgccggattgccacatatcgtcatgcgattctttaccgttagtgatgccaaagaagcccgtaaaagtgttttctatgccacagggtttatcggctatttttatatcctgacgtttatcattgggtttggtgcaatattattagtcagccccagtcccgcgttcaaagatgtgactggagcattaattggtggaacaaatatgtccgctgtccatctagcagatgccgttggcggtaacttcttccttggtttcatctctgccgtggcctttgccactattttagctgttgtggcagggttaactttagcaggtgcttcagcggtttctcatgatctctatgccaatgtaattaagcaaggtcaagccaatgagcgtgatgaactgagagtttccaagattactgtcattatcctcggttttgtcgccataggattgggtattttgttcgaaaaacaaaatattgccttcatggtgggattggcattctcaattgccgcaagctgtaacttcccgattattttattgtcgatgtactggaacaagctgacaacgcgaggggcactcattggcgggtggttaggattaattactgcagttgtattaatgatccttgggcctactatttgggtcagcatcctcggtcatgaaaagccaatttatccgtatgaatacccagcactgttttctatgtttgtagcattcatcggtacatggttattttccatcacagatggatcacaacaaggtcagcaggaaaggaaaatgtttcgcaatcagtttattcgttcacagactggaattggtatcgagtag

SEQ ID NO: 1650 - DNA, 312 bp, Xenorhabdus bovienii
  Coding DNA location: Contig name=SeqID_16865; Position on contig =2522..2833bp; Strand=-
atgaatcctaatatttatcaagaaattgaaaataatccccgctttaaggaattagttaagaaacgtggacgctttgcctggttgttatccaccatcatgttagtaatttatgttagctttatttttcttatcgctttttcccctgaatggctaggtactcccctctatgaaggctccagcatgacccgtggtattcctgtgggtgtcgggattatatttatttctttcatattaacagggatctatgttgtcagggcgaatggtgaatttgatcgtttgacttcgactatcctcaatgaggtaaaaaaatga

SEQ ID NO: 1651 - DNA, 99 bp, Xenorhabdus bovienii
  Coding DNA location: Contig name=SeqID_16865; Position on contig =2823..2921bp; Strand=-
atgagttcccacggatttttgtaccctgcgtttggctgtctacaacgcattaaggtgtatcgttcaaaatccaaaaggagacgctctgatgaatcctaa

SEQ ID NO: 1652 - DNA, 1956 bp, Xenorhabdus bovienii
  Coding DNA location: Contig name=SeqID_16865; Position on contig =3000..4955bp; Strand=-
atgactcaaataatcaagcatcttattcctgctgacattgcagaaacggccctgataagcaaacaacaatatctacaagattaccaatggtcactacaagatcctgaatcgttctggggtgagaaagggaagatagtagattggataaaaccttatactcgggttaaaaacacttctttcgacccaggacatgtcagtatccgctggtttgaagatggcactctgaatttaagtgccaactgccttgaccgccatttgcaagaacgtggtgagcaaaccgctatcatctgggaaggagacaatcccgcagaatccagacatgttacttatcgcgagctatatcatgatgtctgccaattcgccaatgtattgaaaaaacttggtgtcaaaaaaggcgatgtcgttgcgatttatatgccaatggtacccgaagccgccgttgccatgctggcatgtgcccgagttggtgcaatccattccgtgatttttggtggtttctctcctgatgccattgctggcagggttatcgattccaatgccaagctggttattaccgcagatgaagggatacgtgcaggccgcgttattccattgaaaaaaaatgtcgatgaagcattgagcaatccagccgtgaccgacgttgctaatgtggtagtcttcaagcgtactggtaacaccaaaaactggcaggaaggccgtgatttgtggtggcatgagttgatcgaaaatgtcagcacagattgccctgccgaagaaatgaatgccgaagatccacttttcatcctttatacctctggctcaaccggcaaacctaaaggggttctacataccacaggcggttatctggtctatgcttctttgactttcaaatacacgtttgattaccgtccgggtgaaatctactggtgtacagccgatgttggctgggtaaccggccacagttaccttctgtatgggcctctctcctgcggtgccacatcattgatgtttgaaggggtgccaaactaccccgatgtcaatcgcctctgtcaggtcgttgataagcatcaggttaatattctctatactgcaccaaccgccattcgtgcattaatggctgaaggcgataaggcgattgaaggaaccaaacgtacgtcactacgtatcatgggctcggtaggtgagccaatcaatcctgaagcatgggaatggtactaccggaagataggtaatagtcaatgccctatcgtcgatacttggtggcaaaccgaaacaggcgggttcatgatcacgccattacccggagcagttgatctcaaaccaggttcggctactttgccatttttcggcatcagtccggcattggtaggcaactcaggtgagccattaactggcgaatgcgagggcaatcttgtcatcacggattcctggccaggacaagcgcgaactttatatggtgatcatgagcgttttgaacaaacctatttttcgacgttcaaaggcatgtattttagcggagatggcgctcgacgtgatgaagacggctattattggatcactggccgtgtcgatgatgtcctgaatatttcaggtcatcggttgggaaccgcagaaattgaatctgcgctggtttcacatccaaaaattgcagaagctgccgttgttggcattccacaccatatcaagggacaggcgatttatgcctatgtcacactgaatcatggtgaagaaccttccccagatctttataccgaagtcagaaattgggttcgcaaagaaatcggcccgattgcaacacccgatattcttcactggacggattcgttacccaaaacacgttcaggaaagatcatgcgccgtatcttgcgcaaaattgcttccggcgataccagtaacttaggtgatacctccacactggccgatccgggtgtcgttgaaaaactactggaagaaaagcaatccatgaatctgtcttaa

SEQ ID NO: 1653 - DNA, 627 bp, Xenorhabdus bovienii
  Coding DNA location: Contig name=SeqID_16865; Position on contig =5327..5953bp; Strand=+
atgagctattccctgcctgctctaccttactcttatgatgctctggagcctcatttcgataagcagacgatggaaattcattataccaaacatcatcaaacctacgtaactaacacgaatacagcgctggaagccttccctgaattagctaaacttcctattgatgagctgatccagcagcttgataaaatccctgcggataaacgcacttttattcgtaataatgcgggagggcactcaaaccacagcctgttctggaaaggattaaaattgggaacggtcttgggtggtactttgaaaacggccattgagcgggatttaggtagtattgagatcttcaaggaaaaatttgagcaagccgctgcaacccgctttggctctggctgggcatggctggttctaaaagcagatggcaaacttgcggttgtttcaactgccaatcaggacagcccgttaatgggagaggaaattgccggtgcttcaggttaccccattttgggtctggatgtgtgggaacacgcttattacctgaaatatcaaaaccgccgtccagactatattaaggcgttttggcatgtagtggactgggatgaggcagcaaagcgttacgaagaaaaaattaagtaa

SEQ ID NO: 1654 - DNA, 1035 bp, Xenorhabdus bovienii
  Coding DNA location: Contig name=SeqID_16865; Position on contig =6029..7063bp; Strand=-
atgaatgaacccactgtaatgaaaccaaactcccaaaaacctattgtattcagcggcgcacagccttccggtgaattgaccatcggtaactacatgggggcattacgtcagtgggttaaaatgcaggatgagtatgattgcatctattgcatcgttaaccagcatgctattaccgtgcgccaagacccaaatgaattgaaaaaacgcacgcttgatacgctggcactttacctcgcatgtggcattgaccccaagaaaagtacgatcttcgttcagtcacacgttccacagcattctcaattaagttgggtacttaactgttacacctatttcggtgaactcggccgtatgacccagtttaaagataaatcagctagtcatgcggaaaacatcaacgcagggttatttagctatccggttctgatggccgcagatattctgctttatcaggccaatcaaatccctgtgggaattgaccagaaacagcatcttgaattgagccgtgatctggcacagcgctttaatgccatttacggtgatattttcaccgtaccagaaccattcattccaacgggtggtgctaaagtgatgtctttgcaagatccagccaagaaaatgtcaaagtcggatgataaccgtaataacgttattgccctgctggaagatccaaaatcggcagcgaagaaaatcaaacgtgccatcactgattccgaagaaccaccacgtgtacgttatgatttggaaaataaacccggcgtctccaatttactggacattttggcaggtgtaacaggtaagacaattcctcaattggaagctgaatttgaaggccagatgtatggtcatctgaaaggtgcagttgcagaagccgtttctggaatgctgactgacttgcaggaacgttttcaccatttccgcaatgatgaagcattacttaatcaaatcatggctgaaggagctgccaaggcacaagctcgtgctcaggcgactttagataaagtttacgaagcggtagggtttattgctcatccgtaa

SEQ ID NO: 1655 - DNA, 705 bp, Xenorhabdus bovienii
  Coding DNA location: Contig name=SeqID_16865; Position on contig =7068..7772bp; Strand=-
atggtaacaagtattaagaaaaatcttcgtgccattgcatttgatctggatggaacattagttgacagcgccagcggtctggcggaagcactggatcaggctctgattgccaaaggtttacctgcggcaggcaaagaacgagttgctatctggataggtaacggcgcggatgtcatggttgagcgtgcactgaaatgggcaggagtagaatccacccctgaactgcattgtgaaacccgtaagctattcgatgggttttatgaaacaaccgtgacaacaggcagccaactgtttccccacgtaaaagagactctggcaacactggcacagcataatctgccaatggccatcgtaaccaataaacccacaccttttattgcgccattactggaatcattggggatcagtgaatacttttcactggtgctgggtggtgatgatgttaaagagaaaaaaccccatcctgccccgctatatctaacaatgggcatgtttggcatccataaagaagaattgctttttgtcggtgattcccgtaatgatattttggcggcacaggcagccggctgcccttgtgttggcttaacctatggatataactacggagaatcgatagcattaagccacccagattatatattggaccatttcccggatttactaccggctatcggattatccacgttgaaacttcaggaagcgtaa

SEQ ID NO: 1656 - DNA, 675 bp, Xenorhabdus bovienii
  Coding DNA location: Contig name=SeqID_16865; Position on contig =7772..8446bp; Strand=-
atgaagaaagattttctgattgccccatccattctatccgcagattttgcccgattaggtgaagataccgcaaaggttctggcagcaggcgctgatgttgtccactttgacgttatggataatcactatgtgccaaacctgaccattgggccaatggtctgccaggcgctgcgtgattatggcattacggcaccgatagacgttcatctgatggtaaaacctgtagatcgtattatccctgattttgccaaggcaggtgcaacctacatcactttccatcccgaagcgagcgagcatgttgaccgtaccctgcaactgatcaaagaacatggctgtaaggcaggtctagttttcaacccagcaacccctctcagttaccttgattatgtgctggataagctggacgtaattctgctgatgtccgttaacccgggtttcagtggccagtccttcattccagaaaccctgaacaagttacggcaggtacgcaaaatcattgacgacagcggatacgatattcgtcttgaagttgatggtggcatcaaggccaataatattagagaagccgctcaggcgggcgcagatatgtttgttgctggttctgctattttcagccagcctgactataaaacggtcattgatgagatgcgccgtgaattatcaaaggtggcataa

SEQ ID NO: 1657 - DNA, 819 bp, Xenorhabdus bovienii
  Coding DNA location: Contig name=SeqID_16865; Position on contig =8505..9323bp; Strand=-
atgaaaaaaaaacgcgctttcttaaaatgggccggtggaaaatacccgttggtggatgacattagacgtcatctgccagagggagaacgcttaattgagccatttgttggcgcaggctcggtattcctgaataccgattatgattcttacatcttgtcagacataaatagtgatctgatcaacctgtatgacacggtaaaatctcgtccagaagaatttatcaatcatgcccgtccattattctctcaggagttcaacactgcggaagacttctaccgcctgagagaagagttcaacaaaagccaagaaccactgtaccgcagtctattgtttctttaccttaaccgccactgctataacggcctttgccgctataactctcggggagaatttaatgtcccttttgggcggtataaaaaaccttattttcctgaagatgaactttactggttcgctgaaaaagcccaaaaagcctcttttgtctgccagcattaccaaatcacgctagacaacgcaccacaaggatcagtaatttattgtgatcctccgtatgccccactttcggcaacggctaattttacggcctatcatacaaatagttttaacctcctcgatcaagaaaatctagcgaggatggcctatcatctttcctctcagcagggcattcctgtgctcatatccaaccatgacacgccaatgacgcgggaatggtaccatcaggcttctcttcatattgttaaagcccgtcggacaataagtagaaacattcttgctcggagtaaagttgatgagcttttggcgttatactgccggaagtga

SEQ ID NO: 1658 - DNA, 966 bp, Xenorhabdus bovienii
  Coding DNA location: Contig name=SeqID_16865; Position on contig =9409..10374bp; Strand=-
atggacgaattaaaatcagaaaacaaacaaaaaacagaaaacgaatttaaacctgatacatctgatcgccgccctccgcgatcgcgcagccaatccaaccagcccaaactggcagtatcccgccagcaattaatgattggggttggaattctggtgcttttactgctgattattgctatcagttctgcattgaaatcgccaactgatcatgagaaacagcaatcccagaatacggctgagaaaaacatcgatctatccggctcttcttcactctctaccaataatcagagtagctcaccggaaaatccatcggcaccggcaagccatggctcacaagaaatcagtatgccacccattagcaatacaccaagcaaagatctttctccaacacctgaggcaagtagccacaaccagcgcatagaattgcccggtgatatttctgatgccttgaatcaacagcaaggcaacatcaatgatacggtgcaaaaaaacctgacgccatcacagtccaactctatgcaacagacggtgataccgccagttgaacagaataagactgaaaaagttgcaccgccgaaaatagaaaaaacggaaaaagtggcaaaatcagaaaatcatgccaaatcaactgataaaccagcaatatcccatcatcaggccagtaaaaagggtgtgaccgatactcgcggtgatttactgaaagcctccgccaaccgattcacactccagttaagtagcgccagccgctcggataccttaattgccttcgcaaagaacaataacctttcaaattatacggtttatgaagcgaaacgtgaaggtaaggcatggtttatcttgatccacggtagttatggttcggtttctgacgccaaaagtgccatttcctcactcccggctgaagttcaggccaaaaaaccttgggttagaaaactacaacaggttcagcaagatctgaaaaaataa

SEQ ID NO: 1659 - DNA, 111 bp, Xenorhabdus bovienii
  Coding DNA location: Contig name=SeqID_16865; Position on contig =10471..10581bp; Strand=-
atgtctgccatcgaccagctaaatacacgattatctgaatatggcaaaattccttctgagaataaaagcttgaataatgaatcattttctggctgttatgctataaaatag

SEQ ID NO: 1660 - DNA, 1098 bp, Xenorhabdus bovienii
  Coding DNA location: Contig name=SeqID_16865; Position on contig =10560..11657bp; Strand=-
atggaacaagtaactgttacgttaggtgaaagaagctatccgattaccatagcccaagggctattttctagcgatgaggcattcaagcccctgcaagctggtcagcaggtcatgatagtgaccaacgagacgctggctcacctgtatcttgaacaggtgaaatccacattgcagggtatgggtcttcgggtagacgaagttatcttacctgatggtgaacagtacaaatcactttttgtggtcaatgacattttttccgctttactggaaaataatcatggtcgtgacacaacgcttatcgctctcggtggtggtataatcggtgatatgacagggtttgccgccgcttgctatcaacgcggcattcgcttcattcaagtacccaccacattactttctcaggttgactcttccgtcggtggaaaaaccggcgtcaaccatcccctcggcaaaaacatgataggggccttttatcagccagcgtccgttatcatcgatatcaattgcctgaaaacattacctgctcaagaactgcatgcaggtctggctgaagttatcaaatacggcatcattctggatggtgaattttttaactggcttgaaagcaatatcgagaaattactggctctcgataatcagacaatgtcttattgcattcgtcgctgctgtgaactcaaagcatgggttgtcgctgctgatgaacaagaacgcaatgggatgcgagcactattaaatctcggccatacctttgggcatgctattgaagctgaaatgggttatggcgtctggctgcatggtcaggcggttgctgcgggtatggtgatggcagcacgggcatctgagcttgtgggcacgttctcaagacaggatactcagcgcattatcagcttgctggagcgggcaaagcttccagtcaacggcccagtggaaatgtctccagaaatctatttgccgcatatgatgcgcgacaaaaaagtctctgcgggaaaattgcatctggtactgcctacggcaattgggaaagcagaacttcgttctgatatcgggtctgatgtcatattggacgccgtccgcctatgtctgccatcgaccagctaa

SEQ ID NO: 1661 - DNA, 522 bp, Xenorhabdus bovienii
  Coding DNA location: Contig name=SeqID_16865; Position on contig =11703..12224bp; Strand=-
atggcagagaaacgcaatatctttctggttgggcctatgggtgccggcaaaagcactattggtcgtcagttagctcagcaactcaatatggagttttacgactctgatcaagaaattgagcgacgtaccggagctgacgtgggctgggtatttgatgtggaaggcgaagaaggcttccgcgaccgtgaagaaaaaataattaacgaattgactgaaaaacaaggcatcgtactggcaacgggtgggggttctgttaaatcgaaagaaacccgtaatcgtctgtctgcccgtggtgtggtcgtctatttagaaacaaccatcgaaaaacagttagctcgtacccagcgtgataaaaaacgccctttacttcaagtggatgcaccagcacgcgaagttttagaaaatttagctgatgagcgcaaccctctctacgaggaaattgctgatctgactatccgtacagatgagcaaagcgccaaagttgttgctaaccaaattatcgaattactggaaaaaaactga

SEQ ID NO: 1662 - DNA, 252 bp, Xenorhabdus bovienii
  Coding DNA location: Contig name=SeqID_16865; Position on contig =12329..12580bp; Strand=+
atgggaaaattatctcagcacatcaacctgtattgcaactatatatatctggcacgaaccgttgtagtctggtttatgctttgttggctgactgtgagcctactttatgtttattggggtagactcttacttgtgatgttagacccgctcactcaattagataatccttgtatgctaaattactctcagcgtcaaatccataaacaggtcagaccaagaaaaatagtagaaaatctggtgaaaaagacataa

SEQ ID NO: 1663 - DNA, 1086 bp, Xenorhabdus bovienii
  Coding DNA location: Contig name=SeqID_16865; Position on contig =12627..13712bp; Strand=-
atgaacaatcatttttttattctactggcttgcctgtttctgctactgccaaccctcagttctgccgaagaaattaacgcatggaaagaaacagagagcgaaatagcggtaagaaatccgttccagccaccgaaaaacgaattagatgaacaactcgaattttccccagcagaacgggatgaacaggagcaggagattgaatatcaggctattactctgcaatacgctgacgcagggcagatcgccgaacaattacagaaaaatattccggcgctactaacaaaatggggcaaagttgaacacgatcccttaaccaacagcctgatattggaagataagtttgatgccattacccgcatcaaaggttggctgaaagaggtggatacaccacaacaacaagtacaaattacggcccatattgtcaccagcagcagagaggctctgcatgagttgggaattcactggggcatggcggctgatccactaaatcgctcaataggcctcaaccgtttgaatttgcatcaatccgcaggtaatcaaagccaccgactggtactgaacactgcccgcatccatgcaagcttgctagaaatggagctcagtgcactggagcaggaaaaccaactggatatcattgccagcccaaggctgacagcctcacaccaacagccagccagcattaagcagggttctgatatcccttatctcgttcaggacaaggacaaaacgacgattcaatttaaggaggcggtattaggtatggaggtgactccacacatcttgagaaaagggaaaatccgtttagcgctaaaaatcagccagaacgcccctggactccccattagtcagggaggaaatgaaaatctggcgatagataaacaggaaatcgtgacgcaggttaccgtcagaaacggggaaaccctgattcttggtggcatttttcagcagaaaaaaggcgctagcctgcaaaaagtcccttacttgtctgatcttcctctattgggtgcattatttaaccaaaaaggagagcagcacagccgaagggaactcgtaatttttattacacctcaactgaccgatatttaa

SEQ ID NO: 1664 - DNA, 552 bp, Xenorhabdus bovienii
  Coding DNA location: Contig name=SeqID_16865; Position on contig =13715..14266bp; Strand=-
atgaaaagtaattatcttgtgtggtttcatcgtccagcatggcagttgtttctgttgcagcaattgctggtcattccactcatattaagtttctatttttgggtctggcaggagaatgaatacgcaatccatgacctccagctcaatatcaccgagcagaaacacaattcggcgttatccgaaaagcgtatcgccgagttacccaatctacccgatatccgacaacagattcagcaattgacagcagaactcagccaaggcagcaatattttgcccaacaatatcccgcaaaaaaatgccaccgtactcaaacgccttcatcagcccttaaccagctctggcagtcaactcatggagtggaaaagccataaggaaggcaaccaaattttctggcacatcatgctgttactaagctatgaccaactcctccatttcctcaatgaaattcaacaagtacaacctgttttgctgattaaacacctcaccatcatccctgtcgataacgatctgactgtccgcatggtgctgtcagatgccctccatgagggataa

SEQ ID NO: 1665 - DNA, 552 bp, Xenorhabdus bovienii
  Coding DNA location: Contig name=SeqID_16865; Position on contig =14256..14807bp; Strand=-
atgatgtatcaggttaattttttaccgtggcgtcaggcaagattgaaacgcctatgccgggaatgggggctattgctctgcctgcaattaatgctctgcgtatctatactgacgtttatttccgtgcaacaaaaaaacaaacttgcgcaatataccaaccaattaacagaaattagccatcaattagtgcaattacagcaaaatatcaaagaaaacgaacaagccgttcaacaccatcatcaattgacactgcaattaaggaaaaaacagacattcatggaacagaatcaaagatatttacagttatttcgtcaacttccgcacttattgccggaaaaaagctggcttactgcattcagtgacgacaccggccaattggtttttgccgccagcagtcaaaactacgatgatgtctcggacttactggataacctgaccgacaatgcctcactgaacaatgtccaactgaaaaaaatgagcaccacggaagaacatctcaagatatttactatcgatgccaactggttaatgggagcacctgatgaaaagtaa

SEQ ID NO: 1666 - DNA, 828 bp, Xenorhabdus bovienii
  Coding DNA location: Contig name=SeqID_16865; Position on contig =14804..15631bp; Strand=-
atgtatttatcaaaatggtatatcggactggatgtccatgaacattacattaatgctctcgcagccattaaacgtcgtgatggctggcaacttcgccattgctggcaatatcgtttatcaagcgacattatttcaggaggacggctacaacatcctgaaaaattaggccacattttaatgcaatggcggcaaaaattacctaaaaagattagcttacgattaacattacctgttcaacaaaccttacagaagcagatcgccctacctacccatactctattgcaagaaccagaactcggctggtttgtgcatgccaatgccgaaaaacagttccctgtcagtgatcttgcgttggattatcgggtgcgtggtcagcaaatttgtatcagcgccacccggcaaaaagatctcaacctctggcttaagctgctcgcagacatcgatttatcccccgatgccattgatatttctccctgcgcattacgctatattgccaaacttgcaggcgttcccgatgacggctggttgatccacaaacgcatagcagactggctatgggttgcccccgccagtggcccttttagttatggtctgatatcaatgcaggcacatccgcatctggcacaaatcatcagccagttgcctgtctcaccagacatagctagccctgagatttattacagtgacgaacagcatgctatgccaacagaacccgttcatgtctggaacatgctgaccgcatttcgccattaccagctcccattacccgaaaaaactaatgccttcattatcgctgcggggctggcactgaggccggatgatcgatga

SEQ ID NO: 1667 - DNA, 2529 bp, Xenorhabdus bovienii
  Coding DNA location: Contig name=SeqID_16865; Position on contig =15749..18277bp; Strand=+
gtgaagttcataaagtattttttgatccttgtcgttgtttgcattttattgggagccgcctcgatttttggtttgtacaaatatatcgagccgcagttgccagatgtcgcgactttaaaggatgtccgattgcagacacaaatgcaggtgtacagtgctgatggcgagttgatggcgcaatatggtgaaaaacgtcgtctgccgctaaccctttccgaaatgccacccttgatggtaaaagcctttattgccactgaagatagccgtttttatgaacaccatggtgttgatcctatcggcgttatccgtgcggtttcggtcatgatgacttctggccatgcttcccaaggggcgagtaccattactcaacagttggcgagaaactttttcctcagcagggagaagacgctgatacgtaaggcgaaagaggcgtttctggcgattaagatcgaacaactgttgacgaagaatgaaatcctggagctatacctcaacaaaatttaccttggcaatcgtgcctacggtgtaggggctgcggctaacgtctattttggtaagaatgccaatgagttgactttgagtgagatggcgatgattgccggattgccgaaggcgccttctacttttaacccgctctattcttatgagcgtgcagtcggccgtcgtaatgtggtattggggcgcatgctggaagaggggtacattacccagcagcagtacaatgaagccagaagtgagaaattggttgcccgttatcattcaccacagattgtcttctctgcgccttatctgactgaaatggtacggcaggaaatgattaaccgttatggtgaaaatgcctataccgatggatataagatctataccaccattactcgtaaagtccaattggctgccgttgatgccgtccgtgcaaatgtgattgattatgatgtgcgtcatggctatcgcggcgcacaggaagtgttatggactgtcagccagtcagcatggagccagggccaaattgtcgataagctgaaaaccctgcccaaatatggtccattgctgcctgcggtggtcacgaagtccagtgcgactcaggctgaagctatgctggtggatggcagtaaagttgaactgactatggcgggtgttcgttgggcgcgtcaatttaagtctgacagtctgcaaggggcggcaccacgcagtgtcaatgaagtgattcgagccggtgaacagatttgggtcagaaaagtcaatgatacctggtggctggcacaattacctcaagttaacgcggcgttggtatctctcaaccctatgaatggcgaggtagaagcgctggtcggtgggtttgatttcgagctaagcaagtttaaccgcgtgacccaatctctgcgtcaggtgggttccaacatcaagccattcctgtataccgctgcgatggacaaagggctgacgttggcatctatgtttaatgacgtgcctatcagccgttgggatgcgggagctggaacggattggcgtcctaaaaactcaccgccgacttatgatggcccgattcgtctgcgtcaaggattagggcaatccaagaacgtggtcatggttcgagccatgcgtgcgatgggggtggattatgccgctgactatctgcgccggtttggcttgccgggggaaaatgtcgtgcggacggaatcgatggcgctgggttctccttctttcacaccaatgcaaatggtgcgtggctatgcagtgatggcgaatggcggttatttggttgatccttacttcatcactaaaattgaaaatgatgaaggaaaggtattgtttgaagctaaaccgaaactagcctgtccacagtgtgaaaatattccggtgatttatggtgatacagcgcgttccattgagttgtccgaagattcgattgagaacgtgacccattccaatgtcacgcaaaattcgactcagccccagtcagagttagagcgtgctccggtcaatacgaacaacgatgatcagcagtacgcgcctcatgtcatcagtacgccgctagcgttcctgattcatgatgccttgaataccaatgtctttggtgaaccgggttggatggctacaggctggcgttcagcccgtgatttgaaacgccgggatatcgggggcaaaacaggaacgacaaacagctcgaaagatgcgtggttctctggttatggccctgatatggttgccacggtctggattggtttcgatgagcatagtagagctctggggcgtacacccgccctgaaaggtgaaggcggagcgaaaagtgctcaacccatttggaatgatttcatgaaagtggcgctggaaggtgtaccggtaaaagtgatggaaccaccagcaggcattgtttctgtcaccattgatcgcgcgacgggtaagctatccaatggtgggggcaatacccgtaaggaatatttcattgaaggtacacagccaacggaatatgctgttccagaagcaggaacgacagtcactgagaatggggagagtcaggaactgttctga

SEQ ID NO: 1668 - DNA, 4596 bp, Xenorhabdus bovienii
  Coding DNA location: Contig name=SeqID_16865; Position on contig =18369..22964bp; Strand=-
atgcgcgtcaaagtattggccgagaaaagtgacatctctgcccagcccctgctggatgttgccaagctatcgaaccaatccgactatgatcactggcaacaagtcagcagcgcactgtttgccgcctgcacacaggaagaacaaaccaaactggaaggttctctcaatgaactgtggcgtgatgcccttattgagtatctgctgggacaatgggcgccatcggatgataatttatccgatatcaccaccgttgaagacttatcaaattacttcttgaccgatttgcaagttgccacagaggtcagcaccagcagagtggctttcgctatcgccagtttacaacgctatctgttccgcctgttttcccgtctggaaacgggctatggcgtacaaaccatcagtgatgagcgcattgaacactggaaccgtaacctgagccaatatggtcactggcaggcatggcagaagcaaagaaacttccctgaaaactttatcgaccctgcccgcaggctacgtaaaacccgtgcttttgcggatttggaaaatgatttggggcagtccagattgaacaacaatatgatccagacggctatcctgcgttatttaaccgagtttgagcggatcagtaatctgcaactggtcagtgggtatattgatggcactgatccggaaaatgattattatcactttatcggtaaaaacaacgctaaaccggtggagtattactggcgcactcttgatatcaagatgcgtgatgacaatgatcggatcagcccattggcatggagtgaatgggagaaaatcaccctgtcactgtcaggaacgttactggctctgcgtccaatcgtgatttctggccgccaatatactatttgggttgaacgggaagccagcccgctgatgagcgcagatcaaaaaccatcggattatcgcgccatcaacgtaaaattcacctataagcaaagcaacggtgagtggagcgcaccgaataccctgttccgactggatggtaccgattccaaaggcgaatacccgacaaaagatggtaaacgtgtccccgataacgaaaacccgtatctgaaagatgaaaaatacaaaccggggctgatcgcaatggtggatatacaacgcgaaggcgatccgtggatgggcgtcttgctgtatgacaccacaaaaacagacagtagtgtctggaagaaaaaccaagactatttccttgaactgcgcgacttactgctggtggataaaaaagcactcaataaccaagatgaaaatacacttatctcatcttggtacaaaatttttaaaaactctgacacattgcagcaccattacgtgggtactgagaaatttatcgaatacaaagcaagtgaagacaataagaacctcatattgaagttagacgctaaactcagcggagataaaaccaaactgattctgacagggacaaatactttgattaaaaggaatcccaaaggatacggtacaaaatttaaaattttcaataatatagaatttttgtcaaaacttcctaccgaagactttgatggcactattaaagttgataattctgacaaggaatcaatcaagatacatattcctgccagtcaaaccagtctgaaaacattccatcttacctggcaaggggatcaagcaccaacatcaacatttactgtatcttatggcagcatcatactttttactgtgtctcctaatgaatggaaagacaataccgtgactaaactcgctgagttgaattggctcaatggtatagtttctcagcgaagtgaaacatggaaaccagatacgtcagcacttgttgtcacaacaaagaataaaggttcaagaggtaggaggacatttgatgtcctttataattgggaatacacaaaatcaaaattgacactgacgcttgatacaccttcaggcacagccccaacaattaaggaagtaatactcaatggtagtgccaccacggaagaaatcactatcccgatccgtgctaatatcgacgaatattccttcacactatccgcaacattagaaaccgagtattcaggtgctaaccaacctctagactatacaggtacagtctcaaataaataccagatcatcgtaagagaaagcgataggatccctgttatcaccttaagcaggaatacaaaacaggcacaatatctggacattacgagccttggattccgctccaccgccatcagattaaataccttgtttggcaaacaattagtcgcccgggcaacgcaatccattgagcaggttttgtcatgggatacccaatcactgctagaaccgacgttagatgacagtacatcatcaacaccaatagactttagcggtgccaacggaatatatttctgggagttattcttccacctgcctttcttggtaacttatcggcttagcgaagaacagcgtttctacgatgcccgacgctggctactcaactatctgtttgatccctatgggtcaatgcggatgtggaattctcgccctatcatcgaaaatggcagtaacctgcccccgtcagtgaaagaagacgactctgataccattgcttacagcctgccagtgtattaccaaaaaacgctgttccattttcagatcacactctggatacaggagggagataacctttaccgccaactaacccgagacagcctgaacgaagcaagtttatgctatcaacaggcactacaactgctcggtacattaccggaaggtttggatgtcacccttgaacagatcaaggcagactttgaacccgatgttagggtcgttgatggccgtccttttgtatcgccattcaataatcaattaattgaatatcaaaaaacgctgaatagccgtctgtataatctccgccatggcctgacgctcgatggcaaagtcctgacgttgccactgtatgccggtgccgacgatgataacctcctaatacaacgccacacaggaagttctattagtcagtggaataatctccggcaacaggttccaccttatcgcttcccagccatgttaaaacgtgccaatgatgcggtgaaacagttaattcaaatggggcatcggctattcagtgccatagaaagtgaagtcaatgccgagcaggaagtgctggaacaatcacaggctcttcggttatctgcattcgccattgagctgcaacaggaagctgtccagattgctcaactgggcaaatccacgctggaagaaagtaaaaagatggcacaagagcggtatgatcactatcacaatctgtacgaagagaatctttccgctctggaaatctcagccctcacaatcaaaacatcatcagaagttgtcaaagcaacggcagcccctttctatgctgcgggtgctgcactggacgtcgttccgaatatttttggcctggcagtcggtggaggcaaatactccgcacccatcagaaacgcagccatcatttctgaattggtttctgaagggttatctcttatcgcagatagacttcaggacagcgcagattacgaacgtcggcgccaagagtgggaaattgagtacaaacaggcgcaaagcgaaatcaatattattgaccgccaattgcaggagcaggaggtgctaatcaagagtgccaataccgctctgcgggaagctcatgctcaacagacagccgcccgtgaactgtatgagtttatgacaacggggttcttggtcgttcctacttatcagtggctgatgggacgcctcgctgccctgtatgcccctgcctatgacgctgtgctttcgctgtgtctgatggctgagacaagctggcgttatgaagtgggggattatcagcgcaggagctttatcaaaaccaccgcgtggaatgcttcttatcgcggcctgctggcgggtgaatccttgcagttggatctgctgcaaatggaaaatgcgtggctacagcgcaatgaacgccgcatgaatatcaagaaaaccatctccctcagcgagttgctgacagcgcatgaattacagaatcaaattgaaaaaaaacaggtggtcagctttacactgaatcccaagctatttgataccaattaccccgggcattacctgcgtcagatcaaacggatttccgtgtcaatttcgctaagtaccttgagcgtcacacctatcctgtcaccagaaatcagtgccgtcctgacccagacgggcagttcaacgctgaccagcgcagatattgaaggaataaactggctttatgatcccagcagaaaagcaggcaacaataagaatattgttaccaatctgcgcgcccagcagcagatcgccctctcttccctgagtgaagatgatggcagtgtggcaaaagagaactggctgtacaccctgatgtttgatgatgaccgttatctgccatttgaaggcaccggagccatttcaacatggacgctggcattcccagataagcaggtgatcaataaaatattccgtgatcctctgctaccactggcctcatggcggttaaaagatatcaacattcatgtgcattatacggccgtggatgggggtaaacagtttaccaaagccgtcaaagataaagtgggtaataagtaa

SEQ ID NO: 1669 - DNA, 2817 bp, Xenorhabdus bovienii
  Coding DNA location: Contig name=SeqID_16865; Position on contig =22688..25504bp; Strand=-
atggccaatattctggaatcaagaaccagctataagacgctttttaatgataatcaagatctctactgtctgccgggtttacccgaaaccaatgatgggcctctggcctatctggttgatttgtatcagcagactcgactgtttgagagcgaggctgacaaagacagtgtccgatttctcagccaaagacgtcccgatatcgaaacactgttgcttgatagtacaaacctcaataaaaccagtagtctattaccattgatcattgaagccttggcccaaaaggtcaaggcgcatatcaacaagaaccagcctttgaccaattcactggcagagattcactatccgcttgcactgccgtttcattttccgctgaaacaaaccatcgcagtgttggcagaaaaagagctcccattgtttgaactgatccaacaggccgatcgccaatatcccaattttatcgataacaatctgagttcagactcgctgcaaacagccatgatggtcagcagttcgctggcaccgaaacttcagactctgctacaggaaaaatcgcaaagcgaccaaaaagatttctttgccaaatattacggcgttaaaggggatgcagccgaggccgcgttatctttatctcgtctcaccgtctttacccagcaaaccaacctgagttctcaagaagcggaacggcttttcgccatcaatgggctgtctgacaataaaatcacccacagtatcgtcacctattccagcaatgtcgccaagcccactaatgcgggtaaacagttcccttccggtgccaactacgcagcttcattcatcaatgccggcaccgaaccggccatctatctggcaaaaaccgtagacccgaaaacagcaaaagatgtcgttttgctcaaagaaatcagcaatgacaatttcgatcgcattcagcgtttcctgcatatccagaaagcactgaaactgacgtctgaacagcttgatctgctgttggtaaccgcccgacaagctgaaaaacaacaggatttcgccattactgaagcaacgttacgtgctttgggcgttttcctgcatttccaacaggaatacagcaccacagccgagcaatttgcagcctttatcggccaaattaccccctattcgctcgaaaacaaactgtcattttttgatcgtttgttcaatgcttccggtctgtcacagcaggcagcatcgtcttcagtactggttttagacaatcaggaattcgatccctccacgatcgaagggctggacgcattaaccgtcaatcaattgtgtgctggcctgaagatcgatgatgcgacctgtcagattttactcagcttaatcatgcaggcacaaacgctgaccaaacccaaacgctcactggatgtggtatcggcgctgtaccggctggttgaattaccgcgcctgctgaagttgcccgtcaaagaaggtttgggattgttgttattgttgaacaacgataatccgaactacctgcaacaactggccggagtgcccgtattaagtaaaaatgccgaagatattgatatccttgatgtgatggtccgtgtcatgaatgctgcacaatggataaaacgccatgagctgtctacattatccctgaatctattactgacaccttatcaacccgacgccaatggtgtgactagcgaagatattgagaatatcgactggctcaaaaaagtgatctccattctgcccgatcaacaatatgccttgctgagtgaagataaaattgcggcggccatgatgggatttcaggccaagcaaatcccggttaattggatgaaatcgttttccgaactggttgatgaaaacatgggaattattcagggtgatctagtttcagcagacaatagcgcggaaaaagccttgtctgaaaaggttggaaaaatcctgcaagaactggcagaagaagaagcctggaaagctcaaggagatacgtggactcaaattttgacagttctgatccgcgatgcctttatcgctcagcaagatctggtgattaaagccatcagccatgcgtttaatcttgatgaaaccctctctttgccattattactgtggacaggcaacaatcaggcgactttcctgcgcgattccatctcattggcaactccagccggcgatccccaattgaaggcaaaagccgtcgccacatggtacgacctcaaccgctacaccgcgattgtcaaatcattcaaattgacagcaaaaacgatacaggcgctaatcgggaatccagactggtttggattgcatctgcccgacgataagctacgcgatcttgatctcaccttcttgcatcgactgagccgttatggtgattggctggatttattagccaatcacaaaactgaagacgacgtactctattatctgagccaagccaatcaaataggccaaacgccaccgctggataacatctggacaaccgaggttggacgagcaaagaaatccaacaggtcacaaatggcttcgagcataacgtggcacaaaatgttatcggcatcagcacgattatgcgcgtcaaagtattggccgagaaaagtgacatctctgcccagcccctgctggatgttgccaagctatcgaaccaatccgactatgatcactggcaacaagtcagcagcgcactgtttgccgcctgcacacaggaagaacaaaccaaactggaaggttctctcaatgaactgtggcgtgatgcccttattgagtatctgctgggacaatgggcgccatcggatgataatttatccgatatcaccaccgttgaagacttatcaaattacttcttga

SEQ ID NO: 1670 - DNA, 141 bp, Xenorhabdus bovienii
  Coding DNA location: Contig name=SeqID_16865; Position on contig =25579..25719bp; Strand=+
atgttttttggcagattggtagggttgcactatggcctgtcaatgattgctatccagcctaaaatatattttggatctgatcgttttttaaaaaaacacttgatttcaattggctggattaagtgttttattaatcaatag

SEQ ID NO: 1671 - DNA, 162 bp, Xenorhabdus bovienii
  Coding DNA location: Contig name=SeqID_16865; Position on contig =25959..26120bp; Strand=-
atggaacgcgttaaaacctatcccaatcgacaggtatgtgccttcaagtttctgcttttgctggctgcgtttactccccagtcacatggttatctatatgcctgggaattcactcacttgtcatcgcgctacaacttgaaatctatttgcgataaaaaataa

SEQ ID NO: 1672 - DNA, 564 bp, Xenorhabdus bovienii
  Coding DNA location: Contig name=SeqID_16865; Position on contig =26107..26670bp; Strand=-
atgattgatcagaagaaacctaaaatattgaatataaatgacgttgcccattcccgtttattcaatattcagtctgttaatcttgagttcagcaatggcgtaaagcgactttatgaacgcatgaaaccctccaatcgtgaagcagtactgatcattcccgtgatcggcgatgagttactccttatccgcgagtatgccgttggcattgaacaatacgaattgggttttcctaaaggtgccattgatgcaggagaaagcccccttgaagcagccaatcgtgaactgaaggaagaagtgggattcggggcagccaaactggaactgctgacgaaactgacaatggctccttcctatttttccagcaggatgaatattgtcattgctcaagatctttatcccgaacgtttggaaggagatgagccagaaccactagtacaggttcgctggccaatcgcagatatgatgtctttgctggaacatcccgatttcaacgaagccagaaacgtcagtgccctgttttttgcacagcgatacctgcaagcatcaagcaatggaacgcgttaa

SEQ ID NO: 1673 - DNA, 195 bp, Xenorhabdus bovienii
  Coding DNA location: Contig name=SeqID_16865; Position on contig =26714..26908bp; Strand=+
atgcatccaatcaccgaaagattattggtaaattcaatttttgtgatgaaattggatacgcatccaaactttgctttaatatggccgattatgccagtaaatgacagcgattatcgcttgtatgtatttttgttgctatcttgctgctgcataaaaggctttattttgcgaaatggtgtaataaaatttatttaa

SEQ ID NO: 1674 - DNA, 117 bp, Xenorhabdus bovienii
  Coding DNA location: Contig name=SeqID_16865; Position on contig =26913..27029bp; Strand=+
ttgttaataaaattaaaaatagaaggcaagaatagaaatagcctgaatctgcgtattttgctaggttgttattctgccagtctctttattgctgtcatgggcgtggagaagaaatga

SEQ ID NO: 1675 - DNA, 2109 bp, Xenorhabdus bovienii
  Coding DNA location: Contig name=SeqID_16865; Position on contig =27026..29134bp; Strand=+
atgagttcactagtcattatattggctatttttatcactagcctgattataatggcttcctttctgactttcagatggaagcggcctgataacgcgcgttatctaccgtcaatcgccaaaacagcccatcgtaagctgaatactgatgaatatcaggcaattgactcttatttgcaaaatgtcctgcccctgatgcagccagataggagccacagatcaggccaaccagcactgcctgtcaaaaatgatacggtttataccatcaatcacaccatcaaccgcttttctgccgccactgatgaatcgcagcattggcgctattatgttgatgaaatagagatacatcttcctgcgttacttgagtcattcatcaagcagcagaatacgattgagattgttcagaccacatccatgcctcttgtgattgccgtgaatggccacttcctgaaagattatcagcaagatctgtccattgcgccaatcgtgaaacaaacggcacaggcttcaatccagaaaaatggcaattccagtgccaattttttgtatatccgcaaggaaacgccagaagagaatcgtctgcgtcattcaacaggcattctggaaggcattctcatgtgtattggcttgtcgttctggtttttggctcttttcatgccaacgcccatattaccgtggctaatgttggctgctgttctgtttctgattgccagcttctggccgattttcaggccatcttcttcgcgtaacttgttgaatattagctgcttcagtggtattccgaaacgttgggggatattcagtgaatctgaaccggaacagcggaggaatatctctctgggtggtattgatcttctctatccctcacattgggaaccgtatgtcgttcatgagcttgaccgaaatactgaagttgatatatataccaattgccatgtcgttcggcaggggcgctacctctcattgcatgaggaagaaaaacactatccttatcagcgccatagaaaaaatctgatactggtggttttttccatttttgccctgttggtactttatttttaccagcccgtgagcttatctatgcggctcagttttgcatggctgcatggcagcaatacccaagtcatcaccagcgttactgaactgcaaaatatgcctctgaaggaaggtgatgtactgcgagtcaaaggcatcgggatgtgctacacaccacccagactgaatgataatcccagtggaatcaaacatatatttgccgcgtttgactgcactggcatctactggaataacgatagcccattgcccatgccggaatcagacattatcgaaaatgcatcaacattgattacaacggtcaatgagcaattacacccaattgaacgtagccggaaaaccaaccctggcctgaatgaagccattgcgaaatcgggtatgacactactcgacaatttttcgcaagtcatcttgaagacgcataatttgtgtatggacgagattgattgtattcgtctgaaaagcgcactggtcaatctgagcaatgctgaggattgggatgatctattgaaacaggctgaaagagggaaactgaatggaaccaaagtattattacgttcagtaagtgcagatgcactggaaaagttagttaatactaccacagcatcatttatttatcgggaaattgataaaataagcatgctcctgaacagcccatcgccgggaggcgtcctgctgatcagcgaggaagggaatcagttggttgaattgccttattcatcatttcttgcctatgaatacagcgcactggatcagtggagggaattacagcggctagctgacatattgttgagtgctccatttgaagctgtcggaattgtgacgaaattgtccgaagacgcgaatgggactcgccgtatcaccttgcatagtgaacccgattccgtgactcttattcgttatttgggaagcagcttcttcctggcaatactcatggcgatattgagcatcaatgccattctgatgataagcaaaaggcagagaaacaaggtgcggctccagcgcataggccagtactacgacaattgtttcaactcgaaacagccgccgatggattag

SEQ ID NO: 1676 - DNA, 486 bp, Xenorhabdus bovienii
  Coding DNA location: Contig name=SeqID_16865; Position on contig =29137..29622bp; Strand=+
atgagtctgcgggctgtgttaccctcaatccgttttttgccagcttcgattagacatttgggagaaacaaccatgccgaattcagacaccgatcagactgtgcgcctcgataaatggctctgggctgcccgtttttacaaaacacgctccatcgcgcgtgaaatgattgatgggggaaaagttcattataatgggcagcggagtaagccgagtaaactggttgagttgaatgcagaaattaaactgcgtcagggaaatgaagagaaaatagtgactgttttagcattgaacagtcacagacgcagcgccactgaagcccagcaactttatcaggaaacggaaaaaagcattatcaatcgggaaaaaacggcattggctcgtaaaatgaatgtgctcacgatgccgcaccccgatcgccgccccgataagaaagagcggcgtacactgattaaatttaagaacacgaaattaaacgagtcggaataa

SEQ ID NO: 1677 - DNA, 873 bp, Xenorhabdus bovienii
  Coding DNA location: Contig name=SeqID_16865; Position on contig =29649..30521bp; Strand=+
atgaccaagcatgatcaattacaccgctttttgttcgaaagccattctgtccggggagaactcgtttccgtcagtgaaacgtaccagcggatgatggaaaagcaccattaccctctgcccgtacagcagttattaggtgaattgttggtcgcaaccagcctattgactgccacattgaaattcaacggagatatcaccgtacagattcaaggtgatgggccagtcagactggcggtcattaatggtaataatcaacagcagatgcggggcactgcccgtattgatggtgatgtggatgctgcgagcagcctgcgggatatggtcggcaatggttatatggttattactgttacgccaacagaaggtgagcgctatcagggcgttgtcgcgctggaaggggagacgctggcagaatgtctagatgcgtacttcaaacagtcggaacagttgccaaccagactgtttatccgcacaggaatgctggatggaaaaatggcggcgggtggcatgttattgcagatcctgcccggcgcacaggaaggcagcgaagacctgcttgatcatctggtacaactcactgcgaccatcaagggagaagagctgtttacgctggatgtgaaagaaattttgcatcgtctttatcatgaagaagatgtgacgctgtatgagcctcaacaggttgaattccgctgcacctgctctcaccaacgctgtgctgatacgctggtgacgctgccggatgctgatcttcaggagattttgctcaaagatggcaaaatcgatatggaatgtgaattctgtggtatgcactatattttcaatgataaagatatcagcgaaataaagattgtgaaaaaagaatcgctgcactga

SEQ ID NO: 1678 - DNA, 1620 bp, Xenorhabdus bovienii
  Coding DNA location: Contig name=SeqID_16865; Position on contig =30721..32340bp; Strand=+
atgagcgttaaaggcattactgcgcaggaacttgcggtttatggtatttgtgatgttagcgagattgtttataacccaagttatgaattgttattctctgaagaaactcagccctcactgcaagggtatgagcgtggcacactgacccatcttggtgcagttgcggtagatacggggattttcacggggcgttctcccaaagataaatatattgtccgcgacgatgtgacgtgcgataccgtatggtgggctgatcagggaaaaggtaaaaacgataacaaaccgctcagtcaggaaacttggtctcagcttaaagggttggttacacagcagctttcaggcaaacgtttgtttgtcgtggatgcattttgcggcgcgaatgcagatacccgcctgaaagtacgttttatcaccgaagtggcgtggcaggctcattttgtcaaaaacatgtttattcgtccatcggacgaagaattggttaacttcaccccggattttattgtaatgaacggggcgaaatgcaccaacccgcagtggaaggagcaggggctgaattctgaaaactttgttgcctttaacctgactgaacgcatgcagttgattggtggtacttggtacggtggcgaaatgaaaaaagggatgttctcaatgatgaactacctgctgccattgaaaggtattgcatccatgcactgctctgccaacgtgggtgaagaaggcgacgttgccattttcttcggcttgtctggtacaggtaaaaccacactttccaccgatccgaaacgcaagctgattggtgatgatgaacacggctgggatgatgacggcgtgtttaacttcgaaggtggctgctacgcgaaaaccattaacctctccaaagaagcagagccggatatctatcatgcgatctgccgcgatgctctgctggaaaacgttaccgtgctggcggatggcacagtcgatttcaatgacggttccaagaccgaaaatacccgcgtttcttatcctatctaccatatcgaaaacatcgttaagccagtatcgaaagccggacatgccactaaagtgattttcttgaccgctgacgctttcggtgtattgcctccggtctcccgtctgacgccagaacagacccagtatcacttcctatctggttttacggcgaagctggcgggaactgaacgtggtgtgacagaacctacgccaacgttctctgcctgctttggtgcggcattcctgtcactgcatccgactcagtatgcagaagtgctagttaagcggatgcaggcatcaggtgcgaaagcctatctggtcaatactggctggaatggcacaggcaaacgcatctctatcaaagatacccgtgcgattatcgacgcgatcctgaatggtgatattgaagatgtggataccattgagctgccgatctttgacttggctgtaccgacagcattgccaggcgtggatacaggcattcttgatccacgtaacacctatgcggataaatctgaatgggatgttaaggctaaagatctggcacagcgttttgtcgataactttgacaaatatactgatacagccgcaggtgctgcattggtgaaagcagggcctaatctgtaa

SEQ ID NO: 1679 - DNA, 696 bp, Xenorhabdus bovienii
  Coding DNA location: Contig name=SeqID_16865; Position on contig =32428..33123bp; Strand=-
atgatctacttacgtaaagcttcagaaagaggtcacgccaatcacggctggttggacagttggcatacattttcatttgctgactattatgacgccaatttcatagggttctctgcccttagagtgattaacgaagatgtgattgatgccgggcaagggtttggcatgcatcctcacaaggatatggaaatcctgacttatgtgctttccggtacagttgaacatcgggacagtatgggaaatcaggggcaaatttccgccggagagttccagattatgagcgcaggaacaggtatccgtcactctgaatataatccgcatgatagtaacaaacttcacctgtaccaaatctggatcatgccggaaaaaaatgacctgtctccgcgctacgagcaacgctgctttgattctgccaaaggtcgccagttaatcctttcgcccgatactcgcgatgactcgttaaaagtatttcaggatatgactttatggcgttgggcactgaaaaacggcgaaacagacgaatataatatagaaaaatcgcgaaaaatctggattcaggttgttcgtggcgaagtgactatcaatggcgttcaggcgaccaccagcgatggcatcgctatctgggatgaatttcatcttcaattaattgccagccaagagagcgaaatcctgctgttcgacctgccacctaactga

SEQ ID NO: 1680 - DNA, 117 bp, Xenorhabdus bovienii
  Coding DNA location: Contig name=SeqID_16865; Position on contig =33384..33500bp; Strand=-
atgataataaacatcaatcgaatatcgaaggaaatgaaaggaaaaaacgaagcgatcacattacctacaatcccgtgtaaagatcgactttttagtcatacctctaaatttggttaa

SEQ ID NO: 1681 - DNA, 135 bp, Xenorhabdus bovienii
  Coding DNA location: Contig name=SeqID_16865; Position on contig =33597..33731bp; Strand=+
gtgatttcattacaggcgatctgcggattaacccataaacgctcctatctcgacatttttatggttactgtattagccgggcttctggggctcgttgtggtcattattctcggttcgttattcggctcattttga

SEQ ID NO: 1682 - DNA, 1158 bp, Xenorhabdus bovienii
  Coding DNA location: Contig name=SeqID_16865; Position on contig =33766..34923bp; Strand=+
atgtccactatcgtgttgcctcgcattatggaagtaggcggtggggctatcacccgtcttccgcaggttctgcaaagtatccgcagtaaaaaacccctgatcgtgacagacaaagtgatggttcagctaggttatctagataaactgcaatctattttgcaagatgctggcattgaaagcgatgtttatactgacacagtaccagagccaacggctgcctctattcaggccggaattaagaaaatgaaaagtgatcggtttgatgccgttattgcactgggtggcggaagcgcgattgacagtgcaaaagccatcgctgtgatgggtaaatttggcggcacagtcaatgaataccgtttccctcgtcaattcaatgaaccgggacttcctatcattgccattcccacgacggcgggaacaggatcagaatgtactcgcgtcaccattattactgatgaaaaaaccgatgaaaaattactttgcataggtgccggattcatgccgattgccgctattatcgactatgagctgactatcagcgttccagcaagaactacggcagatactggcattgatgcgatgactcatgccatcgaagcttatgttagccagaaagccaatccctattcagatagtcaggctattgccgctatgaaactcatcggccctaacctgcgcaaggtctatcacgatggcaataataaagttgcccgtgaggccatgatactaggctcgaccttggcaggtattgcattctctaacgcatctgttgcattagtacacggtatgagccgccctattggtgccttcttccatgttccacatgggttatccaacgccatgttgcttcccgctgtcacccggttttctttagatgcagccaaagagcgctatgccgaatgtgcacgcgcactaacttttgcaaaaccaacagacagcgacaatgtagcctgtgaaaaactactaacgactttagtcgatttaaatgaagcgcttttcgtgccaacaccagagcaatttggcattgataaaacatgcttttttgcggttgtggaaacaatggcaaaacaagcggaagcatccggatcaccgagtaataatccacgagttccaaccattgcggaaatggtaaccatttataagcaattgtggaattaa

SEQ ID NO: 1683 - DNA, 1491 bp, Xenorhabdus bovienii
  Coding DNA location: Contig name=SeqID_16865; Position on contig =34949..36439bp; Strand=+
atgagtatcgtaggacattttattaacggcaaggttactgatatccattcacgcttacaggatatttataatcctgccactggcgaagtcagccgtcaggttgctattgcctccaaggctaccgctgaagaagcgattgcggcagcacaagcggctttccctgaatggcgtgatactccgccaataaagcgggcacgtattatgttccgttataagcaactgctggaagagcatgctgatgaaatttgtcgtttgattggtcaggagcatggcaagattattcatgatgcagcaggtgaactccaacgtggtatcgaaaatgttgagtatgcctgtggagcacctgaaatcttgaagggagagtttagtaaaaacgtagggccgggaatcaactcctggagcgacttccagccattgggtgttgttgcagggattaccccatttaacttcccggcgatggttcctctgtggatgtaccctctcgcactggtttgcggtaatacctttgtactgaaaccctcagaacgtgatccaagtgctcccctgtatattggccagttattaaaaaaagcggggctacccgatggtgtatttaacatcgtcaatggtgacaaagaagtggtggatacactactaactgacaaacgggtaaaagcagtcagttttgtgggatcaactcccgtcgcgcggtatatctacacgaccgctacagccaacggcaaacgttgccaagcacttggcggggctaaaaaccacgctatcgtcatgccagatgccgatatggagaatgtagtaaactcactcttaggggctgcatttggttcatcaggtgagcgttgtatggcactgtctgttgcagtggcaatcggtgatgaaattgctgatcagttggtcactcagctgcaagaacgcatgaagtccctgaccattggggttcatagtgataaaaataatgattttggccccgtcattacccgcgagcatcagcaaaaagtatgcggttatattacaagtgctgaacagcaaggcgccaaaattttggttgatggtcgtaacatgaaagtttctggttatgaaaatggcttctttgtcggtgccacattgattgatgatgtcactacagatatggatagctataaagcagaaatctttggccccgttttacaagtcgttcgcgttaaaaccatgcaggaagcgatggatattatcgatgaacacgaatatggcaacggcacttgtatctatacgcgtgatggagaggcagctaactattttgccgatcgtattcaggttggtatggttgggatcaatatcccgctgcccgtccctgtttcttaccatagctttggcggctggaaaaactcattgtttggtgatctctacgcctatggtcctgatggtgtgcggttctatactcgtcgtaaaactatcacgcaacgctggccatccgctaacctgcgtgaaggcgcagagttctcaatgccaacataa

SEQ ID NO: 1684 - DNA, 108 bp, Xenorhabdus bovienii
  Coding DNA location: Contig name=SeqID_16865; Position on contig =36603..36710bp; Strand=+
atggaactctgtatgtcatacatgatatatctaacattaaatggtaagaagcagggcttaatatcagcagggtgttcaacgcttgattctataggaaatcgatactaa

SEQ ID NO: 1685 - DNA, 261 bp, Xenorhabdus bovienii
  Coding DNA location: Contig name=SeqID_16865; Position on contig =36834..37094bp; Strand=+
atggcaatagactccaatgagtcactaaatggtggttttattttttatagaacaagccaaatagggcaattagaattattctacgaagtaaaaattacagaagccactatcacagatatttcctgtgtatacccacactctattaatgatcatgatataatgccatatgaaaaagtcacgttaaactataaatctatatcatggaaccatgtgactgctggaacatcagcttatagcatctgggaagatagaatattgtaa

SEQ ID NO: 1686 - DNA, 270 bp, Xenorhabdus bovienii
  Coding DNA location: Contig name=SeqID_16865; Position on contig =37124..37393bp; Strand=-
atggaggatgtttgcagtattgtttttttatcctttgacattttatttttgcatttctattttttattatttgtttttttaaagttgccaaaacacaataattcaatttttaaatttcttacattttttggtattttaggttttgtcattagtttgcctgtatattggtacggtgatttcaaattaaaagaaaatggatatattacttgttataaaaaatcgttaaatgctccaaaaaaatatgtaaaaaataaaaagctatgtgactaa

SEQ ID NO: 1687 - DNA, 735 bp, Xenorhabdus bovienii
  Coding DNA location: Contig name=SeqID_16865; Position on contig =37572..38306bp; Strand=-
atgaagatctttatgttttttttaacgtttgaagaagctatctattttgtaacaaatatatgtgaaccgaaccctaatttatcatggaaagataatctattttcagtagcagatgttgtaacaacgtatgcgggtaatatattagatggctatgcctttatgcgattagcaaatgaattaagtagtaactttggcgtaagagtaactgaatatgtcaatagatatggaaatagaatgataaagctcacggggaataccggagtcagaagctttttaacagctacaaaatatagagtagatcattggaaggtgatagatataggtataggaacacaagcaatgcgatcgggaataattacagcatctagaagagttcttattgtttcttttctgtatagatcaatggaattattatttagagatgagtacgatatttatgattttttcggaaatatcacgatggatgtagccaaaaccgctgttggagctttggttggctttggggttgttgctggtgcagcaattttttttgaaggtggtgcttttgctttaggagttgctattgtggcgttaggttttggggcttttacgacttgggtgctatatgagcttgatgaccgttataaaattagtaaaaaactgataaactacatgcgtgaaaaggaactagctgaggctgataaattagattatcgtaaacagccatttggttatccttatccacgaataaaataa

SEQ ID NO: 1688 - DNA, 207 bp, Xenorhabdus bovienii
  Coding DNA location: Contig name=SeqID_16865; Position on contig =38275..38481bp; Strand=-
atgttatgtaattttatggggtgtcaaatgagtagaagtgaatttgaaagagcatttatggatggttctattggttttgaaaatggaacattagtacctttaagtgatagcaaattaataagagagaaaagatattctgaacttcaaaatgaatttcaaaaaaaattaaatgacaatgaagatctttatgttttttttaacgtttga

SEQ ID NO: 1689 - DNA, 234 bp, Xenorhabdus bovienii
  Coding DNA location: Contig name=SeqID_16865; Position on contig =38584..38817bp; Strand=+
atgacactgcgttttaagttcctcgaccagccgataagtgttggctatggcgttgaagtttctgtccacatctttactgaagaaaaagttggcactgacaccagtaacaatccctatcgacaacattgccccgccaatcatccaccaaaagtagcgctgaagccggtcataacgccattggagatcgtcctcaaactgccccctatatcttcaaaacggggttcttttttttag

SEQ ID NO: 1690 - DNA, 198 bp, Xenorhabdus bovienii
  Coding DNA location: Contig name=SeqID_16865; Position on contig =38865..39062bp; Strand=+
atgcgtaacacaggaattatgttaaatatgtcacttgtgacggctttttgtatatacaaaaatgtattctatggtgtgacgatggagcttgaatttgaatgggatcccgccaaagcggaaactaattaccgtaagcacgggattcgttttgaagaggcggctcttgtttttgatgatccttttcattggtcaatgtag

SEQ ID NO: 1691 - DNA, 174 bp, Xenorhabdus bovienii
  Coding DNA location: Contig name=SeqID_16865; Position on contig =39054..39227bp; Strand=-
atgctcataacgtttcctctcattccgttccgcttttcgggcgctgataatacgaataacctcagtcccatcttcaaactgtgtcgtgtgagcgaccagaacaaccacacatcctttcacagttccaatcgtctgccagcggtattcgccattttcaaaacgatcctacattga

SEQ ID NO: 1692 - DNA, 366 bp, Xenorhabdus bovienii
  Coding DNA location: Contig name=SeqID_16865; Position on contig =39157..39522bp; Strand=+
atgggactgaggttattcgtattatcagcgcccgaaaagcggaacggaatgagaggaaacgttatgagcatagttagatataaacgaagcgatttaccgcctctgactgaaaacagggagtctgaactgaaagcattgtctggcaaacctgatagtaatattgattacagtgacatcgcaccgctgaatgaagctttctggaagaacgcgacacaagggcagttctatcgtccggtaaaaacacaggcatcagtcaggattgatgctgatgtgttggcctggcttaaagaagcaggaaaaggttatcagacgagacttaatgctatcttacgtgaagctatgatgcgtgatttgcatcgaaagtaa

SEQ ID NO: 1693 - DNA, 105 bp, Xenorhabdus bovienii
  Coding DNA location: Contig name=SeqID_16865; Position on contig =39526..39630bp; Strand=-
atgccaggcatgaaaaaggggactgctcacctcaatggagttaacgtgctaaaaattccgtttcgtgagcggctcccaaaaagcccgatttggcgggctgtatga

SEQ ID NO: 1694 - DNA, 111 bp, Xenorhabdus bovienii
  Coding DNA location: Contig name=SeqID_16865; Position on contig =39646..39756bp; Strand=-
atgttccccgttttttgccgtctttctccggtgaacgacgataacggcgatcgcctatctccttgcctcgagttacttccgtcgagcgtatccagccctgaacaggattaa

SEQ ID NO: 1695 - DNA, 396 bp, Xenorhabdus bovienii
  Coding DNA location: Contig name=SeqID_16865; Position on contig =39804..40199bp; Strand=-
atgattataccgagattgttgtacttcattttttttatttttttcttgtttggatgtattcaacgagaatctcaagacttcttgatgtttaaagtatcagatactgagttttttcatctcaaaccacaatgtgtaaatgatgttatatatgcaggggaagatgaggtgggtaatgattatatcgatatacatgtaaaaaaaaatgaatattgtttgggtaagctagatcaacttcttagatcaaatataggcgctgtccttacaatttatttttcagagcgaaaaatagttagcgcaacaattcaatcagctattggagaaaaatttagaattactgtaccagataggctcacggggattagaatcagagattctcttttaggagtacgattctaa

SEQ ID NO: 1696 - DNA, 285 bp, Xenorhabdus bovienii
  Coding DNA location: Contig name=SeqID_16865; Position on contig =40254..40538bp; Strand=-
atgccttcaagacaagtttatgcgcctcccggttttttcggtccgtggatagatttacaaggatggggcggcggcccacacacaattcgttatagctttgatacgaactcgcaggctccatcaacattttctgtcgagattaattatattgatgagccaacatcgaaaacaattcaaaccttagggccaggtgaatacttagttgttagtaagggcggtgctggtattgacaggattaggtgtcgaagtcatagcgctggtcaaaacgtgatcgtttcttggtag

SEQ ID NO: 1697 - DNA, 159 bp, Xenorhabdus bovienii
  Coding DNA location: Contig name=SeqID_16865; Position on contig =40785..40943bp; Strand=-
gtgagggtcccctttggggttccgatttactccttgacgaatcagcttcgtgtacacgaaaaatacaatggcatagagttaatgcgggattcgcaaattgctagcgtttggcatcaaaacagatcaaagaacggcaagcactgtcagatttcaatctga

SEQ ID NO: 1698 - DNA, 171 bp, Xenorhabdus bovienii
  Coding DNA location: Contig name=SeqID_16865; Position on contig =40887..41057bp; Strand=+
gtgtacacgaagctgattcgtcaaggagtaaatcggaaccccaaaggggaccctcacgatttactccttgacgacactccgactaatacacttgtgaaaggtgttgtgaacacgaagtgggcgcaacacctttcaccgatgacaaaacgaaccaacgttcccggagcttga

SEQ ID NO: 1699 - DNA, 303 bp, Xenorhabdus bovienii
  Coding DNA location: Contig name=SeqID_16865; Position on contig =41133..41435bp; Strand=-
atgtcgaacatggtttattgccgtggttgtggaaaagaaatccacacttccgcaagttcttgccctagttgtggtgcagttcaaaaagaagaaataacaggcgagaaaagcagaataactgctgctctattagccttctttcttggttttatcggagtacataaattttatctaggaaaaataggaactgggtttttataccttattttttgctggacgttcattccttatgttatttcttttattgaatttattatctatttatgtatgtcagataaagatttcgctaagaagtatggttaa

SEQ ID NO: 1700 - DNA, 174 bp, Xenorhabdus bovienii
  Coding DNA location: Contig name=SeqID_16865; Position on contig =41500..41673bp; Strand=+
atgattttcggttgctctgatatttggggtagagccaacagtttcaccatgaaccgccatctgatggaaagctcacactgccaaaacatacacgataaaccgtgttggatggagaacgggaattattgtacgtttagagcattttttaaccgttcaagacacgcaactgattga

SEQ ID NO: 1701 - DNA, 186 bp, Xenorhabdus bovienii
  Coding DNA location: Contig name=SeqID_16865; Position on contig =41675..41860bp; Strand=-
atgagcttcactgtgcgattttttctctttaaacaccagtcttccaaaaaccgctcaaaatcgttttcaggcctttttaggggtgcgcttggagatcggaaatccgaatacgttaagcctgttttttgtaacctaaatacgatacgacgagtgagacaacttataagctatatccatttttgttag

SEQ ID NO: 1702 - DNA, 1539 bp, Xenorhabdus bovienii
  Coding DNA location: Contig name=SeqID_16865; Position on contig =42671..44209bp; Strand=+
atgatctctttattttacatttttgctacaagtttgacgaaaatgcaactattaaatatattaaatcataggttatatcttatgcattcaatccatcggagggtaatcatgccggtaccaacgcttaagcatttcattaatggtcagtatattgagtctaaaggttccgaatattttgatctggtcagcccggtcactggtgaatcttatgcgcgttctcctaacgcgactgtagcggatgttgatgatgcttacgcatcggctaaagaggcatttaaaatctggggacgcagtacaccctcggcacggcagcaggcgttgctagcgctggctgatacggtggaaaaaaacgctgaacgtttgattgagtcgcaaagccgcaatacagggcagctcaagcacctgattgcctccgaggagattgcgacgtcggtggatcatatccgcttcttcgccggtgcagctcgctttttggaaggcaaggctacagcggaatatctttctgatatgaccagtagtatccggcgtgaaccgctgggtgtggtagggcaagttactccatggaactatccgttgatgatggcggtgtggaagatagcgcctgctctggcagcaggtaataccgtggtgcttaaaccgagcgatactacgccggagagtactctgttgctggctgaactgtctgctccgttcttccctgccggcactttcaacgtggtgctgggtaatgccagcgcgggttccctggtcgtttcacacaaaacgccggctatggtttccatcaccggttccgtacgtgccggtttgcaggttgcgtcttcggcggcagctaatctcaccagagcgcatctggagctgggtggcaaagcgccggtggttatttttgctgatgcggatgtggacaaagccgtggagatcattgttaccgcagggtacttcaacgccggtcaggactgcacggcagcttcacgtgtgctggtgcatgaatctgtttacgatattttcgtcactaaactggtggcggcagctaaagctacccgttttggcgatccagaagataaagaggcgctgtatgggccgcttaataatgttcgccagttggagcaagtcacagggttccttgcacgtctgcccgctcatgcccgtatcgaaacaggaggtcgtcaggccgatcgttcgggatattactttgaacctacggtgattactggtctggagcaagaagatgaaatgattcagaccgaaatttttggccctgttatcacagtacagaagttcctaacagaacaggatgctatcgagaaagctaacgatgtgaaatacgggttggcctccagtgtctggacccgcgaccatggccgcgcgttgcgtctgtctcgtgagcttgactttggaactgtctggattaacacccatattcctctcacggcagaagcaccccatggcggcttcaagaactctggatatggtaaagatctgtcggcttatggtttcgatgaatatacgcgtatcaaacacgtgatgagttccaacgactaa

SEQ ID NO: 1703 - DNA, 783 bp, Xenorhabdus bovienii
  Coding DNA location: Contig name=SeqID_16865; Position on contig =44216..44998bp; Strand=+
atgcccataatggatcaaaatagatcttcacgtgacttggtgtcgcgcgcgcaccacgagctgtttactgaccgtgatgtgggggcgcttgaacgttattttgcgccgaatttcatcgaacattccccgttggttaaaaagggtcttgccggattgcgtgagcgggttcaggcacatcctgaactgcaccatgaaatgtatcgcgtcctacaggatggtgacctagttgctattcacggccgttttacggggttagacgagcagccgttggtcggtttcgatctgtaccgggttgccgatggtttaatcgtggagcactgggacggcttagtgccgcagtccgcgcccaacgctagtggccgaactcagttagacggcccgactgaaacgggctatagccatgacagagagaagaaccgcgagctggtggttaactttttcacccgtaccctgatcgaaggacactatgatgagtttagaaactacaccaatggtgaagagtttcgccaacacagccccgatattcccgatggtacggctgcggtcattgcgtttcttaagcaactcaaggatgaagggcagggcctgcattatgcaaaaatccaccatacagtagccgacgggcagtttgttctgagccattcggaaggaagtattgccggagcacgtcacagctactttgagctatggcgtatcgagaacggcaaagtggctgagctttgggatgctatcactccggtaccggaggatgcgcaagcgctgcatcgccacggtattttttaa

SEQ ID NO: 1704 - DNA, 723 bp, Xenorhabdus bovienii
  Coding DNA location: Contig name=SeqID_16865; Position on contig =45052..45774bp; Strand=+
atgacggaatattccatcatctatgcaccgctcgatcaggctacccggactgaacaggttgtcgaacgtttaagtaacgcgatcatctctgggatattacagactgatgagcagctgcctaacgaaaacgagctgtcgcggctgttgggtgtgtcaccggtaactgttcgtgacgccctgaatacgctgcgcgccaggcagttgatcgatactcggcgcggacgtcatggtggtagttttgtatgtcaggttcctgttgaggcaatgcggaaatatcatccgttgcggctgatggcttcaggtgaactagcggatttcagcgagtttcactgtgccgtgatcggccacagcgcgaggcttgcggctcaacgttcaacaccgggtgaactgagaaagcttgggcaactgatcgacagctttgcggccgcaacgcaaccggatgcccgtatacagacagatatgcgctgtctgttaaccctggcatcccagtcacagtcggctaggcttgccaatcaggagctggagattcaggccgaatggacgcctttgatggggcttctgtaccgagaggttgccgttcacagcgaggttaccgccgcctggcgtacactcttggctgctctgtataagggtgatgacctagcctgttaccagttggcgcagaagatgattacccaaattactgaccacttgcttgaatgcaaaattcttgcagagatctga

SEQ ID NO: 1705 - DNA, 753 bp, Xenorhabdus bovienii
  Coding DNA location: Contig name=SeqID_16865; Position on contig =45821..46573bp; Strand=+
atgtacaacgatatacacgtagaacgggccaggagcatcctggacgatattctggtcacggcgcagcaggccaccgccgctctagcggataagacagcgcgtattctattggcgctgccgttatatcatacggcaggtgtccgcttggcgcgggagcaacgcggcgcattgcaaaaacatatccacgatgtactgcgtaataacgcctggtgtaacggggcgggatttgccagttatgcggtcccgaaaacggttgaggaggagggggggtactggacgctggagtggtggcgtcaggaaggggataccattcaatatgcgccgctggaacacaatcaggagcagcgcaggcgcctggatttccgattgtttgagtggttccggcagccggccaactgtcatcttcccgtcattgacggcccctatgtggattatgtctgcaacggcgcctacacgattacgatagcccatccggtgcttattggtggggagtttgttggtgttgcggcggtggatatgctggtctcgacgttggatcggttacttctgccggctctgggcgctatcggtaagccagcattgattattaatgacgatgcgcgtgtcgtgacttcgacagtgccgggagtgcgttcaggttcgttattgaagagccaaagcgttaaccggtcggccgatggtgaagtcccttcactgcgtctggtaattttgccgtcatcacacactgaatcacacagggcgtttgtctgctga

SEQ ID NO: 1706 - DNA, 1284 bp, Xenorhabdus bovienii
  Coding DNA location: Contig name=SeqID_16865; Position on contig =46610..47893bp; Strand=+
atgactgaatctatgttagctaaaaggcgcagcgcggctatcgcaaaaggcgttggcgtgaccacacaagtctatgttgagcgtgcggaaaatgctgaaatctgggatgttcaggggcaacgctatattgattttgccgccggtatcgccgtggtgaataccggccaccgccacccgcgcgtcattgccgcagccagagagcagctggaacagtttacccatacttgtcatcaggtagtgccttatgaaaattatgtagcgttagccgaacgactgaaccgtctggtgccgggtaattttgtgaagaagaccgtctttgttaccaccggggctgaggcagtagaaaatgccgtgaagatcgcgcgtgccgctaccgggcgcagcggcgtagtggctttcagtggcgcttttcatggccgtactttcctcggtatgtcattaaccggcaaagtcgtgccgtataaaatgggattcggcccgctggttagcaacgtttatcgtatcccgtttccgatagagctgcacggtaccagcgtggaacagacgctgaacgcgctggataatctcttcaaaaccgatattgagccgacgcgtgtcgctgccatcatcatcgaaccgatacagggagaaggcggcttctatcctgcgcctcctgaactgctcaaatccctgcgtgaaattgccgatcgctacggtattgtactcattgctgatgaaatccagaccggtttcgcgcgtacgggcaaactgtttgctatggaatatcatgaggttgcagccgatttgaccacgatggcaaaaggtctggcggggggattcccgctggcggctgtaacgggacgagcagagctgatggatgcggtagtacagggtggtttggggggaacctatggaggtaatccggtggcgattgcggctagccatgcggtgctggatgtgatcgaagaagagaagctggctgcgcgtgcgacgcagttgggagagcggctaaaacaatgtctgcatgaactgcggccgcgtgtcccgcagatcgccgacgtgcgtggacttgggctgatgattgcggtggagtttaaccgtgcggacagtcaggaacccgatgctggctttaccaacgcggtgcgtcagaaagcgctggagcggggtctgattctgctgacgtgcggtatacacggtaacgtgatccgtttccttccaccgctgactatacaaaatgatgtttttgacgaggcgctcaacgttctggagtctgtgctgctcgatctgaaccgtaccgccgtttaa

SEQ ID NO: 1707 - DNA, 399 bp, Xenorhabdus bovienii
  Coding DNA location: Contig name=SeqID_16865; Position on contig =47976..48374bp; Strand=+
atgcactggtatttaaatgtattaaagaactatgcctgtttcagggggcgagcccagcgtaaggcgttctggtattttgttctgtttcagattctggctgttctcatcatttctttcctggaaaggctgtttgctgttgccaatcccgaaatttatatggggtggttcagcgctatctatctgctgctcacctttttgccagcgctggcggtaaatgcccgccgcttgcacgatatcaactgtagtgcctggtggctactgttacatcttatcccgtttgtcggcactgttatcttactgattctcgccgctctgaaagggcaggcgggcagcaataaatacagttcagggaaccggatccattcacagggaaatcccccgagccaggctaacgggtaa

SEQ ID NO: 1708 - DNA, 1542 bp, Xenorhabdus bovienii
  Coding DNA location: Contig name=SeqID_16865; Position on contig =48400..49941bp; Strand=+
atggcaatgaacagaagagattttatctctactgccgcgatcctcgcaggggcaggagcactttcatctctacttcccaccacccctctgctcgcccgaaccttaactgcggccgatgcttcggctgtcaatattgaccaactccggccgatgctgttgcaggatgcacagtacagaaccagccggttggggttggatccgcgcatttggaactggcatagagacgtggctgccatagccatgccagccaactactatgaggcctccctggctgattggccggcttttggaagctttcctagagaccagaattgtgaggttgtggtcgtcggcggcgggttgctgggggcttccactgcgctgcatcttgcagaagcgggcgtggatgtgattctggttgaaaaggataacattggttcgggagcctctggccgtaatggagggcagatgacccccggaattgctcgctgggaagctgaaactatgttggaaaaattttcacccgatgaggccaaacgtttatggcgttttgcatcggttgaagcgatgaatcttgtggatgaactccgcgagcgttacggttttgaatgtgaccgcaaatatggtcatattacagcagcgatacacccgggtcatatggggccattggtggctaatgccgatgcccggcgccagctgggagatacggcggtgaaggttattgggccacacgaattgcgggaagagtatgtgcgttcgaatatctatcatggtgccaatatcgacagcatcggtggacaggttcagcctctggcgctgctgcgaggcctaatttatggctttgccagactgggtggacgagtctatgacagcacgaaagtgaagggcatcaggcaggatgccagcagcgcggtcatagaaaccgaacggggagttatcagggcgagtaaagccgtggtactgggagtgcatggctccaccgaagagtttatctccggcccttccactaccgtgccttttttcacctatgtggcggtaactccgccgttgtcggtggatatcaaagaactgatcccgtcaggtctgccagtctacgatacacagttacagatagactattatcgcgaggtgcgcgacaaccgcctgctgtttggtgggcagggcactggcaactcctggtcatcgcgtgatgtgaacaactatttgcttgatcgtatcagaaccgtgttcccacatctggaaaaacccgaattggaatactcgtggggcgggatcagcgatctgaccctgaacggtgccaccgatgcccgtaaaagcggtgacagcgtcccagtatatatggtgcatggctggagcggtcatggagtggcgcagacggttcgtattggcaaagccatcagcgacgatctcaccgaacgcaatcacgactttgccatgcttactcgcatcgaacactcgagtattccgctgggttcccatttctctccggtggctatcccattgattaaaggcgctctaggagtgataaacacagtgaatccggcagatatggtttcgttctga

SEQ ID NO: 1709 - DNA, 114 bp, Xenorhabdus bovienii
  Coding DNA location: Contig name=SeqID_16865; Position on contig =49992..50105bp; Strand=-
atggtcaacacagtttgttattttcctgctggctcagcgcagtcgatttcgtcgagtgaaactgacatttattgtctctgcacagagccatcgaaactctcaatttacgaataa

SEQ ID NO: 1710 - DNA, 123 bp, Xenorhabdus bovienii
  Coding DNA location: Contig name=SeqID_16865; Position on contig =50209..50331bp; Strand=-
atgataataaattctttcacaaagaaactatttttcatcgtaaaaacgtctggattggttaggtactggcaacctcttggtgttgtgatgctcaattacgaactagcaaaacaagtatcatga

SEQ ID NO: 1711 - DNA, 843 bp, Xenorhabdus bovienii
  Coding DNA location: Contig name=SeqID_16865; Position on contig =50334..51176bp; Strand=-
atgaatagaatcctgaatgtatgcgtggcgctgtgtcttacagtgattccagttgaagcagtaaaggcagatattactgcgccgattgtttaccttgagcatgtaactccttctatttcgctcaatatcaatggtaaagaagttaataagctttcaattgatactggggcatccggtgccttttatctccctcaaactgtctttgattcgatttttccagagctaaaccatcgcacaacagctgtgcaaaattccattgatgtttttggagttgagaagtctgctgtaatggcaagagcagccaatattactgttaatggtgaacacctttcagatgttaacgttgaaattttcaaaacgtggggtaacggcatgttagacgacaacggacaactgatcatagatggagtgctagggctgggtgtcgccaaaaacaaaacgcttattatcaactacgcttcaaaagtgctgacgataaccgaccatcttaaagcgcttcctgatggctaccgctggcaatctatcccgtttacccgcacaaggaacgggatagaaatcagtgtgtcatcgggtaatgagaagatacgtcgtatggttattgatactggcgcaagccatacaatgattttcactcgctcaaaggaggggtgtgctaagttatcgcagcactgcccgaagaaagccattgtgacgcctgacggcgttaagctctctgcgtttatctttcagattccagatgaacggatagattttgatggcctgttaggcgatgactttctttcaaacagagttcttatcatatcgaatgatcgattgttaattagcttgcctaataacagttaa

SEQ ID NO: 1712 - DNA, 1176 bp, Xenorhabdus bovienii
  Coding DNA location: Contig name=SeqID_16865; Position on contig =51601..52776bp; Strand=-
atgacttacgatttcgatgatgtgattgatttttctaaatctcatctactcaaatgggaatatccgtcaccttatttgccatccaatacagatgaagcacctctcccgttatggattgctgatatggattttcaatgtcctattgaagtgcgaaatgcgctccataactctataaaccaaggagtttttggttatagcaaagcaagtgacagtctttttgaggctattatgcaatggcaattgcagcaccatcgctggccagtaaaagaagaatggatcatacagagtccgggtgttgtgaacagcttgagtttaattattcaaacttttactcaattgggagatgaaattttaattcaaccaccgatttacagccccttttatcagtgtgccttattgaatggaaggcggatagtaacagcaccattagttgaaaaagaattgggatacacactggatcttgatgtatttgaggcagccattacccccaacacgaagctgttttttttatgtaatcctcataacccaactggatacgtatggaataaagatgaattaaccgcaatgggggatatttgtttacggcatggcataatgatcatctctgatgaaatacatcaagacttgatcctttctacagataaaaattatttgccttttgctaacatctgtgatgaattttctgatacctgtattacttgtacgtcccctagtaaaacattcaatatggcaggattacagacttctaatttgtttattgccaataaaaaaatccgcaaaaaactaaaacacacttatacatgttgttcattacacatccccaatagattaggactcgttgcctgtgaagcagcctatcgttatggggcatcatggttggctgagttattgagatatttacgtgacaatcggatgttattacaacaatgtcttgggcaactttctaaagttagacttttcgatgcagatgctctttatcttggttggatggatttcagaaacagtggcattgcaccagaaaatttgcaacatgagttacttaaccgtgctcatttatggttggatgatggaataaaatttggtgcagattatgccggatttgccagaatcaattttgcgtgctcccgctcaacaatagatacagctattcagcgattgaaccgactctttgagtaa

SEQ ID NO: 1713 - DNA, 960 bp, Xenorhabdus bovienii
  Coding DNA location: Contig name=SeqID_16865; Position on contig =52835..53794bp; Strand=-
atgcggggggctttttatgtgttaggaagtattaatgtgtattttattcatagttttcctttgctcatagtattgcgcttgattcaggggtgtggtgcaggagctatgtatgttgctattttcgctagtgttcctattcgcttcaagggggcagaagtaggaaaagtatttagcatgcttaatggagtgatcagtctggtgcctatactggccccaatgataggaggaaaactagctgtacattatggctggcgatctgacttttatgtcttggggggggtcgggttattatgttgtcttcttgccttatggaaaccattaccgaaaaggcatagaaatacttctcttttgttggtaaagatattttcaggatatttagaggtattgcgtcaccctaaatttttacttggatgtttgacgagtagctttggattcgccactcaattgatcttcttttcaagctcccccgtagttcttattgaaaccctaaatatcccagttgaccggtttggttattattttgctattaatgcaattgccatcactgttggcagcttgctaactgctcgattattagggcgaggaaaagatatcgccatgttgtatggtggggctctattattattgttggctatgattggttttgtcttgaccatttatcttttaaaaatatcagtttggtcgtatcttatttcagctacattgggaagtttgggatttgccatattgcttggtactgggacaactattgctttatctccatttagtcatttatctggacgagcttctgcattaatcgcgacaatacaaatgtcattttcatcattaattgcctggattgttatgaggtattggagtagtgattggttatcaatgataattacgtattttctgttagcctctgcgattttggcggtgatatatatatatcggattaataatcctaagagctctcaatga

SEQ ID NO: 1714 - DNA, 258 bp, Xenorhabdus bovienii
  Coding DNA location: Contig name=SeqID_16865; Position on contig =53770..54027bp; Strand=-
atggtaaagaaaaacagtattgtaatgcagtttgtctggttgattccgctggtaattgctgcccccttaggattggatatctgtttgcctagtataccgatgatatctcgtgaattaggcagtttacctgagatgaatcaatggttgattagtggatttatactgtgtttgagcttcagtcagctgtttttcgggccgatggtcgatcagttcggctctcaacgtgtgttgctatgcggggggctttttatgtgttag

SEQ ID NO: 1715 - DNA, 1143 bp, Xenorhabdus bovienii
  Coding DNA location: Contig name=SeqID_16865; Position on contig =54027..55169bp; Strand=-
atggataaaccaatatcttcttatgaagatatttcaacatccattgacaaatcaataaaaattgcagaagactatcatcttcttaattctctgtatcagaaaaaacaatgtgaaaatccatatcaagttttttctttaatggctcaacgtagatatcaaacatcctttgatatcataaaaaaatatctttcagaatgtttttttatgacaaattgcccagtcacaaatgtacaaacttttcattctgatgggcaatggcgtatgccaacggaaattatagaacaacattatcatccttataatcaaggttatgggaagtgttcacatagtggttatcattactttgatattatcccctttgtattagaatctgctattagtgaagaaaaacaatacgacaatattgacgtttttgcgacagcagtccgtcctaaggatgttctcagccagtttagtttaaatgattaccgaaaattatttggtcagcatacctttgataaggctaatcactatgatgaaagccaattggattctctcttaggtgcttttggtgaaatcgattgttgcagtaatgtttcctttaaacatggcgataaaataattactactgcttcgataaatttgtgtcacaatggatattcacagcgaaattgggtaacggccgctggccgggatctttataaaggtaatgggcgcgttgctcatgagtctcatgtttttcagcaaggcccatttcaatccattcactttcattcatataaatcaaatgagcctccagttgcaaattatcgtatagggacgaaagaacatctagaaatctatatttttcgcaaccataaaatgcttgggggggaacatattgaagttttcaatattgatgacattattgcaatagaaggtggacgaaaaggaataaaaggaaaagctaaaggcaaagcgttttacgaattcatctcagggataagaggtgaaattgctgcgtcgaatatggtttctgattttagtaaacatgaaattggatctacattgacatcagcaatttatcagtccatatcccatcaatatcatcggttaaatcctctgattaatcgttgttttcacattaaacaaaatgttcctaaaacagaagagcagatttattga

SEQ ID NO: 1716 - DNA, 312 bp, Xenorhabdus bovienii
  Coding DNA location: Contig name=SeqID_16865; Position on contig =55220..55531bp; Strand=-
atgctaaatagtaatcatacggtcaatctgttattgattggctttggtccacatagcaagagaatatattatccattactggaagatgcaatggatgatcctaaattaaatttatgtgcagctgtggatttgatatcggaaaagaaaaatataaaattatacttatctgggaaaatgttgcagccagaagtaacttatttaaataatgttaataataatcaagatgaattaagtttggatgttcaaatagtattgaatgaaattgtgaaaaacacgctattaatggtgttattattgcaactgaacctctag

SEQ ID NO: 1717 - DNA, 1719 bp, Xenorhabdus bovienii
  Coding DNA location: Contig name=SeqID_16865; Position on contig =55543..57261bp; Strand=-
atgaaagaaatagtattagcaattaatatacctattttggtcgatgggtcggtgacttatgatggaaatgtcgtattagctgatagaaatcaggttattatggcgattgctgaagaacgagtttcaaagaaaaagtatgatggacaagtgactaatgcagtaaaagaaattttatacagaaacaaattgacattagatgatctctccgcaatttctgtagttagtttcgggcaacctatgacctcctcaggtgcgatggccaataatcttaaaaaatatcttgatagtttatttctcggattcgaaaaaattcatattgtgaaatctcatcatgtagcccatgctatgagcgctgtttgccaaactgatgttaagcgtgcattggttgttgtcgctgatcataccggcaatattattggtgaaataactgatacgaaagttttggaaaataattcagctgaacaggtcagttattatttgtatgaaaataacgacttgaaattgcttgctcaggacaatacacaaccttgcgatcagggatatggtcggttttatggtgatgtgacttgttatctaggatttgacagctatcgtgagtcaggaaaaacaatgggactggcttcatttggtgatcctgccgttttttcatgttatccggcatttactgagacgaaaactggtgttgtgtctgaattaaaagatgagaactatgtttatgattgtacaaaagacattcaaaattggttcagaaaacaaggagtccatattcctgaaaggcgtcataaagccggcgttattcgtccctttgatatgcacctcgcggcatgggctcaggatcaactacaaaaatcaattatcaatcgagtaaaagaattaatcaataaatatcatatcgatacagtatgtgttactggcggtgtggcaatgaattctgtgatgaaccgtaaattagaagaagaattgaatatcaatgtttatgttcctccttcacctggtgatgctggattagctcttggggccgcagcggagtatttttggaagcaagataaaaaaatatctaaatttaattcttcaccttatttaggtcctgtttattcagaagatgaaattttagaaagtattttctcttataaaaatgaatttgtcattcaaaaagtaaatgaccctgaatatcaagctgcacggatgattgctaatggtaaaataataggctggtttcaggatcgtagtgaatatggccccagagctttaggtaatcgtagcatccttgcttctgcatctaacagttggacaaaagaaatactcaatagtcagattaaattacgtgaatggttcagaccttatgctcctgtggttttagaggaaaaggcggatatttatttcaacatgttgtctcccgtgccttatatgatgaaagtagctcctgtgaaagcacaagcaagacttgatatacctgcttgtatccatgtagatggaacagcgagattacaaactgtctctgctacttcgaatcaaaaattttataaccttattaaagaattggataaaataacgggtataccagtagtactcaataccagttttaatttagcaggaatgcctattgtagagtccccagttgatgcgattaattgttttagacaatcaataggcatggatgcactattcattggtaattattgcttagaaaaaaacacattatttaataaaaatatttaa

SEQ ID NO: 1718 - DNA, 834 bp, Xenorhabdus bovienii
  Coding DNA location: Contig name=SeqID_16865; Position on contig =57277..58110bp; Strand=-
atgtttaaaaatttttatgatggtaaaaacatccaattttgggatgaattagcaaaaattcattttgataaatctgattacaacattgatagttatgatccacaaaaatataaattaaaaagcattgagatatctgaattaggaaatttaacaggaaaaaaagtccttcatttacaatgtcatattgggttagatagttttgctattgaaatgttaggtgcaaatgtaacagcaattgattattcttctgtagccattgatactgcaaaatgcattaaaagaaaatttggtttaaaaacaaaattttattgtgctaacgtttatgatttatcttctcttaatttaggggagtttgattttatttttacctcttatggagttatcatttggattcagcatttaaatttgtgggctaaaacaatatcctcgcatttaaaatctggtggtgaatttattattattgatgatcatccttttgctcgtatgctcagcaatcctagccaggacaatacatcgttcaataactcatttatttccttccatcatctatccggtgatccgattaaggctaattataaatattcttatgcaaacagggatgttctattaaagaatcaagagcaatacgtttatttccatagcctatctgagataataacaagtttaataaacgaagatatgcaattaatgaaatttaaagaatttgataaaagtttctacaaagcgttctcacagctatttgaaaatgaagaaggatggtggtgttttgaacataacaccatctcgattccattaatgtttttattaagagtaaaaaacattaaaaacagttag

SEQ ID NO: 1719 - DNA, 510 bp, Xenorhabdus bovienii
  Coding DNA location: Contig name=SeqID_16865; Position on contig =58256..58765bp; Strand=+
atgggctcagccaataaggctactcatgggaaaatccgaactgttatccccataacagagaaggatttaaccatgagtagattcaagaaagcatcgcatgtactttggtgttgtcaatatcatatcgtctggacgcccaaataccgatttagaatactgaaaaataatgtaggaagggaggtctataagcagatacggatttcatgtgaacaactcgagatagaaattgtagaattgaatgttcaactcgatcatgttcatcttttggtaaaaatacccccgaaattatctgtatctcaggtgcttgggcatttaaaaggacgaacagccattcgattatttaataaatttccctatttaagaaagaaaaagttatggggaaatcacttttggtcgagagggtactgtgtagataccgtaggtgtaaatgaagaaatgataaggaagtatgtgaagtatcaggaaaaacatgaacatgaagacaatcaattatcgttaaaagggatgtga

SEQ ID NO: 1720 - DNA, 186 bp, Xenorhabdus bovienii
  Coding DNA location: Contig name=SeqID_16865; Position on contig =59145..59330bp; Strand=-
atgatccaaggaagaaatgaactgattctcggtgtgaaagataaaacctattatcaaaaactggatgggtttcatgttttggataaaccactgcctgccaaaaaaatctgtactctgcttaagaggagaattcctttcgtacaaacacttatcaggcttaaagatgacgaaaagcttctgaaataa

SEQ ID NO: 1721 - DNA, 1260 bp, Xenorhabdus bovienii
  Coding DNA location: Contig name=SeqID_16865; Position on contig =59440..60699bp; Strand=-
atggaaaaatttgatgtagtgattattggtgctggcgcggccggtttgttttgtgcggctcaggcagggcaaggggggttaaacgctctggttctggataacggcaaaaaagcaggtcgcaaaattttgatgtccggtggcggacgctgtaatttcaccaatatgtacactgaacctgccgcgtatctttctgccaatccgcatttttgtaagtcagcactcgctcgctatacccaatgggattttattggcctcgttcaacgacacgggatcgcctatcacgagaaagccttaggtcaacttttctgtgatgactctgctcaacagattatcgacttgcttttgaaagagtgtgaggcaggtcaggtgactgtccggttacgcagcgaagtgacacaagtcgaaaaagacgagcagggttttgtgattacgacggcagggaaaaaagtaagcacacactcacttgttgtagcatctggtggcctgtccatgcctggattgggcgcgtctcctttgggttatcgcattgcggaacaattcggcctcaatatcttgcctacccatgcagcactggttccttttaccctgcataaaccgttattggaacaactacaaacactctcaggtgttgcggttccttcaattgttaccgcaaaggacggcacagtattcagagaaaatatcctgtttactcatcgcggactttccggccccgctattttgcagatttccagttattggcaacccggtgagtatgtgagtattaacttactccctgatatggatctggatgcgtttttggataaagagcgggaatcccatcctaatcagagtctaaagaacacattggctaaattgctgcctaaacgtttggtggaatgtttgcagtctcttgagcaattgccggatgtttccctaaagcagcttaatcctgctcagaaaaaggaactgatcgctaccctgcaatgctggcaggtacagccgaatggcactgagggatatcgtacagcggaagtgacgatgggtggcgtggatacgaatgagctgtcgtcaaaaacaatggagtctcataaggtgaaggggctgtattttattggtgaggttgtcgatgtgaccggctggctggggggatataacttccaatgggcgtggagttccgcgtgggcttgtgcacaggcgctgttgtgttgtgtagaaacaataaagttagcccgtaaggcttgcatagtgtcattttcagaagacgactgtaccaattga

SEQ ID NO: 1722 - DNA, 168 bp, Xenorhabdus bovienii
  Coding DNA location: Contig name=SeqID_16865; Position on contig =60628..60795bp; Strand=+
ttgccctgcctgagccgcacaaaacaaaccggccgcgccagcaccaataatcactacatcaaatttttccattcgtttgtctcttttggccgagttattttgcaggaaatgtactttatcgtggggaactgtccgcgaactacggagaaaaagatatatttggtttaa

SEQ ID NO: 1723 - DNA, 1530 bp, Xenorhabdus bovienii
  Coding DNA location: Contig name=SeqID_16865; Position on contig =60961..62490bp; Strand=+
atgcgccgcgttcatgtcctactaactggcttaacgtttatgctacatctgtttactggcctggatttttataccagcctaatgttagtacttgctctgttgtttgtgcttttctatgaagccatcaatgggtttcatgataccgcaaatgcagtagcaactgttatttatacccgcgcgatgcgttcgcagtttgccgttgtcatggcaggggtttttaactttttgggtgttctccttggtgggttaagtgtcgcttatgcgattgtgcatctattgcctacagatcttctgttaaatgtcagttctactcacggcttggcgatggttttctccatgctgctggcggcaattatctggaatttgggcacatggtatttcggcattccggcatccagctcccatacgttgattggttccattatcggcatcggtctgaccaatgcgatcgtgaccgattcttcggtagttgatgcgctgaatatcaccaagatgatacagattttcatgtccttgatcctgtctcctatcgttggtttggcgatcgctggagcgatggtatttttactgcgccgttactggagtggtactaaaaaacgtcgtcgtatccatatgacgcctgctgaacgtgaaaaacaggatggtaaacgtaaacctccattctggacacggactgcgctgattctttctgctgtaggagttagcttctcccacggtgcaaatgacgggcagaagggtatcggcttgatcatgcttgtgctgataggtgtcgcgcctgccggcttcgtggtcaatatgaactcaacgagctatgacattacccgtacccatgatgcagttgcctctttgcaaaagtattatgtgcagcacggcccggcactttcccatgctattgagctgaccccggccgcttcttcagtagaagttccggtggatcagatgctccattgcgataacgcacaagcgcagaatgtgctgaatacggctgctgtgatgctgggaagtattcagaacttcagtgagttgaccccagaccaacgtaacaatatgcgccgtatgttgatgtgcgctgctgatacggcgggtgctgtggctaaactgtctgaaaccagtcttgaagatgcccgtttcctgaataaactacgcaaggatttgctgaataccgttgagtatgccccgatgtggatcatcattgctgtggcactcgccttgtctctgggcacaatggtaggatggaaacgtgttgctgttaccatcggtgaaaaaattggcaaaaaaggcatgacctatgctcaaggtgtttctgctcaggtcacggctgccgtttccatcggggttgccagttatacgggtatgccagtgtccacgacgcaggtactctcttctgcggtagcaggtacgatgctggttgatggtggtggtgttcaaagcaagactattaagaacatcatgctggcgtgggtactaacgttacctatttcaattggattatcaggcatcttgtactggattgccctgcaactgatctaa

SEQ ID NO: 1724 - DNA, 330 bp, Xenorhabdus bovienii
  Coding DNA location: Contig name=SeqID_16865; Position on contig =62573..62902bp; Strand=-
atgttcaatattattgcattcttctgggcagttagccttgtcggtattgttaacgtgatccgctgcttatcttcgctccgcgtattgttgtcaatcttgcgccaatcagatccgatgctatatcaatccgttgatggtaatggtttttttacaacccacggtcaattcaataaacatattcggctggtacactatatcaattcacaaggttatctcacccatcacgacaccaatgtcatctttatctacgaaaggttacggaagcaatttttattgacgggaatgttatgtggagctgttgtgctatgtctgatagccatggcaatttga

SEQ ID NO: 1725 - DNA, 432 bp, Xenorhabdus bovienii
  Coding DNA location: Contig name=SeqID_16865; Position on contig =63098..63529bp; Strand=+
atggcttacaaacatattcttattgcggttgatttatctccagaaagtcagattttggtagaaaaagctgtttcaatggcgaaaccgtacaatgccaaagtttccttgatccatgttgatgttaactactccgatctttataccggtctgattgatgtgaatcttggcgatatgcagcagcgtatcgcggatgaaactcgcaatgctctgaaagatctgtctgtcaatgcagactatgagatccaggaaacattgagtggttgcggtgacttagggcaggttcttgttgatgctatcaagcaatacgatatggatttggtcgtgtgtggtcatcatcaggatttttggagcaagttgatgtcatcagcccgtcagctcattaacaccgttcatgttgatatgctgatcgtgcctttgcgtgatgaagaataa

SEQ ID NO: 1726 - DNA, 102 bp, Xenorhabdus bovienii
  Coding DNA location: Contig name=SeqID_16865; Position on contig =63568..63669bp; Strand=+
atgcaggcgatttttttgtctgaagaaaagatgatgagactgttttggaaattgtcaaaactatttttaaggaaacttataaaaatagttgttgaaatttaa

SEQ ID NO: 1727 - DNA, 1344 bp, Xenorhabdus bovienii
  Coding DNA location: Contig name=SeqID_16865; Position on contig =63787..65130bp; Strand=+
atgaatatttcaccctctttggtctcatttcttgattcgattcagtctcacaacccacatcaaccggaatatttgcaggcagtgcgggaagtgttgacatcactctggccttttcttcaacaaaatccgcaatatcgtgagcaaagcctattggaacgtctgatagaaccggaaagagttatccagttccgtgtctgttgggtcgatgatcagggtaaagtacaggtcaaccgtgcatggcgggtacagttcaattctgccattgggccatttaagggagggatgcgttttcacccttctgttaacctttctatcctgaaattccttggttttgaacagaccttgaaaaatgcgttgacgacactgccaatgggcggcgcaaaagggggttctgatttcgatcccaaaggtaaaagccacggggaagtgatgcgtttctgtcaggcattgatgacagaactttatcgccatctggggccagataccgatgttcctgccggagatattggcgtgggaggccgagaagtggcctttatggcaggtatgatgaaaaaactgtccaacaatacggcatgtgttttcaccggtaaagaactctcttttggtggcagcctgatccgccctgaagccacaggttacggtctggtttatttcacccatgagatgctcaaacgccacggcatggggctggaagggatgcgggtatcggtctctggcgcggggaatgttgcccaatataccatcgaaaaatgtatggaactgggggcgaaagtcgtcacagtatcggattcaggcggcactgtgctggatgaagaaggcttcacgccggagaaactggctcatctcgaagagattaaaaatcaacgctacggccgtgtggaagagtatgccaaagagcgcggattaaccttcctgaaaggccaggatccgtggtcaatacctgtcgatatcgcattgccttgcgctacccagaatgaattggatctggatgcggcgaagacgctgatcaaaaacggcgtgaaagtcgtcgcggaaggggcgaacatgcctgcgaccatttctgccactgacgctttccttgaagcaggcgtcttgtttgcaccgggcaaagcagccaatgcgggaggtgttgcaacgtccggtcttgaaatggctcagaacgcagctcgtctgagttggaaagcagagaaagttgatgtgcgcttacaccacattatgctcgatatccaccatgcctgcgtagaatatggcggggaaggcaagcagaccaactacgtacagggcgcgaacatcgctggctttgtcaaagtggctgatgcgatgctgtcgcaggggattttgtaa

SEQ ID NO: 1728 - DNA, 114 bp, Xenorhabdus bovienii
  Coding DNA location: Contig name=SeqID_16865; Position on contig =65102..65215bp; Strand=+
atgcgatgctgtcgcaggggattttgtaattctcatgtaatcaatgatgtttcgcggataagccccatgtacaaacacggggcttgttttttgaatcgtagccgtatcgattag

SEQ ID NO: 1729 - DNA, 744 bp, Xenorhabdus bovienii
  Coding DNA location: Contig name=SeqID_16865; Position on contig =65212..65955bp; Strand=-
gtgaagatttgtttaatctgtgaacaaggcgctgataacagcgccttatctcaattggctgaacgctggaatctggttcatgatgaagattccgtcatggcgctgatcttgacacctgaacggctggaactgcacaaactcgatgagccaaagctgagcggtatttatgtcgattttgttgccggcacgttggcacatcgccgccgttttgggggtggccgtggtgaggccgtcgccaaggctgtcggcatcaagaaaggttatctgcccacagttgtcgatgctaccgctggattggggcgcgatgcctttgtgctggcgtccatcggttgtcaggtcagaatgctggaacgccatccggtggtagcagcactgctggatgacggcttacagcgcggctatcagaatgaagagattggtagctggctgaaagaacgtatgacgctgatccacacctcaagcattacggccttgacggatattacaccgccacctgatgtcgtttatctcgatcccatgtatccccatcggcaaaaaagcgcgctggtcaaaaaagagatgcgcgttttccaatcattagtaggcgccgatgaagacgcggacggtttgctggagcccgcccgtgcgctggcaaaacggcgggttgtggtaaaacggcctgattatgcggaaccgctggcaggggttaaggcttccgctgcgattaccaccaagaatcatcgtttcgatatttatccctgctaa

SEQ ID NO: 1730 - DNA, 2043 bp, Xenorhabdus bovienii
  Coding DNA location: Contig name=SeqID_16865; Position on contig =65962..68004bp; Strand=-
atgactaacccgttactgactccttctgtattgcccaaattcgctgccattgagccaaaacatgtcgtgccagccgtgaaagagacgttagccaactaccgtcaagtgattgagaaagttctggccggaaatgtcacatttacttgggataatctgtgccagccaatttctgaagcgaaagatcatctttcccgcgtgtggtctcctgttgatcatctcaatgcggtcaaaaatagcccagaacttcgcgaagcctatgaacaaagcctgcccctgatttctgagttcgaaacttggatggggcagcacgaaggattatatcaggcttataaggctctgaaagagagcgaagcctttaaagcactatctcagccacagcgtaaagctatcgaaaatacgctgcgtgattttgagttgtctggcattggtctgccgaaggaaaaacagaaacgctacggtgagatttccgcccgtttatctgagcttggctctcagttcggcaataatttgctggatgccacgatgggatggaccaagctgatcactgatgagtgcgatctggagggtatgcctgacagtgccaaagccgccgccaaagccgctgccgaagctaaagggttagagggctggttgctgacactgaatgggccaagctatctgccggtcatgacctatgccgatgacagtgaactgcgccaggaaatgtattacgcctatacgacccgcgcttctgagcaagggccaaatgccggtcagtgggataacagtgccgtcatgacggaaattctcgcactgcgccatgagctcgcactattgctgggtttcaaaaactatgctgaaaactctctagccaccaaaatggctaaaacacctaagcaagtactcgatttcctgaacgatctggccaaccgcgcccacggtcaaggcgaaagagaactggaagaactcactgattttgccgaatcacactattgggtcgatgagctggaagcgtgggatctggcctattatagtgaaaagcagaaacaacatgatttctctatcagcgatgagcaacttcgcccttatttccctgaacaacgtgccattgaaggtctgtttgaagttatacgccgcatttatgcgattaccgctaaagagcgccgcgatgtagaaacatggcatcctgatgttcgtttctttgaactgtatgatgaaaaacagacattgctcggtagtttctatctggatctctatgcccgtgagcataagcggggtggcgcatggatgaacagttatgtcggcagaatgcgtcatacttccggcgaattacagacgcctgtcgcttatctgacctgtaacttcaataagccggttggcgatcagcccgcactgtttactcacaatgaagtgacaacgctgttccatgaatttggtcatggcctgcaccatatgctgacccaggttgaaacgttagatgttgcgggtatcaacggtgtaccgtgggatgccgttgaaatgccaagccagtttatggagaactggtgctgggagccagaagcactggcgtttatctccggccactatgaaacgaaagaacctctgccgaaagagatgttggataatatgctggccgccaaaaattatcaggcagcgatggccatcctgcgccagttggaattcggtctgtttgatttccgcctgcacgctgaatatgacccggcaaaaggtgcgcaaatcctgccaaccttgcagtcagtgaaaaaacaggtcgcagttgtgccatcaccggaatggggacgcttccccaacaccttcagccatatttttaacggtggctatgcggctggctattacagttatatgtgggccgatgttctggctgcggacgcttattcccgctttgccgaagagggaattttcaatcgcacaaccgggcagtctttcctcgataatatcctgacccgtggcggttcagaagacccaatggcgctgtttgtacgcttccgtggtcgcgagccgaaactggatgcaatgctgaaaagctctggtatcagtggataa

SEQ ID NO: 1731 - DNA, 267 bp, Xenorhabdus bovienii
  Coding DNA location: Contig name=SeqID_16865; Position on contig =68103..68369bp; Strand=+
atgccgcacttttatgcggataatcggggtctttttatatcagagatctgtgagatgacgaatgagtttagatgtttcgtgggacgcgctataatccctgctcttcatcgttttccttatggaagatcatcgcccccggtggggcggctgggcttcaaatccagatggagccgccagcggctcccggcaggttcaactcctgtgatcttccgccactttttgtctattactgtctttttacttcagcaaaataattcaatttattga

SEQ ID NO: 1732 - DNA, 126 bp, Xenorhabdus bovienii
  Coding DNA location: Contig name=SeqID_16865; Position on contig =68329..68454bp; Strand=-
atgatgacaaagcgtaattttttcacagagaatctcctatgttcagattacaagaaaattccactgaaatacaaaaaacaccctgtcaataaattgaattattttgctgaagtaaaaagacagtaa

SEQ ID NO: 1733 - DNA, 114 bp, Xenorhabdus bovienii
  Coding DNA location: Contig name=SeqID_16865; Position on contig =68482..68595bp; Strand=-
atgatttccccctgcatactatacttattggtgcagttgaaaaatatatcgggccaaatattaatgcccagaaatgaacgtagtcaacctacccgatgttcatttttgctgtag

SEQ ID NO: 1734 - DNA, 93 bp, Xenorhabdus bovienii
  Coding DNA location: Contig name=SeqID_16865; Position on contig =68835..68927bp; Strand=+
atgagtttataccttcgtctttcaagtttctgcttttctggctacaacttgaaagacgaaggggatgattatatcggtttctggattgagtga

SEQ ID NO: 1735 - DNA, 327 bp, Xenorhabdus bovienii
  Coding DNA location: Contig name=SeqID_16865; Position on contig =68903..69229bp; Strand=-
atgaaatatacattacttatgctgcttattctgtctccccttagtctggccgccagttttgattgtgcaaaagccaaagcgccagatgagaaagcaatctgtactgatcatcggcttaatgatctggatatagaaatgagcgtcaaatatcatttcctacgagggttatttgctatgggcatatcgggtgagatgcatgacagccaaaaggcttggctaaagcaacgccagaagtgcaaaggcgataaaacatgcctgctacaaagttatcaccggcgtattaaccagcttgatacactttatcactcaatccagaaaccgatataa

SEQ ID NO: 1736 - DNA, 480 bp, Xenorhabdus bovienii
  Coding DNA location: Contig name=SeqID_16865; Position on contig =69230..69709bp; Strand=-
atgtcttacttaaaatgtttgaattattttggtgccggtttccttctcttttccgcattcgtacaagcacaatcgccatcataccaattgtctacaagccaacaaaaatacctgcaacagcaaatagataaacaaatgacagataaatcagcggccaaagaggtagaagactggtcagatactaaaaaagtagccgagtttatttgcaggcctttagcgctctctgttattcaacgggagcacaaagaggctgacaaagtgtttctcggtgatgaatcaccaaacagtataagattgattgattcccggctcataggtacggggatgtatcgcaacggcattggctggaaaaatattagattctcctgcgaactggactctaaaacaggcaaagcgctgtcattcaaactgttaaaagcattgccaccgcaattacagactgggccagggcctgtgatccttcctaaaaaagggcagtag

SEQ ID NO: 1737 - DNA, 1665 bp, Xenorhabdus bovienii
  Coding DNA location: Contig name=SeqID_16865; Position on contig =69924..71588bp; Strand=-
atgactgaacagcaaccttggtggttagatagcgttatctaccagatttatccgaaaagttttcaggacagtaccggaagcggtacaggtgatatcaatgggatcacccaacggctggattatctacagcacctcggtgttgaggctatctggatcacgccgttttatccgtctccacaagttgataatggctatgatgttgccgattactgcgccattaatcccgattatggctcaatggaagactttgacaatttagtggaaaatgcccatcgccgtggcatccgcattattttggatatggtctttaaccacacttcaaccgaacatccgtggtttcaggctgcacaggatatcaatagcccttatcgccagttttatatctggcgcgaaggctccagcgattccctgcccaataactggaaatccaagtttggcgggaatgcgtggcagtggcatgctgaaagccagcaatattacctccatctgtttgcggtaaaacaggctgatttgaactgggaacatgaacccgtccgcgccgagctgaaaaaaatctgtgagttctgggcagaccgtggtgttgatggcttgcggctggatgtggttaatctcgtctcaaaacagcaggattatccgagtgacgatcacggagatggccgccgtttctataccgatggcccgcgtattcatgaatttctacaagaaatgagccgtgatgtgttccagcccaagggcttgatgaccgtgggtgagatgtcttccacagcgcttgagcactgcctccgttacagcgctttggatagcagtgcgctgtccatgacgtttaattttcatcatttgaaagtcgattatcctaatggtgaaaaatggacactcgccaagcctgactatattgccttgaaaaagattttctcaacctggcaacagggtatgcatcaaaaggcatggaacgcgcttttctggtgcaatcatgatcagcctcgcatagtttcccgatttggggatgaacaccaacaccacaggacgtcagccaaaatgctggcaatggtgctgcacggtatgcagggtacgccgtatatctatcaaggcgaagagctgggtatgacgaatccccactttgagcgtatcgaagagtatcgggatattgaaagcctgaatatgtatcaggaacgcattgagcaaaacatggcaccagaggagatactggcaattctggcgcagaaatcccgcgataacggccggacgccaatgcagtgggatgcttcagccagtgccggctttacctctggcacaccgtggatagcaccttgcgataattatccagagctcaatgccgaagctgcattgcaggataaagattccgtcttctattgttaccacgaattaattaagttgcggaaacaacaacccatactgacctacggtgattatctggatctgttacccgaccatccttcgctttggtgttatctgcgtcgctggcagaatcaggtcatgttagttatcgcaaatttaagtgatgaaaaccagctatggtctccagaatcttctctcacagataaagaatggcaggtattaataagtaattatccatcgccttcctcaatggaaaaagagatatctattaaaccttatgaatcaatatacttgattgctgctcaataa

SEQ ID NO: 1738 - DNA, 1410 bp, Xenorhabdus bovienii
  Coding DNA location: Contig name=SeqID_16865; Position on contig =71607..73016bp; Strand=-
atgaagaaaaatcaagtaaatcagaaggatcttgaaaaacttattactttgattggtggaaaagagaatattgcttctgtcagccattgtattacccgcctcagattcgttctccattcaccagaaaatgccgatgccaaggccatcgaagagctatccatggtaaaagggtgttttaccaatgccgggcaatttcaggtggttattggaaccaatgtagacatttattataaagctctgcttgaaaatacggggaaacaatccgttaataaagaagaagttaaacaggtagcccgacaaaatatgaaatggtatgaaaatgcaatttcacattttgctgagatctttttccctctgctgccagccttaatcagcggtgggttaatattaggcttccgtaacatcattggggatatccctttcagtgaaggcaaaacactcgcccagctatatcctatctggcaaaccatccatggttttctctggttgatcggtgaagctatattcttctacctccctgtaggtatctgctggtctgccgttaaaaaaatgggcggaaccccagtattaggtattgttttgggcattacgctggtttcaccacagttgatgaatgcttacctgcttgggcagcaaacaccggaagtctgggatttcggctggtttgccatttccaaagtcggctatcaggcgcaagtcattccttctctattggcgggtttaacgttgggatggattgaaactcggctgaaaaaatgggtgccggattatctttatctggtaattgtccccgttgtttcgctgctgctggcggtcttccttgcccatgcgctgatcggcccggtgggacgcgcaatcggtgatggggtcgcttgggtcgtcaagagtctgatgactggaagtttcgctcctatcggtgcagccctgttcggctttttctacgcaccactggttattacgggcgtacaccaaaccacattagcaatcgatctgcaaatgatccagagcacgggcggaacccccatctggcctatcattgcgttatccaatatcgcccaaggctctgccgttgccggcattatctgggcaagcaaaaagcagaaagaacgcgaggtttcgattccggcagccatttcagcctatctcggcgttaccgaacccgccatgtatggtatcaacctgaaataccgttacccgatgttctgcgcgatgattggagcgggtctggccgggctggtatgtggccttaatcatgtgacggctaatggcattggtgttggtgggatcccaggtattctctctatcaagccgcagttctggatggtctaccttattgccatgatcatcgccattgtcgtgcctatgctgcttaccgtactggtctatcgcagaaatgagctaacgcattaa

SEQ ID NO: 1739 - DNA, 189 bp, Xenorhabdus bovienii
  Coding DNA location: Contig name=SeqID_16865; Position on contig =73455..73643bp; Strand=-
atgaatttatttatgacgacaccatctaggaagaaattccataaaggcgatatcctaaaagttagtttatgttaccatttgatatttaagaaaatggttaagctcagagcgggtgataccgctgactgctgtgacaccgttattgtcagtagtatgaatattagttggaattatagatatgactactga

SEQ ID NO: 1740 - DNA, 492 bp, Xenorhabdus bovienii; identical to SEQ ID NO: 1438
  Coding DNA location: Contig name=SeqID_16865; Position on contig =73669..74160bp; Strand=+

SEQ ID NO: 1741 - DNA, 354 bp, Xenorhabdus bovienii
  Coding DNA location: Contig name=SeqID_16865; Position on contig =74097..74450bp; Strand=+
atgccgatcagagcgcttattacaagcggtcccacagcggattgctcacaagctgaggccttgattgacggaatagatgcagaacatttattagcggatcggggctatgacagtaataccgttgttgaacaagcagaaaaacaaggcatggcagcgcaaattcccggccgaaaaaatcgcaaagtgaaacgagaatatgatcgggaactctatcgactcaggcatttagttgaaaatgcttttcttcatcttaaacgctggcggggtatagcgacccgttatgccaaaaatagtgcctcatttcttgctactgttcagatccgctgtcttgctctttggttaaatgtcttatga

SEQ ID NO: 1742 - DNA, 1047 bp, Xenorhabdus bovienii
  Coding DNA location: Contig name=SeqID_16865; Position on contig =74797..75843bp; Strand=+
atgaacagcacaaatgaaataaatatatcatttccacataaaaaaacattagaggccatcctgtttttatctgcttttttattattttcatttactcaacctgtctattctatagaaatgaaagctgccccaaaagactctcagccacaattgttcaggagaagaccaaaaattaaaattctatttgcattctctatagaagccgctgaaaagcttggatatgtgtatggtagtgagctgaaagataagaaagcaatagagcaaatgaatgaggttgcagatttaatgatatcagttggcaaccgatcattcagaaattcctatatacattttgaactgggaagaacaaaggttattgcatcttatatctctgaaaagaatcttatgacccatgaacattatctggattttaatatgactggtatgttaaagcagcttcctggtacccggaataaaaacgacaaaaaaattatttataggtttaaagaattttatttactcgaacaatctcgtattgctctgaaagcagatgtggttgtattgatcataactgcaaaatatcatttcaataaaaatgagtgtggaagctcatttgatggcaaaaagggaattaatagagatactgcgtatatggtggtcagactcccttgtatgattaacaaggaaaacctcgatttcaactatcacttagggcatttgataggtgcaagcgatagcgtgaatagtggtggtattagtaaagaagatgaatttttttatgggcatggttacatacaaaataagcataaaccttattggcgaaccattatgactcgagctgaggactgcccaagttgtactgtgattaattattggtcaaaccctctggctgaagttaatgagatacctacgggaatatacagaactaataataatgcgttgctatggagagtgcatggtcgcaaactcgtaagagtctatgaggagttttataaaaataaggggaaatcgccagttctattactgcagcgcccagttaaaaacaattatatatctactcaaaattag

SEQ ID NO: 1743 - DNA, 321 bp, Xenorhabdus bovienii
  Coding DNA location: Contig name=SeqID_16865; Position on contig =75954..76274bp; Strand=+
atgggtaacaataatgaaaaaacagaattagtgaataaagacaagggcatatactcaaaagttatttcaatagatgtcggtgatattaatggaggtggaggtggaggtgcggatattaaccctataatttgcgttaaaaatattaacaatgatgtgattgattattataaactagcatttcctgaagaagagataaatggagccgcaacatactcagtaatattggcagctttttcctatgacatgccaataatattgaaattcattgggtctgaacgcattgccggtgttattatcgataccgatatcggtgataaataa

SEQ ID NO: 1744 - DNA, 336 bp, Xenorhabdus bovienii
  Coding DNA location: Contig name=SeqID_16865; Position on contig =76436..76771bp; Strand=+
atgaacgaaaatgataaatcagaaaaaaaattaatcttagtgaggccggctagtgatttattagttaaagacgtaataattgtttcgttggaaactaacattgcaggtaacaatgttaatgtgtcatttaaatatttaaaaaatccaaacattttcaccaatttttttcttaattatcctaattataaaatgggtggaggaggtatattcgcaacgttactgtcagctttaatcaatcaatttactgtaacattaaaactccttgattatccctatccggcagaaataatttatattacaggtattctcgttaaaggagtggatactccgccttaa

SEQ ID NO: 1745 - DNA, 93 bp, Xenorhabdus bovienii
  Coding DNA location: Contig name=SeqID_16865; Position on contig =76944..77036bp; Strand=-
atgggaaaggggcgaaaatatggaacatctgagataacaaggtggaaggttaggagaggtctatctttgaatggtaaaaagaggattccataa

SEQ ID NO: 1746 - DNA, 108 bp, Xenorhabdus bovienii
  Coding DNA location: Contig name=SeqID_16865; Position on contig =77000..77107bp; Strand=-
atgagcaaaaaatacgattgttatcaaaaggattacagtttcggtctccgacaacatggtaacgattctatatgggaaaggggcgaaaatatggaacatctgagataa

SEQ ID NO: 1747 - DNA, 456 bp, Xenorhabdus bovienii
  Coding DNA location: Contig name=SeqID_16865; Position on contig =77127..77582bp; Strand=-
atgcctatatgggtagatgctgatgcatgtcctaaggttataaaagaagtattatatcgtgcagcagaacgtgaaaaagtacaggttacattcgtggcaaatcaacgattaagtgtacctgcatccgcttttttacgtacattacaagtccctgctgggtttgatgtcgctgacaatgaaattgttcgtcgctcagaaatcggtgatttagtgattacagcagatattcctcttgctgctgaagtgatcgaaaaaggtgcaatagcactcaatccgcgcggtgaacgttatagtgaagcgacaatacgtgaacgcctggctatgcgtgattttatggatacgatgcgggcgagtgggatccacacgggagggcctgctacgttaaaccaacgtgatcgccagcagttcgcaaatgaactagataagtggttattacaacaaaaaagagtatcttga

SEQ ID NO: 1748 - DNA, 138 bp, Xenorhabdus bovienii
  Coding DNA location: Contig name=SeqID_16865; Position on contig =77774..77911bp; Strand=+
atgctctttcctccagtacgaaagactcagatcgccttcaccctctttttttttccagataccacgaggcttgccagctcatcagctaattcaggtgagtcacccaattaccaactagaatctgatggatatttttga

SEQ ID NO: 1749 - DNA, 162 bp, Xenorhabdus bovienii
  Coding DNA location: Contig name=SeqID_16865; Position on contig =77966..78127bp; Strand=-
atgttccatgattcctgcctgtctctgaatcaagtgatcaccgttccttaccgtcccgaaacagatgccgctggcgaaactacccgcattaacccgtttcgctggtcagaaaaagtcggcgaccaacgaacttatcttgtgatactatttctggtaaattaa

SEQ ID NO: 1750 - DNA, 1116 bp, Xenorhabdus bovienii
  Coding DNA location: Contig name=SeqID_16865; Position on contig =78385..79500bp; Strand=-
atgaaatctctctatgaaaaataccaattgcggccagtgatcaacgcggcgggacgcatgaccgcactgggcgtttcaacgccccgatctgatgtgattgagcaggtcgctactgggctgaatcattattttgagatggccgatttagtcgataaaaccggtgattacatcgccagattgctgggcgtagacagcgcaatcattgtctcctgtgcttcagcagggatcgcccaatcgatagctgccgtgattgtcaaagatgatgatgatttgctgcttaatctgcatcgttcagagaagccagtcccccgtgaaatcattcttcccagagggcataacgtcaacttcggcgctcctgttgacaccatgattacgctgggtggcggtaaagtcattgaagcgggttttgccaacgaatgcagcgcaacacagctcgccgccaaaatcacgccccaaaccgccgccattctctatatcaaatcacatcataccgtacagaaaagcatgctgaccgtagccgaagctgcccgcattgcacaggagcaccagctccccctgatagtggatgccgccgccgaggaagatttaacgctctattaccagctgggagccgatctggtgatttacagcggtgccaaagcgattgaaggccccaccagtgggttggtgatcggcaaacagccctatgtgaattgggtcaagcggcaaagttacggcatcgggcgcgccatgaaaatcggcaaagaaggcattcttggcctgacactggccattgagcgctatatcaccgacaaaaaagagtctggcgcggacatggtggcaagaatgacaccttttattgacagactgaaccgcatcaaaggcgtgtcggccaaagtggtatgggacagcgcagggcgcgatatcgcccgtgctgagatcacttttgacgaacagatgattggcaaaaataccttcgacattctggcacaactccggcagggaaaaacggcgatctacttgcgggaataccaagccaataagggaaaagtagaggcggatatccgcagcgtgaccgcagtacagcttgattcgattgcatcagaaataagaaggttaatattgggaggaaaataa

SEQ ID NO: 1751 - DNA, 1155 bp, Xenorhabdus bovienii
  Coding DNA location: Contig name=SeqID_16865; Position on contig =79484..80638bp; Strand=-
atgtatgacttaatcattaaacaggggaaactgatcaacggggctatcattgatatcgtgatcaatgatggccggattgccgccattggccccttggcggcgacaggattatcagccatcaggtatattgatcttcatggtcattactttgtcagtgccggctggattgatgcccacactcactgttatccgcaatcgcctctctattttgatgaacccgatttgattggggcagccagtggtgtcacgacggtggtcgatgcgggcagcgcaggagcggatgatatcgaccattttcattccgtggcgcgcagggtgaagactcatgtctacgctttcctgaatatcgcccgcacaggcatgcgtagtcagaacgaactggcagacttaaccaaaatcgacgcttcccgcctgcaagatgctgtcagacgtcacgctggatttgccatcggtctgaaagcccgcatgagcaaaagcgtggtgggtgaaaatggcctccaaccgctcatccaggctaaagctctctattctaaactcagacaaaaaaccagtggcctgccgctgatggtgcatattggcaatccaccgcccaatctggaggaaattgccgatctgctgacccaaggcgatatcattacccactgctttaacggcaagcctaaccgtatcctcgatgataaaggtaatctgaaacctgccattcagcaggcactgtcacgcggcgttgttctggatgtaggacatggtacagagagtttcagcttcactgtggctgaacaagccataaggttcggcgcctatccccatatgatcagttccgatatttaccaaaaaaaccgcgtcggtgggccggtttatagcctcgccaacgtgatgaccaaattcctcaccctgggcgttccgcccgaacaaattcttaactgcgtaaccgccaaccctgcggatttacttcatctgccacgcaaaggtcggctggagcggggtcttgatggcgatatcacgatttttgaattgaaaaatcaacgcattgaactgttcgatgcggaaggacaggtcaggattggcacgcaacaatttatcccaatagcggccattcttgcgggtacgcatattgtggttgtggaaaggagcacagtcgatgaaatctctctatga

SEQ ID NO: 1752 - DNA, 651 bp, Xenorhabdus bovienii
  Coding DNA location: Contig name=SeqID_16865; Position on contig =80667..81317bp; Strand=-
atgaatactgaactgaacaaacctgatttctggtacgcagaatggtcattcccgctgtttgtcggtctgctgtcagccgggattttcgccggtacgcatatgtatgtggtgtatggattcggggcattcaatgaagtggctttcgtcgccatgctgcgcgccggcattgataccggcgcttatggcacggtggcggcatttggtgccagtttcctgttcgcccgtatcgtcgaaggatcactggtcgggatcctggatatcggtggcgccctgcaaaccgggattggtctgggtgttcccgccctgctgctggccggcgggtttgattttctgataacccacttctgggcggcgctaatcactggcatgttactcggcgttggcgttggtctgctgatcatcctcgcccgcaaattcaccgttgcacagggaaactccacctttggcgcagatgtcatgatgggtgcaggcaatgcttccggccgtttcctcggccccttaattattctggctgcaatgacggcttctattccgattggcgttggttcactgattggcgcactgctgttttatgtgtggaaaaaaccggtagcaggcggggcaattttgggcgccatgatactcggctattttttccctgtgacagcgtaa

SEQ ID NO: 1753 - DNA, 792 bp, Xenorhabdus bovienii
  Coding DNA location: Contig name=SeqID_16865; Position on contig =81320..82111bp; Strand=-
atgggtgctaccgcgtcttttattgaaatactcggcatgtcgctggtgatcggcggcctgtgcggtttcggcctcggtgccggagcggcacgcatgttccatgcgccaaccgtacagggcatgggcgcttttcgcacgttaggcgaactgaacgcctgcgaaggcgatcctgcctctcacttctccttcggcctcggtttcttctttaatgcgtgggcctcgtccgttgctgcgggggcgttcacacaagatgtcgatcaccgcatcattcccaattggggcgcggccgccttgatgatcaaaaatcgcaacgtcgcagaaaccctgcacaacccgaaaaaaatggccatcgcctgcgggattatcggggcattgctggtcgcgttcctgaacaccacggcctctgccgttcccgctgccttgcagaccactgccaccaacgtgctggtgcctgccgccaatttactggtcaataccgtgatgcccgtcttgttctggctggccgcaatggatgccggccgccgatccggtttctgggccacgttgttcggcggctgcgcgcaactgattatgggcaacgccattccggggctggtattaggcattctgatcggtaagggcgtggatgacagtggttggaataaaatcacccgtaccatgctgatcgccgttattttgctgtttgccctcagcggcttcttccgtgaattcgatcttaaactgctgacctctttcatgctggatgcaccgggctggctgcaacatatccatcaactgatgaggggtaaataa

SEQ ID NO: 1754 - DNA, 330 bp, Xenorhabdus bovienii
  Coding DNA location: Contig name=SeqID_16865; Position on contig =82127..82456bp; Strand=-
atgaaagagttgattgaaacatcggttcgggtcagcggctccggcgataccaaacagaaagccatcgccgatgccctgaatgccgtacagcgcacggtactgcaaggaacgtctcacatcatcctgcgcatcgaaccgaaagacgttgccatcgtcagcgccatcagcaaggtcacgacggagaagttcctgttctttttcctgccccgtcagcgtgaacactattccgtcgtgctggatgttttcgtcaatgtctctttgctggatgtgcgagctatccatttcaaacaatccacttcaaaccatcacaatcatgccgacagaaaatga

SEQ ID NO: 1755 - DNA, 402 bp, Xenorhabdus bovienii
  Coding DNA location: Contig name=SeqID_16865; Position on contig =82440..82841bp; Strand=-
atgacatcaaccaaaattgttaaaaaacaaatcattgtggttatcggtgaccgtttgggcaaagggaaaaacgtcgcggcgggtgtcgaagcagcaggcggcaaagcgattgttattccgggcgtcgcggcggatatgaaactgggtgatgtgatgcatcacgaacaggcagatatcggcatctctttttgcggcagtggcggagcgggcgcaatcaccgcacaaaacaaatatggctacccagtacgtcacggtatgcgctccatcgaagaaggagaaaccgcgatccgtgaaggttgtacggtgctcgggtttggttttatggataaagcggagttgggcgagcgcctggttcgcgctttaatcaaaaaacaggcggccaaccatgaaagagttgattga

SEQ ID NO: 1756 - DNA, 390 bp, Xenorhabdus bovienii
  Coding DNA location: Contig name=SeqID_16865; Position on contig =82872..83261bp; Strand=-
atggcgggaaactcgacgatgcgtcgtgatcgatttgactggaaaaattttatgcttaaaccccccatgcgtttcaatatggcgaaaggcaaccttgatcccgaagcggtcagccaaagattactggcacttattaaacagtggctggaagcggcgggtgcttataccacgcaagtacaacagcagatgctgaccacccatatcagggcaatggtgatgagagccaaaacaggagaacctttgccagaagtggataactcgctgtttgacgaagtttcgccggaatctatcgcattggcggcacaagtcgtcgaaacgctgcccggactggccgttgaagaggcttatctgctatccgtgcattttgaagtcgcgcgttccaacccttaa

SEQ ID NO: 1757 - DNA, 1920 bp, Xenorhabdus bovienii
  Coding DNA location: Contig name=SeqID_16865; Position on contig =83485..85404bp; Strand=-
gtggccttgttcccttatccgcgtctagcccacctttttgaggtgatccacaaagaaagattgccgcaggctgaactggcaaaacgctttggtgtttccagtcgcaccattcgcacggatattacggaactgaacaacgctctacgtcattacggcgctcagatcctctataaacggggaagcggatattctctcagcattgaggatcacaccttattcgcctcgctgccaaaacaaaagcaaatgatccagacgatcccccgcacggccagcgatcgggtggatgcattgctgttgaaattgctgctggctactcagccagtcaaactggatgatattgcggaagcctggtctatcagccgaggaacgttgcaacatgatatgggcgtggtacgtgaaattgtcagtaaatatcccctgcaactgaccagtattccccgtctcggaacccgactgaccggcaatgaacgcattatccgatcctgtctgacagacacactattacgccgattttcgctcgaagtcgaaccgtcactcagccagttcaggacagatattctggcggatatcgacctgtcttatatcgaaacaatcctgcaaaacagcctgactcgattcggtatccgcctgaacaacgaaggccgccaatatctgatatttaactgtgccgtttccattctcagaattacccgccgccatgagctgacacaaggtgtcgtccatgaatgggacaacgcaatacaaaatgtggcatatgaaatctcacaaagtttgatctgcgtgctaggcagcgaaatatctgcatcagaagccggttatctcgcgggacagattgccgcacagagaattccccaacacgataatcccaccccgcatacacccaacagccatcaatgggtagacgaaatcctcaacgatatcaatacgtcctataactatgatttacgccatgacagcaagctaagaagcgatctcgcaacacatttaacggtattaatcagccggttgcagcagcaaatcagcaccaaaaacccgctactggcggatatcaagcaacattatcctttcgcctatgaagtcacggtaagcgctctgacccgtatcgaagatcaacttcccttcgtcatcagtgaagatgaactggggtatctggcggtgcatatcggcgttgggttggagcgccattacggaggttcgacgcatgttctggttgtcaccgattcaggcaatgccacgcggcggatgattgaggccaaaatcgcccgtgaatttccgcagctcaagatccagcgcgtactgccactccatgaatacaacgccttggactatgtggaagaaaatttcgtcattaccactttgcgtctgtcagagaaaaataaacccatcgtcaaaatcgctcccttccctactgcttatcaattagagcagataggacggctgacaatgatggaacaaacccgtccctatattttggagcgtttcttcgacgagcgttattttatggtgatcaaggaagatatcacgcaggaaatcctgtttaaaaccctgtgcaggaaattgcgggcgggcggctatgtcagagaggatttctgtccctcgttgattgaacgggaagccattgtttctacgttattgggggagaatattgctctgccacattcattgggattgctggctctcaaaacggtcgtcgtcacggttctggcgcccaaaggtatcgaatggagcaaagaaacgaagacgcgggcgaatgtcattttcctgctcgccatcagcaaacaggattatgaagaagcgatggcaatttatgatctgtttgtcacgtttgtccgggaaaaagccactaaacggctattacgcagccggaatttccatgattttcagatcatcgccaaagacagtcttggccgctcagtctaa

SEQ ID NO: 1758 - DNA, 174 bp, Xenorhabdus bovienii
  Coding DNA location: Contig name=SeqID_16865; Position on contig =85498..85671bp; Strand=-
atgcacgatctaaataattatttttcccatatcgtcaggaaaaaatgtgccagtcattttccctgctgcggttttaatgccataagcaatatccgtacaactttcctctgtcgcaggttcacagacatgaaaatgtcagcctgtttttccactgagatcactcaaaaaggctaa

SEQ ID NO: 1759 - DNA, 843 bp, Xenorhabdus bovienii
  Coding DNA location: Contig name=SeqID_16865; Position on contig =85991..86833bp; Strand=+
atgtctagatttattatcagtcggaataacaagtctttacttaatgaaaccgtattctatcttacaaaagggaatatgcttacattaaagatcgatggtttgaatagtaataccaaaagacatcttaaatttcaatcgaataatacgcttgtgtccatttttcaacgtgataattatctgtttagagaacaaaccttgcaaataacagctctgagtatgggagtaagcgtggttagagcggtggatactgatatagattactgtccctattttgcagaaggcgtcgctgaggactgttttccaccattaacaattcatgtcttatccaaaatatcgattccaacggacttaactgccgagcagaaagcgattttaatggtgcttttagcggaaacgacgtcacctgaaacaaaaaaaataaagtacaatgaaaaagaagctaaagataccatgcaatatatgcatgatgttctattgaacagaatccggtctcctaaagcacatgagcttgatgtgcccagacaggggaataaattaatcgggctcatttcagggccacggacaatagaggggtttagccaataccccaatattaaaccctctatacaagatagaattaatggtatgatagcttctgctaatgaaggtagtaattcaaattttttagcttatcgtcgattaattaaaaatgctattgatatagcaaaaagtaataaaatctccaatacagagattattgcatggagaactggaagtgctgagcctcctggttcaaattttacaaaattattttcattacaagggcaggatttttataagctggctgatagttatcttaaataa

SEQ ID NO: 1760 - DNA, 531 bp, Xenorhabdus bovienii
  Coding DNA location: Contig name=SeqID_16865; Position on contig =86844..87374bp; Strand=+
atgaaatatttaattggtttatgcatgattctgttctcgttaactgctttttcaaagcaagatgaactggatttcaaagcttgggaaaagacgggaagttggggaatctatgactcaaaaccagataattattttaagccgttaaagataaataactataaagagggttatttacgctcatttagttatcttattaagcggtttaatttacaaaatgtgaataatgaatactgtttgattggttacaaatggaataaaacaaaagatcgcgatgagcgtgaacgtattattgttttttggaaaacggctaattatctgattgattgggatctgccggatggtgaggacgatcatcgttataaagccattatattcagcaaaccctttattgatatgaatgaatctgttgttccttataaggaagcagaaggtgcgcaggctttatgggctaaagaaggcgttattcaaatgatgaatgattgtgaattgaatgggcaaaaaatcacgataacaccttctggggtcaggtaa

SEQ ID NO: 1761 - DNA, 177 bp, Xenorhabdus bovienii
  Coding DNA location: Contig name=SeqID_16865; Position on contig =87533..87709bp; Strand=-
gtgatttttaaaaaaccacaagaattccattccgagagtttaagcggtattagtcaattttcaactaatatgactgtatccatggcgcatttggggaaacagctattttgcatacatagcatgctacttcttggctgtaattctgtaatttcacttttcagaatcaggccgaactaa

SEQ ID NO: 1762 - DNA, 594 bp, Xenorhabdus bovienii
  Coding DNA location: Contig name=SeqID_16865; Position on contig =87743..88336bp; Strand=-
atgaaagtcccctatttttctcagtgggaatcattccatttagccaatgacattattcaccatcaacttccacttagtcatgatccgctatgggaacaatccggtgcagattccccagaggaatatgcgaaatgggcaaatcatatctgtggtatggcttgtcttaaaatgttgcttgcagctcgctcagggaaaatttacccattgctgaaattaactaaaatggcaaccgagtacggagcataccagatagaaaatgagcatataaaaggaatgatttatgcccctgtagtttcaatgttatcggaacaatttgggattttctctcaaatagtgaccggtatggcggccgaaaagatacatggggtttttacccaagatagtttatatatagcttccgttcatcctagtatcagatggccaacacgattacctgaaaaaaagggcggacatcttgtgctggtgactaacgctacacccgaagaaataacctttcataatccttctggtgctaacactcaaagtcaaattgatgtaaaaatgtcagtagatatttttagccgattttatgccgagcgtggcatactcatttag

SEQ ID NO: 1763 - DNA, 828 bp, Xenorhabdus bovienii
  Coding DNA location: Contig name=SeqID_16865; Position on contig =88333..89160bp; Strand=-
ttgttgatcatcgtactaacgactttgcgaacccttgcccttaaaaaagttgcagaacgtgtatctccagagaatactgcttttattattggcgctggcacgtttttaacgtgcctttctctacttcctgtcgccataaccacgggcatctcaactccatctgatttccttaacctaacagggatatctgctggattgatgaaaggggtgcttctaggcataatgctgatagcacaacaaaatcttatcaacaaaagcctttcatctgccacttatgtattccctatatctcttgggtttattgcactcgttgatatactgatatttggttctaatcttacctttgcctcgatcctcagtattaaccttctttttgtcgccggaattcttttcactatgattggtcatattaaaagcatgcacagacgaagtaagcttatgtttttcattatgatattctgtgtaatcgggtttgcaattatggaccgaacagggattcccacgagtggttggtttacctatttattatttactggcatagggaatatatttgttgtttttttctatcagaaaaataaattttcttttgttccactgaaattttggctttccatatcaattatctgggttttaccagaattattttttaactatgctattgccacttatttacctgtcagctacggatatctagcaataactctcagaattcctttacttatgctaatttcagtgcttgtctatcgtgaaggcaaactctctgaacaaatgttattttcctttgttgctgttatcgcgattttacttatgttcatggagagactatga

SEQ ID NO: 1764 - DNA, 732 bp, Xenorhabdus bovienii
  Coding DNA location: Contig name=SeqID_16865; Position on contig =89184..89915bp; Strand=-
atggaaagaataggattaattggcggtgtcagttgggcatcaactatggaatattataaacgtttaaatatggctgtgcagaatactggtaaagattttgaatctgccgatctggctattatcagcctcaatttttcaaaaatacttgccgcccagaagcgagatgataatgagactgaatttaacattctcagtaaagcagttcatcaacttgcgcaagccgaagtaaaaaaaatccttatttgttctaatacaaccagtaatacttgcgatcggctttcaaaactggttaatattccaattatcaatattattgatgccaccgcaaataaattactcagcatgaaggtttccaatgttgggttaattggtactcaatatgttatggaacgtgatttttataagaaacgacttgaagctaaaggaataaacgtattaatacctagatccaggactcggcaagtcatacatgattctatttatcaggatctatgtcgctatgcgctcactgacacatcccgtggaataatgtatcgtgctattgatgaattagctgaattaggcgcagaagccgtcattctcggctgtacagaaattcctttagttgtcaatgatagggtgtatcaaaattcaataaaaataattgattctatcgatgctcacattgaagccgcattgtctctaacaccggaaaataataatacttcgtctatgttaaggcctctcaattga

SEQ ID NO: 1765 - DNA, 1098 bp, Xenorhabdus bovienii
  Coding DNA location: Contig name=SeqID_16865; Position on contig =89926..91023bp; Strand=-
atggtttattttcctagcgacacaaaaacaactataccattatcgatcatttttggtggaatttccccagaacatccagcatcagttagttcttttgataatcttataaaaaatttcagagagcttaattttgatagaaatattaattcaatatactttttcgataaagatggttctgttttatataacacctatacaccttatatttctcccgatgattttactcattctggagataaaatagatttatatacagcaatcaaaaggatgtctgaacaaaacgaatttcacatcaatcttcttcatggtaatttaggtgaggatgggcatatccaaggagttgctaagtattttaaaattaaaggaacatttggtagtgtacttccttcctcgctctctatgagtaaataccatatgtcacactatattaatagtttattaccctctttaagatcaccgaaaacattactcttaactgaaggtaatctagaaaaagcattttcattgattagcgataacttccctgaagaaaaaatagttataaaacccaattcattaggcgcttctttatttacaaataaatatgttaatctggaaaatgaaaaaaaatcaatattggataatttgaaaaatatttttgaatacgatagatttgccttggtacaagaattcatcaaaggaaaagagtattctgttggttgcattcgaatagaagggaaagcaatagcactcaatgttatcgaaataatcacaaagaatggttttttcggtcatgatgaaaagcatcgaattaataaagcagaagaaatccttttaatacaagattcagggataacgagaacactaaaagatttatctattaaaatttttgaatctactggatatgaatttatgtgtcgatttgactttattgttaccgagtctgaagaaatatactttcttgaatcaaatccgatcccgggcatgatgaaaaatagcatattccctaagatgttaaaaggacacaaattatcaatacctagcttgtttattcacctatcatgttcatcacaaaacatttctgaaaaaaaatctatttttaactacattatcgagtaa

SEQ ID NO: 1766 - DNA, 627 bp, Xenorhabdus bovienii
  Coding DNA location: Contig name=SeqID_16865; Position on contig =91530..92156bp; Strand=-
atggaaaattattttgacagcccatttaagggcaaaaccttagcggaacaagtcactaatccgaatattcaggtcggccgtttcagttactattccggttattatcatggacattcttttgatgactgcgcccgttacctgtatcccgattcagttgatgtcgataaattgatcatcggcagcttctgctccatcggcaccggagtcgcctttatgatggcgggtaatcaaggacatcgtttggattgggtttcatcctttccgtttttctatatgtcggaagagccggcctttgccgatgctcaaaatggctaccagccgatgagagacaccgttatcggcaatgatgtctggatgggtgccgaagcgattattatgcccggcgtaaacattggcgatggggcagttatcggcacccgctctcttgtcaccaaggatgtcgaaccttacactattattggcggcaatccggctaaggtgatcagaaaacgcttttcggatgaacagattgcgatgttactggaaatgcagtggtggaactggccgctggagcaattaaaagcggcgatgaaattgctcacttcagcggatattgaagggttatatcggtggtggaaaaatcagtag

SEQ ID NO: 1767 - DNA, 951 bp, Xenorhabdus bovienii
  Coding DNA location: Contig name=SeqID_16865; Position on contig =92447..93397bp; Strand=-
atggaaaaaatggcacacaaactcgacgactttatccgacacgcccttgatgcccagcccattagtggaacatcgctgatcatctctctgtttggggatgccctcagtcaccgtggtggtgaagtatggttgggcagcctgagcctcctgctggagccgatggggttcagtgaccgttttgtgcggacatccgtctttcgcctgcaaaaagagggctggctggcagtggagaaaatcggccgtcgcagctattaccgcatcaccgagcgtggcatgaatcaattccgccatgccgagagcaaaatctacctgagcgaacagcctgagtgggatggcaaatgggatctactgctgctggaaggcacgaccaaagaagaacgcaaccgcctgaaaaaagaactgagctggcttggcttcggccagctcaacagtaccctgatggcggcaccaagcagcgcgcaaagtgatattcccgccctgcttggcgaactcaacgccagtgattccgtgatctattttcgggcagactatccctatccccgctcagaacaaagcctgaaagagcgggtatcggccagttggtcactggatcaggtggtaaaacactatcacgagtttatcgtctcattccgtcccttaatgaagctgctgcaagattgcagtgaagccgacctgacaccagaacgcagcttccagttacgtctgctgcttattcacttttaccgccgagtggtgctgcgcgatccgctgctgccggatgctttactgccagcacaatgggaaggacaggttgcccgtaacttgtgtaccaatatctaccaacgaatagaccttactgcgacacgttacgtcagcgaacgctgtgaaaccaccattggcacacttccgcaaccgggagcggcgtattaccgccgttttggtgttctgcacagtgaatccggtatcgtctga

SEQ ID NO: 1768 - DNA, 1308 bp, Xenorhabdus bovienii
  Coding DNA location: Contig name=SeqID_16865; Position on contig =93529..94836bp; Strand=-
atgagcaacaacgtacaacacctcgattccattgagtttgcttcacgtgacgaaattcaggcgcaccagtttgaacagataaaatggacgctccatcacgcctacaacaacgtgcctatgtaccgccgcaaatttgacaccgccggcatccatcccagtgatttcaagcaacttgaggacatcaccaaatttccctacaccaccaaacaggatttacgggagcactacccgttcgatactttcgccgttccgatggaacaaatcgtgcgcatccatgcctcatcgggcaccacagggcatcctaccgtggtgggttatacccagcgggatattgaccattgggctaatctggtcgcccgttgcctacgatttgctggggcaagtgccaaagacaaagttcacgtcgcctatggctacggcctgtttaccggagggttgggagcacactacggggctgaacgtctgggcgcaaccgtgatccccatgtccggcggtcagaccgaaaaacaggcgcaactgattctggacttcaaacccgacgtcatcatgatgaccccttcctactgcctgactttactggatgcgctggaacagcggatgggcggagatgccagcaaatgctccctgcgcgttggcattttcggcgcagagccttggacagaagcgctgcgccgcgaaattgaaacgcgcatgggcatcaaagccttggatatttacggcctgtccgaagtcatggggccggggatcgcgatggaatcggtggaacacgctaacggttccaccatttgggaagatcatttctatccggaagtgattgatcctgacaacctgagcgtactgccggatggtaaatccggcgaactggttttcacgaccctgaccaaagaagccatgcccgtgatccgttaccgcacccgcgatctaacccgtttattgccgggtactgcccgtcatatgcgtcgtatagacaggatcgccggacgctctgacgacatgctgattatccgtggcatcaatgtcttcccatcacaggtagaagaacagatcatccgcttcaaagagctgtcgcctcattaccagttagaagtgaaccgcacaggcaattatgactgcctgtcagtcaaggtcgagctaaaagagccggagcggcttgacgctcaacaacgctgcgacatctgccaccagttgcgccatcacattaaatccatgatagggctgagtacagaggtcagtatcgtcaactgcggagacatcccccgctcagaaggcaaggcggtcagagtgatcgaccaccgccagcatgagtaa

SEQ ID NO: 1769 - DNA, 117 bp, Xenorhabdus bovienii
  Coding DNA location: Contig name=SeqID_16865; Position on contig =94805..94921bp; Strand=+
atggaatcgaggtgttgtacgttgttgctcatagtttcctgtccctttgttgatttgtttgtaacaggttgttgtttttatgtgcaggtgtgggttatttgccaatacccgatataa

SEQ ID NO: 1770 - DNA, 1215 bp, Xenorhabdus bovienii
  Coding DNA location: Contig name=SeqID_16865; Position on contig =94932..96146bp; Strand=-
atgacccatgcgtttatctgcgacggcattcgtacacctatcgggcgttatggcggggccctttccggcctgcgggctgacgatctggccgctctgccgctacaggcattactggcacgttatccctcgctggattggcaacacattgatgacatcattctgggctgcgcaaatcaggcgggggaagataaccgcaacgtggcacgcatggcggttttactggcagggttaccctattcggtgtcagcgaccacccttaaccggctatgtggctccggtctggatgctttggcctttgccgcccgtgccattaaagccggcgaagcgcaactgatgctggcgggcggtgtcgaatccatgacccgagcccctttcgtcatgggtaaaaccgacagcccattcagccgccaagcacagatctttgataccacccttggctggcgctttatcaatcccctgatgcagcagcagtttgggacagactccatgccagaaactgcagagaatgttgccgcccagtttcaaatcagccgtgacgatcaagatgccttcgccctgcgcagccagcaacgcaccgccagcgcccaacaacggggtattctggcggaagaaatcacccccgttaccctgcccgctgccaacaaaaaagaggtagcgaccatcgtctcacaggatgaacatccacgaccggagacgacattcgaacaactgcaacggctgaaaacccccttccgcactgacggaacaatcaccgccggcaacgcctctggcgtcaatgatggtgcggcggcactcatcatcgcctcagagaaggccgctttgcagcaggggctgacaccccgggcgcgcatcatcgcaaccgctacctgcggcgttgaacctcgcattatggggatcgggccactgccagccacccgcaaggtactggagctcactggcctgagcctgaaccagatggatattattgaactcaatgaagcctttgccgcgcagtcactggctgtcatgcgtcagttggggctatcggatgatgcagaacaggttaatccgaatggtggcgcgattgcattgggtcatccattgggtatgagcggggcgcgtctggcgctgactgccactctggaactggaacggcgtgccggccgctatgccttgtgcacgatgtgcatcggcgtagggcaagggatcgccatgattattgaacgcgtatcgtaa

SEQ ID NO: 1771 - DNA, 456 bp, Xenorhabdus bovienii
  Coding DNA location: Contig name=SeqID_16865; Position on contig =96143..96598bp; Strand=-
atgtccgctaacgcttccagccaactggctcagcgctgcattgaagccatgtatgccaaagatgcctgcgcccagaatatgggaatgcacatcgaccatgttgatacaggggtcgcccaagtgagcatgaccattaaaccagacatgctcaacggccatcaaagctgtcatggtggcatcctgttcagtctggccgataccgccttcgcctatgcctgcaacagcgaagggctggcagcggtggcatccggttgcagcattgattttatccgcccggcctttagcggtgaccacctgacagccaccgcttttatgcagcatcagggcaaaaccactggcttgtatgacgtcaaaattatcaatcaggacggcaaaatagtggccttcttccggggtcacgctcatcgtctcggtcattctattctgaaagagagccagggagagcaacaatcatga

SEQ ID NO: 1772 - DNA, 1599 bp, Xenorhabdus bovienii
  Coding DNA location: Contig name=SeqID_16865; Position on contig =96588..98186bp; Strand=-
atgaacacgccagcacatcatcgtccgatccttcacggcccgattgccgtcattggcgcgggaacgatggggatcggcattgcgcaagtcgccgctcaagcagggcattccgtcctgctgtttgatgtgaagggtgaagcggcacagcgtgcactggagacgctgcacacccgtctgcatcagcgtgtggaggcaggcaaagcagaagctggcgcaacccaagccctattgcagcgcatcacacaggttgactccttacaggcactagcaccgagcgcactggtgattgaagcgattatcgaacaactggaggtcaaacagaacctgttccgccaactggaaccgctctgttcagccgaaaccatttttgccagcaacacctcatcgctatcgattaccgccattgcccgtgtgctggcttcaccccaacgcatggcggggctacattttttcaaccccgcgccactgatgaagctggtggaaatcgttcaggggttggaaacatcttctcaaacgatagccgcactcaaaagtctcgtcaccgattggcaaaaacagcctgtagtctgccgctctacgccgggttttatcgtcaaccgcatcgcccgcccgttttatgcggagactttgcgcgcattggaagaaaacattgcttcccccgccacactggatgcagtaatgaaagaatctggcggctttgcgatgggggcgttacagcttaccgatttaattggtcatgacgttaattatgccgtgaccgaatccctgttccacgcatttcacggtgatccgcgcttccagccttcactgcgacaaaaagagctggtagaagccgatcatctgggacgtaagcgcggtcgggggttttatgtttatgatggcaaagaaaaacatcagccattaccccggttggaaaccctccaagagcaaatacggcctacgcggattcaggcaacgggcgattggggaactctgccacattttgccgcgctgttaaaaccgttgttaccacaatatggaatcgccctcgaagaaagcaaaaataccggttcccagccgccagcattacagcttgatgacgttatattaacgctgacacaaggtaaaaccagcgcacagcttgctgatgaaatcagggcgccagtggtacagtttgatcttgccgccaatcatcagactgcttccatcatcactcttagctcggcctgccagaacacccagctgcagacggaaaaagtgatcagtttcctgcaatctctcggcaagcaggtggttctcctgccggattacccggccttactgacgatgcgcaccgtggccatgttgtgcaacgaagcgctggatgccatcaataaaggcatcgccagcgccgaagatatcgagctggcgatgtgttacggcgtcaattaccccatcggcccgttggcatggggggaacaactgggctggcggcacattctcagcacgctggaaaacttacagcaattttatggtgaaccccgctaccgacctgcacctctgttacgccaactggcggcaggctatgtaacgctgcatctccagcgggatcaagataaggagcacaaccatgtccgctaa

SEQ ID NO: 1773 - DNA, 798 bp, Xenorhabdus bovienii
  Coding DNA location: Contig name=SeqID_16865; Position on contig =98189..98986bp; Strand=-
atggaaaatatgtcaatgatactcactgatattgaagcaggtgtcctcagcattacgctcaaccgtccagaacgcattaacagctttaacgaggaaatgcaccaacagttaagtgaagcgctgaagattgctgaacaggatgaatccgtgcgctgtgtcctgctctcaggcgctggacggggcttctgtgccggacaagatttaaatgatcgcaacgccatcacctcggagggtgacgttcctgatctcggccaatccgttgaacgtttctacaatccgctgatccgtcgcctgacttccctgcccaaacccgtgatctgcgccgtcaacggagtagcagcaggcgcaggcgtctccgttgcactggcctgtgacattgtgatcgcttcccgtaccgccagctttattcaagccttctgccgcattggtctgacgccggatgccggcggtagttggttcctcccccataaaatcggacatgcccgggcaatgggaatggcattattgggagacaaaatcagcgcggaacaagcactggaatggggcatgatctggcaggtcatcgaacccgaagcgttagaagataaaacacgggagctcgctcaacatctggcgacccagccaacggtggcgctgagttgcatcaagaaagccacttatgccgccgcagccaatagcttggatcaacagcttaatctcgaacgtgatttacagcgcctgtgcggacgcagtgaagacttccgtgaaggtgtcagtgcattcattgacaaacgccaaccacagttcaaagggagataa

SEQ ID NO: 1774 - DNA, 774 bp, Xenorhabdus bovienii
  Coding DNA location: Contig name=SeqID_16865; Position on contig =98990..99763bp; Strand=-
atgagtcacgaatggattttatgccaccagcaacaacgggtacgcacgctgaccctgaaccgtccagaagtccgcaatgccctcagcaatgactgtctggagcaactcgtgcagcaattggaacaggcggatgccgataccggaactggagctatcgtcattacgggttcatcaagctattttgcggcgggcaccgatctcaaggaactacagcagcagaccgttgcgacggcaatgacagaccgccgcccacaactctggcagcgtttgcacaacatcaccaaacctcttattgcggccgtcaatggctacgcactgggtgcaggttgcgaactggtgctggcctgtgatctggtgatttgcggtgaaagtgcccgcttcggcctgccggaaattacattgggattgatgccgggcgctggcggtacacagcggttaatccgcagtgtgggcaaagcactggccaatcaaatgatcctaactggcgaggcgatcgacgcccaaaaagcacagcaggcagggctggtgagcgaagtctgtatcgatgctctgacgctggaacgcgcggaacagattgccctacgcatcagtgaattttcgccgctggcgttacgggcggctaaggctgcactcaagactgcatacgaaaccagcctgtcacaagggctgctcgccgagcgccagcaatttgtcgctctggcggggacagccgatcgccaagaaggcattaccgcttttcttgaaaaacgtaaaccaacattcaaagggttctga

SEQ ID NO: 1775 - DNA, 1311 bp, Xenorhabdus bovienii
  Coding DNA location: Contig name=SeqID_16865; Position on contig =99788..101098bp; Strand=-
atgccaagcaacgtctgcgggagtccggcatcgcgcctccgcagggcctggcttgtgaaaaaccgacagagacagaaacaatcacctgcccacgttgtggcagccatgagaccgaaaaaatcagtgaattcggttccaccgcctgcaaagcgctctatcgctgtcagcagtgtctggaacccttcgactatttcaaatgtatttgagtttagggagcagcaaaagatggctacttttcatcgtccgacttttcaccgcttaagcattgcagcgattgagcgggaaacacctgatgccgtgaccgtcacactgcatgtccccgatgagttgaaagccctcttttgctatcaacccggccagcacctgacactcaaggcacgggtggatggcgcagagctacgccgctgttactccatttgcagttcaccactggacaatggattacaaattggcatcaaggccacctatcaaggacgtttttcgacgttcatcaaccagcagcttaaagtcggggatgagctggatgtcatgcaaccacaaggcaatttcggccaccatcccgatgggaacaaagcgggaaactatctggcaatcgctgcgggttcgggtatcacgccaattctatcgatcatcaaaagtacactggcgctggaaccggatagcaccttcacgctgatttacggtaaccgcaccagccgttccgtgatgttcaaagaagcactggccgatctgaaaaatcgctacctgcaccgttttcaggtgctgtaccttttcagccaggaaatcaccgatagcccgatgttcaacggccgcattgatagcgaacaccttcaacgcctcggcaagatcctgctcaatttcagccagttcgaacaggcctttctctgcgggccagcagccatgctggatgatgctaaatctgcacttgagcaggccggcatggcgtccgaacgtatccatacggaacgtttcaacaccgggcgtaatccatcaagcaccgctgttcgcccggccaatctggctgaacgcaatgaaacccatgtggagattcatctggatggccgcaccctgaacattgccatgaacaccgaagatgacagcattctcgatgcggcactgcgtcaaggtgccgatttgccctatgcctgtaaaggaggcgtgtgtgccacctgcaaatgccgcctcaaatccggtgaagtggatatgagcgtgaactacagccttgagccggatcaactggctgccggttatatcttaagctgccagtcgtggccgaaaggcgacggcgtggttgtggattttgacatctag

SEQ ID NO: 1776 - DNA, 504 bp, Xenorhabdus bovienii
  Coding DNA location: Contig name=SeqID_16865; Position on contig =100893..101396bp; Strand=-
atggaacagcaagttaacacattacagccgccggctatccatcagatctggcaatgtctgcaccagattgccgatcctgagcttcccgtactctccattactgatctcggcatggttcgggcagtaacccctcagcaaaccggctggcgagtcatattcaccccgacgtactccggttgtccggcaacggaatacctgatcaatgagatccagcaaacactggcacgggcgggctttacgccgattactatcgaaataagcctgacaccggcgtggacaactgactggatgaatgctgatgccaagcaacgtctgcgggagtccggcatcgcgcctccgcagggcctggcttgtgaaaaaccgacagagacagaaacaatcacctgcccacgttgtggcagccatgagaccgaaaaaatcagtgaattcggttccaccgcctgcaaagcgctctatcgctgtcagcagtgtctggaacccttcgactatttcaaatgtatttga

SEQ ID NO: 1777 - DNA, 777 bp, Xenorhabdus bovienii
  Coding DNA location: Contig name=SeqID_16865; Position on contig =101426..102202bp; Strand=-
atgaagacacatagcgttgctccacccaatcatgatctgcttaattatgtgctacggcagggggataccccgttaattctggcacagcgcctgtgtgaatggtgcggccatacgccagagctggaaattgaccttgccctgtcgaatatcggcctcgatctgctgggacagtcacgccattttctcagctacgccgccacactttatggaatggattttgatgaagatcggctggcatttggccgcgatgaacgagaataccgtaatctgctgctggtagagcaacccaacggcggctttaacgatacgctggtgcgtcagttttttattgatgcttatcacgtcctgctccatcaggtactagggcagagccgcgatccccaattggccgctatcagcaccaaatcgttgaaggaagtcgaatatcacctgcgtttcagccgtggctggatgatccggctgggggatggcacagaactgagccgcgagaaaatccagcaatcggtcaatcaactgtggcgctttactggcgaactgttctattgcgatgaagtggaacaacgactgaccgaagatggtactgcagtcgatccccgtactttgtacgaaccttggcggcaaatcatcaacgagacattcgcccaagccacattggaaattccgcaggaaacaccctaccgacagggtggtaaacaggggctgcataccgaacatctgggatacatgctggcggaaatgcagtatctgcaacgcacctatcccaactgtaactggtaa

SEQ ID NO: 1778 - DNA, 288 bp, Xenorhabdus bovienii
  Coding DNA location: Contig name=SeqID_16865; Position on contig =102213..102500bp; Strand=-
atgattgataccgattggccgctgtatgaagtctttatccgcagcaaacaggggctggctcaccgtcatgtcggcagcctccatgcagcagatgatcaaatggcgctggagaacgctcgcgatgtctacactcgccgcaatgaaggttgctccatctgggtagtgaaatctatctatctggtggcatcacaacctgaagagcgcggggcttttttcgatccctcggaagacaaaatctaccgtcacccgactttctataccattcctgatggcatcaagaatatgtaa

SEQ ID NO: 1779 - DNA, 942 bp, Xenorhabdus bovienii
  Coding DNA location: Contig name=SeqID_16865; Position on contig =102545..103486bp; Strand=-
atgacaactaactcacttcaagcgtactttgacgccaaaatcgcggcggatctttccattgaggccaaagactggatgcctgatgcctatcgccaaaacctgatacgtcaaatcggccagcacgcccattcggaaattgtcggcatgttaccggaggccaactggatcacccgcgctccgacactacgccgcaaagcggtgctgctggcaaaggtacaggatgaagccggacacgggctttatctgtacagcgcggcagaaacactgggctgtacccgtcaggacatctaccagaagctgctgaatggcaagatgaaatattcatccatctttaactatcccaccctcaattgggcagatgtcggggtgattggctggctggtggatggggcggcgatcatcaatcaggtcgccctgtgtcgggcatcttacggcccgtatgcccgtgcgatggtgaaaatctgcaaggaagagagtttccaccagcggcagggttatgaagccgttatggtactggcggcgggcaatgacgcccaacgcgcgatgctgcaagatgccatcaaccgtttctggtggccgacgctgatgatgtttggccccaatgacaatgattcccccaacagcgcccaaagcatggcatggaaaatcaaacggttcagcaacgatgaattgcggcagaaatttatcgacagcaccgttccgcaattggaagcactgggcatgaccgcacccgatcccgaactggcctgggatgaaaccacggggcactaccgttttggtgaaatcgattgggacgaattctatcaagtgctcaaaggacagggcatatgtaatcacgaacggctggaagccaaacgccaagcttgggaaaccggaagctgggtgcgtgaagccgcttcagtgcatgccaagaaaatggcagccagaaaaaatgccgcttaa

SEQ ID NO: 1780 - DNA, 2109 bp, Xenorhabdus bovienii
  Coding DNA location: Contig name=SeqID_16865; Position on contig =103778..105886bp; Strand=+
atgattgattcattaatgcgttcggcggagaaaaaaatgcaacagttaaccagttatatttgtggtgcttgggtttatgggcagggcaacgccagagccattcatcatgcggtgagtggtgaagccttgtatcaagtgtgttcagatggtctgccactggcggatagtctgggatatgcccgtgaaaaaggcggtaaatcgttgtccgccatgacgttccaacaacgtgcgcagatgatgaaagcggtcgcgaagcatctgcttgctaacaaagaaacgctgtatgctatttcagcagaaaccggagcgacccgtgcggatggttgggtggatattgaaggcggcattgcgacgctgttttcttatgcagggctggcggggcgtgagttaccggatgataccctgtggccggaagatgagatgatcccgctttctaagcagtcgcagtttgtggctcgtcatatgttgacttcgcgtcccggcgtcgcgctgcatatcaacgcgtttaacttcccttgctggggaatgctggaaaaactggcaccaacgtggatggccggtatgccagcgatcatcaaacccgcgacggcatccgctcaattgacgcaggcgatggtcaaaatgatcattgatagcggtctggtgccggaaggcgcactgcaattgatctgcggtggcattggcgatctgtttgatcatctcgattatcaggatgcggtgacttttacaggatcggcgcagaccgggcagaagctgcgtgtccacccacgactgatcgaaaaatccattccgtttaccatggaagccgattcccttaactgctgtatgttgggcgaggatgtaacgcctgaaatgccggaatttggcgtgttcatcaaggaagttgtccgcgagatgacggccaaggcagggcaaaaatgtacggccatccggcgtattatcgtgccagtcagtcagcttgaggcggttaaacaggcactgcttaaacgcctttccggagtgaccgtcggcgatcctgcgctgccggaagtgcgcatgggcgcgttgattagccttgaacagcgcgatgaggttcaggccaaggttgatgaactgttgagtcacggttgtgaacccttgtgcggtggttctttggatcaactggtgctgaccggtaattccagcagcgagggcgcattctacccaccgactctgctctattgcgctgatccggtgacacatcaagccgtacatggcacggaagcttttgggcctgtttccacgttgatgccgtatcaggggacagaacaggcgatagcgctggtgttgatggggcagggcagtttggcgggttcgctggtcacggcggatgagcagatcgcggtgcaggtgatccgggcaacagcgtgtgcccacggccgtatgctggtgctggatgaagcggcatcggcggaatctacggggcatggatctccactgcctatgctggtacatggtgggccggggcgtgccggcggcggtgaggaactcgggggactgcgggcggtgaaacactatatgcagcgcaccgcgattcagggcagcccaaacatgctggccgccatcggccgtgaatgggtacgtggtgccaaagtgaagtccgatccggttcatccgttccgtaaatatttcgaacagcttgagattggtgaaagcctgctgacggctcgtcgtactgtcaccgaagctgatatcgtcaattttgcctgcctgagcggagatcatttttatgcgcacatggataaattgggtgcggcggaatctctgtttggtgaacgtgtggcacatggttattttgtcgtgtcggcagcagcgggattgtttgttgatgcagcggttgggccggtgcttgctaactatggtatggaaaacctgcgttttattgagccggtgaaaattggcgatactattcaggtacggctgacctgcaagaagaagattaagaaagcccagaaaacccctgatgacaaaccgcaaggtgttgtggtgtgggatgtgcaggtcttgaatcaggagcaacagccagtggcgctttacagtattctcacgctggtggaacggcagcaaggggattttaccgcgtctgagtag

SEQ ID NO: 1781 - DNA, 297 bp, Xenorhabdus bovienii
  Coding DNA location: Contig name=SeqID_16865; Position on contig =105829..106125bp; Strand=-
ttgtccaccttaatattaaaaggtaatacctttgactgctatatcataaaatctttactttcttggaagaattattccgaaaactgcaactcacctattctacagataaaattcaacccgaattcaaactttagagaacagcctgaggatcaccgctattttattttctttgacaaatatcctcaggcatttcagtttccttactcaacaaatctccgatttgtttatctcaaccgcacctactcagacgcggtaaaatccccttgctgccgttccaccagcgtgagaatactgtaa

SEQ ID NO: 1782 - DNA, 273 bp, Xenorhabdus bovienii
  Coding DNA location: Contig name=SeqID_16865; Position on contig =106127..106399bp; Strand=+
atggcgacatcagtaaaacttgacgataatttaaaaagccggatccagaatttggcagaagtgcgccagcgttcggctcactggataatgcgtgaagctatacgtgattatgtagagcgtgaagaaaaacgtgagtccttcaaacaggatgtattgcgagcctgggaagcgtatcaagagaatggattacacctgacacttgaagaagccgacgactggttagcaaagctcgaagcaggagataatacggagttacctgaatgccacgtttga

SEQ ID NO: 1783 - DNA, 132 bp, Xenorhabdus bovienii
  Coding DNA location: Contig name=SeqID_16865; Position on contig =106387..106518bp; Strand=+
atgccacgtttgatctggtctccggcggcccttactgacgtacaaaagctctatcgttttctagtcaagaaagatgaagcagcagctcgtagagctattaaaacaatacgtgccagcgtgacaccagcctga

SEQ ID NO: 1784 - DNA, 378 bp, Xenorhabdus bovienii
  Coding DNA location: Contig name=SeqID_16865; Position on contig =106484..106861bp; Strand=-
atgaaacagtatattgaagattatattgatatacgatatggcttgaaagttacggtaaaagaacctaatacactaaaaaaaagcctgaatatactgaactcaatattagcaaatggcagatttccatcattacttcccccaaccgaaaaaacttacctaaacaacagagcgtcactctctccttttctagataatttagtatcccgcttctttttggtgctgcaccgcaagaattgtggctgtttcaccatcaaaacgatacaagtcaatatagccactgctaccaaaatcaataagccattctcggaatacgggatccatatcttcagcagggcgtcctacttcaggctggtgtcacgctggcacgtattgttttaa

SEQ ID NO: 1785 - DNA, 132 bp, Xenorhabdus bovienii
  Coding DNA location: Contig name=SeqID_16865; Position on contig =106858..106989bp; Strand=-
ttgatcgtacggatttcgcacggcttccagggaggaacatctttgagcctgtgttatggtggtaaccgttttagtgaagacctagatttcgcaggtggaaaagattttcgtcccgccaattgggggcgatga

SEQ ID NO: 1786 - DNA, 537 bp, Xenorhabdus bovienii
  Coding DNA location: Contig name=SeqID_16865; Position on contig =106986..107522bp; Strand=-
atgaaccagactacagccattcactgcttaaacaagctcgatcaacaaggtcgttacgtcttcaccagtagagatctcgctaaactgttttcggaagacagcaaacgctcttttgaagccggactgagtcgtctagtcaagcaaggtatcttatcgcgtgcttgtaaaggggtttacgtgttcaccttatcaagacacaaaggacttcacacactagaattgattgccaaaacaatgcgacgcggtgaatacaactatgtcagtttggaatctgctctatctgaatacggagctatctcacaaatccccattgatcggctgacggtgatgacgacgggtagaaagggggaatacaacacaccttttggtacggttgaatttacccatactaaaagagcagtatcagacattatcaaccacatccaagatgttggcagaccacttcgtctagcaaataaacaggcagcttaccgtgatctaaagcgagtaggcagaaacacacacttggttgaaaaggaaatggtctatgaaaattga

SEQ ID NO: 1787 - DNA, 1038 bp, Xenorhabdus bovienii
  Coding DNA location: Contig name=SeqID_16865; Position on contig =107549..108586bp; Strand=-
atgacaattactctgacagatgcccaaaaagaagccctcgaattgatgcacgatacgactcgtgatgggcgtgtacgtgaccgcatcaaggccgtgcttttggcctcagaaggctggactgcccagatgattgcccaggctttgcgtattcatgaaagtacggtgagtcgccatctgaaggattacgtctctgaggaaaaactcgcccctgaaaatggcggctctgaaagccgtttatctgccgaacaaacgacagaattagtggagtatctgacggcaaatttgatgcacactaccgcgcaaattgtggcttgtgtctgggcgcgctggcaggtgactttcactgtggctgggatgacaaaatggctccaccgccaagggttcagctacaagaagccgatgggaacgcctcataaatccgatgcgggtaaacagcaacactttattgagacctacaacgcgttgaaagctgaatgtggccaaaatgcgcctattttgtttattgatgcgatgcatcctacccagtccacaaaattaagttacggctggatgaggcgcggaagagagcatgtcaaagtggtcgaaaccacaggcagccggacccgccttaacatcatgggcgcactcaatttgcaacggattgaagagaccattattcgtgaatatccgacgattaacgcgaaaaatgttgtcctgtttttcggctcaattcgagaaacctatccgctttcacaaaaaattcatctcattctggatggagccggttaccaccgcgctgaaatagttcaattttttgccgaggtcctgaatatcgagttgcattatctgcccccttacagccctaacctcaacccgattgagcgattatggaagtatgcgaatgagcaggtacgaaataatatctatttctcggaggcaaaaacattccgtgaaacgctgcatcacttttttcatgtcacattgccagaaaaagcgaaagaactcaccacccggttaacagataatttccagactttaagtcctgcatcttcaagttaa

SEQ ID NO: 1788 - DNA, 156 bp, Xenorhabdus bovienii
  Coding DNA location: Contig name=SeqID_16865; Position on contig =108522..108677bp; Strand=-
atgtgtacacaaatctcactttataatgatatatacccatcgtcattgaagatgcttgattttttattcgtatcagatcaagatcgcgcccatgacaattactctgacagatgcccaaaaagaagccctcgaattgatgcacgatacgactcgtga

SEQ ID NO: 1789 - DNA, 1080 bp, Xenorhabdus bovienii
  Coding DNA location: Contig name=SeqID_16865; Position on contig =109360..110439bp; Strand=-
atgaaaacctatccattgcaaagtatgacgatggcgcaagcccagcagcagcagttcaaactggtggatattatctgtcgtcactttcctggcgctgattttctctcgcaaggtgatctgggcttagtcccggatctgcaccaaccccggatgacccaccgtattgaagcggtcatcgcggagcattttggtgctgaggcggcagcctttgtcaatggagccggaacaggggcgctacgcgcggggttggcagcattggtcagtcccaacgctacgttgctcgtccacgatgcaccgatttatcccacgaccaagatatcgattgaacagatggggcttcacgtggtgcatgcagatttcaatcatacagaacaaattgcagcggccatccggcaatatcaacctgctgcctgcctgatccagcatacacgacagaagatagatgacagctacgccctgcaagatgtgctcgccatactccatcagtatcaaattccctcattggtcgatgataactatgcagccatgaaagtggcgcatattggctgcgaatatggcgcgacactctccagtttttcctgttttaagttactggggccacagggagtcggcttagttgtcggcaaacaaacaacgattgagaccctacgccgcagcatgtactccggtggctgtcagatacaaggctatcaggcaatggaagcattgcgtgggctggtgtccgcgccagtgacccatgcagtacaggcagaagttaatgaaacgttggtgacacgattgaatcagggggaattgccgcaggtgaaacaagcatttctggctaatgctcaatccaaagtgttattggtggaatttcacgaacccatcgccgaagtggtactgactgccgcacatgggctgggagcattaccttacccagtgggtgcagaatccaagtttgaaatcccgcctctgttttaccgtatttccggtacatttcgtcaggcagatcctacactggaaaaacgcatgattcgcattaaccccaatcgcagtggggcagaaacagtgatacgtattttacgggaaagtattttgtag

SEQ ID NO: 1790 - DNA, 1368 bp, Xenorhabdus bovienii
  Coding DNA location: Contig name=SeqID_16865; Position on contig =110444..111811bp; Strand=-
atgagtgatatcaatgccacacaacatcttcacagttttctgatgagcctgatggaagttgacccttccaaggccgggttgctcgctgccattggtgcgattgctgccatgatggcaaaccgtggtattgctgttttccatgatggtctgcgcccactgctaccggaataccttgaaggccggatgagccgcaaggctctcgccgcgaccagctttgccctgagcatcggtctggttgtcggctttggtattcccttttcactggcagcgccgattgtgctggttcacagcctgctgctcggcactgatatgatcggcatctggtgtgccaacagccgaagagggtttatcgcctcgggtatcatcggcgccctgtatgccattgccttgctcgccggcctgcgctcagtcgtcgaactgtttgccatgctgccggtgaatttcaccgatgacctcaagaaagttggcgatcctattgtcgcctgcttcgcgctgttccctgcgatagttgtgggttatcaatatggctatcgcaaagggctatgggtcatgctcaccgcgttgataggctatctggccaccaaggcgattggcccgctcagctttggtggcatgatcgaaaaaccggtcagtctcgatcccaacggcgcagcattgctgttgtcgatgactgccatgttctactttgcgatgcgggagcgtccagcccagtcagcggaacagaaaggagccaatgaagttttagtcgggctgttctctacccgtattgaacgcatccagaaaaacaaatggctgttgatcctctgcggcggcctgaccgcaagtgccgcgaccatgtctttcagcctgctggccgaaggcccggtttccctgcaattaatggcgcagggcgaacagaccaacgccctgttggtcgcactggcacgcgccatcagctttgtcccgctggtcggcaccacggcgatagccacgggagtttacagcccgaatggcatgaaattcgtgtttgtggcgggtctggcaaccaacaacccgtggatcgcctttattgcgggcggtatcaccatgttcattgaaatccagctgctagcgaaaatcgccatttggctggataaataccctggcgtaaaagcctgtagtggtcatattcgtaccgcgatcaccaaaatgctcgaagtcgccctgctggttggtggtatgattgcctccaacgctattttgccaggtataggctttatgatcgtggcgggtatctacctgctcaaccgcacttccaaacgtcctttggtagagatggctatcggcccaatcgcaactattgcggtgggtatccttgccaacgtgctctatctgctgggaataaagtaa

SEQ ID NO: 1791 - DNA, 363 bp, Xenorhabdus bovienii
  Coding DNA location: Contig name=SeqID_16865; Position on contig =111822..112184bp; Strand=-
atgaaatttgtcgttggtggacaaatagaaaaagaaagaatagccgaaggcattcgacaattagcgggagacaaagccactgcaattaccatcatgaatgacattgaagccgctatggcgattaaaaatggtgatgcagattactatctcggtgcatgcaataccggtgggggtggcgcactggcaatcgccatcgcccttatcggcctgaatcaatgtgtcaccatcagtatgccgggcaaaatcctgtctgacgacgagatcattgcccatgtgaaagcaggtaaaaaagcattcggttttacaggtcaggatattgatgttgtcctgccggtgatcatcaacaccatcgtttctcggtga

SEQ ID NO: 1792 - DNA, 1089 bp, Xenorhabdus bovienii
  Coding DNA location: Contig name=SeqID_16865; Position on contig =112270..113358bp; Strand=-
atgggataccagaaacagactgggaatacacccacacattccgctccgtattcctcatccagaattgatgaagctgaagacgcactcaaacaggcgggctaccaagaatatcaggttaaacgtcggggtgagacgctgttatattcatcaaacaatcaattaaataacccatatccgggcacgaagcaaaatacctgtattgatacatcaggctatacctatgtacatgaacatctgcatatcgatctctctggtgcgaaaggcagtctcgactgtcggttagaccaatacgatctgatcgtcgatgaacttcgtcacctttatacccttggcctacggaacatcgcggagatgaccaactgctacatggggcgcaatgccagctttctactggatttgatgcgtgatagccacatcaacatcattgcttcgacgggttactataaagagccattcttccccgttcatttcagcgaattaagtgtacaggcgattgccgacgatatgattgctgaaattgaaacgggcattgacggtactgggctaaaagccggtgtgatagcagaaattggttccagccttgatcaaatcacaacggatgagaagaaagtgtttgcagccgccgctctggcacatcatgccactggctgccctatctccacccataccaccttaagtacaatgggacgtgagcaactgtctctgctcaaagaatttggcgtttccgctgcacatgtggctatcggtcattgtgatctgaaagataacctcgacacgattattcccctgcttgaagaaggggcgtgggtacaattcgatacgattggcaaaaacaactactatccagacagcgggcgcattgccatgttgcgggaagtcgccaaacgtggcctgctgagccaagtgatgctctcccaagatatcactcgccgttctcatttaaaaagtaacgggggaattggattcgattatctgttaaccgtattcgttccgatgctattggcagccgatttttcccaaacgcagatagatctcatgttacgcgataatcctgcacaatttttccgacacggcttttctaagacttaa

SEQ ID NO: 1793 - DNA, 1176 bp, Xenorhabdus bovienii
  Coding DNA location: Contig name=SeqID_16865; Position on contig =113455..114630bp; Strand=-
atgtttatcaatgctctgaaaaaacagaaccccaaattgattgaaatagcaaaagacctttggcagcaaggcgcaatattaccagacacttacatcattgatgtcgatcaggtcttggacaatggtcgacgtttgctgcaagcagcagagcaatatggcgttgaactctatttgatgaccaaacagattggtcgcaatccttggctggctcaaaagctcattgaactcggttaccccggtgtcgtggccgtggatttcagagaggcatataccctgagtcagcatggcataccgctatgccacatcggtcatttggtacaaacccctgcacacctgatagaaaccatgcttaaacagcatccgggtatcattacggtgttttccattgaaaaagcgcaggcgatctcagatgccgcagagaaattgggacgggttcagcccatcatgctgaaagtgtttgataagcgtgatatcaccttaccctctcaggaagcaggcatcctcttcgatgaactggatacaaccgttgacatattaaaaaccatgccgggcattaagttgagcggtttaacccatttcccctgcctagagtggaatgtccgatatcagacaaccctgcccaccatcaacttgcagaccctcctcagggcgcgcaacagacttgaacagcttggcattgaactctcacaaatcaatgcgccttcagcatcaagctgcaataccatccccctgctggcaaaatatggtgctacccaccttgagccgggacatgccctgaccggcactatacccgccaatatcagtggccgcgaacctgaaaagatctcaatggtctatatcaccgaggtttcccaccattacgacggcaacagttactgctatggcggcggctactataaacgtgggcatatgaaatacgcgctggttttccctgaatgtgcgcgctcccccaaaaccgtgcgggtactgagtctgggagatccctgcattgattaccatctcccgatatccggtatccaccctatcggcagcccagtgatcatgtgcttccgtacccagatttttgtcacccgcagcgacgtagcgctcgtttccggcattcaatcaggctcaccaaagcttgaaggtatttatgacagccaaggaaattggaaaaacagaggttattttcaataa

SEQ ID NO: 1794 - DNA, 144 bp, Xenorhabdus bovienii
  Coding DNA location: Contig name=SeqID_16865; Position on contig =114643..114786bp; Strand=+
atggctgcaatgcggcacggctgtgtgaaagttaaaaaggctgagaaatccaaaatattcatttttttgaatatttatagtgtaaacaaaattcagggaattttggttgcaagtattaaaccatataaatttaccaacagatag

SEQ ID NO: 1795 - DNA, 363 bp, Xenorhabdus bovienii
  Coding DNA location: Contig name=SeqID_16865; Position on contig =114735..115097bp; Strand=-
atggtagaacaacggctaactatcctgttgcaaggtggcgtcattgatcaagatatctacgataacatgcttgatattgtgcatgatctggaagatatctggttaatccctgtccatcatccacaaggcgaaatggcgcttacccacatggcgagtgctttcatgcgctcacgtcgtggcgaaattgttttgccacttgaaaataacatcttgaccaaaatcgagcagtcagagcactgtgcgcaattattcaaaatccatcgcgcattgttggaaaaattcacagtcacactgcaccccaacgaagaaggctatctgttggtaaatttatatggtttaatacttgcaaccaaaattccctga

SEQ ID NO: 1796 - DNA, 909 bp, Xenorhabdus bovienii
  Coding DNA location: Contig name=SeqID_16865; Position on contig =115147..116055bp; Strand=-
atgatgagtcaaacattcattaaaaaagaggggattgcacaatcgtttctagctcgttatctcctctctgagcaatgtggcaaccgcctgaaaactattgagttactagctaaagaatgtggattgtccgtaggtttaatgcaagcagcattgaaatctcttgaacaggcacaagcggttggaattaagcgtcgtggtcgtaatggcagctttctttcgcagattaaccataaattactcttagagtacgccgatatcggcaatgtggtctgcgcgatgccgcttccttatacccgtgcctatgaaggtctggccagtggtttaaaagtattgtgtgcagagattcctttttattttgcacatatgcgtggctcagacatccgcattgaatgcttactgaatggcatctatgacttagcagtaacgtcgagacttgccgcagagcagcacccagaaaataaagatttatatattgcgctttcactagggacacaaagttatacagacaggcatagattaatctttcgtcatggcgaaatggattccattcgccgggttgggttggacagtacttcagcagaccaaaaaataatgacaaatcagtattttgaaggaaaagagattgaaatggtcgaggtctcctatcacgaatgcctgaatcaaatcatgaaaggccacattgatgcggccatttggaacgtcgggcaaggtcacgaactgatagcacaaggtttgatgactcagctcccggatgacagtgagtgctttatcaaagcctccgaagccgttattttggctcgtaaggacaacatccccatccagcagctcctgcacaccatggttgatcgggaggtgctgctgactcatcaacaaaacgtggtcgcaggcacaatcgaaccggtttattga

SEQ ID NO: 1797 - DNA, 510 bp, Xenorhabdus bovienii
  Coding DNA location: Contig name=SeqID_16865; Position on contig =116491..117000bp; Strand=-
atgttaaccattcgggaagcgacaatcagagacgcggtgctgttatcccagctcattgaggaaagctatcgttttcacttttcccatttgtggcataacaaagccgaattggaagaatatgtcgccgaagagcgttcaccagaacgaatatcggactcactccgcacccccaatcacaagtggtttattgctgaaaccgatcacccgattggttttggcaaaatcgccttccatgaaccgatccctgatagcgatttaacgggcgtctatttgcataaactccatctgatgccacatcagactgggcagaaatacggtgagcaagtctttgaccatatagtcaaactcggtcaggaacaggggttacaatggctttggctggaagtattggaacagaacacattagccatcaaattttatgaaagaaaaggaatgagatggtataaaaatattatcttttccagtcccaagcagaaaagtaccctacatattatgactaaaccaatatga

SEQ ID NO: 1798 - DNA, 141 bp, Xenorhabdus bovienii
  Coding DNA location: Contig name=SeqID_16865; Position on contig =117017..117157bp; Strand=-
atggtaggatgtcgaaaagctgatttaattattttaccgggaacaggccatatccatactgccgcaggtttcggtgactgtccggaagaaaagcggctgatcaacgaaatatccgatgatagcctgatccctaataaataa

SEQ ID NO: 1799 - DNA, 1506 bp, Xenorhabdus bovienii
  Coding DNA location: Contig name=SeqID_16865; Position on contig =117377..118882bp; Strand=-
atgggaaccaaagacttgattgtgatcggcggcggaattaacggcgcgggtattgcggcagatgcggctggccggggactttcagtcctgctattggaaggtcaagacttggccagtgcgacttcgtctgccagttccaagctgatccacggtggcctgcgctatctggaacattatgaattccggctggtcagtgaagcactggcagagcgtgaagtattactgagattagcgccgcatattgcattcccaatgcgttttcgcctgccccatcagccacatctgcgcccggcctggatgatccgcattggcctgttcctgtacgataacttgggtaaacgcgttagtctgccaagcagcaaggggctaaagttcggtgcaaattccgtgctaaaaccctccatcagccgtggttttgaatattccgactgctgggttgatgatgcccgtctggttgtcctgaacgcacaggaagtccagaaacatggcggtgaagtccgtacccgcactcaagttacccacgcatggcgtgaaaagggttactggatggttgaagcgaaagatctcaccacgggcaaaaccgatacatggcgcgccaaaggtttagtcaacgcgactggcccgtgggtcaaaaacttctttgatgatgggttgaaactgaaatcaccttacggtatccgtctgattaagggcagccatatcgttgtacctcgcgtgcatgatgaacctcaagcctatattctgcaaaacgaagataaccgtatcgtgtttgttattccgtggaatgatgagttttccatcatcggcaccaccgatgttgaatacaaaggcgatccaaaagaagtcaaaattgacgatcaagagatcggctatttgctgaaagtctataacgaccacttcaagaaacagcttgaccgtagtgatgttgtctggacttactccggcgttcgcccactgtgcgatgatgaatcagattcaccacaggcgatcacccgtgattacacgctggatgtacaggatgaacaggggcagatgccattgttgtccgtctttggcggtaagctgacaacctaccggaagctggctgaacacgcgatggaaaaactggtacagtactatccaaacgcaggtaaggcgtggaccaaaaacggcaaattaccgggcggtgaactggaaggccatgatcgcgatggttatgcacgtctgctacgccagcgtcataactggctgccagaaggtgtggcacaacgctatgcccgtacttacggcagcaactgccagataatcctgaaaggcgcagaagccctgacagatttaggcgagttcttcggccacggcctgtatgaagctgagttgcgttatctggtcgaacatgagtgggtgactcagttagacgatgctatctggcgccggactaaattgggtatgtggctgaccgatgaacagaaacaacgtgttgctgactggctggcacagaacgttcaatcaagccaggcacaaggctaa

SEQ ID NO: 1800 - DNA, 759 bp, Xenorhabdus bovienii
  Coding DNA location: Contig name=SeqID_16865; Position on contig =119145..119903bp; Strand=-
gtgaagcaaactcagcgacatgatgcaataatcgagctggtgcgccttcaaggttatgtcagcactgaagagctggttgaacactttgatgtcagcccgcaaaccatccggcgtgacttaaatgatctggcagacaaaaataagatccagcgtcatcacggcggagctgcattaccctccagctccgtcaataccgcctatcatgaccgtaaaatcatgtggtcagatgaaaaagcccgtattgcccggcaggttgccacccagatcccaaatggtgcaaccctgttcattgatattggcaccacccccgaagccgtcgcgtatgcactactcaatcaccgggatttacggattgtcaccaacaacctcaatgttgccagcctgttcatggggaaagaagatttccggttaattatggcgggtggtgaagtccgttcccgtgatggcggcattattggtgaagcaacgctggatttcatctcccagttccgccttgattttggcattcttgggatcagcggcatcgatagcgatggctccctgctggaattcgattaccatgaagtccgtaccaaacgcgccattatcgagaactcccgctgcgtgatgctggttgccgaccattcaaaatttggccgtagtgcaatggtcaacctcggcaacatgaaccttattgatttcctgttcacggataaagcacctcctgtcagcatccagaaaatcattgagcagcatagtgtcaaattggaactgtgctaa

SEQ ID NO: 1801 - DNA, 834 bp, Xenorhabdus bovienii
  Coding DNA location: Contig name=SeqID_16865; Position on contig =119965..120798bp; Strand=-
atgatccacgtaacctcaatatccaatccacgactggctcaggcctttattgattatatggcgacacagggcattaacttgactatgcgccctaccaatgaacctgcgctggttgagttgtggctggaagatgaaagccggttaggttttgttgagcaggaacttaaccaattttcccgcgatccactcaatgaacgctatcaagccgccagttggcaagctggcaaatcgggttattcatttaaatatcacaacagcctgaatttgagcaccctgaaaagtcagtccggcccgctgactatctccgtgaccgctctctgtatcttagtttatctctggatgcaggcggcgggtgattccaatgtcatgcgctggctggcatggcctaatggtgaacaatatctggaattatggcgctgggtcagccctgccctgctgcatttctcactgacacatgttctgttcaatctcgcgttatggtggtatctcggcagtcaggtggaaaggaatatgggtgccggaaaactctttgaaattacgatagtctctgcggttttcactgactgggcacaatcattgttcagtggatcgcattttggtgggctttctggtgtggtctatgcactgatcagctatgtttggctaaccggtgaaatttcccccaaaagagggatcagtgtccccagagggttaatcgctatctcggtcatctggttattggttggctatttcgatatgttttcactaaatatcgccaatgccgctcatttttcagggttaatcatcggcttactcatggggctatgggataatttacgtaaacaaaaaaattaa

SEQ ID NO: 1802 - DNA, 324 bp, Xenorhabdus bovienii
  Coding DNA location: Contig name=SeqID_16865; Position on contig =120872..121195bp; Strand=-
atggaccgttttcaaacaataaaccctgaacaagcctaccagcattggctgaataaaactgctgttatggtggatatccgtgatccacagagtttccgtgccggacatacaacaggcgcatttcatctgaccaatgaaaccctcaataacctcctgcaagaagctgattttgaccagcctgtcatggtgatgtgttatcacggccacagtagtcaaggcgccgcacaataccttgtgaatatgggttttgaaaccgtttacagtgttaatggtggctttgacgtatggcagagaagctatcctgaggccgttaacacgctatag

SEQ ID NO: 1803 - DNA, 576 bp, Xenorhabdus bovienii
  Coding DNA location: Contig name=SeqID_16865; Position on contig =121360..121935bp; Strand=-
atgattaatattactgaagcagcgcaagcgcactttgccaagctactggcaagtcaagaaccgggcacacagatccgcgtttttgtcattaatccgggaaccccgacggctgaatgcggtgtttcctactgcccaccggatgctgttgaagccactgataccgaactgaaatttgaccagatttctgcctatgttgatgaaatcagtgccccttttctggtagaagccgtcattgattttgtaactgatcaacttggctcccagctgaccctgaaagccccgaacgccaaaatgcgcaaagtgacggatgatgccccactgattgagcgtgttgagtatgttctgcaatcgcagatcaaccctcaacttgcaggtcatggcggccgtgtcagcctgatggaaatcaccgatgcaggttatgccatcctgcaattcggcggtggttgtaatggatgttctatggtcgatgtcaccttgaaagaagggatagaaaaagagctgttgaatatgttccctgagttgaaaggggtcagagacctgactgaacaccagcgtggcgaacactcttattactga

SEQ ID NO: 1804 - DNA, 999 bp, Xenorhabdus bovienii
  Coding DNA location: Contig name=SeqID_16865; Position on contig =122008..123006bp; Strand=-
atgcaatacggctggcaaccaatcctcccagcgaccaacccagccacagcgcattatccggtgcctgctgccatacggcatccgccatttccgccagagtcattgccggatacggctggctgcgaccataccccggcaaatccaccagatgcaggcggaagtgcgaagccaatcgcgtttccacggaacgccagacctcagaattcaacccccatccgtgcagcatcacaagatcgcgtggagcctcacccattatctgccaaaacaacttattcattgttattctcatcttatttgtcatcaaggaaggaacctatgctaacaatggttggatactgttggctatgccatcaaagtttgtattttgctcatcatgggatctgtcatatctgccaccagcaattaaaacggctgcaatgcgtctgtccgcgctgtgctctgcctgcggaatcgagagattttccctgtggccgctgcctgaagaatccacctccgtggcaacatctcatcgccattacggactatgccccgccattaagccggcttatccagcgctacaaatatcacggcaccccacaactcgcgacggtattagcccgtctgtttctcctgcattggttgcagggttatcgtgatggccgctggaataagccggattgtatactcggcattcccctgcacagcaaaaaacgctggcaacgtggattcgatcaaattgaactgatcacccagccgttatcacgctggctacaatgccactatcagcccgatcttttgtggcgctcgcgtgctacacttacacaacggggcttatctgccactcaacggaaaaccaatcttaagcatgcctttcaattgcgtggcgattttaccgatcaaaatgtcgcgattttcgatgatgtgatcaccacgggcacgacgttgcatgaagcctcacaattgttgattcgtgctggtgcccactccgtgcaagcctgggcaatatgccgaaccttgtag

SEQ ID NO: 1805 - DNA, 789 bp, Xenorhabdus bovienii
  Coding DNA location: Contig name=SeqID_16865; Position on contig =122718..123506bp; Strand=+
atgagaataacaatgaataagttgttttggcagataatgggtgaggctccacgcgatcttgtgatgctgcacggatgggggttgaattctgaggtctggcgttccgtggaaacgcgattggcttcgcacttccgcctgcatctggtggatttgccggggtatggtcgcagccagccgtatccggcaatgactctggcggaaatggcggatgccgtatggcagcaggcaccggataatgcgctgtggctgggttggtcgctgggaggattggttgccagccgtattgcattggatcatccggcgcaggtcgcgggtctgattaccgtggcatcttcgccaaagttcagtgcggaaggtgactggccggggattaaaccgactgtattgcaggcttttgagcatcaactgagtgaggatttccagaagaccgttgaacgttttctggcattgcagaccttgggcactgacagcgcacgtcaagacgcacgtttactgaaatctgtgatattgagccagccgatgccgaccgtggaagtgctcaatgcagggctggaaattctgcgtaccgatgatctgagggcagaactggcgcaactccggctacctttcttgcgtctgtatggttatctggatggccttgtgccgcgtaaaattgctgcacggctcgacaatgagtggccgcatactgattcggtcattatgcgtaacgctgcccatgcgccttttatttcccatcctgatgaatttgtggatgccttaatggagtttgtggttaacgcaggattgtga

SEQ ID NO: 1806 - DNA, 444 bp, Xenorhabdus bovienii
  Coding DNA location: Contig name=SeqID_16865; Position on contig =123553..123996bp; Strand=-
atgcctaaagagttattcactgctgaaatagaatcatccggccacctcaaaatgaaatgttcaacacgtggcttttccttccatgtggacgaacccaaaaatctgggaggaacggatgaagcaatgaatcccgtggaagcattactttcggctttcggggcttgccaatgtattgtggcgaaaagttttgcccgcaaacataaaatcaatttgattgatattcaggtaaaaatggaaggggaattggataccgatggcttcaccggtagaaataaaaacgccaaaatggggttttccaaaatcacctccaaattctatatcaaagccgataataccgaacaagagatccgcgattttattgattttgtcgaaagcaactgccctgttcttgataccatcctcaatgcacctgaaattgtcactgaagtttatccttccgaataa

SEQ ID NO: 1807 - DNA, 240 bp, Xenorhabdus bovienii
  Coding DNA location: Contig name=SeqID_16865; Position on contig =124067..124306bp; Strand=-
ttgaatagtgctcatcatcaatccttatgtggtgacaattgtattacaagcatactgcattacatttgtaatgcaacaataagtatcaactggttttttccatcattcgaacgattctcattcacccaattgggcagtaattcgggaattactgctgttttttattgctatattcttcatatttaccgctttatttttccatatgaaaggttaaaatcgcattccccaaacataaattga

SEQ ID NO: 1808 - DNA, 255 bp, Xenorhabdus bovienii
  Coding DNA location: Contig name=SeqID_16865; Position on contig =124292..124546bp; Strand=+
atgagcactattcaagtaagggttgatgaagatctgaaaaaggcgtcttacaaggcttttgaaaaactcaatgtgtctccatctgacgcgttgcgtctgtttctgcgttacgttgcagagaatgaaaaactgccattttctgaagtatcgctgattgtggctgaaaatgataatgatgaagatattttagacgttgttcgtgaacgtatcagaaatccagccaaacgggttagggttaaccttgatgaaatttaa

SEQ ID NO: 1809 - DNA, 294 bp, Xenorhabdus bovienii
  Coding DNA location: Contig name=SeqID_16865; Position on contig =124536..124829bp; Strand=+
atgaaatttaatatcgacttcgacgaacgcgccttgaaggagtggcataaactggataaaagtatacgggagcagttcaaaaagaaattgcgtaaactacaagaaaatccctatatagaatctgccagattacacggtgatctggcgggttgtttcaaaatcaagttgtgttcgtccggttttcgtctggtctatcaagtgatagatgaagaaatcgttatttgggtcatcgctgtaggcaaacgagaagattcaatggcttatgatatagcgaaaaaacgtcttggtgtataa

SEQ ID NO: 1810 - DNA, 240 bp, Xenorhabdus bovienii
  Coding DNA location: Contig name=SeqID_16865; Position on contig =124913..125152bp; Strand=-
atgattagcctgttgaaaatccgggatgctgtcgccctcaacgggcgcaccgatgcaaggtcactgagccatcagttttcaacaccgctaccgatggtggaagccatgctcaagcaactcgtcacaatgggcaaattggaggaagtcgatacttcctcctgcctaagcggcggctgcaagcaatgtccagaaacgcagaaatgcgctattaaggtgtatcaactgatggtaaaaaactga

SEQ ID NO: 1811 - DNA, 2316 bp, Xenorhabdus bovienii
  Coding DNA location: Contig name=SeqID_16865; Position on contig =125162..127477bp; Strand=-
atgatgaaacaattaacaataggtctgatcggtaatccgaatgccggcaaaaccacgctgttcaaccaactcaccagctcccgacaacgggtaggtaactgggcaggtgttacggtagaacgcaagaccggccgttttaccaccgatgagcatcaaatcgagcttgtcgaccttcccggaacgtattccctcacgaccatttcggagcagacctccattgatgaacagattgcctgccactacattctcagtggtgaagccgatatgttgatcaatgtcgttgatgcttccaatctggaacgcaatctctatctctcgctgcaattaattgaactgggcatcccctgtattgtcgcgctgaatatgctggatatcgccaaaagccaacatatcaacattgatattgcggcgctggagcaacgcctcggctgcccggttatcccgctggtttctacccgtgccacggggatcgatacactgaaggaaaccatcgaccattatcaaccgtcttcccaacctatacgggttgaatatcccgattccttgttgcaggaagtcaatcatcttgccagccagatgactcagaatttcaatccgcaacagcgccgctggctgactttgcaggtgctggaaggggacatttacagccgtgagcgagcaggactgacgcagtcgcagctcgctgagagcaaaatgcgtctgcaacaacagcagcttgacgagccagaactgattattgcggattcacgctatcaagcgattaatgcgctgtgcctggctgtcattgatacccgtgccgcgacaccgcacaagctgactcaggcgatggataaagtgatcttgaaccgctggctgggtgtgccgattttcctgtttatcatgtatctgatgtttgtgctggctatcaatcttggcggcgcgctgcaacccctattcgatggggcttccaccgccattttcattgatggtatgcgctggctcggccacacacttcacttcccggattggttgacggttttccttgcccaaggcgttgggggggggatcaacacggtactgccactggttccccaaatcggcctgatgtacctgttcctttcctttcttgaagactcaggctatatggctcgtgccgcatttgtgatggatagactgatgcaatcactgggcttaccgggtaaatctttcgtacccttgattgtcggctttggctgtaacgttccttccgtgatgggctccagaacattggacgcaccgcgtgaacggctgatcaccatcatgatggcgccttttatgtcctgcggagcacggctggccatctttgccgtctttgctgccgccttctttggtaaaagcggcgccagcatcgtcttctctctgtatatactcggtatcacagtcgctgtcctgaccggcctgctcctcaaacacaccctgatgcgcggtgaagcatcgccattcgtcatggagctgccggtctatcacgtcccccatgccaaaaccctgctgctccagtcatggcagcgtctgaaagggtttgtgatccgtgcaggtaaagtgatcgttgctgccagcatgctgattggcgccctgaatagcttctccttctctggcaaagcggtggataacatcaacgaatctgcgctggcttctgtcagtaaggtgatcacaccactcctgtatcctatcggcgtacattccgataactggcaggcgacggttggcctgatcaccggtgcgatggcgaaagaggttgtcgtcggtacgctgaataccctgtataccgctgagaacatcaaccaagcgccattcaatccagatgaattccatctgctggatgaactgaaaggtgccgttgcggagacatggaacagcctgaaagagacattcactctgagcgccctttccaacccgattgaggccagtaaaggcgatggcaatatggatagcagcgcgatgggaacgatgagtgctaaatttggttccgccatttccgcttacagttatctgattttcgtactgctgtacgtaccctgtgtttcggtaatgggggcgattgcccgtgaaaccagccgtggctggatgctcttctccatcctgtggggattggatgtcgcttattcgctggcggcagtgttctatcaagtcacgacattttctgcgcatccacaaagcagcctgattaccattctggccgtgattgtatttaacgtactggtctttatcggcttacgccgtgctcgcagcagagtcaccatagcgttcaataacaccgcaggccgaagctgcgaatgctctgacagtagttgccactag

SEQ ID NO: 1812 - DNA, 231 bp, Xenorhabdus bovienii
  Coding DNA location: Contig name=SeqID_16865; Position on contig =127539..127769bp; Strand=-
atgtcacttcttccaaatcgaagttataaaattctggggttttctgcacagattagccccgcctatcggcagaaattattgtcactggggatgttacctggttccacatttcaggtcattcgcgtggctcctttaggcgatcctgtacaaatcgaaacacgcagagtcaatcttatcctgcgtaaaaaagacttggcgtttatcacactagataacaccccactcgaatga

SEQ ID NO: 1813 - DNA, 123 bp, Xenorhabdus bovienii
  Coding DNA location: Contig name=SeqID_16865; Position on contig =127781..127903bp; Strand=-
atggatattgcctattatcatcactcacaatcaaaatcagaaataataaacgtacttttttcttgtggttcctgcttgattagggataataattcttataatcacttaccttttcagttttaa

SEQ ID NO: 1814 - DNA, 540 bp, Xenorhabdus bovienii
  Coding DNA location: Contig name=SeqID_16865; Position on contig =128126..128665bp; Strand=-
atgaataaatatgctaaaagcagttttgatttactcagcaatatacgatttttcagccttgccactcaccatcctgattcaggctcaccttggtcagcgtcactgctgtatattccaagatacgatccattacgcctgatctggtattcgaaattgattacccgtcattcgcacgaaatttctatcaacccattagtcagtggctcgctttaccgcaaccgggtcaatcctgacacatcactggatcttgcaggggcacagtttatcggccaggctcacgaaatcccgtacaatgaactgcaggaaacttacgattactactttaacttcctctttcctgatgaaaatatcagaaagaaaaaagcacggcctctcagtgaatttcacggccatggccgccgacggttttatgaattagatgttcaagaatggtgggtatacgattccgaactttggcacaatcagcaagatgatggccgcgtttttgttccactaagtgaattggcacatccaccaaaaggcaaacagatacattcataa

SEQ ID NO: 1815 - DNA, 477 bp, Xenorhabdus bovienii
  Coding DNA location: Contig name=SeqID_16865; Position on contig =129034..129510bp; Strand=+
atgagtacacctgcacaccgccgccacgatatttcagatcgcgtctggagcctgcttgaacctcatttgccaggacgtcaaggcgcttgggggcgtgtagctgaagataatcggcgttttatcaatggggtgttttggattttacggacgggtgcgccttggcgagacctacatactgattatggtgactggaaaaatacccaccgtcgtttttgtcgctggagagataaagggatatgggaaaaactgctcgaacaatgggttaatgaccccgatttcgagtggttaatgattgatgccagccatattaaggttcatcccgatgcggcaggcgctaaagggggtaatcaggatatggggctcacaaaagggggctcaataccaagatacatttggccgtggatgcgcatggtatgccggtcagaattattattacaagcggtaccacagcagattgttcacaagctgagaccttaa

SEQ ID NO: 1816 - DNA, 354 bp, Xenorhabdus bovienii
  Coding DNA location: Contig name=SeqID_16865; Position on contig =129447..129800bp; Strand=+
atgccggtcagaattattattacaagcggtaccacagcagattgttcacaagctgagaccttaattaaaggactcgatgcagagcatctattggcggacaggggctatgatagcaacgcaatagtagaaaaagcagaacaacaaggcatgcaagtccagatccctagccggaaaaatcggaaggccgccagagaatatgatcgtgagctctatcggcttcgccatttggttgaaaatactttccttcatcttaagcgctggcgtggtatagccactcgctatgcaaaaaatagcgcgtcttttcttgccgcagtgcaaatccgttgccttgttctttggctgaaaatctcatga

SEQ ID NO: 1817 - DNA, 2343 bp, Xenorhabdus bovienii
  Coding DNA location: Contig name=SeqID_16865; Position on contig =129915..132257bp; Strand=-
atgaatgaatctttaagtcgaatcattgccggtgagttacaggctcagccacagcaagttctcgccgccattactctgttcgatgaggggaataccgttccctttgtcgcccgttaccgtaaagaagccaccggaggtttagatgacactcagcttcgccaactcgaaagccgcctgggttatctgcgcgaactgtcagaccgccgtcagactattctgaaatctattgaggaacagggaaagttaaccgttgagctcgcagagacgattaataccacgcagagtaaaacagaactggaagatctgtacttaccgtataaacccaagcgccgcacccgtgggcaaattgccattgaagccgggctggagccactggccgacctgctgtggcaagatccgcaacaaacgccagaactggcggcagccgcctatgttgatgctgacaaaggcgttaccgataccaaggctgcactggatggcgcacgttatatcctgatggaacgctttgccgaagatgcggctctgttggtgaaagtgcgcgaatatctgtggaagaatgcgcatctggtcgccaaagttgtcgaaggcaaggaagaggaaggcgccaagttcagcgattattttgatcaccatgaatcgattgccaccgttccatcccatcgcgctctggccatgttccgtgggcgcaatgaaggcatcctgcaactggctctgaatgccgatcctcaatttgaggaagcccctaaagagagctattgcgaacagattatcaccgatcatctgaacctgcggctgaataacgcgccggctgacagttggcgtaaagccgtggtgagctggacatggcgcatcaaggtgctgctgcatctggaaactgagctgatggggacgttgcgcgagaaagccgaagacgaagcaatcaacgttttcgcccgtaacctgaacgctctgatgatggctgcccctgcgggcatgcgcgccacgatgggattagacccggggttacggacaggggtgaaagttgccgtcgtagactctacaggcaagctgattgccacagataccgtttacccgcataccgggcaagaagtcaaagctgccgccgccgttgctgctctgtgcaccaagtatcaagtcgagttggtcgccattggtaatggtacggcatcccgtgaaacggaacgcttctttgccaacatccagaagcaataccctgacgtcaaagctcagacagtgatagtcagtgaagcaggcgcatccgtctattccgcctctgaactggcagcactggaattccctgatttggatgtttcactgcgtggcgccgtttccatcgcccgtcgcctgcaagatccgctggcagaactggtgaaaatcgatccaaaatctattggtgttggtcagtatcaacacgatgtcagccagactcagcttgccaaaaagctggataccgtggttgaggactgtgtaaacggcgtcggtgttgacctgaataccgcatcggtcgctctgctgactcgcgtcgccggactctccaagtcagttgcccagaatatcgtgaactggcgtgatgaaaacggccgcttcgacaaccgtaatcaactgttgaaagtgaatcgtctggggccaaaagcgttcctgcaatgtgccggcttcctgcgcatcaatcagggtgataacccgctggatgcctcaaccgttcaccctgaaacctatcaggttgtcgagaaaatcctggccactaccgaacaatccctgtctgaactcatgggcaatcctggtgccctgcgtggtttgcaggcacaggactttaccacggataaattcggcatcccgaccgttacggatatcctgaaagagctggaaaaacccggccgtgacccgcgtcctgaattcaagacagcgactttcgctgatggcgtcgagaccatgaaggacctgcgtgtcggcatgattctggaagggacggtcactaacgtcaccaacttcggggctttcgtggatatcggtgtacatcaggatggcttagtgcatatctcctcactatctgatcgttttgtggaaaatccacatactgtagtcaagactggcgatatcgtgaaagtgaaggtgatggacattgacctgaatcgcaagcgtatcggattgactatgcgtcttgatgagcaacccggcgaagctccggcacgtcgtagcggttctcagagcagtaacccgcgtaatagcaacgaacgcaatggtaatgacagaaaccgccagacttcccgctctccgggatcaacggcattgtccaacagcgccatgagtgatgccctggctgctgcatttggcaaaaagcgttaa

SEQ ID NO: 1818 - DNA, 495 bp, Xenorhabdus bovienii
  Coding DNA location: Contig name=SeqID_16865; Position on contig =132499..132993bp; Strand=+
atggctaagagtaactacattacccgagaaggctggcatgcgcttgatcaggagctgaaatatctctggaaagtcgaacgtcccaacgtgactcaggctgtttccgatgctgcggcactgggagaccgttcggaaaatgccgagtacatttatggcaaaaaaagattaagagaaattgaccgtcgtgtgcgatttttatccaagcgtcttgatgcactgcaaattgttgatcctgatccgagacaggaaggcaaagtcttttttggtgcatgggtgaaagtcgaaaacgaaaaagccgaagaacatatttttcgtctggtggggccggatgaatttgatcctgccaaaaagtggatttccattgattcacctgtggccagggcgctgcttggcaagcaggtggatgatgaaatcaccgtcatgactcccaatggtatggcgatttactggattctggagattggctaccagccgttgggggttagtctctactga

SEQ ID NO: 1819 - DNA, 720 bp, Xenorhabdus bovienii
  Coding DNA location: Contig name=SeqID_16865; Position on contig =133056..133775bp; Strand=+
atgcaagagagttataaaatccttgttgttgatgatgatatgcgcttgcgggcgttgttggagcgttatttatcggagcagggttttcaagttcgtagtgtagcaaatgcagaacagatggatcgcttattaaccagagaatccattcaattgattgtactggatttaatgttgccgggcgaagatggcttatctatctgtcgaagattgagaagccagcataacccgatccccattatcatggtgtcagcaaaaggggaagaggttgaccggattgttggccttgaaatcggtgctgatgattatctcgtcaagccttttaacccacgcgaactgctggctcgtatgcgggcggttatgcgccgtcagagccatgagttaccgggggcaccaaggccggataatgcggtagtgaagtttggcaaattcaaactcgatcttggaacgcgtgaaatgttccatgaagatgagcaattgtccctgaccagcggcgagttttctgtattgaaagttttggtttcccatcctcgcgagccattgtcgcgggataaattgatgagtctggcacggggaagagaatatggtgcaatggagcgctccattgatgtacaggtttcccgtctgcgccgcttgattgaagaagatcctgcccatccccgttatattcagacggtctgggggctgggatacgtttttgtgccggatggaagcaaggtatga

SEQ ID NO: 1820 - DNA, 1002 bp, Xenorhabdus bovienii
  Coding DNA location: Contig name=SeqID_16865; Position on contig =133772..134773bp; Strand=+
atgaaaaggctctggctctcgctgcgcgctttgttcccccatgttctgtatttaactttggtaattgtgctgggcagcctgatgatcagttatctggctgcccagagactggtagagatggaaaaactctcatttgccatcgtgttctcttatgtctttgccagtgttttcacggctgctttgactgtttccatcccattctggttttacctccgcgcccagatacagctattgagaacgatgcagaaggcagtgagaaagatggaaaaagggaaaatcgttgcaccactccctgaagcgggagctccggccatacgctcgctgatccgggcgtttaatcaaatgttaacgggacatacagcgctggaaacggatcgcgctagcttggtggcgggtgtgagccatgacttgcgtacgccactgactcgtatacggctggcgatagaactgatagaagggaaagaaaattttctgcgggaatctatcaatcgtgatattgaggagtgcaatgcgattatcgatcaattcatcgattatcagcggtctgggcagaatgtgccaatgtcatgctgcgaattgaatgggctgcttgacgaagcgattactgtcgaaaatgacggtgtcggaaatatcgaaagtcacctgtcagccaaccccgttttcattatggctaatccactgtcaatcaagcgcgccttgaacaatatgttcactaacgcccaacgctatggacagggatggattcgggtcagtagtggcgttacggagaagtctggctggtttcaggtggaagataatggcacagggatgacagaagaagagagcgctactctgttccagcccttcacacaggggcaacgcgttcacaataatgggggtgtaggcctggggcttgccatcatccgacgcatcgtcgatatccatgatggtgacatcgaagtcggaaaaagcgaaaaaggtgggttgtccatgcgcgtttatatcccacgggtgacgaaataa

SEQ ID NO: 1821 - DNA, 123 bp, Xenorhabdus bovienii
  Coding DNA location: Contig name=SeqID_16865; Position on contig =134830..134952bp; Strand=-
ttggtttcatactccctcctgctgggatacgcatcattaattaaaaacaagcgtcaaactacgtcaacaactttgcttttatctgaaaaaatggttcaggggaaaaataggttaattcaatga

SEQ ID NO: 1822 - DNA, 1068 bp, Xenorhabdus bovienii
  Coding DNA location: Contig name=SeqID_16865; Position on contig =134916..135983bp; Strand=+
atgatgcgtatcccagcaggagggagtatgaaaccaatgcgtaccaccgtggcgagcatcatggcagcagcacttgccatgacatccctgtcttcgtttgctgcttccagtctgacgggggcgggtgcgacattcccggcaccggtatataccaagtgggcagattcctaccaaaaagaaacgggcaataaaatcaactatcaaggtattggttcttcgggtggcgtgaaacagattattgcccataccgttgattttggtgcatctgatgccccgctttctcatgaaaaactcgcggcggatggcctgttccagtttccaacagtgatcggtggcattgtgttggccgtgaatatttctggcatcaaatccggccagttggtcttagatggcaaaaccctcggtgacatttatctgggcaatatcaagaaatggaatgatccggcgattgccaaactgaatcccgacctcaaactccctgatcagaatatcgccgtcattcgccgtgcggatggctctggtacttccttcgtcttcaccagctatctgtccaaagtgaacagcctctggaaggaaaaagtcggggtgggttcgacggttaaatggccggccggcttgggtggcaagggtaacgatggcattgccgcgttcgtccagcgtttgcccggttccatcggttatgtagaatacgcctacgcgaaacaaaataacctcgcttataccaagctgatttcggcggacggtaaagtcgttgcgcctactgaagcgaatttcagtgctgcggcgaaaggggcggattggagcaaaagtttcgctcaggatctgacagcccagaaaggtgacaatgtgtggccgatcacctcaacgacttttattctgatccacaaacagcagaaaaatgcggcgaatgggattgaagtgctgaaattcttcgattgggcttatgagcagggcggaaaacaggcgaaagatctggattattctgtcctgccgcaagaagtcattggacaggtacgtgcagcatggaagcgcgacataaaagacagcagtggcaaaccgctgtactaa

SEQ ID NO: 1823 - DNA, 957 bp, Xenorhabdus bovienii
  Coding DNA location: Contig name=SeqID_16865; Position on contig =136084..137040bp; Strand=+
atggccgaacgtaaaacggcactgaaagcaccaagcaaaaatggcgatattattttcagcgcactggttagactggctgcgctgatgacgttatttctgctggggggcattatcatttcgctgattattgctgcctggccgagtatcaagacctttggttttagttttctatggaacaaggattgggatgcgccggcagagcaatttggcgcactggtgccgatttatggcacattggtgacctcactgattgccctgattattgccgttcctgtgagttttggtattgccctgtttttgacggaactggcacctaactggttgaaacgtccgctgggcgtggcgattgaactactggccgcgatccccagtatcgtttatggcatgtgggggctgtttgtctttgccccgctgttcgccacttatttccagcaacctgtcggtgatgtgctgtcgagtattcccatcgtgggagaactgttctccggcccggcttttggtatcggcattctgacggcaggcatcattcttgccatcatgattattccttatatcgcttccgttatgcgtgatgtgtttgagcaaacgccggtcatgatgaaagagtccgcctatgggatcggctgtacaacctgggaagtgatttggcgtatcgtcctgccttacaccaagaatggcgtgattggcggcgtcatgttggggcttggccgggcgttgggggaaacgatggctgtgacctttattatcggcaatacctaccaacttgacagtctctccctctacatgccggggaatagtattacttccgccttggccaacgaattcgccgaagcggaatccggcctgcataccgcggcattgatggaactggggctgatcctgtttgtgatcacctttattgtgttggcgttgtcgaaattgatgatcctgcgtctggcaaagaatgaggggcgctga

SEQ ID NO: 1824 - DNA, 927 bp, Xenorhabdus bovienii
  Coding DNA location: Contig name=SeqID_16865; Position on contig =137027..137953bp; Strand=+
atgaggggcgctgagatgacaacgggcaataatcatcagccacgtgcggttggcgcgataaatacggcggagatgaacaaccgtcgccggatgcaggcatggcgccgccagaaaaaccgtattgccctgttgctgtctatggcaacgatggcatttggcctgttttggttgatctggattttattctccaccgtcaccaaaggcattgatggcatgtcgctggcactgtttaccgaaatgacacctccgcccaacaccgaaggcggcgggctggcaaacgccatcgtcggcagcgggctgctgattttctgggcaacggtgttgggtacgccattgggtatcatggccggcatctatctggcggagtatggccgccgctcatggctggctgaagtgatccgttttatcaacgatattctgttgtcggcaccttcgattgtcgtcggcttgtttgtttactcggtgattgtgacaaaaatgcagcatttctccggttgggcaggggttatcgcactggcgttgctccaaattcccatcgtgatccgcacgaccgaaaacatgcttaaactagtaccggacaacctgcgcgaagccgcctatgcgctgggtacaccgaaatggaaaatgatctctgccattacgttaaaggcttcgatatccggcatcatgactggtgtcttgctggcgatagcccgtattgcaggggaaaccgcgcccttgctgtttacctcgctttccaatcaattctggagcactgatctcagtcagccgattgcgaacctgcccgttaccatcttcaagtttgccatgagtcccttctctgactggcagcaactggcgtgggcgggagttttactgattaccttgtgtgtactgctgatcaacattgtggcgcgtgtgctgtttaagaataaaaagcacggatag

SEQ ID NO: 1825 - DNA, 777 bp, Xenorhabdus bovienii
  Coding DNA location: Contig name=SeqID_16865; Position on contig =138008..138784bp; Strand=+
atgaataaggctaacgacattgcaggaagaaaaatccaggtacgtgatctgaacttctattacggcaaatttcacgcgctgaaaaacatcacactggatattgcgcagaataaggtgacagcctttatcggcccgtcggggtgcggcaagtccacgttactgcgtactttcaacaaaatgtatgaactgtatggcgaacagcgggcagaaggcgaaattatactggatgacaccaatatcctgacggataaacaagatatcgccctactgcgtgccaaagtcggcatggtgttccaaaaaccgacaccattcccgatgtccatttatgacaatatcgcttttggtgtgcgtctgtttgaaaaactgccaagggctgaaatggatgaacgcatccagtgggcgctgacaaaagccgcattgtggaatgagaccaaagacaaactgcaccagagtggttatagcctttccggtggtcagcagcagcgtttatgcattgcccgtggtattgcgatccgtccggaagtcttgttgttggatgaaccgtgctcggcacttgacccgatctccaccggacgtattgaagagttaatcagtgaattgaaatcggaatatactgtggtgatcgtcacccataacatgcagcaggccgcgcgctgttctgaccacactgcatttatgtacctcggagaattgatcgagttcagtgacacagacacgctgttcaccacacccagaaagaaacagactgaagattatattacaggccgttacggttga

SEQ ID NO: 1826 - DNA, 717 bp, Xenorhabdus bovienii
  Coding DNA location: Contig name=SeqID_16865; Position on contig =138803..139519bp; Strand=+
atggacaatctgaatcacagcaaacacatttccggccagttcaatgctgaactggaacatattcgcactgaattaatgacaatgggcgggctggtggaagaacagctcagtaaggcgattctggcgatgcacaatcaggacggggagctggctcggcaagtcatcgaagatgaccataaagtcaatatgatggaagtgacgatcgatgaagcctgcgtccgtatcatcgccaagcgccagccgaccgcgagcgatttgcgtctgattatggtgatctccaagaccattgcagagttggaacgcattggcgatgttgcggataaaatctgccagacggcgctggaaaaattctcgcagcagcagcagcccttgctggtcagcctggaatcgttgggacgccatgctatccagatgctacacgatgtactggatgcctttgcccgtatggatctggaagaagccatccgcatctaccatgaagataaaaaagtcgatcaggaatacgaaggcatcgtccgccagttgatgacttacatgatggaagatcctcgcaccatcccaagcgttatgaccgcacttttttgtgcccgctctattgagcgcatcggggatcgttgtcagaacatttgtgaatttattttctattacgtcaaaggacaggatttccgtcacgttggcggtgatgaactagaaaagctgctcaccaaagaccaatga

SEQ ID NO: 1827 - DNA, 102 bp, Xenorhabdus bovienii
  Coding DNA location: Contig name=SeqID_16865; Position on contig =139490..139591bp; Strand=-
atgtttatcatctttaggaataagaaagccaaaaacgccggaataaaattcccgcgtttcaggcagttaagatcattggtctttggtgagcagcttttctag

SEQ ID NO: 1828 - DNA, 849 bp, Xenorhabdus bovienii
  Coding DNA location: Contig name=SeqID_16865; Position on contig =139677..140525bp; Strand=+
atgaaatttcgcaatcaatcccgcgtagcggctgttgcgctgctgaccagtctggcattggtttctggtgtggcgaaggcagataaacttgatgatattaaaaaagccggtacggtacggattgcggtattcgacagtaacccaccgtttggttttatcgatccgcaaacgaaaaaactggcgggctatgatgtggacatcgccaacgcgatcgccagtgatctcggtgtaaaactggaactgcgtccgactaacccagctaaccgtattcctctgctctcttccaagaaaattgacttaattgccgccaatttcacgatcaccgatgagcgtgccaaacaggtcaatttttccatcccttattttgccaccggacagaagttcattgcccgcaaaggtgtcctgaaaaccccggatgatatcgccaagctgcgcattggggcagataaaggcactgtacaggagatcactctgcgtgagcgttatccgacagcaaaagtcatctcttatgacgatactccactggcatttgcggccttgaggaatggcaacgttcaggcgatcacgcaggatgatgcgaaattggttggcttgctggcaaacgtaccggaagcgcaaaaagcggattttgaaatctcacccttcagcattacccgtgaatatcaggctgtagccgcgaccaaaggggaagatcggttgattgatgtggttaaccagacgctactgaaactggaaaaagagggtgaagcggagaaaatttacaatcgttggtttggcgctgagactaaatcggctcagccgcgtggtgatttcaaattcgccccattggatcgtcaggcaaaaccttaa

SEQ ID NO: 1829 - DNA, 738 bp, Xenorhabdus bovienii
  Coding DNA location: Contig name=SeqID_16865; Position on contig =140602..141339bp; Strand=+
atgtttgagcaatttattaccgagcacttactggctcctgagtatctgcgatggctctggcaggggttcctgatcaccttatggctctctgcctgcaccatcatttcttcgaccttactgggcttcatgattaccgcagcacgggacagccagatcaaaccgttgcgttggctggttacggtttacaccacgatattccgcaatacacccctgttggtacaactgtttttctggtatttcgcctccggccaaatcttaccgcaggccgccatgatttggctgaatacctctcatgaaatccccattgcgggtctgacattggcatggccatccttcgaatttctggcggggtttattggcttgacgctctattccgcgccttttgtggctgaggaactgcgggcaggcattcagggcgtcggccgtgggcaaaaatacgctgcccatgcattggggttaacgggctggcaggccatgcgctatgtcgtgctgccgcaggcattgaaaatcgccatgccacccctgttggggcaatacatgaatattgtcaaaaattcctcattgacgatggcgattggtgtggcagagctttcctacgcttcccgtcaggtggagacgcaatcactgcaaacctttgaggcgtttggtgtcgcgacggtactttatattgccattattgcggtgatggaaggttggggacagtggcgtcaacagagagcactggcgaggggatactga

SEQ ID NO: 1830 - DNA, 750 bp, Xenorhabdus bovienii
  Coding DNA location: Contig name=SeqID_16865; Position on contig =141341..142090bp; Strand=+
atggactttaccgttattacggaaaactggcgctacttgttgctcggcacctttcctgatgggccgttggaaggcgcggcgctaaccttggtgatcagtatcatggcaggggtgatttccattgtcttgggtacggtggcaggtattgcgctggcgatgttgcgaggcttctgggttaacctgctcgcggcaatattgggcttcttccgtgccattcccgtgattatgctgattttctggacttactttctgctgccggtggtgctgggaatggaaattcccgaaatcaccactgtggtctgcgcactggcgttgatcacctccgcttatctggcgcatggcgtcaaagcgggcattctggcgattggtgaaggtcaatggcgggcagggttatcgctgggtttcaaccgttgggaagtgttgtggcatatcgtcttgccgcaggcattgagaatgatggtgccgtcatttattaaccaatggattgccttaattaaggatacttcattggcctatattgtgggcgtggcagaattatcatttttggcaacacaggtaaataaccgtagcatggtatatccgatggaagtctttttatttgttgcgctggtttattttgtcatgtgtttatcactggagctcattgccaactctgtcgcccgccgtttttcgatacaacgggaaagaacaacacgtttcggtttctggcgtaaaaaagcattgatagtggttccaaaagttaatatttga

SEQ ID NO: 1831 - DNA, 480 bp, Xenorhabdus bovienii
  Coding DNA location: Contig name=SeqID_16865; Position on contig =142335..142814bp; Strand=+
atggcaaattcgatttatgtgacaattaaaggaaagcttcaggggctgatttctcagggatgttctacactggattctattggcaataaattccagttaggtcatgaagatcagatttttgtattacaatttaatcatggcatttctcgtgcacaaaacgttgcacatcagcctgttaaatttattaagcttctggataaatcgtcaccattactactgatggcaatttcaaacaatgaagaacttgatctcatgtttgatttttaccggacttcgcaagcgggtgggcaagaacgctattactctgtcaatttaagaaacgcaaagctattaaatgttaatgttcaatatccacattctgtgaatcataacgatcggcagccagaagaggttgttgcagttcaatataaagatattgtttgccaacatcatatagcgggtacatcagggtattgtgtttgggaagaaaccgtttattaa

SEQ ID NO: 1832 - DNA, 1026 bp, Xenorhabdus bovienii
  Coding DNA location: Contig name=SeqID_16865; Position on contig =142872..143897bp; Strand=+
atgcaatttgacagccttacatcacaattaagaaatgaatttgatgaaagtaagctaccagattttcagcatgccagaatgtttggttccatacatcatggtgctgacaatatcgattttcagattattgctgatgcattggattgccaccgtgatttttatggtgccggaattatttattcagatgggttatttaagcgttatttggtcaggccatcaaaaagacgtggaagccctgttttttctgagttaacacatattattatcttcaatcttgaagcaggcaatgctccagaagctgagctgacaaaaacggtttctgaaccgagtctggtgtgggaaattggatcgacggcgctttcatgtggtggggctgtggcatttttgttaacaacggctggctctggtgctgcgataccctttactggaggggcaagttccgcaggtgtagtcttggcttacgctgggtttactgcgagtagtcttcaatgtatgaatggagcatacagaatttataatcttactgggaaaggagacgaaggcgtggagcatattggttggttggattcacaggattggtatgtgaccacgacaaccctcttagatatcacgtcccttgcttctggaacagcagctttaaaagaagcctatcaaacttatagggtaatgaaagccacttcttctcgtcgtgcagcagaatggttgaacaagatgccacggtatgaaaaaaaacgattaacagaggaaattatacggtatcataatcctggaatttctaatcgagaaataaaaaatttaatatattcggggcaatatcctaaacgttatccaacggaacaaattcgccaaacactcaaaaatcatttaataaatacactttcttcaggtggtgctttcgctggtagtggaatgactggagtaatcaggaatcctgcaagtatagttacatcaggtaattatataattggtgcaatttattctattgctgttgaaaaacccgcgagttatatttcaaatggatattaa

SEQ ID NO: 1833 - DNA, 723 bp, Xenorhabdus bovienii
  Coding DNA location: Contig name=SeqID_16865; Position on contig =143887..144609bp; Strand=+
atggatattaataaaaagagtgataacacgagaatcttcatgagtataaaagaatttatctataatgttagattgaattctcttttaatagaagtgatgaatctagatcgtagattgaagataaatgactcatcattaaaagaagaaattggatataaacagtttaaatatcattttaatccagttacgtcgaaagtgtattttctattggggataattggatttagtttggtcttatcatcttcaatgcttttggcggttctgatttcttatgtaatagatagtggagttaataagttagctatcattccatgtatgttattggttttttctattctttcattaatattttttagttttttatctttagggaagggaggtaaggaaggaatttacatacatcgtatactatatcaatctatattagtcattagtgttttattattattatttgatagttcgccatttttacattttttttattatgcattagttatggctttttctttattgattaaatttattatgaatagttattcttattttaatgcagtaagagatatgaagcttttcagaattgctcatgtttttctgactaaagatacgcaagaaatattaaacatgcctcggaaagagtctaaaaaacgcattaaagaagttgaatttcagagacggcgtgagattaaagagaagaaaagagccaaagaagcagcaggaaaataa

SEQ ID NO: 1834 - DNA, 318 bp, Xenorhabdus bovienii
  Coding DNA location: Contig name=SeqID_16865; Position on contig =144676..144993bp; Strand=+
atgaaaaagatgcccagacatgagaggaaacggctaactgaagaaattatgcgacacaataattcaggagtatctaaccaagcaattaaagatacgatagaacaggggtggtacattaaacgttatcttatagaatctatacagaaggcattgcggaaccatctgagagattttctcatcgcaactggtgggtttgtaggtagtggaatgacaggaacaattaggaatccagaaaatatattaacgtcaggtaattatatgattggttcgatttactctattgcttacggaaatcctgctagttatttatctgaatga

SEQ ID NO: 1835 - DNA, 645 bp, Xenorhabdus bovienii
  Coding DNA location: Contig name=SeqID_16865; Position on contig =145051..145695bp; Strand=+
atgaaagattttattttaaatacagaatttaaaaaactcttgggtaaggctaaggatctggaagcaaaaataaagaatgctgatccagtgttaaaaaatatcacgttgaatgatcttagttataataaatatttttcttaccctggtcggtttaagataggttttataatattttttattatgatagtttatatggcttttttttcaggtgtagcggtagctatacctagtttattaatagaaaatacaagttatgaaataaaagcattttcttttgttttgtcattaatgcttagtgcttttatttcattttctcatattggtcttactttaagtggatactattatggccctgttatccaaaaatatacaaatactgttgtattcttttttagtttgtctatgtcttatttgaaaggagtgtatgactctgatttcttttatttttctgctatagcgttatgttgtttgtttatcaagttaatgttgaatggtaaatattattctggttttatatgggctaaaatgtgcatcagggttgaacgtattgtttttaatgatgaattggataagataaaaggatttaataaaaagcagttaagggaatattcaagaactataaaatcgaaaaagcgtaagaaataa

SEQ ID NO: 1836 - DNA, 189 bp, Xenorhabdus bovienii
  Coding DNA location: Contig name=SeqID_16865; Position on contig =145740..145928bp; Strand=+
atggacataaaacatatattaactaacaaccaattcagaagtattttgactctgtataaaatcacagataatagaatcagaaatagtgattctttacttgtcgacgcaccggatatcgtcaggcttaagggtaaaataatgtctgccaatgaatctccacaaaaatcattatgttatttaactcattga

SEQ ID NO: 1837 - DNA, 147 bp, Xenorhabdus bovienii
  Coding DNA location: Contig name=SeqID_16865; Position on contig =145922..146068bp; Strand=-
ttgatttgcagagccagaattgagtgtgctcatataatatttattcccaaaaaacgaagttttcgacctatcctacaggaaacttattcaaatcgttaccctgaaaaggtaaaaaaagtaaacgattgcggcaagcacaatcaatga

SEQ ID NO: 1838 - DNA, 1338 bp, Xenorhabdus bovienii
  Coding DNA location: Contig name=SeqID_16865; Position on contig =146036..147373bp; Strand=+
atgagcacactcaattctggctctgcaaatcaacagggtctgcttcagcgcgtgtttaagttagaggaacatggcacgacggttcgtaccgaaatgatcgccgggtttacaacctttctgactatggtttacatcgtctttgtcaatccgcaaattttggcggtggcgggaatggatatcaaagccgtatttgttaccacctgcctgattgccgcatttggcagcattatgatggggttgatggccaatcttcctgttgctgttgcgcctgcaatggggctgaatgcgtttttcgcttttgtcgttgtcggggcgatggggatttcgtggcaggtcgcgatgggggcgattttctggggtgcggtagggttgttgatcctcaccatttttcgcgtccgttattggatgatcgccaatatccctttgagcctacgtgtcggtattaccagcggtatcgggctttttatcgccatgatggggctgaaaaatgcgggcattatcgtgccaaatccagacactatcgtctcaatcggcaatttcgcttcccataatgtcctgctgggaacattgggcttttttatcattgccattttggcagcgcgtaattttcatgccgccgtactggtttccattgtcgtcacaaccgtcatcggcctgatgatgggttatgtggagtatcacggtatttttgacctaccgccaagcgtgatgagcgttgtcggaaatgtcgatgtcaaaggtgcgttggatatcgcattgtccggcgtgattttctctttcatgctggttaatttgtttgattcttccggtacgttgattggagtgacggataaagcgggtattgcagacagtagtggtaagttccctcgcatgaagcaggcgctgtatgtggatagcatcagctcggtagcgggctcttatgtcggaacgtcttcggtgacagcctatatcgaaagctcttctggggtttctgttggcgggcgtaccgggctgactgctattgtggtgggtatgctgtttctgttggtgatgtttgcttccccgctggctagtatggttccggcgtatgccactgcgggagcgctggtttatgtgggggttttaatgacctcgagcctgacacgggtaacgtggaatgatctgactgaatccgttcccgcctttatcactgcggtcatgatgccattcagtttctctattacagaaggtatcgcgctggggtttatcgcttattgcgccatgaaactgggaacggggaaatggcgtgaaatcagtccttgcgttatcgtcgtgacattattgtttgtgctgaaaatggcgtttgtcgatgctcactaa

SEQ ID NO: 1839 - DNA, 1470 bp, Xenorhabdus bovienii
  Coding DNA location: Contig name=SeqID_16865; Position on contig =147433..148902bp; Strand=-
atgcgtttttttgatacttcgtcttatcgcatgccgttgtttctttggatcacgggctatgcgcttttgtgggtaatcgcaagctactcactcgaccccactgtaccttatgatgctgtagaagccttgaattgggggatgaatggagagtggggctcacccaaaaatccgtggctggtgggcacagtgatgctacctgccatacacatcagcacaatttccttcagtttttactggtatttcacccactttgttgccattgctatcggaatgctgggtgtctggcgattagccttccggttgacaggtaaagttgaactggcgtggcttgccatgctgacactgaatctgtccggcatcatcaacttcgatatcattccttataatgataattatctgttagtcatgctctggccgtgggcactgctatttttcctgcgggccattgacgatcatcccaaatggtggctggcattcgccctcaccacagggctggcaacaatggggaaatattcttcactttctatcattggctccgtctttttgctctctctgttcgtacccaaagtgcgccgtagctataaagagcccctgttttatctcgctatcgcactctggttcatgctgatattgcccaacggctggtggctggtgcataacgacttcgccgcgtttaaatgggtagattcccagattcagcaaggatttaatctgcataccacgcgcgcggtactttccgtgttctatcccctgattatcgttagtacgattatttacctgtcaggcggacggattggctggccgaaacagcaatccaatgcgctggtcaatatcgttatcctactgcccctgctgattatttatggctggttttccttcaatcagggcgggcgaatgaccgaatggctacaaccatttatgacggtagcacccgcgctgctcgtcggttcactgactgtactcccccgcaaacccctgaaaaatacgctgcggggtttggcaatatgtgcgctattggtttgggtgggttatatcagtgtgatgatagccaatgtccgtggtgcagggcaaaaattcgcaggtataaaaacgttcaccagccagctggatcagcgctggaatgaactttacccaaccccactacattatgttggtggtgaatacttgcatcaatggttgacgttttacagtcattaccgcccagaaacaatacagccttgggagttaggtaatggcgagccccctaatgtgtataatcgccatatcaaagagagcaatattgtgaaaaagggtgcgttattggtgggagagaaaggtaagagctgcgaacaggaaaacttccagtctacactcaagcaatggtcagtgttggtcatcagctacaaggaagaattctccttccagccacagccgagtgccaaaactgaaaccgtctgtatcggtttcgttgcccctgaaaataatcagtaa

SEQ ID NO: 1840 - DNA, 519 bp, Xenorhabdus bovienii
  Coding DNA location: Contig name=SeqID_16865; Position on contig =149050..149568bp; Strand=+
atgaaccagttaaagaaaaagtcaccagcgaaattttcggctggtaagcaaaaaagaaaaagccgcgaagagttgaatgctgaagggcgtgagcgtaaacgccagaaaaaacacagtggtcacccatctggcaaccgtaatcacggtaatgacagtaacaaaaaccgttctggagacaagccggggcaagatccgcgtatcggcagtaaggttccggttcctttgattattggcgaaaaagtcgtggtaaaaccggttgtggaaaaaccgaaagccagccagaagccccgtctgtcaccacaggaagagctggcaatgctggaacaggatgagcatctggatgagttgctggcacgtcttgagaagggtgaagagctctctcaggaagaaaatgcttatgttgacgagaaacttgatcgtatcgatgagttgatggaagagctgggcattaatctggaagaagatgacagcgaagaagagaagaaagaagatatcatgcagttgctgaagggtaagtaa

SEQ ID NO: 1841 - DNA, 180 bp, Xenorhabdus bovienii
  Coding DNA location: Contig name=SeqID_16865; Position on contig =149679..149858bp; Strand=-
atgaagtgtaacgaggccctgaatagttgtatttctggatcaaaggtaaatcccaaacaatggcttgctctgacatatttattccttccgttgttttcgccccccgaaacgcaacgcttttaccgaattgcagcgctgtgttccgatggcacgactcaaccgatttttacgtctcaatag

SEQ ID NO: 1842 - DNA, 1374 bp, Xenorhabdus bovienii
  Coding DNA location: Contig name=SeqID_16865; Position on contig =149783..151156bp; Strand=+
atgtcagagcaagccattgtttgggatttacctttgatccagaaatacaactattcagggcctcgttacacttcatacccaacggctttggagtttaaccaacagtacgataatactgcttttgcgcaggccgccgcgcgttaccccgatcgcccactttctctctatattcatattccgttttgccacaagctctgttatttctgcggttgcaataaattggtcactcgccagaagcataaggcagatgactatctgaatattctggaaaaagaaatcacggcacgagccagattattctcccagaggaaagtcagccaaatgcattggggtggcgggacgccaacttatctcgacaaaacacagatcagccgattgatgtcggtgctgcgtagccactttgattttctgtcggaagccgagctttctattgaaattgatccacgtgagatcgagttggatgtgattgaccatctgcgccatgagggttttaaccgcctgagcatgggagtacaggattttaataaggaagtgcagcatctggtcaatcgtgagcaggatgaggattttatcttcgaactggtcaatcgcgcccgcgaaacgggttttacttcgaccagcattgatttgatttatggcctgccgaagcagacatcagagagttttgcctttacattgcagcgggtgctggcgttgtctcctgatcgcctgagtgtgttcaattatgctcacctgccggacttatttgcggcgcagcgtaaaatcaaggagcatgatttaccaagcgcagaacagaagctagatattttgcaggacaccattgctaccctgacgggcaatggttatcagtttattgggatggatcactttgcccgccctgatgatgaactggcgattgcccagcgagaaggtgttttgcatcgcaattttcagggatacaccactcagggagagtgtgacttattgggcatgggcgtttctgccatcagcatgttgggcgatagttattcccagaatcagaaagatctcaaaatctactacgcggcggtggaagaacagggtcatgctttgtggcgtggtttagtgctgacacaggatgactgtattcgccgtgatgtgatcaaagatcttatctgcaactttcggctgacttttgcagatatcgaacagcgttatgggctgaatttcgccgactattttgccgaagacctgcaactgttggctccgctagtggaagatgggctagtagatatcacggagaagcagattcaggtattgccaaaaggacgtttgttgatccgtaatgtctgcatgtgctttgatagctacctacgtaatcagatgcgccagcggcagttttcacgggtgatatga

SEQ ID NO: 1843 - DNA, 129 bp, Xenorhabdus bovienii
  Coding DNA location: Contig name=SeqID_16865; Position on contig =151258..151386bp; Strand=-
atggggaaggaatacgattacccggaaattgaaggagttggggatagaatcgtgattaatttactgactcaaatcagacctttttacattattaactctggtaaccagaatatccgagtctcaggttaa

SEQ ID NO: 1844 - DNA, 1434 bp, Xenorhabdus bovienii
  Coding DNA location: Contig name=SeqID_16865; Position on contig =151332..152765bp; Strand=-
atgcaacgaggaaaagtctggatcgttgatgatgacagttctatccgctgggtacttgaacgggcgctgagtggcgcaggtctggagtgcatcagttttgaaaatgccgattccgtgctgacggcactctcacaggactgcccagaagttctgctgtcggatatccgcatgccgggtttggatggcttgagtctgcttaaccagataaaacagagcaatccacagcttcccgtcattatcatgacggcccattccgatctggatgctgctgtcagtgcctatcaacaaggcgcattcgattatctgccaaaacccttcgatattgatgaaactgtcgcattggttgagcgggcgttgagtcattaccgcgaacaacatcaatcatcgcgcaatccgcaagtagcagcctctgtttctgagatgattggggaagccccttccatgcaggaggtgtaccggattatcggccggctttctcgttcctccattagtgtcttaatcaatggtgaatcgggaacgggaaaagagttggtcgcccacgcgctgcaccgccacagcccacgagcttcatccccttttattgccttgaatatggcggcgatcccgaaagacttgattgaatcagaactgtttggtcatgaaaaaggcgcttttactggtgccaatcaagtccgacacgggcgtttcgagcaagctaatggtggctcgctattcctggatgaaattggcgatatgccgctggatatccagactcgcttactgcgagttctggcggaagggcaattttatcgggtgggtggctacgcgccagtaaaagttgatgtgcgcattattgccgccacccaccagaaccttgaacagcgggtgacggaaggtaagttccgcgaagatctctaccatcgcctgaatgtgattcgtgttcaattaccccctttgcgggatcgcgtagaagatattccccgtctggcacaccattttctgcaacagactgccaaagaattgggcgtcgaggccaaggtgcttcatcccgataccgaaatcgccctgatgcatctgccatggtcggggaatgtccgccaattggagaatgtctgccgctggctgacagtgatggcagccagcaaagaagtgctggtacaagatttgcctgccgatctgattgagaaccctacaacggaaaaaatcggcaattttccctcctcccgttctgcactacctgaacactggccgcgacaattggctgagtgggcacagaacgccttaaaagagggacgcactgatctcctttccgatgctttgccgttgctggagcgtaccttactcaattgtgcgttggaatatacaaacggccataaacaagaagctgcacgtttgctgggatggggaaggaatacgattacccggaaattgaaggagttggggatagaatcgtga

SEQ ID NO: 1845 - DNA, 1044 bp, Xenorhabdus bovienii
  Coding DNA location: Contig name=SeqID_16865; Position on contig =152790..153833bp; Strand=-
atggctgattttcccaaagcagaacacatactcgactcactgattaacagtgtcttggtactggataacgatttgattatccgctatgccaatcattccgccatgcaactactggcacaaagtacgcgtaaattattcggcactccccttccggtactattcagctatctctcactggacacagaattgatgcgttccagtttgatcaggggtcatggttttaccgataacgaagtgatattggtgatcaataatcactctcatgtgatgtcgctcagtgcccaacccatttccgaacagtttattctgctggaactcgctcctatggatagccagcgtcgtttaagccaagagcagatacaacaggcacagcaggcggctgcgcgggaattggttcgggggctggcgcatgaaataaaaaacccccttggcgggctgcggggagcggcgcaactgctcgcaaaagcgttgcccgatccctccctgcgggaatatacccaagtgattattgagcaggctgacaggctgcgcgccctcgttgatcgattgctggggccacagcatccgggaacccggatcagccagagcatccaccatgtggttgaacgaatctatcagttggtatcactggaaatgcccgccaatgtcactttgatcaaggattatgatcccagcctgccagaactggcgcattatcctgatcaaattgaacaagttttactgaatatgacccgcaatgcactacaggccttgggggagaaaggcggaacgatcaccctgcgaacccgaaccgcgttccaaatcaccttacatggtgaacgctatcgtctggtagccagaattgatattgaagacaacggcccgggcattcctcccaacattcaggatacgctattttatcccatggtcagtgggcatgaaggaggaactggacttgggttatccatcgcccgtaaccttatcgatcaacacgctggcaaaatcgaattcaccagttggccgggtcacacggaattttccatttacctgcctatcaagaaataa

SEQ ID NO: 1846 - DNA, 246 bp, Xenorhabdus bovienii
  Coding DNA location: Contig name=SeqID_16865; Position on contig =153794..154039bp; Strand=+
gtgagtcgagtatgtgttctgctttgggaaaatcagccatcgtcatccaacctttgcacttttttggtgcattgtaccttattcagacataaatcgagcagtctctccgttcagtctgtgatttgttcatcaagtgtcatctgccgtcgcgaatgtgcaggaaaaggacccatccgaagatgggtcaaaagtttcacggcaacaaaaaaggatagtcgtaatgccatcaagcattacacgctgtaa

SEQ ID NO: 1847 - DNA, 1410 bp, Xenorhabdus bovienii
  Coding DNA location: Contig name=SeqID_16865; Position on contig =154027..155436bp; Strand=-
atgtccgttgaacatgttttgtccatgattgaagaacatcaggtgaagtttattgacttacgttttactgataccaaaggtaaagaacaacatatcaccattcctgcccaccagattgatgaagacttcttcgaagatggcaaaatgtttgacggttcatctatcggtggctggaaagggatcaatgaatccgacatggtgttaatgccagatccaacgaccgcaatgcgggatcccttctttaatgatgccacactgatcctgcgctgtgacatcctggaacccggcactatgcagggttatagccgtgatccgcgttctattgccaaacgtgcggaagatttcctgcgtgcaagcgatattgctgatacggttctgtttgggccagagcctgagttttttctgttcgatgacattcgtttcggtagttccatttcgggtagttattaccatattgatgatgttgaagccgcatggaacagtggaacacgctatgaaggcggtaacaaaggccaccgtccgggcatcaaaggcggttattttccggttcctcccgtggactcctctcaggatctgcgttcagccatgtgtctgacaatggaaaaaatggggctggtggttgaagctcaccaccatgaagtggcgaccgcaggccagaatgaaatcgcgacccgctttaatactatgaccaaaaaagcggatgaaacccagatttacaaatatgtggtgcacaatgtggcccattcattcggtaagaccgcaacgtttatgccaaaaccgctggtaggcgataacggctctggtatgcactgccacatgtcgctgtccaaaaatggcaccaacctgttcgcaggtgataaatatggtggcctgtccgaactggcgctttactacatcggcggcgtaatcaaacatgcccgtgcattgaatgcctttaccaacccaaccaccaactcgtacaaacgtctggtaccgggttttgaagcaccagtgatgctggcttactcagcccgtaaccgctctgcttccatccgcattccggttgtggcaagcgccaaagcccgccgtattgaagtgcgtttccctgatccggccgcaaacccttatctgtccttctctgccctgctgatggcaggtcttgatggcatcatcaacaaaatccaccctggtgatgcgatggacaaaaatctctatgacctgccagcagaagaagctcaagagatcccaaccgtagcctcttctctggatgacgcgttagccgctctggatgcagaccgggaattcctgactcgtggaggtgttttcactgatgatgccattgatgcttatatcaaattactgcatggtgaaatcgaacgcgtacgcatgacgccacatccgctggagtttgaactgtattacagcgtgtaa

SEQ ID NO: 1848 - DNA, 225 bp, Xenorhabdus bovienii
  Coding DNA location: Contig name=SeqID_16865; Position on contig =155811..156035bp; Strand=+
atggttggcttgcataaatctatccggcttcaaagagctatttttatgcttagtactacagccgtaaagattgcaaaatcaatgtattatcagatacgcgataaactgagaacttatatgacctcaaacagagacatttctcttgctcatataaaagcgttgaaaactctcaccgtgggacatcattcccacggttttctgttaatttcattggcactttcttaa

SEQ ID NO: 1849 - DNA, 177 bp, Xenorhabdus bovienii
  Coding DNA location: Contig name=SeqID_16865; Position on contig =156036..156212bp; Strand=-
atgcaaatcaacacattgtatgccacgcttaaagatattcacatcatccggctactagatacaaatgttgcatatatagaaattgctataatactgatacatgtaccacataagatagaacaagttgcacacagctacgagctgaaggccaaaatcggactaaggacaacgtggtga

SEQ ID NO: 1850 - DNA, 96 bp, Xenorhabdus bovienii
  Coding DNA location: Contig name=SeqID_16865; Position on contig =156392..156487bp; Strand=+
atgcaaccacctgtcaaaatctggttgatgatttttattattacggggttgtacgccggacaatggcattcggttaaggaaaccattaggctatag

SEQ ID NO: 1851 - DNA, 231 bp, Xenorhabdus bovienii
  Coding DNA location: Contig name=SeqID_16865; Position on contig =156681..156911bp; Strand=+
ttgtatcataaacgatggaatatagaggagttatatgaaatttccaaatcaatattagatattgaggattttcattcacatactgagaaaggcatcagacagaaaattcaggaaaatatattattactctatctggcaagaatatctgaaaatgacctcaaaggcaggagaaatgatacattttgccatcttcaaagaagtcttcatcaatctggtgggctgggatggtga

SEQ ID NO: 1852 - DNA, 168 bp, Xenorhabdus bovienii
  Coding DNA location: Contig name=SeqID_16865; Position on contig =156838..157005bp; Strand=-
atgtccattaagcatgttttatccatgattgaagaacatcaggtgaagtttattgacttacgttttaccgataccaaaggtaaagagcaacatatcaccatcccagcccaccagattgatgaagacttctttgaagatggcaaaatgtatcatttctcctgcctttga

SEQ ID NO: 1853 - DNA, 138 bp, Xenorhabdus bovienii
  Coding DNA location: Contig name=SeqID_16865; Position on contig =156980..157117bp; Strand=+
atggataaaacatgcttaatggacatgctgaactctcctgggtcacgtctgcctgatagaacgatgcaagaaggatgtcattttatcttaaaggagcatttctggatgatcaatttttataaaactggtgttgcatag

SEQ ID NO: 1854 - DNA, 1779 bp, Xenorhabdus bovienii
  Coding DNA location: Contig name=SeqID_16865; Position on contig =157390..159168bp; Strand=-
atgattaatgaagatgcattactggctgcacccattatctctggagttaaagatggtgttttagataaatctaaaatagatgattatatttcattgtacgtccctaaatacgaaggaataagtaacaaagacactattattcttaattttgttaaagagtttaactatgaagtttcagaccctcatggtttagctgatcctatcttggtcggaaaaattcacaaaaacgatgttccagctcaggaatatgtagcctcctatactcgtaaacaatactttggtaatgttgaatactcggaacctttatatgtaaaagttattaatggtacatcttctcagccatcagataaagaaccctttatcgttatgggggctcgttatgctgaccttgctgtagctaatgggcttaaagcaccacagcggctgactgcttggactaaagagggtaagccacatccagtaacatggacttatataggtggaacaccatcattcacttctcctttttcacatattaattccccatttttctatgattctgctccgtggctccccatttcagttcaagacgaacaaggtaacaagctcaaaataaacccaatcaatgtgtttggtaatggtggtacgctaggtcttccaaaggcagattttaacgatccagtggaagagccatatccctctgcttttgctgtgctactcaatgacaacaccatggttggttggggaggaaccttcggtaattcctatattcaatctggagttaaaaccattactacaaatggcccctcttatgctgggcttaatgtgggttcaggtacattatggtatcacggtgattctaatagttctgatctccctactggttcctttgatgatgtgggagccggtggaaatagcttttttgctgtttcggaagctaaccagcagatggaagcctggggaacaatgactggtatttatacttatcttggggatgggaagaatgtttttgtaggaaatagtttggctattactatatataatcccggtacggaacagataataagttggtggggttcatcaatggagaactggaatatagagccgcgttattcttctatttccaaaccacgttacattacatcaatggcaacaaggggattcgccgttatagatgaaagtggtaatctttctacttggggtgattcaagtgtatttggcgactttaaccccccacatcaagattttatacaagctgcttcaacgactccctttatttcgaatcttggggcgccaaccggtaattacgcacttcaccgtgatggtacattatatagttggtcgaccctaggctacaccaccaacaccggctccgatggcgactcatctagtaatggagtagatatagctaccactaaacaaaaatatcttatgccgggaggcatccctccacatggcaaagtatattggggtggaatacagaattatgacgacggcccagtgttcgagaaatttatagctcttaaagatgtggttcaaataacttgctcagctaatgcatctgcggcattacgtcaagatggtaccgtattaacctggcaaaatgctgaacctagtagtgttaactttataccccaacctgaaatgaagaatgtaagagccatctacgcaacaggaacagcatttcttgctctgacagcagataacaaagtccatacatggggtggttctgatggtggtggagatagcaatgcagtacaagcacgattacagggtaaactgacctactatatggattaa

SEQ ID NO: 1855 - DNA, 1566 bp, Xenorhabdus bovienii
  Coding DNA location: Contig name=SeqID_16865; Position on contig =159316..160881bp; Strand=-
atggtggttaatatgcccagtaatatgcaactttctcttcctagcggctctagtgttatcataggccaacaattagctattacagttactttaacatctgatacatctatatctcctaagacagacttctatttaagtaataatacagctatcatatatatagactcctctaatataaaattgggtaatggatttggattgtttattgttaacttacaagtatcaccggaagtcaatgatggtgatactattacttttgatatcggttcatcagatgataacttccccacaatacccatccaatacacagccaggactctagatcataattctttaattttaaaatgggattcacattacatacaggttccgcataataaaaatattccaccaaaggggaaatttgtccgagctacagcattcgttaaagacgaaaatcaaaaatcaatacctaatctttctgttgtaatttctgccaactctattttcagtttggaaaaagttaatttctataaatctgataatataaataaaatagatgttttatcatttaataatgataatgaaatgatcttaaatacagataaaaaaggacgtttaattttacatgtataccctaaagaatctcaagcactgattcttagtttgtacactgaagtatatggtgtatccgggcaaatagaatcagaagggggattgcaaattattgataagaatacaccggatgataatgataaactggcagctccaagaatagatgggtttaatggaggtgaattaaataatgaaggacaaacaacatttcttgtcaaagtagaaaaatataatgattgtagaagaggtgatgtcattcatttttcagtcaatggaaaatataatgattattattatactgttgaagatattaacaatcttggagattataagataccacttccctattctatgtttcccatagatatgactattgaattcgcctataccgtttcccataacaatagcaatattttatattcaaaatcattagaattaacatactcaggagaaccctggccagctccaacttattatgataaatgtgtggtttactctagttttggacatgatgaccaaaataatattatacaagaatttcccaccacagaatgcattgggtttaatgaaaataatgttgttaactgctataatatatctaattattataaaaataaatatagtgaggggttatttgtcctaattacaggaactaacgatcctgatgataaaaccaaaccaccattaggaagcaaaatatatttaaaactgaatatcactgcaaattatcgcagtcctcacaaaacttaccctggaaaaatacctgaaacaccagggccagatggtaaaaccgctgtcggagtaatcagtattccatataatattcttaatggctgtggtcaatatgaagattgtcatgcaggacttattcaatttgattaccaagccacaagtgacaatggaaccatccaagcaaaatcttggaaaggaagaattagtacagctaatgaaggtacaccgcctgaatgttaa

SEQ ID NO: 1856 - DNA, 1242 bp, Xenorhabdus bovienii
  Coding DNA location: Contig name=SeqID_16865; Position on contig =161042..162283bp; Strand=-
atggttaatactgctaaagatatcgtgaatctaaaatcattaatattacacattgattctccttttatatctatttctcaatcatccaataataatacagatgaaatatatactaaagtaacagcaactatcagggatatacatggaaagcccttaggtggaaaaaagatatttatttctgacagttctaattccaatttaaaaaaaattaaaatatatgattctaataacagaacagaaattacaactgtatctgaaaaaaactatgaaggtttttttgtaaaagcagataagcaaggtaatgttttatttttcatacatcctataaaatcagagaatttaatacttaaattgttttctcaaatattaggagacacaaaaccaattccagcagatcatgcaatatatattgttgatcatacattagatgaaattcctgaaaagtatccagaaccagaaatactcaactttattgaaggagatctaatctcagatggggaaagtaaatttttagtcaggattccagagtatgacaatgttcaggatggagattacatactatttatcgttaataataaatatactggtaatgtcatccaaatttcaggtaaaaattatttaagtaaattttttccattaccttatgacatttttgataaagagaacgatcatttttcctattttagctatattgtcatcagagccctaggagatataactaaatataaatctagaccattgactttgacttacaaaggaaatcaacaaaatcaaccctgggcagatgttatcaggatatacaatacttgccaagtgtattctagttatgggatttttcctgacagcattgtatatgatactgttgataataatacgatatctcaatacaaaaaaactaatgatctcgcaggattatttgtacaaataactggtaccaatgatcctaatgacagcacaaaagtggctctaggatcagaagtaactttaaatttatatattaattcaaaaaccggaattattcattggtcttgtacacgcataatgccatatgcagcaggaaatgctggaaaaaatgtagcattaacatttccaataccacatgatttattgaaagatcgggagtcttatgaagatagatcaagtatgatttattttgactatcaagttgggaaagataccgatctcaatgtaacatatggaaacatttggcaagcgacaattgacactgatatatactcttaa

SEQ ID NO: 1857 - DNA, 1215 bp, Xenorhabdus bovienii
  Coding DNA location: Contig name=SeqID_16865; Position on contig =162713..163927bp; Strand=-
atgaatagtaataaaataaactttgaatcattaagattagatgtgtgttttccatttttggctgttcctaatctatctactcaaggtgttgatggaagaaaaattaaggttaccgcaaaagttcaagacatatacggtaattctttacctaacatttccatatttgtatctgattctatttctggaaatttaaagaatgtgaaaatttatggttcagaccaaaataaagaaattaccccagtaaaacaagatggtagagaaggattctctatagaaacggataaatgtggggatatattattttttattcacccacatcaatctcttcctgttgttttaaacttatatacaaatatagtcgactcaacaaggttaatgcctgctaaacataaaatctttatcgttaataattctctggacagcatgaaaataaagtttgatatgcctgaaataattaatttttggggggagtatctaaaatcagatgggagtgctaaatttgaaattgacattccacactaccctggaaaaacactaggtgattacattctattttttgtaaatggagaatatacgaaatattttattcgagtagataataataatgattcaagcacctcaactgaaattccatatgatattttcacgaaaaatgtatactctaatttcttctatgttatcatcagaggttttggaaatatattagaggaaaaatctgtttcattacctttaacttataaaggaggtgttatatataaaccagttccagtagtagaaagaaattatgctgcatgtatcgtatataccagccttggtactgaatcagatgctataatcccaaatgatagttcaattaattatgctgcaataatgcaatacccagatggccagaaaaaaggattatatgttgaaatattaggtactcaagaccctaatagagaaaaagataaagtcccattaaatattcctgtaactttgaagttatatctaaactcaatagataagagttatgctaaaatttatccaggaaaaataaaggtacagccttcaggtaggacatccgctgttattcatattccattcgatgatgttaaagatgttaaactatatcaagatggtggagtaggttatatttactttgactatacattttatgacggcaatgatcaatatggagaaatttggtcggcagaaattgaaactgatgatgactaa

SEQ ID NO: 1858 - DNA, 1575 bp, Xenorhabdus bovienii
  Coding DNA location: Contig name=SeqID_16865; Position on contig =164007..165581bp; Strand=-
atgaaaacaacagcaaaaaacccattaacagcatcacttaaccaaaatgccactttgataataggacaaagctttgttcttattcttactttaacaccagatactcctttatctggagatgtcaaagctaaatttacaaccgtaactaatatcactccaccaacggatcatttagattttaaaccaataacaaataaggaaggtaaaataataaattatacctgtgttataatgttaagtgtaagtagcgctttaactgaacaggatcaaattatttttaatgtaggaacaacccttcctgtagctaacatgacacccttgaaatttaaatgcaaccttaacaaaataaaccccgattcattggaattgactattgacaatgtttttttagatacatttaatgttaaaaacagttctgtaacaaataaaaccaaagtatctacgatactgacagataagagcggaaagacactatctggtgttccaatatatatagattcttttagatcaaataatttacatgaatgtactattaaggataataacggtaatattattacaccacaacaattttatacttatgatggattatttcttaattctcaatcagatggtagtattgtattttatatctacccagaaaagtcgctttcaatggtgcttgatttgaggtgttcagttatagacgcctttgactacatcccagcaacatcccctctattttttattaacacggaacgccctaaccctatggatagtctacgagaacccgacatattagggggatttccaggacctttaacttctaatacaggagagccaaatttttatgcctctatagataattatgataacagtaaacgcggagattatatagtatttatgattaaaactgataatgatactacgcctaagtatagtggatattatgtttctgttagtaacccaaatacagaactaggacaaggaaaatactcatactctctgccttatgatatttttaatatttctattaactacgaatttagttacatagtcatttttggggaagcagctggttcgaaaacttcaaggccataccctgtgacatatatgggcggtgcaatatataatcctcctacaaatgtaacaagagattatgatctctgtaaagtatataccagccttggtattggtaaagcagagatacaacctgacacaggtattagttatgatagtataaaaagatatttggacaatccaagcacaccaaatactggattatttgttgaggtattaggggggaataatataccaggaaaagttccactaaattataaagtcacactaaacgtatatatccagtcatcaaatcgtaatacccataaatcctggaccttacctatgccaacacaggtcggtagtcaaggcattgtatcattgtcctttcatatttcctttgaatttctgaataaaatctacccctatgataatggtggtccaggtagtatttattttgattatgagtttaacattggaaatgaaaaaaattatgggaaaatttgggaaggattgattgacacacgaccagaataa

SEQ ID NO: 1859 - DNA, 348 bp, Xenorhabdus bovienii
  Coding DNA location: Contig name=SeqID_16865; Position on contig =165753..166100bp; Strand=-
atgaacccagcggcagagcgtagaatgatcgacggttatccctcgctcagccatcatttcttccagattacgcaagctcagaatgtaggtcagagaccagcgaacacactaagcgataatatcaacaggataatggaggcgtttaaacgcgtttcggatcagggacatcactctggattcgctcaaaaacaagggagcttaccggatgaccgcttaatgcgacagagccagaatttatcgccaatagaactgttttatcgactaactgtgttaaaaaaacaatcacaccggatacgactgataaactcgccgttaatgcgacagaaccctaatttttctcttaagtaa

SEQ ID NO: 1860 - DNA, 255 bp, Xenorhabdus bovienii
  Coding DNA location: Contig name=SeqID_16865; Position on contig =166044..166298bp; Strand=+
atgatggctgagcgagggataaccgtcgatcattctacgctctgccgctgggttcatcgtcgggttccgttgatgggcaaacgttatcggcggagcaagcccgccattgggcgtcggtggcgaatggatgaaaccgatatcaaaatcaaaggacaatggcgttacctctaccgtgctgtagactcagacggcaatacggttgattttttgttgaccgcctatcgggataagagtggtacaacaaagccgcgctag

SEQ ID NO: 1861 - DNA, 96 bp, Xenorhabdus bovienii
  Coding DNA location: Contig name=SeqID_16865; Position on contig =166353..166448bp; Strand=-
atggcgcgggcatttttacccctattgatgccgggtagatttaagcaaaccaacaagagatcaaaatcagtattgcaaaaatgggtgagaccatag

SEQ ID NO: 1862 - DNA, 318 bp, Xenorhabdus bovienii
  Coding DNA location: Contig name=SeqID_16865; Position on contig =166660..166977bp; Strand=-
atggcctcctatcctgttgcgatacctgctgttgggccaataaccgcgagcgcactctctgcacaattaggtaacggtaagcaatatgcgcgcagccgggattttgcggcctcaggcgggagaaataccctcttggggatcagcaagcgaggagacaaaaatttgcgctggttacgggttcaatgtgccagagtgtttatccaaaacattgcgcctctgtcgggaaaattagccgattgggtcaaaatgcagctaacaagaaaacattcctgtgttgcgtgctgcgcattggcaaacaaactggccagaatagcctga

SEQ ID NO: 1863 - DNA, 195 bp, Xenorhabdus bovienii
  Coding DNA location: Contig name=SeqID_16865; Position on contig =166979..167173bp; Strand=+
ttgtatctcaataacctgattgaacaggatcatcgcaggcgaatacgccctattctgaggttcaaaaactttaggcgggctcagaccgtattagctgggattgaacgggtttgcatgttgcgcaaagggcaatacccgcaagaaccagaatatccaatttcaccggaggcctatttctatcaactaacggcataa

SEQ ID NO: 1864 - DNA, 3777 bp, Xenorhabdus bovienii
  Coding DNA location: Contig name=SeqID_16865; Position on contig =167417..171193bp; Strand=+
atgtcatcatatattcgtaaattcattggtttttttatctttatttgtgcattagttatgctttctatactgatgaatgcctttgcagatggtaaagataacgtagacatttttattagtgaatcaagtaaaaaaataattaatgagaataccaatgatacttcagaatctgatgccaaaaatttaatcgccagaaatattcaaacagtaggcaatatcctatcatcttctccttcggatttagcagagcaagctaaatcctatactttgggaaaattcaacagtactgtctcttccgaagctaaaaaatggttatcacagtttggtactgccagaatcaattttggtctggataaaaagggaacgctggaaaacaactccctcgatttattgctgccactttacgacaacaaagcagactggctgctattctctcaattaggctatcgtaacaaagacagtcgtaataccataaacgttggcttaggtggacgctatttctatcaaaactggatgtatggcatgaatactttttatgatcatgacctgacgggaaataatcagcgtttaggtttgggaggcgaaatttggggcgactatatcaaactctccgccaatgcctattatcgattgagtgaattacaaaaatcacggaattttaagaattatcatgaacgcccagcaaatggatatgacattaacggcgaatttttcctgcccgtctaccccaatctaggtgcgaaactgacatacgaacaatatttcggtgataacgttaccttatttaatcgcaataccagacagaaaaacccaagcctggctaaattaggtttaacttataccccaattccactgataacaatgggtgtggattataaacagggcgaaagcggtcatactgaaacgcagtttttagctaatttcaattataaactgggggtgcctctcagtgcgcaattatcgccagaaaatgtggcttcaatgcgtacattgacaggaagccgttatgatttagtggaaagaaataataatattgtgcttgatcatataaaacaatccactattcaactttctataccccagtctttaattggttatagccatgaagaaaaaacaatatcgactacaaataatcctgataataaagttgaattacaagataataaagaatttatcaaaaacggcggtaagataaatgttaagggaaaccaaattttcattacattccctacatatcaacttagtcatagcgagacaaataattatcctgttaatttcagtgtatttgaaaacagtaccgtaaaaacagcgtctaataatggaataatgaccttaattgtcaggccatttgtagtaaaagaaaaagaagtcagtcctatagaaacattacctgctgatggtaaaaaaacttatctctttactcctgttataacctacgatgccgtaggtaaccagcctttagctcaggttacccttgataatgttcaatggacaaccgagccagaaattggcgaaaaatcaggactacagtggggaaaacctgaaaaaacatcaaaaactaatgagaaagggcaattacaagcagctttaaccagtactaagcccatcaaagatgtgaaagtattcctgcaaatggatggaatgcctaaaacgcaagtaggaacggtgagttttggagaagatacttcacgttttcaattaggtgaaataaacatttcattaccaaacaatatgaaaacgcctctaacagcagatggggttcaggcttatacctataaagctgttgttttatatggtaagaatcgagtcccaccaaatacatcaatcgccgatataaaatgggatcacgatcataaagagatttcgactttgaaattagtacctgatggtgacaaaaccgatagtgaagggcaattgatcgcaacattgacgagttctgaacccgtcaatcatgtcactgtgactctttcgattgaagggcatccagaaaaaccagctggccgcgtttctttcgaaccggcagaaatttcgctaaaacattcaccttcaggaccaatattggttggtgaaacatatactgttaaagcaacaagtaacgataaagattcaccgaaaaatctgccaataacgtgggattttgatgctcctcagcatgataaagttacacataattatactgctggtcattcagaggcaacatttagcagcagtgtggagcaggtagttacagtaaaagctgctattaatggttctctgccctcgcaaacagatttggttttcaaaagtccatcaattgagaacataatgttaagctctgagacaccaaatggaacaatttcgcccggagagtcatataaatttatagccaccgtatttggtgctgatggtaaaactccctatagtggaagcactattccatttgagtggagaattaaatcaccaacagatgctgaaaaggcgggtctatctttatcgccctcaggaaaagtaactgctgtatccgatggagcattaaacgcagaattaacaagtaaaaaggatacatctgctgttacagctgctgaagtatgtctgactattgttgatgctcctcaatccccaacaacgcgtaagtgcatagattcaattaattttaaatctccgcctgtggattttgatattaccagtgttgaagtccataaggttgtggtcgatggtattgaaaaaccatttgatccccaaaaaccgctgcttggcaatggtgctgacaaatacaaatacagagcattgattacaaagaaaggaagtaaagaccaagaaaaaattgcaaatcatacatttaatggtgtggaatggacacgcaaccagaaacaaatcgacaataaatacttatctgaacctgaaacaatatcattaaaaacagatgatgatggatatttatatgcaacattagacagtaatgttggagttggtaatgaaaaggatatcgaaaagacatttatcaacgtgacattgacaataccgagtgaattacccagtggtgaacccaagagtaagggttctgctaatttggtgaattttattccaaagcctgaacaagcagtaatgtttgtttataatcaatataatgaaaacaagaatataacctttcaggaaccacatccttataattattttcgatcgttaaatgcagagctgagagatccccacgagccagagaaaaattttaatcagcctgaagttatatatagttacagtgatgcaaaatcagattttgaccccttattatctttaggagaaaataacaaaggaccgatagagttttatgctgtaggcagcgcaacagtaaaggcaacaataaataaagatgatggaagaatttacctatatgaatataaaataaatataaaaaaatatcctttacttccaacttatacggggaatgagaatcaaattaatctatatggttatcatactgctgatagtcccgtgatatgtgaactttctaatactcctcctggttctgctagattcggtgaatctatcactttttctgtacaggatcttagctcttctattggcggtataactgcattatctaatgaatttaagaaccttaatgattggggttttttccatccagaacaaactcaggccgactcaaaaacaattcaatataaactaaatgatggatcgaataaatatgtaatttttaatcctattactgacaaagaaaatacagatataaatgcaagtggattattaatttgtgaaacaaacacaaaaaaatcaaattaa

SEQ ID NO: 1865 - DNA, 147 bp, Xenorhabdus bovienii
  Coding DNA location: Contig name=SeqID_16865; Position on contig =171240..171386bp; Strand=+
gtgggttctgtcgcattaaatcctgtttggataatatggcattttttattggttgaactgacgatgtccccgactcgagaagcgttcaaacacctgcattatcctgttgatatcatcgctcagtgtgttcgcgggtctacgcgctga

SEQ ID NO: 1866 - DNA, 201 bp, Xenorhabdus bovienii
  Coding DNA location: Contig name=SeqID_16865; Position on contig =171728..171928bp; Strand=+
atgcgactgataaactcgccgttaatgcgacagaacccccccccagatatctgctgtcagagcaagaaatgctgtccctgttgcgtagatggcttttacattcttcatttcaggttgggatataaagttaacgcgactaggttcagcatgttgccaagtttaatacggtaccatcttgacgtaatgccgcagatacattag

SEQ ID NO: 1867 - DNA, 192 bp, Xenorhabdus bovienii
  Coding DNA location: Contig name=SeqID_16865; Position on contig =171942..172133bp; Strand=+
ttgaaccacatctttgaaagctataaattcctcgaacactgggccgtcgttataattctgcacttcatcccaatatactatgccatgtggagggggtctccccgcataaggtttttttgtttagtggttgctatatctactccattactatatttgaataaaaataatttatgtaaaaatatcatttattaa

SEQ ID NO: 1868 - DNA, 132 bp, Xenorhabdus bovienii
  Coding DNA location: Contig name=SeqID_16865; Position on contig =172581..172712bp; Strand=+
gtggtgcaaaggtcaaacagagcaggtatcattaagcccaccgcagaactgtatcttgttgacgttctagatgtactgattacatcctctcatcatggtatctcttcctgtacagacaaacttctagggtga

SEQ ID NO: 1869 - DNA, 1824 bp, Xenorhabdus bovienii
  Coding DNA location: Contig name=SeqID_16865; Position on contig =172848..174671bp; Strand=+
ttgtcaattaataacttaagaaatatcgccatcatcgctcacgtcgaccatggcaaaaccacgctggttgataaactcttgcagcagtctggtacatttggcgaacgcgcagcaacgactgagcgtgtaatggattccaatgatctggaaaaagagcgtggcatcaccattctggcaaaaaacaccgccattaaatggaatgattaccgtatcaacatcgtagacaccccaggccacgccgactttggtggtgaagtagagcgtgtgatgtcaatggttgacagtgtgctgctgctggttgatgcgatggatggcccgatgccacaaactcgctttgtaacccagaaagcctttgcccacggtctgaagcctatcgttgtcatcaacaaagttgaccgtcctggcgcacgtcctgactgggtcgtcgatcaggtatttgacctgttcgtcaacctgggtgcaactgatgagcaactggacttcccgatcgtttatgcttctgcactgatgggtattgctggtaacgaacacactgacatggctgaagatatgactccgctgtatcaggcgattgttgatcacgttgagccgcctaaagttgatctggatggcacattccagatgcaaatctcgcagttggactacaacaactatgttggggttatcggcattggcagtattaagcgtggcactgtaaaaccaaaccagaacatcaccatcgttgacagtgaaggcaaaacccgtaacggtaaagtcggtaaagtcttcagtcatctgggtttggatcgcattgaatctgctcaggcggaagccggcgacatcatcgcgattaccggtctgggcgagttgagcatctctgatacgctgtgtgataccagtgccgttgaagctttgccagcactggcggttgatgagcctactgtcagtatgtacttctgcgtaaacacctcacctttctgtggtcgtgaaggtaagtacgtgacttctcgtcagatccttgatcgtctgagaaaagaactggtacacaacgtggcactgcgtgttgaagaaaccgaagatccagatgcattccgcgttgcaggtcgtggtgaactgcacctgtccgtcctgattgaaaacatgcgtcgtgaaggctttgagatgggcgtttcccgtccaaaagtcatttaccgtgaaatcgatggccgtaagcaggaaccattcgagcaggtcacactggatatcgaagagcaacatcagggtgacgtgatgcaggctctgggtgagcgtaagggtgaactgcgtgacatgctgccagatggcaagggtcgcgtacgtctggattactctattccaagccgtggtttgatcggtttccgtacagaattcatgaccatgacttccggtacgggtctgctgtatgcgacattcagtcattatgatgatattcgtccgggtgaaatcggtcgccgtcaaaacggtgtgatgatttccaacggtcagggtaaagcggttgcttacgcactgtatagtttgcaggatcgcggcaagctgttcctcggtcacggtacggaagtttatgaaggccagattatcggtattcactctcgttccaatgacctgaccgtgaactgtctgacaggtaagaaactgaccaacgttcgtgcatcaggaacggatgaagcaacgacactgtctccatatctcaagaaaacactggagcaggcgctggaatttatcgatgatgacgaactggttgaagtgactccgcagtcgattcgcctgcgtaaacgccatttgactgaaaatgatcgccgtcgcgcaaatcgcggcaaagaaatgtaa

SEQ ID NO: 1870 - DNA, 660 bp, Xenorhabdus bovienii
  Coding DNA location: Contig name=SeqID_16865; Position on contig =174886..175545bp; Strand=+
atgataaaagtacaaaacgacaatcgtcagtcaggagggattatgctgtatattttcgatatgggtaatgtgattattgatattgattttaaaagagtactggctgtctggagtaacctgagtggaacaccactggcaacattgaccacaagattttcaatgggagaggcttttgagcaacatgaatgtgggcaaataacggatgctgagtttgcagatgtgttgtgcgatgaaatggaggtctcgctcagttttgaacagttcacggaaggctggcatgcgctctttattgatgtcagacagaatgttattgaactgatgaataaattgcgtgaacagggacatcgtgttgttgtactgtcaaatacaaaccgcctccatcttgattactggccacatcattaccctgagattgcagcatctacagatttcctttatttatcccaagatctgggcatgcgcaaaccgaattctgacatttttaaatacgtgcttggagcagaaggtgtgaccgctgaacaggttgtattttttgatgatgttttggtaaatgttgaagctgcaagaaaaataggcatcaatgctattcatgtgactgacaggaacgtgattcctgattactttaaggcacatgatttctcccttcccacagaaacgtaa

SEQ ID NO: 1871 - DNA, 549 bp, Xenorhabdus bovienii
  Coding DNA location: Contig name=SeqID_16865; Position on contig =175517..176065bp; Strand=+
atgatttctcccttcccacagaaacgtaacttattctgcccttgccgaggcggtttaccccactttccttgcccgttttgggcaaggatgacatggataacagacaaaaaaatgatcgcattaattcagcgcgtaacacaggcgaaagttgttgttaaggatgaaactatgggggaaattgagcaggggctgctggttttactcggcgttgagaaagaagataaccagcaaaaagcgcagcgtttatctgaaaaagtaatgggatatcgggtattcagtgatgagcagggaaaaatgaatctgaatgttcagcaggctaatggtagtttgctggtcgtttcccaatttaccttggctgcagatacccaaaaaggtttaagaccgagtttttctggcggtgctgaacctcaaaaagcagatgaactttatcgctattttgttgaacagtgccgggtaactggtgtaaaaacagaaacggggcaatttgccgcagacatgaaagtgagtctgacaaatgatgggccggtgactttttggttgcaggtatga

SEQ ID NO: 1872 - DNA, 918 bp, Xenorhabdus bovienii
  Coding DNA location: Contig name=SeqID_16865; Position on contig =176179..177096bp; Strand=+
atgtaccatctgagagtacctcaaacagaacaagagctggaaacctattatcaatttcgttgggagatgctgcgcaagccgcttcatcagcctatcggttcagaaaaagatggttacgattcgatggctcatcatcaaatggtggtggatgaacacggtaatccggttgctgttgggcgcttatatatcaatgcagacagtgaaggcgctattcgttttctggctgttcatcccaatgtgcagcagaaaggactgggtacattgattgctatggcattggaatcagttgccagacaagaaggtgtgaaacggattgtttgcagtgcacgggaagatgccgttgatttttttaataaattgggatttaaaaaccggggtttgatcaatggtgccagaacgtctcccattagccatttcctgatgatcaagcctatcatgagtcttgatgatattctgcatcgtccggactggtgtgcggagttgcagcaggcatggtatcaacagatccctctgagcgaaaagatgggtttacgcattacccaatatactgggcaacgctttattacaacgatgccagaagcggggaatcagaacccgcatcataccatttttgcgggtagcctgttttcgcaggccacactgacagcatgggggctgatctggctgttgttacaggaacgccaactggggggcaacattattctggtagatgccaatatccgttaccgacagcccattacggggcgccccaatgccgtcgctgatttcaataacatgagcggtgatttggctcgccttgcccgtggcaataaggcacgggttaaactggaagtacaggtcagcggtgaacagggcgttggtagcgtgttcaccggcacttatctcgtgctgcctgtcgaacgccccgttacagtttaa

SEQ ID NO: 1873 - DNA, 1824 bp, Xenorhabdus bovienii
  Coding DNA location: Contig name=SeqID_16865; Position on contig =177086..178909bp; Strand=-
atgaagtggttaaggaaattttttgttactcttttgctgttgctgattttggcaattatcgtcatttatatcgttgtccagacgcactggggaaccaaacaattaaaccaatggctcaacagacaaggccactacgagatcagcattgaaagcatcggtcacaactggctacaacctgcgacattaacgcttaacaacgtgaatatccatgatcagcaaagcgctttctcactcaatgccaataccgttaatctggatctcaaatggcaacacctgctgacaccgcgtaacctccatcggctaacattgcaacaagggaaactgatactggcaggcgatcaattgccctccctcttgcaagcagacattctgcaactaaaccagatgaatattcagttagaaaacccccatacacaaattaaaggggaaaatatcacgggtggcatcaccccttggatgcctaccgcaggaaacccgtttggcaatgggcagtatcagtttagtgccagtactatgagtttcaacggtattccctttgaaaaggttatcatgcagggcagctaccagaataagactctgactatcgacacttttggtgcggcatttctgcaaggggctatatctggggatggccggcagttacctgacggcagctggcgctggaataatctcctgatcagcaatatacgctggcaatcaccgatgacattgagcacgttgcaagaaaaaacccgtcatcttccggccattcatgttaaagacctcaatatcaccaatgccaagctacaagggaaaaattggtctgtcgattacctggataccaccatcaaaaacctgggactggtgaatgggagctggaaagctaaagatgggctgattgatttcaatgtcatgaatatggcattcaataacgctcagttcagcaacacactggggcaactccatttttctggtgatacttttactgtcgctcatctgacgacccactaccaaaaagggttattcaacatccaatccgagtgggatcgcaaaaaccgtcaactgacgttcagtaacagctcagtaaccgggctagtttatgacctgccacccacatggcgaaacgatatcaaaaacgctgcaccggagtggatttcagggctgaaattaaatgatatcagcgtcaataatactctgctgattgatgttaatccggatttcccatttcagctcaccactctctcaggccatgtggacaccatgaatatcctgaaaaacggcaggtggggattatgggagggtcaggcgtccttacaggcggccagtggaacatttaataaaattgaaataactcgtccctatctgcaattacacgctacaaatgacaagctaacgattgataaactgaacgccttcaacggtcatggactactacaagctagcggttcagctgaacagcaaacagcccaaaaaccttttgtgcttaatttcaagggaatgaatgcggatttaggcatcctgccacgatggggttggataccactcactattcagggtgaaggaaatttttcactcaccataacaggtaatctctctgctgatgatattaaaggtaccatcaatggcacactgactgctgaagataaatcatcaaacaaagactcacagtccattgctcaggggctaattttaagcagtaactgctctccagctggagccgtagatggcgctgcaatagcgcaccctacggcaccttcaacggaagttcatacagcagaggcaggtaatacaagcgcagaaagtgaaactgccgagagtaaaacctgccccaaaattaaactgtaa

SEQ ID NO: 1874 - DNA, 1386 bp, Xenorhabdus bovienii
  Coding DNA location: Contig name=SeqID_16865; Position on contig =179114..180499bp; Strand=-
atggttacctcatcccgtgaacactctgcatcagaagcgcccgagaaatcaggctgcgaattgatttaccgtctagaagataaaccgccacttctacacgcactgtttgcggccagccagcatctgctggcaatgtttgttgccgttatcacgcccgccatgttgatctgtcaggcgctggggctgtccgaacaggatacacagcgcattatcagcatgtccctgttcgcatcaggggtagcatcgcttatccagatccgctcctgggggcctgtcggctctggcttgctttccattcagggaaccagttttaattttgttgcgccactgatcatgggaggactggctcttaaaaatggaggagcagatatcccaaccatgatggccgctctgtttggtacgctgatggtggcggcaatcaccgaagtgctgctttcccgcgtgctgcatctggctagaaaaatcattacgccgctggtttccggtattgtcgtgatgattatcggcctgtcgctgatccaagtcgggttgacttccatcggcggcggttactctgccattcaaaacggtacgtttggtgcgcctgaaaatctgctgctggcaggggccgttcttgccgttatcgtgctactaaatcgccagcgcaatccctacctgcgagttgcttctctggtcattgctatggcggtaggctatctggtggcttggtacatgggtatgcaacctcatgcaacacccagaacagacacgcccgttatcaccgttccctctccgctctattacggactgtcttttgactggaatctactgatcccccttatcctgatttttatggtgacgtcgttggaaaccatcggcgatattacagcgacctccgatgtttcagaacagccagtcagtggcccgttatatatgaaacgcatcaagggtggtgtactggcaaatggcctcaattcgatagtttcctcagtattcaatacgtttccgaactcctgttttggccagaacaatggtgtgatacaactgacgggcgttgccagccgccatgttggttacattatcgcttctatgctgatcctgttggggctgttccccgccgtagccggatttgtacaacatattcctgaacccgtgttagggggcgccaccattgtcatgtttggtactatcgccgcatccggtgtcagaattgtctcccgcgagccactgaaccgtcgcgccattatgatcatcgcgttgtcgctggccgttggtttgggcgtatcccaacaacccttgattttacagtttgcacctgagtgggtgaaaaatctgctatcttccggcattgccgctggcgggctgactgcaattcttctgaacctgatttttccgcaggaaaaatag

SEQ ID NO: 1875 - DNA, 102 bp, Xenorhabdus bovienii
  Coding DNA location: Contig name=SeqID_16865; Position on contig =180602..180703bp; Strand=-
atgcgacgttataatcatcctataaaaacgccaagagcagctaagggatggattagaaaaaaaattactgataaacacaagttaaaaaatttaaaagtgtga

SEQ ID NO: 1876 - DNA, 1215 bp, Xenorhabdus bovienii
  Coding DNA location: Contig name=SeqID_16865; Position on contig =180742..181956bp; Strand=+
atgtatcagctggatatttatggcacgctcgttgcggctacgctggttttgctactgggaagaaaactcgtacaatcaattccattccttgagaaatataccatccctgaaccggttgcaggcgggctattggtcgctgtcgttttgctggccgttaagcagtccacaggttgggaaatgagtttcgatttatctctcaaagaccccctcatgttgatgttctttgccaccatcggcttgaacgcgaaccttgccagcctgaaagcaggcggaaaatttctggtactttttgtctttgtcgtgattgggttgctgctggtgcagaacacagtgggtattgcactggcgaaaatgcttggacttgacccattaatgggattattggctggttccatcacactttcaggcggacacggcaccggagctgcctggggtaaagtattctccgaacgctatggttttgataatgcgaccgaagtagcaatggcctgtgcgacattcggtttgatattggggggcttgattggcggccctgtggctcgtttgctggtgaaaaataccaaagcgccgggcttgggggcagatgataccgaaattcctactgcgtttgagaaaccttataccggccgcatgattacaccattggttatgctggaaaccatcgccttaatctctatctgtttgttggcagggagttatattgagaaacagctagagcatacgatgtttgaattgccaacatttgtatgcgtattgtttgttggggtaatcctgagtaatggcctatcgctgcttggcttttatcgagtatttgaccgagcggtatcggtactgggcaacgtcagcctgtcattgttcttggctatggcgttgatgagtctgaaactgtggcagttggcttcacttgcattgccaatgttggtgatccttgtggtgcaatcgatagtgatggcattatatgcgattttcgtgacttaccgtgtgatgggcaaaaattacgatgcttctattctgtcggctggtcactgtggtttcggtttgggagcgacaccgacggctatcgcaaacatgcaggcaattacggatcgatttgggccatcacatatggcattccttcttgtgccaatggtaggtgcgttctttattgatattgttaatgctgccgttatcaaaatttatctgttgttaccggtattcccgtctatagcaggctaa

SEQ ID NO: 1877 - DNA, 2082 bp, Xenorhabdus bovienii
  Coding DNA location: Contig name=SeqID_16865; Position on contig =182079..184160bp; Strand=-
atgaaaggccgactacttgatgctatccccttaaccaccttgcatggtgttggtgccagccaggtcactaagctcgccaaattagggctggttaatctacaggatttgctgctacatctgcctctccgttatgaggatcaaacccgtctgtattccatcaatgatttactgcccggtgtttatgccaccgtgacgggtgaggtcttgcgtacccatgtcacttttgggcgtcgtcgcatcatgacctgccaaatcagtgatggaaccggagtattgaccctgcgctttttcaatttcaccgccgccatgaagaataatttagcagaagggaagcacgtcattgcctatggcgaaatccggcgcgggaatcaggggcctgagattattcatcccgaatataaagtccagcaacacgctgaacgcgttcagttgcaggatacattaacccccatctatcccacgacagagggagtgcgtcagacaacactgcgtaagttaatcgagcaggcgctggaacttcttgatacctgtgtcattaacgagttattaccggaagaatttagccgcaagatcatcagccttcctaacgcactgcatactttgcatcgtcccccgccggatgtttcgctgactgatttggataatagccgacacccagctcaacgccggctgattctggaagagttgctggcgcaccatttaagtatgctggcggtcagagccggtgctcaacgctttcatgcccagccgctcaccgcagataatgctttaaaacagcagcttctgagccaattgccctttgttccgacagatgcacaggcacgagtagtggcagaaatagagcaagatttggaaaaaaacgttccgatgatgcgcttgatacaaggggatgtcggttctggcaaaacactggtagccgcactggctgctttacgggcgctcgttcacggtaagcaagttgcattaatggcacccactgaactgcttgctgaacagcatgctaataccttccgtcaatggtttgaaccacttggcattcaagtgggctggctggctggcaaacaaaagggcaaagcgcgtcaggcacagcaggaagccatcgcaaacggtcaagtaagtatggtggtcggtacacatgcgatgtttcaggaacaggtcaaattctcaggtctggcactggttatcatcgacgaacaacaccggtttggtgttcaccagcgccttgcattatgggagaagggacgtgaacaaggcttccaccctcatcagttgatcatgaccgccacaccgattccacggaccttggcaatgacggcttatgccgatctggatacctcgatcatcgatgaactgccgccggggcgaacgccagtaacaactgttgccattccagatacccgcagaaatgaaattatccagcgcatcaaaagtgcctgtttggatgaaggacgtcaggcttattgggtatgtactctcatcgaggattctgaagttctggaagcgcaggccgctcaagccaccagcgaagaactggctctgatattaccggatctgaaaatcggtctggtgcacgggagaatgaaatccgcagaaaaacagaccattatggataccttcaaacagggtgagttgcagctactggttgccaccacagtcattgaagtcggtgttgatgtacccaatgccagcctgatgatcatcgataatcctgaacggctggggctggctcaattgcaccagcttcgtgggcgagtgggtcgaggagccgtggcttcacattgtgtcctgctgtataaaaccccgctgaccaacaccgcgagaatgcgcctgcaagttctgcgggacagtaacgatggttttgtgattgcccagaaagatttggaaatccgggggccgggtgaattgcttggcactcgtcaaacgggcaatgctgaattcaggatcgccgatttactgcgggatcagggaatgctaccggaagttcagcgtatctccaattatatccatcagcattatccggaacatgcaaaggcactgattgagcgctggctgcctgatcgctcacaatatagtcatgcctga

SEQ ID NO: 1878 - DNA, 126 bp, Xenorhabdus bovienii
  Coding DNA location: Contig name=SeqID_16865; Position on contig =184183..184308bp; Strand=-
ttggcggcagtttcacgctgtaaggggctggaacagccactgattgatcagcaggggcaaatcatcgcaagtgaatcatggtgggcagcaatgcaggcaacgactgcaccatcaacagggaaataa

SEQ ID NO: 1879 - DNA, 2109 bp, Xenorhabdus bovienii
  Coding DNA location: Contig name=SeqID_16865; Position on contig =184339..186447bp; Strand=-
ttgtacctgtttgaaagcctgaatcagcttgttctcaaatatttgcctgaagatcagatagttctactgaaacaggcctatgttgttgcgcgggatgcccacgaagggcaaacccgctccagtggtgagccatatattactcaccctgtcgctgtttcctgtattctggccgaaatgcgtcttgaccatgagacactcatggcggcacttctgcatgatgtgattgaagatacgccagcgacatttcaggatatcgaacagctattcggcacggctgtcgccgggttggtggaaggtgtctccaaactggataagctgaacttccgtaacaagaaggaagcacaagctgaaaacttccgcaaaatgatcatggcaatggtgcaggacatccgcgtcattctgatcaaactggcagaccgtacacacaatatgcgaacccttggctccctgcgccctgacaaacggcggcgcatcgccagggaaacgctggaaatctacagcccactggctcaccgtctgggtattcatcacctgaaaacggagctggaggagcttgggtttgaagcactgcaccctaaccgttaccgtgtgattaaagaggttgttaaagctgctcgcggcaatcgcaaggagatgatccagaaaattctgtcggaaattgaaggcagattaacggacgctggcatccaatgcaccgttagtggacgggaaaaacacctctactctatttatcgcaagatgcacctgaaagaacagcgttttcactccatcatggatatttacgcctttcgcgtcatcatcaacaaccttgatacctgctatcgtgtactggggcaaatgcacagcctgtataagcctcgacccggcagagtgaaagattatattgccatccccaaagccaacggctaccaatccctgcatacctctcttatcggcccacatggcgtccctgttgaagtccagatccgtactgaagatatggatcagatggcagaaatgggggttgcggcacactgggcatataaagtgcaaggagaatcaggcactacagctcaaattcgcgcccaacgctggatgcagagcctgctggagcttcagcaaagtgcgggaagttcttttgaatttattgaaagcgttaaatctgatttatttcccgatgagatttacgtttttacgccagaagggcggattgttgaattaccggcgggggcaagcccggttgacttcgcctatgccgtccataccgacatcggtcatgcctgcgttggagcacgtgttgatcgccaaccttatccactgtcgcaaacacttagcagtgggcagaccgttgaaattattacagcgccgggtgcacgcccgaatgcagcatggctgaactttgtcgtcagttccaaagctcgcgccaaaatccgccagctattgaaaaatcttaaacgggatgattcgattggactggggcgtcgtctgctcaatcatgcgcttggcaacggaaagaaaattactgatattcctcaggaaagtatcaccaaagagctggtaagaatgaaacttgccacattggatgatctactggctgaaattggactgggtaatgctatgagcgtggttgttgcacggaatttgctgggcgcaacggaaaaaataccaaacaacaacaatagcacccgtaaactgcccatcaagggagctgacggtattttgattacttttgcaaagtgctgtcgtccaatccctggcgatccgatcatttctcatatcagtccgggaaaaggtctggttattcaccacgaatcctgccgtaatatccgtggataccagaaagagccggaaaaattcatgcctgtcgaatgggataaagatgtcaacagcgattttatcgccgaaattaaagttgatatgtttaaccatcaaggcgcactggcgaatctgacggcggccatcaacgatgctaactccagcattcagagcatgaatacggaggaaaaagatggtcgcgtttattgtgctttcatcaggctgacgacccaagaccgtattcagttggcgaatattatgcgtaagatacgtgttatgccagatgtgatgcgagtcagccgtaaccgaaactaa

SEQ ID NO: 1880 - DNA, 276 bp, Xenorhabdus bovienii
  Coding DNA location: Contig name=SeqID_16865; Position on contig =186466..186741bp; Strand=-
atggcacgcgtaactgttcaagacgcagtagaaaaaattggtaaccgttttgacctagtgttggtcgctgctcgccgagcacgccaattgcaatcaggcggtaaagatcctctcgtagcagaagaaaacgataagatgactgttatcgctctgcgtgaaatcgaacaaggcctcatcaacaataaaattcttgatgttcgtgagcgtcaggagcaacaagaacaagatgccgcagaaattaaagcggtttctgtcatcgctgaaggtcgtcgctaa

SEQ ID NO: 1881 - DNA, 624 bp, Xenorhabdus bovienii
  Coding DNA location: Contig name=SeqID_16865; Position on contig =186796..187419bp; Strand=-
atgaaccaaggaacgttatatattgtttctgcgccgagtggagcaggcaaatcaagccttattcaggctttattaaaaactcagcctttgtatgacactcaggtttctgtttcacatacaacgcgcccaacgcgttctggcgaaaatcatggtgagcattattttttcgtcactgttgatgaattccagaatatgatcagccatgatgaatttttggaatatgcttgtgtttttggtaactattacggcacatccctcaaaattatcgaagatacactagccagtggcgttgacgtttttcttgatattgactggcagggagcgcagcaagtccggcagaaaatgccggcagcccgtagcatttttattcttccgccatcgaaggaagaattgctccgtcgcctgcgtggtcgcggtcaagacagcgatgaagtcattgacaaacgaatgtctcaggcggtcgcggagatggaacattacggcgaatatgattacgtcattatcaatgatgatttcaatacggcactagccgatttacaatctattattcgttcagagcgtatacgattagatcgtcaggctcaacggcatgatgccttaatcagcaaattattggcaggctga

SEQ ID NO: 1882 - DNA, 210 bp, Xenorhabdus bovienii
  Coding DNA location: Contig name=SeqID_16865; Position on contig =187325..187534bp; Strand=-
atgtccgttggcatgtattgtaacgctgcatgggttgacgtatccgtgtatactatgtgggattttatattcctgcgcttgcatttattaatacccaatcagtcaagaaatcatcatgaaccaaggaacgttatatattgtttctgcgccgagtggagcaggcaaatcaagccttattcaggctttattaaaaactcagcctttgtatga

SEQ ID NO: 1883 - DNA, 1860 bp, Xenorhabdus bovienii
  Coding DNA location: Contig name=SeqID_16865; Position on contig =187726..189585bp; Strand=+
atgcttaattttctcatcatgatattggcgctgttgtttggaatacctgtggcattggcgggaatggcagagcaggcgccagcaaaatttactgaaagcgtagaaaccggcagtacaggaaacatggcggattgtcctgtttggtcacaggagaaaatccaacgtgaaatgcagcacctgacacggcagatggcggagtgggatcagctttatcgtcaacagggtatcagtgaaatcgatgatgaaatctatgatcaactattggaaaccctgacactttggcgaacttgtttacatcagacgtcagacagcacgttttctgttgctgtgccacgggaggggaaacatcctcaccctgtgcagcataccggcttaaacaagctgaaagggataaaggaaattcatcagtggctacagggacggtcggctgtttggctgcaacccaaagtggatggtgttgcggttacgttggtctatgagaaaggccgactggcggggttaatcagtcgtggcaatggttcggaaggaacgaactggatggacaaaagtccatttattacccgcattcccaaacagataaaaaatgcaccggagcgcttggtgttacaaggtgagctgttctggcagcaggatagtcaccgccaatctattgtcggtagtcaaggagcgcgcagcaaagtcgcagggctgatgatgcgtaagtcatctgcgccagaacttggtcagatagggatatttatctggggctggccagatgggccagatgagatggcggtaaagctggagcgattggcatcaatgggatttcccaccgcacagcaatatagccaccgaattatcagtgcgcaagatgctgagaaaagatggaaatcctattttatccagccacttccttttgctacggatggcgttgtcttaagacaggaaactgagcccactggccggcagtggcgcgcaggctcaaacagttgggcggttgcctggaagtatccattgcagcagcaattgacaaccgtgagagatgtccatttcaagataggccggacaggaaggatctccgttttgctggcgctggaaaaagtgaagctggatgataggcaggttaggcgggtcaatctcggttccgtcagacgctggaaacagtggaacgtttatccgggagataaagttacggtagcgctggcggggcatggcgttccgaaactcgataaagtggtatggcgtattgctgaacggcctgatattcagccaccgaatgcgcaggactttcattcgctgagttgccttgtatcccatgatagttgccagcaacaatttattgcccgtctgacatggcttggggaaaatctgaaaatgaaaggcgttgggcaaggaacatgggtagctttggtgaaatatgggctggtgacacatttaacggattggctggcgctggatattgtacaacttactgaagtgccaaacataggaaccaaacgtgccgagttgatttttgcccaattccagcaggcaagattacagccgctttcgtcatggcgtgaagcgatagggttgccttatgccaatcgatttacggatgaaatgggctggcaatgggatttgctgttatccgaaacaggcatgaaaaatccattaacggcaaagcaaaccgcaaaaattgcagcctttttgcagcatccagagattaaagcgttagttcatgcattaactgtatatagaattggagaaaagcagggaagtgaggagaataaggttggggagaagaaagaagcggagccgataagtcattcagaagcaagggagcaagagcgtgctcccgatgctcttaataatgtcagtgatcagaaccgtcataattga

SEQ ID NO: 1884 - DNA, 699 bp, Xenorhabdus bovienii
  Coding DNA location: Contig name=SeqID_16865; Position on contig =189560..190258bp; Strand=-
atgtggctaaaaaatttcagtcgagacgttattattccaacattacactttactactacgttattccatttgatcaaacttatgctacttagtgtcctttatatcattggtatcacggctgaagccatgacaggcgccttagccgcaggtcgccggaaaatggatgtattcggcgttatcattattgcttccgtgacggccattggtggtggctccgtccgtgacattattctgggtcattacccacttggctgggtagaaaacccagcctatatcgtgaccgttgcctgcgctgcggtgatcactatctgggttgcccccatgatgaaacatctgcgccgtttatttctcattctcgatgccattggtctgattgtcttttccattattggtgcacaaattgcgctgaatatgaaccacagcccgatcatcgccgccattgctgccgtgattaccggggtttttggcggggtactgcgcgatatgttttgtaatactatcccgctggtattccagaaagagatctatgcgggtgtttctttcgctgccgcttggctatatatcgggttattacacacgccattgcacccgaacagcgtgatcctgattacgcttatcgcagggctggcggctcgattgattgctatccgttatcgtcttggtttacccatcttcaattatgacggttctgatcactga

SEQ ID NO: 1885 - DNA, 1302 bp, Xenorhabdus bovienii
  Coding DNA location: Contig name=SeqID_16865; Position on contig =190311..191612bp; Strand=+
atggtctttaaggaacgccagattacattcgacagccgtagccatcagataactaatataaatatctggactcctgatagccaatggctggtatacgacgttcgccccagtggtgcgtcttttacgggtctcacgatagaaaaaattcatgtcggcagtgggcaggtagaagtgatttatcaggcgcaggatggagcgcacgttggtgtagtgacggtaaatctacaggagcctgttcgctatgcgttcatccacggtccagaaaagccagataggcagtggcagtatgattttcatcatcgccgaggtgtgattgtctctgatactcagccaaatgtagccgtcaacattgatgcgctggatattactcccccttatacacccggtgctctgcgcggtggtacgcatgttcacgttttcagccctgatggtaaccgtttgagttttacttataacgaccatgtgatgcatgaacgagatctggcgcttgatttgcgcaatgttgccgtggctatccctctgagagcagtcattccaccgaaaaaacatcccagagaatatgatggcagttatttttcggttgttgtcagccgcacgacagcgcagccacgttctggcagtgatgagatcaatcgggcttatgaagaaggctggattgggcaacagggatatctcaaagaaaatggtcagtggcagcgttgggcactggcttttattggtgatacccgtgctgagaatggcgaaaagataccagaaatttatctcgttgatttaccggagaacaatgaggattatgccattgagggcaaacagcctttggcaggaacagaagcaacactgccagcaccaccagcaggtgtgaaacagcgccgtttaacttttacccatcaaaatcgctggccgggggtggtaaatgttccccgacactggctgagaacatcaccggatggcagcaaaatcggatttttgatgaaagacgaaacgggtatcgttcagttatggtacatctcgccaaatggtggagtgccaatgcaactgactcacagtgcatatcacatacagtcggcatttaactgggacagcggtggtcggttcatcgcctttgtttgtgacaatagtattatgctctgtaatagccaaaatggcgaaatgcatcggctgacagcacgtactgatgatgcaccttctgcggatgcgattgtgatatcaccggatgaccgatatgttgctttcatgcgtgatattgatggttatcggcaagttttgattgtcgaaaccggcatcgctggtgtgggggaatag

SEQ ID NO: 1886 - DNA, 357 bp, Xenorhabdus bovienii
  Coding DNA location: Contig name=SeqID_16865; Position on contig =191613..191969bp; Strand=-
atggaaacgatgaaaaaccataaagtgcttctattattgtgtaccacactgggatggtcacttgtcactggctgctccagcataatgacccacagcgggccttatcaaggttattactctggagcaaaagccagcattggcatgctgaaagatgacagtaccgggtgggtcatgaaacctttgctcgccgtggatctcccgttctctgcctttctggatacgctcctgttcccctatgattatacccgttccagcaaagaccaagctgaacactcacctaagcatcgccttgaaaaactggagcaacgctcaactgccacagcaacagccccagaaaatacgaacgctgaaacataa

SEQ ID NO: 1887 - DNA, 132 bp, Xenorhabdus bovienii
  Coding DNA location: Contig name=SeqID_16865; Position on contig =192525..192656bp; Strand=-
gtgaacaggacagtagttattagaatccaaaaagaattcttcacacaattaggaaaggaaaacaatccctgtttatactctttccctgaactgagtctatttaatcagaaaaacccgaatctaataacttga

SEQ ID NO: 1888 - DNA, 1257 bp, Xenorhabdus bovienii
  Coding DNA location: Contig name=SeqID_16865; Position on contig =192723..193979bp; Strand=-
atgaaattttctcaattcggaaacaaattcacacaagattcaggaattacccgcctgatgaatgatctcaaccaaggcctgagaacacctggcgccatcatgctaggtggtggcaatcctgcccatattcctgaaatggatgattattttcagcagatattggctgatctggtgtcaagcggccagttgggcgaaaccctgtgcaactatgatgggccacaagggaaaaatacgctgatagcggcactggcccaagagttacaggaaaagctcggttgggagatccatccacaaaatatcgcattgaccaacggcagccaaagcgcctttttctacctgttcaatctactggctggccgcagtgaagatggctcgatgaagcgagttttattccctcttgcacctgaatacatcggctattccgattctggtctggatgaagggctgtttgtcgccaataaaccgaatattgagttgctgcccaatggccaattcaagtatcgggtcgatttcgatcacctgaatatttccgaagatatcagcctgatttgcgtctcccgtccaaccaaccctaccggtaatgtcattactgacgaagagttgctgcgcttagatgggctagctcaacaacatcagatcccactgttaatcgacaatgcctatggtgtaccgttccccggtattatcttcaatgacgcgacgccactgtggaatcccaatattatcctatgcatgagcctgtccaaacttggcctgccgggttcccgctgcgggattatcatcgctaatgagaaaatcatcagtgctgtcagtaatatgaatggtgttattagcctcgcaccgggcggtgtaggtcccgctatcgcgttggaaatgatcagacgcaatgatctattccgcctatctcaaaatgtcatccagccattttataaaacgcgggtagacaacgtgattgagatcattcgtcgccatatgtcagaagatcgctgccttatccataagccggaaggggcaatattcctctggctctggttcaaaaacctgccaatcaccacggaagtgctttatcagcgcttgaagaaacggaaagtgttaatggtgccgggtcattttttcttcccaggtctggagcacaactggcctcatgctcatcagtgtatgcgcatgaactatgtacctgatttggaaaagatcgaagaaggcattcgcattctgtcggaagagattgagatcgcgcatagagaagcgatccgctga

SEQ ID NO: 1889 - DNA, 159 bp, Xenorhabdus bovienii
  Coding DNA location: Contig name=SeqID_16865; Position on contig =193944..194102bp; Strand=+
ttgtgtgaatttgtttccgaattgagaaaatttcataacggcgtttgcgtctgttgttttataggagaaagggacaccataccccgccccttattggggcgcaatggggtcaagcctgttctctgtgttgttatatattacattatgattattcattga

SEQ ID NO: 1890 - DNA, 588 bp, Xenorhabdus bovienii
  Coding DNA location: Contig name=SeqID_16865; Position on contig =194168..194755bp; Strand=-
atggaattcatcaacaaggaaagtattcgctgtgcttgggtcaccgccgatccagattatcttgcctatcacgataatgagtggggcaagccactgaagaatagccagcagctctttgaactgctctgccttgaagggcagcaagcggggttatcatggctgacgatcctaaaaaaacggcagggctaccggaaatgcttccatcaatttgatccggtcaaaatcgccagcatggatgaaaacgatgtcgaacaactgctcaaagatccggctattgtgcgcaatcgtgccaaaatcaatgccattatccacaatgcccgcacttacctgaaaatggccgatcaaggagaggatttcagttcatttatctggcattttgttgatgattccccactcattaatcactggaaatcacggacagacgttcctgtcagaacccccatttctgatgacctgtcaaatgcactgaaaaaacggggcttcaaatttattggcagcacaacctgctatgcgtttatgcaagcggcgggtttagttaatgatcacctcacaagttgcctgtgccgaaaagttgaaatcagtgcataa

SEQ ID NO: 1891 - DNA, 291 bp, Xenorhabdus bovienii
  Coding DNA location: Contig name=SeqID_16865; Position on contig =194792..195082bp; Strand=-
gtgagaagttcctgcgccgacttccatatccagtggttggataatggtgcagccttgacgcgcccagtaatcctgcaatgtcaggatgagcccctgaaaggttttggtatcaaacttttgcatgttgaatccacacgcgatacatcacgcgatacatatgaatttaaacgaaagcggtcagtataccctttgaccgtaagatatacagcactgatcacccgccaattttgctgcagtataaaaaaatcttatccgagcctctttacttgtatatttatacagttaatataa

SEQ ID NO: 1892 - DNA, 909 bp, Xenorhabdus bovienii
  Coding DNA location: Contig name=SeqID_16865; Position on contig =194960..195868bp; Strand=+
atgcaaaagtttgataccaaaacctttcaggggctcatcctgacattgcaggattactgggcgcgtcaaggctgcaccattatccaaccactggatatggaagtcggcgcaggaacttctcaccctatgacctgcctgcgcgctttagggccagaacccattgcggcagcttatgtgcaaccttcccgtcgtccaactgacggtcgttacggcgaaaacccgaatcgccttcagcactattaccagtttcaggtcatcatcaagccatctccagacaatattcaggagctttatctcggttcattgaaagcgttgggactcgatcctaccgtccacgatatccgttttgttgaagacaactgggaaaacccaacgctgggcgcatgggggctgggttgggaagtttggctgaacggtatggaagtgactcagttcacttacttccagcaagtcggtggtcttgagtgcaaaccagttactggtgaagttacttacggtctggaacgtctcgcgatgtatattcagggcgtggacagcgtttacgatctggtgtggagcgatggcccactgggtaaaacgacttatggcgatatttatcaccagaatgaagttgaacagtctacctataattttgaacacgctgatgtggatttcctgttcacctgttttgaacagtatgaaaaagaagcacaggagctgttggcgctggaagcaccactgccactgccagcttatgagcgtattttgaaagctggccataccttcaacttgctggatgctcgtaaagcgatctccgtgactgaacgtcagcgctatattctgcgtatccgtaccctgaccaaatcggttgctgaagcctattatgcctcccgcgaggcgcttggcttccctatgtgtaagaagaattga

SEQ ID NO: 1893 - DNA, 2070 bp, Xenorhabdus bovienii
  Coding DNA location: Contig name=SeqID_16865; Position on contig =195878..197947bp; Strand=+
atgattcaacagactttccttgtggaaatcggcacagaagaattgccaccaaaggcgctgcgttcgctagctgaatcctttgcggccaattttgaaacagaactgaaaaacgccaatctgggtcatggtgaaattagctggtttgcagcccctcgtcgtctggcactgaaagtggcaaatctggctgtggcacaggctgatcgtgaagtggaaaaacgtggcccggctattgctcaggcatttgatacggaaggcaagccaaccaaagccgcggaaggctgggcgcgtggctgtggtatcacggttgatcaagccgagcgcatggtaacggataaaggcgaatggctgctttatcgcgcgcaggttaaaggccgtgaagcgaaagaacttctggcggatatggtgagcagttcgctgggcaagctgcctatccctaaactgatgcgctggggcgataaagaaactcagtttgtccgccctgtgcatacggtcacgatgctgctgggcagtgacgtgattgagggggaaattctgggcatcaaatctgatcgcattatccgtggtcatcgctttatgggcgaggcggagtttgcgattgataatgcagagcagtacccggcgattttgcaggaacgtggtcgtgtcattgcggactactatgcacgtaaagcgttgatcaagcgtgatgcagaacaggcagcgatgcagcttggcggtgtggcagatctgacagacagcctgctggaagaagtgacttctctggtggaatggccagtggttctgacagcgaaattcgaagagaaattccttgaagtgcctgccgaagcgctggtttacaccatgaaaggcgatcagaaatatttcccggtttacgataaatccggcaaattgatggcgaattttatttttgttgccaatattgaatcgtctgatccacagcaaatcatttcgggtaacgaaaaagtagtgcgcccacggctggcagatgcggaattcttctttaagactgaccgcaaacagcgtttggaagacaatctgctgcgtctggaaacggtactgttccagaagcagctgggtacactgcgtgacaaaacggatcgtattcaggctctggctggctggattgccgaaaaaatcggtgcagatgtcactcatgcgacccgcgcgggcttgctgtccaaatgtgacctgatgaccaacatggtatttgagttcacggacactcagggcgtgatgggaatgcactacgctcgccatgatggtgaagcggaagatgtggctctggcactgaatgaacagtatcagccgcgcttctctggcgatgagttgccatccacagccgtttcctgtgctgtggcgattgccgataaaatggatacccttgctggtatcttcggtattggccaacatccgaaaggggataaagacccgtttgcgctgcgtcgtgcggcactgggtgttctgcgtattctcgttgagaaaaaattgccgcttgatctccagaccttggcagaagaagccgtgcgtttgtatggtgacaaactgaccaatgagaacgtggtggatgatgtggttgagttcatgctcggccgtttccgcacttggtatcaggagcagggttacagcgttgatgctattcaggcagtgctggcgcgtcgtccgactcaaccggcagattttgatgcccgaatgaaagcggtaacgcatttccgcacactggatgaagcggtttcactggcagccgctaataagcgcgtttccaacattctggcgaagtcagaagagaagctgaatgacagtgttcttgcttctgtattgaaagccgcggaagagatccaactggcgacccatcttgtggtgttgaaagataagctggctcctctgtttgcggaaggcaactatcaggacgcgctggttgaactggcttctctgcgtgaagtggtggacgcgttcttcgacaacgtgatggtgatggatgaagatcaacaagtcagaattaatcgcctgacactgttgagtgaactgcgcgagttgttcttgcgcgtggcagatatttcattgctccagtaa

SEQ ID NO: 1894 - DNA, 1833 bp, Xenorhabdus bovienii
  Coding DNA location: Contig name=SeqID_16866; Position on contig =2..1834bp; Strand=+
gcattacacagcaaaaggctggtttatacctatttatacacaaatttatccacagatggatattttggtaaaatttgtcgagcatcacgcaaacgttttcgttacaattatcgcaggaaaaaacaccacgtgattttttctgattgtttcgaaatgttattgcggatgccattttttctctcaatatgctggttttttctcaatagcacagtcttgttttatgaaattcaagggatcataccaatgcaacagcttcgtccaatccgtcgtgccctgctgagtgtttctgacaaagcggggattgttgaattcgccaaagccttatccagtcgcggtgtcgaactgctttcaacgggcggcaccgcacgcctgctggcggaagcagggctgaatgccactgaagtttctgactatacgggcttccccgaaatgatggatggacgagttaagacgcttcatcccaaagtacatggaggcatccttggccggcgtgggcaggatgatgaaatcatgtcactacaccagatttccccgattgatatggtagtcgtcaatctttatccttttgcacaaactgttgcgaagccagattgctctctggaagatgctgttgagaatatcgatatcggcggcccaacaatggtccgctctgccgccaagaaccacaaagatgtcgcgattgtggtcaacagtcaggattacggcaaaattattgaagagatggataaccatcaaaattccctgacccagctaactcgttttgatttagcgatcaaagcttttgagcataccgcggcctatgacagtacgattgccaattactttggcaaactggttcctgcttatcatggtgaggcgaatcagccatcaggccgtttctcccgtacactcaatctgaacttcattaaaaagcaggatatgcgctacggtgaaaatagccatcaagatgctgccttctatatagaagagcaaattgccgaagcttctattgccacagcaacacagttacagggcaaagcactctcttacaataatattgctgataccgatgctgctctggaatgtgtgaaaacgttcgccgagccagcctgtgtaattgtcaaacacgctaatccttgtggcgttgcagttggtgcagatatgcataccgcctatgaccgtgcatttaaaactgatccaacctctgcatttggtggcattattgcttttaaccgcgagttggatgccgatactgccaaggcgattattgagcgccagtttgtcgaagttattattgcgccttctattaatgaagaagctctgccgattctggcaaccaaacagaatgttcgtgttctggcgtgtggcgaatggcattcgccagttgctggtctagactttaagcgcgtcaatggcggcttactggtgcaggatcgtgacttaggtatggtggcagaagctgatctgaaagtggtttccaaacgccagccaacagagcaagaaatgcgggatgcgctgttctgctggaaagtagcgaagttcgtcaaatccaacgcaattgtttacgccaaagataatatgaccgttggtattggtgcaggccagatgagccgcgtttactctgccaagattgcgggtattaaggctgccgatgaagggttagaagttcaaggctgtgccatggcatccgatgcctttttcccattccgtgatggcattgatgcggctgcggcagtcggtgtgagctgtgtgatccagccgggtggttccattcgcgatgatgaggcgattgctgctgctgatgagcatggtatcgccatgattttcactggcatgcgtcatttccgccattaa

SEQ ID NO: 1895 - DNA, 1284 bp, Xenorhabdus bovienii
  Coding DNA location: Contig name=SeqID_16866; Position on contig =1850..3133bp; Strand=+
atgaatatattgattattggcagtggcggaagagaacatgcactggcatggaaagcagcgcaatctcctttggcagataaggtttacgttgcaccgggtaatgcaggtactgcactggaagcaaatctggaaaatatagacattgctgcgacagatattgctggattgttggcttttgctcaaaaccacaatatcggtctgactattgtagggccagaagctccgctggttatcggtatcgttgatgctttccagcaagcagggctgaccatttttggcccgaccaaagccgccgcccagttggaaggctctaaagccttcactaaagattttctctcccgccatcagatcccaacagcggcctaccaaaatttcacagaaattgagccggcattagcctatctgaaaaagatgggagcacccattgtcattaaggcagatggtctggcagccggcaaaggtgttgttgtcgcgatgacaatagaagaagcacagaatgcggttaaagacatgctggcaggaaatgcgttcggagatgccgggcatcgtattgtcattgaagaatttttggatggagaagaagccagttttatcgtcatggtagatggtaaaaacgtggttcccatggcaaccagccaagatcacaagcgagtcggcgatggcgatactgggcccaataccggaggaatgggggcttattcacctgcgccagtggtaacggatgaggttcaccgccgtgtaatggagaaaatcatctcccctaccgtagaaggaatggctgccgagggtcatacctacatcggctttctttatgcaggtttgatgatcgataagcagggagagccaaaagtcatcgaatttaactgccgctttggtgatccagaaacacagccgatcatgatgcgcctgcgttctgatctcgtcgaactgtgtctcgctggagcacaaggccagttaagcggaaaaacatccgaatgggatacccgtccggcattgggtgtcgtactggccgcaggcggctacccagccaattatgccaaaggtgacgttatcagcggcctgaatcaggaagcggatacagacgaaaaggtttttcacgcaggcacagctttcaaggataaagacgtcgtaacagcaggaggccgtgttttgtgtgttaccgcgctgggcgacgatatcgcagaagcacagaaaaaagcttacctgggagctgagaaaattggctggcaaggatgtttttatcggaaagatattggataccgagccattgctcgtctgaaataa

SEQ ID NO: 1896 - DNA, 654 bp, Xenorhabdus bovienii
  Coding DNA location: Contig name=SeqID_16866; Position on contig =3180..3833bp; Strand=-
atgctacaggggctgctagcattgggttttatctcattgctcagcgcctgctcggttcaacctaaggttccgctcttcagtgccagtggttttattaccgacggaggtgttatccgtttatggcgcttgaatgatcaaaacagtcaacctcaagtcattatgagtgtttacagcccttaccgtaatacagatacctctgtgactttttacgaataccgttacggtaatttgtggcagatccgccgctctgtacttgataattatccaatagacgaaacattgcggatcgataaagataacaaggttatttttatgcagcggcaggcaaaagaacacagtgaaccgctttccagcgatgagattgttcgcctgcggtttgatgccaaacggataaaagaaatcagtgacgctttaatggccggaaatgtccatctggtacaggggcattggcaggatggtaaagtgactacttgttcggagaaacaattatccattcaatttgagcctgaagatcgggcatggctcaaggaaagggaaaagaatagtgctggcatattgaccattgcatggctggatgcgccagaaggaaaacagttactattggtcgccaatgatgatttttgccgttgggaaccgacgaaagataaactgtaa

SEQ ID NO: 1897 - DNA, 273 bp, Xenorhabdus bovienii
  Coding DNA location: Contig name=SeqID_16866; Position on contig =3884..4156bp; Strand=-
atgaataagactgaattagttgatgcaatcgcagaacaagctggtctgactaaaactcaggcgaaaactgctctggaatcaactctgaatgcaatcactgaatctctgcgaaatggtgattcagtgcaactggtgggctttggtactttcaaagttaatcatcgtgcagaacgtactggtcgtaacccacagactggtaacgaaattaaaattgcagcagcaaacgtacctgctttctctgcgggcaaagcactgaaagacgcagttaagtaa

SEQ ID NO: 1898 - DNA, 165 bp, Xenorhabdus bovienii
  Coding DNA location: Contig name=SeqID_16866; Position on contig =4149..4313bp; Strand=-
ttgccggatttaaagacttcacatttaccctcactctgttctacattgggggtgaaaagaagtggctatcggtgcgtgtatgcaggggtgctgtcaaatcggcatatccgtcgcactcgatgctttgcaaacgataaacacactgtaaggataatctatgaataa

SEQ ID NO: 1899 - DNA, 591 bp, Xenorhabdus bovienii
  Coding DNA location: Contig name=SeqID_16866; Position on contig =4341..4931bp; Strand=-
atgttaagaaacccgatccacctgcggttagagaaatttgaaagttggcaacattggacttttatggctagtctatgtgagcgaatgtatccaaattatcaggtgttttgtcgtcagacagggtttgctgaccccgcacagtatcgtcgtattttagatctggcgtgggagacattgatcgtcaaagatgcaaaagtaaattttgatagccagctggaaaaattagagaccattatcccatcagcagatagctatgatatttatggtgtgtatccagcaattgatgcgtgcattgcattaagtgaagtcattcattctcgtttgagcggtgcaacgttagaacatgcaatagccgtcagtgaaatatccatccgtaccgttgctatgctggaaatgacgcaggccggtagagaaatgactgaggatgagttaaaggcattgcctgccattgaagaggaatgggatattcaatgggaaatttaccgtttattggcagactgcgaagaacgggatatagaattaattaaaggattaagggctgaccttcgcgagactaaggttagcaacatcggtataaatttggagcaataa

SEQ ID NO: 1900 - DNA, 768 bp, Xenorhabdus bovienii
  Coding DNA location: Contig name=SeqID_16866; Position on contig =5008..5775bp; Strand=-
atgccggagcattcgtcgaagcggtacacagactttcagaaaaatatcaccgatgacttcatgattgatacaaaggcgttacgccaggaacaaatagaaaaagcacagcaggttatccgtcatgattctttcgtgacgacttctacttccgcgattcctgagtctacgccttttacgccagaattaattgctggcgctgacgtcgggtttgaaaaaaacggtacggtgactcgtgccgctattgctgtcctgcattatccttcgcttgaattgctagagtatcaggtcgccagaattgatactgtgcttccttatattcctggtctactttcatttcgtgaataccccgcgttgatggcagcatggcaaaaactcagcttacggccggatctggtgatggtggacggtcagggaattgctcatccacggcgttttggtgtcgccagccattttggcttacttgcggatatcccgactatcggggtggccaaaagccgactgtgtggtgagcacccgcctgtgggagatgctgtcggaagttatcaaccattgatggatcatgcggagcagattggcgttgtatggcgaagtaaaaaaaggtgcaatccgctctatatttccatcggccataaggtcagtcttgacagttcggtcttctgggttgaacagtgcatgaagggatatagattgcctgagccgacccgttgggcggatgggattgcctcaaatagaccattttttaagcaaacaatgcagaaaaatctataa

SEQ ID NO: 1901 - DNA, 1065 bp, Xenorhabdus bovienii
  Coding DNA location: Contig name=SeqID_16866; Position on contig =5720..6784bp; Strand=-
atgaatgagttgaaaaacgaccgctatctgtgcgccttattacgccagcctgttgatgtcacaccagtatggatgatgcgtcaggcggggcgatatttgcctgaatataaagcaacgcggcaggaggcgggagatttcatctcgttatgcaaaaatactgaactggcctgtgaagtgacgctccagcctctgcgtcggtttccattggacgcagcaattctgttttccgatattttgactattcctgatgcaatggggcttgggctgtatttcgaaagcggagaagggccgcgttttcactctccgattctcagccatgcggatgtggagaaactccctgtacctgatccggagatggagctgggctatgtgatggatgccgttcgtgcgatccgtaaggcactggcaggtcaagttcctctgataggtttttcgggtagtccgtggacactggcgacgtatatggtcgaagggggaagcagcaaggcgttcaccaaaataaaagccatgctgtatgcccaacctgctacgttgcatctgttactggataaattggcaaacagcgttattctatatttaaacgcgcaaataaaagcaggtgcacagtctgtcatgattttcgatacttggggtggtgttctgtctcatcgcgattatcgggagttttctctgcaatatatgcataaaatcgttgacggattgatccgcgaacacgaaggccgccgtgtgcctgtgaccctgtttaccaaagggggcggacaatggctcgaagcgatggcggcaactggctgtgatgcccttgggcttgattggacaacgaatatcgcagatgcccgtcgtcgtgttggcgataaagtcgccttgcagggcaatatggacccatccatgctgtatgccgctccagcgcgaattgaagaggaagtttcgacgattttgcaggattttggtatgggtaatgggcatgttttcaatctggggcatggcattcatcaggatgtcccaccggaacatgccggagcattcgtcgaagcggtacacagactttcagaaaaatatcaccgatga

SEQ ID NO: 1902 - DNA, 147 bp, Xenorhabdus bovienii
  Coding DNA location: Contig name=SeqID_16866; Position on contig =6777..6923bp; Strand=-
atgagcgaatggctcacgttattgcagttgtgccagaagttcgatttctggcatgttacaatgcgccggttttttatagtgaaagtcaaactgaccgtaaccaaagaattttgcggccaattaatcaagggagcttgccatgaatga

SEQ ID NO: 1903 - DNA, 771 bp, Xenorhabdus bovienii
  Coding DNA location: Contig name=SeqID_16866; Position on contig =6938..7708bp; Strand=-
atgattcaacaaaaactgacaggtatggaacgaggctggtgggttatcagccttgagaatctagtttggctgccacagggcgaattgccgtcagggacagccagacaatggtcattacaaggtcatatggcgcggcctattggtgagtggctaggcgagactgtgtggctggtgtgtcagaaaatggcgtcagagatggcgtctccccgcatggttgcttctcagaactccacattgtttcaactggtaggacgtggcatccaactcgccgagttttatcgctcacaccatcactgcggctattgtggccatgaaatgcagcatagccagcatgaatgggcctgtttgtgcaatcattgccatgaacgttattatccgcaaattgcgccatgcgttattgttggcatccgtcgtgatgaccatattctgctggcgcaacatcagcaccatcgcaatggtatccacacggtgctggccgggtttgttgaagtgggggagacgctggaagaaaccgtgcatcgtgaagtcatggaagaaagtggaatcaagatccgtaacctgcgttatgtggcttcccagccgtggcctttcccgcaatcattgatgatggggtttctggcagattatgacagcggtgagatccaacatgatcccgttgaacttatcagcgcagattggtatcactatgatgaccttcctttgatccctccgtcggatacgattgcccgccgtttgatcgaagagacggttgcgctatgtcgtaacacgtaa

SEQ ID NO: 1904 - DNA, 141 bp, Xenorhabdus bovienii
  Coding DNA location: Contig name=SeqID_16866; Position on contig =7798..7938bp; Strand=+
atgattcaatcaatctatatcaaaatctatttatttcgaaatgagacgctcacatttcccaatttttcaccgatactttccttgaccaacaaattttggacaatatcattcactggcatatcagtcgatgagctgaaataa

SEQ ID NO: 1905 - DNA, 663 bp, Xenorhabdus bovienii
  Coding DNA location: Contig name=SeqID_16866; Position on contig =7988..8650bp; Strand=+
atgtcacagcagattgcggtatttgatctggatgatacattgatttgtggggattccagcctgctttggacggaatatttgtgggaaaaagacattattaccgatcatcgttttatcgaggcagaccagaaaatgatggctgactacagtgctggtaaactggatatgcacgattatctggcattcaatttacaatcactgaatcaagtacactatgaacaggttgatatttggctgacagattttgtggaaactaaaattaaacctatcttttatcccgcagccaaaaaacaattggctatctatcggcaacagaacattcccatcattattatttctgccaccgtttctttcgtggtgaaaaaaatcgctgccgcatttggggtgccgacagccatgggtattgatatggtcatggaagatggctgctatacggacagtattttgggaatccctaccttccgtgaaggaaaagtcacgcgtttgcagcaatggctgacagagcagaacttatcacctcagcatatctccttttacactgattccatgaatgacctgccgatgtgtttatttgctaacaaagtgtttactgtcaatgctgatatacggttacaaaaggaagctgaaaatcatggatggagacaattgagctgggtgttataa

SEQ ID NO: 1906 - DNA, 144 bp, Xenorhabdus bovienii
  Coding DNA location: Contig name=SeqID_16866; Position on contig =8623..8766bp; Strand=+
atggagacaattgagctgggtgttataaagaaaccatttctacatccaatatattttaaattttcggatatagttcgtcgttatttttcttactactttataacgacgtttcctttccaaaaaacattacaattttcttattaa

SEQ ID NO: 1907 - DNA, 132 bp, Xenorhabdus bovienii
  Coding DNA location: Contig name=SeqID_16866; Position on contig =8749..8880bp; Strand=-
atgcatatttttatagtaatttattgtatttactgtatttactgtatttactgtatttactgtatttactgtatttactgtatttactgtatttttagttggttctggtatttcttaataagaaaattgtaa

SEQ ID NO: 1908 - DNA, 126 bp, Xenorhabdus bovienii
  Coding DNA location: Contig name=SeqID_16866; Position on contig =9184..9309bp; Strand=-
atgttttctgtggcattttcacctaatgttgcaacattaggtgagtaccttcaaatcatcaggcgtgggaaggcttttatcccattccgttatgaatattcaaatcactattcatcatttaaataa

SEQ ID NO: 1909 - DNA, 258 bp, Xenorhabdus bovienii
  Coding DNA location: Contig name=SeqID_16866; Position on contig =9485..9742bp; Strand=+
ttgtcggagtgcctagcgttcaacgtatatcacgatgaacacaggctgagaccgttgattcgggatccgcagaacctgatcgggctaatacccgcgaagggaacaagagtaatcatcccgctggcatatcctcctgtttctatagagatattattcagcaccaaccattactccctgcgagctccagacaagcaattttctcaacttaagcccattccggtaggcgatgctcccattcgcataacggacaggctataa

SEQ ID NO: 1910 - DNA, 1974 bp, Xenorhabdus bovienii
  Coding DNA location: Contig name=SeqID_16866; Position on contig =9761..11734bp; Strand=+
atgtctaataatactgttattccaactactgatatcatccctgcggccgatgtctcgccaaaaacccatccggcacggccacgcaaggcacagcgggatgcagcacaggaatttatcaattccgttcaaggcattaccttccccaactcacgccgaatttaccttgcaggctcccgcaaagatattcaggttccgatgcgtgaaatccagttatcaccaacactgattggcggcatcaatgaaaatcctcaatttgaggaaaacgaatccgtgcccatctatgatacatcgggtgcttatggtgatcccgactcggtgctggatgtgcgagctggcttgaagaagatccgtcagccgtggatcaaagagcgtaatgataccgagccagttgctactctcagttctgactttacccagcagcgccttgcggatgccggactggatcatctgcgtttcaaccagcttcctcatccactgaaagccagacaaggcgggcgtgtcacccaattgcactatgcacgccaaggcattgtcacacccgaaatggaatttatcgccctgcgagaaaatatggggcgtgaacgcatccgcagtgaagtcctgctccaacagcatccggggcaaagtttcggggcgaacttaccggagaacatcacgccagagtttgtccgtcaggaagtagccgctggccgggcgattattcccgccaacatcaaccatccagaatccgaaccgatgattatcggccgcaattttctggtgaaagtgaatgccaacatcggtaactcctccgtcacatcctccattgaagaagaagtggaaaaactgatttggtctacccgctggggtgccgatacggtgatggatctctctactggccgttatatccacgaaacccgcgaatggatcttacgtaacagtcctgtacctatcggtacagtccccatttatcaggctctggaaaaagtgaacggcgtagcagaaaacctgacatgggaaatgttccgcgatactttattggaacaagccgagcaaggggtggattatttcaccatccacgcaggcgtcctgctgcgttacgtaccgatgacggccaaacgtctgaccggcatcgtctcccgtggcggttccattatggcaaaatggtgtctctcccatcatcaggaaagcttcctctatacccatttccgcgaaatttgtgaaatctgcgccgcctatgacgtttctctgtctttgggagacggtttgcgccccggttcaattcaggatgccaatgatgaggcgcagtttgccgagctgcataccctcggcgagctgaccaaaattgcctgggagtacgatgttcaggtgatgatcgaagggccgggacatatcccgatgcaattaatccgccgcaatatgacggaagaattggaacattgccacgaagcgccattctatacgctggggccactgacaaccgatatcgctcccggttatgaccatttcacctccggcatcggtgcggccatgataggctggtttggttgtgcgatgctgtgctacgtcacgccaaaagagcaccttggtctccccaataaagacgacgtaaagcaaggtctgatcacgtataaaatctcggcacatgcggcagatctcgccaaaggtcatcccggagcacaaatccgcgacaatgccatgtcaaaagcccgttttgaattccgctgggaagaccaattcaatctggcacttgatcctgaaaccgcccgcgcctatcacgatgaaaccctgccacaacaatccggcaaagttgctcacttttgctctatgtgtgggccaaaattctgctccatgaaaatcacgcaggacgtgcgcgattatgcagcaaaactggaacaggaagcaggcatggaacagatgtcagaagaattcctcgctcatggcagcgagctgtatcacagtgctgaggacattagcgatgaaaaatcagcctga

SEQ ID NO: 1911 - DNA, 774 bp, Xenorhabdus bovienii
  Coding DNA location: Contig name=SeqID_16866; Position on contig =11619..12392bp; Strand=+
atgcagcaaaactggaacaggaagcaggcatggaacagatgtcagaagaattcctcgctcatggcagcgagctgtatcacagtgctgaggacattagcgatgaaaaatcagcctgaatcctcaacaattccacaagccccttttgcctcaaccgtgcaccgtttggggctttatcccgtcgtggattccctgacgtggattgagcggctactgaaagcgggcatcagaaccctgcaactacgcatcaaagatctccccgaagatcaggtagaagaggatatccaatccgccattgtattgagccgccaatacaatgcccgcctattcatcaacgattactgggatctggccatcaaacatcacgcctatggtgtgcacttggggcaggaagatctagatatcgcggatctcaatgccatccggcaagcagggctgcgtctgggcatttccacccatgacgaacatgaactggcacgggcaaaagccctgaggccttcttatatcgcactgggtcatattttccccaccgccacgaaagagatgccttcaaagccacaaggcctttcggcattgaaacatcaagtggaaataaccccggaatatcccaccgttgccatcggtgggatttcactggatcgcgtgcctgatgtcgttgcaacaggagtgggtggcgtagcattggtcagcgccattactaaagccaaagattggcggcaggcaactgacagattacttcatttgattgaaggaaatgatcggaggctcttatgttaa

SEQ ID NO: 1912 - DNA, 825 bp, Xenorhabdus bovienii
  Coding DNA location: Contig name=SeqID_16866; Position on contig =12386..13210bp; Strand=+
atgttaaacgaccaagaatttatgcggtacagccgtcaattgctgctggaagacatcggccctgatggacaggaaaaattaaaagcaggaaaagtactgattgtcggattgggtggattaggttcacctgcggcactctatcttgcagcggcaggcgtaggccacctttatcttgcagatgatgatatgttgcatgtctcaaacctgcaacgccaaatcctctatcgcacagcagatattcccgcaggaaaggcggttttggcagcgaagcaactgactgccctgaatccgctggtcgaagtcaccgtgctgaccgagcggcaagatcgtgaatcactggaaaatttcgtccgtcaggtcgatctagtactggattgctgcgataacatggcgacgcgtcatgctatcaataccgcctgtattgcagaaaataaaccgctgatcagcggtagtgccgttggtttcagtggacagcttatcgtattcgaacccccttatttgcacggatgttatgcctgtctctatcctgatcaggaagagccgcatcgcaactgtcgtacagccggtgttttagggccggtcgtcggggtgatcggcacgttgcaatcgttggaggcaatcaaaatgctggtgggtctcccctcctccctgagcggaaaactacgactttttgatggcagacagcagagttggagcacgttacagctaacatcatcatcgcagtgtcctgtgtgcggaacccatgcctcaaaatctggttccacaaaacctgatcgcgcagaaaccgtttcaggcaaaacacgctcgggaagagaggtcgcatga

SEQ ID NO: 1913 - DNA, 201 bp, Xenorhabdus bovienii
  Coding DNA location: Contig name=SeqID_16866; Position on contig =13207..13407bp; Strand=+
atgaacattatcgtcaacgatcaaccgatcacactgagtacgtcgatgacggtgcaacagttactcgaacatgtacaacgctcccaatcaggcaccgctttggccattaatcaaaccattattccacgctcagagtggaacacccatcagattaatgacggagataatatcctgctgtttcaagccattgccggaggttaa

SEQ ID NO: 1914 - DNA, 768 bp, Xenorhabdus bovienii
  Coding DNA location: Contig name=SeqID_16866; Position on contig =13410..14177bp; Strand=+
atgttaaaaatcgctgatactctctttcattcccgcctgtttacgggaacaggcaaattcgccaatgcaaatttgatgatcgagtcgatacgtgcttctggtagccaattggtcactatggcgatgaagcgcatcgacctgcatggcaatgacgatggcattctcgccccactacaacagttaggcgttaaattactgcccaatacctctggggcaaaaacagcagaagaagcggtgtttgccgctcgccttgcgcgggaagccctaggaactcactggatcaagttggaaatccatcccgatgtaaaatatcttttgcccgaccccatcgaaacgctgaaagctgccgggcaattggtaaaagaaggattcgttgttctgccctattgcggcgctgatcctgtcctgtgtcgccttctggaagaagtcggctgtgctgccgtgatgccattaggcgctcccattggctcaaacaaggggctgctgacgcgagattttctgcaaattatcatcgaacagtccagagtacccgttgtcgtggatgccggtatcggggcaccaagccatgcactggccgctatcgaaatgggtgctgatgcggtactggtcaatactgccatcgccgttgcccgcaatcccatcaaaatggcactggcattcaagacggcgattgaagctggcgagctttctcatcaggctggtgtggcaagccagaaatcacatgcagaagcttccagtccactgaccgattttctgggggcgttatga

SEQ ID NO: 1915 - DNA, 1125 bp, Xenorhabdus bovienii
  Coding DNA location: Contig name=SeqID_16866; Position on contig =14192..15316bp; Strand=+
atgactgatcatacatttcgccagcgctggcagcagttggattgggacgacataacactgcgcatcaacagtaaaaccacgcaggatgttgagcgagcattaaaccgcgatcgtctggcaatggatgattttatggccttgctctctcccgcagccctgtcttaccttgagccgctcgcccaacgtgctcaacaactaacgcgccaacgattcggcaataccgtgggattttatatcccactctatctttccaatctgtgcgctaatgactgcacctattgtggtttctccatgagtaaccacatcagacgcaagacactcaatgaacaggagattgaagctgaatgccaagccatcaaaaaactggggtttgaacatatcctgttggtcacgggagaacatcagagcaaagtcggcatggattatttccggcgctatctccccattatccgcagccagttcagttctatcacaatggaagtccagccattggcacaggaagaatacgctgaactgaaaacgctggggttggatggcgtgatggtctatcaggaaacctatcatgctcccagttaccaactgcaccatctgaaaggaaaaaaacaggattttcactggcggctggaaaccccggaacgcctaggacgcgcaggtatcgacaaaatcgggctaggtgcgttgatcgggctgtcccctagctggcgtaccgattgttatatggtggcagagcacctgcttttcctgcaaaaacaattctggaaaagccgttactctatttcctttccaagattgcgcccctgcgcaggtggcgtagaaccggcttccctgatgagcgaagctgagctggtacaactcatttgtgcatttcgcctgctagcaccggatgtggaactttccctatccacccgtgaatcaccgtttttccgcgatcacgttgtaccactggcaatcaatcatgtcagtgccggttccaaaacccagccggggggttatgccgacgatcatcatgaactggaacaatttacgcctcatgataatcgctcagttgttcaggttgccgcagcactggtgaaatcaggtttacagccagtctggaaagactgggataattatctgggacgttag

SEQ ID NO: 1916 - DNA, 1038 bp, Xenorhabdus bovienii; identical to SEQ ID NO: 1289
  Coding DNA location: Contig name=SeqID_16866; Position on contig =15394..16431bp; Strand=+

SEQ ID NO: 1917 - DNA, 597 bp, Xenorhabdus bovienii
  Coding DNA location: Contig name=SeqID_16866; Position on contig =16573..17169bp; Strand=-
atgaatttgcagcactgccattggcttaatgagcctgcctcgtggaagcatcaagaagatgtactccatgtgacgacagatattaaaactgatttttggcgtgatacatggtatggctttcagcgtcatagcggccatgtttttggtcgctatgttgatgatattcatgttgaagcgggttttactttccaaatttgtatcgaagggtgttttgaacatttatacgatcaggctggcattatgctgctggtggatgagcaacattggttaaaagcaggtgttgagcattctgatggtcaggcgacgatcggcagtgtgctaacgaattcttgctctgactgggcgatgggcgtctttccgggtaatcctgataagttctggttaaggctgacttatggtgaaggagtgatcagactgcaatattccactgatggggtgaaatggccgttactgcggttatcgccttttgctgttgacagtcagcggatttttatcggagcaatgtgttgttcgccggaacgagaagggttgcaggtaaagttctccgattttagtttgaaatcatcgctgaaaagacacctgcatgatttgagttag

SEQ ID NO: 1918 - DNA, 1071 bp, Xenorhabdus bovienii
  Coding DNA location: Contig name=SeqID_16866; Position on contig =17184..18254bp; Strand=-
atggcagcttgggcacctcttattcctttggttaaggagagatttgcacttgatgatggtgctatggggttgctcatactggtatttggcattggttcctttatcacgatgcctttggcggggatgctggccagccgtttcggttgtaggaaaatttttcccctgtttgccctgctggcaattttgatgctaccggggttaagtatattgccaaccccttgggcactagcttgtgcgctgtttatgttcggcgtggggattggcgcgacggatgtggtgatcaatattcatgcagtcaatgttgagaaaatggtgcagcagccaattatgtccggttttcatgcgttgttcagtctgggcggaattgcgggtgcagggtcagtcagtttactgttgttgatgggaatatccccatttcaggtcatgtccgcagtggcattattcattattctattgttgctgccagcatggaacggattattggatcacatagaaacgggcaataccccatcttttgccttgcctcgtggtattgtgatcctgctcggttttctttgctttgtcgtttatctgatggaaggctccatgttggattggagcgggatcttgctgagtagtgtccataatatggatagccatcaggcggggtttggttacacgcttttcgccattaccatgacatgtggccgctttttgggcgataaaattatctcgatgtttggataccggcgggtttttctggcaagtgcaattttggctacttcgggttttgtcctgatctatctggcatccagcatgattgtattgggtatttctttcctgatgataggagcgggtttatccaatctggctccgatgtttttcacagcttcagggcagcagaaagtcatgcctgattctcaggcggtttctgccgtctctacgatgggatattcgggtatcctgctggggcctgcaattatcggaggtttggctcatcaggtcacattgcatggcgcttttgcctgtattgctttactttctcttacattgttagcgggctatggattgattcatcccgccagaaaataa

SEQ ID NO: 1919 - DNA, 189 bp, Xenorhabdus bovienii
  Coding DNA location: Contig name=SeqID_16866; Position on contig =18163..18351bp; Strand=+
atgccaaataccagtatgagcaaccccatagcaccatcatcaagtgcaaatctctccttaaccaaaggaataagaggtgcccaagctgccatactgaagccggcaataaaaaaagcgagccgtgtcgcgatgatcggctgctttatcgaagaaactgcatattcctcagacaacttaattcctccataa

SEQ ID NO: 1920 - DNA, 96 bp, Xenorhabdus bovienii
  Coding DNA location: Contig name=SeqID_16866; Position on contig =18399..18494bp; Strand=+
atgtactctgacgcacaatcatgccctccacaggttttgctggaggacatcaatattgcttacattgctattgcacttacattagcatcacgctga

SEQ ID NO: 1921 - DNA, 639 bp, Xenorhabdus bovienii
  Coding DNA location: Contig name=SeqID_16866; Position on contig =18486..19124bp; Strand=-
atggataaattcaatgtcatttttgatatcgatggggtcattgtcgatagtgaacaactgcattttgatgtgttgtgtggactggcacctgatcacacgcgtgatattcagccacagcaattgattggtttgagtctggcggaaacactgaatgaaattggtgttccattactcgagcagcaaggcattaccgacaagattatctcggtttatcaggaaaagttatctgcacattatctacgtccgggggtgactcgtctcatcgcggccttacagcaaaatgacattgcttttgggtttgtttccaccgcaccgcgtgccgtttgtctggctaatttggggttactgggtttgtttgatgaacctgccttgatttccggtgatgatgttgaaagaactaaaccttttcctgatccctaccttgccatgctaaagctgaaaaggatggatgttcagcagactttggtgattgaagatacggatctggggatcgcagcagcaaaacaagcagggatcccgtgggtatatgcttggcctcatgatttgtcggtggctgaacagtacgggcaggcgacttgtattattggtgaattgacggatattccgcaattttctgggataaattcgctgtcagcgtga

SEQ ID NO: 1922 - DNA, 1062 bp, Xenorhabdus bovienii
  Coding DNA location: Contig name=SeqID_16866; Position on contig =19138..20199bp; Strand=-
atgaaagccctgaaattcaaccaagtatggaatgtccagattcagcaagttgaacccttgcactgcattgaatcggatgatgtggtagtcgatattgcagtatgtgggatttgcggcacagatataggaatcattactggttcttatcctgtagcggtaccgggaaccacattggggcatgagaccacgggagtggtgacgcaaattggtagtcatgttacccgttttcagattggtgatcgtgttgttatcaatccgacatactcctgtggacattgtaggatgtgtcagacaggtaatcccaatcactgcgagaaaaaattggggacggaagcgggggtttcttacgatggggcatttgccgagcagtatttggcgaaagaaagctcgctgatcaagcttgatgagcatgtcagtatggaagcggcttcgttgactgaacctttgagctgcacactgacgggagtggataaactggggatcacccataccaatattcgggccgtggtagctggggctggccctatgggaatgctgtatctctgggcgttgcatgaacggggtgttaaggcattcatgatcgagaaaaacccgagtcgtgtgcagtttgctatcaacaacctgccggcagaatgtcggttatataccgattttgatgaagcgttgacgcaggaatacggtgataaatcagccctgatcgatttatgtgtagataccacgggacaactgaccgaatatgttttcgaccatttagccgcaggcggtaagttgctgaatgtcgctttaaaagataaacatgccaatcttgatattctgaaaattgccgacaaaagtctttctgtcatcggttcgattgactccttgaacaacagttttgagcgtgcttacgccatgatccgggatggtgttatccccgctgaacgcctgattagtcagatctttgattttgaggattatcagcaggcttttctcaccgtgggctgtgatattgccgagaaagctcaagtgccgctcagtacaccaaactgcaaggtattgatccgtatggctgactttaagtaa

SEQ ID NO: 1923 - DNA, 1251 bp, Xenorhabdus bovienii
  Coding DNA location: Contig name=SeqID_16866; Position on contig =20199..21449bp; Strand=-
atggaaaatagaaatcatcttgacgatatgctttcccgttttgttggtcacggtccttatttggaaatcgatggcgaaaagcatattgatgcggcatcaggtacgtttaatttgccgcttggctacactaaccacagagttgcggaaaaactcaagcaacagattgatagatgtacgcatttaagttctgcttatacgcgagaaatgtcacagtatattttgaccaaattggtgaaacatacaccagaaggcattgacagaatgtggctgcgggatgtttccggttctggagctgttgaaggtgccattcgtatcgcccaaaaagccacaggacgctctggcattatctcgttctttcttgcccaccacggccagtctcttgcaacagcgcagatctccggcaatgcgttcaggattaaagacttccatatcagtattgatggttcgataaaaattccagcacctgccagtgtcatggtagaacctgactcgaatgagaaagagagccaatatgccgatctggaacagttcattcagttgggttccagtgacaatatcgcatgtctgattattgaaccgattcagggcaatggcggcaacaccgttttccccgtggagttctatcgtaaaatcagggaaatctgccatcagcacggcatcatcattattgcggatgaagtacagacggggtttggccgtaccggaactttctttgcatcgacaggttatgccaaggaattagagccagatatcattgtgttcgcgaaaggggcagggggtattggtattccgactggcggtgtgctgatgcgcagctcgctggatgtgttggaatcatttgagcattccagtacttccggtgctaatcccttgtctttagtcgctctcaacgaagttattgatattattgaagatgattccattctggaaaatgtgcagcagaacgaggctttcctgcgtgatggattgttggccttacagcataaataccctgaaatcacgggggtcagaggcatgggctacatgttcggttttgatactccaaccccagaatttgcggcacaggtgattgaaaccgccagccgtcaacgattgatcctgcgtggctcccgttatggcaaagggcgggcgcttaaggtacgtcctcctttggtttgtacacaggaacacttacatgaaattctccataaactggatctggcattcgctgaattgacggtttctgcaccgaagcacagagaggttgcataa

SEQ ID NO: 1924 - DNA, 2877 bp, Xenorhabdus bovienii
  Coding DNA location: Contig name=SeqID_16866; Position on contig =21652..24528bp; Strand=-
atgaaatcaaccaacctgtttgcaaaagataggcgtttctctaaatttggttgggcattaatgaatgttagtggtgaaaatgaatcaataacattgaacagggttttggtatcagttttattcattgcttatgaagggaagaaatcaatgcttatcccatcgaaactcagtcgcccccttcgccttaataatatggtcatgcgcgagcgtctgttagaactgctcagtgaagtacagcactatcgtctggtattgataaccagccccgcagggtatggtaaaactacattgatgtcacaatgggctgccggacagagtaatctgggatggtactctctggatgacagtgacaatcagccggaacgttttgccagctacctgatcgctgctattcagcaggcaacacaggggcattgtgtaaaaagtgacgttctggctcagaagcatcagtatgccaatttacccgcattgtttgcgcagttgtttattgaacttagtgaatggaaacagccgatctttctggtgattgatgattatcacctgatagagaataacctcattcatgaagccatgcgctttttcctccgtcaccagcctgaaaatctgactttgacaatactatcccgtcatttgccatcgttgggtgtggctaacctacgtgtgcgtgaacagttattggaattcgatagccagcaattggccttcgattatcaggaaacccagcagttttttgataaaaggctggccagcccactgggtgcggataattgcaaacagttatgcaacgacgtcgcgggttgggcgacggccttgcagcttattgccctttctgcccgtcagtcaggcaatacggcggaaatgtcggcaaaacgcctttcggggatcaatgccagccatctcgcagattatcttgtggatgaggttttaaatcgtgtggatcaggatacgcgggatttcctgctgcgcagttctatcctgcgctcgatgaatgatggcctgattgtttgtctgacgggagaggataatggccagcaacgccttgaggatattgaacgtcaggggctgtttatccaacgcatggatgattctggcgaatggttctgttttcatcctctgtttgcctcattcctgcgccaacgatgccagtgggaaatggccgcgaaattgccagaattgcacagggccgcagcagaaggctggttgatgcagggttttccgggggaagccattcaccatgcgctggctgccggagataccgtactgttgtgtgatattttgctgcaacatgcttggggtctgtttaaccacagcaagctgtcactattggaagagtgcatgaatgcactgccatatgagcaattactggaaaatccgcgtctagtactgttacaggcatggctggcacagagccagcatcgttattatgaagtgaatgctttattgaatcagacagaacagtcgctgaagcagaaacaaatcattattgagccggaattgctggcagaatttgatgccctgcgtgcccaagttgcgattaacgatggccggccggacgatgctgatacgctggctgagaaggctttggcagcccttttgcccgacaatgaatatggccggattgttgcgatgtcggtgaaaggggaagttctgcattgtaaaggggaattgtcccatgcattggcattgatgaagcaaacggagcaacttgcccgacgctgccatgtttatcactatgctttgtgggcgttgttgcagcaaagtgagatcttattggctcagggctatttgcaggcagcctatgaaattcaaaaccacgcttttgatttgattcgtgagcagcatttagaacagttgccgatgcacgaattcctgttacgcattcgttcacagcttttgtggtgttgggcgcggatagacgaatctgaagaagcggcgcgtcgaggcctggaagtgttgtccagcgtccagcctcagcagcaattacaatgcctgacccaactggcgaaatgttccttgatccgaggggatattgataatgcccgccgttacctgtcccgctgcgaaaatctgttgaataacgggcattatcatcgtgactggcgaaccaataccgacaagctacgcgtcattatctggcagaatttggaagatagcggctcggcgactcagtggttggtacaggcggaacggccagaaagcttcaataaccatttcaatcagaatcaatggcgcaatatcgcccgtgcacagatcctacttggtcagtatgaggaagctgaacctatcctgggaatgctgaataagtacgcgagagaattgctgctgataagcgatttgaaccgcaatctattgctgtgtaatctgctgcactggcagcttggacacaaggctgaagcacaggctgttttgatggaagccctgagtttggctaaccgcacaggatttattagtcactttgtacttgaaggtgagttgatggctcaacaattgcgccagcttattcagctcaatattctgcctgaacttgagcaacaccgtgcccagcgtatcctgcgggaaattaatcgccagcatcggcataaatttgcccattttgatgaaacgtttgttgagcagcttcttacacaccctgatgtaccggaacttatccgcaatagcccgctgactcagcgtgaatggcaggtattggggttgatttattccggttacagtaacgatcaaattgccgcagaactggaggtcgccgcgaccacgatcaagacgcatatccgtaatctgtatcagaaaatgggcattacccaccggcaggatgctattcaacaggctcaacatttgatgcaaataatggggttgagtgttgaatcaatgaatatttaa

SEQ ID NO: 1925 - DNA, 219 bp, Xenorhabdus bovienii
  Coding DNA location: Contig name=SeqID_16866; Position on contig =24548..24766bp; Strand=-
atgctgaagattcttgaggcggtaggcatcatcctacggggatattcacagggaggagtgcaagggcgtagccattggccgtatttaaataaacagcaaggcaggtggcagaagaaatgggtcaacaacttgataggaaaagtttcctacttgtcccgttttttcgaggcttttcgcaatttcattgggaacaggaaaaattgtaagcaaagaatgtga

SEQ ID NO: 1926 - DNA, 2409 bp, Xenorhabdus bovienii
  Coding DNA location: Contig name=SeqID_16866; Position on contig =24821..27229bp; Strand=+
atgcaacagcccaaattagataaagccgtctttcaagccgcgcttacacgccagtggcagcgctttggccttagttcagcacaggaaatgaccccacatcagtggtggcaggccatcagtgctgcactattagaattacttccctcttccagccagaaccatgcccatcagtttcataaccctaagcgtcatgtgaactatatttcgatggaatttctgataggccgtctgacagccaacaatttgctgaatcttggctggtatgacgatgttcaggcttatctggcagaagatggactgactttgagtgacttactggaacaagaagctgatcctgcattgggcaatggtggtctgggtcggctggcagcctgttttcttgactcaatggcgacgattgatcaacccgcaacaggctatggccttaattatcagtatggcttgttccggcaatcctttgatcaagggctacaaattgaggcacctgatgactggaagcgcggttcctatccgtggtttcgccataatgcccaattgaaagttgacgtaggtcttggcgggaaaatcgtgatgacagccgaaggtcatgaaacttggcttcctgcctttaccttgattggcgaagcttgggatctgcctgtcattggctatggtaatggcgtcacacagcccctacgcctgtggcaagcaacgcacgataatccttttgatctgtcacttttcaatgacgggcaatttctgaatgctgaacaacagggcatcgaagccaccagcctgaccaaagtgctttacccgaacgataaccatcaggccggaaaacgcctgcgcctgatgcagcaatatttccagtgtgcctgtgcgatggcagatattctgcgtcgtcatcagcaggctggccgcaaggtggaagaattaccacgctacgaagtcatccagcttaacgatacccacccgactatcgccatccctgaaatgatgcgtctcctgctggatgagtaccaattggattgggaaacagcatgggaaattacagggcagactttcgcctatactaaccatactttgctgccagaaggtttagaacgctgggatgagcatctagtcagtgaactgctgccacgtcatcaccgcattattcaggaaatcaaccgtcgcttccagaaaaccgtggagcaaacctggcctggcaatcaacaggtgtgggaaaaattagccgttattcacgaaaatcaggtaagaatggctaacctctgcgtagtcgcctgttttgctgtcaacggtgtagcagcattgcattcatccctaatcgtgacggatctgtttccagagtactatcacttgtggccggaaaagttccataacgtaaccaatggcgtcacaccgcgtcgctggttaaagcagtgcaatccagcactctcctcactgattgaccaaaccttgaatcatgaatgggttaatgatcttgagagcctgaaacaactcgaaccttatgccaacgatgcagctttctgcgaagcttatcgcagcatcaaacaggaaaataaaattcggttgtccaactacgtcaataaagtcatggggcttaagattgatccccacgccatttttgacgtacagataaaacgtctgcatgagtacaagcgccaacatttgaacctgctgcacatcctctctctgtatcgacagattcaggagaatccgtcactggatatccacccccgcgtcttcctgtttggcgccaaagcagctccgggctactatctggcaaaaaatattatcttagccattaaccatgcggctgaaaagattaatcatgatccgatcgtccgtgatcgtatcaaaattgcctttattcccgattacaacgtttccaccgcagaattgatgatcccggcggctgatgtctcagaacaaatttctactgcaggtaaagaagcctccggtacaggcaacatgaaactggccttaaacggtgcattgaccattggcacgctggatggcgccaatgttgaaatcgccgaacaagtcggcaatgacaatatttttatcttcgggaacaatgttgaagaagcaaaagccttactgaaaagtggctacaatccacgggagatcctccagcagaatcctcatctacaaggcatactggatgcacttgccagtggcgaattcagccacggagacacgcaggcattcgatctcatgctgcatagtttggttgatggtggtgatccttatttagtactggcagattttgactcctactgccatgcccatacgcagattgataccctgtaccgtaaccctcaacactggacacaccgtactattctcaacactgcccgcatgggtaaattcagttctgaccgagctattcaagattaccaacagcgtatctggcaggccaaataa

SEQ ID NO: 1927 - DNA, 2109 bp, Xenorhabdus bovienii
  Coding DNA location: Contig name=SeqID_16866; Position on contig =27238..29346bp; Strand=+
atggaaaataaacacctcgacaatttggcaacagaggctggcatagccgccgaatatattaatgcctacgggaaaccgcaggctatccctgccgaaattcggcatcggatattggcagccatgtatacagatccaccggccaataggccggtttctgatttacctgttttaaccgtgcctgtggttaaagtgatgactcaaggtcagacaatcactttacctttgaacagtacagaaaattatcggtggcaaatacaaacagagcaaggagagatatttcaaggggattgccaatatcaaatcactctgccggctaaccttcctctgggctatcacacactgacattagtgccaatacaatcaatatcagcaaaagaacctcatacccagcacccagttatgcagattattgtggcgccagaacgttgctatgagccagaaacgctgataaatggcggaaaactctggggagcctgtatccagctctataccttgcgttcagaaaataactggggaatcggcgattttggcgatctgaaatatatgctgcaagaactgacgcaacggggtggcgcatttatcggcctgaatccacttcatgccatgtatccagccatgcctgaagacgccagtccctacagcccttcttcccgtcactggctcaatatcatttatattgatgtgaaccaggtagaagatttcacatacagtgttgaagctcaaaaatggtggctattgccggaaactcagctcaagctccagcatgtccgccaaacagaattagtcgattacaccagcgtgatgacattaaaaataacagcgctgcgtctggcttatcaacagttccaaacccgatccgctacagatcacctgtacattgcttttcgacaatttgttaccaaaggtggtaaaagcctttactctcaagcagcctatgacgctctgcaccgtaaactctacgacgaagacagcgcttactggggctggccggtatggccagaaaaatatcgtgaacctgatagcgatacggtgaaggaattctgccaatcacattggcaggaagtcgagtttttcctctggttacaatggctggccgatacccaattagctggctgctttaccgaaagccagcacaatcatatgccaatcggcatttatcgtgacttggctgttggtgttgcacaaggcggctcagaaacatggtgcaaccgaacggtgtattgcaccaaggcatctattggcgctccaccggacatactcggcccactcggacaaaactggggcttacctccgataaacccacatgtattacgagcccaagcctatcagccttttattgaattactgcgtagcaatatgcgccactgtggggcattacgtattgatcacgttatgtcactactcagactatggtggataccacaaggagaaactgccgataaaggggtttatgtccattatccagttgacgatttgctggcgatactggcgctggaaagccaacgccaccactgtatggtgattggcgaagatttagggatcgtgccagaagaaattgtcgggaaattacatgaccgaagtgtctattcctataaggtgttctattttgaacgggatggacacggagaattccgctcacccgatgaataccccacacaggcaatggcaaccattactacccatgatttacctacattacgcggattctggcaaaacaaggatttgatgttgggggaatcaatcggcttatacccagataccactctacttgatgggttatatgatgaacgtaagcattgtaagcagaagttattggacggtttgaaccgccatggttatttatctgcatcactgagcatgacagacacgccagctccgatgtcagcctccatcaatcaaagcatacatcgctacattgcccacagtaccagtgccttattgggattgcagcccgaagactggctagatatggaactccccgtcaatattccgggaacgtccacagagtatcccaactggcggcgcaaactaagcattacgctggaagctatgttccaagatgaacatatcaaccacttacttcaaacggtaggagagtaccgaaggtaa

SEQ ID NO: 1928 - DNA, 891 bp, Xenorhabdus bovienii
  Coding DNA location: Contig name=SeqID_16866; Position on contig =29416..30306bp; Strand=-
atggcgatggtgcaaccgaaatcacaacggtggcgggtaggggcaacacatatgttaatgctggcttttattgcattgatcttattgccaatgttgatggtgattgctatttctttgcgacctggaaattttgccacaggtagtcttatccctgaaacaatttcatgggaacactggaaactggcgcttggttatagcgtggaatccccagatggacgtgtcacccccccaccattccccgtcatacaatggttgtggaattcagtaaaaattgcattcattacggctacggggattgtggctttgtcaacgacctgtgcttatgcctttgctcgaatgcgctttcgtggcaaaagcactttgttaaaagggatgctgattttccagatgttccctccggtactttcgctggtggcgctatatgcgctctttgatcgattaggtgcctatattccatttatggggcttaatactcacggtagtgtgatttttgcctatatgggagggattgcactgcatgtatggacgatcaaaggttatttcgaaacgctagatggttctttggaagaagccgcaatgctggatggggcgacatcgtggcaagttttccgtttgatattattaccgctttccgtgccaatactggcggtagtgtttatcctgtcttttattggtgtcataaccgaagttcctgtggcgtcactgctgttgcgggatgtagacagttatactctggcggtaggaatgcaacagtaccttcaccctcaaagctccctctggggggattttgctgccgcagcggtgctttccgcaatccctatcaccgtgatgttcctgcttgcacagcgctggttagtcggtgggttaacatcagggagcgtgaaggggtga

SEQ ID NO: 1929 - DNA, 1563 bp, Xenorhabdus bovienii
  Coding DNA location: Contig name=SeqID_16866; Position on contig =30319..31881bp; Strand=-
atgtcagcgagattggacaaaacagaatggtggtcgcatcctgtcctaaaatggttcggagtcagtctgtgcctattttttaccggttatttgattgtattgatgtatgcccaaggtgaatacctgtttgccatgctgacactggtattactgggaagtggtatttatgtctttgctaaccgtaaggcttatgcttggcgttatacctatccgggaattgcgggcatgagcctgtttgtattgtttccacttatttgtactgtcgccattgctttcacgaactatagcagtacaaatcaactaacttttgaacgggctcaaacggtgttgatgagtcgtcaatatcaggcaggtcagacatttaatttcaaactttatcctgaatctgaacagtgggtactggccttgagtgttcctagtagctctcaattactggtatctgatcctttttctttatctacatctgcgggggaagaagtcattctacctttgcataagcaggaaaaggtttttgagagtgatgccgccgcattgcgaaccataactcagtatcggcaggcgttaggtcagcttgttactgttctgccggatggcagtaagttacgtatgagttcactgcgtcagttttccggcatacatccccttcattccattggagaagacggcatcaccctgaccaacaatcaaacggggacacaatatcgaccgaatatggatacagggttctatcaagccacgaacgctgagggcggctggagtgagggaacattaagcccgggattcacggtttctgtcggttggaaaaactttttgcgggttattcaggatgacggtatccaaaaaccctttctttcgatttttgtctggactgtgatcttttccctgctaacggtgatattgacggtggcgctgggtatgatccttgcgtgtattgtgcagtgggaggcgctcaaaggacgggcaatttatcgtgtactgcttattttgccgtacgctgttccttcgtttatttccatcctgatttttaaagggttatttaaccagagttttggggaaatcaacctgctgcttaacgggctgtttggtttgaaaccggagtggtttaccgacccaacactggcgcgaacgatgttgattatcgtgaatacgtggctggggtatccctatatgatgatcctttgcatggggctgctgaagtcaattcctgatgatctttatgaggcatcggccattgatggggctgggccattacagaatttttccagaattacttttccattgctgattaagccgctgactccgttgataattgccagtttcgcttttaattttaataactttgttttagttcagttgctgaccaatggcaggccggatcgcattggtacaacaacccctgcgggttataccgatcttttggtgaattatacctatcgtatcgcttttgaagggggcggaggacaggattttggtttggctgcggctattgctacgttgattttccttttggtcggggcattagccatcattaatctgaaagcgactcgtattaaatttgattga

SEQ ID NO: 1930 - DNA, 1200 bp, Xenorhabdus bovienii
  Coding DNA location: Contig name=SeqID_16866; Position on contig =32017..33216bp; Strand=-
atgacaaaaacaactctgaaagtgggtgctcgcgctctgatgctttccgttttaacgacatggatactctctgcccctgcttttgcaaagctggaagaaggcaagctggtgatttggatcaacggtgataagggatacaacgggctggcacaggttggtgagaaatttgcaaaagagacaggcattcctgttgctgttgagcatcccgacaaattcgaagaaaaatattctcaaatagccgcgaacggtgatgggccagatatcattttctgggcgcatgatcgctttggtggttatgcccaatctggtttattggccgaagtgacacctgatcaaccgttcatggacaagctatttccttttacctgggatgcggttcgttatgatggcaaactgattggttatcccattgcagttgaagcgctttctcttatttacaataaagatttagtgaaatctccgccaaagacatgggaagagatccctgcgctggataatgaactgaaaaagcagaataaaagcgcaatcatgttcaacttgcaggaaccttatttcacttggccactgattgctgctgatgggggctacgctttcaaagtggagaatggtgcctataacaccaaggatagcggagtgaataatgcgggctccaaagcggggatgcaattcttggttgatttggtgaaaaacaaacatctgagtgctgatatcgattactccattgctgaagcggctttcaataaaggcaaaacagcaatgaccatcaatggcccgtggacttggacgaatatcgacaaaagtaagatcaattatggggttactttattgccaacctttaaaggaaaaccctctaaaccgtttgttggcatcttaaccgccggaatcaatgcagctagtcctaataaagaattggcgaaggagtttctggaaaactatttgctgaccaacgaaggcttggcaacagtggataaggacaaaccgttgggggctgtggcgctgaaatcttatcaggatatccttgcgaaagatccacgtattgctgccacgatggcaaatgctcagcaaggtgaaattatgccgaatgtttcgcaaatgagtagtttttggtatgccatgcgcagtgctgtccttaatgcagtgaatggtcggcaagctattgatgccgcgcttaatgatgcagaaaatcgaatagctaaataa

SEQ ID NO: 1931 - DNA, 186 bp, Xenorhabdus bovienii
  Coding DNA location: Contig name=SeqID_16866; Position on contig =33156..33341bp; Strand=+
atgtcgttaaaacggaaagcatcagagcgcgagcacccactttcagagttgtttttgtcatcattccgtccttttcgtcgtttgcaggttcaagatgaatttctcgttacaccgctagaaaatggttcccagtgtgcaatcaacggaaggcaagctcatcctcccctgttctacgcctcaccataa

SEQ ID NO: 1932 - DNA, 96 bp, Xenorhabdus bovienii
  Coding DNA location: Contig name=SeqID_16866; Position on contig =33342..33437bp; Strand=+
atgagtgtgaacttgattacaaaaacactgaaaatcaggatgttaaccttaaagagacatcaatttttgcgatttaaatcacatcttgctcagtga

SEQ ID NO: 1933 - DNA, 156 bp, Xenorhabdus bovienii
  Coding DNA location: Contig name=SeqID_16866; Position on contig =33427..33582bp; Strand=+
ttgctcagtgatttttcacggaatctctcaatcacattaatctcatcctccttatgcctcccccataaaaaattatgggatggaggatttttattcctgttattttgcacacaattttgccaccagtttttcactaagtttttactacaaacatga

SEQ ID NO: 1934 - DNA, 138 bp, Xenorhabdus bovienii
  Coding DNA location: Contig name=SeqID_16866; Position on contig =33506..33643bp; Strand=+
atggaggatttttattcctgttattttgcacacaattttgccaccagtttttcactaagtttttactacaaacatgaaactagggtgacaactccgaggggaacacatgtccagcgtcacactccgcaatgtatctaa

SEQ ID NO: 1935 - DNA, 1110 bp, Xenorhabdus bovienii
  Coding DNA location: Contig name=SeqID_16866; Position on contig =33612..34721bp; Strand=+
atgtccagcgtcacactccgcaatgtatctaagacttatggtgaaactgtcatttccaaaaatttcaaccttgagattgaagaaggggaatttgttgtttttgttggtccatcaggatgtggaaaatcaacactgttaaggatgattgcaggtctggaagacattacctccggtgatttactgatagcaggacagcgaatgaatgatgttcctcctgccaaacgcagtgtaggtatggtttttcaatcctacgcgctatacccccatctgtctgttgctgacaatatgtcattcggcatgaaactggccgggatcaaaaaaagcgatatccagaagcgagttcaacaagttgcagaaactcttcagctcgcccatctgctggatcgtcgccccaaagcactatcaggagggcagcgtcagcgagttgccattggccgcactctggtcgctgaaccgaatatctttcttctggatgaaccactctccaatctggatgctgcactgcgtgtccagatgcgcatcgagatttcacgcctgcatcaacgccttcaacgcacgatgatctatgttacacatgatcaaaccgaagccatgacgctggcggataaaatcgtcgttttggatacgggcaacattgctcaggtcggtaagccactcgaaatttatcactaccctgccaaccgttttgttgcgggcttcatcggttccccaaagatgaatttcctaccagtcaaagtctctgccacagcagtcgatcaagtacagattattttgcctaacgggcagcatgtctggctaccagttgaaagtaaggatgtcactgtcggtagcaatgtatctctaggtatccgccctgaacacctgctgcctaatgatgtggccgacgtaacgctggaaggaacagtgcaaatcgtagagcaactggggaatgaaactcagattcacatccgcatacctgcaattcaccaaaatttggtttaccgccagcctgatgttgttctcgtggaagaaggagcaaccttcactatcgggttagctccccatcgctgtcatctattccgcgaagatggaactgcatgtcagcgtttgcataaagagcccggagtctga

SEQ ID NO: 1936 - DNA, 1275 bp, Xenorhabdus bovienii
  Coding DNA location: Contig name=SeqID_16866; Position on contig =34755..36029bp; Strand=+
atgcgtatcttacctctttcattggccatgctgactggtttgttatccatgcaggccactgcggtggagttccacggttatgcccgttctggcattggctgggcaggtaaaggaggagaacagaaatgtgtccaaagcaccggtgcacagagtaagtaccgtctgggcaatgagtgtgaaacctatgcagaactaaaactagggcaagagttatggaaagagggtaacaagcgtttctattttgataccaatgtggcctattccgttgcacagaaagatgactgggaatcaaccaacccagctttccgcgaagtcaatgttcaggcaagcaacatcattgactggctgcctggttcgacgctatgggctggtaagcgtttctaccagcgacacgatgtgcatatgatcgatttttattactgggacatctccggccctggagcaggtttgcaggatattgatttgggatttggtaaactttcccttgccgtgacccgcaatacggaatccggtggttcgcatggctggatcgccgataaacgcgatgaagttccgacttccaatgatgttttcgatgtgcgattagctaatttacaggtgaatgaaggtggcactctggagcttggcatcgactatggacgtgccaatgcgcgcaagggttaccatctgaatcaaaaagcatctaaagatggtgtaatgctgacagctgaacatactcaaagcttgttaggtggctttaataaatttgtcgtacagtacgccactgatgccatgacttcctacaatagtggccattcagaaggtgctagcgtaaacaatgatgggcatatgttacgtatcctgaatcatggtgctatcaatattacggataaatgggatctgatgtatttagccatgtatcagaatatagatcgcgataatcgcaacggcaacacatggtacaccgttggtgtccgcccaatgtacaaatggacgcccatcatgagtactttgctggaagtcggctatgacaatgtgaaatctcaacgtaccaaagacaccaacaatcaatacaaaatcacgctggcacagcaatggcaggcaggtgacagtatctggtcacgcccagcaatccgtttgtttgcaacttatgccaaatggggtgaaaaatggggctatgcaaacaaaaataacggttacaagggtgttgcctacaatgattcgtcatcacaccgtttcagccgtggtaacagtgatgaattcacctttggcgcccagttcgaagcttggtggtaa

SEQ ID NO: 1937 - DNA, 1005 bp, Xenorhabdus bovienii
  Coding DNA location: Contig name=SeqID_16866; Position on contig =36029..37033bp; Strand=+
atggattcagacaaggctaatacaatgaaaataaaactgctttcagtttgtctcagtactctgctttgctatgcacttcccgcagcgagctatgcagcacctgatacagcaatgcctgacagttctgacaatgtagttgtgcccgatagcaaactgcacaataccacagcacctgcgctgactatgtcgtccttacagaaattaaagtggctgccagctaatactcatgccactcagactattatcctgaatagtgcatcatcccagattaatgaaggggatattcaaggagcggtagctgcatttgcattgccagccaaccaaggttcattagagatcactctgaatagcctgataaaggataagcaggtttattcgcccaatgtgttagtgcttgatgagcaattgcgccccgcagccttttacccaagtcattattttcaatatcaacgaccgggcatcatgtcagttgacaggcttgaagggacgttaaaattaacacccgcattggggcaacagcaaatttacctgctggtttataccacccgtgctgatttgcagtcatctacacaaatggtcgatcccgctaaagcctatgctcagggagtaggtaatgccgtacctaatattcctgatccgatggctcgccatacggaaacaggaacattaacgctaaaagtgaaatcagaacgcgatgccggtaatgtcctgattggtcaggccttctcagcacccgcgccaaaacctgtcacggtcggctccatgcaaacagcaacgacagccgttacaacactacaacctgttgttccagctattatccccaaaaacaaaccagttctaagtgataccgaaaaatattttaatgacgccattaagaaagcgattaatgacggtgatattgataaagcactacatctgctggatgaggctgaacacttgggttcatcaactgcaagggatacttttattattggggttatggtaagaaatgagatattcatttaa

SEQ ID NO: 1938 - DNA, 111 bp, Xenorhabdus bovienii
  Coding DNA location: Contig name=SeqID_16866; Position on contig =37030..37140bp; Strand=-
gtggttatccttttagaattacaatatatttgtattattatcttggatatttatttcttcggaaaaattttaaaaaaatatctggttaataaaggggttatagattgttaa

SEQ ID NO: 1939 - DNA, 1254 bp, Xenorhabdus bovienii
  Coding DNA location: Contig name=SeqID_16866; Position on contig =37205..38458bp; Strand=-
atgagccgaatcgtctatgttattgaagtcgctttattactgttttttagtttcttttccaatcctgtattagcacagcaccacaatttatcaaactatcgttacatggaggtgactaaagacagtgaaatatatgctcgggtaggtgaacatattgttcaggttggattattaaagaaaggtcattttctaaaggcggctcaggaaaaaggcgatcaggatgatcattacgaatttcattttggtaatggtcaaggctatattgagaaagaaaatctaaaagaagtcaaaaaatctgtatctttcaatgtcccgctcgctactcttgataaaaaaaacagcgaaaatttaatgatttttaaggatgttcgggtttatagcacgcctgaagttaatagttcatcgattgcgattctgagtgctaatctccgctatccaattttagacaaactgaaagatccctcagaccagacgtggtatgaagtaaatctaggggatcgcgtaggttacattagtggtcaggatgccgaactggatcatggtattcctttgctgacttatcaccatattctgaaagataaagagaataagcgttttctccatacctcaacaacgacctctttatcggcttttcgcgagcaaatggattatttgaaacaggcagattacaccacgatttcattgtatgagttggaaggctatctgaatgggactctcaacttacctgcaaaagtggttggtctgacgtttgatgatggattgaaatctatttaccgttatgcctatccaatcttgaaaaagaatggacagaaagcgactctttttattatttcatccagaattaagcggtatccgcaggaatggaattctgaagacctgcaatttatgaatctttctgcattatatgctacaaaggatgtgtttgattttcagtctcatacccactttttgcatcgtctggggaaaaacaaacaaccaatattattcagccgttcatatcacaccattctgtatgattttgaacgttctcgccgtgcactgtcacaattcaatccccatgttctctatctctcctatccctttggtggatataaccagcaagctatggatgcagcccgaaatgcaggatttcatttagcagtcacaaccaaacagggtaaggtaaaattgggagataacccatttgcactgaagcgtttatatatattacgaaccgattctattgaaaaaatggcaaaaatggttgctaattaa

SEQ ID NO: 1940 - DNA, 4272 bp, Xenorhabdus bovienii
  Coding DNA location: Contig name=SeqID_16866; Position on contig =38552..42823bp; Strand=-
atgggccactcacctaacaggtctaactccgacaggagctatttcgtgaaagacttattgaagtttctgaaagcgcaaactaagaccgaagagtttgatgcgatcaaaattgctctggcctctccagatatgatccgttcgtggtcattcggggaagtaaaaaagccggaaaccattaactaccgtacgttcaagcctgaacgtgacggtcttttctgcgcacgtattttcgggccagtaaaagattacgaatgcttgtgtggtaaatacaagcgtttgaaacaccgtggtgtgatttgtgagaagtgtggcgtcgaagtgacccagactaaagttcgtcgtgaccgtatgggtcatatcgagctggcatctccaaccgctcatatctggttcctgaaatctctgccatcccgcatcggtttgctgctggatatgccactgcgcgacattgaacgcgtactgtacttcgaatcctatgtggttgttgaaggcggcatgaccagccttgagcgtgcgcagatcctgacagaagaacagtatctggatgcattggaagagttcggtgatgaatttgatgcaaaaatgggcgcagaagcgatccaggctttgctgaaaaatctcgatctggaaaacgaatgtgagactttgcgtgaagagttgaacgaaactaactctgaaactaagcgcaagaagctgaccaagcgtattaaactgttggaagcattcattcagtctggcaacaagccagagtggatggttctgaccgttctgccagttctgccaccggatttgcgtccattggttcctctggatggcggccgtttcgcaacttcagacttgaacgatctgtatcgtcgcgttattaaccgtaacaaccgtctgaaacgcctgctggatctggctgcgccagacatcatcgtacgtaacgaaaaacgtatgttgcaggaagcggttgatgcgctgctggataacggccgtcgcggtcgtgcgatcaccggttctaacaagcgtcctctgaaatccttggcagacatgatcaagggtaaacaaggtcgtttccgtcagaacctgctgggtaaacgtgttgactactcaggccgttctgtaattaccgtagggccatacctgcgtctgcatcagtgtggtcttcctaagaagatggcattggagctgttcaagccattcatctacggcaagctggaactgcgtggtctggcgacgactatcaaagccgccaagaaaatggttgagcgtgaagaagcggtcgtatgggatatccttgatgaagtgatccgtgaacacccagttctgctgaaccgtgcaccgacccttcaccgtttgggtatccaggcatttgagccagttctgatcgaaggtaaggcaatccagttgcacccattggtgtgtgcggcctataacgccgacttcgatggtgaccagatggctgttcacgtaccgctgacgctggaagcccagttagaagcgcgtgcgctgatgatgtctaccaacaacatcctgtctccagcgagcggtgagccaatcatcgttccctctcaggacgttgtattgggtctgtactacatgactcgtgactgtgttaacgccaaaggcgaaggcatggttttgaccggtcctaaagaagctgaacgcgtttatcgcgccggtctggcttctctgcacgcccgtgtcaaagttcgtatcactgaagaagtgagagatggcgaaggcaatgtcaccaccaatacgggtctggtggataccaccgtcggtcgtgccatcctgtggatgattgtaccgcgtggcctgccttactcgctgattaaccaggcgttgggcaaaaaagctatctctaagatgctgaacacctgttaccgcattctgggcttgaaaccaaccgttatcttagctgaccagaccatgtataccggttttgcttacgctgcccgttcaggggtatccgtaggtattgatgacatggttattcctgagaagaaagaaggcatcattgcagaagcggaagcggaagtggccgaaattcaggaacagttccagtcaggtctggtaaccgcgggcgaacgctataacaaagttatcgatatctgggctgcggcaaacgaacgtgttgccaaggcgatgatggaaaacctgtctactgaaactgttattaaccgtgatggcgaagaagaacagcaagtttctttcaatagcatctttatgatggctgactccggtgctcgtggttctgccgctcagatccgtcagttggcgggtatgcgtggcctgatggcaacaccagatggttccatcatcgaaaccccaatcaccgcgaacttccgtgaaggtctgaacgtactgcagtacttcatctcaacccacggtgctcgtaaaggtttggcggataccgcattgaaaacggcgaactccggttacctgactcgtcgtctggttgacgttgcccaagacttggtcgtgactgaagatgactgtggtactcacaacggtatcttgatgactccggttatcgaaggtggtgatgttaaagagccattgcgtgagcgtgtactgggtcgtgtgacggctgaagatgtcctgaaaccaggtacagcggatattttggtttcacgtaataccctgctgaatgaaaaatggtgtgatctgttagaagaaagctccgttgacagcgtgaaagtacgctccgtagtaagctgtgagacagacttcggcgtctgtgcaaactgttacggccgtgaccttgcccgtggtcatatcatcaacaaaggtgaagcagttggtgttatcgcggcacagtcaatcggtgaaccaggtacacagttgacgatgcgtacgttccacatcggtggtgcggcatctcgtgcggcagcagaatccagcattcaggtacgtaacaaaggtcatctgaagctgttcaacgcgaaatacgtcactaactcagcaggcaaactggttattacttctcgtaatacagaactgcgtctgattgatgatttcggccgtaccaaagagagctacaaagtcccttacggctcggtactgtcgaaaggtgatggcgagacagtgaccggcggcgaaaccgttgcgaactgggatccacacatcatgccagtcgtgagtgaagtatccggtatcatccagttctatgacatggttgatggccagaccattactcgtcagacggacgaattgaccggtctgtcatcactggtggttctggacagtgcagaacgtacaggtagcggtaaagacctgcgtccggcactgaaaattgttgacgctcagggtaaggatgttctgatctcaggtactgatatgcctgctcagtacttcctgccgggtaaagcgattgttcagctggaagatggcatatctatttctgcgggtgatacgctggcgcgtattcctcaggaatctggcggtactaaagatatcaccggtggtctgccacgtgttgcggatctgttcgaagcacgtcgcccgaaagagcccgctattctggcagaaatcagcggtattgtttccttcggtaaagaaaccaaaggtaaacgtcgtctggtaatcagcccattggatggcagtgatgcttacgaagagatgatccctaaatggcgtcagctcaacgtattcgaaggtgaagttgctgaacgtggtgacgtgatctccgatggcccagaatctccacacgacattctgcgtctgcgtggcgttcacgcggttgcccgttacatcaccaacgaagtacaggaagtttaccgtctgcaaggcgttaagattaacgataaacacattgaagttatcgttcgtcagatgctgcgtaaagtgactatcgcgagtgtgggtagttctgagttcctcgaaggcgagcaggttgaatacgcgcgtgttaaagtcgcgaaccgtaagctggagcttgatggcaaattagcggctaccttccatcgtgacctattgggtattaccaaggcatcactggcaacagaatccttcatctctgcggcgtcgttccaggaaacaacgcgcgtactgactgaagccgctgttgcaggtaaacgtgatgaattgcgtggcctgaaagagaacgtcattgttggtcgtctgatccctgcgggtacaggttatgcgtaccatcaggagcgcatccgccgtcgtcacgcaaacgaagtggttgaagcgccacaagtcagtgttgacgaagcgactgcaaaccttgctgaattgttgaatgcaggtttcggtagcagcagcgataaacagtag

SEQ ID NO: 1941 - DNA, 4029 bp, Xenorhabdus bovienii
  Coding DNA location: Contig name=SeqID_16866; Position on contig =42909..46937bp; Strand=-
atggtttactcctataccgagaaaaaacgtattcgtaaggattttggtaaacgtccacaagttttggatattccatatctcctttctatccaacttgactcgttccagaagtttatcgagcaagatcctgaaggccaaaatggactggaagcggccttccgttctgtgttcccaattcagagttacagcggcaattccgagctgcaatatgtaagctaccgtcttggtgaacctgtttttgatgtgcaagagtgtcagatccgtggtgtgacttattccgcaccgctgcgcgttaaactgcgtctggtgatctatgagcgcgaagcgccagaaggcacagtcaaagacattaaagaacaagaagtctacatgggtgaaattccactcatgactgataacgggactttcgttatcaacggtactgagcgtgttatcgtatctcagttgcatcgtagcccaggcgttttctttgacagcgataagggtaaaacccattcatccggtaaggtactgtataatgcacgtatcatcccttaccgtggttcatggctggatttcgaattcgatcctaaagataacttgtttgtgcgtatcgaccgccgtcgtaaactgccggcttcgattattctgcgtgcaatgaattatagtactgaagacattctgaacctgttcttcaacaaaacggtcttcgaaattcgcgataacaaattgcagatgactctggttccggaacgtctgcgtggtgaaacggcttcatttgatattgaagcaaacggcaagctttatgttgaaaaaagccgtcgtatcaccgcacgtcatattcgccagttagaaaaagatcagatagaccgtattgaggttcctgtcgaatatatcgcgggtaaagtcgtcgcaaaagattacatcgaccagaacactggtgaaatcatctgtgcagctaacatggagctctctctggatctgctggcgcgtctgagccagtctggtcacaaaaccatcgagactctgtttaccaacgatctggatcacggtgcatacatctccgaaactctgcgtgttgacccaaccaatgatcgcctgagcgcgctggttgaaatttaccgcatgatgcgtccgggtgagccaccaacacgtgaagccgcagaaaatctgtttgagaacctgttcttctctgaagaccgctatgatctgtctgcggttggccgcatgaagttcaaccgttctctggatcgcacagaaattgaaggttccggtatcctgagcaaagaagacatcactgatgtgatgaagaagctcatcgatattcgtaacggtaaaggtgaagtggatgatatcgaccacttgggtaaccgtcgtatccgttctgtcggcgaaatggcggaaaaccagttccgcgttggcttagttcgtgtagaacgtgctgtgaaagagcgtctgtcactgggcgatctggataccctgatgccacaggacatgatcaacgccaaaccaatttctgctgcggtgaaagagttctttggttccagccagttgtcccagtttatggatcagaacaacccgctgtccgaaatcactcacaaacgtcgtatctctgcattgggcccaggcggtctgacccgtgagcgtgcaggcttcgaagtacgtgacgtacacccaacccattacggtcgtgtatgtcctatcgaaacgcctgaaggtccaaacatcggtctgattaactcattgtccgtttatgctcgtaccaatgagtatggtttccttgaaaccccttaccgtttggtacgtgacggcgtagtaaccgatgaaattcattatctgtctgctatcgaagaaggtaactacgtcattgcacaggctaacaccgtgctggatgaagaaggccacttcgtagaagatctggtgacttgccgtcattatgatgaatccagcttgttcaaccgtgatcaggttcagtatatggacgtttcgacacagcagatcgtgtccgtcggtgcttccttgatcccattccttgaacacgatgacgccaaccgtgcattgatgggtgcgaacatgcaacgtcaggcagttccgactctgcgtgctgacaagccgctggttggtacaggcatggagcgtgcagttgccgttgactctggtgtaacttcagtcgccaagcgtggtggtgtgattcagtacgtagatgcatcccgtatcgttattaaagttaacgaagacgaaatgtacgcgggtgaagctggcatcgatatctataacctgaccaaatacacgcgttccaaccagaacacctgtatcaaccagatgccatgtgtttctctgggtgaattggtagaacgtggtgatgtactggctgacggcccatccactgatttgggtgaactggcgctgggtcagaacatgcgcgtggcgttcatgccatggaatggttataacttcgaggactccattctcgtatctgagcgtgttgttcaggaagaccgtttcactaccattcacattcaggaactggcttgtgtgtctcgtgacaccaaactggggcctgaagagatcactgctgacatccctaacgtgggcgaagctgcactgtctaaactggacgaatccggcatcgtttacattggcgcggaagtgaaaggtggcgatattctggttggtaaagtgacaccgaaaggtgaaacccaattaacgccagaagaaaaactgttgcgtgcgatcttcggtgagaaagcatctgacgttaaagactcttcactgcgtgtgccaaacggtgttgccggtactattatcgacgtgcaggtctttacccgtgatggcgtagaaaaagacaagcgtgcgttggaaatcgaagaaatgcagttgcgtcaggcgaaaaaagacctgacagaagaactgcgtatcttcgaagctggcttgtttgcccgtattcactccgtactggttgccggtggaattgaagcggaaaaattaagcaaactgccgcgcgagcgctggttagagctgggtctggctgatgaagaaaaacagaatcagttggaacagctggcagaacagtatgacgaactgaaaactgagttcgagaaaaaactggatgctaaacgccgtaagatcactcagggcgatgatctggcaccgggtgtgctgaaaatcgttaaagtgtatctggctgttaaacgccagatccagcctggtgacaagatggcaggtcgccatggtaacaagggtgttatttctaagatcaacccgatcgaagatatgccttacgatgaaaacggaacacctgtagacatcgtattgaaccctctgggtgtaccatcacgtatgaacatcggtcagattctggaaactcacttgggtatggcggctaaaggcattggtgacaagatcaatgcaatgctgaaacagcagcaggaagttgccaaactgcgtgaattcatccagaaagcctatgatcttggtgacgatacccgtcagacagttgacctgaatactttcactgatgaagaagttctgcgtctggctgaaaacctgaaaaaaggtatgccaattgcaacaccagtcttcgacggtgcgaaagagactgaaatcaaagagctgttgaaactggctggcctgccgacgtccggtcagatcacactgtttgacggccgcactggtgagcagttcgagcgtcaggtaaccgtgggttacatgtacatgctgaaactgaaccacttggttgatgacaaaatgcatgcccgttctaccggttcttacagcttggttactcagcagccgctgggtggtaaagcacagttcggtggtcagcgcttcggtgagatggaagtgtgggcattggaagcatacggtgccgcgtacaccctgcaagaaatgctcaccgtcaagtccgacgatgttaacggtcgtaccaagatgtataaaaacatcgttgatggtaaccaccagatggaaccaggcatgccggaatctttcaacgtattgctgaaagagatccgttcgttgggtatcaacatcgagctggaagacgaataa

SEQ ID NO: 1942 - DNA, 147 bp, Xenorhabdus bovienii
  Coding DNA location: Contig name=SeqID_16866; Position on contig =46900..47046bp; Strand=-
atgagtattacggaaaatattctattttctgttcgaataaatagtgttgcagagtgctgtcctaaagggcgggcagagtgggtcactgatcagcgagctgaggaaccctatggtttactcctataccgagaaaaaacgtattcgtaa

SEQ ID NO: 1943 - DNA, 366 bp, Xenorhabdus bovienii
  Coding DNA location: Contig name=SeqID_16866; Position on contig =47275..47640bp; Strand=-
atgtctatcactaaagaacaaattctggacgcagttgcagaaatgtctgtaatggacgttgttgaactgatcactatgatggaagaaaaattcggcgtttctgctgctgcagctgtagctgttgttggcggtgctgctgaagccgttgaagaaaaaactgaattcgacgtaattctgtctagcattggtgctaacaaagttgctgtaatcaaagcagtacgtggcgcaactggcctgggtctgaaagaagctaaagacctggttgaaagcgcaccagctgctctgaaagaaggcatcagcaaagacgacgctgaagctctgaaaaaatctctggaagaagctggtgcttctgttgagatcaagtaa

SEQ ID NO: 1944 - DNA, 498 bp, Xenorhabdus bovienii
  Coding DNA location: Contig name=SeqID_16866; Position on contig =47704..48201bp; Strand=-
atggcactaaatcttcaagacaaacaagcgattgttgctgaagtcagcgaagtagccaaaggcgcgctgtctgcggttgttgcggattctcgcggcgttaccgtaggtaaaatgactgaactgcgtaaagcaggtcgcgaagctggcgtttacatgcgtgttgttcgtaacaccttgatgcgtcgtgctgttgaaggtacggattatgagtgcctgaaagaagcgtttgttggtccaaccttgattgctttctctagcgaacatccgggcgcagctgctcgtctgttcaaagaattcgcgaaagcgaacccagcattcgagattaaagcagcagcctttgaaggtgagtttatttcaggtgaaaatatcgatcgcctggcaacactcccaacttacgaagaagcaatcgcacgcctgatggcaaccatgaaagaagcctctgcaggcaaactggttcgcactctggctgcgctacgcgatcagaaagaagctgcttaa

SEQ ID NO: 1945 - DNA, 153 bp, Xenorhabdus bovienii
  Coding DNA location: Contig name=SeqID_16866; Position on contig =48161..48313bp; Strand=-
atgaaatttattttctggattctgctcaccgtgtttcagcgctcaggcacgcttggtgctttgagtgaagtgagtcccgggttttcccggttaatccaggagcaagaagctaatggcactaaatcttcaagacaaacaagcgattgttgctga

SEQ ID NO: 1946 - DNA, 702 bp, Xenorhabdus bovienii
  Coding DNA location: Contig name=SeqID_16866; Position on contig =48540..49241bp; Strand=-
atggctaaactgaccaagcgcatgcgcactatccgtggtaaagttgatgcaactaaacaatatgacatcaacgaagctgttgctctgctgaaagaattggcaactgccaaattcgtagaaagcgttgacgtagctgttaatcttggcatcgatgctcgtaaatctgaccaaaacgttcgtggcgcaactgttctgccacacggtactggtcgttcagtacgtgttgctgtatttgctcagggcgcaaacgctgaagcggctaaagctgctggcgctgaactggtaggtatggacgatctggctgatcagattaagaaaggcgagatgaatttcgacgtcgttatcgcatctccagatgcaatgcgcgttgttggccaactgggtcaaattctgggtcctcgcggcctgatgccaaacccgaaagtgggtactgtaactcctaacgttgctgaagctgtacagaacgctaaagcaggtcaggttcgttaccgtaacgacaaaaacggcatcattcacaccaccatcggtaaagttgactttgacgctgacaaactgaaagaaaacctggaagccttggtagttgcgctgaaaaaagcaaaaccatcttcagctaaaggtattttcatcaagaaagttagcctgtctaccaccatgggtgcaggtgttgcaatcgaccaatctggtctgaacgcaacagcctaa

SEQ ID NO: 1947 - DNA, 429 bp, Xenorhabdus bovienii
  Coding DNA location: Contig name=SeqID_16866; Position on contig =49245..49673bp; Strand=-
atggctaagaaagtacaagcctacgttaagctgcaagttgcagcgggtatggctaacccaagcccaccagttggtccagctctgggtcagcagggtgttaacatcatggaattctgtaaagcgttcaatgcgaaaactgaaagcattgaaaaaggcctgccaattccagttgttattactgtttacgcagaccgttctttcactttcgttaccaaaaccccaccagctgccgttctgctgaaaaaagcagcgggcgttaaatcgggttctggcaaaccaaacaaagaaaaagttggtaaagtaaccagcgcacagatccgcgaaatcgcggaaactaaagctgcggacatgactggtgctgacgttgacgcgatgatgcgttcaatcgaaggtactgctcgttccatgggcctggtagtggagggttaa

SEQ ID NO: 1948 - DNA, 546 bp, Xenorhabdus bovienii
  Coding DNA location: Contig name=SeqID_16866; Position on contig =49843..50388bp; Strand=-
atgtctgaatccccaaaaaagcgttggtatgtcatacaggcattttctgggttcgaaggtcgtgttgctcaatctctgcgtgaacatatcaaattagatggtatggaagattctttcggcgaagtcatggtgccgacagaagaagttgttgagatccgcagtggccaacgccgtaagagcgagcgcaaattcttcccaggttatgtcttggtacaaatggtaatgaacgatgcaacttggcatctggttcgcagtgtaccgcgcgtaatgggttttatcggtggtacatctgaccgtccggctccaatcagtgataaagaagtcgatgctattatggatcgtcttcagcaggttggtgataaaccacggccaaaaaccttgttcgagccaggcgaaatggttcgtgtcagcgatggtccgtttgcagatttcaatggtgtagtggaagaagtcgattacgagaagagccgcttgaaagtttcggtttctatctttggccgtgctacgccagtcgagttggatttcagtcaggtagagaaagcctaa

SEQ ID NO: 1949 - DNA, 384 bp, Xenorhabdus bovienii
  Coding DNA location: Contig name=SeqID_16866; Position on contig =50392..50775bp; Strand=-
atgagtgcgaatagcaatgctcaagaaagcaggcgtggtcttgatatagcaaaatggttactggtggcagtgctgctagtagttgctattgtgggtaattattattaccgggagtataacctggctctgcgcgcgatagccgtcgttgctattgttgctcttgcaggagcagttgcattctggactgcgaaaggtaaagccacattagcatttgcccgtgaagcccgcgttgaaatgcgtaaagtcatttggccaactcgccaagaagctctgcacacaacattgattgttgcagcggtgacagctgtcatgtccctgattttgtgggggctggatggtatactggtgcgtttagtttcatttattacaggcctgaggttttaa

SEQ ID NO: 1950 - DNA, 138 bp, Xenorhabdus bovienii
  Coding DNA location: Contig name=SeqID_16866; Position on contig =50790..50927bp; Strand=-
atgggctttgttatcatgcagatacgaaaagtcctactgaattatggtgccaagtcagatacaattacaattatctttgggttcggtctgatttgttttgctcttgcgaggcaagctggctatctatttacatcatag

SEQ ID NO: 1951 - DNA, 1185 bp, Xenorhabdus bovienii
  Coding DNA location: Contig name=SeqID_16866; Position on contig =51084..52268bp; Strand=-
gtgtctaaagaaaagttcgaacgtaaaaaaccgcacgttaacgttggtactatcggtcacgttgaccacggtaaaactaccctgactgctgcaatcaccactgttctggcgaaaacttacggcggtagcgctcgtgcattcgatcagatcgataacgcaccagaagaaaaagcgcgtggtatcaccatttctacttctcacgtagaatacgataccccaactcgccactatgcgcacgttgactgcccaggccacgccgactatgttaaaaacatgatcacgggtgctgctcagatggatggcgcagttctggttgttgctgcaactgatggcccaatgccacagactcgtgagcacatcctgctgggccgtcaggtaggcgttccatacatcatcgtgttcctgaacaaatgtgacatggttgatgatgaagagctgttggaactggttgaaatggaagtccgtgagctgctgtctcagtacgatttcccaggcgatgatacgccaatcatccgtggttctgcgctgaaagcgctggaaggcgaagcagagtgggaagcgaaaatcattgaactggcagaagcactggattcctacattccagaaccagagcgtgacattgacaagccattcctgctgccaatcgaagacgtattctccatctctggccgtggtactgtagtgactggtcgtgttgagcgtggtatcgttaaagtgggtgacgaagttgcaatcgttggtatcacagatacggtgaaaacaacttgtactggcgttgaaatgttccgcaaactgctggacgaaggccgtgctggtgagaacgtaggtgttctgctgcgtggtactaagcgtgacgaaatccaacgtggtcaggtactggctaaaccaggttcaatccagccgcacactcaattcgaatcagaagtttatattctgagcaaagatgaaggtggccgtcatactccattcttcaaaggttaccgtcctcagttctatttccgtacaactgacgtaaccggtactatcgaactgccagaaggcgttgagatggtaatgccaggtgacaacatcaacatgatcgttaccctgattgctccaatcgcaatggacgaaggtctgcgtttcgccatccgtgaaggtggccgtactgtaggtgctggtgttgttgctaaagtgattgcataa

SEQ ID NO: 1952 - DNA, 2109 bp, Xenorhabdus bovienii
  Coding DNA location: Contig name=SeqID_16866; Position on contig =52338..54446bp; Strand=-
atggctcgtaaaacacctatagcacgttaccgtaatatcggtatcagtgctcacatcgacgccggtaaaaccacgacaactgaacgtatcctgttttacacaggcgtgaaccataaaattggtgaaactcacgaaggttcagcgacaatggactggatggagcaggagcaggagcgtggtatcacaatcacgtctgctgcgacaactgcattctggtctggtatggctaaacagtatgagccacaccgcgtcaacatcatcgacaccccaggccacgttgacttcaccatcgaagtagaacgttccatgcgtgttcttgacggcgcagtaatggtttactgtgcagttggtggtgttcagccgcagtctgagactgtatggcgtcaggctaacaaatacaatgttccacgtatcgcgttcgttaacaaaatggaccgtatgggagcaaacttcctgcgcgtagtagaacagatcaaaagccgtctggctgcgaaccctgttccacttcaactggcaatcggcgctgaagataccttcactggtgttgttgacctgttgaaaatgaaagcgatcaactggagtgaagcagatcagggtgtgactttcgagtacgaagagatccctgctgacatggttgagctggctcaggaatggcaccagaatttgatcgaatccgctgcagaagcatcagaagaactgatggacaaatatctgggcggtgaagagctgactgaagaagaaatcaagacagctttgcgtaagcgcgttctggctagcgaaattatcctagttacctgtggttctgcatttaagaacaaaggtgttcaggcgatgctggatgcagttatcgattacctgccagcaccaactgacgttgaatctatcaaaggaatgctgccagacggtaaagatactccagcagagcgtcactccagcgatgaagaaccgttctctgcactggcgttcaaaatcgcgactgacccattcgtgggtaacctgactttcttccgggtttactctggtgttgttaactctggtgatacagttcttaacccagtgaaagaccggaaagaacgttttggccgtatcgttcagatgcacgccaacaaacgtgaagaaattaaagaagtccgcgcaggcgatatcgctgctgcgatcggtctgaaagatgtcactacaggtgatactctctgtgacctgaacttgccaatcattttggagcgtatggaattcccagagccagttatctctgttgccatcgaaccaaaaactaaagctgaccaagaaaaaatgggtatcgctttaggacgtctggctcaggaagacccatcattccgcgtatccagtaacgaagaaactggtcagactattatcgcgggtatgggtgaattgcacctcgacgttctggttgaccgtatgcgtcgcgaatttaacgttgaagcgaacgtaggtaaacctcaggttgcttaccgtgaaactattcgcaataccgttgagcaggaaggtaaacacgctaaacagtcaggtggtcgtggtcagtatggtcacgtttggctacgtgttgagcctctggaaccaggtggcgacggttacgtgttcgagaacgcaatcgtcggtggtgttgttcctaaagaatatattccaggcgtagataaaggcgttcgtgaacagctgaaaggcggtgttctagctggttatccaattgttgacgttaaagttaccctgtttgatggttcttaccatgacgttgactcctcggaaattgcctttaaaattgctgcatccatggcatttaaagaaggcttcatgaaagcgaaaccagttctgctggaaccaatcatgaaagttgaagtggaaacaccagaagactacatgggcgacgtcatcggtgacttgaaccgtcgccgtggtatgatcgaaggtatggatgatctagcaacgggcaaaattgttcgtgctcaagtaccattatctgaaatgtttggttatgctactgacctgcgttctcagacccaaggtcgtgcttcttactccatggagtttttgaagtacaacgaagcgcctagcaacgtcgctcaggctattatcgaaactcgtaaagctagataa

SEQ ID NO: 1953 - DNA, 150 bp, Xenorhabdus bovienii
  Coding DNA location: Contig name=SeqID_16866; Position on contig =54436..54585bp; Strand=-
gtgaagacgttcaccgtatggcagaagctaacaaggcgttcgcacactaccgttggtaattccttcgtagtgaatatgttctgggtagcttctcggggctactcgttctcaaaattgaacgcccacgagagaggaaaacatggctcgtaa

SEQ ID NO: 1954 - DNA, 471 bp, Xenorhabdus bovienii
  Coding DNA location: Contig name=SeqID_16866; Position on contig =54527..54997bp; Strand=-
atgccacgtcgtcgtgtaattggtcaacgtaaaattttaccagatccaaaattcggatctgaattgctggccaaattcgtgaatatcctgatggtagacggtaaaaaatctaccgcagaagcaattgtatacagtgcgctcgagaccctggctcagcgttctagtaaaggtcatctggaagcattcgagctggcgctggataacgtgcgcccgactgtcgaagttaagtcccgccgtgttggtggttctacctatcaggttccagttgaagttcgtccggttcgtcgtaatgctctggcaatgcgttggatcgttgatgctgctcgtaaacgcggtgataagtcgatggctctgcgcctggcgaatgaattatctgatgcggctgaaaacaaaggcactgctgttaagaaacgtgaagacgttcaccgtatggcagaagctaacaaggcgttcgcacactaccgttggtaa

SEQ ID NO: 1955 - DNA, 549 bp, Xenorhabdus bovienii
  Coding DNA location: Contig name=SeqID_16866; Position on contig =55096..55644bp; Strand=-
ttgtcagtaaataccttgtcattgcaggtattttaccagcatagaaaagctgtatatttcttgacacctcgtcaagtcagcaataaaattccgcgtcctcatgttttgtcattatggctgacagaggataaaatccgtgtttacgaagcaaaaaaaccaggagtttttttaataatggcaactattaaccagctggttcgcaaatctcgtagctcgaaagttgtgaaaagcaacgttcctgctctggaagcttgcccgcaaaagcgtggcgtatgtactcgtgtatatactaccacccctaaaaaaccaaactcagcattgcgtaaagtatgccgtgttcgtttgactaacggtttcgaagtttcttcctacatcggtggtgaaggccacaacttgcaggaacactccgttatcctgatccgtggcggtcgtgtaaaagacttgccaggtgtgcgttaccacactgttcgcggtgcactggactgttctggtgttaaagaccgtaagcaaggtcgttctaagtacggtgtgaagaagccaaaggcttaa

SEQ ID NO: 1956 - DNA, 288 bp, Xenorhabdus bovienii
  Coding DNA location: Contig name=SeqID_16866; Position on contig =55659..55946bp; Strand=-
atgttatatactgtgagtcgctcaccttaccatgatgacttcaatgcgatgctgggccttgtctctgatgcagatgatgttctgttaatgcaaaatggcgtgctgctggggatcaatgacaatcgctatttggctgaattgatccgtacgggagcccgtgtttatgccttgcaggaagatttgattgcacgggggctggttgagcagatttcagaccgtgtacaggtgatagactacaaaggctttgttagcttaacagcgaaacatccgcaaaattttggctggtag

SEQ ID NO: 1957 - DNA, 360 bp, Xenorhabdus bovienii
  Coding DNA location: Contig name=SeqID_16866; Position on contig =55966..56325bp; Strand=-
atgaaaaaaatcgccttcgtttttactgaagctccccacggatcttctgctggcagggaaggtctggatgcgctgcttgcaacatcggcattgactgagcaaattggcgtattctttatttctgatggggtattccaactgttggccaatcagcagccagagacaattctggcgcgtgattacatctcaacatttaagctactgcccctgtatgacattgataaatgctacatttgcctcgatgatctgaacgctcggggaggcagcccagcaagcgaccttgtgctggaggcggaatttctcccggcggcggcaatacgtgaagtactatcaggatatgatgttgtgttgaaattttaa

SEQ ID NO: 1958 - DNA, 396 bp, Xenorhabdus bovienii
  Coding DNA location: Contig name=SeqID_16866; Position on contig =56352..56747bp; Strand=-
atgtcatcgctgtcttattgcctgctggtgactgggccggcttatggcactcagcaagccagcagtgcctatcaatttgctcaggcgctggttgcttcaggccataaactgcacagcgtgtttttttatcgcgaaggtgtccaaaatggcagtcggctggtggctcccgccagtgatgagttcgatctggtcagggcgtggcaggcaatagccgcccagcaccaattcaacttgtttatttgtgttgcagcggcactgcgtcgcggtgtcacagatgaacagcaggccaacgaactcaatctgtccgccgtgaatctggcggatgggtttgagctcagtggattgggttcgttggctgaagccatgatgctgtgtgatcgcgtggtacaattctag

SEQ ID NO: 1959 - DNA, 735 bp, Xenorhabdus bovienii
  Coding DNA location: Contig name=SeqID_16866; Position on contig =56747..57481bp; Strand=-
atggtgtattgcatgtctaccccactattatccggtgataacagtgatattgatttactggaaaaccaaccgttcagtgaaacggatcatgaaattttaaaatcttacgaagctgctgttgatggcttggctatgctgattggtgggcattgtgaaattgttcttcattcactggaggaccttaaatgttcagctgtcagaatagctaatggtgagcataccggccgtaaaattggctctcccattacggatttggcattacggatgctgcacgacattacagatgaagactgtagtgtttccagagcgtatttcacgcgggcaaaaagcggtgcattgatgaaatccgtcacgattgctattcgtaatcgctctcgtcgggtcattgggcttttgtgtattaatatgaacctggatgtgcctttctctgagattattcaaacctttattcctgaaaaaacgcatgaggtgtcttcaaacgttaattttgcctcttcagtagatgatcttgtggcacagacactggaatttactatcgaagaagtgaatgctgatcgcaatgtttccaataatgcgaaaaacagacaggttgtcctgaatctctatgagaaagggatttttgatattaaagatgcgattaatcaggttgctgatcgtctgaatatctccaaacataccgtatatctttatattcgccagtttaaaaatggtgaatacgcgagttcggagaaataa

SEQ ID NO: 1960 - DNA, 129 bp, Xenorhabdus bovienii
  Coding DNA location: Contig name=SeqID_16866; Position on contig =57468..57596bp; Strand=+
atgcaatacaccatccttcaagctcagactttgcctcaccgaaaatatcagggcgagatttattataaaatcacattaatgcaacttaacagaaaacatttcaaatgttctgtgttctattcagaataa

SEQ ID NO: 1961 - DNA, 759 bp, Xenorhabdus bovienii
  Coding DNA location: Contig name=SeqID_16866; Position on contig =57850..58608bp; Strand=-
atgaaatcattgttaaaaacgactttattggcagcgtcactggcaatggcatttagtgtaccgcaggcattgtctgctaatacagaaaacgaagtaaaactgaatagtgcgtttaaaacagaaaatcagcaaaacgcttatgcattgggttcttctctgggtcgctacatgggcgcttcattaaaagagcaggaatcgctcggtatcaagttagaccaatctcagttattggcgggtgttgaagatgcattaaaggataaaagcaaactgaatgatcaagaaattcagcagatccttggcgcttttgaagttaaagtgaaaaatgcagcacaagctaaggcagagaaagaagctgatgaaaatgctgaaaaaggggctaaatacagtgagcagtttgccaaggaatcgggtgttgtaaaaactaaaaccgggcttctctacaaaatagagaaggaagggagtggtaaaacaccaacagaaaaagatacggtggttgtaaactacaaaggtagtttgatcgatggcaaggtgttcgacagctcctatgagcgcaaagaacccctgacaattggtttggatcgtattattcccggctggaaagaaggtttacagcatgtgaaaaaaggcgggaaaatcactctggtcattccaccggatttggcttatggcaaagcaagtcttcctagtattcctgctaattctactttagtctttgatattgaattgctggatatcaagccggctgccaaggcaaaataa

SEQ ID NO: 1962 - DNA, 174 bp, Xenorhabdus bovienii
  Coding DNA location: Contig name=SeqID_16866; Position on contig =58557..58730bp; Strand=+
atgccattgccagtgacgctgccaataaagtcgtttttaacaatgatttcatcctattctccaatcagtttttttgggattcaccgtccgcaaaagctacgtgaacgaactcactataactgtctgcggaaaccgaacacaatactcgtcatacattggcttcagaaccattaa

SEQ ID NO: 1963 - DNA, 219 bp, Xenorhabdus bovienii
  Coding DNA location: Contig name=SeqID_16866; Position on contig =58849..59067bp; Strand=+
gtggaattatccgaatttgaacaaagatttgaacagctagaaaccaaactggcctaccaggaagtcactattgaagaactgaataaagaagtgagaaaacaacagatagaaactgaaaagctcaaagagcaactacaattaatgtccgaacgcctgaaaacccaccagtcgtcgatcatcgcaccgctctcggaagaaacaccgccccctcattactga

SEQ ID NO: 1964 - DNA, 531 bp, Xenorhabdus bovienii
  Coding DNA location: Contig name=SeqID_16866; Position on contig =59168..59698bp; Strand=-
atgaaagtagcacaagacttggtggtcagcctggcttatcaagtaagaacagaagaaggtgttttggttgatgagtctccggtgagcgcaccgttagactatctgcatggccgtggttctctgatcagcggtttagagaaagcggtggaagggcgtgaggcgggtgaacgttttgatgttagcgtcgaagcaaatgatgcatacggtcagtatgatgaaaatttagttcaacgcgtaccaaaagatgtttttgttggcgtggatgaattgcaggtgggtatgcgtttcttggctgatacagacatggggcctgtgccagttgaaattaccgctctggaaggtgatgaagttgtcgttgacggcaaccacatgctggctggccagaatctgaaattcaacgttgaaatcgttgctatccgtgaagcgaccgaagaagaattggctcacggccatgtgcatggtcagggtggttgtggcgatcacgaccacgatcatgaagagcatgcatgctgtggcggcggctgccattaa

SEQ ID NO: 1965 - DNA, 204 bp, Xenorhabdus bovienii
  Coding DNA location: Contig name=SeqID_16866; Position on contig =59844..60047bp; Strand=-
atgtcagtcagtcgtaaacgttttattgcaggagcggtttgtcccaagtgtcagtcgcaggatacgctagcgatgtggcaggaaaataaagtcgatattgtggagtgtgtccattgtgggcatgtgcagcggcaaaccgatgaaaccgtggcgcctcatgttagagagcaggaacaggttatcggtatctttaaaccacaataa

SEQ ID NO: 1966 - DNA, 1848 bp, Xenorhabdus bovienii
  Coding DNA location: Contig name=SeqID_16866; Position on contig =60062..61909bp; Strand=-
atggctgaaatcgcctttgtctttgggagggatgtaattatggagaattcagcgctgttaagcgccggaacactgtttttgtttgctgctgttgtggctgttccccttgcccagaaattcaagattggggcggtattaggttatctgattgccgggattgtacttggcccgtgggggctggggtttattaaggatgtcgaggaaattctgcatttctctgaactgggggttgttttcctgatgttcatcattggccttgagctgaatccagctaaactctggcagctcaggcgatctatctttggtgcgggtacggctcaggttgtattgactgcgctggtgttgattttattcctgtgtctgacaaatttttcatggcaggccgctgttatcggtggaattggccttgctatgtcatcgacggccatggcgctacagttgatgaaagagaaaggaatgaccagcagtgaaagcgggcaactcggtttttctatcctgctgtttcaggatatggctttgatccccgctctggctctgattcctctgttggcgggcagtacggcatccagtgactggtatcgggtcgggctgaaatttgttgcttttgcgggcatgttgctgggagggcgatatctgctgcgcccactgttccggttggtggtgaaatcggatgtcagggaggtgttcacggcggcggcgctgttggtggtgctgggagcggcgattttcatggaggaactgggtttttcaatggcgctcgggacttttattgccggggttttgctggctgacagtgaatatcgccatgagttggaaatttctattgagccatttaaagggctgctgctggggctattttttatttccgtcggcatgtctttgaatatgggcgtactgttgactcatttgtcaggggtattgttcagtgttttgggactggttctgataaaaattttcattctgtatgtgatcggcaggcttgccggcttgaaaaactcatcgtgtttgcagttttccggcgtgctgagtcagggcggggaatttgcatttgttttattctcaacggcgctggggcagagcgtgctggatcagaatcaaatgtcactgttgttggttgtcgttacattgtcgatgatgacgacgcctctagtgatgcagttgatccaacgtattctggctgggtattataatgcccaggaagaaaaaaacagtgaacagccatttgtggaggataatgaaccacaggtgattctggtaggatttggccgttttgggcaggtagtggggcgccttctgatggcgaataaaatccgtatcacggtattggaacgtgatgccagtgccatcagtacgctgcgtcgttatggctataaggtgtattatggcgatgcgagagagcgggagttgctgcgtgctgcgggggcggcaaaagccgaggctatcgtgattgccagtgatgagccggaagagaccatggcgatagtgcatctgtgccagaagaattttcctcacctgcatattattgcgcgggcgagagggcgtctggaagcgcatgagctgttgcagaatgatgttaaagatttcagccgtgaaacgttttccagtgctctggaacttggtcgtaaggcattgattaagactggaatgcatccacatcaggcttatcgcgcccagcagcatttccgccgtctggatatgcgtatgttacgtgagctgatgcctcagttacatggcgacgtggcgcagatatcccgtgtgaaagaggctcgcagggaattggaagaactgtttgaacgggaaatgcttaatgagcgtcgccggccggaaggctgggacgaatataaatag

SEQ ID NO: 1967 - DNA, 549 bp, Xenorhabdus bovienii
  Coding DNA location: Contig name=SeqID_16866; Position on contig =61873..62421bp; Strand=-
atgctattgccgcctaaaatattgctgttatatatccatccagaaccacagatctctgtggctaatcatgttttgctacagcccgtgcaggcgttggagcatgtcactcttcacgatctatacggctgctatcccgatttttttattgatgtgcctttagagcagaaattgctgcgtgagcatcaaatcattgtttttcagcatccattgtatacttatagttgccctgctttactgaaagagtggatggatcgcgtgttgagccgtgactttgtcggcgggtcagaactggcgctgagaggaaagtattggcgttccgtcatcaccacaggagaacccgaaggcgcttaccggagaggtggatataacctctatccgatggaagaaattctccgtcctttcgaattaacggcatcgatgtgtcatatgcattggttatcacccatgatcatttattgggccaggcgccaacgacctgaagtgctcgtcagccacgcgaatgcttatcgggaatggctgaaatcgcctttgtctttgggagggatgtaa

SEQ ID NO: 1968 - DNA, 1953 bp, Xenorhabdus bovienii
  Coding DNA location: Contig name=SeqID_16866; Position on contig =62541..64493bp; Strand=+
atgattgttttctcatctctgcaaatccgtcgcggcattcgcgtcctactggacaatgccagcgcaaccatcaatcccggccaaaaagtgggattggtgggtaaaaatggctgtggtaaatcgaccctgctttcattactgaaaggtgaactccaggctgaaaatggctccgtaacatttcccaacaactgggcgctggcgtgggtgaatcaagaaacgccggctttggaaatttcagcactggaatatgtgatagacggtgaccgtgaattccggcaactggaacagaagctgaaaatcgccaatgaacagaatgacggtcacgccattgcccatcttcacggccagcttgataccattcaggcatggacaatccgtgcacgagcatccagcctgctgcacggcctggggttttcccaaccccagttggaacaatccgtcagttcattttccggtggctggcgtatgcggctcaatctggctcaagcgctgatttgtcgttccgacctgctgctgctcgatgaaccgaccaaccacctagatttagacgcggtcatctggctcgaaaagtggctgaaaaactataccggcaccttgatcctgatatctcacgatagggactttcttgatccgatcattgataaagtcctgcacattgaacagctgattttggctgaatacaccggcaactactcctcctttgagcggcaacgcgcggctaaacttgcccagcaacaggctctgtatcaaagccagcaggaaaaagtgactcacctgcaaagctatattgaccgttttcgtgccaaagcttccaaagcgaagcaggcacaaagccgcattaagatgctggagcgcatggaactcatcgcccctgctcatgttgataacccatttcgtttcagcttccgccagccggacagcctgccaagcccgcttttggtgatggaaaaagtcagtgccggatatggtgaaaaaaccgtgctggattcgatcaaattaaatctcgtaccgggatcacatatcggcctgttggggcgcaacggagcgggtaaatctacattgatcaaacttctggcgggtggacttgcaccacagcggggcgagatcgctttagccaaaggcatcaaactggggtatttcgcccagcatcagctggaatacctgcgcgcagatgaatccccgctgcaacatttagtcagaatcgcaccacaggaaacggaacagcaactccgtgactatctgggcggctttggtttcaaaggtaatcaagtgaccgatccgagtgggcgtttttccggtggagaaaaagcccgactggtattagcgctgattgtctggcaacgaccgaaccttctgctgcttgatgaaccgaccaaccaccttgatctggatatgaggcaggcgctgactgaagcgttaattgatttcgacggtgcactggttgtggtatcgcacgacagacatttattacgctccacaaccgatgaactttatctggtacatgatggcaaagtagaaccgttcaccggcgatttggaagactatcagcaatggctgactgaacagcaacgccaacaaacgcgtgaaaatcaggaaaaggaaaaagcggcctcaagtcccgatgcttcaatgaatggcgctcaaaattacagtgcccaggagcgtaaagatcaaaaacggcgtgaggccgaatttcgcaaccagacgcagccattacgcaagcaacttactgcccttgaaaaacagatggaaaaactgggcacagcattggccgggtgggaagaaaagctgtcagataacacaatctacgaaaatgatcgcaaaactgaattgaccgaatgcctgcaacaacagactcaaaccaaatccaagttagaagatgcggaaatggagtggctggatattcaggaacaacttgaacagatgagcaaagcatttaacgcggatcagtaa

SEQ ID NO: 1969 - DNA, 891 bp, Xenorhabdus bovienii
  Coding DNA location: Contig name=SeqID_16866; Position on contig =64819..65709bp; Strand=-
atggatatacgcaatcttgaggcttttatcgttttggctgagactcttaattatcataaagcttcagaaaggctttatctttctcagcctgccttgacgaagaaaatacacgggttggaaggtattcttggtgcttcattattcctaagggggccaaatggaacgagattgacagacttcgggcataagacgctggaaaatgcccgaaaatttttatctcactatgaacagtttaaaagtcgggttcattttgattcaaaggaagatattatcaggcatttatatgttgggtcttgttttcctatccataactattctcagatagaaaagcagatcgcggataagaaagggaatgtcgtattggcgctgatgaccgggctgtcggttgagcagcagatcagtttgttgaatgcgggaatgctacatgttgcggtgatgcctctggctgcgataactcagttggagccgaaaaagatttttactgaaaaactggtctatctttttaaaagaaggagccatctgatacctaaatttagggcggagaaaagtcgacttggaaatgggaatgttccggttcattcatcagaaaaaaaagatattgttgagttaaccgattgccttaacgtattccctatttatacgggtgacagtaagcatttgttattaaagactaatgacattatgctcatcatggagatgattacaaaaaatagtgcgtatacgtgtgttcctcaacgtattatcagctcgatccctgagtattatatgaatttgctggaaattgttgaaacggataaaaaaatagaactcggcgtaatatggggtaaatcaatcgatgatcatctgattgatgatgttgaaaatttttctgcattggttgctaatttgtaa

SEQ ID NO: 1970 - DNA, 123 bp, Xenorhabdus bovienii
  Coding DNA location: Contig name=SeqID_16866; Position on contig =65653..65775bp; Strand=+
atgataattaagagtctcagccaaaacgataaaagcctcaagattgcgtatatccatgttctctcgctcaatgattgtttaataactacaaaacattacagactcatggtgatagcattttaa

SEQ ID NO: 1971 - DNA, 153 bp, Xenorhabdus bovienii
  Coding DNA location: Contig name=SeqID_16866; Position on contig =65908..66060bp; Strand=+
atggaaactaaaaaccaaaatacacaactgacggtacagcaccaagaaaacttcaatctatacctgtcaatacaccatacacataatcacattactggttattttatatgtcgtacaatttggactatcaccagaaaaaaaataatgaactga

SEQ ID NO: 1972 - DNA, 273 bp, Xenorhabdus bovienii
  Coding DNA location: Contig name=SeqID_16866; Position on contig =66608..66880bp; Strand=+
atgaaagtgctgatgactttatcgtgcatacatggacgccccttatttgccaaacaatcgtttgtcatgaccagaactcggttaagattgcagtcatacatccggactttagttgaggccgtcgccttttcgctgaccagactcttatcatttcggcgcgctatgagcgcttgcacgacaccagagttttctgatcacggtctaacctctcttgccatcacttctcgattgcccgtgcaacctttggaaattacttttatatgggctccctga

SEQ ID NO: 1973 - DNA, 210 bp, Xenorhabdus bovienii
  Coding DNA location: Contig name=SeqID_16866; Position on contig =66945..67154bp; Strand=+
atgtaccagcaacgcccagataatcctggcattcttattcgccagcgccaccacagcaatattggtattacgtctcgacaacagactattcagccagttttctgttcggccagttttctgttcggccggttttctcttttacgtaccgtaccaccaccctatctccataaatcaatagtgtccgtaaataattgtcaccccgtttgctaa

SEQ ID NO: 1974 - DNA, 228 bp, Xenorhabdus bovienii
  Coding DNA location: Contig name=SeqID_16866; Position on contig =67136..67363bp; Strand=+
ttgtcaccccgtttgctaatcccctgtaaagttaacttactcccactcgaatgttgccgggggaccagaccccgccatgccgccagctggcaaccattagagaagtgtctggcatcccctaccgatgccagtgttgaattttctgttccggttctatcacctgacgatcaagcggtcatgctcccaatagttagattatccttgcaagatagtattcacgctcaatga

SEQ ID NO: 1975 - DNA, 255 bp, Xenorhabdus bovienii; identical to SEQ ID NO: 422
  Coding DNA location: Contig name=SeqID_16866; Position on contig =67326..67580bp; Strand=-

SEQ ID NO: 1976 - DNA, 252 bp, Xenorhabdus bovienii; identical to SEQ ID NO: 421
  Coding DNA location: Contig name=SeqID_16866; Position on contig =67457..67708bp; Strand=-

SEQ ID NO: 1977 - DNA, 276 bp, Xenorhabdus bovienii; identical to SEQ ID NO: 420
  Coding DNA location: Contig name=SeqID_16866; Position on contig =67757..68032bp; Strand=-

SEQ ID NO: 1978 - DNA, 114 bp, Xenorhabdus bovienii
  Coding DNA location: Contig name=SeqID_16866; Position on contig =68089..68202bp; Strand=+
atgacccgatcaagctccttcaggtgttcacccaactgctggaatagttgcctgaagatatctggcagactattactgacactctccagaatctcaggcagtcgtactccctga

SEQ ID NO: 1979 - DNA, 156 bp, Xenorhabdus bovienii
  Coding DNA location: Contig name=SeqID_16866; Position on contig =68225..68380bp; Strand=-
atgaagatgacaacagtgggtatcgatctggcaaaaatgtctttcagatccacggcgttgatgcacaaagtgaaacggtgctcaaaaaacagctaccgcgcgagagggattggtcaaaccgtactgcgcaggccaatgccattaggggtttactga

SEQ ID NO: 1980 - DNA, 273 bp, Xenorhabdus bovienii
  Coding DNA location: Contig name=SeqID_16866; Position on contig =68398..68670bp; Strand=-
atgcggtttgatggcgttattgtctcctttcaacattgtggtctatatgaccgatggctggagagggtaaaaacgctggcaggaaaactgcatgtggtcagcaagcgttatacacaacgcatagagagacataatctgaatcttcgtcatcatttggtaagactgactcgcaaaaccctgtctttttcaaaatccgtagaaataatgggatggatgccccattcaagcggcatcagtgtgccaaaatggaagtgtattaaaacagccatttaa

SEQ ID NO: 1981 - DNA, 132 bp, Xenorhabdus bovienii
  Coding DNA location: Contig name=SeqID_16866; Position on contig =68635..68766bp; Strand=+
atgttgaaaggagacaataacgccatcaaaccgcatcaatgtcttctttgttcttgggccaaaaacgtgggcgatgacttttcacctaatcctgtcgtaggcataaaagagccaacgaggtttgttctttga

SEQ ID NO: 1982 - DNA, 114 bp, Xenorhabdus bovienii
  Coding DNA location: Contig name=SeqID_16866; Position on contig =68716..68829bp; Strand=-
atggctcccggcatcgaagtgattatttgttgcgaaatggatgcgcagtggtcatacgtgaagtcaaagaacaaacctcgttggctcttttatgcctacgacaggattaggtga

SEQ ID NO: 1983 - DNA, 252 bp, Xenorhabdus bovienii
  Coding DNA location: Contig name=SeqID_16866; Position on contig =68861..69112bp; Strand=-
atggcaaagattgatgttacctgcccatcttgctgtgcagttaaagggatccatcgtaatgggcgctctcgttccggtcatcaacgttacctttgccaatcctgtcgccatttctggcaactggaattcacttataccgcatgttgtcccagtacacatgagcaaatcgttgatatggccatgaatggagtgggatgtcgggcgacagcgcgtgttatgggattggtcttaatactgtccttcgtcacttaa

SEQ ID NO: 1984 - DNA, 945 bp, Xenorhabdus bovienii
  Coding DNA location: Contig name=SeqID_16866; Position on contig =69249..70193bp; Strand=+
atggcatattcactttcccatcacatacaacaggaacaaatgatgaaaatcgatctgagcaatatggtgacagaaagccgtaaccctgccagtacccatattgatgagctatccacactcgatatgctgcgcgttatcaatgatgaagataaaaaagtggctctggccgttgaaaaaacgctgccccaaattacccgggtagtcgataaagtggccgaggcatttcgtcacggcggacgattgatatatagcggagccggaacctccgggcgtctgggcattctggatgcgagtgagtgccccccgacttatggtacaaagccggagtgggttgtcggtttaatcgccggcgggcatcaggcgattttgaaggcggtcgaaaatgcggaagataatcagcaatcaggcgcagaggatcttaaaggactacacttcaatgaaaaggatgtgctggtcgggatcgccgccagtggccggacgccttatgtgttgggcgcgatggaatatgcccgatcggtcggggcaactatagcctgcatcagttgcaatccgaacagcccgatgacgcaattggctgatatcgccattacgccggtggtggggcctgaaatcgtgacgggttcttcccgcatgaaggcaggaacggctcaaaagctagtgctgaatatgatcacaaccggtgccatgatccgcacgggtaaggtgtatggcaatttaatggtggatatagaagccaccaatgctaaattgatcgaacgtcagaagaatattgtcatggccgccactgaatgcagcagggaaacggcagaacaggctctgaatgcctgtgacggtcactgtaaaaccgcaatcgtaatgattttatcgggaacctgtgccgaagacgctaaaaggttactggcagaacaccaagggtttatccggcctgctatctcaaaatcctga

SEQ ID NO: 1985 - DNA, 1449 bp, Xenorhabdus bovienii
  Coding DNA location: Contig name=SeqID_16866; Position on contig =70223..71671bp; Strand=+
atggctaaaatcagtcaggaaatgctggttgaaatactcagggcaatgggtggcgtgaataatatcgtgcattgtggcaattgcatgacccgcctgcgcttaacactgcatgatgattcactggtcgataaaactgccttaacgaaaatttccggggttttaggtgtcattgaaaatgacgaacagctccagattgtccttggccccggcaaagcacaaaccgccgcggatatgatgaacgggctattgagtactgccgatcattccaccgctgaacctcagcccgccggtttgaaagagattgcttcttccaataaaaagcagctcaaagaaaaacaaacccgttcagttcataagtttctggctaaattcgccaccatttttaccccgctgatccccggttttatcgccgttggcctgttattggggttcgctaccttactggaacagattttcattcagggagccggacatcccaatgccgcattgggggagatggtcggctatatgaaagttttcagcaaagggatgttcagtttcctgagtattctgattggttataatgcgcagaaagcctttggcggctccggcgtcaatggtgccattatcgcttccctgtttgtgctgggttataacgccagcgccaccagcggcttctattccggtatcagtgatttctttggcttcgccattgacccgcgcgggaatatcatcggggtgctgattgcctgtattctcggcgcttgggtggaaaaacagatccgcaaaattataccctctgatctggatatgatcctcacttccaccctcaccctgctcatcatgggtgccgtcgcgtttattgtcatcatgcctgtgggaagctacctgtttacagcgatgtcatggctgttcatgcatctgaacggtaatccattcggtgcggcaattctggcagggttattcttaattgcggtgatgtttggtgtacatcagggttttgttcccgtctattttacgttgatggatgtgcaaaactttaactcgctgttcccgattctggcgatggcgggagcagggcaggtcggatctgcgctggcgttgtatatgaaagcccaaaaaggttcgctgctacgcactcaaatcaaaggtgccatcattccgggttttctggggatcggagagcctctgatttacggtgtgacgctacctcgcgtcaaaccctttgtcacggcttgtctcggtggcgcaatcggtggcttttttatcggtctggttgcctggctgggagtccctgtcgggctgaattcggttttcggcccatcgggtctggtcgccctgcccctgatgacgtccgatagtggcatcttcacgggcatggcagtgtatggcgcaggtttaatcattgcttatatcagtggttttatactgacatttttctttggcagtaaaaatattgatttaagctga

SEQ ID NO: 1986 - DNA, 606 bp, Xenorhabdus bovienii
  Coding DNA location: Contig name=SeqID_16866; Position on contig =71673..72278bp; Strand=-
atgaccgcaagcctgatattctcactaagcgccttcttattgatctctgcgattacacctggcccgaataatatgctgctgacttcatcgggtgccaattttggtttccgtcgctcgttaccgctttgggtgggtatccttcttggcatacagacaatcctgctactgtctgcctttggtgtgggagcagtgctgctactgtatccggcgatgcacaccgtgttgaaagtgctcggtagtctgtatttattaaggctggcgtggaaaacgtcgacggcacattataaacggttggaaacggcaaatttggcggccgttcccatcaaaggctaccaaggctggttattacagtttctgaaccctaaggcgtggatgatgggattgggcgccgtcggcagttacagcctacagggagacttatataaccactcagtggtcgtaataagtgtggtgatgctggtttccaacatgatcgccggtacagtgtggattgttctgggttcgctgattggctccctgctgaaaagccgcaatgcctggtttattttcaacatcactatgggtattttgaccgctgcttgtgtccccctgatttggatgggttga

SEQ ID NO: 1987 - DNA, 219 bp, Xenorhabdus bovienii
  Coding DNA location: Contig name=SeqID_16866; Position on contig =72449..72667bp; Strand=+
atgatgatcccgtggcaacaactggcacccgaaaccctactcgatctgatcgaaagttttgtcttgcgggaaggcaccgattacggtgaagatgaaaaaacgctggagcaaaaagtacaggatgtaaaacgtcagcttgaacggggagaagtcctgctggtctggtctgaactgcatgagaccgtcaatatcatgcccaaagagatgtttcgcccttag

SEQ ID NO: 1988 - DNA, 918 bp, Xenorhabdus bovienii
  Coding DNA location: Contig name=SeqID_16866; Position on contig =72721..73638bp; Strand=+
atgacgagaaagatagttccaacttttattgataaggagtctgttcttatgtctgccaaacaccctgtcattgccataacgggttctagcggagccggaacaacaacgaccagtgtggcgttccgcaagattttccaacaacttgaagttactgccgcactcatcgaaggggatagtttccaccgttacacccgtcctgaaatggatgccgagatccgtaaggcgaaggagcaaggcaggcatgtcagctattttgggccagaagccaatgatttcagcatgttggaaaagacattttgtaactatggtgaaacaggcactggccgctgccggagatatctccacacctatgatgaagctgtgccttacaatcaagtaccgggtacattcacgccgtgggaatcactgccatcaaacaccgatattctgttttatgaggggttgcatggcggcgttgttactccacagtataatgtcgccagctatgttgatttgctgattggtgtcgtccccatcgtcaaccttgagtggatacagaaacttatccgtgataccagcgaacgtggccattcaagagaggcggtcatggattccgtggtgcgttcgatggatgattatatccgctatattacgccacagttttcccgtactcatatcaatttccagcgtgttcccaccgttgatacctctaaccccttctccgccaaggctattccatctctggatgaaagttttatcgtgattcgtttccgtggcctgaaacaaattgatttcccttatttactgtcaatgcttcaggggtcatttatttccagtataaataccattgtcgttcccggcggaaaagtggggctggccatggagttaattatggctccgtgggttcagcaattactggaaggcaaaaaaatttcttga

SEQ ID NO: 1989 - DNA, 189 bp, Xenorhabdus bovienii
  Coding DNA location: Contig name=SeqID_16866; Position on contig =73712..73900bp; Strand=-
atggcttatgggaaaccgaataatgctaatatttccaaagagaaaaggaaaaggaacataaaggcaggaactgctaaatggcttctttatcgtgtaagaatcggcgagtactttggtaaatattgtacagcttttacgagttttaccttgctgaattttctctttataatctgtttttattgttactga

SEQ ID NO: 1990 - DNA, 633 bp, Xenorhabdus bovienii
  Coding DNA location: Contig name=SeqID_16866; Position on contig =74200..74832bp; Strand=+
atggttctcggcaagccacaaacagaccctactcttgaatggtttttgtcacactgccatattcacaaatatccatccaagagcacgcttattcatcaaggcgagaaagcagaaacgctttactatattgttaaaggttcagttgctgttctaataaaagatgaagaaggtaaagaaatgattctctcttatttaaatcagggagatttcattggtgagcttggattgtttgaagaaggaaagctgcgtactgcatgggtacgagctaaaagtgcctgtgaagtcgctgaaatttcctacaagaaatttcgccagctcattcaggtcaaccctgatattctgatgcgtctatcctctcagatggcaaaacgcttacaaacaacttcagaaaaagtcggtaacctggcatttctggatgtcacaggccgtattgccaagacgttaatgaatctggccaaacagcctgatgcaatgacccatcctgatggtatgcaaataaaaattacacgtcaggaaattggccagattgtcgggtgttcccgcgaaacagttggccgcattctgaagatgttagaagatcaaaacctgatctctgctcatggcaaaaccattgtagtatatggaacccgctag

SEQ ID NO: 1991 - DNA, 222 bp, Xenorhabdus bovienii
  Coding DNA location: Contig name=SeqID_16866; Position on contig =74733..74954bp; Strand=+
gtgttcccgcgaaacagttggccgcattctgaagatgttagaagatcaaaacctgatctctgctcatggcaaaaccattgtagtatatggaacccgctagttcctgaaattgctcttgaaactgagccagcgcaacccttatcctgcactggcttttttgttgcttcctttgtcttatctgtgcaatggcagcatcaagccccgttccgccgctttctgtaa

SEQ ID NO: 1992 - DNA, 576 bp, Xenorhabdus bovienii
  Coding DNA location: Contig name=SeqID_16866; Position on contig =75122..75697bp; Strand=-
atgctattaataatagataactacgattcttttacattcaatttatatcaatatttttgcgagttagggacaaatgttttagttaagcgtaatgatgaattacagcttgaagatattgagaagttggcgcccacacatttagtgatttcgccggggccttgtacgccaaatgaagcagggatttcactagaggccatttcgcattttgccggcaagttgccaatcctcggtgtgtgcctcgggcatcaggctattgggcaggcttttggtgcgagtgtggtcaaagcccgcgaggtgatgcacggaaaaaacagcttgatccaccataatcaacaaggagtattcaaaggattgaaccgtccactgactgttacccgttatcattctctggtgattgcagctgaaaccctgccagcgtcgtttgaagtgaccgcatggagtcagcacaacggtaatgtagatgaaattatgggaatacgtcaccgtactttgccattggaaggtgtgcaatttcaccctgaaagcattctcagtgaacagggacatgatttgttgaataattttctcagatattaa

SEQ ID NO: 1993 - DNA, 117 bp, Xenorhabdus bovienii
  Coding DNA location: Contig name=SeqID_16866; Position on contig =75734..75850bp; Strand=+
ttgccctaccctagcgggcattgtgcattctgtatttcgataaaatcaggtaaagcagcatcaacagcagcgggacgctcatcataccacagacgtatttttaaaatagtaggatag

SEQ ID NO: 1994 - DNA, 567 bp, Xenorhabdus bovienii
  Coding DNA location: Contig name=SeqID_16866; Position on contig =76010..76576bp; Strand=-
atgtttaaacgtatttttgtgtcgcttatggctgcatgtgctatcagtgtgatagcagctccggcattggctgccgaaactcatgtgaagctggtaacatcagcaggggaaatagagcttgcgctggatagtaacaaggcgccaatcaccacaaaaaatttcattgagtatgtcaatgaagggttttataacaacaccatttttcaccgcatcattcccgggtttatggctcagggggggggcttcacaaaagacatgaagcagaaggtgaccaaagcgccaatcaaaaatgaagcagataatggtttacgtaatctgcgtggcacgatagcgatggcacgtaccgcagataaagacagtgccaccagccagttcttcattaatgtcaccgataacgccttccttgaccacggtcagcgtgattttggttatgctgtctttggtaaagtcgtaaaaggtatggatgtggttgataaaatgtctcaggtcaagacagaaaatgttggcccttatcaaaatgtccccgtgaaaccgattgtgatcctttctgccaaagttgcaccttaa

SEQ ID NO: 1995 - DNA, 597 bp, Xenorhabdus bovienii
  Coding DNA location: Contig name=SeqID_16866; Position on contig =76942..77538bp; Strand=+
atgacccactttgtcacgagtgcacctgacatccgccacctgcctcaagatgtgggtattgaggtcgcgtttgccggtcgatcgaatgcgggtaaatccagcgccctgaatgcactgactaaacaaaagagccttgctcgcaccagtaaaaccccggggcgtactcagcttatcaacctgttcgaagtggaagaaggtattcggctggttgacttaccgggttatggctacgctgaagtgccagaagagatgaaacgcaaatggcagaacgcactgggagagtacctccagaaacgtgagtgtctgctggggttggtggttttgatggatatccgtcatccactgaaagatctggatatgcagatgatcgaatgggcagtcgtgatgcaagtacccgttatggttttgctgacgaaagcggataaattggcatccggcgcccgtaaaagccaattggcgaaagtccgtcaggagctggcttctctgggtggcgagattcaaattgaaaatttctctgtcctgaaaaaaatcggcatcgatcaacttgagcagaaacttgactactggttcaaccagcctgccattgaggtggagtga

SEQ ID NO: 1996 - DNA, 168 bp, Xenorhabdus bovienii
  Coding DNA location: Contig name=SeqID_16866; Position on contig =77861..78028bp; Strand=+
ttgtcacaagccctttcgcggcattatgaggataatttcaggccgttaaataaacagtcattccatcaatatacttcaataaaaaattatccccataaaattctgcaccataacaaaaaagccactttttttgtggctcttttgtttactttgcagatttttgactga

SEQ ID NO: 1997 - DNA, 2847 bp, Xenorhabdus bovienii
  Coding DNA location: Contig name=SeqID_16866; Position on contig =78054..80900bp; Strand=-
atggcattctacgctttaatcatcccacagaacgacgaagaaaattttatggcacagatagcagacaatcccttgattttggttgatggttcttcatacctttatcgtgcataccatgcgtttcctccgctgaccaatagtgcgggagaaccaacgggcgccatgtatggtgtcctgaatatgctgcgcagcttaatcatccagtataaacccagtcatgtggcggtcgtgtttgatgccaagggcaaaacgttccgtgatgagttatttgctgaatataaatctcatcgtcccccgatgccggatgatttacgtgggcagattgagccactgcacaaaatggttgaggcaatggggctgccaattctggttgtgccgggcgtcgaagctgatgacgtcattggtacactggcattgcaggcggaaaaagaagggcgttccgttctgattagtacgggcgataaagatatggctcagttggttacgcctcatatcacgctgattaacaccatgactaacaccattctggggccggaaggggtctcggagaaatatggtgttccacctgagttgatgatcgattttctcgctctgatgggagactcctccgataatattcccggcgtaccgggtgtcggtgagaaaacagcgctgggattattgcagggtatcggcagtctggatgatatctatgccagacttgatgagatcgcgacactcagcttccgtggcgctaaaacgctgagtgggaaaatggagcagcacaaagaggtggcttacctttcttatcaattggcaacgattaaaacggatgttgagctggataaaacctgtctggagcttgcggttacagcccctgacagcgatgaactgctggcgctgttcagccgctatgaattcaaacgttggttgagcgatgtacagaatggcagttggctggaaggtaatagccaaaaacccgctgcggcaggtgctacggctaactcagctcccgccggcagtgcaccggttgctgtcaatatttcgtcggaaaattatcaaaccatccttgaccggaaatcccttgatgagtggattgtgaagctgaaacaggctccagccttctcttttgatactgagacagacggccttgatacgttgacggtcaatctggtgggcatgtcttttgctattgcggtgggagaatcagaggttgaagcggcatatctgccgttggggcatgattacctcgatgcaccagaacaactggatctgcatgaagttctggcggcattaaaacccctgctggaagatgcaaacctgcctaaaattggtcagaacctgaaatttgatcgtggggtgctggcacgttacgacgttgctttgaatggcattgtttttgatacgatgctggagtcgtatgtcctgaacagtgtgagcggacggcatgacatggatagcctggcagatcgtcatctgggatataaaaccacgacttttgaagaaatcgcgggcaagggcaaaaagcagcttaccttcaatcaaatcccgctggaagaagcggcaaaatatgcggctgaagatgcggatgtgactttgcggctgcaccaagccatgtatccacaggtcgacagtgtgccgacgctgaaaagcatcttccagaacatcgaaatgccattggtgccagtgctttcccgcatagagcgaaccggcgtgctgatcgatgcccaaaccctggctgaacactcaacggaaatcactgcgcggctgggagaattggaaaaagccgcttatgaactggcgggtgaagagttcaatttggcttccccaaaacagttacaggtcattctctttgaaaagctgaacctgcctgtactgaaaaagacgccaaatggggcgccatcgaccaatgaagaagtgttggaagaactggccgataaccatgaactgccgcgggtgattctggaacatcgcggtctggcaaaactgaaatccacttataccgacaaactgccgcagatggttaaccctctcaccaaacgagttcatacctcttatcatcaggccgtaacagcgaccggacgcctttcttcccgtgatcctaacctgcaaaacattcctgtccgtaatgacgaggggcgacgtattcgtcaggcatttattgcaccggaaggttatcacatcatggcggcggactattcgcagatagaattgcggattatggcgcatctgtcacaggataagggcttgctggaggcgtttgcgcagggtaaggatattcacagtgcgacggcggctgaagtctttggcgtgccactggaaaaagtgaccagcgaacagcgccgcagtgcgaaagcgatcaattttggtctgatttatggcatgagtgcgtttggcctatcccgccagttaagtattccgcgcggagaagctcaacgctatatggatctctattttgaacgctatccgggggtactggcctatatggaacgtacacgccagcaggcggctgagtatggttttgttgaaacgttggaagggcgtcgcctttacctgccggatatcaaatcgcgcaatgccatgcgccgcaaggcttctgaacgtgaggcgattaacgcgccaatgcagggaacggcggcggatatcatcaaactggcaatgatcgcggtggataattggatcgtcagtgagcagccaaatgtacgcatgattatgcaggtgcacgatgaactggtatttgaggttcatgaatcagagttggcgacagcggagcagaaagtcagtgagttgatggaaaaaagtatgcagcttgatgtgccgttaaaagtggatgtgggaattgggatcaactgggatcaggctcactga

SEQ ID NO: 1998 - DNA, 255 bp, Xenorhabdus bovienii
  Coding DNA location: Contig name=SeqID_16866; Position on contig =80815..81069bp; Strand=-
ttgatttttacctcctgttgctcattttttaggggggtaaacataaatctgttttatgtgccaattttttgtgcacaaagttatccacaattcattcatcagaatatttgtcagaaaaagcctgtcagcacgagaaaattatcgcaaaattcgtctataacgacacagtatggcattctacgctttaatcatcccacagaacgacgaagaaaattttatggcacagatagcagacaatcccttgattttggttga

SEQ ID NO: 1999 - DNA, 108 bp, Xenorhabdus bovienii
  Coding DNA location: Contig name=SeqID_16866; Position on contig =81026..81133bp; Strand=+
atgtttacccccctaaaaaatgagcaacaggaggtaaaaatcaatggattacgtggagtattaaagaaatattacaatgacttaaaaatcactgacttgtggatataa

SEQ ID NO: 2000 - DNA, 624 bp, Xenorhabdus bovienii
  Coding DNA location: Contig name=SeqID_16866; Position on contig =81262..81885bp; Strand=-
atgaagacattttggttagcactggtgggagtatttatggcatttaatgccagtgcttctggtttttatgaagataaacaatacgttgaattaaaaaatccagtggccaatcagccacaggttttagaatttttctccttttattgcccccactgctaccagtttgaaaatatttaccatgttcctagtaccgttgagaagaatttgccagcaggtgtcactcatgagcgttaccacgtcgattttatcgggcctttggggaaagatttgacagaggcgtgggcggttgccatcgtcatgaaaattgaggataaagtcaccccaattttgtttgacggtatccagaaaacccaaaccatcaatagcaaggccgatatccgtaatgcttttatcaaagcgggtgtgtcaggtgaagagtatgatgcggcattgaacagctttatcgtgaaatctgtggcagccaaagagcgtcaggccgccagcgatttacaactgcaaggcgttcctgctgtttatgtgaatggcaagtaccagattaaaaatgggggtattgagccagcgacagtgactgagtatgccaagggcttttctgatgtagtgaattatctggtgacaaaaaaataa

SEQ ID NO: 2001 - DNA, 978 bp, Xenorhabdus bovienii
  Coding DNA location: Contig name=SeqID_16866; Position on contig =81903..82880bp; Strand=-
atggcttttaacttccagaatattacaccggacttaatcatggatgcgttggtgcagtcgggtttgtatattgattctggcttaactgaactgaatagctatgaaaaccgcgtctatcagtttatggatgaaaatcgtaaacgctatgtcgtgaaattttatcgtccgcagcgctggagccagcagcagatccaagaagagcatgatcttgcactggcattacagcaggcagatttgtcagttgcggcgcctctggtgtttgccggccagacggtactgaatcatggtgggttcttcttcgccattttccccagtgtgggtggacgccagtatgaatctgataactttgatcagttggaagatgttgggcgattgctggggcaaatgcatcaaattggtcgccagaaaatattttctacccgtccaactattggtttggatgaatatttataccagccataccgctatttatctgcatgtaaattaatccctgctaaacataaaaaagccttctttgctgcgttggatgagttaaatcaaacggtggaaggatcatggtattctgatgggcagatattacggctgcatggtgattgccatgctggcaatattctgtggcgtgatgaggcatggttcgtggatcttgatgatgcccgtaatggcccggcgattcaggatttgtggatgttgctcaatggctcacggcaagaacgcttgatccaattggatatcctgcttgagtcatatagccagtttacggattttgatccaaaaacattggcactgatagaaccacttcgcgcgatgagaatggtctattatttggcttgggttgcccgtcgctggcaagatccggcttttccaaaagcctttccgtggatggccgacagcgacttctggcatggccaagttagtcttttttctgaacaaattcggctgttacaggaatcacctttacagctaaatccgatgtattaa

SEQ ID NO: 2002 - DNA, 114 bp, Xenorhabdus bovienii
  Coding DNA location: Contig name=SeqID_16866; Position on contig =82889..83002bp; Strand=-
ttgctaatttgtatagccatttataaggaattaaaaatgaagaagattttaagacggctttgctgcgtgcgagaggcattattaaagattaatgaagagagagcagggttgtga

SEQ ID NO: 2003 - DNA, 207 bp, Xenorhabdus bovienii
  Coding DNA location: Contig name=SeqID_16866; Position on contig =82996..83202bp; Strand=-
atgcgggtggatagtcctccggccagaattgcgccactcatttttggatgcgtcatgttaactcacctgatatttggcaatgaaatatttaattatttggcttataacctttgtaaaccaatatgtaacaatgctttcatggaagagagtataacctttacgcttattgacagaccaactctttctctaagtcattatccttgctaa

SEQ ID NO: 2004 - DNA, 588 bp, Xenorhabdus bovienii
  Coding DNA location: Contig name=SeqID_16866; Position on contig =83147..83734bp; Strand=+
atgacgcatccaaaaatgagtggcgcaattctggccggaggactatccacccgcatggggggggatgataaaggattactgcaattcgaaggcataccattataccaacacattgccacaagattgcagccgcaggtgcaagaactgctgattaacgccaaccgtaatcaggcgctttatcagcagagtggttatcccatcataccggatatcatcaccgatttttctgggccactggcaggtatgctggcggtattgaagaaggccattaatgaatgggtgatctttgtcccctgtgatgtgccagattttcccgatgaccttgtggaaaaactgtggcgttatcggcagcattcatgggcagtttatgtccatgattgccaacgtgcccatcccacactggctttaatgcaccgcagcctgatcccccgcttggaaagctatctggcactgggagagagaaagctggtgttttttatgcagatgattaaagcaaaagcggtttattttccctatctcggctccttcaccaatttaaatacaccggaagaataccagcattgggaatatttccaggagtcagcatga

SEQ ID NO: 2005 - DNA, 534 bp, Xenorhabdus bovienii
  Coding DNA location: Contig name=SeqID_16866; Position on contig =83731..84264bp; Strand=+
atgagcccgacgacattgccgttgctcggcatcactgcctatagtggaacaggtaaaacaacacttcttaagcagatcattccgctattgcgccagcagcatatccgcgtggggttgattaagcacactcaccataatatggatgtcgatcaaccgggcaaagacagttatgagctgcgtaaggcaggggcagcacaaacgttggtcgccagccagcagcgctgggcattgatgacagaaacaccagacttaccagagctggatctacactatctcgccagtcggttcgatgcagattccctggatctggttctggtcgaaggcttcaaggaagaggccattgcaaaaatagctctctatcgccacggcctgaacattgtctttgaccagatccttgatccccaagttattgctattgccagcaacaccccgctggcaacatcgcttcctcagcttaatatcaaccaaccacagcaagtaacagcgtttattgtggcgtggttgagggcaggcagcgctggcaagcatggctaa

SEQ ID NO: 2006 - DNA, 741 bp, Xenorhabdus bovienii
  Coding DNA location: Contig name=SeqID_16866; Position on contig =84271..85011bp; Strand=-
atgccaaaaaaagatgtagactataattctattggagatcgttatgaactcttcatgaataataggcctcaacgtgaaatcgacgttcgtaccatactcaatctggttggcgatgtacgcggcaaatcggttctggatttggcttgtggttatggttactttggtcgagagctacgaaatcatggcgcttcaaaagcggttggtgtagatatttccgaaacaatggtagggcttgccagagcaaaatcgaaacaatatggagatgatctggaatttcatgtacgaaatgtctgcaatatggagtcatttggtcagtttgatatcgtcattgcggcttggttgcttaactattcggaatcgattgaagatctggaaaagatgtttcaggctgttgccaataatctcaagccttctggtaagttcattgcttacacagtttctcctgattatcgattagccgtaagtaactgtgatatttatggcatcaatatcctgagcgaagaaccatggaaagatggcatccgttatcaagccgaatttttaactacgccaccaagtccttttacgttttatcgatggagccatgaagattacgaacgcgctattcaaaaagctgggtttaatcgatttgaatggcaaaagcccgaattgttggagagcgatatcaaacgttttcccgagggtttctgggatgacctccaacagaatggcctgaatattggccttacctgccggttctga

SEQ ID NO: 2007 - DNA, 114 bp, Xenorhabdus bovienii
  Coding DNA location: Contig name=SeqID_16866; Position on contig =85142..85255bp; Strand=+
ttgatttcagaaagtatcaatacgagtaggggtaagcaacgaaactttttggaaaacagcccacaaattatgttgcgggttgtacatattatgtggaattgttcagtttattag

SEQ ID NO: 2008 - DNA, 357 bp, Xenorhabdus bovienii
  Coding DNA location: Contig name=SeqID_16866; Position on contig =85317..85673bp; Strand=+
atgtttccagttacatataaaatagacttcttaatcttattaacacgaccccaaaaaccatcgaaaaatcctctgcattattggaggtatccatttcataaaatgaagaattggactgtatctttgattgttacagaaccgaaagtgctggtagtttcttcaaggggaatagatcggttaatagagagaggcttaaataaaaataattttcttggttggtcgatgtttttaggctctccggtttggaaaattacggcaacaaagatgaatcattatttaaatattgattacccttataaatatggtcaatatcggtcaaaaatagaaatgttggctaatttcccagaactaaaatga

SEQ ID NO: 2009 - DNA, 279 bp, Xenorhabdus bovienii
  Coding DNA location: Contig name=SeqID_16866; Position on contig =85734..86012bp; Strand=+
atgacaccaacaaattcgacagaagaattattactggatatcgctaacaaagataacctttcaaaagaaaataaaaaaatgcttatcaatgcgacggcttatccagaccaaaaaacaaattatgcggcaagaaaaccatgcgctgtatgcccacctccacaggcaatacccgaatttatagaaaatctaattagttctttagatatcaaccagccacaacaggtaacagcgtttattgtggcgtggttgaagggaagaaacgcaggaaaacatagctaa

SEQ ID NO: 2010 - DNA, 741 bp, Xenorhabdus bovienii
  Coding DNA location: Contig name=SeqID_16866; Position on contig =86068..86808bp; Strand=-
atgtcgaaaaaacatgcagcctataatgctattggagaacgttatgagcaattcatagaagacacacctcaacgtgaaatagacgttcgtaccatactcagtatggttggtgatgtcagtggaaaatcggttctggatgtggcctgtggatatggttatttcggtcgagagttacgcaaacgtggagcgtcaaaagtcgttggtgtggatatttctgaagcaatgatagagcatgccagagaaaagtcggaacagcataatgatgatatagaatttcatgtgcaagatgtctgccatatggaatcacttggcaagtttgatatcattgttgcggcttggttgttcaattatgctgaatcgattgacgatttggaaaaaatgtttcaggtcgtcgctagccatctcaaactttcaggtaagttagttgcttatacggtttcacccgctttccgtttcaatcagggtaactacgatatttatggtatcaatattctgagtgaagaaccatgcaaaggtggcgcctattatcacgtggaatttttaacgacaccaccaagcctccttattttctatcgatggaaccatgaggattatgaacgagctattcaaaaggcaggattcagtcgagttgaatggcaaaaacctaagctgttagagaatgatttcaaacgttatcccgatggtttttgggatattttccaacgaaataatctgaatataggctttacctgtcagttctga

SEQ ID NO: 2011 - DNA, 138 bp, Xenorhabdus bovienii
  Coding DNA location: Contig name=SeqID_16866; Position on contig =86794..86931bp; Strand=+
atgttttttcgacatgattattactcccctgataaacggataatgataatcgctccgattttctactgtgcagttgaaggggcttcatatctttatgaatggcatctaattttacttgatggtgccaatggcagataa

SEQ ID NO: 2012 - DNA, 300 bp, Xenorhabdus bovienii
  Coding DNA location: Contig name=SeqID_16866; Position on contig =87043..87342bp; Strand=-
atgcaagtcacgttagtcaaaatcaacgttaaagccgacaagattgacgaatttatcgaggtttttcgtgataatcaccttggttcggtcaaagagccgggcaacttacgctttgatgtgctgagggatgaaaatattccgacccgcttttatgtttatgaagcctatgctgatgaaactgcggtggccgcccataaaaaaacgcctcattacttgcgctgtgtcgagagattggaagcgttgatgaccgagccaaggaaaaaaataacgtttattggcttgatgccggaagggaaatag

SEQ ID NO: 2013 - DNA, 885 bp, Xenorhabdus bovienii
  Coding DNA location: Contig name=SeqID_16866; Position on contig =87344..88228bp; Strand=-
atggcagatttagatgacatcaaagacggtaaagattttggtattgatacaccacaaaagaacactctgtttgaattgaaaggcagtggtgcgctggattggggaatgcagtcgcgtttggcgcggattttcaatccagcgaccaataaaacggtgatgctggcgtttgatcacggttattttcaggggccgaccacgggattggagcgtattgatatcaatatcgccccgctgtttgagcacactgatgtactgatgtgtacccgcggtattctgcgcagtcaggttccacctgcaaccaataaacctgtggtactgcgtgcatccggcgctaattcgattttgactgagttgtccaatgaagcggtggctgtggcgatggaggatgcgcttcggctgaatgtgtgcgccgtggcggcgcaagtttatattggttctgagcatgaacatcaatccatcaagaacatcattaagctggtggatcagggaatgcgctatggcatgccgacaatggccgtgacaggcgtcgggaaggatatggcacgtgaccagcgttatttctcactggcgacccgtattgccgctgaaataggggcgaatattatcaagacctattatgttgacagcggttttgaacggatcgcagcgggctgtcctgtgccgattgtgattgcaggcggcaagaaattaccggagatagaagcactggagatgtgctatcaggcgattgatcagggtgcgtccggtgttgatatgggacggaatatcttccagtccgaagcgccggtagccatgctgaaagcggttcaggcggtggttcatcacaatgagaagccagcacaggcttatgaactgttcctgagtgaaaaggctaagggggaataa

SEQ ID NO: 2014 - DNA, 1032 bp, Xenorhabdus bovienii
  Coding DNA location: Contig name=SeqID_16866; Position on contig =88259..89290bp; Strand=-
atggagataggcatgaaagcaccaacactgaaaaaatgggttctggccagtgcattaagtctggtatgtgtctcctgggtacaggcggctgagaaaattgcgtttattccgaagctggtcggtgtcggcttcttcaccagtggcgggcaaggtgcggtagagacaggtaaggctctgggcgttgacgtcacttacgatggcccgaccgaaccgagtgtcgcggggcaggttcagctcatcaataatttcgtcaatcaaggctataacgcgattgtggtatcggcggtatcaccggatggcctgtgtccggctctgaaacgagctatgcaacgcggtgtcaaagtactgacatgggattcagatacggcacctgaatgtcgttctatctatatcgatcaaggcacaccgaaacagttgggcggaatgctggtggagatggctgccagtcaggtcaaaaaagaccaagccaaagtggcgtttttctattccagcccgacggtgacggatcaaaaccaatgggtgaaagaagcgaaagccaagattgcggcggagcatcccaactgggaaattgtaaccacccaatttggctataacgatgccaccaaatctttgcaaacggcggaaggcattttaaaagcatggggagatttggatgcgattatcgctccggatgccaatgctttgcctgctgcggcgcaggctgcggagaacctgaaacgcaggaatgtcgcgatcgtcgggttcagtaccccgaatgtgatgcgcccttacgttgcaagcggcacagttaaacagttcggtctgtgggatgtcgtcaagcagggcaagatagccattcacgttgctgatgaaatgctgaaaaaaggcgatctgaatgtaggggatcagttagatattcctgatatcggcaaactggagatttcacccaacagcgtacagggataccgctacgaagcgaaaggcaacggcattgttgtgatgccggagcgtgtgatttttaccagcgaaaacatcaaccaatacgatttctaa

SEQ ID NO: 2015 - DNA, 1017 bp, Xenorhabdus bovienii
  Coding DNA location: Contig name=SeqID_16866; Position on contig =89296..90312bp; Strand=-
atgaatgctttgcagcgttacggctgggaaactgcccttgcggcgctgttggtaatggaaattctgctgtttggcatggtaaatccacggatgctggatattaacgtgttgttgtttagtaccagtgattttatctgcattggcattgttgccctgccgttgacgatggtgatcgtcagtggcgggattgatatctcttttggcgcggtgatcggcctgtgtgcgattgctttggggatcatgtatcaggcggggctgccgatgatcgctgcgatccctctgacgctgatcgttggcgtactgtgtggcctgatcaatgccacgctgattttctataccggcgtgaatccattggtgatcacgcttggaacgatgtacctgtttggtggcagtgcgctgttgctgtccgggctatcgggcgcgacaggctatgaaggcattggtggctttcctgcggcctttaccgattttgccaacctgacgctgttcggcctgcctgttcctttggtgatcttcatcttttgcgttctgatgttctggctgtttatgcaccgtacccaccgtggccgttatgtgtttctgattgggcagaatagccgtgccgcccgttatggggcgatccccgtgaatagaactctgtacttgctgtatgccctgacgggtttggcttccgcgctggcggcgatcattctggtgtcttatttcggttcagcccgttctgatttgggaagttcattcctgatgcctactatcactgccgtggttctgggcggtgccaatatttatggcggctctggctccattgtgggcactgcgctggctatcctgctggtgggctatttgcagcagggattgcagatggcgggcattccgaaccagatatccagcgcgctgtccggtgcactgctgattgcggcggtggtcgggcgctcggtttctctgcatcgccatcaaattcgtgactggtggcaacgccagcgggcttctgcttcgccacaaaatacccctgaacgataa

SEQ ID NO: 2016 - DNA, 1014 bp, Xenorhabdus bovienii
  Coding DNA location: Contig name=SeqID_16866; Position on contig =90312..91325bp; Strand=-
atgttgaagtttatccagaacaaccgcgaagttacggcattgatcgccattctgggattatttctgctgttgggcagtcttgatcggcaggctttcagcgtgcagacgatgggcatgatttttggtaatgcgcagatcttgatgttattggcgctgggggcaacgtgggtgatgctcacgcgcagtattgatgtgtcagtcggttcaacaacgggcttatgcgcggtggtgttgggcatgtcacttaatggcggattaccgctgccgatggcatgtctgatgacgctgttggtcggcatggtggcgggattaatcaacggggtgctggtggtatggctgaaaattccggctattgtcgctaccttgggaacccttggcttataccgaggcctgatgctgttgctgacgggcggtaaatggatcgaaggtttgccggctgatgtgaaagcgcttgccagaccggactggttcggtatctcaccgattggctggttgttgatattgctggttctggcgatgacgtggatgttgaagaaaagcgattttggccgaggcttctatgctacgggtgataaccagcagggtgctcgtcagcttggcgttcctgtcaatattatctgcatcacggtttttgctgcgaacggcgtgatggctgcactggcaggcattgtttttgtggctcagattggttttatcccgaatcaaacgggtagcgggctggaaatgaaagcgatcgccgcttgtgtattggggggcattagtctgttgggcggaatgggaaccgtggttggggcgattttcggggcttatttcctgacccaaatcgacagtgtgttggtgctgctaaggttgccggcatggtggaatgattttattgccggtctggttttgttggctgtgctggtctttgacggacgtttgcgcagtgccgttgaaaagaatttacgccagcaacgttacgcccgttttctggagccgataaaaagcccggcaaaaaaacaggagaagccatga

SEQ ID NO: 2017 - DNA, 1548 bp, Xenorhabdus bovienii
  Coding DNA location: Contig name=SeqID_16866; Position on contig =91319..92866bp; Strand=-
atgtcacagaacaataccaccaatatgccttcccaaaatgattctggcagtgtccctcttttggcggttcgtggagtcagtaagcaattttccggtctggcggtattgaaacatattgatttcatactgactcgggggcaggttcatgccttgctcggcggcaatggggcaggcaaatcgacgctgatgaaaatcattgctggcattgagcagccggatgcgggaacgctgatgctggatggccgttctgtcagtcatctgacacccactaaggcgcatcaattgggcatctatctggtgccacaagaacctttgttatttcccaatctttctgttcaggaaaatattttattccgcctgcctaaacatcaggtcagcaaaagccggatgcagcaattactggctcagttgaattgttcgatggatctgaatgcccctgctggcagcctgaatgtggcggatcagcagttagtggaaattatgcgcgggctgatgcgttattcccgtattttgatccttgatgaacccacggcatcgctgacgccggcagaaacggagcgattatttgagcgggttcgtgagttgcagcagcaacaagttgggatcatctttatttcccacaaattaccggaaatccgtcagattgctgattatgtcagtgtgatgcgcgatggtggcattgcgctcagtggggcaacggtggcgttttccacagaagcgattattcaggccattacgccggaggcgaaaacaggcgcgttaaccggatcgcagaagctgtgtctggaagttagcagcagtgcttttgccatcaatcaggccgaacctgtccttgaagtatcttcgctgggtggcgaagggtttcgtgatatttctctgaatctgagtgcgggggagatcgttggcctggcaggagtggtaggcgccgggcgaacggagctggcggaaacattatatggattacgtccgattgtgcagggagagatccgttttcggcagcaagtgatcaatcaacgggatacggtcgcccggttgcgatctgggctggtttacctgccggaggatcggcaggcgtctggtctgtttctcgatgcaccgctcagttggaatattggttcactgacgcacagccgccgtactttctggacacgccccgcctatgatgccgccgtgcttgaacgttaccgtcgggcgctcaatattcgcttcagtcatatcaatcagcctgtacgcaccttgtcgggcgggaatcaacaaaaaattctgatcgccaaatgtctggaagccaagcctgccgttctgattattgatgagccgacacgcggtgttgatgtcgcggcgcgcagtgatatctaccagcttatccgcagtatcgccagccagcaggtggctattctcctgatctcgtctgatcttgatgagatcgtgcaattggcagatcgaacgctggtgatgcatcagggagggatctgcgggcatctggataaagccagtatgagtgtggatgcgattatgcatcttgcttttggtgaggaggcgtcatgttga

SEQ ID NO: 2018 - DNA, 96 bp, Xenorhabdus bovienii
  Coding DNA location: Contig name=SeqID_16866; Position on contig =92826..92921bp; Strand=-
atgttcaatgtccgtgtccgcaaaacgaaagtctgtaacgccatgaggtgctgtaatgtcacagaacaataccaccaatatgccttcccaaaatga

SEQ ID NO: 2019 - DNA, 1107 bp, Xenorhabdus bovienii
  Coding DNA location: Contig name=SeqID_16866; Position on contig =93024..94130bp; Strand=+
atgttcaaatttttgcgatcgccctctagcacatcagaggctttcatgcttaattctttgccagtggataaacaagttgttatgccgatcaaaccaaccaagaagcaatcagtatcagaaagaagcgtgttatccgaggaactttcttattcagataataaccattcaggtcatggctattcaggaaaccgcatgagtgaagaagaactactggctcgcatagcctggttttactatcacgatggtctgactcaaggagacatcggtgaattgctcggcctcagccgcctcaaagtctcccgcctgctggagaaggggcggcagtcgggcgtgatccgcgtgcagatcaattcacgctatgaagggtgtctggaattggaagatacgctgcaaaaacgctttaatctcaagcaggttcgtgtactgccggctcttgacggaataaacctcaacacccgtcttggcgtcggcgctgcccacctgctgatggcactgattgagcctagtcagctactggctatcggatttggcgaaaccccgatgtgtactttacagcacctgagcgggtttatttcatcccaacaaatccggctggtgacgttatctggcggcgtcggcccttatatgacggggattggtcagctcgatgcagactgccctgtcagtatcattcctgcaccgctgcgggcgtcaactcaccaagtcgccgcgacgttccgcgaagaacgcagcgtgcgggatgtgatcctggctgcctgtgccgcagatatcgccgtggtaggaatcggagcgatcaaccagcgacagcaggcgaccatcatgcgttccggctatatcagcgacggagaacaattgatgtttggtcgcaaaggcgcgattggggatatcctcggttatttcttcaatgcagaaggtgagctggtcggcaatatcgatatccatcaggaactgatcagtatctccctaccagagctgaaaacgatcccgaatgtgatcggtgtggcggggggtatcgaaaaagccgacgccatcgttgccgcactgaaagggggctatattagctcgctggtaaccgaagaacagaccgcaagagctatgctgacgtaa

SEQ ID NO: 2020 - DNA, 1593 bp, Xenorhabdus bovienii
  Coding DNA location: Contig name=SeqID_16866; Position on contig =94202..95794bp; Strand=+
atgaatcaacgcgctcacgctcacccatcagggaagtatctgatggcgcttgatgcaggaactggcagtatccgtgcagtaatatttgatctcgaaggaaatcaggtcgccgttggacagactgagtggatacaccagcctgtaccgaatgtcgcaggttcaatggaattcgatctaaaaaacaactggcaactggcgtgtcaatgtatccgccaggcactgcaaaaggcagaactgcctgccagtgcgattcagggcgttgccgcctgctcaatgcgggaaggcatcgttctgtataatcgcagtggcgatcccatctgggcctgtgccaacgtcgatgcccgctctggtcatgaagtcagcgagctgaaggagctttacgacaatacctttgagtatgatgtttaccgttactccggccagactctggcactgggcgcaatgccccgtctgctgtggcttgcgcatcatcgcgcggatatctatcggcaggccagtacactcactatgatcagcgactggctggcttatatgctcagtggcgagctggcggttgatccctccaacgcaggcacaacggggatgctggacttagtcagccgcaactggcgcccgagcctgctggaaatggccggactacgttccgatatcctttcccccgtcaaagaaaccggcaccctgctcggttacatcaccggaaaagcagcggcagaatgcggcctgaacagcggcacacccgtcattatgggcggcggcgatgtccagctcggctgtctcggcattggtgtcgtcaaacccgcgcagaccgccgtactcggtggcactttctggcagcaggtcgtcaacctgccagcaccgatcaccgatcccaacatgaacatccgcatcaacccgcatgtcattcccggcatggcacaggcggaatccatcagctttttcaccggcctgaccatgcgctggttccgcgatgccttctgcgcggaagaaaaactgatggcggaacggctgggtgttgatgcttacagcctgctggaagacatggcggcacgagttcccgctggagcttatggcatcatgccgattttctcggacgtcatgcgctttaaatcgtggtatcacgctgccccttccttcctcaacctgtcgattgatccggaaaaatgcaacaaagcgacgctatttagagcactggaggaaaacgcggccatcgtctcggcctgtaatcttgatttgattgctgatttttccggtgttaagccagactcactggtctttgccggcggtggttccaagggcaaactctggtgccagatcctcgccgacgtgacaggattacccgtgcgggttcctgtagttaaggaagcaaccgcgttgggctgtgcaattgcggcgggcgtgggggtttcattgtatgactcactgcctgaaaccggggaaaaactggtgcgctgggagcgggaatatcagccggatttgacacattgggagatttaccaaaaaacgaaaaaaaattggcaggcagtgtacacagaccaacttcatctggtggatgacgggctgacgacatcgctgtggaaagcgccggggttgtga

SEQ ID NO: 2021 - DNA, 174 bp, Xenorhabdus bovienii
  Coding DNA location: Contig name=SeqID_16866; Position on contig =95740..95913bp; Strand=-
atgatattttacatactatttcctttttgtgttaattttgtccggtttaatatactggcgtttctggttatgttaatgggactaagaagaatatttaatttgtatatgaaggaacatattcacaaccccggcgctttccacagcgatgtcgtcagcccgtcatccaccagatga

SEQ ID NO: 2022 - DNA, 117 bp, Xenorhabdus bovienii
  Coding DNA location: Contig name=SeqID_16866; Position on contig =96012..96128bp; Strand=+
atgtctgatgctgatcaacaaattgaacacatgaccaaaaagccctctattcctatagagggcttttactatataacctcagcttcgtttaagaatagcgatatcagtatcccgtaa

SEQ ID NO: 2023 - DNA, 234 bp, Xenorhabdus bovienii
  Coding DNA location: Contig name=SeqID_16866; Position on contig =96090..96323bp; Strand=-
atgaaggcaaaagcgttatctctttgggatagattgatgttaagaaggcgattcttgatagaaacggtcatcgaccagctcaaaaatatttctcagatagagcattcaaggcatcgcagtcagctcggttttctgctggaaatcgctgcgggtctaattgcttatacattccagcctaaaaaaccgagcttgaatttacgggatactgatatcgctattcttaaacgaagctga

SEQ ID NO: 2024 - DNA, 567 bp, Xenorhabdus bovienii
  Coding DNA location: Contig name=SeqID_16866; Position on contig =96408..96974bp; Strand=-
atggttaatttagaagaattttactgctgcgtcgatgacttttgccaaacatttatccccctctggcatcaacaactcattgaaaacggattactcaaacggcaccgcgaagcttccctttctctcagtgaagtcatgatgatcctcattttatttcatatgagccattatcgtgattttaaaacgttttatattaaatatgtaaaacaacatcttaaggccgattttcccggattggtcagctatacccgaatgctcactttgaagaaaagggcacttattcctctatgcgcttttctttcttcacgcaaggctaaaacccaagggatcgcttttattgatcccaccaaaattgctgtttgtcacaaccttcgtattccccgccatcgtgtatttgagggggttgcacaacgaggaaaaacgagtacaggttggttttatggctttaaacttcatctggttatcaatgattgcggtgaacttttggccgtgaagttaaccacaggaaataaggatgatcgtcaccctgtcaaagcgatggtaaaagggttaacgggatgtttatag

SEQ ID NO: 2025 - DNA, 99 bp, Xenorhabdus bovienii
  Coding DNA location: Contig name=SeqID_16866; Position on contig =96973..97071bp; Strand=+
atgcctggggatctccacgattttgttttctttagcaaaaactttgatcgtgcctcaggcactttagttcccttcttaagcaaatctcaggttatatag

SEQ ID NO: 2026 - DNA, 462 bp, Xenorhabdus bovienii
  Coding DNA location: Contig name=SeqID_16866; Position on contig =97106..97567bp; Strand=-
atgactattaaatctagagaaactcccgtaaatcctgattatcctacttgtgatgagtgttatgctaagttaatgatttatcctgaatatattcatccggatgaagtaagttctttattacagttagaacctactaaaaaaaatatagtaggtacaaaaattacaagtagttcagggcgaacaagagaaataaaaatagctggttggcttttatcttcagaaaattatgtaaattcaaaagatattagagatcatttagattggcttttaaataaaatatctaaatcttctgaaggattaaagcaattacaaaatacagataaagtaacaatgagaattgattgtgtttggcgttctattgcatggcacggaggtcccacattatggcccgagcaaatgaaaataatgtccgatttgggattagaatgctcatttgatatctattttgtaggtgaagaatag

SEQ ID NO: 2027 - DNA, 1353 bp, Xenorhabdus bovienii
  Coding DNA location: Contig name=SeqID_16866; Position on contig =97721..99073bp; Strand=-
atgagtaaacattacgattatattgcaattggtggtggcagtggtggtattgcctccatgaaccgtgctgccatgtatgggcagaagtgcgcgctgattgaagcgaaagcgctaggcggaacatgtgtgaatgtgggctgtgtaccaaagaaagtgatgtggcatgccgcccagattgcggaatctattcatcaatatggtcctgattatggttttgataccacggtaaatcgttttgactggaagacactgattgccagtcgtacggcttacattgatcgtattcatcagtcctatgagcgtgtgctgggcaataataaggtcgatgtcattcaggggtttgcccgttttgttgatgcgcatacagtcgaggtcaatggagaaaaaatcaccgctgaccatatcctgattgctacgggtgggcgtccggtacgtccagcgattccgggagcggaatatggtattgattctgatggtttctttgaactggatgaaatgccaaagcgtgttgctgtggtaggcgcgggttacatcgctgtggaaattgctggtgttttgaaggcgctgggcagtgaaacgcatctgtttgtgcgcaaacatgcgccgctgcgttctttcgatccgctgattgtcgagaccttgctggaagtcatcaaaaatgaaggaccgacactgcatacagaagcgatattaaaagccgtgattaaacatgctgatggtagcttgacgctgcaattgcaggatggcagagagcagacggttgatacgctgatctgggcgattggtcgcgagccgatgacagataatctgaatctggcagtcactggtgttgagttgaatgagaaaggttatatcccagtcgataaatatcagaataccaatgtcaaaggcgtatatgcggtaggcgataacacgggggcagtggaattgacgccggtggcaattgcggcaggtcgtcgcttgtcggagcgtctgtttaataacaagccggaagagcatctggattacaccaatgtgccaacggtggtattcagtcacccgccaatcggtacggtaggtttgacagaaccgcaggcaaaggaacagtatggtgatgatcaggttaaggtttatacttcgtcatttactgcgatgtatactgccgtgacacaacatcgccagccatgtcggatgaaattagtttgtacgggagcgggtgagaagattgttggtattcacggtatcggctttggtatggatgaaatcctgcaaggttttgcggttgcgctgaaaatgggcgcaacgaagaaggattttgataatactgtggcgatccatccgacggcagcggaagaatttgtgacgatgagataa

SEQ ID NO: 2028 - DNA, 231 bp, Xenorhabdus bovienii
  Coding DNA location: Contig name=SeqID_16866; Position on contig =99062..99292bp; Strand=+
atgtttactcatcttaggtcacttccgtctaatcaattaacttacaagtacaagctaaagttcaacctggcgtctattatgacaaaaagttatcaccgactgtggatggttctggctttcattactataggccacaactatttggtgataatgccgttttggacggacgtctattcaggcaccacccatgccacagaggtatgccctgttccttcaggaaccaatacttga

SEQ ID NO: 2029 - DNA, 843 bp, Xenorhabdus bovienii
  Coding DNA location: Contig name=SeqID_16866; Position on contig =99232..100074bp; Strand=-
atgctaagttatcgtcacagtttccatgccggcaaccacgcggatgtgctgaagcacactgtgcaaagcctgatcattgagtcaatgaagggaaaagagaaacctttcctgtatttggatacccatgcaggcgcaggccgttatcagttgagcggggaacatgccgagcgtacaggggagtatctggaaggtattgcccgtatctggcagcgtgatgatattcccgaggaattgacggcgtatatgggcgcggtaaaggcgctgaatccgcatggtgttctgcgttattacccaggttctccgctgattgcccgccatttattgcgggaatatgacgagcttaacttgagtgaattgcatcccagtgattttcctttgttacgcagtgaattttcccgtgatgaacgtgtgcgcctcctgcgggaagatggttatcagcagctgaaatcaaaactaccgcccagaagtcgccgcgggtttgtgctgattgaccccccttatgaattgaaatctgactaccagaatgtcgtcaagggtattttggaaggatataagcgctttgcgaccggcacttacgcgctgtggtatccggttgtactgcgtcagaaaattaaacgtatgctcaaggatctggaagcaacgggcattcgcaatgttttacagatcgagcttggggtacgtcctgacagtgatcagcgtggtatgacggcgtccggcatgatcgtcattaatccgccgtggaagctggagcagcagatgaaagcagtattgccatggctgcatcaagtattggttcctgaaggaacagggcatacctctgtggcatgggtggtgcctgaatag

SEQ ID NO: 2030 - DNA, 255 bp, Xenorhabdus bovienii
  Coding DNA location: Contig name=SeqID_16866; Position on contig =100171..100425bp; Strand=-
gtgaatggattatcgctaattacctcgaaatacatccctcagaaatctggcctagccgctattttgatagtaacggtcaacttatcaaacgaactacccgaaaagtttctaattagcggaaatttagttaaaaaatatctccgtggggtaacgattaccccacacagtgtcttcctttggttcggttttcatctcttccaaaataaatattcatccattactttgttactatgctttattatgtttttgtattag

SEQ ID NO: 2031 - DNA, 372 bp, Xenorhabdus bovienii
  Coding DNA location: Contig name=SeqID_16866; Position on contig =100310..100681bp; Strand=-
atggtggttcaggcaggggaggcttcggcctcgctggttatagttacccagtctgcaaaccctgtctggatcgccaccatcaatgatcaattaatggaaggggtagcaggaatgaataacgttagaaatgactggcatcaagctgatattattgctgcattacgtaaacgtggtacaaccttagcggctgtctcccgtgaatcgggactcagttcatcgacattagcgaatacacttagtcggccttggccgaaaggtgaatggattatcgctaattacctcgaaatacatccctcagaaatctggcctagccgctattttgatagtaacggtcaacttatcaaacgaactacccgaaaagtttctaattag

SEQ ID NO: 2032 - DNA, 1434 bp, Xenorhabdus bovienii
  Coding DNA location: Contig name=SeqID_16866; Position on contig =101061..102494bp; Strand=+
atgtctcaccatattactggtcaatcaaggcatcaatccacgctctttccagaactcatggacgactttgttagcgaagataacccagtgcgagttattgatgtctttgttgaacatctcgatttactcgacttaggttttgaaagcgtgaatcccaagtcaactggccgtcctagatatcaccctgccacgatgctcaagctctacatttacggttatttaaatcgaattcaatcatcgcgacggctggagaaggaatgcaaccgcaatgtcgagttaatgtggctgcttgaacgtttatctcccgacttcaaaacgattgcaaacttcagaaaggataatggtaagggaattaaaaacgtttgccgtcaattcgtcgagttatgccgacaactcaacatgtttgaagatgccgtgttcgctattgatggtagtaaattcaaagccgtcaataataaatccaaaaattacacccccagtaaagtgcagtttcatatcgagcgagttgaaaaaagtatcgagaaatatttaagccagatggatgccaaagatgagaacgaaaaagagtctgatctgattgtcgcagcatcgaaattagcctggctaaaacagcgcttagttgagctaaaagcactcgaaaaacaagttaatgagcatccggacaaacagatatcacagacggatcctgatgcccgcttgatgaaaacacaccacatggaaagacaagtctgctacaacgtgcaaacggcggtcgatacaaagcaccatctcatcgtttgccacgacatcgtcatgacaacagaccgaggtcaactgacattagttgccgggcaagtccaaaaggttttggggaaggaatcgattaccgtgttagccgacaaaggctacttcagtcgaaatgatatcaaagacgcggatgatcaaggcatcacggcgaatgtgccacaaattgacacgtcaggttcggagagcaaaggcatttttaacaagtctctcttcaagtacgacaacgacagtgatgtatacatttgtccggcgggtcaaagtttacaaaagcgaatgagagtagtggagaaaggtgtagaactggatgtttactttaacaatttagcgtgcaataaatgtccaatccgatctcaatgcacaaaatcaaagaaagagccccgtcgcataagacgatggatacatgaatcgattattgatgacatgcaaaaacggttggacgagcatccggaattcccggtgataaggaaacagagtgttgagcatccgtttggcacgataaaaatgtggatgggagcgactcactttttgactaaacgcctcaaaaatgtgagcactgaaatcagcctcagtgttcttgcttacaacctgaaacgtatgatgaccatactgggaactgtcggtttgatggcagccatcagtctgagctga

SEQ ID NO: 2033 - DNA, 114 bp, Xenorhabdus bovienii
  Coding DNA location: Contig name=SeqID_16866; Position on contig =102609..102722bp; Strand=+
atgagcgctaatcggatgcttaaatgcaacccaaatcgatgtttgttggatgaaatcacggtttttacacagtctgtgccagaagcggacatcgcggacgacaccgtttgttaa

SEQ ID NO: 2034 - DNA, 93 bp, Xenorhabdus bovienii
  Coding DNA location: Contig name=SeqID_16866; Position on contig =102735..102827bp; Strand=-
atgcgagggagtaaggttcagcggttcgctaacaacgcaatatgtcaggtcagcgagccaccttttatgcccagcgaggcattgcttttttaa

SEQ ID NO: 2035 - DNA, 696 bp, Xenorhabdus bovienii
  Coding DNA location: Contig name=SeqID_16866; Position on contig =102964..103659bp; Strand=-
atggtgattcaaatgactaattttacactttcgccggaggatgaagttataattgcagaatgcattaagaaaggatatgcagcatggaaggatgacagtgttaaagatttgaagtccagacttaaagaacatttaaaaaaaaggcaaaagcatttttgctgttactgcttgagaaatatgtttgatgaattcaattatgtgattgatatagagcatatattacccaagcataaatacgttgattttatgtttactttggataacttagccgcctcatgtaaaagatgtaatatgaagatgaaagggagaagtgttgcgtttatcaatccatgtttcgaaaacaatcatgatcccttcgcaacagaaaactataaattcatacacccaaacactgatatttttgttgatcatattttatacatcacccttcaggaaggaacgaatattcttgtgtcttatagtgttaaaaacaatagccctaaaggatgctatagcattaacttttttaaacttgatagacttgcaagaaacacgaatgataaagcacaagggattcctgtcgaagatgaagattattacgaaggtaacccagaggatgatgatattgatgatattgatgatattgatgctggtaatcggttaatggatatagaaggaataatagaggatttagcttttaaaaatgatcaaatatga

SEQ ID NO: 2036 - DNA, 1215 bp, Xenorhabdus bovienii
  Coding DNA location: Contig name=SeqID_16866; Position on contig =103640..104854bp; Strand=-
atgtcatcatccaaatggattacaaaaggtaccaacatggctaaaataaaaattatattaggtgagaatggacaaggcaaaacaagatatctacttaactattttaatgaaaactttcatcgtgaacacatagcagtagtatcaaattcaataattaacccattcccattaattaggaaaaacagtcatcactattacggtttaagatcgagatatggtcaaactcaagatatattatcaaggaacataaataattattttattaaattaatcacgaacaattcactaagaggtttactaagtatatgcaaattgattgggtattcagatgagattttagtcagaagagaacctctatacaggattcaaaaaaaagaaaggtatgattatgagcttgtttattctacttatggaaaggaacaatacaaaagatttcaatcttataagcaacaattaagtcgtggaattgtagaaaaacacggttcatatattgaaaaaagtcatgattattatcttacctacaatggtaatgaaagagaaaatcaatcaattaaagatcacatgaaatatgaacaagaagttaggactgatttaggtttgcatagtttcaatcaactattcaccagcagaattttcgttaaaaaaaataataaaatttttcctattgaaaattctagttctggggagttgtacatgctttcttttggcctttttttacgtaaatttttagatgaaaggaaaacgaacttacctaaagttatattgattgatgagcctgaaaatagccttcacccaaaattgcaaagaaaatatatagaatttctgattggttttcttggatacaatgatgatgtcaaagttattattgcaactcactcccctttcattacaatggagaacgatttttatagcgctgatttttctttgtatggtattgaaaatggggtgattttcgatactaatcataagcaaaaaaataataacatagagcaagtgtattatgagctttttgggatcttgacgccaaaaaatagatatctttcatattattgcaatgaaatcgtccgtggcgttgccgaaaaaagaatttcctttgatgatgcattccaagcaatttccagaatgaagaatgtagcatttgatgaaaaacaatatgatttccttaacgatgtaattaatcttttgaaaaaagtacatggtgattcaaatgactaa

SEQ ID NO: 2037 - DNA, 117 bp, Xenorhabdus bovienii
  Coding DNA location: Contig name=SeqID_16866; Position on contig =105180..105296bp; Strand=-
atgagcgaaaagccgacatcacatatggaggcagttgatattaatttgctagtcttctgcaaagcatcccgcaatgatgcacctcgcgtatccctttatgacatatctgttggttaa

SEQ ID NO: 2038 - DNA, 1662 bp, Xenorhabdus bovienii
  Coding DNA location: Contig name=SeqID_16866; Position on contig =105413..107074bp; Strand=-
atgaacgcatgggagcagtacgcttttaatatccaaaacggtaaaatttcggcctgtaagcgactgaaacaggccgtgaaacactactataatgacctgaataacccacgttatacgtttgataccgaggttgtggcgcgctttattgccttctcccgtctctgtccgcacgtcaaaggccatttacgcggtaaaccgataatccttgagccgtggcagcaattcgcttttgctaacctgtttggcttcaaggtaaaggctactggccgcagaaagtaccgtagcgcttatattcaggtgccacgcaaaaatgcgaaatccaccgttgccgcgatattggctaattggttcttggtgatggagtcaggccagcaggatatttacaccgccgccgtcagtcgtgatcaggcacgtatcgtgtttgatgatgcccgccagatgagtttgttatcaaagccgctgaaaaagcgggtatccatccagcaacataaactgacctattcgaaaaccaatagcctgttaaaaccactggcagccaaagcttccacgattgagggcacaaacccctctcttgctattgtggatgagtatcatttgcaccccgataacgccgtctactctgcccttgaattaggcatgggcgcacgtcccgaaggtgtcctgtttgccattaccacagcgggcagtaacgtaatctccgcctgtaaacagcattatgattattgctgccagatactggacggcgaagagcagaacgaatcactgtttgccttgatttacgagctggacggcgagaacgagattgatgatgaagcgctttggataaaggctaaccccaatctcaatgtctcggtagacagtgacgctttgcatgacacgatacagaaagcccgcggtattccctcacaatggacggaaatgttaaccaaacgctttaacatctggtgtcagggggaaacgccgtggatgggtgagggcgcttggaaagcctgtcagactgattataatgaaagcgacctgaaaggactggagtgctacgccggactggatttatcgtcaacgggcgatatcaccagtgtgtgttacacctttcctgtggataatgaactgttactactgacccgccattacttaccagaagcccagttacagaatcccgccaataagaatcgtgcggtgtatcggcaatgggcacaaatgggctggatatgcactacagcaggcgactgtattgattatgaccgtatccgagatgatattctcaaagacagtcagcactttgatatcaggctggtcggcttcgacatatggaacgctacccacctacgaacacaattacagggcgcggggctggatgttgagccgttcccgcaaacctatatgcgctttagccctgtggcgaaatcggccgaggtgtttgttaaccgcaaggtcattcgtcacaatggcgatccggtgctggcatgggcaatgtccaatgtggtgatggagaccgacgcgaacgccaatatcaaaccgaacaagaagaaatcggcgaacaaaatcgaccccgcaatcgcgttcctgatgagttttggcacatggcagagtgagcataaagagtttgcattcagcctcagtgatggacagaaacagagactggctaattttgatggaatttag

SEQ ID NO: 2039 - DNA, 450 bp, Xenorhabdus bovienii
  Coding DNA location: Contig name=SeqID_16866; Position on contig =107071..107520bp; Strand=-
atgacaaacgcgcttctcagcggaaccgaccccctcctcaaatttttacgcacggcactttttttgaaaataaactcacaagggagacagaaaattatggccagggcacccaaacccccgacatatcttaatgacattgccgccagtcagtggaaatccaaggcaaaaatcttaggcgaacgggaagatctgaacgccgccgactggaacaacttagaactgtattgcgtcaactatgccatttaccgaaaagcggtggcagaccttgatattcggggctttagcatcgtgaacagtcagggcagtgaaagccgtaacccgtccttgagcgctaaggccgacgcggaaaagatcatgataaaaatgtcgtccttactgggttttgaccccgtatcacggcgtaaaaatccggtggaaaccgaggaagaggacgaattagatcgcctatga

SEQ ID NO: 2040 - DNA, 435 bp, Xenorhabdus bovienii
  Coding DNA location: Contig name=SeqID_16866; Position on contig =107554..107988bp; Strand=-
atgccgtggcaacctttaaggcgctgtagttatccgaattgccgtgaacgggtgaagtcaggccgctgtgaacaacaccaacgggaagcccgacggcagcaggacaaacaacggggaacccgaacccaacgaggctacagtaaccgatggggacgctatcggctgcaatacctgaaagccaatccgttgtgtgtccactgcctacagcaagatatctatgcctctgcaacgattgtggatcacattatcccgatacagggtgaagctgatgtgttgttctggcctgaattcaatcatcaatcgttatgccagccctgccataaccgcaagaccgtacagacagaccctatcaccaaagcgaaacgcaaacagggtatctatcaggaacgggaagcagaagcggcaaaacatcgcggttggttagtcgcagaataa

SEQ ID NO: 2041 - DNA, 297 bp, Xenorhabdus bovienii
  Coding DNA location: Contig name=SeqID_16866; Position on contig =107989..108285bp; Strand=-
atggttgaaatccctttaaatgaaatcaaacagcattgccggctggatgaaagcgacacgcttgatgatgccttgttaatgggctatgccgaagccgcgctggaagtctgccagcaacatattggcaagcggtttgataacggattggcttttacccctgctattaaggtgggctgtctgctttatatcggtttgctgtatgagaatcgggagatggcagtggatgcagagcttaaagaggtgcctttcaccattaaatcattgtggtctgtctatcgtgatgtgggagtgtattag

SEQ ID NO: 2042 - DNA, 378 bp, Xenorhabdus bovienii
  Coding DNA location: Contig name=SeqID_16866; Position on contig =108285..108662bp; Strand=-
atggaagcaaacggtagaaatcaagaaacaaccggagggcaaggaatgagggcaggcagattgaggcatcgggtgactatccagaaatccgagcagtcacgcgccccgtcagggcaggttattgacaagtgggtggatgccgccaccgtctgggcagaagtgagggcgattagcgggcgtgagcgtttggcatccggtgccgtgttctctgaggccactgtgcgtatctggatgcgttaccgtgatgacgtgaccaccgccaatatcattctctataacggggctaacaccagaggaactgcttttgacattgtggcggttatccctgatgcgaaatacacccgcttagagttgctttgtaaaggcggtgttttctaa

SEQ ID NO: 2043 - DNA, 1218 bp, Xenorhabdus bovienii
  Coding DNA location: Contig name=SeqID_16866; Position on contig =108614..109831bp; Strand=-
atgtggccttttaagcgaaaagacacggaaacccgcagcatgagcattgatgagtttctttttctggcgggcgcgtctaacaccaaatcgggcgagcatgtttcaccgtctacggcggagggcttacctgcggtaatgaatgccgttacggtgatcagtgaagcagtggcgaccatgccttgctatctctatcgggttcagcaccagcacggcaaagaatcccgcgaatggctcagtgatcatcctgtcgactatttgctgaatgagtgtccgaatgactgccagaccccatttcagtttaagcgaaccctgatgcgtcattgcttattaaatggcaatgcttatgcggtgattgtctggggacgggatggtcagccacaatcgttgcacccttacccaccatcagcggttgtccctcaacgattatcggatcaccggttcgtgtacaccatcaccgaaccttatagcgggaaggtaaaaacctatttacaggaagaaatcttgcatctgcgctatgccaccgaagacggttttcttggacgttcgcccgtcaccatttgccgcgaaaccttgggcttggggctggcacaacaacgccacggagccagcattatgaaagagggcatgatggcagcgggtgtgattaaagccgctgactggctggatggcatcaagggcaataaggcactggaagcccttgaacgttacaagggcgctcgcaatgcagggaaaacgccgatccttgaaggcgggatggaataccagcaattggggatgagtaatcaagatgcggaatggctggcctcccgtcgcttcacgattgacgatatcgcccgtatgttcaacgtcagcccgatctttctgcaagagtactcgaacagtacctacagtaactttagtgaagcgtcccgcgcctttctgaccattaccatgcgtccgtggctcgccaactttgaacagcaaatcaaatcggccttgctaatggcatccccgaaacgggggattcgttatcaagtggaatttgataccgccgacttgcttcgcgccaatccgaaagaacgctttcaaagctatgagacggcgattaagtcgggggtgatgtgcccgaatgaagcccgtgaacgtgagggactctctccccgtgcagggggggatgaatttagtcaggcatggaagcaaacggtagaaatcaagaaacaaccggagggcaaggaatga

SEQ ID NO: 2044 - DNA, 549 bp, Xenorhabdus bovienii
  Coding DNA location: Contig name=SeqID_16866; Position on contig =109834..110382bp; Strand=-
atgaataacgattttgaaatccgtaccgcttccctttctgccagtgagaaaaagctcatcggctacgtggtgaagtggaacagccgatcccacgttttatgggatgaatttgttgaacaattcgccccgaatgcgtttacgaacagtctgacaaacaataccgatgttcgggcgctttatgaacatgatcacatgaacctgttaggtcgtaccacatcgggtacgttgcggcttagcgaagataccaccggactacgcttcgagttaaccccgcctgatacgcagttggggcgtgatgtacttaccttggttgagcggggtgatatttccggtatgtcctttgggttcagggcactaaaagatcagtgggatattggtcaagagccgtatatcagaaccgttttagaagcagaactgcgggaaatcactgtcaccagcttacccgcctaccctgaaagcggggtggagattgccagacgttccctgaatgctgtcaagcctaatcatgttgatttgcgccattactggctgcaactgtccgaggtgtga

SEQ ID NO: 2045 - DNA, 1155 bp, Xenorhabdus bovienii
  Coding DNA location: Contig name=SeqID_16866; Position on contig =110426..111580bp; Strand=-
atgaaaaaactactcgaattacgccagcaaaaatctatcctaacaaatcaaatgcgttcccttctcactaaagctggagatgaaaaacgctcactaaccaatgatgaagccaaacagtttgacgaactgcgcagccagtccgattccctgaatgcggaaattgcccgttatgaaacccttgccgatgatgagcgtagtcaggcaggtaaaacccaaccaacccgcgataacctcagcaatgatgaattccgccattatattctgaccggagaaacccgcaccttatccacgggcgttccgtcagagggcggctataccgttatctccgaactgaacaaacagatcatgcagcaacttaccggtgagtcagtcatgcgtcaaatctgtacgattaaaaccacacgcagcaacgaatataagcaattagtttcggtcggtggtgcggcggtggcacacggcgaagaaggtaaggcacgcagcgagacaaccacaccaaagatggaagaagtcagcattaagctgttccctgtctacgcttaccccaagaccacgcaagagatcatcgattttagcgatgtggatatcttaggctggctgacctcagagattgccgatacgttcgtggataccgaagaaacggatcttgtcagcggtgacggcagcaaaaaagccaaaggctttctggcttatccccgcgacacgaaaagcgacaaggtgcgtgattttggcacgttgcaaaaactggaagctaccacgcttgaggccgataacctgattgaccttaagtttctacttaagaataagtaccgcaaaaactccgtctgggtgatgaactccaataccgccgcccaagtgcaaaaactgaaaaacggcaatggagattatatctggcgggaacgcttacaagcgggtgatcccgatatgctgctgggcttacctgtccattatctcgaatttatgcccgatggtgtgatcggtctgggtgacttcaaacgcggttatttcattgttgaccatgaaacaggcatccgcacccgccccgacaatatcaccgagccgggattttataaggtacacaccgataaatatctgggcggcggtctggtggactccaacgcaatcaaggtgctggaagtgaaaagtgccacgaaataa

SEQ ID NO: 2046 - DNA, 669 bp, Xenorhabdus bovienii
  Coding DNA location: Contig name=SeqID_16866; Position on contig =111706..112374bp; Strand=-
atggatttagttaaaagtgaggagctaataattaatcatggatggatagggtttttattattcattttcatgtttttactttttgtttttaccattgtaaatgtacatacaaccttactgtataaggtatttgttcttttcaatccagagaaaaatttgttcagaaaaataaagtctcttcgaaggatatcaaataacgagagaatatcagaagatataagggcattggcaaaaaatgaagaaattaggattataaactccttttatttaaaatgtaatcttagcgttgatgctcaaaatatttgggcaaagttaattctctttcataaaaataaaaacatccctatggaattatataagagagcttattctttatttcctgtgaaggattcaagactagtggagaaaatcagtctgtctaatttagtcagggtatggatagtaacagtattccaaataatattgctgttatttgtaggagcattaggatcactgtctatagttgcttatttaggtgctgtggatggtggtgttaaattatctttatttttcttttcttactttataatatttatattatttttggctttttttagctcgggaattccaaactattttagttatagtaaaataaaaaaactcattaaagaatataatgaaacgcattaa

SEQ ID NO: 2047 - DNA, 510 bp, Xenorhabdus bovienii
  Coding DNA location: Contig name=SeqID_16866; Position on contig =112408..112917bp; Strand=-
atgtactatcgtgataaattcggtgttttgcttttagataaaaaagataatctaagttattatagtcagcagaaaatttttattgaaaacaaaatgactgcccttgatgtttataatcaaatgacacaaaaaacaccattatggttacgcctgtcttttgcaataagagataaaatatcaagtcttgctggtgtagaaaaaattcatggattctcagatgagaatttaaataaagaacttcacgctggaagctatatcgatttttttaagattgtacgtatcagtgatgatgaaatatgtctattgtctaaggacatacatttgacggtgctgatatctctgaatattttctctgatgataatcataaagacggttgtatagctactgtgaccgcatctgtgataacgcataatttttttgggaaagtgtatatgatacctgtatctcttattcatggcagcattgtgagggggatgttatctaaagttggtcaggtattaaaagattaa

SEQ ID NO: 2048 - DNA, 192 bp, Xenorhabdus bovienii
  Coding DNA location: Contig name=SeqID_16866; Position on contig =112984..113175bp; Strand=+
atgtcatatgatctgagcagccatcagtttgtatctttattatacttctatatccctatatcatcattcatatataactacatagattttcacgggataacgggatatatagatatttttgtatttatttcaaatggttatcctaccccattttatcccacttatcccgtagcacagaaatactatttttaa

SEQ ID NO: 2049 - DNA, 2739 bp, Xenorhabdus bovienii
  Coding DNA location: Contig name=SeqID_16866; Position on contig =113392..116130bp; Strand=-
gtgaatcagggaaataataatcagaaaagccgcccgttagatgttatccgtgcagtgaagcaatccgcagtcactcactggcaactcttgttgcccgcctgtggcgttgatgttcccttaaagggcaaacacggcgcttgcccgatatgtggaggtactgatcgctttcactttattgacgataacaataacggtgactggcattgtcgccagtgtgatgagcagaatcacggtgatggtctggatttggtggcgcgaaccaaagggatcacaatctttgcagcggcgaaactcgtggcgggtgtgctggcacttcctttgcctgaacccaagcccgctaaagaacagccccgaccagtgaaacctattgctgaacgcatcacaacaatgctcgctacagctattactggcgaatctcaatatctggtgaaaaaggggctgcaatgccccaatcagcgattattgaaagatggctctttattgctggtggttcagacgctggacggcacgatcacaggcggacagaccatcaagccgaacggtgaaaaacgccttgtctctggaacacagaagaaaggcagttttattcccgtttcagagatcaccggaacgcccgatactttcatcattagcgaggggtatgcaacggcgctaactgtcaatcagttacatgagggcgtggtattggctgcgattgatgaaagtaatttactcacagttgccgagctggtcagagcgcagtggccagacgcaaaaattatccttgccgcagataatgattgtcacgtgcagggagaacgggacaaaaacggtaaactaaaaaagaacgttggcaagattgccgctgaaaaagccgctcaatctgttgatggatgggtcacgttgccgccaacggaagataaagccgattgggatgattaccgccagcgttacggcatcaaggcagcaaagcaagcatttagtgaaggtttgtatcaggttgggaaaaaagtgtcagtgtcaaagtcagttgtgattaatttaggtgaacatcgagagaaagaacgcgatccattaaagccacatgttgatacacgaaagaacggtatttattgggttgaacccaaggaacagaacggtgaaatcattgaaattgaaaaatggctgagtgattacatggaagtggtcggtattggcagtgatggcggagaaggttatctcattattaagttatctcaggaaggcacaggcaaacatacctttgaggccatgccccgccgtgaaattggtatgcctatgggctgggcgcgactgcgttcacgggggattaatatcacaaccaaaaacagtttattaccgattttagccgatcacttacagcgcagcggagaccgccgcaagtgggaagtcacacagacggcaggctggcattgtggggcatatgtcatgccggatggtgaaatcatcggtcagccttatatgcctgtggcgttttgtggtggcacatcagctattgcaggttatgtcgtcagggggacagccgaagactggacaacccacgttgcttcattaatgaaaggtaatcgttcaatgatgctgggggtgctggtggggttagctgcgccgctgaactcgctaacaggtggtaactgttttggcgtgcacttattcgctcagtcctcagcaggtaaaacaaccaccgttgaggcagccagtagcttatacggtgatcccgaagaacttaaactatcgtggcatggcacccatcacggcttaaataatgaagcggcagcccgaaatgatggttttttacccattgatgaaattgggcaaagcgccaatccgaaagaagtcgctaacagtgcctacagtttgtttaacggcgttggaaaaattcaggggaaacgggaaggtggaaaccgtgccgttattcgctggaagatagccgccctttcgacgggtgaggaagatttagaaaccttcctgataaaaggcgggatcacgccaaaggcagggcagttagtcaggttgttaagtgtaccctttgtcgacactgagtttttcaatggttatgaggacggagatgcacacgcaagggcaatcaagcgtgaatcaaaacgctactgtggggcggtgggtcgggcgtggatcttgtggctgtctgaaaatcaggaacgggcaatagaaaccgtgacctgtaaagaaaaagagtggctggatagcctgccagaagaagcctcggcacaagtaaaacgcgttgctgtgcgttttgctttactggatgccgccggagaactggcgacacatatcacaggctggagcaaggaagattgccacactgcgataaagcaaagttttgatgactggttagaagattttggtatcgggaaccgtgaaaaatatcaggttgtcacccgtgcccgtgattttatccagaaatacggtctatcgcgttttcagccttatacctatggaaaactgaatgggaatatagacaccgctaacgccatgagaatcaacaatctcgcgggctatctggtacataatcgccgtggtgatggacaggtggaatatcacattatccccagtgtatttgaagaagaaatcttgcagggattacagaagaaatcaggctttgaggctctggaagaagccggaatgttgattaaaatggagaaagatcgctttatcagtaaaaccatttcagtgaatggcactcaggggcggtttgtggttttgattttcaaggatgaagattga

SEQ ID NO: 2050 - DNA, 408 bp, Xenorhabdus bovienii
  Coding DNA location: Contig name=SeqID_16866; Position on contig =116133..116540bp; Strand=-
atgagcaataaacctatctcactaaagcaggcactgtatcgcgtaggtttgagcacttcacttttcacgttcattatcaaaaaagcgaacgacgagtgcgaaaccaacttaaataacctgattgcactggcgtgcgatatcaatcaggaagttcaccgcgctctgttgaaacatgccccgcagcctcttgcgaataaattattaaattccgtgatacataggcaatccggctcattagatcaggccgcgtttcgtgcgggtttatgcacttctttatacgaagtcattcttgagcaggccagccaacattgttcagaagagttacatgatttgctttctctggcctgtgatatcaatcaggaagcttactactcgctttatgcggtggttcatggcgaggacgagtaa

SEQ ID NO: 2051 - DNA, 552 bp, Xenorhabdus bovienii
  Coding DNA location: Contig name=SeqID_16866; Position on contig =116530..117081bp; Strand=-
atggtaaatagctatagagattctttgagattaagcaattatcaatttgataaacaaccctctttaagagggttagttaacaatcacagttattactggttggttcagattttaggctttattcctaaagtcaggagtttttcgcggcaagcatctttaacccatgaactgaaattacctttatcagcgatctcttcaatttgctcaagcagatcgtcttcaaagcgaattgttcgacgtgtgctgttatttcgttcatatggttttttgcttttttcatcttgcatcggttcgaaccattatgttaatttattaaacagtggtgcgaaccattataaagatgagcgtcataaaaaagcaatgccccgtagtggtggaacactgacgaggcatctaaccaaaccgttaatcgaggtaacgatcatggctgacacacagtctaaccaaactcgcctaaaatttacattcctaattgcatccggcactcagcggctggctggtatgttctcgctgatcttcgtatcacgtcaggaggcacaccatgagcaataa

SEQ ID NO: 2052 - DNA, 285 bp, Xenorhabdus bovienii
  Coding DNA location: Contig name=SeqID_16866; Position on contig =117168..117452bp; Strand=-
atgaccattcaatacagtactcctacacctgaagaacgccgctcaatcctttctgagtatggcgaaccttatgatcgtcttatacgtgaaaaggaacgccagcacattacctctatttccagaacgtcagcatggaaactggaaaatgaaggccgtttccctgcccgtaagccattaggccgcaattcctgtgcttggttgctcagtgatctgctgcactgggtacgtaatccgcccactgtagacaatgtaaataacccatatagccgtaaacctgctaactaa

SEQ ID NO: 2053 - DNA, 1398 bp, Xenorhabdus bovienii
  Coding DNA location: Contig name=SeqID_16866; Position on contig =117579..118976bp; Strand=-
atgaagtttggtgttctgacgttatcttatttgcatttaattatcttaaatatcaattccttagattatattttatactgtatattgttccagtgtttattgacgttttcttacttttacatcacactgtggggtaatcggtggggtaacaaatatcttgagttagagagccaaatgactactggaataaatcgattatcagataagaaactcaaatcgttactgggtgctcgcgctgataaggtgagaaaagtatctgatggtgctgggttgatgattcgcatcacgaaagcaggttctataacttggatttataagtatcgactaggtggaaggagcacggaagcaaatttacttacccttgggcgataccctgatctgtctttagctaaagccagagagatgcgcactcaatgccgaacatggttagccgatggcaaagatccccaacgaatgataaagctggatagagaagaaacattaaaaccagtcactgttcaggatgctatcgaatattggttaactgaatatgttgataataatttagtgaatgccaatagatacagagaacgttttaataaacacctgttcccttatattggagatatggctctttctgattgtgatacccgttattggcttaggcgttttgaccaagtgaaaaaggtagctcccagtgtggcaggaatgcttttgcaaatgtcacagcaggctcttaaattttgccgaatcagacgttttgctgtttcccatgttttggaaggtattacaaagcaggatataggcgtaaaattaaataagcgaaaaaaagttttaactgaaaaagaattatctgatgtagttagagcggtacatagtgatttttttattccttattattcagatcttttttatttattaattgtgtttggtgccagaactgtcgaagttcgtcgttctaaaatgaatgagtgggatttagagcaaaggttatggattgttcctgaaattaacagtaaaacgagagagaaaatagtaagacctatccccgatgctatggtaacgaagatacatagattaaaatcccaaaataaacattctgaatatttattaggagaatataaagaaaatacggctgttagttcaactgggaacagagtatgggaaagattaaaacataatgaaaaatgggttcttcatgacttaaggcgtacatttgcaaccatgctaagtgatgcgggaatcgctccacacattgttgaattgctgttagggcatactttaggtggtgtgctagcggtttataaccggagccaatacctaccagagaagctagatgctttaaacaaatggtgcgagagactggatgtattggcgggtaattatgagaatgtggttatattaaaggcagttcaataa

SEQ ID NO: 2054 - DNA, 135 bp, Xenorhabdus bovienii
  Coding DNA location: Contig name=SeqID_16866; Position on contig =119066..119200bp; Strand=-
atgacgacaccatctagggacctatccaaaattttatacacagatcttgatttgatcctgaaaattcaactgaggctacaactgataggagggaaatggaggcttttatcttttttggcaagaatggggctataa

SEQ ID NO: 2055 - DNA, 354 bp, Xenorhabdus bovienii; identical to SEQ ID NO: 1741
  Coding DNA location: Contig name=SeqID_16866; Position on contig =119197..119550bp; Strand=-

SEQ ID NO: 2056 - DNA, 492 bp, Xenorhabdus bovienii; identical to SEQ ID NO: 1438
  Coding DNA location: Contig name=SeqID_16866; Position on contig =119487..119978bp; Strand=-

SEQ ID NO: 2057 - DNA, 282 bp, Xenorhabdus bovienii
  Coding DNA location: Contig name=SeqID_16866; Position on contig =120053..120334bp; Strand=+
atgatgtcgaaaactatgatcttatctgcattgatcgttttcagtatgaatgttgcctatgcaagccaagagaagacgggatgtgaaataaagaaaaaaacattgaagaaacaacttgaatacgcacaggcagatggagataaacgcctgattgcaggattgacgcgcactttagaaagtataaaggccacttgtgaactggaaaaacgcttaaaatatcaacagcacaacccagaaccgacaaaagacagacttaaaaaaatgcagaccaagaataaatag

SEQ ID NO: 2058 - DNA, 597 bp, Xenorhabdus bovienii
  Coding DNA location: Contig name=SeqID_16866; Position on contig =120378..120974bp; Strand=-
ttgccaagggtaaaattccaaaaaccgttttctcatatcaaatttgattatgaagggggaatgatgtttgtccatgtcgccaacaagaatattattatcgtatttgcgttaatattgggaattgccattgtatttttatctttcaataacagtaagttgagtcttattggttatgttgataaacattgtcagaagaatacgacctgtttgatcgatatgaataaaatcacgtcttttgattgggataaaatgtatatcatcaataaagggatgggtcgtgaggatattgaatatatcatcggtgcggcatttacggggaaagccagtcttttttataaaattatttttgttaaaaatcagaaggtgatttattcggatgaatattacccccatgcagagtcttacgagaaaaaatttcttaaacctgattttaattatccttatgatgtaaaaggaaataattttatctattatgcgatttccagagataactcgatcctttcggtggaaattgaaaataagccatttatgggcgataaagtttattacaaaatctccccttctaatgcacagcaagtcaggggaagaagcttgtag

SEQ ID NO: 2059 - DNA, 99 bp, Xenorhabdus bovienii
  Coding DNA location: Contig name=SeqID_16866; Position on contig =121049..121147bp; Strand=-
atgtggcaatttatccacaaatcaagatatatcctcatggcatattgtaaactccaaaagatcaggctgctgattgaaagcagagggggactcttttaa

SEQ ID NO: 2060 - DNA, 156 bp, Xenorhabdus bovienii
  Coding DNA location: Contig name=SeqID_16866; Position on contig =121130..121285bp; Strand=+
gtggataaattgccacatcacttacaagcaactgttttacaattgctatttgatcttttaagtgcagtttacaagataaaaaaattcaacctctctttattcttcctgcatttaaagaacgctatcatcggtgctctatacagcgaaaaagtatag

SEQ ID NO: 2061 - DNA, 153 bp, Xenorhabdus bovienii
  Coding DNA location: Contig name=SeqID_16866; Position on contig =121655..121807bp; Strand=+
atgaccctaattgaacatttatctgttgttaaagaaacgcgctctgatatcaatcgtcagtatgatatgattgatgtgatcttccttgtcgtcagcgccattatggcctgtctttcctacacaaatattttaacccgcccccttcgttattga

SEQ ID NO: 2062 - DNA, 468 bp, Xenorhabdus bovienii
  Coding DNA location: Contig name=SeqID_16866; Position on contig =121861..122328bp; Strand=+
atgttttcaacctgcgccgaacaatgggcaagtgacacgtttcaacacgcggaattaggtgataaacgccgtaccaaccgcctggtgaaagtggcctgttcgttggctaaccatataggacaatcgctcgtgcaagctcttgactctcctgccgatgttgaagcggcctaccgactgacccgaaattccgccattgcgcctcaggccatcgccgaagccggatttaccgccaccgtcgctcacgctcaacgttatcattgcctgttagcgctggaagacacgacaaccctgtcattttcccatgcgtcggtcgccgatgaactcggttataccacctcgaagaaaaaatcccggggcatgcaggcacactcggtgttgttatttgcacctgaagaacaacaggtcgtggggttgatagagcaacagcgctggtgccgagatgtcagtgattatggcaaaagccgataa

SEQ ID NO: 2063 - DNA, 93 bp, Xenorhabdus bovienii
  Coding DNA location: Contig name=SeqID_16866; Position on contig =122312..122404bp; Strand=+
atggcaaaagccgataacgcgacacacgcccttatgaagggaaagagagttataagtgggaacgggcctcacaaaccgccgacagccggttag

SEQ ID NO: 2064 - DNA, 831 bp, Xenorhabdus bovienii
  Coding DNA location: Contig name=SeqID_16866; Position on contig =122413..123243bp; Strand=+
atggccaacgtgatttctgtctgtgaccgtgaagccgatatcatcgaatatctgcgttataaaacgagccaaaaacaacgtttcgttatccgttcgatgcaaagccggcgtattgaggaaagtcaggatagactttatggctttatcagccagttacagagtgctggagcacggttagttcaggtcagacagaaaggcgggcgtcaggcgcgtgtcgcggattgtgatatcagttatgccgaagtgacgttgaaaatccccgaaggaaaaagcggtgaagcggtgcggatattttatgtcggttgctacgaaaaaggtacggaggatgggctttgctggcatcttctgacctccgaacccgtcaacagtcaggaagaggcccataaaatattcagttattacgagcgccgctggctgatagaagaatttcacaaagcatggaaaacgggcgacacgcaggtagaagcgctgcgtatgcaaagcaaagataatctggagcgcatgatagtgctgctggcctttattgcggtacggatacaccagctccgttttatgggtctgaacaaagaagaggcagagaaagagagcggtgagacagtattaagccccctggcgtggaaattactgtggtcaaaacaagaaaaacggcgtccgccgaaaaaagccccgagtttgcattgggccttcatcaatctgggaaaactggccggctggtacgattccaaacgcatgggtcgagtcggatgggaacgactttgggaaggttggtttcggctgcaaaccctgatagacggctatttgctggctaaatcggttgatttggagatctga

SEQ ID NO: 2065 - DNA, 114 bp, Xenorhabdus bovienii
  Coding DNA location: Contig name=SeqID_16866; Position on contig =123244..123357bp; Strand=-
ttgccggcccgatcacgtcgggcgggcagggactggttgaacgggcggccagcaaggccctgcagaaagccagccagttattgggcggcggcgggggcacggcctgtctcttga

SEQ ID NO: 2066 - DNA, 1479 bp, Xenorhabdus bovienii
  Coding DNA location: Contig name=SeqID_16866; Position on contig =123318..124796bp; Strand=-
atgagcgaacaccctgagaatttaatcatccgggcgggcggcagcccgcagaatctgccggaatttgcggttatccgcgacgaaatcaacaaaatcagccacccggcccagccggaagtcaattgggtgctggtggaatcgctgtcactgaccctgttccgccgtaacggggtcgatttgcagacggcgatttactacacgctggcgcggatgcagctgaacgggctggcgggctttaccgaaggctgtgaactgctggccggggtgatagtcagtgagtgggacgccctgtggccgccgcagccggcggtgcgcacggatttactggaatggttccacacccgcaccggcagccagctgcgccagatggatttcggcaccggcgacctgcggatgatttaccgggcggagcgggcgttgcagctgattatcgaccggttgcagcagtccgacctgaaacggctgccgcgggtggagaacctgctgtggttcttccagaacgcggcgaaaaaactggaaaaaccgcggccggccgcgaaaccggctcagacgccggtgcagatgccgccgctggtctacctgtcccagtccgacaccgagccggaaatgccgccgccgtccgcgccgccgcgccctgaccgcccgccggaagcggacagcccgcgggtacgggtgcagtttcctgagccgccgcggggttggagtgcgtggcagggctttggcctcggggcattattgggcgtgttggtcctggtgggcagcgggctgctgttctaccaaccgctgcaccagcagctcacggctatcacggctcaccccgcgggcgcccggctggcgtggctgtaccagtccgaactggcgggctaccagcgccagctggaccggctggccgagacgcccctgctggcgacgtgggacgcggcccgcacgctgactgacaccgcggaaaaacaatggccggattcggccgagcagcggagcgccacccgccagtggacacaggcgatgaccgcccgtatcgagagtatcccgctgaaaggcagctggcataccacccgcgaccagctccagcagctggccgacaaaatcctgttgcaggagcgtacccggggcagcttcacgctctcgtacctgaaaactgcggtctatgacctccagcgcagccacggcagcgaagtgccgctggaagaactgctgcgccagctcaacgcccgggtggcgagcggggaagcggtgccgccggtactgctgaaaggcattgatgaccgctttaacgccctgctcggccgctatgaccggttgcgtcaggcgaccgaaaatccggctgaaaaacagaccgagaaacagaccacacaccatgagtccaccgtcacccctgacggcgggcatgttggggggattagggggcgccaacaccccacgtctgccggttcaggggattgccggcccgatcacgtcgggcgggcagggactggttga

SEQ ID NO: 2067 - DNA, 2229 bp, Xenorhabdus bovienii
  Coding DNA location: Contig name=SeqID_16866; Position on contig =124875..127103bp; Strand=-
atgttcggcatttattgccatgtcatgcagtgccgcctgcgccagctgtacaccttctccacggtcagcgccctggtgatcgtggccatgtggggcggctggcattacttctaccagaaaaactaccaggccggggaagaggtgctggcgcaggcgaaaaacttcctgtccgtgccgccgccggacggggatgaccgttacggccacctccagctgccgctgctgaacccgatccgggatgcgaccctggcgtacggtaactaccatgagaaaaaatccttcctgaccgacatggcgctgtatcagggggacggggtcgggccgtatgtggaaggcacctacctgaaactgctggagcagcgtttcctgccgtcgctgatgcaggggctgctggacgacctgaaccgggcaccggcgggcagtgaggagaaactcgagatcctgcgggtgatgcgcatgatggaagacggcagcaagcgcaacaacggcctggtcgggcagtacatgcgcgcgcgctggagcaaggcgttccacggccagcgggatttacaggcgcagttgctgacccacctggattacgccctggcccataccgactggaaggggcagcgcgacagggacaatcaggacgccctcgcccgctttgcgccgtttattaagccgatgaaacaggcccagcaggagctgagtgcgctgaccatcaaccagcgggtttaccagaacctgcgcctcaaggcccaggataccctgtccgccccggttaacctgcgtgaccaaattgggccgagttttgacagcgtgtttattgccggcaatgacagccggctggtgatcccgcagttcctgacccgccacggcctgacggattactttgtccggcaggacaaggagctggtggagctgaccgagatggacagctgggtgctgaacctgccgctgaaaaccaacaagtacagcgacaccgatcaggggaatatccagcgtgagatcaccgaactgtacgtcggggactacaccgcccactggcgggcggcgatgaacaacctggaagtgcgggactttgaggatctgccgcaggccatcagcgccatcgagcaggtgatcagcggggaacagccgatcaagcgcgcgctgcaaatcctcagtgacaacacccggccgccggagttgggcggcgccctgagtgacaaggaaaaacaggcgctgctggcgcagtcggattaccggctgttaaaccgcatcagccgggactttgcgccggaaaccggggtactggttgagcacggcgacaagggcagtgccctgcagagcgtttaccagaaactgatggcgctgcaccgttacctgctggctatccagaactcgccggtgccgggcaaggcggcgctgcaggcggtgcagctgcggctggaccagaacaacagcgacgcgatatttgaagtgcagcagatggcgaaaaacctgccggagccgctgaaccgctgggtcggtgacctggccgagcaggcgtggcgggtggtgatgatggaagcggtccgttcgctggaagtggaatggaacgagacggtggtcaagcagtaccagacctacctggccggccggtatccgttcaacccggcggccaccgaagacgtgccgctgagtgagtttgaccgtttcttccggccggacgggacactggataccttctataagcagagcctgaaaccgttcgtggaaaacaacctgaccaccgggactgacgggcgcgagcttatccggccggacgtgctgaaacagctggcggtggcggaccgtatccgcaccaccttcttcaccccgcagaacgggctgggcacggcgtttgccatcgagccggtgagcctgaccggcaacaaacgccgcggcctgctgaacctcgacggccagctggtggattacgcgcacgggcgcagcaacgtggcgcacctggtgtggccgaactcgatgcgggcgggcacggaaagccggctgaccctgatgccggaccggagtaacgcggccccgcgcagcctgagcttcaccggcccgtgggcgcagctgcggctgattaacagcggcaagctgaccaacgtgcagccgggggcgtttgacgtgcgcttcgcggtggacggcggcgagataacctaccgcatttacatggacgaatcggacaacccgtttgcgggcggcctgttcagccagttcagactgccggacaccctctactga

SEQ ID NO: 2068 - DNA, 267 bp, Xenorhabdus bovienii
  Coding DNA location: Contig name=SeqID_16866; Position on contig =126999..127265bp; Strand=+
atgccagccgccccacatggccacgatcaccagggcgctgaccgtggagaaggtgtacagctggcgcaggcggcactgcatgacatggcaataaatgccgaacatgttgccattgtgaagaaattggcgggtattttcggtaaaaaagggaaattatggcgtgatttaacaggttctttgaaattggatgtatatccagtatttattttgcgagtggcttcgcaaaggtcaattttgatgatggaaagttgcgcagggtggcgataa

SEQ ID NO: 2069 - DNA, 492 bp, Xenorhabdus bovienii; identical to SEQ ID NO: 1438
  Coding DNA location: Contig name=SeqID_16866; Position on contig =127421..127912bp; Strand=+

SEQ ID NO: 2070 - DNA, 354 bp, Xenorhabdus bovienii; identical to SEQ ID NO: 1741
  Coding DNA location: Contig name=SeqID_16866; Position on contig =127849..128202bp; Strand=+

SEQ ID NO: 2071 - DNA, 336 bp, Xenorhabdus bovienii
  Coding DNA location: Contig name=SeqID_16866; Position on contig =128199..128534bp; Strand=+
atgacgacaccatctaatgcaggtacctgcatttacaaaatttcccagccagaacggtatcagaaagtcgtttaccgccccaaaggactcaaccgcaccactcctgccattaatttaagcggaaactggctcagtgaagccgggttttctgtcaatgatccgttaaaaatcagggtgatgccgggctgtttgatcatcaccgcccaaaatttccctgaactctggcattgcttaaaaagcctgaatgaaggtcaatgggatgatatcgctgttgccgactggctgcggcaatttcccggcaaactgaataaaacagggctgagaaaaaacacctaa

SEQ ID NO: 2072 - DNA, 105 bp, Xenorhabdus bovienii
  Coding DNA location: Contig name=SeqID_16866; Position on contig =128531..128635bp; Strand=-
atgcgaaccgcttcccaaaatgaaaatattgctatcaatcgctggaaagccgttcattctttgtgttcggaatgtttattttattttgataaaacagattgttag

SEQ ID NO: 2073 - DNA, 351 bp, Xenorhabdus bovienii
  Coding DNA location: Contig name=SeqID_16866; Position on contig =128679..129029bp; Strand=+
atgagtcttcaactttcattacagatggcagaactgccggaatgcgtgatcacaggcagcgcattgaggcagattggctttaccaccgatgcactgtttcgaattgcgcaatttgccaatggcttgatcctctcactgattgagccagaaaccgagccggatctcgccgccctgctccacgaaaccgaatttgaaccacatcaggggattgactgggtacgcgacaatggcgaactttatttggcgggcgactggttgactgaaagtggtttgttggatcatcctgttaccgttgaaacggcgtatggcacgattgtaataagagccgaactaccgattttgctggcctga

SEQ ID NO: 2074 - DNA, 351 bp, Xenorhabdus bovienii
  Coding DNA location: Contig name=SeqID_16866; Position on contig =129107..129457bp; Strand=-
gtgaacttacctgaattaaaactacagtcgggctggtttattttatcttatgaccggccttattattctgatgactcttcaatagcgattgaattgtgtcaatattttgatcgtcttattggttttcacaagaaaacgggatattattttgacgctcgttatgaaggcgatgagtatagtccagggggaaggattaacggtattttctctgtcacgtttcaaagattcaatttcgatataaatacatctggctatggtgatagtacatctacagaaaaactaaaaacagacagtatcagggaattttctcgctcgctgaatgattttgttgaaagggcagagcaacaataa

SEQ ID NO: 2075 - DNA, 210 bp, Xenorhabdus bovienii
  Coding DNA location: Contig name=SeqID_16866; Position on contig =130071..130280bp; Strand=+
atgtggctgattataaaacaaaccaatccggctggaattttacttcgggtaaaaatagtggtggaaatatcatattattttttcctgtcactattttataaacattggatttactatataaaaccgtgttcaataataaactttctatatcgtttagtgagtgttacgcttatcagtaaaaatccgcacgcattaattcattcaaaataa

SEQ ID NO: 2076 - DNA, 288 bp, Xenorhabdus bovienii
  Coding DNA location: Contig name=SeqID_16866; Position on contig =130268..130555bp; Strand=-
gtgcttaaagattgtgtacgtgattctcaatcctctcgtgagttactcatctctcatatgataattatgaattattctttctttgttttaaaatatcacccaactgattttctcttgttaaaagaatacttaaaaaatgatgatgatatgtttgtgaaaatattgtctctaatagttaatattggttttcatgtagataaaaaaacattttttgcattaggtctctctgaatatatcgataatgtgtcaagaaactatcatttattatataattgttattttgaatga

SEQ ID NO: 2077 - DNA, 651 bp, Xenorhabdus bovienii
  Coding DNA location: Contig name=SeqID_16866; Position on contig =130676..131326bp; Strand=-
atggagcgtgttttgctgtcaatttacaaatataaaacggaatcattttttaacgaaagcactttgccttttgataatcaatttttgctttataaatctgatagaaaaaggccgagaagagatgagagtaaaaatagagaattatgctttaagcgtgggtgctatggtgattttcttaaggtaacttcttgggattatcttttcagcgaatatatgcctattgaatattggaaccatattccagacgaatttataaaagataaaaatatttttggatttgcaaatatagattattacaatgtcaatttgataataaatataatgttttttatttttgatattaacaaggaagcgtgtttttatcgaaaggaattatcaaaattctattatcaatatcaagcatctcattacaaaagtaacgataaaacacgcatttttttcttgggaagattatttgcagaggtgtgggtctgggatctggcttacaagagattatccataagaaatggtgagttattatatacggccgaaagcggagtagcttatcatatccatgatttaattgaccgattttgtgatatgattagagcattttctctacctaaataccttcaggaaatgcttgattttataaatccaatgttacattag

SEQ ID NO: 2078 - DNA, 120 bp, Xenorhabdus bovienii
  Coding DNA location: Contig name=SeqID_16866; Position on contig =131281..131400bp; Strand=+
atgattccgttttatatttgtaaattgacagcaaaacacgctccatctcttattattctagtacgtaatgacaaattttggagatacaatatttgtgaaaataaaaaacaaacctcataa

SEQ ID NO: 2079 - DNA, 1032 bp, Xenorhabdus bovienii
  Coding DNA location: Contig name=SeqID_16866; Position on contig =131436..132467bp; Strand=-
atgcttttttcaatttacaaatataaagtagagtcattttttaacgaaaaaatgccacctttagatgatcaatttttatgttatagaactcatgacgaagatcaaattaataatgaaaatttattttttaaaaaagaatataatggagaatatcttcaggtaagattttgggagtatctctttagagaatatatacccgaagaatattggaatcatatcccagatgaatttataaaaaacataggaattcctgattttgttcatatggattattctggggttaacttgatccttaataatatgtttttcatttttgatattcatagggaagttcctttttatagaaaggaattgacgaaattttattgccaatatcaattatcacattacgaaggagacaataatatacgtcttttcttcctgaaaagattatttggtgaaatgtggatttggaatcttgcctatgataagttatccataaaaaatggaaatttaatatttaagtcagaaagtggagctgactataatatccatgagttgattgatcggctatgtgatattattcgagttttttcactaccagatcaccttttggatatgttggattttatcaatccaatgttacatgaatgtattgatattatattgggtaagaatggagtctacgattttaattttgatgatgttaacctaaaatacattgatggaagttattttttagaaacttaccgaaataatcaagaagaaattttcaatgcaattaaaggttgtgtgcgtgatggtcaatcttttcaagaattatttgtctctcatgttattgttatgaattattcttgttttatacttaaaaatagccctgatgaaatactacaattaaaatctttcttaagtgatagtgaaaaaactttcattaaattattatcattggcaatagatattaatttttatgtgtgggaagattcatttgatgggttaaatttagaagaacacttagaaaaagtagagaaaagcgattttttgatcgataaataa

SEQ ID NO: 2080 - DNA, 4722 bp, Xenorhabdus bovienii
  Coding DNA location: Contig name=SeqID_16866; Position on contig =132471..137192bp; Strand=-
atgggaataatgcaggagattgtgacacgttccgcgcgggtgggtgccatgcactcggggcggcgggttcaggggccgaacggccccgcagcggcccgtgaaggtgatcctatccagcacaccagctttctggccgcgctggcgggggtggtggcgggtgctctagtggcggcagcggccgttgctgccaccgttgccgttgcggcgttggtgatcggcacgggcgggctggcctcggtagcagcctttgcactgggtgcgtatgctgtacacgagctgggaggcgtgattagtaatgtgaccgcctcagtaacgaatatggtgaacagcctggggtcaccggatggggcggtagacagcggttcatcgaatgtgaagatagagggcaaagccgcggcccgggcagaagcggacaaagcgaaatgcagtaaacacccgaccccacccctgatcgcccagggcagtgaaacggtgtttatcaacggccacgccgccgcccgggtggatgacaaactggtgtgtggcgcggcgattaaaggcggcgccggtacggtatttatcggctcgggtaagcatgactaccttgaagtgcaggaagaattttctctgctggagcgggcggtgctggtcgcggtggaatttttggttccccccacgcggggcgggctgaaaatcgcgggtaagctgttgacccaacaaggccgtcaggccctgctcaagcttgcgcggaaagaaggcaatgcgttgctggccagcgctaaagccggtgcccgggcagccggaaagcgggcaaaaaatgcggtaaaagacccgaaagcggcggccagcgcgttggcggctggggcgaaatcgggggcgaaaaaagcggcggcctacacgaaagccgaggtgaagcggatcgccggcaatgtcaggacggctcccggcagggtaatgaatggtgcccgaatgggggcagcgaaagcacgccagtcggttcccaatgcaaaaacaggctgttccaaccgggtcggttgtgccaagcgtgccttccacgaaacgaaaggggcgaaacgttactgggaagcggccaagcgtttcttcaaatctgacccgattgatgtcaccaccggggccgtgtttgcccagcataccgagattgagttgggacaaacactgcccctgacgtttatgcgcagctggtcacccggcgagcggggattgctgggtgaaaactggacagatacgttttcaggccgtgccattgtcatcggcgaccgggtcgagatccgtaccaccgaaggggcttcgctctactttatcctgaccccgtcagaccggagcagcatgaacccggagcaccctgaatttactctgagccgggcggaggcggggtatctcctgcatgaacgcaataatccggtcagccagcatttcagcgtgcccgtgccggcaaatgacgggagccagcggtggttattgggcgctttgcgcgatcattacaataatgtcatcgggttccattacagcgaacagcatcagctggtcagggtgacgcacagcgatggtccggcgctggtgcttctgtaccgtgccgatgggctgctggaagaaattcgccgtaccgacagcgatctgaatgacgtgatgacgcattaccgttaccacgacaacggctggctggccgaggcggacagtcgtcagcattttcatctgttttatgactataacgcacagggcctgattagccgctggtcagacggcagccagaccgtggtggattacacctatgatgcccaggggcgttgtaccgatacggtggccagcgggggatactatccggttcactttgattatgaaccgggcctcacccgggcgagtaaccctcaggggcataccaccacctggcaccataatgaccagcagcaggtgacacagctggaaaccccgtgcggccgggtggcccgttatgaatacgatgcatgggggaatttgtgccgggaaatttcgccggaagggcaggttgtcacgctggactatctggccgatacggggctggtcaccgcgtttaccaatgcgatggatctgacctggcagtatgactatgacgaccatgaccgtctgatcagcgtcaccgacccacgcggccgttgctgggcacagcagtacgacgataacggggcgccggaatgctttattgccccgaacggcgataaaaccaccctgatccgcaatgaatttgggttggtgacgaccgtagaggagagtgatggcagcacgcggacgctggaatatgaccgccatcaccggttaacgtcgctgtttgatgaagacaagcgcagcctgcaatggggctacgacagtcaggatcgcgttcagcagttaaccacggtgggcggggcccgctggcgttgggaatatgaccgccatcataatgtggccttaagcgaccggcccaataacagccttgagcgtttccgccatgaccgtcagggtaacctgaccgaatggactgacgcccgcggggtggtctggcacattgaatacggcccgtttgacctgccggtagcccgggtggatggcgaagggaatcgctggcagtaccgctatgacgttgactgcctgcaactggtggccgtggttaacccgcagggggaaagttaccgctatcagctggatgccgatggccgggtcgtgaccgaaaccgattacgcggggacacagtggcattatgcctatgatggcaacagcaactgcattgaaatgcgggatgcactggggcaggtgacccgctttgaatatgacgccgcccagcggatgacggcgatgcacacgccggaaggcaccaccacctaccgttatgacgtgctgggacatctgctggccgtggccgcgcctggcagcgcccctatcacgtatgaatacgatgaacaggatcggctggtcagggaaattcagcagaacggggaaatccgccgtgactacccggagaaccagagtgtcagccggacagtcctgaccgacgggcaacaatggcacatgcaggcggcggtcaataacgcgggggaagtgaatgtgctgatcctcggcggggaggaatgcctgacgcgctcccgggatgccgaggggcaggaatggcaccgccagtcaaacaagggttttattctgcgccaggagtattccctgatggggcagctgactgcgcagcgtgccgggcgcaacaccgagatttttaccgccgatgaagtggcagatattccccagcccaccctggccgggctggataaagaataccgctacgatgcggcgctcaatctggtggcggcgaatgatgagcggcaatggctgcgttatgtagtcaacggcaacggccaggtcacgtcggtcagtgacggcgaccgcttgcgggaacactaccagtacgatgccgccggttacccatcccgccgttttgatggcctcaatgagattgacggggaatggctctaccagaaagggcaccggctgagacgtgtaggcccgcatctgtttgagtatgatgatgcggggcggatgacggcgatgcagcaatggcaggaaggccaccgcccgcaactgacgaaattccgctggaacagccagaaccagctgacccatgtgctgaccccgggcgggcagcagtgggcctaccgctacgatgcgttcgggcggcggatagagaaagactgtgcacagaccggcatgcggactacctacctgtgggatggcagtacgccggcggaaatccgtgaataccgccacgaccgcctgtacagcctccgccatctggtgtttgacggctggcagttactggcgcagcaggtgcagtttttcaccccgaacccggaaaaccgccgtgaactcattgctggcgacatccggacgcactatgcggtctgtgccccgacgggcgaaccgctggcgttgtttgatacggccggtcaccgtgtctggcgccagccggcgtattcactgtatggcctgcgactgggcgctgcgggtgaaaatgccgagtttgatccggggctgaaatttgccggacaatggctggatgaagaaagcgggctcttctataatcggttccggtattactcgccgctggcgggctgttacctgacgcccgatccgataggcattcagggcggggaaaatacctacggttatgtaccgaatccgaccgggtttattgacccgctgggcttggcgaagaaaaaaccgaaggaagatccgagaaggccagcccctgaagtacctaaagtcaaagaggagacgtataaaattgtgcggcacgttagcccagaagaattagaaaatattaaaaaggcgggcgggaaaattgtgttgcattatgacagtccgcgtgtggctcgttggattaatgtacctgctgaacaacatggatatgggacggttaaccctaatgaacaaaagaacatacacagggtgacatatacagtaacggaaaagggatttaggatgttggatatgtcaaataggaatctagccttagacttttggaaattcgatgatggtgaagcaggtgctccagataaagtgttttataaaggtaacgagaaaggtgctcgtggaataggcgtaaacgtattgaaagacttcaacaaggaaattatcagtgctcaatatgaaacaagaataggtaaaacaaaaaaatatagtgaaccaaaaccgattattgaatgtaaaggcaaaaaaaaggggaggtaa

SEQ ID NO: 2081 - DNA, 420 bp, Xenorhabdus bovienii
  Coding DNA location: Contig name=SeqID_16866; Position on contig =137206..137625bp; Strand=-
atgagcgcacacccttaccagatgaacgaaggcaccctgactattccggccaactggcgtgatgaatcgatgcacgtgtttgtcctgccggatgacagcggggtcaatctggtgattaaccgcagcgccgtccccctgggaacggaccccgaagctttttatgcccaaaccctgacgcagtttgtgacccacctgccggactatcaggaacatcagcggctgcaaattgaactgagtggtgaacccgcgtggcggctggattatcagtggcaaagcccggagggggaaatgcaccagacggtggtgatgcaaatccggggcagtcagttactggcgtttaacctgacgtcaccggagccgtttaatgagggacaacgccatgcgctgctggatgtgatcaccagcttccatgccgcctga

SEQ ID NO: 2082 - DNA, 261 bp, Xenorhabdus bovienii
  Coding DNA location: Contig name=SeqID_16866; Position on contig =137624..137884bp; Strand=+
atggtcgtttcctttttcactcgtttaagattgtcactgtattggtctgttcagcccgcgctcacgggcggttatcgggctgagatttttgttaccggccttgccgcgataacggtctgtttggttctttttcgcttagttcagggtgatctggctgccgttcacagaaacccccccgccattcaccgtaatgttggagccgccaaacgagataagaataccgtccgtcgtcatctgaatggtgccatcgccgaccgttaa

SEQ ID NO: 2083 - DNA, 1452 bp, Xenorhabdus bovienii
  Coding DNA location: Contig name=SeqID_16866; Position on contig =137759..139210bp; Strand=-
gtgttcagtctgcgccatccgcacccggcgcgggaattctgcgtgcaatatcaggaaagcgactttaccttcctgcaacggctgacggcggaagagggcatcttttacttcttcgaatgcggcagcgggcggaacacgctggtgtttgccgatgacgccggctccgtgccgccgggcattgtgctgccgtaccagccgggagaaggcagcacgacgggggtgccgtcggtgggcagctttacctgcagcgcccaggtgcgcccggcacaggtgcagctcaaggactacaccttcaaaaacccggcgtggccggcggagttcagccggcagatgaaggaagacaccctgcagcagcggtattacgagcactacgactacccggggcggtttaaggacgaagcccacggcgaagcctttacccgctaccggctggaagcgctgcgcagcgacgcggtgacgggacagggcagcgggcaggccatcgctgtccagccgggtaagctgtttaccctagacaaccacccgcgggcggacctcaaccagccgtggcaggtggtcagcgccagccatacgggcagccagccgcaggcgcgggaaaccgccagcagcgacagcggcaccaccctgcacagccagttcagctttatccgccataaccagcactggcggccggccccgcggcccaagcccaccatcgacggcccgcagattgccaaggtcgtcgggccggcgggggaagaaatcttctgtgaccagtacgggcgtatccggctgcagttcccgtgggacagatacggaaaaagcgacgaccagagttcctgctggatacgggtgagccagccgtgggccggccagggctggggcatgctggcgataccgcgcatcggccaggaagtggtggtggatttcctgcacggcgacccggaccagccgattgtgaccgggcgcacttaccacgccagcaacatcccgccgggggcgctgccgggcagcaaaacccagatggcgttccgctccaagacccacaagggggaggggtataacgaactgctgtttgaggatgcgaagggcagcgagcagttagcgctgcatgcgcagaaggacatgcacaccacggtgaaagatgcccagagtctggtagtcgaggcgggtaaccgtaccctgaccattcagaaaggggatgagttcaagacagtcacggaaggcaatctgacggagagcatctgccaggcccgcagcaccacggcgaatgcggtctcggtgacgacgaacgcgaatggtaccgtgccgggcacgcaactgtatgaagcgcaggatgccatcaccttaacggtcggcgatggcaccattcagatgacgacggacggtattcttatctcgtttggcggctccaacattacggtgaatggcgggggggtttctgtgaacggcagccagatcaccctgaactaa

SEQ ID NO: 2084 - DNA, 453 bp, Xenorhabdus bovienii
  Coding DNA location: Contig name=SeqID_16866; Position on contig =139232..139684bp; Strand=-
atgataatcgcatcacgttccactatgacgacctccatgatgagggaatacctcaactggcccagatcacgcactccgatggttaccgtctgctgttggattatgaccagcaccgactgtcggtgcaggggattgctgggctcatcgcgtcgggcggccagcatgcggccagcaaggccctgcagaaagccagccagttattgggcggccgacccggccattgactttccggcggtgctcgaccgcagcgcgaccctgaccattttgcaggagggggtggagcagcgcagtatcaccggcatggtggcccgtttcgagcagggcaacaccgggctgcaccagaccacttaccagatgagcatctatccggacttgtggcgcaccaccctgcggcagaactcgcgtatcttccagcagctggacatcgccgctatcctcaccatgctcctgtaa

SEQ ID NO: 2085 - DNA, 210 bp, Xenorhabdus bovienii
  Coding DNA location: Contig name=SeqID_16866; Position on contig =139672..139881bp; Strand=+
atgcgattatcatggcggtcacggatacccgacagtgacaacacccgcactatccggcaacaataccaacgccagcaaaaccagctcagtgagattaagctgaggatgcgagaactgattggggaatacaaaacacataaaagagagagaaaagcagggattgagaagctacaggcagcgctagattatcatgggtatgcaccacggtag

SEQ ID NO: 2086 - DNA, 402 bp, Xenorhabdus bovienii
  Coding DNA location: Contig name=SeqID_16866; Position on contig =139977..140378bp; Strand=-
atgacaactgaaaatagtgtgcatttatggattggaaataatttttcctctgaagacgaatatgtgaaatattttgagctagattattctgttgaaggaaattttgatgatcctaactataaactttgccagttttgtaaagatattggtcttcagtggtatgatgaggattttataggaataattccacgccgcgatgaaagtgtctctatagatgaaattttaattgatgctgctgttgatcaaagtgaatttcaatcaataaaagacatatgtgatagattaggaataaaagaagcaaatgccattttttggtatcaggattcagaattacacattaaccctccatataaagaacaatataatggattgaaatatatagggttgtttgaaggtgactag

SEQ ID NO: 2087 - DNA, 4578 bp, Xenorhabdus bovienii
  Coding DNA location: Contig name=SeqID_16866; Position on contig =140375..144952bp; Strand=-
atgggattgaccgatgatatcgtcgcgcgaattgcccgggtaggggcaactcacgcggggcaacgggttgcccctgcacaagggccgagaggccctgcggcggcgcgggaaggggaccccatccagcacaccagttttctggccgcgctggcgggggtggcggcgggtgctttggtggcggtggcggccatggctgccaccgttgctgttgcagggttggtgatcggcaccggcgggctggcctcggtcgcggcctttgcactgggtgcgtatgctgtaaacgagctgggaggcgtgattagtaatgtgaccacctcagtaacgaatatggtgaacagtctgggatcaccggatggggtgatagacagtggttcgccgaatgtcaagattgagggcaaggcggcggcccgggcggaagtggataaagcaacatgcagtaaacatcccactccgcctctggtggcgcagggcagtgaaacggtgtttatcaacgggtctgcggccgcacgggtggacgataagctggtgtgcggggcggcgattaaaggcggggcgggaaccgtctttatcgggtcgggtaaacatgactatcttgaagtacaggaagaattttctctgctggagcgggcggtgttggtcgcggtggagtttttgatgcctccctcacggggcgggctgaaaatcgcgggtaagctgttgtctcaacaaggccgtcaggcattactgaggctggcacgaaaagaagggaatgccctgcttgcctcggccaaattgggggctcagaaggccagggcggccgcccaaaaaatcgcgaataccgtcatatcgggggcgaaggcgggggcgaagaaagtcggtgatgtggctaaaaaagccgcgaataaagtgaaagccagcgccatgaaggtgatgaacggcgcgaaaatgggggcaggcaaagccaaggaggggcttaacaacgccaaaaagaatctgtcggatcgatgggactgcgccaaaacggcctttggggaaacgcaaggggctaaacgttactgggaagcgaccaagcgtttcttctcgaaagatcccattgatgttgtcacgggggcgctgtttgaccagcgcacggatattgccctgggacagaccctgccgctgctgtttatgcgcagctgggtgccgggagaacgggggctgctgggagaaagctggacagacagtttttcgggctgcgcggtgatcatcggtgaccgggtggaaatccgtactaccgagggggcttcactctactttatcctgaccccgaccgaccggagcagtacgaatccggagcacccgcagtttaccctgcgccgcgcagagacgggatatatcctatatgaacgagataatccggtcagccagcatttcagtgtggcgatgcccgctgaggatggaaatcagacatggaaactgggtgcgttacgtgaccgtcacgataacacgatagatttccattacagtgaacagcagctggttaaggtgattcatagcgatggcccggaattggcgttgctctaccgtgaagatggcttgctggctgaaatccgccgtatcgacacgggattgaatgacgtgatggcccggtacggttatcacgataacggctggctggcggatgcaaacagtacccagcagtttcatctgttctatgagtataacgcgcaggggctgattagccgctggtcagatggtgatcagaccgcggtggattatcgctatgatgaacaggagcgatgcatctataccgtgggtagcgggggctattatccgggggtttttgactatgaaccgggtatcactcgggtaactaacccggaaggccatatcaccacttggcaccataacgaccaacaactggtgacacaggaggcaacaccgtgcggcaatgtcacccgttttgagtacgatgagtggggaaacctgcgaagaaaaatcctgccggaaggacaaatcttaacgctggattatctggcgaatactggattggtatctgtttttacggatgccatgggggcaacgtggcgttatcactacgatgatgccgatcgtcttgttagcatgacagatccgttcggccgtgcgtggtggcagagctatgatgataacggtaatccggcatgctttatggcacccgatggcagtaaaactaccctgacgcgtaatgaatttgggctggttatcgctgccgaagacaacgaggggcgcaaacggacgtgggaatatgacggtcaccagcggctgacccgactgtttgatgaagaaaaccgtagtctgaaactgggttatgacagccatgatcggttgcagcggctcatttcgggtggcgggtcactgtggttgtgggagtatgaccgtcatcaccgggtgtctttaagtgaccgcccgaataacagtctggagcgttttcgtcatgaccgtcacggcaacctgaccgaatggacggatgcccgtggcgtaaaatggcacattgaatacgggccgtttgatttgcccgtgggccgtgtagacggtgaaggccaccgctggcagtatcgctatgacctcgacagcctgcaattattggccgtgattaacccgaagggggaaagctactgttatacgctggatgcggacgggcgggtcattactgaaaccgattatgcgggtacgcagtggcactatgcctacgatggtaatggcaactgcatcaagaaacgcgacacactgggtaataccacccactatgaatacgatgccgctggtcggatgacggcgatgcatacgccggaaggcagcacgacttaccgttacgatatcctcggccgcctgctggaagtttccgcacccgagagtgaacctctgacgttcgactacgacgaacaagaccgactcgtcaaagaagtccagccacacggggtaatccagcgtgactacccggacagtgcgacggcagaaagaacgcttcacacttcggatggccgctgctggcaggcgagcacacaaatcaacaacgtgggtgaacttaagctgcttcgcatcaatggtgagcacacgcttaatcttgaacgggacgaagacggatacgaatggcaccgccagtcggataaaggctttatcctgcggcaagcgcattccctgatggggcaactgaccgctcaacgtgccggatgcaataccgagtttttttcggcgcacgaagtggcggatattccgcagcccacactggcgggtctggacaaggaataccgttacgacgccgcgctcaatctggtggcggcgaatgatgagcggcagtggctgcgttacgtggtcaacggcaatgggcaagttacctcggtcagtgacggtgaccgcctgcgggagcattatcagtatgatgcgtcgggttatccttcccgccgctttgacggcctgaatgagatagacggggaacggttgtaccagaaagggcatcggttacgccagcttggacaacatttgtttgagtatgatgacgcggggcggatgaccgccatgcagctctggcaggaagggcaccgcccgcaactgaccaagtttcgctggaacagccagaaccagcttatcggggtgctgacaccgggcggccagcagtgggactatcgctacgatgcgttcgggcggcgcacggagaaagtgtgcgggcaggcagggatgcgcacgacgtatctgtgggacggtgatgtcccagccgaaatccgggagtaccggcacaaccggctgtacagcatccgtcatttggtgtttgatggctggcagttgctggcgcaacaggtgcagttttttacgttgaacccggaaaatcggcatgaactgttggccggggagattcagacccagtatgcggtgtgtgcgccgacgggcgagccactggcactgtttgatgccggcggtcaccgtgtctggcgtcagccagcgcagagcctgtatggattgcgccttggcgtaccgggtgaaaatgcggaactgaatccggggctgaaattcgccggtcagtggctggatgaagaaagcgggctggtctataatcggttccggtattattcgcctgttgccagttgctatctgacgccggaccccattgggctgctggggggcgaaaacccttatgcttatgttcataatcccacggggcagatcgatcctttgggatgggctgaatggaaacctggtaagtttgatgagtggtttaataaggccacagttcaagacgttatagataataaagcatctgtttcttccgccttaagaggaaatggaggaaaacatgagatgtttcctgtttctttagctgctaaagcaaaagaattaggttttacagcagaagaactaaaaaaatatgttgtagatacagataagattacattcacaaatgtaacagacgccaaaggtaatcctgtaccagatggaggacaccatggaagtagagcaggtaggcattttcataataaattaattgcagatctgaaagaagctactggtaaatttggtgcgaagaaaataatggtcaggcaccatcgtaatcatatgatatacagtgagaaatgcggaagatga

SEQ ID NO: 2088 - DNA, 420 bp, Xenorhabdus bovienii
  Coding DNA location: Contig name=SeqID_16866; Position on contig =144965..145384bp; Strand=-
atgagcgcacacccttaccagatgaacgaaggcaccctgactattccggccgactggcgtgatgaatccatgcatgtctttgtgttgccggatgacagcggggtcaatttggtgattaaccgcaccccggtgcccatggggatggatgccgccgcctactatgaacaaacgctgacgcaatttgtgactcatttgccgggttatcaggagcatcaacgattgcaaattgaactgagcggggaaattgcgtggcggctggattaccactggcaaagcccggaaggggaaatgcaccagacggtggtcttacaaatccggggccgtcaattgttggcttttaatctgacctccccccagccctttaatgctggacagcgtgatgccctgctggcggtggtcaccagttttcaggctgcataa

SEQ ID NO: 2089 - DNA, 138 bp, Xenorhabdus bovienii
  Coding DNA location: Contig name=SeqID_16866; Position on contig =145383..145520bp; Strand=+
atggtgttttccttttcgctctttttaagattgtctgtttattcatctgcccagccaacgcgggaacgccgttggctggcttcatcgtgttatcggcttattcgccatggtattctgttttggttttcagccggttaa

SEQ ID NO: 2090 - DNA, 2163 bp, Xenorhabdus bovienii
  Coding DNA location: Contig name=SeqID_16866; Position on contig =145517..147679bp; Strand=-
atgtcgataaaaaagaatatagcgaaactgaagaaagggcgggcgctggtccagcagggacagcaggccgctaacatggcaaaacaggcggcgggcgtgttggggggattaggcggtgccggtaccccacgtctgccgtccattcagggcattgccgggccggtggcgtcggggggattagggggcgccagctcaccacgtctgccggttcaggggattgccggccccattgcgtcgggcgggcagggactggttgaacgggcggcgggcggccagcatgcagccagcaaggccctgcagaaagccagccagttattgggcggcgggggcggcacggccccgagcgggctgcagtttaccctgactgcgggcggcctgccgccggaaacctttgtggtcaccgatttctcgctgaccgaagggttttcccagccgtttcacctgacggtcgggctggcgagcgccgacccggcgattgactttccggcggtgctcgaccgcagcgcgaccctgaccattttgcaggagggggttgagcagcgcagtatcaccggcatggtcgcccgctttgagcagggcaacactggcttgcaccagaccacctaccagatgagtatctatccggatttgtggcgcaccaccctgcggcagaactcgcgtatcttccagcagctggacatcgccgctatcctcaccacgctcttgaaagagcacggtatccgcgacgtggtgttcagcttgcggcatccgcacccggcgcgggaattctgcgtgcaatatcaggaaagcgactttaccttcctgcaacggctgacggcggaagagggcatcttctacttcttcgaatgcggcagcgggcggaacacgctggtgtttgccgatgacgccggctccgtgccgccgggcattgtggtcccgtaccagccgggggaaggcagcacgacgggggtgccgtcggtgggcagcttcacctgcagcgcccaggtgcggccggcacaggtgcagctcaaggactacaccttcaaaaacccggcgtggccggcagaattcagccggcagatgaaggaagacaccctgcagcagcggtattacgagcactacgactacccggggcggtttaaggacgaagcccacggcgaagcctttacccgctaccggctggaagcgctgcgcagcgacgcggtgacgggacagggcagcgggcaggccattgctgtccagccgggtaagctgtttaccctggataatcacccgcgcgccgacctcaaccagccgtggcaggtggtcagcgccagccatacgggcagccagccgcaggcgcgggaaactgccagcagcgacagcggtaccaccctgcacagccagttcagcttcatccgccacaaccagcactggcggccggctccgcggcccaagcccaccatcgacggcccgcagattgccaaagtggtggggccggcgggggaagaaatcttctgtgaccagtacgggcgcatccggctgcagttcccgtgggacagatacggaaaaagcgacgaccagagttcctgctggatacgggtgagccagccgtgggccggccagggctggggcatgctggccattccgcgcatcggccaggaagtggtggtggatttcctgcacggcgatccggaccagccgattgtaaccgggcgcacctaccacgccagtaacatcccgccgggcgcgctgccgggcagcaaaacccagatggcgttccgctccaaaacccacaagggggaggggtataacgagctgctgtttgaggatgcgaaaggcagtgagcagttagcgctgcatgcgcagaaggacatgaacaccacggtactcaatgaccgcaccacccgggtgacgcaaaaccacaccgaaacgattggcggcaagcaggtgataacggtgcgccaagaccgccataaagagattgtgggcaaggacgtcactgccattaataaagagcaagaggtgacggtgaatgagaccagcctgctgagtgtgaagaaaacaatcaccctcaaatcccttgagggcgatatcagcatcagcacggccggggccagtattacgctgaaacaatccggtgaaatcaacattgagggaaccacggtcacgattaacggttcgaacgtgattaccttgaattaa

SEQ ID NO: 2091 - DNA, 1392 bp, Xenorhabdus bovienii
  Coding DNA location: Contig name=SeqID_16866; Position on contig =147695..149086bp; Strand=-
atgagtgaacaccctgaaaacttgattatccgggcaggcggcagcccgcagaatctgccggaatttgcggttatccgcgacgaaatcaacaaaatcagccacccggcccagccggaagtcaattgggtactggtggaatcgctgtcgctgaccctgttccgccgtaacggggtcgatttgcagacggcgatttactacacgctggcgcggatgcagctgaacgggctggcgggctttaccgaaggctgtgaactgctggccggggtgatagtcagtgagtgggacgctctgtggccgccgcagccggccgtgcgcacggatttactggaatggttccacacccgcaccggcagccagctgcgccagatggatttcggcaccggcgacctgcggatgatttaccgggcggagcgggcgttgcagctgattatcgaccggttgcagcagtccgacctgaaacggctgccgcgggtggagaacctgctgtggttcttccagaacgcggcgaaaaaactggaaaaaccgcgcccggccgcgaaaccagttcagtcgccggtgcagatgccgccgctggtctacctgtcccagtccgacaccgagccggaaatgccgccgccgtccgcgccgccgcgccctgaccgcccgccggaagcggacagtccgcgggtgcgggtgcagtttcctgagccgccgcgggggtggagtgcgtggcagggctttggcctcggggcgttgttgggcgtgttggtcctggtgggcagcgggctgctgttctaccaaccgctgcaccaacagctcacggctatcacggcgtccccggccggggcccggctggcgtggctgaccgagcccgcactggcgggctatcagggccagctggaccgactggccgagacccccctgctggcgacgtgggacgcggcccgcacgctgactgacaccgcggaaaaacagtggccggagtcggccgagcagcggagtgccacccgtcagtggacacaggcgatgaccgcccgtatcgacagtatcccgctgaaaggcagctggcataccacccgcgaccagctccagcagctggccgacaaaatcctgttgcaggagcgtacccggggcagcttcacgctctcgtacctgaaaactgcggtctatgacctccagcgcagccacggcagcgaagtgccgctggaagaactgctgcgccagctcaacgcccgggtggcgagcggggaagcggtgccgccggtactgctgaaagggattgatgaccgctttaacgccctgctcggccgctatgaccggttgcgccaggcgaccgaaaatccggctgaaaaacagaccgagaaacagaccacacaccatgagtccaccgtcacccctgacggcgggcattaa

SEQ ID NO: 2092 - DNA, 3570 bp, Xenorhabdus bovienii
  Coding DNA location: Contig name=SeqID_16866; Position on contig =149164..152733bp; Strand=-
atgaaatggccctctttgtcatccttggcgccgttgaaatcggccttgccggcgctatcaaaatttaaatccctgccgcgtctcaaggccacgatggcgctggctctggcacttatccccggcctactgctgatcgcggtctgggtgtgggggccggaatggaaactgcgcaacgacaccccgctggacagtctggcggcgcgctggctggcgaccgccctcatcatcctgatggtgctgctctggatcggcatcaaagcgtggcgccgcctgcgccagctggaaaaactcaacctggacgtcgagctgaaaggggttgatccggtgcgggtcgatatcgaacaccaggcccgttacctcgatcactggaaagcccagctgcaacgccatctggacagctataactacctgtaccagcgtccgtggtacatgatgatcggcagccaacagagcggcaaaaccacgctgatcaaggaaggctataaactgtccgacatcgcggcgccggaatacctgcgccaggatggcgacatttcgctgaggctgcgctgctggctgggcgaaaaagcggtcatcatcgatcccgagggcggcctgattgaccagccggtgccggtcaacagtgacaaaccgcagatcaacagccgcctgtgggaatccctgctgaactggctgacggaaaaccgccagcgccagccgcttaacggcattattctggccgtcgataccctgcgcctgctgaccgacaaccgggagcagcgggatcgctacgtgcgggaaatccaccagcgcctgcaaaacctccgcctgaccttccacagccagctgccgctctatctggtcatgaccaaaatcgacctgctgcacggcttcgaagcgatgtacccgtcgctggatcgccggcagcgtgaccaaatcctcggcgtgaccttcagcctcaataaccgggatgaaaaagcctggcgcagcgagctggaacagttctggcagcagtggatggccaacctcaacggggcgatgccggacatgatgctcaacggcgtcgatgccggccagcgcagcgccctgttcagttttacccggcaggtccaggggctgcacagctatatcgcgcagatgctggaagacatcctgtacaacgatgaacaccaccgcccgatgttgcgcggcgtctacctgacctccgcccgtcaggtcggccagatggatgacctgttcacccagtccgcgtcagcccagtatcacctcggctcgcaggcgttcccgacgtggccggcgggcgacaccctgccgtactttacccaggccctgtttgaggaggtgctgctggcggagccgaacctcgccgcagaaaaccgtctctggctcagccgcaaccgccgccagctgtacaccttctccacggtcagcgccctggtgatcgtggccatgtggggcggctggcattacttctaccagaaaaactaccaggccggggaagaggtgctggcacaggcgaaaaacttcctgtccgtgccgccgccggacggggatgaccgttacggccacctccagctgccgctgctgaacccgatccgggacgcgactctggcgtacggcaactaccacgagaaaaaatccttcctgaccgacatggcgctgtatcagggggacggggtcgggccgtatgtggaaggcacctacctgaaactgctggagcagcgtttcctgccgtcgctgatgcaggggctgctggacgacctgaaccgggcgccggcgggcagtgaggaaaaactcgagatcctgcgggtgatgcgcatgatggaagacggcagcaagcgcaacaacggcctggtcgggcagtacatgcgtgcacgctggagcaaggcgtttcacggccagcgggatttacaggcgcagttgctgacccacctggattacgccctggcccataccgactggaaggggcagcgcgacagggacaatcaggacgccctcgcccgctttgcgccgtttattaagccgatgaaacaggcccagcaggagctgagtgcgctgaccatcaaccagcgggtttaccagaacctgcgcctcaaggcccaggataccctgtccgccccggttaacctgcgtgaccaaattgggccgagttttgacagcgtgtttattgccggcaatgacagccggctggtgatcccgcagttcctgacccgccacggcctgacggattactttgtccggcaggacaaggagctggtggagctgaccgagatggacagctgggtgctgaacctgccgctgaaaaccaacaagtacagcgacaccgatcaggggaatatccagcgcgaaatcaccgaactgtacgtcggggactacaccgcccactggcgggcggcgatgaacaacctggaagtgcgggactttgaagatctgccgcaggccatcagcgccatcgagcaggtgatcagcggggaacagccgatcaagcgcgcgctgcaaatcctcagtgacaacacccggccgccggagttgggcggcgccctgagtgacaaggaaaaacaggcgctgctggcgcagtcggattaccggctgttaaaccgcatcagccgggactttgcgccggaaaccggggtgctgcttgagcacggcgacaagggcagtgccctgcagagcgtttaccagaaactgatggcgctgcaccgttacctgctggctatccagaactcgccggtgccgggcaaggcggcgctgcaggcggtgcagctgcggctggaccagaacaacagcgacgcgatatttgaagtgcagcagatggcgaaaaacctgccggagccgctgaaccgctgggtcggtgacctggccgagcaggcatggcgggtggtgatgatggaagcggtgcgttcgctggaagtggaatggaatgagacggtggtcaagcagtaccagacctacctggccggccggtatccgttcaacccggcggccaccgaagacgtgccgctgagtgagtttgaccgtttcttccggccggacgggacactggataccttctataagcagagcctgaaaccgttcgtggaaaacaacctgaccaccgggactgacgggcgagagcttatccggccggacgtgctgaaacagctggcggtggcggaccgtatccgcaccaccttcttcaccccgcagaacgggctgggcacggcgtttgccatcgagccggtgagcctgaccggcaacaaacgccgcggcctgctgaacctcgacggtcagctggtggattacgcgcacgggcgcagcaacgtggcgcacctggtgtggccaaactcgatgcgggcgggcacggaaagccggctgaccctgatgccggaccggagtaacgcggcgccgcgcagcctgagcttcaccggcccgtgggcgcagctgcggctgattaacagcggcaagctgaccaacgtgcagccgggggcgtttgacgtgcgcttcgcggtggacggcggcgagataacctaccgcatttacgtggacgaatcggacaacccgtttgcgggcggcctgttcagccagttcagactgccggacaccctctactga

SEQ ID NO: 2093 - DNA, 1437 bp, Xenorhabdus bovienii
  Coding DNA location: Contig name=SeqID_16866; Position on contig =152730..154166bp; Strand=-
atggacatcagaacacaattcgactggttcggcgccctgttggcgcccctgtccgacgaacagacgggcaaggcactgagtgagagcgaccccgcctgggaattcatcgacggcgagatggtcaaattcggctcgctgtcacatggcacgctggaggttgacgccctccagcgacaggctttgcaacttttcagcgaacacagcaaggacttccggctgatggttcacctgctgcggactttgcagcatgccggtcaccccgccgagctgatcctggcgatagagctgctgaccgagtacgtcaaaaattactgggaaaaagcctggccggtcaaaccgggattgaagcgccgactggcacagcaggtgatcaaacggtttgaatcggcccaggcgggcttcaccgagcaggccagcaaaagccagcgcgacgaggcacaaggtgccctggctcacctggcccagtgctggcacgccaatgaacccgacctcgcgaaagacgtcgatcaactgcgtacccgctataaccgccagccagaggcccgaacggcgccggcaccgcctgcacccacagcccctcaggcggcgtcggcggctccgtcgtctcacgcccctgaacaagcgccgatgcctgacgtggcggtcaacagttccagtgataaagcgtggaaacagaccctgatgatcgtggcggatttgctgtgtgaacggtatcccgaatccccgatcggctatagcctgcgccgtcatgcggtctggcacaccattaccacggcaccgatggcgaacgccacgggcaaaacgccgttggcaccggcgtcagcggatcgcaccgccgattatctggcgcgactgccgacggcggataacaaattgctggcgcaaattgagcagagcctgaccctcgccccttattggctggatggccatgccattgccgcacaggcggcggaacaacggggctacagccacgttgcgcaggccatgcgtgacgaactgaatgcgtttttggcccggcttcctgtactgaaaactttaagtttttccgacctgagtccgtttatttctcctgacaccctggactggctcacaccggaacccgacaccagcggaaacccgggagccgtgtcggccgatcaggaagccatctggcactgcttccagcaacaggggctagaagccgccctgaagatgctggaagaacaccagcagctactgacggagccccgggatcaattctatggtcagttgttcactgcccaactgcttgaagaagcgggcatgaccgcactggcacaacagcattaccggaacttgttacacacgggacaacacatgttactcactgaatgggaacccagcctgctgaccctgctggctgaaaaaataccttcgcctgcgaaggatactgcgtcacacaggagcgttaacacatga

SEQ ID NO: 2094 - DNA, 666 bp, Xenorhabdus bovienii
  Coding DNA location: Contig name=SeqID_16866; Position on contig =154172..154837bp; Strand=-
atgaatattgtattaattatcagcgcgttgctcgcgtcattgggaggtgatcccaaattggcgaacctggttgagccaaaggaagtggccgcacccaaagaagaatacgtggacgaaatgcaaaaatgccgttttgaaccgtccccgcttgtccggctggcgtgttatgaccgtacggtgaataacctgaagtttaacgccctgcaaatcccgatggaaaacatggggcttgtgtggcgacaggcgatggagcaggagatgaaacgcaccgattactccactggcttcatcgtaacgcagggagaaaatggtgaggcacccgttatcctgaccacaccggcggtcggggtgccgcctccccgtccggttctgatgctgagttgcattgaccgcattacccgtttgcaggtggcactgcctaaaccgatggaatccggtacggtcaccgtggccacggacaaaacccaattcaaaaccgagtggttcctgcgggaacacggttacttatgggaatccagccgcggcttgccgggcattgaggaaatcaagcgcttaatgaacagcgaccagatgaccatcacggcccgcactggcagcccgataacctttaatatttctcagctggagcaggccgcgaaacccttacgcgacgcctgccgttggtaa

SEQ ID NO: 2095 - DNA, 795 bp, Xenorhabdus bovienii
  Coding DNA location: Contig name=SeqID_16866; Position on contig =154834..155628bp; Strand=-
atgaaacagcggctgaaaagcgcgttagcgttattagatgatgacactatagaacaactggttggccactttctgctggtgagccagagctcgcgttttgatgccctgttagttttcttgcttaacaccaatgaaaacagactggaatgctacaacctgccggaactccaccaagccagctcacgccggctgaatgtggatattgatgacgtcaataacccgctgatacaggttctgcgcaagggagccccgacggtatgggattccctgaatcacggtgcgcgcattgacgatgtgcctttccgcacgtttgttgcggaactgccgcataactgcgggttgtatgccattcccctgtttgactgtaacggacaggcctgcggcgtgattgccatttttgccgaacatgtcagccattttatcaacaatgaaaacatgttcggcctctattgccatgtcatgcagcaccgcctgaaaaaattgcaggaactcgaacagctgcgtgggcagttacgccaaatccgccaggtatttcaggttcagcaacagaaagaaaaacaactggatgaactgcttgcctccctgagtggatcgaaacccgcaggtgtgagccgtatctccgtggattacagccacatcgataatctgccaaaggccatcgaagaatttgaaagcgccgtgttggttcaacgtcagcgtcagtatggcaacgacacccgactgattgcccaaagtctggggattgccccgcgctcgttggtttacaaactggctaaatacgggtgtagattatga

SEQ ID NO: 2096 - DNA, 2715 bp, Xenorhabdus bovienii
  Coding DNA location: Contig name=SeqID_16866; Position on contig =155628..158342bp; Strand=-
atgattcagattgatctgcccactcttgtaaaccgtttaaacccgatgacccgccatgcactggaagcggcggcggcatcctgtgtcagccagcagcagcctgaaattactgttgcacaactgttgtttcagatgatcgacacacccctcagtgatgtgcgcctgatcctcaataaagcagacatcgataaagatctgctgaaagaacaactcgatcagatgatgcctcatcatcaggcgattgtacaaacctatccgaacttctcaccgatgctggtggaatggttacaggatagctggctgctggcttccacggagatgcagcatactgaattacgcggtggcgtcatgctgattgctctgctgttcagtccaatgcgttatctgactccacagcccgcgcgcatgctggcgggtatcaaccgtgaattgctgcgtcagaactttgctgaatggacgaatggctctgccgaacagcctttcagcggcgacgataaaaatgggcagggcgtacatccggcaaacagcgacagcctgctggcgcgttttacccagaacatgactgaacaggcgcgtcaggacaaactcgatcctgtgctgtgccgtgataacgaaatcgatctgatgatcgacattctctgccgtcgtcgcaaaaataacccgatcgtcgtgggtgaagcgggggtgggtaaaagtgccctaattgaaggtctggcgctgcgcatcatcaatgaccgtgtaccggataaattgcgcaacagcgaactgatgacactggatctgggggcattgcaagcaggggcagcggttaaaggtgagtttgaaaaacgcttcaaaggcatcatggctgaaattagccaatcatctaagccgatcatcctgtttatcgatgaagcgcacactttgattggtgccggtaaccaagcgggcgggctggatatctccaacctgctgaaacctgcattggcgcgtggtgaactaaaaaccatcgcagcgaccacatggagcgagtacaaaaaatacttcgaaaaagacgcagcactgtctcgtcgcttccaattagtgaaagtttctgagccaagcgcggaagaagccaccgtgatcatgcgtggtctgcgagccatttatgaacaggcgcatggtgttctgatcgatgatgaagcactgaaagcctctgcggtattgagtgaccgttatctctctgggcgccaactgccggacaaagcgattgacgtactggataccgcctgtgctcgcgttgccattaacctgacatcgccgccacgccagatctcctcactgacgaccgaattgcaccagatgcaaatggaaatcgatgttctgaaaagagaacagcggatgggtctgaatgaacatgcggaaagactggaagaactgcaaaaccagcaggtagagatccaggaagaactcgtcacgctggaaaaaaactggcggcaacagcaggagctggtgacacagatcatcgaattgcgcagtcaactcctggcggatagcgacgagtcagttgcagcagaaacgatggataaaaccatcgaaaatgcggttgaagagacggctgaagacgcggaagagcaggaagctattgcgcaagacgagccagaagtcgccgctgacgaacaatccctgatcgaaaaactggcgctgctcaacgcacaactggcagagctacagcagaagcaaacgctggtttctccccatgtagacaaaacccagattgcctcggttatcgctgagtggacgggcgttccattgaaccgtctgtcacagagcgaactgtctatcgtgaccgaactgcctacccatctgggacaaagcatcaaagggcaggaagttgcgatccagaacttgcataaacacctgttgaccgctcgtgcagacttgcgtcgtccggggcgtcctctgggggccttcttgctggtggggccaagtggtgtcggtaaaaccgaaaccgtcctgcaaattgctgaactgatgtttgggggtcgccaatacctcaccaccatcaacatgtctgagtttcaggagaaacataccgtttcccgcctgattggttctcctccgggctacgtaggttatggggaaggtggcgtactgaccgaagccattcgccagaaaccgtactccgttgtgttgctggatgaagtcgaaaaagcgcaccctgatgtactgaacctgttctatcaggccttcgacaaaggcgaactggccgatggcgaaggacgcatcatcgactgtaaaaatgtcgtgttcttcctgacttctaaccttggctatcaaactatcgttgatcatgccgagcagccagatcaacttaacgacctgctctaccctgaattggccgcgtttttcaaacccgccctgctggcacgtatggaagtgatcccttacctgcctctgggtcacgaaacgctgaaaaccatcattcagagcaaactggctcgactggataacctgctgtctcagcgctttaacgccgaagttacgatcagcgatgacgtatcggaagagatcctgcaacgtgccacccgtgcggaaaacggtgcccgtatgctggaatccatcattgatggtgccctattaccgcctgtttcattactgctgttgcagaaaatggccgcaggtaccgcaatcagtgccatttgcttaaccgcggtagaacacgagttccatgctgaggttgaggaggcagaataa

SEQ ID NO: 2097 - DNA, 768 bp, Xenorhabdus bovienii
  Coding DNA location: Contig name=SeqID_16866; Position on contig =158352..159119bp; Strand=-
atgagtgatatcaatgttggcagtccgtcactggaaaagtctgagacgctgaaaacgtttcagcgccagtatcagctaccgttgcgtggtgaaagcctcaacccgatgatcgatgcggccacccccttactggggatggttctgcgtttgcaggatatgagtgatcaggcactgccagataagctttaccaacaggttgttactgacattcgagccattgagcagtttctgcaaaccaaaggttatgaacccggagcgattgtttcattccgttacgtactatgcaccttcattgatgaaaccgcgttggggcacggctggaacagtcagaatggctggttgaagcaatcgttgctggttcacttccacaatgaaacctggggcggcgaaaaagtctttgtattgctcgaacgcctgatgggggaggcacagcgctaccagcacctgctggagttcatttatctctgcctctgcctgggttatcgcggacgttacaaagtcagcacccagaaaagcgatgactttgatcgcctgttccgtcgcttgcagcaacagcttcactcactgcgtggagaagctccgccgaccacgctatatgtcgatatcaacgagcgtgatgagcgttatcgcctgagcagacgttggaccatcaagcacctgttttggataagtgtaggtttgctggctgctatttacagtttctatgccatccgcctcggtgatcaaacccaagacatattaaagcagctaagtaacttattgagatag

SEQ ID NO: 2098 - DNA, 1353 bp, Xenorhabdus bovienii
  Coding DNA location: Contig name=SeqID_16866; Position on contig =159122..160474bp; Strand=-
atgccaggcaaaaatcgggtgatttggcacgaaggattgttcatcaagccacaacattttcaacaacaacaaaaacacaatgattatctggctcatagcctcgtatcggtgttggccgcttatggtcacggtttcagctctctgagcatcaatcaggatctgctcaatttagggcgcatcggcattaccgaagccagcggcatcatgcaggatggcacgatattctctgcgcccagccaagatctgctgccaaaaccgctggacatcgaaagcgtcaatgacctgaaaagcaaagacatctatctagcattgccaatgtccagcgataccattcgggaaattgctgacaaagaagcggaaattcaaagcgcagtacgttatcgggaactgccgagcgatgtccgtgacctgcatactaagggcggcgattcctttgccctgaaccttgcgcaattgacgccggttctgatgcaaggctccgaagacatgagtgcttacacggctatcccgctgtgccgcatcaaagaaaaacagaaggatggcactatcgttctggatagcgaatttatcccgacctgtctgtctatctttgtcgctgacaagttaagacgttttatggtggaaatcgacggcctgttgactgaacgctcaagaacactggccaaacgcattggttcgccgggtcagcagggcgttgcggatgttgcggagttcatgatgcttcagttgttgaaccgcgtgcaacctctgttcaaccattacgcaaaacagaccgtcctgcacccgctgcatttatatacccaactgctccagacctgcggtgagctgagaaccttcaccgatgcgagtcgcttgccggggaatgtgctggcgtatgaccacaataacctgacggataccttccaggacgcgatgcacgccattcgtgatgcactgaacgtggttctgacaccgcgtgcaacgtcaattgtcctgaaacagaacgaaggtggtatccgcgtggcgacgctccacgacaacgatctgctgcgcaaagccgaattcgtactggctatcagcgcaagtacgccacaggagcagttacgtcgtcagttcgtgcagcaaaccaaagtcacctcgatggaaaaaatccgcgatctggtcagcgttcagttaccgggtgtgccactgattgcattgtccgcggctccccgtcagttgccgtatcactctggatacacctacttccgtctggatcagaagagtccggcatggaaagagatccagcaggggaattccatcgcattccacgtatcaggggatttccctgacttagatatgcagctctgggctatcaggggcggtaaggaataa

SEQ ID NO: 2099 - DNA, 555 bp, Xenorhabdus bovienii
  Coding DNA location: Contig name=SeqID_16866; Position on contig =160477..161031bp; Strand=-
atgaaacattccgctagtcatcgtgtatgggctgtagggattttattgttgtcagcgatgttgctgaatggctgtagcggtgcatggaacgcgacaaagaaagtcggtcaagtgatctgggacccttccacaccagtaggaaaaccggatgaacaggcttctgttgccaacattacgttattggccgaaccgaacatcaaccccaatgaaagtggtgaagcggctcctgttgaaatgaatctggtttatctcagtgaagattcgcgttttttggctgctgattatgatcagcttgaaagcgacaaactcgaaaaggcactggggaaaaattatatcgatcatcaggattacacgctattgccggggcaatacaaacccctgtcaacgctgatattggaaaagaataaccgttacatcggtgtcatcgttcactatgcagatgcaaatcaatctgaatggaaaaagatcatccgagtaaaagacatcggccgccattacaacatcttggtgcatgtcagaaataacgacgtcgaacttagaaaagaggaggagtag

SEQ ID NO: 2100 - DNA, 1296 bp, Xenorhabdus bovienii
  Coding DNA location: Contig name=SeqID_16866; Position on contig =161015..162310bp; Strand=-
atggaaaaacaacaaccaacgctttcattgcgggttctcaacagtgagcaactggaaagtggcagatccgccagttgcctgttttcggcacagggtggtacggtcggtagcagtgaaagtcacctgtggtctgttcaggatcagcagggaaatattcatccatcacaattctccgttcagtggcgggatggtgcattctgtctgcaagtactcgcagaacctgtgcagatcaacaatgccgcattaacgtctcagtcaagtctgatccgtttgcagcagggggatcagataaaggcaggtaatctgtccattaagatccacatcagtttttctgatgcagatcgtgttgatccttcgacggtatcacctgaatccttggtgtccagttacagcaacccgctggatgccatgatggaaggcgcagtagcacaaaaagccgtgtttgccgacgataacagcattgctccgacgatccagcatagtttcagcgatgacccgctcagggtactcgatagcgaaagcctgaccacgctgaagcagcaggttgaagccaatgatactgagcagcttttgccgccggatcatttccaaacccccccgtttgctaaccctatttctgataaccgaggcagtgttatggatcaggagttccttgatttaccgggtatcacttccgatcggcagtacgcagatatggatgttgatcatgttgccattacccctcttatgcgtgggttagatgcacagttacctctgcatgatagccagcaggctaacgattttctgcaagagatgggcaaaaccatgaaagccgccattgaagggttattggctctccagcgtgaacagcatgggctgcgtgataaacaacttcgccccatcgaagataacccactgcgcctgaatatggattatgacaccaccatgcaggtgatgttctcggatcagaaaagcccggttcacttgtctgcacccgctgccgtctcggaaagtctgcataacctgcaattgcattatcaggccaatcgggaagccatttcggcagcattggacaccatgctggaagccttctcccctgatcaattgctccgtcgcttctcacattaccgtcgcagcaacgaagtcaggaacaaagacgcggcttgggcgtgggaaatgtacaccaactattaccgtgaattagcttccagccgccagcaggggtttgaaaagctattccgtgaggtgtatgagcaggcttatgaccgcgcactgcgtcagggcttagaggactccagcaatgaaacattccgctag

SEQ ID NO: 2101 - DNA, 1053 bp, Xenorhabdus bovienii
  Coding DNA location: Contig name=SeqID_16866; Position on contig =162316..163368bp; Strand=-
atggccagtacagataggtcaacactcattgatgtaatcactgagcaagatcctgccacacccttggcattggacatctcacagtacaacttttatcagttggttgagctgctcaatcagctggcggtagcgtgggaaaaaacaggagagacagatcgtcctgatcgtgagtctgttcgtttcagagccagtgccagtctggcatttccgactcgtgacgtgatctcactctcgcaggccagacggggttattttgagctggaagtctcctttatggggctacacggcagtcagtccccgatgccaggttattatctcgattcgctggcttgggaagaagcgcagaacgaaaaccgactgacggattttctcaacctgtttaaccatcgcttaatcacgcttctgcatcagatctggcggaaatatcgctattacgtctgctttaagaaggggggagacgatcacttttctcagcgcatgttttcccttgtgggtctggggagcgatgtcaaccgccggatgctgaacattaatcacagcaaaatgctggcctatgcagggctgctggcaagccccggccgctcgccggaagtgatatgcagtttggtttcccactgttttgatttacaggatgtcaccctgcacggctggcaattcagaaaggtcaccattccccttgatcagcagaaccgcttgggaagcgaaaggaaaggacaggtaatcggtgactctaaactgtccatgctggggcagaatttcaccattggttcatgggtcggcgattacagcgggaagttccttctcagcatcaataatctgacccgtgatcggttcctgtcattcctgccggatggaaagaattatgccccattggtgatgtttatttctttcgtcatgcgcagtcaatttgcatgggaactgcgccttggtctggcagaaaatcaggtcagtggcatggtattgggggcgcagcagaataaccatctggggtggactagttttctcggcgaaccggaaaagaaaccctttgtcacaatttcagttatggaataa

SEQ ID NO: 2102 - DNA, 1833 bp, Xenorhabdus bovienii
  Coding DNA location: Contig name=SeqID_16866; Position on contig =163332..165164bp; Strand=-
atgtcatttgaaaaatatttcagagatgagttgaactatctgcgacaactggggaaagaagccgcagttgagcgtcctcatcttgccgcatttctgtctgaacaaggttctgaccccgacgttgagcgtttgcttgaaggttttgcattcctgactggcaatctacgggcaaagattgatgatcagttccccgaactgactcacggcctgctcaatatgctttggcctaattacctgcgtccgactcccagtatgactatcatcgagtacacgcccgatgagagcgtcgtaacgaaagcgacaccggtcaagcgtggcacacagattatgagtaacacgctgtcaactcatgatgatatttattcgaacgaaaaatcgggtggtaaaagagacgaacaaagccgctgtacttttacgctgtgtcgtgatgtctggcttttccctctctccatccaagacatttccgtcaataacagtaatgagcaaggcatcatcggcctgaattttgcgtcgaaaactgaactgaacttgcatgaactggaactggacaaactgcgtttttacctgagcggtgatgactataccacttctcagctttacttctggctctgttattacttcagaaaagcagaactggtggttggcgataaggtaatcccactaccggattttgattttgtgccggttgggtttgaacgggaagatgccctgctgccgtaccccaaaaacgcttacatgggatatcgcattttgcaggaatatttctgctttgcggagagcttcctgttttttgatgtgaagggtttcccaacgttgcctgaagatctcaagaccaaagatttcaaactgaatttacatttttctcaggcattaccaccagaagccaagattcggcatgatactttccgtctgcactgtacaccagccatcaacctgtttccgatggacagtgaagccattgaactcaatggcagccagactgaatatccattaaaggccagttatagcctccccgataactacgatattttttccgtcgatggcgttgaaagctggttggcgggtgaaaatggcgaacgcagtcgggcacgtatcggcgagcgcgtctatacaccgttcgaaagtttcaatcaccagattgatgacgaagatgaacgctcaatgcgttattaccgccttcgggtgaaagaatcacctttccgccgggggctggaacatttcatctcatttgtacggggagatgaatcggatctgctcagactcaaactaaaagaaaatgtttctatcagtttgacgtgtactaaccgtgaattgccgttgcagctgcgtgttggcgacattaattacccatccatcggcagcccgacatttgcgacattccgcaatatcacgcgcccgtcagtaccactctatcctctgctggatggcggtctgcactggtcgctgctgtcaaacatgtcgctgaactatatgtcattgctggataaggacgcgctgaagcaggtactgcgtacctatgatttccccagcatccataaccgacagtccaaacggtcatcgcagaaacggctcgatgccattgaaaagattgagacagagccgacagatcgcctgttccgtgggcagcccgttcgcggcctgcgctccacactgtatatccggcaacaggcattcagttcagaaggcgagctttatctgttcagtacgattttgtcacggtttttctcactgtatgccagcgtcaacgcttttcatatgttgaaggtaatcaatttagataatcaggagtgttatgaatggccagtacagataggtcaacactcattgatgtaa

SEQ ID NO: 2103 - DNA, 441 bp, Xenorhabdus bovienii
  Coding DNA location: Contig name=SeqID_16866; Position on contig =165165..165605bp; Strand=-
atggctgcgctgtacagttggaataggggcagctctgccagtctgttcgagcgcattcaagggaagggctccggctcttcccgtcagtcaaggatgcgttcattgcttgattctataaagaagcatctgaaggaagtgctgaattctcgtcctggtgcctgtcagagtgctattgatctgggtgtcattgatctcaatgacgcgacggcgacatcggtggattttaagcaaagcatcgagtgggcgatagaagagtgcatcagaaattatgagcccagaatatcagcggtttccgtcagcgccatcaacgatgattcagatccgttgctgttgagctttcacatcagcgctgaaatcttgttggatgatatcaacgatattgtggaattcagcattcagttggataacaaccggcgctattgcctggagcgaactcaataa

SEQ ID NO: 2104 - DNA, 1479 bp, Xenorhabdus bovienii
  Coding DNA location: Contig name=SeqID_16866; Position on contig =165608..167086bp; Strand=-
atggctcagcacgaagaaaacagcaccgctcttgcttctggcgcaacgacctccctgcttgatgaaattatgtctcaggcaaggatcacaccagaaaatgacggctactatatcgcaaaacaaggtatcgccgcgtttatcagcagtatcctggacacaggcgccaacgaagaaccgatcaacaaactcgtcgttgataaaatgatcgttgagcttgataaaaagctgagtgagcagatggatgaaatcatgcacgcgaagccgtttcaggagctggaatcctcatggcgttcactgaaaattctagtggatcgcactgatttccgtgaaaacatcaaaatcaacatcattcatgctactaaagatgaaatgctggaagattttgaattttcgcctgaaatcattcagtctggtttctacaaacacgtctactctacaggttacggtcagttcggtggtgaacctgttgctgccgtcatcggtaactatgcattcaccaactcctcacctgacatcaaactgatgcaatacgtcagtgctgtcggtgcaatggctcactcaccattcctttcttctgtttcacctgagttctttggtgttaacagctttaccgacctgccagccatcaaagatctgaagtccgtcttcgaaggcccttcacatactaaatggcgtgcattgcgcgaatctgaagattctcgctatctgggtctgacagcaccccgtttcctgttgcgtctgccttattccagcgttgaaaatccaatcaaaaacttcaactatcaggaaaatgtcagccgtgaccacgagcacttcctgtggggtaacacggcttatctgatggcgagttgcctgacagacagctttgctaaatatcgctggtgtccaaacatcatcggtccacagagcggcggtacggtgagcgatctgcctgtgcatctgtatgaagcaatgggtcaggtgcaggctaaaatcccaactgaagttctgatcactgaccgtcgtgaattcgaactggcagaagaaggctttattacactgaccatgcgtaaaggcagcgataacgccgcattcttctctgcaaactcagttcagaagccaaaagttttcccgaatacccgtgagggtaagattgcggaaaccaactacaagttgggtacgcagcttccatacatgttcatcatcaaccgtctggctcactacatcaaagtgttgcagcgtgaacagatcggctcttggaaagagcgtcaggatctggagcgtgaactgaatatgtggctgaaacagtacattgctgatcaggaaaatccgccaactgatgttcgtagccgtcgtccgctgcgtgcagctgaaatcaaggtactggatgttgaaggcgatccaggttggtatcaggtggctatgcaagttcgcccacactttaaatacatgggtgcaagcttcgaactgtcactggttggacgtttggataaggaataa

SEQ ID NO: 2105 - DNA, 498 bp, Xenorhabdus bovienii
  Coding DNA location: Contig name=SeqID_16866; Position on contig =167107..167604bp; Strand=-
atgagtaagaatagtccaggtagcgtagctccgaaagaaagaattaatattaagtatgttccgaatacgggtgaccagaccgcagaagtcgaattacctctgaatcttctggttgtcggtgacttgaaaggaaagaaggaagacacgccaattgaagaacggcaaacagtttcagtcaataagagcaacttcaatgctgtaatgaatgaggcgaacatcaacctgacttttaacgtccctaatcgccttgatgaaaaaaatgaagaagacatgcctgtgaatctggaaattaaatcactgagtgatttttcaccggataatatcgcaaaaaaagtgcctgagttgaataaactcctggaactgcgtgaggcattggttgcactaaaaggccctttgggaaatattcctgcatttcgtactcgcttgcagtcgctgctggatgatgaatccgttcgtgagcaactcctgaaagaacttgaaatcgtcaataaaaaataa

SEQ ID NO: 2106 - DNA, 141 bp, Xenorhabdus bovienii
  Coding DNA location: Contig name=SeqID_16866; Position on contig =167853..167993bp; Strand=-
atgcagagcgtaaaaccaaatatttgtctatttttaggaggaaaaagcgcttataatttcctacagattgacataggaatattaaaagctggaatagagggagttatcaatttgtgtttaggctttacatcaaaaaaataa

SEQ ID NO: 2107 - DNA, 129 bp, Xenorhabdus bovienii
  Coding DNA location: Contig name=SeqID_16866; Position on contig =168326..168454bp; Strand=+
atgattataaaatttttatttgtcattgaattagagcttgccttgcaatttgcaaattactttgcattacacgatttccgctttattattcgctccgagtgttcggcagcgatagttttatttaattag

SEQ ID NO: 2108 - DNA, 519 bp, Xenorhabdus bovienii
  Coding DNA location: Contig name=SeqID_16866; Position on contig =168525..169043bp; Strand=+
atgccaactccatgttatatttccatcaatgggaaaactcagggcaatattactgctggtgcattcactgctgaatcagtaggtaatatcttcgttcaaggtcacgaagatgaaatgctggttcaagaatttgaccacattgttactgtcccaactgatccgcagtcaggtcagccttctggtcagcgtgcacataagccattccgcttcaccgttgcattgaataaagctgttcctctgctttacaacgcactggcttctggcgaaatgttacctactgttgaattgaaatggtaccgtacttcaatcgaaggtaaacaagagcatttcttcacgaccaaacttgaagatgcaactattgttgacattgattgcaaaatgccacactgccaagatccatcaaaagcagaattcacccaattaattcgtgtatctctttcttatcgtaagattaattgggaacacactacagcgggcacttctggttctgatgactggcgcgcgccaattgttgcttaa

SEQ ID NO: 2109 - DNA, 99 bp, Xenorhabdus bovienii
  Coding DNA location: Contig name=SeqID_16866; Position on contig =169235..169333bp; Strand=+
atgcataagtacatgattacgtacgtaaccaatctgactgatgctaccgtgttgatattgccttacggcagcactcacttttgcatgacgatttattga

SEQ ID NO: 2110 - DNA, 147 bp, Xenorhabdus bovienii
  Coding DNA location: Contig name=SeqID_16866; Position on contig =169410..169556bp; Strand=+
gtgatatgtcaactccttcccctaacctgtaatcaaagtgacataagtgaaatttttaaattaaaaatacagagtaataaaagaactttgttgttttatcgctatcctactgaaattttaattaagcacgaattacatttgacttaa

SEQ ID NO: 2111 - DNA, 102 bp, Xenorhabdus bovienii
  Coding DNA location: Contig name=SeqID_16866; Position on contig =169531..169632bp; Strand=-
atggtttgtagttatatatttatcttaatgatttattatgactcgttttggttatgtcctatcttattgttaagggttaagtcaaatgtaattcgtgcttaa

SEQ ID NO: 2112 - DNA, 1671 bp, Xenorhabdus bovienii
  Coding DNA location: Contig name=SeqID_16866; Position on contig =169771..171441bp; Strand=+
atgattaaaaagacggcaatttttatcttattatgtaccgcccttcaggtaaaagcgtcacctgaagaactcaatgtcatattaccgacagatgagacaagaaggactttacaggacagttcaagggaaatagaccagttaattgagcaacgccgtcaccaaggattaatcaatcgttccggtgccctttcgcctcagactgtctctccagtactggtagaagcaccagcatgtctggatatccgcagcgtttatctccaaggcattacgctgctgactctgacagatctgaatacactcagcgcattgcctgacaactgtattaccagcaatgacatcaataaactgtcagcagaaatcactaacctctatattgccaagggctatattacggcgcgggtgcaatttattcctcccagccatcatggggaattgggaattaatgttgtcgaaggttttatcgaggccatcgaaggtggtaatcgctggatcaatagccagatgctatttcctcatctgacgaataaaccactgaatcttgatcagcttgaccaaggactggatcaggcgaatcgtctgcaatcaaataaaacaacgctcgatatcttacccggtacggtcagtggcggctcggtcatcaggctaagtaaccaacattccaccccgtggaaaatatccgcgacaaccgataactacgggcaaaaaagcacaggaaaatggataagccgactgaatgccagcatcgacagcccattggggttgtccgactttatcagtctcagcggcatcagtaccgtcgataaccccgacacccaatataatcgggctgctactctgttctattcacttccttacggtgctgcgactttcagcggttttaccagctattcccgatataccagccatccaaagctacaaaataatgtgcacaaactgcatgggaattcacagcagtcgggtatgcgtatggattgggtattccaccgcaatcaatcgcaaatctcgacgctgaatacccagcttgtttacaagaatttcaacaactatttcgatagcgccaaactcagtcacagcagtcaaacattaactgtgttttcactgggaataagccacttacaaatcattgcgaatggccttatcacttttgatacgggcattgaacagggaacaccatggttcagtgctcaaacctcaacagacaacttgaataagcaatttaccaaaggaaagttatccgtaaatttacagcagcgcttcaggctatttgatatgtcctaccggctcaataaccaattttatacccagtacagcccaaacggactgcccggtgttgagtggctcaatatcaccgaccgcaatgcagtacgaggattcagtaaaaatacgttatccggtgataacggctggtatctgagaaataccttatcccactcaataccgatactcaaaggttcgcttgacctgcgggcgggagtggatgtcggacgggttaaaggctatcggagtcaggatggctggcaaagtagtgctggattaagtactggcttgacattgcgctatcagcgcctgcttgccgatgtcgagttcagtcgaggcaaattattatcccatcaaaacagagacaaggatgagtccatgcaactgttaacacgcgtttcttacactttttaa

SEQ ID NO: 2113 - DNA, 120 bp, Xenorhabdus bovienii
  Coding DNA location: Contig name=SeqID_16866; Position on contig =171474..171593bp; Strand=-
atggatacggcaagttttcccgtaggagataacttgaattttttctcttgcatattattacctttattgactttcttttattgccatgtgcagccccctgagagtgaaaccctaagttga

SEQ ID NO: 2114 - DNA, 4449 bp, Xenorhabdus bovienii
  Coding DNA location: Contig name=SeqID_16866; Position on contig =171541..175989bp; Strand=+
atgcaagagaaaaaattcaagttatctcctacgggaaaacttgccgtatccatggcaattattctggcaacctgttcagccagttttgccaacggcattacgcccggaggcgatgcaggacatcgtcctgatgtcatcctggcggatacaggggctacggtagtcaatatcgtggcaccttctgactcagggctatcacataaccaatatgaggatttcaacgtcaatcagatgggggcggtattaaataactcattgatcgagggatcatcagaattagccggccatttatctgctaacagcaatctgaatgggcaggcagccagtgtgattttaaatgaagtcatcagccgtaacccttcattcttgctcggccaacaagaaattttcgggatagccgccgattatgtgctggcaaaccccaatggtatcacctgcaacggttgcggttttatcaataccaatcaggcctctctggtcgtcggtaatccgttagttgaaaatggcgtcctgcaagggttcaatacttttaacaaccaaaatgcgctgagtatcaaaaacaatggcttgtcacatactgacgttctgaactttattgcccccaaaattgatagtcatggtcgggaaatcaccgctaaaacgatcaatatcacgacaggtaataaccagatttcagccgatggaaaaattctggcatcacaacaagcggacgttggtgtgctcgacagctattacctcggcagtatgcaggcaggacgtattcgtctgctgaataccgcagaaggaagcggcgtcaatctgcaaggcaaggtgacggccagtgacagtattgatattaagtcttacggggatgtgaagttgcaggccgctaatctgaaaggcggggatatcacattgcaaggcaacaatgtcctgtctcaaggacgcctcaatcaatcctcatcagacaaagacggcagtgacaaccaccaagacagtttcagcggtctttatgtccaacagaagcaaatcagcgagtccattgcccgtacccaattggaaggcaagaatattacgctggtggccaagcagaataatcgcgttatggcaaccgatattgtaggggataatgtcgagctggccggtgctgatctaaaactgggtgggcagcaactccaccagttgacccgcgacaccaaaaataaatggatattatcctggcagtacgatgtgaccaaagagagtgacaaataccatcatgaaggtaataccatcaaggcgcatgaaaatgtccacctgacggccagcgaaggtaatgcagaagtgcttggcagtaaaatcagcgctggcaataaactgtccgtatccgcccagaaagatgtgaaactggcaggtctgctggaatcagaagtgactgccgagaaaggctataagaagaaccacactgttggtttgcagaccggaaactggaacaaaaaccataccgcccagagaagcatcggcagtgaattgaatgcagggggagatttaggcatcaatgccggagcaaatgctgaaattatcggttctcaggtccattctggcaaaaacctgattgtttctgccgatcagcaggcgaaaatcacggttcaatctcttgttgataatcaaagccttgccaagagtaagaaatactggggtggcattgcgggcggcagtaacaaagataacctcaataaagaagaaactcatcatacctctgatatcaacgcaaacggacatttgctgctgtcggggatgaatggtgtcactattaccggcagtaaagtgaaagcacaacagggagcttatgttgaagcaaatgatgggcaattaatcattgataacgcggttaacaactcctataagaaagtggatgaaagaaccggtacaatatttaacattaccaaaaattcgaaccaagaacacaatacacagcagaccacgtccaacagtcagctggtttccgataccgatctgaaattactcagcaataaagatatcaatatcattggtagtctggtgaaaagtgcgggtgagctggaagtgaatacatcaggcaacatcaatgtactggcttatggtgagcagaatagccatcatcaggaaaaaaccgatctaaactggcaatattacgcccgtgaagcagaagacaaacagtaccgtgtcggtatcggccttgagcacacgcgtgatagtcagaaaaccgatgtcacaacgcagcgtccatcagaattgaacggtggcaaccttaccgtaaatgcaagcgaaaatgtcactgtcactggctccaaattagtgacgacacaaggtgatgccaaagttacagggaacaatatcaacttcctgaccggagaaaacaggacatcaaccgagaattcacaggtaaaaggccgtggcggtctgtttttgaccggtggtatggataggctcggtggcggtattgaagggggttacgccagtaatggccaatcccaaaaccaaaccactgcagtggtatcaaaaactcaagtcaccggcaatcttgaattgaatgcgatgggagagttaaaacagcaaggcactcagcatcaggtcaatggtgcttaccaggccaatgccggtagcagcaaaaacctggcgacagaaaatacggaatcaaactccaccaatcagttgcgggtggacggtgaaatcagtggttcagccgattacagtgcaacgactcgtccggcagaaaaaacagccaaagcggtcagtgagaagaaattggatacttccattgccaaaattggcttaccgaatgccggccttgagttagcggccaaaggccgcagccattataccggcaatagccagtcaaacgcagtcgtcacttcaatccaggcgggtaacgtcaaagtcaccactaacggtgatgcttacgatcaaggaacccaatatcaggccaataaaggcgacgtgtcactgacagccggcagtcataccagtgaagccgcctacaatcgtaaagatagccattcttctgacaccacaggcaacgcccgcctgcgcgtttacacctcaactggcagtgatatttccgttaatggcaaaggtgatggcagctatcaggcaacctccaacagcagtgctaacgccgtgaccagcggagtacaggcacaaaacggtattgatatccaagtgaccagagacgcccgttaccaaggcactaccatgaatgcgggcagtggcagtacaaacatcaatgcgaaagaaaatatccagttcgatcaagccaccaaccgcaacgagcaaaaccgtacaggccacaatggagaaatttctctgaccgtgggaaccaacccagatggtaaaaatttcagtgccagcgctggcggtggttataacactgaccagcagaacagcacgacggctcaaaccagtaccctcacaggtgaacagggtgtaaacctgaatgcaggcaataatctggcactgaagggttctgatgtctctggtaagcaagtcgatttaactgcacaacgtgggaaaattgaactgacttccgcccaggacaccgtcaacaacaatggctggaatgttggtctcaagggcaaaggggggatgtccagcaaggcccgtaacaatgaaagcgggggtagcgcaggaagtagcaatgcggcaactgacaattccactgacagtagtgaggctggcaacaaaatcatcgatagcaaatataacattggtggtgaagtgaaattcggtgtcaatcgtctggatacaatgacataccataacggccatgtgtccggcggtaacgtcacgctgaccagcggtggcgatacttcactcaaaggcaccaatattacggccgatcatgtgacaggcaatgtaggtggcaatttcaatgttgaaagcctcaaagacagcactcatagcctgaatgtcggcctggatgctggcttgggttacagcaaaacggtcaaaggagacgataaagctacacttcctgtaccgactgccgatagcagttcatcagaagcagcacctgaaaccacagcagcggatgataaaaaagaggtgccgggactaaaagaccagttgactgccgccttcaaaggttacagcggtaaactgaaaggcaattacgatacgctggacagagaagccattggtgagcagtccaccctgaccggtactcacggcgttaatctggatgtcgcaggaaaaacctatttagtcggcggtaaaattgacagtgcacaagggacggtatcaatgaatacccagcagattggacatcagtctgtgactggatacgataagggtagaaatctcggtgttaatctaccagattccatcgtaggccttaccggtgctgcacaaaaaaacattttttccggaaaaattcctttcgtaaaaaatgagagccacgatacagaaattcctgctacccacagtgggatcaaaggccatcaattaaattaa

SEQ ID NO: 2115 - DNA, 144 bp, Xenorhabdus bovienii
  Coding DNA location: Contig name=SeqID_16866; Position on contig =176070..176213bp; Strand=-
atgttactcacaatgttaactctatgcgctgaatcggtatgtagaaaaagagtaacaggcaaaacggaaaaggcaacagatacggataggtctgtggcagtgggtaagagagtgattaaatgggcagaactcaaggataaataa

SEQ ID NO: 2116 - DNA, 975 bp, Xenorhabdus bovienii
  Coding DNA location: Contig name=SeqID_16866; Position on contig =176242..177216bp; Strand=+
atgctaagtgatattgaaaagaaggaacgctctaacacggaaaaagacaacacaccgttgcagaaagggctggatggcagtaagaaagcgctttccatgacaattcgcattagtaactatatccgacgcattccctttattgcccatttaatccgaactctccaacgcttcaatgatcggatggggagtcagttcggtgccgccattacctatttttcatttctatctctgatcccaatattgatgctctcttttgccaccgcgggttttgtgttggcatccaatcctgatctgctgacaaggttaatcaatggcattgccaatagcatcagtgacccgtcattggccaatacgctgaaaaacagtgttgataccgcagtgaatcaaagaacgacggttggattgacgggtctggcaatcgcactctattcaggagtgaactgggtaggcaacttacgcgaagccatcctcgcccaatcccgtgatgtctgggaacgtcatcatacagaaaaagaaaaaatctactctcagtatatccgcgattttttctccctattcggtctgctgttcgcattggtgataacgctttcgctgacctctatcgccggatctgctcaggcaaccctcgttcatgcccttggattagaaggtattgaatggctgcgccctgcatggacactgataggcatgaccatttccatttctgccaattatttgttatttctgtggatactgtggatcttgccccggcatcaacctgagcggaaagcgctgtttcagggaacattaatggccgctgttgggtttgaaatcattaaatacattatgacgatcatgctgccaagacttgccagttcgccttctggcgccgccttcggctcggtcattggtttgatggcatttttctatttctttgcccgtctgacactgttttgtgctgcatggatcgccaccgcagagaagcaatcagaataa

SEQ ID NO: 2117 - DNA, 285 bp, Xenorhabdus bovienii
  Coding DNA location: Contig name=SeqID_16866; Position on contig =177240..177524bp; Strand=-
atgagtaaaattttccaaaaaagggcgatcaaattcgccctttacatggataaactatccgtcaatcatcggctactttttcgccgtagccctgacttcggttacacttttgccgccaatgccccagttatccgtttcaacttcatcaataatgacaaacgtcgtcgccgggtttttacccagtacatccaccagcagctgggttgcaccttcaatcaattgcttcttctgctcggcagtcgcgccttcgcgggtgattctgatgtttacaaatggcatacatga

SEQ ID NO: 2118 - DNA, 405 bp, Xenorhabdus bovienii
  Coding DNA location: Contig name=SeqID_16866; Position on contig =177542..177946bp; Strand=-
atgaacaacgccagagaattaattgcgcatcgaagcatcatggaacttcaccaatggatagaagacgtatttaccaatgatcagcaaaaaggtgctgcgtctctggaaaaactgctttcttgcttcagccctgaattcagcatgattacaactcgtggacatactgctttttttgttcaggtcagtgagctgtttcatcagaatatcggtaacaaacccggtctaaagattgaaattgattcaattaagacacttgttaatactggcgatacggtggtatgccaatacagggaaacacattgcatgaatgacataaaacaagcacgttggtctgttgtcatcattgaatttaaagagggaaatgcgttatggcgttaccttcatgaaacctcgattgtggtttaa

SEQ ID NO: 2119 - DNA, 1350 bp, Xenorhabdus bovienii
  Coding DNA location: Contig name=SeqID_16866; Position on contig =177943..179292bp; Strand=-
atgacttatcgttatcgtattgcaataatttttctggttggtttttttatagactgcatcaacatttttatgtcagctatagctttaccagatatcgcacgtaatttgtcagtttcggaatcaacggtaacctgggttgcgaatagttacatattgggattaacgcttattattcctataagtaactggttggcaagtcggtttggcacccgccaaatcatgactgcatccatgttgattttttcaatagccgcgttttttgcgggtatggcgacgcattttctcagcctagcactattccgttttgtacagggtctcggtggaggattgttgattcctgtcgggcaggccctgactttgagtctgtttaaaaaacacgaaagagcaaagatttcaatgattattatggcggtcgcattaatcgcccccgcagtctctccgggagtgggggggataatcgtagatcatttctcttggcattgggtgtttttcagcaatattccttttagtcttatcgcagcactattgtcatttttctggattaaaacggaaaaaacaacggctcctaaacctgatttgagcggcctatttttggtaagtttgtcgctggcttctcttttgcttggtttgtcgctctatgctgaagcaagcattaaattcgtgccttacatattggttatcacaggaattttgtttgctttactttatgttcgccattaccgccgcatcaataatccggtactcgatttaaacattctgaccaacatccagatgcgtttttcaatatgggtctattacgctgtacccggtgtatttaccggagtgaacctgctcaatatcttctatctacaacaagaactgaattggtctgcggagaaagccggattactgatgcttttttatgcagccggttccttctgtgcgatattagtctgtggtcgaatatataaccagttggggtcggtacgtttgttctttgccggtctcgttttacatgccgcaggaattgccatactcgctactgtaaatacccctcaggatcagcctcttctgattatggcataccttttgatgggaatcggtggggggataggcgcaaataccgcgcaaactacggcgatgctggattttgaaggagaagatttatcccgtgccagcacgatctggaatctcaatcgccagatatgttttagtattggcgccactatttttgccatgatttttaatgtattgcagcataaaaccactccggcaacggcttactctatcacgtttattattgcagcaatttcaggtttattgcccctgttaaaattgcgccaactggctaagagtcgggagactgtatga

SEQ ID NO: 2120 - DNA, 891 bp, Xenorhabdus bovienii
  Coding DNA location: Contig name=SeqID_16866; Position on contig =179379..180269bp; Strand=+
atgatgaataaccaattaaaccggattcaaacctttatcgctgtagtggattgtggatcattcacacgggcagcagaacggctgttgatcagcaaagcaatgaccagtatccacgttaagcggctggaagagtcattaaacgtaccgttattgattcgtaattccagaggagttgcgctgacggaagcaggtcagcttctttacaatgaatttagtgaaatctttattaatattcagtccagcttagataatgtggctgaacagtatctttcactttctggcaccctacgtatcacatcaacaatcgagttcggtgatcggtttcttcttcctctgattggcgagttctgtaagatacatccacaacttaatatcagctataacgctggctctgctcttaatgaccttatttcagacaggctggatttagccattaggttgggggtattgcgagattcttctcttaaaagtcgtaaaattgctgactataaaatttatctggtggcatcacctgactggcttgaaaaaaataaactggaatcagtcaatgatctcaggggcgttgattggattgccaacagtaatttgcaaacaccgacccactgggaattaagtcaccccgccttaccgtcaattgatatacgtgctaaagccagattcaacaccaactcttcgacatcaataaaaacaatggctattgcagggttcggtgtgactgtcttaccggaatggatgataaaaaccgagctgaaatcaggcaatctagtgcgactttttcctgagtattcactgccaaaacagcctgtaacaatcgtattcccaaatgggcacaaaattcagcgcaaatgcagagtgtttattgattatctggtagagaagatcaagttatga

SEQ ID NO: 2121 - DNA, 1485 bp, Xenorhabdus bovienii
  Coding DNA location: Contig name=SeqID_16866; Position on contig =180450..181934bp; Strand=-
atgcagggcaagaaaatcgggtatcttattggtggcgccattctggctacgtcttatttagcacaggcagagaccttacagcctgatccggcttggcaacaaggtaaacttgaaaatgggttcagttggcaagccctgcaaactccacagcgtcccaatgacaggatacaactgcgtttaatcgtgaaaaccggttcactggcagagaaaatgcaacaacaaggctacacctacctcattcccaaagtcgtattgttcagcagcaaagatttgtcatcgcaaaaactggaaaatctgtggcgcaacgcgattgatagcaaaaatccccttcctcctgccattgtttcatatgatttcacgctttatagcctcagcctgccaaataaccgccctgatttactgaaagatgcactggtgtggctgtcggatattgcgggtggtgcggtttttacgccagagactttggcacaggccatgaaagcgaccgatcattccgtcgcgactttacctgcagatatacgagatcctgtgtggcggatgcggctgcaaggctcgacattgctcgatcatgatccgggtgcgagcgtatcagtgcctgtagatgtcaaaaaagttgaagcattttatcggcaatggtacacgccagatgcgatgacgctgtatgttgctggtcatgttgacagccgggtactgtcagagcgcattaatcaggcgttttcgccattaaaaggaaaacggcagacaccggtagctgttgcgacgttgttgccgctgaaatcagaaacgcttggcgtagtcagtgataaagctcaacaagatcggctgtctttagtctggaacctgaactggcaaccgattaatgattcgcagaccctgcttcagtattggttaaacgatttggctcgtgaagcgctttatcgctacctgcaattgggacgggaagaagagcaggctgacatgaagttagatctggattgtcgcatattgtaccagcgggcaaactgttttttgaatatggatacttcttcggacaagctgacagaatccacactttatctggcttctgagctggcatcattgcgtgaaaatggtctgccacaagagcaatttgatgaactgtatgctcagaaacggcttcaattgcaacagctctttgcggtctatgcccgtacaaataccgatctattgattaaccagcgcctgatttcacagcagaataatgtgatagatattgcaccggagcaattccagcgcttaagacagacgtttttatcttctctgacaccacagcttttgaacaaaaaactgaaagagatgttgtctcaggacatctcctttattctggtgcagccaaaagatgaaacggccgttaatgtgaatcagctcagaaacggttttaaccagattatgcggccggggcctgtgccggaagcacccgccgttgataccaagcaagctgctgacatcaaaaaaggagcggagtag

SEQ ID NO: 2122 - DNA, 138 bp, Xenorhabdus bovienii
  Coding DNA location: Contig name=SeqID_16866; Position on contig =181894..182031bp; Strand=+
atggcgccaccaataagatacccgattttcttgccctgcattctcacttacccctacctatttagttttatccttgttatccctggcttcacctgccacagtttaactattcatgccaaaccattaatacccagatag

SEQ ID NO: 2123 - DNA, 708 bp, Xenorhabdus bovienii
  Coding DNA location: Contig name=SeqID_16866; Position on contig =182057..182764bp; Strand=-
atgaaattgcgtgtcaaacgttcattaaccattaaacaaatggccgcagtgacaggagtcgctttgataactattgccattttcattactatccagttatcacacctgttacagcagcggaaagatgattatatcagccagctcaataatgcggctgcacagattcaagttcctctggcagaagcgctgctgaattcagatctcaataaagcgaaaacgctgttgattgggttaaaaacatcaggcatgctggggcgggctgatgtggtatcaccggataatgcccgggtgatgagcttggatttcgcgacttatcgccctatacccgaattggcaaagcaggtttttggtattcccgttgaggtacagatccctttgcatatctatggtattacctcgcaaaccgaagcgtcacagggatacctgatcttgcaggtcgattctaaccgagtgtaccgatttgccttgaatacacttgcattaatgttgaccacctatttactactcgcacttattcttacggtggcgataagctggtgcgtgaatcgcattatcatccatccactgcgcgatgttgcgcgtgcactgaatgaagaacagccgactgcgcccataccttgtcccaaaaaccatcaggatgatgaattagggttactggttaaaggctataatcgtcagattgataagcagaaactgcgattaaaatga

SEQ ID NO: 2124 - DNA, 129 bp, Xenorhabdus bovienii
  Coding DNA location: Contig name=SeqID_16866; Position on contig =182801..182929bp; Strand=-
atgatatggataatgcaaacgttattaaatataaacgtcatgttgcggtcattcttctgttttgaactcatcaaaataagacgaccgctagaaaaatcaagtatactcagtcacattattaaggtgtga

SEQ ID NO: 2125 - DNA, 1032 bp, Xenorhabdus bovienii
  Coding DNA location: Contig name=SeqID_16866; Position on contig =182958..183989bp; Strand=-
atgagtgagcaaaacattcgtaatcaaaacaggcgtgaacaggaaaaggccactgtccctttactcaaagccaccgagttaaagaaatattatccggtgaagacagggatgtttgcgcctgagcgtatggttaaggcgctggatggtgtttcatttgagctggaaaaaggcaagacgctggcggtggtaggagaatctggctgtggcaaatccacacttggccgcctgctgaccatgattgaaaaaccgacggagggtgagctttattatcagggacaggatttattggtgccagataaacaggcagaaaaactgcggcgccagaaaatccagatcgtcttccaaaacccttatgcctctttgaacccgcgcaaaaaagtggggcagatactggaagaaccgttgctgatcaacacgtcgctcaccgcagcggaacgcaaggaacaagtgttgcagatgatggaaaaagtgggattaaaacctgaatattatcagcgttatccgcacatgttctccggcggccagcgtcagcgcattgccatcgcccgtggattgacgttaaatccggatgtgttgattgccgatgaaccggtttctgcgctggatgtttcggtgcgggcgcaggtcttgaacctgatgatggatttacagcaggatctgggattgtcttatgtgtttatttctcatgatctctcggtggttgaacatatcgctgatgaagtcatggtgatgtatttggggcgttgtgttgaaaaaggcagtaaagaccagattttcaataatcctcgtcacccttatacacaggcgttgctgtctgcgacacctcgcctgaatccggcactgcgtcgtgagcgcatcaagctgacaggggaattgccaagcccgatgaatccgcctccgggttgcgcctttgccgcccgttgccgtcgcgcatttggtcattgtacgcaattccagcctaagctaaggcaatatgacgagcaattggtcgcctgttttgcagttgaacaggacgaaaattcagccagataa

SEQ ID NO: 2126 - DNA, 1032 bp, Xenorhabdus bovienii
  Coding DNA location: Contig name=SeqID_16866; Position on contig =183986..185017bp; Strand=-
atgggctgcgtgacgcactcgatcctaagctcaagcagtaggggtattgaaatggcattgttgaatgtagatcaattatcggtgcactttggtgaagaagatgcgccattccgcgctgttgaccgtatcagctacagtgttgagcagggacaggttgtcggggttgttggagaatccggctcaggtaagtccgtcagttcactggcaattatggggctggttgattatccgggcagggtcatggcagaaaaactggaattcgatggccgtgatctgacaaaaatttctgagaaagagcgtcgccagttggtcggtgcggaagtggctatgatcttccaagatccgatgaccagcttaaacccgtgctataccgtggggtttcagattatagaagcgcttaaagtacatcaggggggtagccgcaaaacccgttaccagcgggcggttgatttgttgacgctggtgggtattcctgatccggcttcccgtctggatgtctatccacaccaattgtctggtgggatgagccagcgcgtcatgatcgctatggcgattgcctgtcgtcctaagctgctgattgccgatgaacctacgacggcactggatgtgaccattcaggcacaaatcatcgaattgctgctggagttgcaacagcaggaaaacatggcgctggtcttgatcacgcatgacttagcgttagtggcggaagcggctcatcatatcatcgtgatgtatggcgggcaggtagtggaagcgggcaaggcaactgaaatcttccgtgcgccccgtcatccttatacacaggcattattacaggcactgccggaattttcgacggataaatcccgtctggcgtcgttgcccggcgtggttccgggcaaatatgaccgtccgacagggtgcctgctcaatccccgctgtccctatgcgaatgaacattgccgtcaggtagagccagcattgaaaacggttggggaaagtcaggttaaatgtcatatgccgctggatgatgaggggaggccgacagtatga

SEQ ID NO: 2127 - DNA, 951 bp, Xenorhabdus bovienii
  Coding DNA location: Contig name=SeqID_16866; Position on contig =184977..185927bp; Strand=-
atggcatcgtcaacccacgtatccgtcataagaaataaggagcacatgatgactcaaaccactgagccagcggtatctggtgcgccgaaattgatgacgccgatacaggagttttggcattactttaagcgtaacaagggcgcggtcgttggctttgcctatattgtcctgatgctgctggtggcgctattggcgaatgtgttggcaccccacggcccggcagagcagttccgtgactcgctgttggttccaccgatatggcaggacggaggaagctggcagtttatccttggtactgacgatgtagggcgcgacattttatcccgtctgatgtatggcgcacgcctctctttgctggtgggttgcctggttgtggtgatgtcgctggtgatgggcatcatattgggggtattggcaggttatttcggcggtcttgtcgatacgatcatcatgcgtattgtcgatatcatgctggcattgccaagcttactattggcattggtactggttgccatttttggtccgtcgattgtcaatgcttcactggcactgactttcgtcgccttgcctcactatattcgtctgacaagggcggcggtactggttgaagtgaaccgagattatgtaatggcttcacaagtggctggtgcaggagccatacgtcagatgttcatcaatatcctgccaaactgtcttgctcccttgattgtgcaggcatcattgggtttttcaaatgccattctcgacatggctgccttggggtttttgggcatgggggcgcagccacccacaccagaatggggaaccatgctggccgatgtcttgcagtttgcccaaagcgcgtggtgggtagtgacctttccggggctggctatcctgctgaccgtattggcatttaacctgatgggggatgggctgcgtgacgcactcgatcctaagctcaagcagtag

SEQ ID NO: 2128 - DNA, 1020 bp, Xenorhabdus bovienii
  Coding DNA location: Contig name=SeqID_16866; Position on contig =185890..186909bp; Strand=-
atgctgcaatttatcctccgacgtttgggaatggtaatccccacgtttattggtattacactgctgactttcgcttttgtacacatgatccccggcgatccggtgctgattatggcgggagaacgcggtgtttctgctgagcgtcatgccgaattgatggctgctatggggttggataaacctctctgggagcaatatcttcattatattaatggtatatttcatggtgatttggggatctccctgaaaagccgcattcctgtgtgggacgagtttgtgccccgattcaaagcgacattagagttaggggtctgcgccatgttacttgcgatctctgttggtattccggttggcgtactggcagcggtcaagcgtggatctgtttttgatcatacggctgtcgggatatcactgacgggctattccatgccgattttctggtgggggatcatgctcatcatgctggtatccgttcaatggaatttgactcctgtttccggccgaataagcgacagcgtatttcttgatgatagttacccgctgacgggattcatgctaattgatactctgttctggggtgaagagggcaattttatcgatgctgtaatgcatatgatcctgcctgcggttgtgctggggacgatcccactggctgtgattgtgcgcatgacccgttccgcaatgctggaagtgttgggggaagactatatccgtaccgcccgcgcaaaaggcttgagccgtatgcgtgtcattattgtccatgctctgcgtaatgccttgctgccagtcgtcactgtcatcggcctgcaagtggggatcatgctggcaggtgccattctgacagaaaccattttttcatggccggggctgggacgctggttgatcgatgcccttcagcgtcgtgattatccggtggtgcaggggggagtattgctagtggcgaccatgattattctggtcaaccttgtggttgatttgctgtatggcatcgtcaacccacgtatccgtcataagaaataa

SEQ ID NO: 2129 - DNA, 1611 bp, Xenorhabdus bovienii
  Coding DNA location: Contig name=SeqID_16866; Position on contig =187053..188663bp; Strand=-
atgacaatctccagtaagaaaaagttcagtttactgaaactgggcattggcctcgttgcgttagcagtaacagcaagtgttcaggcaaagacactggtttattgctctgagggttctccagaaggcttcaatccacagttattcacttccggcacaacttatgatgcgacttccagacagatctacaaccgtttggtggatttcaaggcaggtacgacaaatgtcattcccagtttggctgagcgctgggatgtgagtgatgatggcaaaacctatactttctatttgcgcaagggcgtgaaatggcatagcaataaggaattcaagccaactcgcgatttcaacgctgatgatgtgatttttacttttatgcgtcagaaagataaaaatcatccataccacaaagtttcaggtggcagctacgaatactttattggcatggatctggataacatcatcagcaaaatagaaaaagttgatgattacaccatccgttttgtgttatcccgtcctgaagcgcctttcattgccgatcttgcgatggattttgcctcggttctgtccaaagagtacgctgatgtgatgatgaaggcgggggcaccggagaaagttgacctgaatccgattggcacaggcccattccaattgcagcaataccagaaagactcccgcattctctataaagcattcaaggattactgggaaggcccggcgaaaattgatcgcctggtgttctccattacgcctgatgcctctgtacgttatgcaaaattgcagaaaaacgagtgtcaggtcatgccgtatccaaatcctgccgacatttcccgtatgaagcaggacaaaaatattgttctgaaggagcaggctggcctgaacgtgggttatctctctttcaacgtcgataaaaaaccgatggataaccttaaggttcgtcaggcgctggcgatggcggtgaacaaagatgccatcatcgatgcggtctatcagggagctgggcagaaagcgaaaaacctgatcccaccgaccatgtggagctatgacgatgacatcaaggattatgcctatgatcccgccaaggctaaggaactgctgaaagaagctggctttccgaatggttttgaaactgatctgtgggcaatgccagtgcagcgtccgtataacccgaatgcccgtcgtatggccgaaatgattcaggctgactgggcgaaaattggcatcaaagccaagatcgtcagttatgagtggggcgaatacctgaaacgcgccaaagatggtgaaccgcagacggtgatgatgggatggacgggtgataacggtgatccagataactttttcggcactctgtttagttgtgcggccaaagagaaaggttccaactattcgaaatggtgttacaagccatttgaggacgttatcaagccagcccgtgaaacggctgacacggctaaacgtacagcgctttacaagcaggcacaggttgtaatgcatgagcaagtacccgcattgatcattgcccactccacggtttatgaaccaatccgtaaggaagtgaaaggctatttggttgatccacttggtaaacacatcttttacaacgtgactcttgactaa

SEQ ID NO: 2130 - DNA, 237 bp, Xenorhabdus bovienii
  Coding DNA location: Contig name=SeqID_16866; Position on contig =188647..188883bp; Strand=-
atgtgccgattgtcatatttttacaccgtaagtgttaattattttttgattttatgtttttctaatgttgctagtgttatatgtgattatgttgacgtcaggcataacaattggttaattgataaacgaacaacaataacgcaggtcgggacggcatcatttaggtggaaacgctggacttggccaagacacgataaacatcacaaacggagtttaagtaatgacaatctccagtaa

SEQ ID NO: 2131 - DNA, 159 bp, Xenorhabdus bovienii
  Coding DNA location: Contig name=SeqID_16866; Position on contig =188900..189058bp; Strand=-
ttggctaaatttaaaacatttcttcttttctacccgtacccgcatcttatattgccccgtcttttttataaggcggattgttcattttttaagtattcagtcacaaatttcaaattatcaccaatagaaattaattctttatatatccactatttttag

SEQ ID NO: 2132 - DNA, 144 bp, Xenorhabdus bovienii
  Coding DNA location: Contig name=SeqID_16866; Position on contig =189119..189262bp; Strand=+
atgaataaagagaaaaataatgaattatcgaatcggggagattcagttcctgagcgaattgccggcggtttcagagataaaatccagatagatgaacaattttatcaaaccgaccgtgatataacgtcgatgtttaatgaatag

SEQ ID NO: 2133 - DNA, 153 bp, Xenorhabdus bovienii
  Coding DNA location: Contig name=SeqID_16866; Position on contig =189252..189404bp; Strand=-
ttggtagcgcaactggtttgggaccagtgggtcggaggttcgaatcctctctcgccgaccagcattcagaaaccctgctctttgagcagggttttttcgtatgtgctaaataaaaactcggcgttaactcactccttgatctctattcattaa

SEQ ID NO: 2134 - DNA, 114 bp, Xenorhabdus bovienii
  Coding DNA location: Contig name=SeqID_16866; Position on contig =189340..189453bp; Strand=+
atgctggtcggcgagagaggattcgaacctccgacccactggtcccaaaccagttgcgctaccaagctgcgctactcgccgaaaacgaagcgcatcttactgccatcgctgtaa

SEQ ID NO: 2135 - DNA, 975 bp, Xenorhabdus bovienii
  Coding DNA location: Contig name=SeqID_16867; Position on contig =131..1105bp; Strand=+
atgctgcgtcagaactggaagcaacaccgtactttcatggtgtacagtccaacgggatcaggtaagacaggtttagcggcgttcatcactgacggttacatttctcgtgaaatgcgtgtcatgttctgtgtgccttatacaatcctcgtagaccagacggcggcaaagtttacagagtatggcttgcctgagcgcgaaatcagttacgtctggcgtgaccatccaaactatgacccaacccgactgattcagattgcctcagccaataccattatccgccgtgagtttcccgacaatatcgatttactgattatcgatgaggcgcacttacgccataagcggatgctggaaattatccgtgacagtgactttccggtgatcgggttatcgggcacaccctttgccccgttccttggtcactactacgaaaaactgattaagccgaccacgatgaaagagctgattcaacgtggggatctgagcaagtatgaattctatgcgccaaccaagcccgacttaagcggcgtaaaaagcaatcaaagtgctgaatacggcagtgattacaaagaggcggagattgctgaaatcatgtgcggctctgatctggtcggggatattgtcagcaactggctggcgaatggtaataaccagccaaccatttgtttctgcgtgacggtcagccatgccaactttgtgaccgtggagtttaatcgtgcagggatcaacgccgatatcattacggccgagactccccatgaagaacgccagattatgattcatcgcttcgagcagggtgcgaccaagattttagtgaacgtgggatgtcttttggctgggttcgatagcgatgtccgctgcattatctacgcaagacccacaaagtctgaaattcgatgggctcaggcacggttcaccgccttggctatcccgatgatatcgaatacaacgaactgcccagcaagaatgacggcatga

SEQ ID NO: 2136 - DNA, 618 bp, Xenorhabdus bovienii
  Coding DNA location: Contig name=SeqID_16867; Position on contig =1024..1641bp; Strand=+
atgggctcaggcacggttcaccgccttggctatcccgatgatatcgaatacaacgaactgcccagcaagaatgacggcatgaaaacccgtgacagttaccgggagcaggagaaacgggagaagttaccgaaagagtgttcctcctgccactacatgaagccagcgggggtctatgtctgcccgaagtgtggctttaagccgctgacaggtgaggatgtcgaggtggataccagccgcaatatccagaaactcagcaagaaagagcgcgtctacacgcaggccgaaaagcagagtttttactcgcagttgaagtactaccagaaccagcgcgcctcacagggtaagaccatcagtaacggctgggtatcaaatacctttaaagacaagttcggcgcttatccgcgtggattgcatgacaccccacaagagctaacgcccgaagtaaacaatttcatcaagcacaaacaaattgccttcgcgaagtcccgcaaaaaagcggaacaggtgcaaccgtccagcaacgagcagcaggaaatgcgccttgaggttgctcaccaaaaagtgcgcgatattcgtgaagcattaggcagaccatcacatcagggaggcacactgtga

SEQ ID NO: 2137 - DNA, 180 bp, Xenorhabdus bovienii
  Coding DNA location: Contig name=SeqID_16867; Position on contig =1638..1817bp; Strand=+
gtgaacagaatcaaaacgaccgaggctgtgattggccactggcctgaaatcttcgcctattacaaattacccccggtgacaggtaagaatcactttaaagggaagtgcccgatatgcgaacggaaaggcaaattccgcattgacgatatgatcctgaaacaggcctgttcacatggataa

SEQ ID NO: 2138 - DNA, 258 bp, Xenorhabdus bovienii
  Coding DNA location: Contig name=SeqID_16867; Position on contig =2112..2369bp; Strand=+
atgaagctgttgtgcaattaccataaaaaaggctatcagaccgtcgcgaagatgatagaccgatgggcaccaaatgtggaaaacaacacttcggcttatatcaagggtgtggccaaggcactaggtgtcgatcctcatcaggtgattagtgtcgataaagtgacgttgattgtgttggccaagtcgatcattcagcacgagaacggcaagcaaccgtattcaaatgaagtattcgaaaaagcatttaacttactctga

SEQ ID NO: 2139 - DNA, 870 bp, Xenorhabdus bovienii
  Coding DNA location: Contig name=SeqID_16867; Position on contig =2684..3553bp; Strand=+
ttgggcacactcgcgcctgacgcttacgatactgttgtcattaactcggtggttcagtatctggataaagtgcttgcccagttactgccggcgattgccgcaggaggaacaattttgctgggggatatccgcaacttagatttgttaacggcacatgtgacggcgatagaacaaagccatctgggcgaacagcgtatttccgtgggaacgatggcaaaccgtattcagcgacgtttgcaacaagaagaagagttcctgctcagtccaacttattttgcccaattatctgcccgttatccggagattggccgagtggatattctggttaagcggggcgtcggtgacaatgaaatgctatgttatcgttatgaggtcatcttacataaacgagataaaaatgcagcgtcatgtcacgatcaactcataacttggtttgatttcaatgccattgaagaggtgagcagtctgttgcaagcggggacatacgatacctttggtatttcaggcattcccaacacccgtgttaaagatgacgttgaattggcagaagggctacgccattggccagccaaccaaatactctttccaccagaatatgccggaaaattttctccccaggcagaaaaacaggttcaagcatttgaatccctgtttcaatatgcggagcagtgcggttatcaatgtggcgtgacgtggtcacaacagcaacttgacctgctggatgttattttcagccgccactcattgcctcctgtacaggcccgtcatgaatataaccaaacccatttagccaattatccgcaaatctctgccattgggggtgaactttcagagttactggaaacggccctgaaaaaaacaattacctga

SEQ ID NO: 2140 - DNA, 1734 bp, Xenorhabdus bovienii
  Coding DNA location: Contig name=SeqID_16867; Position on contig =3558..5291bp; Strand=+
atggttcccagtatttatatcccaatggagcgcatgccactctcattgaacaataaaatagataaaaaagcgctgcctgttccaaatgacaatgatttgcaccatcaaacttatgtcgcaccaagagatgaaattgagaaaaaactctgtcagttgtggcaaaaccatctgaaaatcaaccaagttggtatttatgataatttcttctcactcggtggtcattcgctcttggcagtgaaaataacgacttccataaaaaatgatttaagtaacaattttagtatgaatcaaatgtttacaaatccaactattgcacagattgccagtgtgattcgtagcgctcaaggccatgacatatctacactattgccaatacagaatgtattcgacggaagaataccgatttcttattaccaaaagatgttctggtctctgatcaaagaggaagcattggacgatgcctttaatgtccccatttccttgttgatagagggggaactaaatcaaagtgcattggaaaaaagtttgcacgttattttagaacggcatgaaagtttacgattaagattttatgaagaagatgagcaggttttcataaaacctaataacaacatgagaataaatttacaaattatcgattcgttgccaaaaggaatagaaaaagaacaaattaccattgaaattaacaaactctgggaagaggagttaaggataccttttgatgtttacaatggcccattattcaagacatttttgctacctgtatcaaaaacacgccatgttttattaattaatattcatcatattattttcgatggatggtctatcaatatttttataaatgagtttaagaaattgtatacggcttactcacaggagcaagatgttattcttccggcagttgcaatgcaatattctgattgtgtttatgatttacaggagcgtcataaaactgagaaatatcaaaatcaactaaaattctggcaacaacaatttgctgatcttgatatgaatgaacgtatttttccagtggctttcagcaaacatctaaccactaagtatcaatttaaagttatcagtatcaatacacctaaatcactggataatgctgtttcgcgatattgtgaaatccataagatcacgccttacatgctatatatggctttattccacgcttgtctttttatgtattctggtgaatcacaacatatagccacatcaccacaagctgatcgttctcatattgacagccatcaaacaataggactgtttttgaatgacctgatagtaaaatcaactatcagcaaagagatgagccttcatgacatcattcagcaaatcagtaattttatttataaagcgctagaaaattcagatgtccatatggcagcggtgattgacagtataggggaaaaggcgagggataatatatttaatattctatttaactatatggatgcccataatttttataactatgcagatagtcccgatagcggaaaaatatcgctgccaaatctcgatatggaattgataaaagttgatccgactccttttcagtcacttgggataaatttcataaatataccacaaaatattatgtgtgaattaagctataacccagagctgtatactgaagaaacagccaataatcttgtgaggtattatgaaagattgctggaagcctttgtatctggtcaagataaagagaatatcagttatttttatgactaa

SEQ ID NO: 2141 - DNA, 738 bp, Xenorhabdus bovienii
  Coding DNA location: Contig name=SeqID_16867; Position on contig =5489..6226bp; Strand=-
atgacacacgacatcttgcaagcactgactttgttgaaatcgaaaaaatggatagatctaacgcatagttttgatgaatgttcaccccattttttcatgtttcaacccgccgaatttaaaactatttttaattataaaaatggattttttgtccaacaattgacattcccaggtcaatatggcactcaccttgatgctccctgccattttgtctctgatgcccgttctcttgatgaattggaattaaaagaactggttttacccttaatcgttattgaccaatcagaaagagcaaaacacaatcctaacttctcgctttccaaagatgacattcttcaatttgaagccgaacatggaatgattgaagcagatacttttattgccctcagaaccgactggagtaaacgttggccatctcaggaaaagatggataataaagatgatcaaggtaataaccaaacaccgggctggggattggatgccctgaaatttttatttgaagaacgtcatatcaaagccatcggccatgaaaccttcgataccgactcagccaaagatttcaggcagaataatgctttaattggtgaatattatgtattagcacaagatacctaccaaatagagctgttggctaacctggatcaagtccctgtgcgtggtgcagtgattctcaatatcgtggctaaacctaaaaacgtgtcaggctttccagtgcgttcgtttgctatcgttccgtga

SEQ ID NO: 2142 - DNA, 414 bp, Xenorhabdus bovienii
  Coding DNA location: Contig name=SeqID_16867; Position on contig =6296..6709bp; Strand=-
atgcaggggaataatatcaataaagtcatcgtctttgcgatgttattcatcccccgaatgggtttttcattagtagacgaagatctggattattgtgctaaaaaagaatcgtgggtagcctataaagtaatagaaaaagcggttgaaaaaaataaccgactcgataaacaccgggcggtatcaactttaatcgccaggcataaactgaaaaaagaagagttaccgataacattttcagaatggggacagttatatagccaaacgacaaaaataatcattccttttatcgataatcaagtacctcccatgacgcttattacctcgtcaattatatcagcggctgaatgttcattaacagaacccacttattttgatataactccaaatagttatccaaaagacgataccccgtaa

SEQ ID NO: 2143 - DNA, 375 bp, Xenorhabdus bovienii
  Coding DNA location: Contig name=SeqID_16867; Position on contig =6983..7357bp; Strand=-
atgaaaaatgatctggatcttttgtcagcttaccagcggatccttagtttaagtgagcaaatgcttgatttagctaaaaatgaacagtgggatgaacttgttgatatggaaatcacttatctgaaggcagttgaagtggttaccctattatcagaaaactcagacgccccactttcattacagcaaaaattaacccaaattttacaaactgtcttggataatgagaaagaaacgaagcgattgttgcaaaaacgattagatgaacttagcgacctgattaaacaagaaagctgcaagcaactattacatgatacttatgggcagttccctgtcagcgactatgaaatggagttaacgactacagagccaaaataa

SEQ ID NO: 2144 - DNA, 411 bp, Xenorhabdus bovienii
  Coding DNA location: Contig name=SeqID_16867; Position on contig =7357..7767bp; Strand=-
atgtatcaacgttcggcaagccagttatacgctcaggtagatcttgagagcgaaattatgaatgcctctccctatcagttgattcagatattgttcaatggggcgcttagcgccctacgtcgtgcaattattctgatgcaacagggcaatatcccagagaaaggtttagctatttccaaggcaatcaatatcattgataatggtctcaaagagggattagatttcgaaaaaggcggagagattgctcagaatctgtttgctttatatgattatatgaatcgtcgtttactccatgctaatttacgcaatgatgagaaggccattaccgaagtgattgatttacttaccgagatttcagattcttggcggcaaataggtcctcattacaacgccagtcaggatattgtttaa

SEQ ID NO: 2145 - DNA, 1437 bp, Xenorhabdus bovienii
  Coding DNA location: Contig name=SeqID_16867; Position on contig =7780..9216bp; Strand=-
atggatttaggttctatactggataaacttcaggcagcagaaagaaaacgtttagaaccattagcacagcagcaaaccagctataaagccaaattaaccggttttggcacattaaaaggcagtttagagaaacttaaaagcgcatccgaagaactgaaaaaattcgataagctcaataccaccaaagtcagcgaagaccataaaacatttaccccaactacggattccaaggctagtccgggtaactacattattgaaatcaatcagcttgctaaggcacagtccctacaatccactgcggtttccaatgtgaaatccccgcaaggagatatactgggcgaagggaaaacccgtaccattgtcatcacccagccaggtgaagaaaagccgctacgcatttccctgaaagatgatgaaacgtctctgattgaaatccgtgatgcgatcaataaacaggaaggcaacgttaatgccagcatcatcaaagcaaccgataataaagacgataaaggcgagaataaaaactacctgatcctgacgtcgaaaaaagcaggaatacagtccgtcatgacaattaaagttgaaggtgatgacaaactgggtaatttgctgaattatacgtctgattacacgtctggtagcgaaagtacccctaaaagtggctctggtgcaatgaagcaaacagtagaagccgcaaatgcaaaattaaaggtcaacggcattgatattgaacgtcagaccaatgaaataaaagatgcaccagaaggcattaccctaaatctgaaaaaactctccgaaaaaagtgaagacgggaagatgtccaaacccgaaacactggtagtttcccgtgatattgagccaacgaaagaagcgattaaaaagtgggttgaggcctataatggggtacagacgactttcgaatcactgaccaaattcaagcctgtagccaaaggtgaatccgcttccaaagacaatggcgccctgctcggtgacggcaccttaaaaagtattcaaagccaattgagacaccagatcttctcaccacaggatgttgctgatattgctaccctgaataaattgggtatcaaacaaaaattagacggcactctggaaatcagcaacgaaaaactggaaaaaaacctgaaagagaaacctgccaacgttaaggctttcttcatgggtgatggtgaaaaaaccggtttcgcaacccaaacttataatatattaaagcaaacgctggatagtcacgaagggactatcgccacagcgaccgaaggcatcaacaagcgtctaaaaacacttgaaagacaagtggaacagaccaataaaaatattgatgcaacaatagaacgctataaacgtcaatttacagaactggataaacttgttaattcattgaagagcacaagttcatccctattccagcttttaagataa

SEQ ID NO: 2146 - DNA, 972 bp, Xenorhabdus bovienii
  Coding DNA location: Contig name=SeqID_16867; Position on contig =9530..10501bp; Strand=+
atggcatcagttattaataccaactattcatctctgctggctcagaacaacctgaccaagtctcaaggcactttaggtacggctattgagcgtctgtcctctggtttacgtattaacagcgcgaaggatgacgctgctggtcaagcgatcgctaaccgttttactgcgaacgttaaaggtctgactcaggcttcccgtaacgcaaacgacggtatctctattgcccaaactaccgaaggttctctgaacgaaatcaacaacaacctgcaacgtattcgtgaactggctgttcaggcccaaaacggcactaactctgaaagtgaccggaaatccattcaggaagaagtcactaagcgtctggatgaaatcgatcgtatttctgcacaaactcagtttaatggtgtaaaagtattaagcaaagatactactctgaacattcaggttggtgctaacgatggtgaaaaaatcgctatcgacctgcaaagaattgataaggaaacattaaagctgggtgattttagcgttgaattacaacgaactgatgcggaaaaaaaggaaattacagcagctgaaggtaaagtaaaaacggctgaagaggccgcgaaaaaagcaacaggtgctgcaaaaactgcggcagaagcaacgcttaaaacagagcaagcagctcttgaaaaagcaaaagaaacaggggcactaccagcagatacattggttaaattagatggcgctttgtctaaagttgacagcctgcgcagctccctaggtgcagttcaaaaccgtctggaatccactgttaacaacctgaacaacacggttaacaacctgagtgcagcgaagagtcgtatcgaagacgctgactacgcaactgaagtttccaacatgagccgtggccagatcctgcaacaggcaggtacttctgttctggctcaggctaaccaggttccacaatctgttctgtctctgctgcgttaa

SEQ ID NO: 2147 - DNA, 723 bp, Xenorhabdus bovienii
  Coding DNA location: Contig name=SeqID_16867; Position on contig =10756..11478bp; Strand=+
gtgagcgatttgtataccgccgaaggcgtgatggacaaaaatagcctctggaagcgctatgtaccactagttcgccatgaagcattgaggctacaggtgaggctgcctgccagcgtggagcttgacgacctgcttcaggctggtggcataggtttactgaatgcggtggaacgttttgattccttgcagggaaccgcgtttaccacctatgcggtacagcgcatcagaggtgcaatgttggatgagttgaggagccgtgattgggctccgcgtagtgtgcggcgtaatgcacgtgaagtcacgcagaccatccgtaaacttgagcaagagttaggccgcccagctagtgagcaggaagttgctaaagaattaaagattaatctgatagaatatcggcaaatactgttagacacaaataacagtcaactgttttcttatgacgagtggcacgaaattcatggtgaaagctgtgaaccagtgattgaggaagagcatgagacaaatcctctccaacaattgctggaaggtgatcttcgtcagcgggttatcgatgttattgaatcgctgcctgaacgggaaaaaatggttctgacgctgtactatcaggaagaactgaatcttaaagagattggcgcggtacttaatgtgggtgaatcccgcgtgagtcagctccacagccaggcaataaaacggctgagggcgcgtttgaatccagaaaagtaa

SEQ ID NO: 2148 - DNA, 513 bp, Xenorhabdus bovienii
  Coding DNA location: Contig name=SeqID_16867; Position on contig =11535..12047bp; Strand=+
atgtctgttacaacacaaaagaaacggcctctcagccgttatatcaaggactataaacatagtcagactcattgtttgcactgtcataaaacccttgaccgtatttctctcgtttttaacggtcaggtaatcaacaaggaagctatctctgagatgactgaattagttgatgacaaaacatgggatgagttacagggtaaatttgtggcgctgtgccgcttctgtagcgaaatttattgcaatagccaaactgattatttcgacattatgtcatttaaacagtatctgtttgagcaaacagagatgagccatagcactgtgcgcgaatatgtggttcgtttgcggcgattggatgaattactaacatcaagcaattacccagcacaagagtttacgccggaaaaaattcaggaaaaactcagtgagaaattgtctcagtctgctttcagtaattacaatatcgcgctgcgtaaatatgagcaatatctgagctggcaacagaacgggcattga

SEQ ID NO: 2149 - DNA, 3966 bp, Xenorhabdus bovienii
  Coding DNA location: Contig name=SeqID_16867; Position on contig =12171..16136bp; Strand=-
atgggcgtgaagctcgatgaagcaacgcgtaatcgtataaaatctgctgcacaacgaattgaacgcacaccacactggctgattaagcaagccatttttaattatcttgaacgcctggaaaatgaggaaaagatcccagaaatatcagtgtttcaggataacaaagaagaaaagatttccgaagaagaatcacagattgaggcgccttatcaaccatttttagattttgccgagcatattttgccccaatcggtgaaacgttctgcaattacttcagcgtatcgcctgcccgaaacgcaggcagttcccatgctgctgcaacgcgctcaattatcagaagaacaagccaaagcgacccacaaactcgcttactccatcgctgaaaaactacgccagcaaaaacatggcattggccgctccggtttagtgcaagggttactgcaagaattctccctttcttcacaggaaggcgttgcgttgatgtgccttgccgaagccctgctgcgtattcccgacaaagcgacccgtgatgcgctgatccgtgacaaaatcagcaacggtaactggcattctcatcttggccaaagcgcatctatgttcgtcaatgccgcgacttggggcctgctgttcacgggcaagttggtatctacccataatgaagccaaattatccaaatccttgaaccgtattatcagcaagagcggtgaaccattggtgcgcaagggtgttgatatggcaatgcgcctgatgggagaacaatttgtcacaggtgaaaccatcgcccaagcccttgctaacgcccgcaagctggaagagaaaggcttccgttattcctatgacatgctgggtgaagctgcgctgacagaagaagatgcgcaggcatatatggtttcttatcaacaggcgatccacgccattggcaaagcatcaaacggccgcggtatttatgaagggccgggcatctccatcaagctatcagccttgcatccacgttatagccgagcccaatatgagcgcgtcatggatgaactttatccgcgcctgctttctctgactttacaggctcgtcaatatgacatcggtatcaatatcgatgccgaagaagcggatcgtctggaaatttccctcgatttgctggaaaaattgtgttttgaaccaaaactggaaggctggaacggtatcggttttgttattcagacttaccagaagcgctgtccttttgtgattgacagcattatcgatctggcgcagcgcagccgccatcgcttgatgatccgtctggtgaaaggggcttattgggatagtgaaatcaaacgcgcccagatcgatggtctggaaggctatccggtgtatacccgcaaagtgtataccgacgtttcttacctcgcctgcgcccgtaaactgctttccgtccccaatctgatctatccacagtttgctacccacaacgcgcatactctatctgcggtttaccatctggctgggcaaaattactatccgggacaatatgagttccagtgtctgcacggcatgggtgaaccactgtatgagcaggttgtcggtaaaattgccgatggcaaacttaaccgcccatgtcgcatttatgcgccagtcgggacacatgaaacactattggcttacttggttcgccgtctgttggaaaatggcgcaaatacttcgttcgttaatcgcattgcagatacttccctgcctcttgatgaacttgttgctgatccggtgacggtagttcaggaactcgcacaatctgaaggacaaattggtctgccacatccgaaaattccactaccacatgatttatacggcaagaaccgcgtcaattcctcggggctggatctgtcgaatgaacaccgtttggcttcactctccagtgcattactgagttcttcgatggaaacatggaacagcgtgccgctgctgggtggtgattatgcgcataccggcgaattgccgacagctaaacccgtcaataatcctgctcggccttccgatatcgtgggctatgtccgtgaggctactgagcaagaagtcagccacgctctggacgttgccaccgacgcaggcactatttggtttgcaactcctccctcagagcgcgccgcgattttagtacgagcggcagaattgatggaaaataacctgcaatctctgctcggtattctggttcgtgaatccggtaaaaccttcaacaatgccatcgctgaagtgcgtgaagctgttgattttctctattattacgcggatcaagttcggcaggatttcgccaatgatacccatcgcccattggggccagtagtctgtatcagtccgtggaacttcccaatggcgattttcactggccagatcgccgcagcattggcggcaggtaatagtgtcttggcaaaacccgcggaacagacgccgttaattgctgctgttgcagtcaaaatgctgcatcaggcaggtatcccgcgtgatgtgctgcaattgctgccgggtcaaggggaaactgtcggggctttgttggttggtgatgagcgtgtgcgtggcgtgatgtttacaggctccactgaagttgccaacctgttgcagcgcaatattgccggccgtcttgatgcacaggggcgcccaacgccactgatcgcagagacgggcggcctgaatgccatgattgtcgattcctcggcactgacggaacaagttgtcaccgatgtggtcgcgtcggcctttgacagtgcgggtcagcgttgttccgctctgcgtattctgtgcgtacaagaagatgtggcagaaagaacccttactatgctgaaaggggccatggccgagtgccggatggcgaatcctgaacacttatcaacggatatcggcccagtgattgatgccgaagcgcaggctggcattgagcgccatatccagaccatgcgcaccaaaggcagggcggtttatcaagcggtacatgaaaatgaagccgacagtcaggaatcttcacaaggcacgtttgtcaaacccacgctgattgagctggaaagtttcgatgaattgaagaaagaaattttcggccctgtgctgcatgtagtgcgttttaaccgcaatgagctggataagctgctggaacaaatcaacgcttccggttacggattaacgttgggtattcatacgcgcattgatgaaaccatcgcgcaagtcacggccaaagccaaagtgggcaacttgtatgtcaaccgcaatatggtcggtgctgtcgtcggcgtacaaccatttggtggcgaaggtctgtcaggaaccgggccaaaagccggcgggccgctttatctgtatcgtctgttatcacagcgtccagtcaatgctgccagccagacgctggagcgtcaggatgaggaatatcagcttgatgccaacgtgcgtgtcgccctgcgctctcctttcaacaaattggctgaatgggcgacggcacaaaataacgaagctctgagcaaagtaattcaggaatacagcctgttgactcagggcgggaccattcgcttactgccggggccgacaggggaacgcaacacttataccctcttaccacgcggtgaaactttgtgtctggccgataatgagcaagatacgttggtacaattgtctgccgtgttgtctgtcggctgtcaggccatctgggagaaggacgagttacatcagcaattgctgcgtcagttaccggatgaggttcgccactccattcgtctgatcaatgattggcagaatgaagagactgagatggaagccgttatttatcacggtgattgcgaccagctgcgtcatgtctgcggtatcatcgctcaacgccaagggccgattgtttcggtacagggttttgcccgtggtgaaacaaacctgctactggaacgtctattgcatgaacgctcattaagtattaatactgccgccgcagggggtaatgccagtttaatgacaattggatag

SEQ ID NO: 2150 - DNA, 1485 bp, Xenorhabdus bovienii
  Coding DNA location: Contig name=SeqID_16867; Position on contig =16692..18176bp; Strand=+
atgacagtaaattcaccaatgctaataactttcattgtctacatttccgcgatgctggtgataggcttcatagcttatcgttccaccaaaaattttgatgactatatattgggtgggcggcgattgggcagtgtggtaacagcattatctgctggcgcttctgatatgagtggctggttattgatgggattgccgggcttaatttttctatcaggcatttcaggtagttggatcgcactcggctgtttgatgggcgcttatttgaactggcgctgggttgccggtcgattgcgcgtgcatactgaagcgaataacaacgcgttaaccttaccggattatttcacccaccgttttgaagacagcagtaaaatcctgcgtatcatctcagcgctggttatcctgattttctttaccatttattgtgcatcaggtgtcgttgctggtggtctgttatttgagagcacttttggtatgagttatgaaaaagcaatatggcttggagcgctggcgactattggctataccttcctcggtggttttttggcagtaagctggacggataccgttcaggcaaccctgatgatttttgccctgattttggtgcccgtactaattttgctcaatgttggtgggtttgagaatgctatcgcggttattgaagcaaaacatacctcttatctggatatgttcaacgggttaaatgttatcgccattatctcgttattgggatggggatttggttatttcggccagcctcacatccttgcgcgttttatggctgcggattctcaccaaaccattcacaaagcccgtcgtatcagtatgacgtggatgtttctgtgccttgctggaaccgtagctgttggtttctttggcattgcctattttgagctgtatccagagcaggcggctcccgtattacaaaagaacgaacgtatctttatcgagttaggtactctgctgttcaatccgtggattaccggtatcttgctgtcggcagtattggcggcagtgatgagtactttgagctgccagttattggtttgttctagtgcgttgacggaagatctctataaagcctttgtgcgcactaaagccagtcagaatgagttggtatgggttggccgtttgatggtgttgctggtggctgctattgcgattgtcattgcaactaatccgaacaataaagtgctggctctggcaagtaatgcatgggctgggtttggtgcggcatttggccctgtagtcctgatttcggtactttggaaacgcatgacgcgcaatggtgcattgatcggtatgctggtgggagcgattacggtattggtatggatgcagtacaagtggttcgggctgtatgaaattattccaggttttatctttgcttctattgccattattggtgttagcctgttagggaaagcgccaagtcaggcaactcaacagcgttttgatgaggcggaagcccattatagaactaaataa

SEQ ID NO: 2151 - DNA, 1407 bp, Xenorhabdus bovienii
  Coding DNA location: Contig name=SeqID_16867; Position on contig =18687..20093bp; Strand=+
atgtctctctctgaacctgccatcaaacgtctcgatcacctcggccttgtcgccgctttttgccatgagatcggtttaccccgcatgattgatgctattttgcctaaatatgcagagcatacggtttctcatggcgaggctcttttagcgatgatcctcaatgggttgggtttccacagtcgaacgctccatatgtgccctgatttttttaagcacaaacccgttgaacgcctgattggggtgggaattatggctgaacacctcaatgatgatgtgctcggccgcacgctggacgccttgtttgactgcggtgtctctgaaatttatcaggttatcgctgagcgggttattgataaattggcattaaaatccgattccgttcaccttgatatcacgagttttcacgtggatggtgagtacaaactccccgatgatgacgagacaaaacgcctcgttttggtgcgtggttacagtcgtgatcaccgtcctgacctgaatcaggttgtgctgcaacttatctgtgaaaatcaggcggggatccccgtatacatgcaggcgatgagcggaaacaccaacgacaccaaagcgtttgcagagacgacgaaacatcacattggctgcctgaaagcggcccaaaacagccgttatctgattgccgatgccgcgctttatacccaagagacactggcctcacttcatcaacaaaatcaaaaatttattacccgggttccgttaaccattaaagaggcgaaacagcacctgctgacggttaataccgaccagttacaaccggttacagaaggttatgccggtcattggattgaatcttgctacgggggcgttccacagcgctggttactggtcaacagtgaagcggcgatgcagtgtgaacatcagactttcaggaaaaatacgcggatttcgacggaaaaagaactgaaacagttcgagaaactcagcaaaaagtcgtttccctgtggtgaagatgctttgcaggcattgtgtgacttcgaagcagaatgccagtttatcggcattgaggcccccaaagttcaaaaaatcgaggtgcataaggggcgaggccgcccggctaaaggtcaacatcccgatagtgttcattatcagctttctgcctcggtctacagccaactggggaaagtggcttatgcccgcctcaaagtcggcatgttcattctggcgacgaatgaaatggacgataaggcgctgaatatggaaactctgctggctaattacaaagcgcaacaaaaagtcgagcggggtttccgtttcctgaaaagtccggagtttctgacttcagcgatttatttgaaaaagccagaacgcatcgaaggcgttattaatgataatgacatgcagtttaatggtttatgctgcactggagcataa

SEQ ID NO: 2152 - DNA, 171 bp, Xenorhabdus bovienii
  Coding DNA location: Contig name=SeqID_16867; Position on contig =20053..20223bp; Strand=+
atgacatgcagtttaatggtttatgctgcactggagcataaaatccgcaccggactgaagcaaaatgccccgttctatcccgatatgaaaggtaaacccacccaatctcccacggcgcgttgggtgtttttgaccttcgaagggattaggctgcgtcccttaattagataa

SEQ ID NO: 2153 - DNA, 306 bp, Xenorhabdus bovienii
  Coding DNA location: Contig name=SeqID_16867; Position on contig =20212..20517bp; Strand=-
atgaaacggcgcggcaaagcggtgctggcagataaaggctattcgggcggaaaactccgcggttatctgcgtaagttgcggataaagagcattattccgtataaaatcaatgaaaaaggcagtactgatggtcgcacacaatttgatgagcaggcttatcgtgaccgtaatgttgtcgaacgttgtttcggttttcttaaaggaaatcggcgtatcgcaacccgttacgaaaaaaccgctcgaaactatttgtccagggtgaaattaggctgtattcgactcttttacaggcggttatctaattaa

SEQ ID NO: 2154 - DNA, 459 bp, Xenorhabdus bovienii
  Coding DNA location: Contig name=SeqID_16867; Position on contig =20595..21053bp; Strand=-
atggcacgctacgacattcctgatgacgcatggatagtgatagaaccttgtttacctccggtccattcagagcgggcaggacgtccacatgttgaacaccgccgagtgatgaatgggatgttctgggtcttgtgctctggggcaccgtggcgtgatttacctgaacgctatggtccttggaaaacggtctataaccgatttaaccgcgggtcaaaatcgggcattatcaacaagatatttaaccggttactgtccattctggatgaaaaaggcttgattgactgggctgaaatttgcctggatggcagcaatattcgcgcgagtaaagatgccgcaggcgcgaaaaaacccctcccgatatcgctgacgatcatgcgctgggtcgctcacgcggtggttatggcaccaaaatccatctggcaaccgacagacggggttttcccctcaacctgcttttga

SEQ ID NO: 2155 - DNA, 459 bp, Xenorhabdus bovienii
  Coding DNA location: Contig name=SeqID_16867; Position on contig =21686..22144bp; Strand=-
atgccaatagtgtatgtgaacagaaaaaatccagattggacatatttgttagacgcggttgcagccaaagggttggcagatgccgtttatgcagtaacagtcactcaggagcaatttgacaatctcaccgcctatcaatttattattgataatggagactacatctgtatcccaaaatcacccgaaccaaaacaggcgtataattgggatggggaaaaatgggttgcagataaacctaaattaaaacaatggcagatttctgaggcggaatatcaaaaacagaatctgatgactgaggcgcgagataaaatagcgccattacaggacgccgttgatttgaatatcgccaccgatgccgagaaatccgcattaaccgcttggcgtaaataccgggtgctgctcaatcgggtggattgcactaccgcccccgatgtcaaatggccggagccgccgaagtaa

SEQ ID NO: 2156 - DNA, 138 bp, Xenorhabdus bovienii
  Coding DNA location: Contig name=SeqID_16867; Position on contig =22343..22480bp; Strand=-
atgtcaatcatcaataaacctgattataaaatattcgctaacgatgcgaaaacaggtgaattagaaatgttccccgatatcctgcgcggatggggagtaaccgtagaccgcacagccggaaaaccgccgatggagtga

SEQ ID NO: 2157 - DNA, 549 bp, Xenorhabdus bovienii
  Coding DNA location: Contig name=SeqID_16867; Position on contig =22464..23012bp; Strand=-
ttgcagcttcccgaaatactcaacatcgataaatcagttggctacggactggatttgataggccgacacattggtattggccggacaatgaagtcatttgtaccaaaagactatttcggctggctgggtatcagcggggcgttgggatttaacgacggtctgttttatcgatacggcgactcgctgcaaaaatccgtcaaactggatgattccgatttcaggttctttatcagagcaaaaatcatcaagaactttcagaaacccactattgagggaattactcattcactaaaacacctattaggggaatattcatttgtcatcgataactatgacatgaccatgaatgtgattgtccctgctgattacctgaccccatttcgattacacgccattctgaaactcgatattttgagtagacctgtcggcgttaaataccagttcgttgttgttaacagtgaccgtccgtttggctgggcgagtgatacacgctcatttggttttggggatggtaaatttacgaggattatcaatgtcaatcatcaataa

SEQ ID NO: 2158 - DNA, 381 bp, Xenorhabdus bovienii
  Coding DNA location: Contig name=SeqID_16867; Position on contig =23286..23666bp; Strand=+
atggaaagtatcactattctacctaaaggcggtcggttgagttccaaaatgtgccgctatctggaacgtggcgatctagtgactcatcactgtttagaagaacacattcgccagtccgaagtaaaagcgcttgaaaatatcatcgatgaggcattcggggtagaaaccgaaccacgcaaagtgctggtactcaagcgtaagccacaaaatgatggcgttaatgtaatagccaatctgattgttcaggctaaggggctttctaatgagtcacaagaagacagcttcaataactgctgcttaccacatgtagctctttactcaaccaagcaaagagctagcaatcggatactggagtcaggcggggttacggcgagagggtga

SEQ ID NO: 2159 - DNA, 252 bp, Xenorhabdus bovienii
  Coding DNA location: Contig name=SeqID_16867; Position on contig =23670..23921bp; Strand=-
atggatagaaattttcggagaaaggttgtcggctggtttcgtgaaaagattaagaataatgtctgggtaaaatggggctacattccggtaattgtgttttatcctaattcactcaaattgtggttccgtgaacatgccccggactttttgccgaactttgtaactgatattattttctcaatccctattgtctttgctgtaatttatatcccaccgctattaattgattatctgaaaaaaacaagaaagtga

SEQ ID NO: 2160 - DNA, 216 bp, Xenorhabdus bovienii
  Coding DNA location: Contig name=SeqID_16867; Position on contig =24059..24274bp; Strand=+
atggcattagaccacggaattttaaatattccactccataaacgttcaaatatcgacagggacattgataaatggaaagcggaacagaccaaggaaaagagcaagcggctggatgaaattaactatcaacgcgaacaggaacggaaagaagctgagcggttatttaaattggttgatagaaagctgatgtgggcggaggctacccgcctagcatga

SEQ ID NO: 2161 - DNA, 177 bp, Xenorhabdus bovienii
  Coding DNA location: Contig name=SeqID_16867; Position on contig =24258..24434bp; Strand=-
atggaatttaacgtcactgttccctttgctgtcttttttggtccaacattcaccacaacaatttggctacctgcgttctcgctggagtttggagctttttatcattcaaatcaaagaactgataaaagtgaaattctcgaaaagccccttttatcgttattcatgctaggcgggtag

SEQ ID NO: 2162 - DNA, 1407 bp, Xenorhabdus bovienii
  Coding DNA location: Contig name=SeqID_16867; Position on contig =24934..26340bp; Strand=+
atggaagaaaaaatacaatctacccacacacctgaaactgaaggctcgcatctacagagaagtctcaccaatcgacatatacagcttatcgcaattggtggcgctatagggactggcctgtttatgggatcaggcaagaccatctcccttgcggggccatcgatcatctttgtatatatgatcatcggatttatgctgttttttgttatgcgcgcaatgggcgagttattactctccaatttgcactataagtcgttcagtgattttgcggcggacttgttagggccgtgggccggtttttttgtgggctggacttactggttttgctgggtcattactggcgttgctgatgttgtcgcgattacctcttatgtcagttattggacgcctgactttcctgagtgggcaacttcgctcttgtgcgtttttatattgctgacattgaatctcgcgacggtaaaattgtttggagagctggaattctggtttgccatgatcaaaatcgttgcgattgttgctctgattgtcataggcggtattttgattggcacccattttcaatctcctgcgggacacactgctgcattatccaatgtctggaatgatggtggcatgttcccaatggggctgagtgggttttttgccggattccagattgcgatatttgcttttgtcggtattgaattggtgggaaccgccgccgcagaaaccaaagatccgatgaaatccctgccaaaagcaattaatgccattccaatccggattatcacattctatgtgctggctctgattgtgattatgtcagtcacgccatggcgctcaattgttgcggataaaagtccgtttgtggagctgtttgttctgattgggttaccggctgcggccagcattgtgaattttgtggtgctgacttctgcggcatcttcggcaaacagtggggttttttctactagccggatgttatttggtttggcgaaagaaggggatgcaccgaagcagtttagtcgtttatctcgccgttcggttcctgcatcgggattgatctttacctgcttatgcctctcttgcggcgtcattctgatttattttattcctgatgtgatgcgggtctttacactggtgacaaccgtttctgctactctgttcatgtttatttggagcatgattttgtgttcctacctggtttatcggaaacgccgccctgcgttgcataaggcatcgatttataaaatgccttttggcatcgttatgtcatggctgtgtttggctttctttgcctttgtactggtattactgtccttgcagccagatactcgacaggcattaatcgccacaccagtctggttcattattttagtgatcgggtttcaaattgtgaaaaaacgcagaactcgcctttatcgctga

SEQ ID NO: 2163 - DNA, 408 bp, Xenorhabdus bovienii
  Coding DNA location: Contig name=SeqID_16867; Position on contig =26394..26801bp; Strand=-
atgcatcagaaaaattcagctatttttgaattactcaaaaatctcgaaatcagcttgcataaagaaaaaagaaaaaatatcgattggctgaacactatcttgcatgatgattttctagaaatcgcaaaatcgggttatgtttattctaaaaaaatcgtaatcgatgaattaacgacagaatttaaaatggtctcgccaatattttcgcaagattttaacatcaaatggctggatgaaaatattgcactgattacctatcaatcctacgaaataaataaatcagaccatccattcaataaagcgcttcgttcatctatttggcaattatctgtatccggtacatggcaacttaggttccatcagggaacaatcatggcggcccagccgctcggcaatatcacgccgtag

SEQ ID NO: 2164 - DNA, 495 bp, Xenorhabdus bovienii
  Coding DNA location: Contig name=SeqID_16867; Position on contig =26944..27438bp; Strand=+
atggaaattataattagggccgctgagtcagaagatgccgagcactttcagaggatttatagccatccagaagtttattccaatacattacaacttccgtgcccttcacgtgaaatgtggcaggaacgtcttaaacaaaataaaattcagggaaccatcaattttgttgctgaaatagatggtgaggtggtgggcacggtgagtttatttactttcgctaacccaagacgcaggcaggtggtgggtatcggtattggtgttgacgcagcttattccggccaaggcgtagggtcaaagatgatggcattcgcgattgattatgcttttaattggctggctgcggttagaattgagttggaagtttttaccgataatgaaaaagcaatagccctatacaccaaatttggctttgaaaaggaaggcgttttacgtaaggcttccctaaaaaatggccaatattgtgatgttatggccatgtctataataaaaaattaa

SEQ ID NO: 2165 - DNA, 936 bp, Xenorhabdus bovienii
  Coding DNA location: Contig name=SeqID_16867; Position on contig =27538..28473bp; Strand=-
atgaaaaataaaacagagcaatcattggtttgggatgatatccgtgtacttctggcgatagcacggacaggcacattaagtcgagcggcagatgttctaaaaatcggtattgcaacggtctcacgaaaaattgaacgacttgaagcgacctttgggatgcctctatttctccgccatcaggctggctatcggctcacagaagacggaaaagaactgctggaaaaagccaaagcgatggaaatagccgccaactcctttctgcttgaagccgatacccggattgcaatttcagggaaagtccgactcgccaccacagaaacattcgcgagtgacttagtaataccgaatttaccaaccttacagaaaaactatcccgacctcacattggaaatcacaacggatattcataccgtagatctacatcgtcgggatgcggatctggcacttcgtatcgtcaggcctgaacgagggcatgttaccgtccgtcaattgggaaaattaggatttgggctttatggcagcaaagattatttggcaacttgttcacctgacatactgaggggtgaatatgaaaaggctcgttttattggttgggcagacacctactcgtaccttccttcattcctatggactgagaaaaacctcaaaggccgaccgttatctgtggctacaacttcactgaacgcacaattggctgccgtaaaagcggggctagggttggcggtactaccgcatttcattgttcaatatactgaacttcaatgcatttctcatgatttgggaatagatcaatccatctggcttgtgattcaggccgatttggcacactctcccagaatacgtaaggttgctgattttttagcggaaattgtttttcaaaatcaggggaagctttcaggacaaactggaattaattctgtgatattgcctgattaa

SEQ ID NO: 2166 - DNA, 924 bp, Xenorhabdus bovienii
  Coding DNA location: Contig name=SeqID_16867; Position on contig =28591..29514bp; Strand=+
atgcgaaatacaccacagtcagctgttgttttaacgttatttgcaacatttttttggagctcaaattttcaagtgacaaaatttgcgctagagagcttgcctccgtggacggcctcagttgaacgctttgtttttgctgtcttcccgatttttatttttatggcattaaaaagtggcattcatggcaaagtgctgaggaaaaacctgctggcatttatttgtcttggggcaattggtgtggctggattcaacggagcgttatttgttggccttcaaagctccagccctatcacggctgcactcatcatggcaacgacacctatttctgccaatatcttggaagccatcatgaatcgtcgttttcctgaacttatccgtgtgttaggaatgggtattagcttactgggtgttgttttggtgatcactaatggtcaattggtgggcggtatggttcatatggcatcgggagatgcaatcatttttgcgggtagtctcggctgggccatttatacggtgggaacccgtaaattcattaccaatgctacgccacttgagataaccagttggacgatgctttttggtgtggtgatattagcgatgatcgctttttttgttgaatcaccgatttcttcaatgcgatcaggaacgtttgagagtcatttagcgagcgcttatatggggattgcgggttcatttttagcttatcttttttggaacataggagttgcgcttagaggagcagggaagacagcgatattctttaactttgtgcctatttttgccctgataatacagctaatgataggaaattcgccaagtttgccacaacttgttggcattatgctgactattgtgggagtgctcttagggcaaggtattatcacggcgtggttcacatccaaaggcattttggaaaaacattaa

SEQ ID NO: 2167 - DNA, 318 bp, Xenorhabdus bovienii
  Coding DNA location: Contig name=SeqID_16867; Position on contig =29874..30191bp; Strand=-
atgagcagcgagaataaacgccgaattaaacgtgttgctgtcaccttaccaactctacttggcccttatcaagatattgaggcaacactggtgatggattcagaaatagccacactatcacatggtacaaatgatgatggccggtttgtcacggatttcaacgacagccgtttcctgccatttgaaggccgagacgtaacatcgggtgaattgacactgaatattttccatgcaggaaaagatgaaacacagcatgatctgattgccaacctgagtgatattattgtgtatttgaactacattattcgagaagtctaa

SEQ ID NO: 2168 - DNA, 279 bp, Xenorhabdus bovienii
  Coding DNA location: Contig name=SeqID_16867; Position on contig =30305..30583bp; Strand=+
atgactgttacgatagaagtgacttgtcgatattgcgatcaagctgaacctgtacgcaaacacggaacaggtaaggccggcttccctcgctactattgcaaagactgccaaagaacctttcaactcaactatcgttataacggccataaaccgggtatgaaagaaaaaattgtggatatggcaatgaatggctctggcgtgagagacacaggccgtgtgttaggtctcggtatcaatacggtgatgcggacattaaaaaactctcgccaaaacaagtaa

SEQ ID NO: 2169 - DNA, 207 bp, Xenorhabdus bovienii
  Coding DNA location: Contig name=SeqID_16867; Position on contig =31178..31384bp; Strand=-
atggccggccgcctgtctgcgctttactatcaaatgtacgatgtcacactaccaatatgtcttcaggcaaaagctgcgttagtacaagagctgggtgaaaaagaaagtgatagcctgtttcaggttccgatctggaatgatctgtggcagggtctactggcaggagaaggtttaagtaccgaattgcagaaactggataatatctga

SEQ ID NO: 2170 - DNA, 138 bp, Xenorhabdus bovienii
  Coding DNA location: Contig name=SeqID_16867; Position on contig =31483..31620bp; Strand=-
atgaaagaattagtggatgtcttttctgattttccagacccacgttgtcagggaaaggtcaaacaccgttttattgatatcttagtgatcgctgtatgcgctgtcattgctggggctaacgccaggggttacacatga

SEQ ID NO: 2171 - DNA, 1440 bp, Xenorhabdus bovienii
  Coding DNA location: Contig name=SeqID_16867; Position on contig =31933..33372bp; Strand=-
atgtgccatggaacaagttataacaatgaccactattgtaattttaccattttaattaatgagattactttcacaacctatggcaaattctcccccgatggcaagcaattcacgccaccttctggttcagccattgctctctatccccccgactatgtggatttaaataacaaactggataccagtctggactcactgtttaattatgatgtccaaaaacagttcgggggttccaatccggtgaataatttcagtggtccttacggcatatatctgtgggaaatctttttccatattccattcttggtagcggtacgaatgcagacggaacagcatttcagcgatgcggatacttggtacaaatacatttttcgtagcgctggttatcgtaatgacgatggcgatcccattatggatgataatgcaccacgctactggaatatcatgccattacagatcgacaaggaatgggatacgacacagcctgccaccaccgatcccgatgtgatcgccacggcagatccgatgcactataagctagcgatattcctgcatactcttgacctgctgattgcccgtggtaacgctgcctaccgccagcttgaacgggatacactggtcgaagccaagatgtattatattcaggcactgcaactgctgggaaccagaccagatatccatatcacgaatagctggtcaaatccgaccctgaatgaagaagccaacaaaaccagcaaaccgacgctactgagcacaccagaagccatgacattctcgacgtggctgaattctggcgatgccaccaatatcggcgatggtgatttcttgccgccttacaacgacgttctgctgacttactgggataagttggatatcaggctatataacctgcgccataacttaagtctggatggccagcctctgaatctgccactgtatgccacgcctgtcgatcccaaaacactacaacgccagcaagcgggtggtgatggtacaggtaatggttcgctcattgatgaacacaaaacccaaggctggcgttatcctttattaattgaacgcgctcgtaacgccgtaagtttattgacgcagttcgctagcaatctgcaaaccacattagagcgtcaagacaatgaaaaaatgacgctgttattgcaaacgcagcaacaggcgatcctgaaacaacaacatgatattcagcaaaccaacctgaaagggctacaacatagcctgacggctttgcaagccagccggaatggtgctgcattgaggcagaaacactatagcgacctagttaatggcggcctctctgcagcggaaattgctggcctgacactgcgtagtacagccatgatcactaatggcgtggcaactggcttattaactgcgggtggtatcgccaatgccgtaccaaacgttttcggcttggctaacggttga

SEQ ID NO: 2172 - DNA, 477 bp, Xenorhabdus bovienii
  Coding DNA location: Contig name=SeqID_16867; Position on contig =34030..34506bp; Strand=-
atgtctgactctttattttctcaaatattaaaagaacaacgccgtgatgcattggtggcccattatatcgccacccaaattcccaccgatctaaaagacagtatccagacggctgatgatctgtatgaatacctgctgctggataccaaaatcagcgatttggtttccacttccttactgtcagaagcgattggcagcctgcaactgtttatccaccgggcgatggaaggttatgatggcactctggcaagttccgcaaaacagtatttcgccgacgaacagttcttatataactgggacagtttcaatcatcgttacagtacatgggcaggtaaagaacgcttaaaattctatgccggtgattatatcgatccaacattgcgcctgaataaaaccgagatatttactgaattggaacaaggcatttcacagggaaaattacaaaacgattttctttattgggcggacagagtatga

SEQ ID NO: 2173 - DNA, 3300 bp, Xenorhabdus bovienii
  Coding DNA location: Contig name=SeqID_16867; Position on contig =34546..37845bp; Strand=-
atggtgattattatgcagaataaagcatcatctttatccggtttattagagcggccactacttgatgccggctataaaaatatctttgaaattgtctcaatcagccgtgctgcttttgttcaatccatcccttccctacccgtcaatgaagcccaagcgatataccttcaagcccgccagcgggcagaaaatctaaaatcgctctatcggtcatggcaattgcgtcatgagcctgtcattaaaagaatgggcaaactcaatacacaatcaaacgcacccatcctggaaaaaaccttggttgatagcattgggagagatggagatttcagcgatatcatgaaccgagccagccaatatgctgacgcagcgtccattcaatccctgttttctcccggacgttacgcaaccgcactctataaagttgccagagatctgcatacgtcatcttccagcctgcatattgatcagcgtcgcccggatctgcaaagtctggctctgagcgaaaccaccatgaatcaggaaatcacctcgctcgatgttctgcttgatatcctgcaaaaaggcagtcaggacatcaatcaactgtccaccacgttttacccgatgacactgccctatgatgatgatctctcacagatcaatgccgccctgtcagcgcaggctcgaactctaaatggggtctggaatactctggcagatgtcacggcgcaggctgtcacagaacaatcctctacggagatacccgataattcgcctaaattttttgccgctgaagtcaagaaagatcagttttttgatggagaaattttctatgttaaggcaatagagttccaaaaccagccgatgatttacctgtcgcactacaccaacggagaaacggttgaaggtgtgcaactgattgcaggtaatccagataacgcagccgcagccgccattgctccgttgaaactcacttggtcgatggcaggtcagtgctactatttggggatccctgacgggacaaaaacgggtgatggcaaaattctgaatggctgttttttacgaggtaatagcccaactaatccgaatcaggacggcgatttcgctcaagtcgccaataaatcaaatagcacacaacccttaagccaattccatctacctgtcacgctggaacaaaatgacaaagataagactcagttttatctgaaaacacacaaaggctatatcgctgtgggaccttccggccaaacaaattggaaaaatgcgttggtcattaatggagaaaaaaccgatgctttactgctgcaattcagcaaagacaacacaggaacaccaacggtgcctgatgatgtcgttccccctgccattaatgacataccttcaccacccgcacgtgaaacgttgtcactaacgcctgtcagctatcaactcatgaccgatccggcaccgacagcagaggatatctccaatcattacggccttggcagcagactgcaggatgtatcgcctttaacttcatctctggctgacacgctaaactccatcgaaacattctgcgaaaaaactcaaatcacctttaatcaactcatggagttaacggcacagagtaccttcagtcaaaacggggcaagcgctcatgcgggtagccgttatttccgttttggtgaaacagaccctacccgtgtcaatgtttatggggcaacctacctgaacaacacactggcagtagatgctgacagccaatatctgtgggtacaaaccgatggcaaaaaactgaatttcagtgacagtaccgttgttgaactgtcaggccgggccgaaaagctggtgcgcctagctgccgaaaccggactctcctttgacgaactggattggttgattgccaatgccagccgcagtgttcccgaacactatggcaaaatcgtattggataaaccggtacttgaagcgctggcggaatatatcagcttgagacagcgctcaggccttgatgtcgatactttcgtcaccttcatttgcgcagtcaatccttatgcccctcgccagacagccagcctctatgagaaaacattccgctcagccgctgacggtaatcaggtcattgccctgggtgaagaagtaaaatacaccttggatgaacaagacgaattatctactttatgctgtaaggccctgggcgttaccagtgatgagtttttccgcatcgggagttactgttttgatgacgctggccactttaccgtggatgaatatactgccagtcaattgtatcgcttcggagccattcctcgtctatttggcctgacgtttgctcaggccgaaattttgtggcgcttgatggcaggcggaaccgatattctgttgaagcagttgggtcaggccaaatcgctgcaaccactgaagatcctgcgccgtactcaagaagttatcgattggatggcttcaacccggctgaatttggtttatctgcaaggcatggtaagcacacagtggaacggaaccgcggccgcagatatgttcaatttcctgcaaaatgtctatgtcagtgttaataacaacccgtcaaattcgctgaaatcccttgatcctgccctgcaacaaaaaatcctgcgggcactgagtgcgggttttagtatcaaaagtaatgtgatgaatattgtgacggtctggctggaaaaaatcacggccgacgatacgttgcccttcacactatctgattactggaatgccattcaaacattgttcagtaccaacaccaccacattggacgatttacaatctgataccaaccttgtaatagccactcagcgattgagtcaattggtgctggttgtcaaatggctgagtctgactgagcaggatctgcaactgctgacagattttcctgagcgcctgatagacaaccaaaccagcgcctctgctcccaatctgtctttactgctcacgctatcccgttttaaacagtggcaaactcaagttacggttcctcacgatgaggccatgcgctgtttcgaacaactcaatgatcccacaatgacaatcggccatgccgcaaccctgatcgcccgattgcatgaaatggataaaggcacagtcgaacaggtcaatattctgctgtttggcgacaataactggccaaaaagttttaccgcgctctggcagcttctgacttggctgcgcgtcgggcaaagcctgaatgtgggcagtaagactctgagtgacctgatgaaaatgatgaaagccgatcctgctgccgaaaacactgctctactggcatcagtcgcccaaaacttaagcgcggcaatgactggccgtcagtaa

SEQ ID NO: 2174 - DNA, 492 bp, Xenorhabdus bovienii
  Coding DNA location: Contig name=SeqID_16867; Position on contig =38210..38701bp; Strand=-
ttgatcgagaccaaacaaaagatcccaactatttttaaaaatgccgaatttgtggaatgttatcgaaaagattttgattccttcgctcatttcactattccgattgatgtcggcagtgcacaagagcctattaatcaacaaaataccgatgtctatatttattcaaataaaaagcagaaaatcattgctgaattgaaattaacagatgcgctaattgaccgtattaacaaagcgaaaaaagatttaagctcactgaaatttaatttctctgtgacaatacatagaacaaaagaaccgattaatgtaaaagcccttggtgtatttatgacaaatgataaaggtcaaatcacccccatggtttatgaagactttgaatggtctaagtccaaatatgctacctttaaattatctgatgttgccgtcaactcgttgttaacaaagggtaaacatccgttattattagagattgattatttcaataaaaataaataa

SEQ ID NO: 2175 - DNA, 135 bp, Xenorhabdus bovienii
  Coding DNA location: Contig name=SeqID_16867; Position on contig =38698..38832bp; Strand=-
atgcgtaaattatctgtaattgctttatccgtgctggcattaactggttgtaaagtcggtttagatacagaagtaaacctcagcgatattcttgctcaacttccggcgattcccgtcaagagtctaagagtttga

SEQ ID NO: 2176 - DNA, 414 bp, Xenorhabdus bovienii
  Coding DNA location: Contig name=SeqID_16867; Position on contig =39194..39607bp; Strand=+
atgaataaaatttgtacgttattattatctgctgtgatgctgtgcagtggttgtgccaccatcgttggtgaaaaaaatcaacttattgaagtcaatagtcagccttcaggcgccgaattttcaatcaaagatgaaactggcaaggtggttgcgcatggaaatacaccccaaaatgtcatgcttgaaaaatcgaatggtcgttattttggtaaaaagaactatcagataacttttgcgaaagaacattttaaatctgccactttgccgctggtagcaagacctaacggatggtatatcgggggcaattttgtatttggtggcttgattggctggttgattgtagatcccctgaatggtggtatgtatacgctgaacccaaaaatagccaatgccgtattgtctgaagccaaataa

SEQ ID NO: 2177 - DNA, 1599 bp, Xenorhabdus bovienii
  Coding DNA location: Contig name=SeqID_16867; Position on contig =39670..41268bp; Strand=-
atggaacaacaatatttcattggtattgatgtcggctccgccagtgtacgtgccgccatttttgatcagaaaggcaagcgattagcattttctgtccgctctatccaacaatttcacccaaaagcagattttgtcgaacagtcatcggcagatatctggtcaaatatcggcactacagtcaaggaggctgtttctcacgcagggatcgatcccactcatgttaaatccatcggttttgatgccacctgttcattagttgcggtcagtgcggaaggagagccgttatctgttgcagaagacggcagtccagagcgcgatatcatcatgtggatggatcaccgtgcaatcgaggaaaccatccgcataaatctcacggatgaccccaccctacgttatgtcgggggtgaaatcagtgtcgaaatggaattacccaagattttatggttgaaaaaccactttccacagcgttatcaagcagcgtggcgcttttttgatttagctgattttctagtatggaaagcgacagatgccgatgttggcagtatttgcactctcacttgcaagtggaattatctggctcatcaaaaacagttcagcaaagaatttcttcaacgtattgggctggaagatctaacagacaagataccgacaattattctcgagttaggccaacaagctggccatcttactgagcagtcggccagtgcattaggcttacacggcgatgttattgttgccagtggcattattgatgcccatgctggcgggctagcgctgattggcgcaaaaccgaatggcagtctggcaatgatcagcggaacctcaaattgccatatgattgtcagcccagagcctgtcatggttcgtggtgtatgggggccttactttggggcgatgctgcctgattattggcttaatgaaggtggacaaagcgctgccggagcactggttgagtggtcgatccgccagcatgaagcctggcccgtgctggaggctgaagccaaagcagctgggcttcattattaccaactactcaatgatgccgttgcccaactggagctacgcgaaaaatacccaacagcccaactgcatattttggctgaccatcacggaaatcgctcaccacgggcaaatcccaacgctaaaggcatgattagcgggttgactctggaacaggagcgagaaggcttggcgcgatattatctggcaacgttacaatctatcgcttatggcacacgccatatcattgatactttgattaaggcagggcatcaaatagatcgtctggtgatatgtggcggtgcaaccaaaaatgcattgtggctgcgggaatatgccaatgcaacggggcaggaaattcatctggcagaggaagaggatgcggttaatctcggtgcagccatgttaggcgcagtcgcctgcggagcgtttactgatattaccgcagcagcccagtcaatggtacgggaaggaaatgtgatcagcccagagaaagaaatgttcccgttccatcaggcaaaataccaagtctatttacagatgtatcaagatcagcagcgttatgttgatatgatgcgttctgctgtgtcttttaattaa

SEQ ID NO: 2178 - DNA, 189 bp, Xenorhabdus bovienii
  Coding DNA location: Contig name=SeqID_16867; Position on contig =41491..41679bp; Strand=+
atggataaaaaaattatagaaatattacaatatgagttaaaagcagcaacaggaaaggagtttcatcgaataatgacagaaattagtgtgccattgcatgagaaaactggcatagatgttattagttatggtaagttaatcaatgaaattatctgcacttttgttatagtcggtaatacaatacactga

SEQ ID NO: 2179 - DNA, 336 bp, Xenorhabdus bovienii
  Coding DNA location: Contig name=SeqID_16867; Position on contig =41801..42136bp; Strand=+
atgctggccagaggattaaaaccgcgccagatcgccgttgagacaggatgcagtgtccgggttatttataactgggttcacacttggcatgacttcgggattgccggtctattgggcggtcatgccggcggccggtatctcgccatgacgcctgaaatgatcgcaaccgcggttgaaatcgcctgttccgaatccctgacgctggcccgaatagctctgggggttgaggaaaagcacggtcctttgccatgcacgcttgaaacgctggcaaagacactgaaaaaacaggggctcacctataaacgagcccgtctgtcgttaaaaaaaacgcgatga

SEQ ID NO: 2180 - DNA, 537 bp, Xenorhabdus bovienii
  Coding DNA location: Contig name=SeqID_16867; Position on contig =42162..42698bp; Strand=+
ttgctggataagattaaggccggtgcacgggcaggccgctaccgtctggtctattttgatgaagccggttttgccgcctctccgccggtgcaatatggatggagtccacggggtaaaccccatgaaactgagcctcaacaccatgacagacggtcagttctgggggcgttaaattacacggacaacacgctgttttaccaggcaccgtcaggcagtatcacacgagctgatgtgattgattttttagagcaggtcgccaaacaaggggacaaccgcctgacatttttagtgttggataatgcgcgtatccatcatgggatagagaaaaaaatcagaaatcgctggttacgagaacacaacctgcttttattttatcttcctgcctacagcccagagctgaatctgattgaaatcatctggaaacaagccaaatatcactggcgacgctttatcacttggactcaggataccgtggagtatgagctaaatactctattggaaggttatggtgctaaatttgcaattaatttttcttga

SEQ ID NO: 2181 - DNA, 402 bp, Xenorhabdus bovienii
  Coding DNA location: Contig name=SeqID_16867; Position on contig =43037..43438bp; Strand=+
atgaatcaaggtcgttgcctgtgtggtgcggtagggataacaacctatcaaaatattgagaatatcaatgcatgtcactgcaaaacgtgccaaaaatggaatggaggcccgtttttatctgtagactgtaagaatgatctgcaaatagaaggtgctgaaaacatttcaacgtattcctcttcagcgtgggcagaacgggctttttgtaataaatgtggaacacaccttttctaccatttacttcagcctagtatctattatgtgccggttgccctgtttgaaaatagtcattcgagtaaattatctaatcaagtttatgtggacagtaaacctgcgtattacaattttgttgaaaaaacaccgatgttaaataaacaggatattcttaatttatttaaataa

SEQ ID NO: 2182 - DNA, 660 bp, Xenorhabdus bovienii
  Coding DNA location: Contig name=SeqID_16867; Position on contig =43724..44383bp; Strand=+
ttgattaatgttttgttagttgatgatcacgaactggttcgcattggtgtgaaaggcatactcgaggatgtaaaaggaattaaggttgcaggagaagccggtagcggagaagatgcggtcagatggtgcagatcaaacagtacggatgttgttattatggatatgggaatgccgggaataggtggccttgaggcagccaaaaaaatcattcgctattcgcctgatacgcgagtaattatgctgactatccatactgaaagctctttgccagcgaaagtgatgcaggccggagtcagaggatatttgagtaaggcagcaacacctcaagacatgattaatgctattcggacggtttatgcaggtcagcgttatatctctcctgatattgcacagcagatggcgctcgaccagttatccccaccaaaagagaacccactggctgaactctcagagagggagttacagataatgacgatgatcactcagggccgaaaagttaatgagatttccacattgcttaaccttagcccaaaaacagtaaatagctatcgctatagaatgttcagtaaactaaatatcaagggtgatgtagaattgacccatatggcgatacgttgtgggttgcttgacgcacagaatatggtaaaccatagcggatga

SEQ ID NO: 2183 - DNA, 1767 bp, Xenorhabdus bovienii
  Coding DNA location: Contig name=SeqID_16867; Position on contig =44471..46237bp; Strand=+
atgtatgacaccactggctcggtgatttatgtcggtaaggctaaggatctgaaaaaacggctatccagttattttcggacacaagttggcagccgcaagacagaatcactggtaaaaaatatcgtccaaatagatgtcacggttacgcatacagagacggaagcgctcctgctcgaacataactacatcaaactttatcagcctcgctacaatgttttactgcgggatgataaatcctacccttacattttcttgagcggagatacccatccgcgtctgaccctgcaccgtggtgccaaacatgcgaaaggcgagtatttcggaccatttcctaactcccatgctgtgcgtgataccttagctctcttgcagaaactttttccgattcgccaatgtgaagacagcgtataccgcaatcgttcaaggccctgtctgcaatatcagattggtcgctgtcttgctccttgtgtcaacggttttgtaacggatgaagaataccagcagcaggttgaatatgtcagcctgttcctatctggcaaagatcagcaggtactgacagagctggttggcagaatggaagaagcaagtaaacaactgcaatttgaagatgcggcttgctaccgtgaccagattcaagccgtgaggcaggtcactgaacggcaatttgtttctggagaaggggatgatctggatgttatcagtgttgcttttgatacgggaatggcatgcctgcatgttttgtttatccgtcagggaaaaatcctgggcagccgcagttactatcctaaaattcccgctgataccaaattggatgaagtagtacaaacttttctcggccaattctaccttcaaggcagccagaacaggacattgccgacggagatcctgctggatttctcgttgcctgaaaaagaacttttggaagcatctctttctgaattatcgggcaggaaagtgcatatccaacctcgtccaagaggtgacagggcgcgttatctcaaattggcacgtaccaatgcagcaacagcattaaccacgaaactatcccagcaatcgactatccatcagcggttggcatcacttgctgaatttgctggcattaaaaaaattcatagaatggaatgtttcgatatcagccatacgatgggagaacagaccgttgcatcctgtgtcgtttttgatggaaatggccctgtgcgctctgaataccgtcgctacaacattgtaggaataacaccgggagacgattatgcagcgatgaatcaagttttacgtcgccgatatggcaaagccattgagcagaccaaaattcctgacatcatctttattgatggaggtaaagggcaattagcgcaagcgctggaggttttcggctcgctggatgttgaatggaataaaaactatcctaagctaattggcgttgcgaaaggcagtgatcgcaaagcgggtctggaaactctgtttttcgaggcagaaggcgggggaatgacacttcctcctgattcaccggcattgcacgttatccagcatattcgtgatgaatctcacaatcatgccatcacaggacatcgccagcgtcgggaaaaagtgaaaaagaccagcacattggaatcgatagaaggtatagggccaaaacgtagacaaatgttgttaaaatacatgggtggattacagcctttacgcaacgcaagtgtagaggagatcgcaaaagtgccttctatttcgtattcgctagcagaaaaaatctataatgcgttgaaacactaa

SEQ ID NO: 2184 - DNA, 114 bp, Xenorhabdus bovienii
  Coding DNA location: Contig name=SeqID_16868; Position on contig =21..134bp; Strand=-
ttgtgcaggtatagttacgcgtcgatttttcagccgtattcaatacgttccttgcctccatgggccacggctgaccctgacaggaggctaataatccgtaaggagcaatgctaa

SEQ ID NO: 2185 - DNA, 135 bp, Xenorhabdus bovienii
  Coding DNA location: Contig name=SeqID_16868; Position on contig =145..279bp; Strand=-
ttgcgactggggtttgcttgtttgaaattatgcgtcagagaagcgcccagtaattttttgtcctgcatgatgcgtttcattgggacatcattggaaataagaataaacgcgttttttcttttacccgtaccttga

SEQ ID NO: 2186 - DNA, 738 bp, Xenorhabdus bovienii
  Coding DNA location: Contig name=SeqID_16868; Position on contig =227..964bp; Strand=-
atgagtgaaattatctacggtattcatgccgttaaagccttgctggatcgcgatcctcagcgattcatggaagtttatgtattgaagggacgtgaagatcgtcgcttaaccccattgttacgggaattggaagatattggtattgcagttcaactggctaatcgtcaatggctggatactcagacagaaagcgcggtacaccaagggatcattgccaaaattaaacctgggcgccagtatcaggaaagcgatttaccggattttctatcgcagttggatcgtccttttttgctggtactggatggcgttactgatccccataatcttggggcttgtctgcgtactgcggatgctgctggcgttgatgtagtcattattcctcgtgaccgctccgcacaactgaatgcaaccgccaaaaaagtcgcttgtggtgcagcagaaaacgtaccgctcattcgggtgaccaatcttgcccgtaccttgcgtttgctgcaagaaagcaatatctggattgtgggaactgcgggtgaagctacccattcgctgtatcagagcaagcttactggcccgatggctttggtgatgggtgcagaaggggaaggaatgcgccgcctgacacgtgaacattgtgatgaattgatcagtatcccaatggcgggttctgtttcttctctgaacgtgtcggttgcgactggggtttgcttgtttgaaattatgcgtcagagaagcgcccagtaa

SEQ ID NO: 2187 - DNA, 2487 bp, Xenorhabdus bovienii
  Coding DNA location: Contig name=SeqID_16868; Position on contig =1051..3537bp; Strand=-
gtgaagcacggggagcaacagcttgctgatgacaacagaggaattacgatgtcaaaagatccttttcaggaacgagaagctgaaaaatacgaatctcctatcccaagccgtgaatacatcttggatatcctttctaaacacaccactccggtaagtcgtcaggaattagcaaaagaacttcagttaaccagtgcagatgcacaggaagcgtttcgacgtcgcctgcgggcaatggagcgtgatggacagttgattttcactcgtcgtcaatgttatgcgttgccggaaagactggatttgttgaaaggtacggtgattggacatcgtgatggttacggtttcctgcgtgcggaaggccacaaagaagatttttatctgccagcagaacaaatgaaaatggcaattcatggcgatgtcatattggcacagcctttgcaaccagaccgtaaaggtcgcgttgaagtgcgtatcgttcgagtactggagccaaagaacagtcagattgtcgggcgatattttgtcgatgcgggtatgggatttgttgtccctgatgacagtcggctaagtttcgatatcttgatcccaaaagaagaaatttgcggtgcaagaatgggcaatgtcgtcgtcgttgaattgacgagtcgtccgacccgccgaactaaagctatcggcaagatcgttgaagtgctcggtgaaacgatgggtacgaacatggcggttgaaattgcgcttcgtacccatgaaattccacatagctggccaccaatggtagaaaaacaggtggtcgatctcgatgaaaatgtaccggaatcggcgaaaaaaggccgtgttgacctgcgtgaactgccactggtcacgattgatggtgaagatgcccgtgactttgatgatgcggtttattgtgaaagaaaacgtggcggcggctggcgtttatgggtagcgattgcggatgtcagctattatgttcgtccgcaaacacctctggatacagaagcgcgtagccgtggtaactcagtctatttcccatctcaagtcgtaccgatgttgccggaaattctgtcgaatgggctgtgttctctgaacccagaagtcgatcgcttgtgcatggtgtgtgaaatgaccatttctgcccaaggcaagctgtcttcctataagttctatgaagctgtgatgaactctcatgcccgtttgacttacaccaaggtatggaaaatattgcagggcgatcaagagctgcgtgaacattaccagccgctggtgacgcatatcgagtatctgcatgagctttatcaggcactggagcaggcgcgggaacagcgtggagccatttcgtttgagtctgaagaagcgaaatttatctttaacgcagaacgccgcattgagcgtattgaacccgttacgcgcaacgatgcccataaactgatcgaagagtgcatgattctggccaatattgcggcggcacgctttgttgagaaaaataatgagccagcgttataccgagtccatgatcggcccagagaagaaagtattttaaatctgcgctcagtcttcaacgaactgggtttgagcttattgggtggaatgaaacctgaaccgaaagactacgctcaattgatgaaagatgtggctgaacggccggatcatgaattactgcaaaccatgttgctgcgctccatgaaacaggcgatttatgatccggaaaaccgtggccactttggcctggctctgcgttcttacgcgcactttacgtcgccaatccgccgttatcctgacttggcattgcaccgagcgatcaaatatttattggcgcaagagcaagagaatggtgccgttgaacagcactggacaccaaccggcggctggcataacgatatggatcacatgctgcaattgggcaaccattgctccatgactgagcgccgtgcggatgaagcaacaagagacgtggcagactggctgaaatgcgattttatgcaggatcaagtgggcaatgttttcactggcttgattactagcgtgacgggtttcggtttctttgtcaggttgaatgagctgtttattgacggcttggtacatgtttcaacactggataatgattactacagatatgataatgtcggccagcgtctgattggtgaatcttctggccagacttatcggcttggtgatgaagtagagatccgtgtcgaagcggttcacatggatgaacgcaatattgatttcgccttgctttcttcgacccgaaaggcgcgtaatcaaggtaagaccgcgcgagataagtcgaaaagaggtacaccagagcgtaacagtagcaaaaaagggcgtgatcataaaaaatcagccaattttgagccagacaacgcctcccgtaaaaagaaaaaagcggaaaagcctaaagcaagcaagaagaaaacgtcagacaaaaccaaaaagattactgcaaaattgaaagcgaaacgcgtgaaaaaaacgcaggaaaatagctga

SEQ ID NO: 2188 - DNA, 426 bp, Xenorhabdus bovienii
  Coding DNA location: Contig name=SeqID_16868; Position on contig =3545..3970bp; Strand=-
gtgagtgtgcagttaaccagttttaccgattatggcttgcgcgccctgatttatatggcttctctgcctgaaggtcagatgactagcattaccgaagtaactgaagtttatggtgtttcacgtaatcatatggtgaagataattaaccagctcagtaatttaggtctagttaatgctgtcaggggaaaaaatggcggcattagtctgggtaagcctgccagcgagatcaaaattggcgatgtagtccgttcactggaaccgcttccattggttaactgtagtgcttgctatatcacgcctgcatgtcgcttaaaattagtgttgaatcaagcggtagaaaattttttgcaagagttgggtaaacatactttggccgatatggtcaaagacaatcgtcccctttatcagttgcttctggctaagtga

SEQ ID NO: 2189 - DNA, 1299 bp, Xenorhabdus bovienii
  Coding DNA location: Contig name=SeqID_16868; Position on contig =4184..5482bp; Strand=-
atgggtaagaacgttgtcgtattgggcacccaatggggtgacgagggcaagggtaaaatcgtcgacttgctgactgaacgagctaagtacgtggttcgttatcaggggggccacaacgcgggccatacactagtcatcaacggtgaaaaaaccgttctccacttaatcccatccgggatcttgcgtgaaaatgtcattagcattatcgcaaatggggtcgttttagcaccagatgctttgatgaaagaaatgaatgcgcttgaatcacgtggggttcctgtacgtgaacgcctgcttatttctgaagcctgcccgttgatcctgccttatcatgttgcactggacaatgcccgcgagaaagcgcgtggtgccaaggcgattggtacaactggccgtggtatcgggcctgcatacgaagataaagtagcacgccgtggcctgcgtgtaggcgatttgtttgataaagaaactttcgcggtcaaactgaaagaaatcatcgagtatcacaacttccaactggttaactactacaacgagcctgctgttgattatcagaaaacactggatgatattctggctgttgcggatatcctgacaaacatggtagttgacgtttctgacctgctctataaagcaactcagaaaggtgaactggtgatgttcgaaggtgcacagggtacgctgttggatatcgaccacggtacctatccttatgtgacttcttctaataccacagcaggtggcgttgcaacaggttctggtctgggtccacgctacgttgactatgttctgggtattatcaaagcctactctacccgtgttggtgcaggtccattcccaactgaactgtttgatgaaaccggcgagtacctgcgtcagaaagggcaggaatttggtgcgacaactggccgtagccgtcgtaccggctggctggatatcgttgccattcgtcgtgcgatccaaatcaactccctgtctggtttttgcatgaccaaactggatgtgcttgatggtctgaaagaagtgaaaatctgtattggttatcgtatgcctgatggtagcttgattgacactacgccattggcagcagaaaactgggaaggtcttgaagcagtgtatgaaactctgcctggttgggatgaaagcactttcggcgtgaaagatcacagcctgctgccagaagcagcactgagctacatcaagcgtgttgaagaactgactggcgttcctgttgatattatttctactggcccagatcgtgctgaaaccatgatcctgcgtgatccatttgatgcttga

SEQ ID NO: 2190 - DNA, 144 bp, Xenorhabdus bovienii
  Coding DNA location: Contig name=SeqID_16868; Position on contig =5450..5593bp; Strand=+
ttgggtgcccaatacgacaacgttcttacccatttcaaaagttcactcggttgcttaaaaatggattctaccatctcatttagcacctttcagtattttttctcacttctgttatttcgtttcgtcatattaacgggctgttaa

SEQ ID NO: 2191 - DNA, 93 bp, Xenorhabdus bovienii
  Coding DNA location: Contig name=SeqID_16868; Position on contig =5579..5671bp; Strand=-
atgaatgaccgctgcctaagccactgtaagaaaacttgcagtggcttttttgttactagcatcattacgaatgcttacttaacagcccgttaa

SEQ ID NO: 2192 - DNA, 1011 bp, Xenorhabdus bovienii
  Coding DNA location: Contig name=SeqID_16868; Position on contig =5727..6737bp; Strand=-
atgcgtaagtcattcgtctttgctattgccgttatattggttgtgctgtatacgtcgatattcatcgtgtacgaaggtcagcgcggtattgtactgcgttttggtaaggttgcgcgtgatgcggaaaataaaccactggtttatcagcctggtctgcattttaaaattccatttattgagacagtcaaaacacttgatgcccgtatccagactatggatatcaaagctgaccgtttcctgacgcgtgaaaataaagacctgattgttgattcttacctgaaatggcgcattaaagatttcagccgctattatctggcgacaggtaatggagaaattgctcaggctgaactgctgctaaagcgtaaattcagtgaccgtctgcgttctgaaatcggtcgtttggatgtgcgtggtattgtgacggattcccgtggtcgtttaactaccgatgtgcgtaattctttgaacttagggacaagtgatggtgatacggcagaaacagcggacaatccggttgcttcggctgcggctagtgtagggcaggaaacgaaaggcaaacagcccgttctgaaccagaacagtatggccgagctgggcattgaggttgtggatgtgcgtatcaaacagatcaacttgccacaggaaatttcagaagcaatttatcagcgtatgcgtgcagatcgtgaagctgaagcacgtctcctgcgctcacaaggtctggaagaagctgaaaagatccgtgcagtagcagataaaacagcaactgaaattaaagctaagtcgaatagcgaggcacttatcctgcgtggagaaggtgatgcggaagcggccaagctgtttgctgatgcgttcaacaaagatcctgaattctatgcgttcatccgtagcctgcgtgcttatgagaagagcttcaagaatgatggcaataacatcatggtactcagcccagatagcgatttcttccgttatatgaaagcgccagttaagcagcacagtaataccaatgactga

SEQ ID NO: 2193 - DNA, 1245 bp, Xenorhabdus bovienii
  Coding DNA location: Contig name=SeqID_16868; Position on contig =6740..7984bp; Strand=-
atggcgtggaatcagcccggtaataacggacaggaccgcgacccgtggggaagcagcaataataatggcggcaactccggcggcaacaataaaggtggtcgaaaccgtggggcaactgatctcgacgatctattccgtaagctgagtgaaaaactcggtggtttcggtggaaaaaaaggtggaaatggttctgagcagggccctaaatttggtggccgtattattggtcttgccgttgctgctgccgttgctatctgggttgtaagtgggttttatactatcaaagaaacagaacgtggcgttgttatccgattgggtaaattcagccatattgtgcagcctggcttgaactggaaaatgacgtttatcgatcgagtccgagccgttaacgtcgaatctgttcgcgaactggcgacatcgggtgtcatgctgacatcggatgaaaacgtagtgcgtgctgaaatgaacgtacagtatcgtgtgaccgaccctgcggcttatcttttcaatgtcaccagcccggacaacagcctgagccaagcgactgacagcgcagtgcgtggtgttgtaggcaaatacaccatggaaaaaatcctgacggcagatcgtaccatcgtgcgtaacgatacccagaaagtactggaagaaaccattcgtccatacaacatggggatcacgctgcttgatgttaacttccagactgcccgtccaccagaagaggtgcaagtggcatttgatgatgttatcgcagcgcgtgaggaagagcaaaaaaccattcgtgaagctgaatcctacaaaaatgctgttttgcctatggctaagggtgatgctcaacgcatgattgaagatgccagagcctataaagtcagtgtggtattgaatgctcagggtgaagtggcaagttttgccaaaattctgccggagtataaagctgcaccggaaattacccgtgagcgtctttacattgaaacgatggagtatgttctgagtaatacccgtaaggtcattgcaaacgaaaagagcaataacatgctggtactgccattggatcaggtttttcgtaaacaagctgaagtaccgaaaacgcagtcatcagatgccaaagtagcgccagagaagagcggctctacacattttgcacctgaacaaggacaaacaggttataacaactccagtaataatcattctagctatggcaatcccagtagcctgcgtggtgagacgctaagacaagggagaccataa

SEQ ID NO: 2194 - DNA, 171 bp, Xenorhabdus bovienii
  Coding DNA location: Contig name=SeqID_16868; Position on contig =8020..8190bp; Strand=-
gtgacagaatcagtactgtcaaaaacatcacccaaaaatattggttgcttactaaaacgacgaaatttgtcgtttctgaccacagaggccgctgtcagacctgtcagggacaggcaatggcctgtgaagtgggaagcctcatccgttagggtggagagcagtcacctctga

SEQ ID NO: 2195 - DNA, 135 bp, Xenorhabdus bovienii
  Coding DNA location: Contig name=SeqID_16868; Position on contig =8163..8297bp; Strand=+
atgtttttgacagtactgattctgtcactgcaattctggcacagtcattccatcaccgccatcccattacagctactacatgactataagcgccttgaaatggctgacaaaatgataccttgtttgtcttcctga

SEQ ID NO: 2196 - DNA, 1281 bp, Xenorhabdus bovienii
  Coding DNA location: Contig name=SeqID_16868; Position on contig =8307..9587bp; Strand=-
ttgtttgatcgttatgaaggcggagaattagccgttctggtgcatgtttttttctcacaggaaaaagatacggaaaatctcagtgaatttgaatcattggtgacttccgcaggtgtttctcctgtgcagattgtgacgggaagcagaaaggcaccgaatccgaaatattttgtcggagaaggtaaagcagaggaaattgctgaggctgtcaagaacagcggtgcagatgtggtcttgttcaaccatacactaagccctgctcaggaacgtaatcttgaacgtctttgccaatgtcgtgtcgttgatcgcacgggtgtgatcttggatatttttgcccaacgggcaagaacgcacgaaggtaagttgcaagtcgagttggcacaattacgtcatttatctacccgtctggttcgaggctggactcaccttgaacgtcagaaaggggggatcggtttgcgtggcccaggggaaactcagctagaaactgaccgccgcctgctgcgtgacaaaatcaagcagattttggggcgtctcggcaaagttgaaaaacagcgcgagcaggggcgtcaggcacgtaataaagctgatattcccactgtttctcttgttggttataccaatgcgggaaaatcaagtttattcaaccggataacttcggctgaggtgtatactgccgatcaactttttgctaccctcgatcccactttgcgtcggatagacgtgaatgatgtcggtacagttgttttggcggataccgtgggttttattcgccacttaccccatgatttggttgcggcgtttaaagctactttgcaggaaacccggcaggcaagattgctgctgcatgttgtggatgcggcaggcagccgtctggacgaaaacattgttgcagtaaacagtgtcctggaagaaattgaagccaatgagatcccttccttgttggtgatgaataaaatcgacatgttggaagattttgttccacgtattgatcgcgatgaggaaaaccgcccgataaggatctggttatccgcacagactggagaaggtatcccgctgttatttcaggtgttgaccgaatatctttcaggtgaaattgcacactatgaattgcatttgccgcctgatgcggggcgtttgcgcagtcgtttttaccagcttcaggccattgagcgtgaatggatagaagacagtggccaaattggtattgaagtcaggatgccgatggttgattggcgccgactatgtaaacaagaattgaatttacttgactatgttgtctga

SEQ ID NO: 2197 - DNA, 135 bp, Xenorhabdus bovienii
  Coding DNA location: Contig name=SeqID_16868; Position on contig =9600..9734bp; Strand=-
atgctggcgctaacccagcagcacaaccggaaagtgatggcgctgaataaatcagtgtccgtgcctgacgtaaataaaaacataggtagggagactttacctatgttttttcctatggatttctacttagcctga

SEQ ID NO: 2198 - DNA, 303 bp, Xenorhabdus bovienii
  Coding DNA location: Contig name=SeqID_16868; Position on contig =9685..9987bp; Strand=-
atggctaaggggcaatctttgcaagatccattcctgaacgcgttacggcgtgaaagggtcccggtttctatttatttggtcaacggcatcaagttacagggtcagattgaatcttttgaccaatttgttattttactgaaaaacacggtcagtcagatggtttataaacatgccatttcaactgttgtgccttcccgtcctgtgtctcaccacggcaataatccgaacgtgacgactggcgttggaaattatcatgctggcgctaacccagcagcacaaccggaaagtgatggcgctgaataa

SEQ ID NO: 2199 - DNA, 99 bp, Xenorhabdus bovienii
  Coding DNA location: Contig name=SeqID_16868; Position on contig =10008..10106bp; Strand=+
ttgttcttaactaagaacctgttggttcgaaaaagtaactactcaaaaataacgctttgtactgatcaattgtacacaatcaatgaatttatgtactaa

SEQ ID NO: 2200 - DNA, 942 bp, Xenorhabdus bovienii
  Coding DNA location: Contig name=SeqID_16868; Position on contig =10096..11037bp; Strand=-
atgagtgatttaaaaactcaacatctgccgacagccattttcatcatggggccgacagcttcaggaaaaacggcgttatcgatcgccttgcgtcagcatcttcctgttgaattaatcagcgttgattctgcgttgatttatcgtgaaatgaatattggcactgcgaaacctaccgcagcagagcaggcacaggcacctcatcgtctggttgacattctcgatcctgctgaaatttattccgctgctgattttcgccgtgatgctctgaaagaaatggctgatatcatggctgccgggagaattcccctcctagctggcggaaccatgctatatttcaaagcattgctggaaggattatcgcccttaccctcttctaatcctgatatccgggcgcagatcgagcaacaggcggccgaacatgggtgggaagccttgcatcggcaattgcaggaaattgaccccgttgcagcagcaagaattcacccaaatgatccacaacgtctcactcgtgcactggaagtttttcgaatttcgggtaaaactctaactgcattgactgaaacgtctggagaaatattgccttatcgtgttcatcaatttgcgatcgcacctgcaagccgtgaaattttgcatcagcgcatcgccgcacgttttgaacaaatgatcaaatcagggtttgaagatgaagtaaaagcgctttatgctcgtagtgatttgcatacagatttaccttccattcgttgtgttggttatcgtcaaatgtggtcttacctttcaggcgaaatctctcatgatgagatggtttatcgtggcatatgtgcgacacgccagctagcgaagcgccagatcacgtggctcagaagttgggacaatgtgacttggttggacagtgaccaacctgaacaggcactgaatacagtgatgcaggttattagtacataa

SEQ ID NO: 2201 - DNA, 1944 bp, Xenorhabdus bovienii
  Coding DNA location: Contig name=SeqID_16868; Position on contig =11030..12973bp; Strand=-
atggctatcaggattttacccccacaattagcaaatcagattgctgctggtgaagtggttgagcgccctgcatcggtggtgaaagaattggtggaaaacagccttgatgccggcgctacccgcattgatattgagattgagcgcggtggtgcaaaattaatccgcattcgtgataacggctgtgggatcgaccagcaagatctgacattggcactggcacgtcatgccaccagtaaaatcgcttcgcttgatgatttggaggcgattgtcagtatgggattccgtggggaagcactggccagtatcagctcggtttcacgattgactctgacttcccgtactgaaagccaaacagaagcgtggcaggcttacgccgaaggccgtgatatggaagtcaccgtaaaacccgcagctcatcccgtcggtacgacggttgaagtattggacctgttttataacacgccagcacgtcgcaaattcctgagaacagaaaaaaccgagttcgggcatcttgatgaagtggtgcgcaggatagctctggcacggttggatgtggcgatcaacctgcatcacaacggcaaattggttcgtcagtatcgtccagcgaaagaagaatctcagcatgagcggcgtttggcggccatttgtggaatggcgtttgtgcaacaggctcttgcgttgtcatggcagcatgactccttgtccattaaaggatgggttgctgatcccatgaatgatactgccgggagcgatattcagtattgttatgtcaatggacgtatgatgcgggatcggctgattaatcatgctatccgccaagcttatcaagatttgcttcagggagagaagcagcctgcttatgtattgtatctggagatcgatccgcatcaggttgatgtcaatgtgcatccagcgaagcatgaggtacgcttccatcaggcacgtctggtgcatgattttatttatcagggtgtggcagcggtattgaaacagcgggagaagggagctgaactagcgcttggctgtgaggagccggctgccagttgggtgccggaaaaccgtccttctgcgggagagaaccattttctccagcaaaatacgacatcaccgaaggcgtcaccgccttctcgtgccgcgacttctcccttggtttcgtctggggggcatgataaagaacagcctcagcttgatcgcccgcattctggcaatgacacgcggcaacttcatcatggggaaaattaccagaagaaacagggcgagttgtaccaaaaaatgatgcaatttgcaccagaggagaaacggctgctgtttcctgaaaaggctgtctccgtgagggaaaaagccgctccagttcctgtttatgcagcacttttgcagggaaaaaacaatagttacagttttggcaaagtattgagcatccatgctgccagttatgccttgattgagtccccgttggggattgggctactgtctttgccagttgctgagcgctggctgaaacaggtgcagttgacgccaggggagctagggcttaaatcgcagccgctactgataccgctgaaactttctctcagtcaggcagaaatcgacgctttaaagcagaatagtgagctattgaagactttcggtattgaatctacagtcgcacatggaaaagtaactattcatgcggtatcgttgccactgcgtcaacagaacctgccgaaactcctgccggagctgttgaactatctagtggaacaaccctcggtctgtgctgaacaggtagcgatttggctctcccgtcacgttgggagcgaacatgaaacgtggaacgttgcgcaagctgtccagcttttagctgatgtcgagcgtctttgccctcaattggtggaatccccgcctgggggcttattacagttaattgatttacaagcagtggtggcacttctcaatcatgagtga

SEQ ID NO: 2202 - DNA, 1326 bp, Xenorhabdus bovienii
  Coding DNA location: Contig name=SeqID_16868; Position on contig =12999..14324bp; Strand=-
atgatgaatgctttctttgtgaaagtgataaaaaaatggcaagcccattgggtgatgtcctgtgcattgtttgtcatgttgagtcaactgatcatgatgacggcgacagcggctacgttgtcgaatattcatgtgaataatagcccatctgaagctaccgtaacgttggaattcacaggcgggcatcctgattatcggtttttccccctgcatgctcctgagcggttggtggtggatattcgtcagtctggtcatgtcataggactgccaatgcgtttatcaggccaggatctggtgaaagtgattcgaaccagtcagtcccctgatgcacagcataagcggtttgtattggaattggcacatcaggctaccgcgacttcttcagtgaaaggatccgccagtgaatatcaggtggtttttacgttgcaagctaatagtgcagcggctaagagtacagcgaatagcacctcgatgcttaagggaaatacttcattacatgaaagtaagcaattactagctaataatgttcagtcaccgaagcaggaaacaaagcctactccggctcatcatgggcagggagtgaaaaagcaggcagctaaggcagcacagggaaaatacccgattgtgattgccattgacgcagggcatggtgggacagacccaggcgccatcgggcaagggggcttgaaggaaaaaaacgtgaccatcagcgttgcacgcaagctggaagtacttttacgcaatgatcccatgttcaagcctgttttgacgagggatggcgattattttatctcagttgctggacgttctgaggtcgcccgtaagcacaaagccaatatgctggtgtctattcatgcggatgcagcacctaatcgcagcgccagaggggcttctgtttgggtactatccaaccgtcgcgcaaacagtgaattggggaattggctggagcagcacgagaaacaatcggaattgttgggcggtgcgggagatgttctatccaatggtgttaatcctctattgagtcaggctgtgttagatttgcagtttggtcattcccagagagtgggctatgacgttgctgttcaagtattgagtcagttaactagcattggatctttgcataagcgcacgccagaacatgcaagccttggtgtgttacgttcacctgatattccttccatcttagtggaaacgggttttatcagtcatttatccgaagagaagctgctggggtctaatgattatcaggcgagattggcacaagctattcactttgggctgcgccactattttcaggctaacccgttgcagacttctccaatgtaa

SEQ ID NO: 2203 - DNA, 465 bp, Xenorhabdus bovienii
  Coding DNA location: Contig name=SeqID_16868; Position on contig =14339..14803bp; Strand=-
atgaaagaactcgttttattacttccaaatgaaaataccacggttgcattgggcaatgcagtggcggcagccggcgatcgaggctatgttatttatttatatggcgatctgggtgccggaaaaacgacattcagtcgtggcttcctacaggcgctcggccatcagggacatgtgaagagtccgacttatacactggttgaaccttatgctttgcaaccgcggcctgtctatcactttgatctttaccgtctggctgatcctgaagaattggaatttatgggcattcgtgattatttccatcaggatgctatttgtctggtggaatggcctcaacagggcgcagggtttttacctgatgccgatattgagctgcatttgagctatgacagtgaagggcggcacgcgcgttttgtggcgttatctgaatatggtgaaaatctgctggataatctgaagtccttatga

SEQ ID NO: 2204 - DNA, 153 bp, Xenorhabdus bovienii
  Coding DNA location: Contig name=SeqID_16868; Position on contig =14893..15045bp; Strand=-
ttgctgccagaagattcagatcgagaggggttgccattgaatatcaaattactgctgcaaaggggacgtagtttagcacacagcggattgaatacaaaaagtgcggtacgtggcagtacggcggagcagaagatgttaaatgataatggctga

SEQ ID NO: 2205 - DNA, 1158 bp, Xenorhabdus bovienii
  Coding DNA location: Contig name=SeqID_16868; Position on contig =15009..16166bp; Strand=+
atggcaacccctctcgatctgaatcttctggcagcaaacatcaaacaatggggcctttcccttggctttcaacaagtcggtatctgtgacaccgatttatccacagaagaacccaaactacaggaatggcttgataagcaataccacggcgaaatggattggatggctcgtcacggtatgatgcgcgcccgtccccatgaactactgcctgacaccttgcgggtcatcagcgtgcgcatgaattacctgccaaccaaagccgcttttgccagtacactgaataatcctgaattgggttatgtcagccgctattcgttaggcagagactaccacaagctattgcgtcaacgactcaaaaaactcggtgagcagattcaagactattgtagtgctcatgaatatcagggaactctgaattttcggccttttgtcgattctgccccgatcatggagcgccccttggcggccaaggctggtctcggctgggttggtaaacactcacttatattgaatcgggaatcaggttcgtggtttttcctcggcgagttgttgattaaccttccccttcccatagatgccccgcaagaggagcaatgcgggcgttgcgttgcctgtatgacgacctgcccaacaggtgccattgttgaaccttatatcattgatgcacggcgctgtatttcttatctgaccattgaattggatggcgttatccctgaagagttgcgcccgttaatgggcaaccggatttatggttgtgacgattgtcagcttatttgcccatggaatcgtttttcacaattaacggatgaagtagatttcagccctcgtgcagccctgcacacaccaaaattacttgatttattcagttggagcgaagaaaagtttctacgcattacagaaggatcggcaatccgccgtattggttatttacgctggctacgcaatatttccgttgctttgggtaatgccctttatcaggatgatatcgtgctggcactggaaaaaagaatcggtttaagtgaggtactggatgaacatatccactgggccatcgatcagcaaataactcgccgcaatgccaatacgattgaagttcaaacatcacagcagaagcgattaattcgggcaatcaccaaaggtctacccagagatgcttaa

SEQ ID NO: 2206 - DNA, 93 bp, Xenorhabdus bovienii
  Coding DNA location: Contig name=SeqID_16868; Position on contig =16573..16665bp; Strand=+
atggacttgttaaatctggatagcaagtgctttatcgacaatttatttatggtggtgatagatagtacggagcgagcagttaagggcaaataa

SEQ ID NO: 2207 - DNA, 1425 bp, Xenorhabdus bovienii
  Coding DNA location: Contig name=SeqID_16868; Position on contig =16748..18172bp; Strand=-
gtgcagataatttcattgattaacttacgtgatgggcgagctatttttattaatggagaggtagtcacaaatcatgtggatcatcctgcattcagaaatacgatcaggtcggttgcgaatctgtatgattatcagatcgaacatgccgacagaatgatgtttatgacagaagcgggtaatcgaattagtctatactggcaattgccttctacacctgaaaaattgattgcacgtggtcgggctgaatatgaactggctacacagagtgttggctggctcggaagaagccccgataacgtgtcgtcggtgcttactgggatgatgactcatatcgaggtatttgaagattattcgcaagagcgggctgatgctctacggaattattttacctatgtgagtgagaaaaacctctatttaacttacgcactggttaaccctcagggagatcgctcaaaggctccaggagaacataccaagaatatttatcacactctgggtgtggtggaaaagaatgccaagggaattattgtcagaggtgcaaaaatgctcgctacgggagcaccactggctgatgaaattctgattggtgtgcataatccacttaaacctgggattgatgaacggtatgcggtttcttttgccatgccacttaatgcgaaaggtatcaagattatttcaaggcgttcttatgaattaggcgtaaatcccaaagattatccgctgtcgtatcggttcgatgaaaatgactcaattatctattttgatgatgtcttagtgccttgggaacgggtatttatttttgaggatatagagatgtgccgtcggcaatttaaggaaactgctgcggaagtgctgatggatactcaaagtcaggctcgttatgcggtgaaattgcattttctggcggggctagctcagacaatggcagaaacaaacggtgtttgcgaatatcccacggtaagagagtctcttgctaaacttgcgtgttatgcgatgaatattgaagggttgtttaatagtttgatccataaccccagagtcgataacgggttttatattcctgatcgaacacagctttatgcgtgtcaggttattgcacaggaaatatatccaaaagtattggagacgataaggaaactcgcgggtggaggtgttttgatgctgccatcaagtgaagctgatttggagaatgatgaaattttacgcattattgagaaaacacaatattcatctgttgcttcccctattgaaagagtcaggctgatgaaactggtatgggatgcagtggggtcagaatttgcttcaaggcatttgcaatatgagatgttttataccggtgcttcttactttgcgctagagcgtctttatacaaaatatgattggaaatcatcgaaggaattggttgaaaagataaaagcgctctag

SEQ ID NO: 2208 - DNA, 441 bp, Xenorhabdus bovienii
  Coding DNA location: Contig name=SeqID_16868; Position on contig =18220..18660bp; Strand=+
atgaaatcgaagatagtcctttctgagcctgaacgaatcacgttgcaacaactcgccctgaatcatcagcatcgggacatccgtacgagaggaaccggtttactcatgctggccagaggattaaaaccgcgccagatcgccgttgagacaggatgcagtgtccgggttatttataactgggttcacacttggcatgacttcgggattgccggtctattgggcggtcatgccggcggccggtatctcgccatgacgcctgaaatgatcgcaaccgcggttgaaatcgcctgttccgaatccctgacgctggcccgaatagctctgggggttgaggaaaagcacggtcctttgccatgcacgcttgaaacgctggcaaagacactgaaaaaacaggggctcacctataaacgagcccgtctgtcgttaaaaaaaacgcgatga

SEQ ID NO: 2209 - DNA, 537 bp, Xenorhabdus bovienii; identical to SEQ ID NO: 2180
  Coding DNA location: Contig name=SeqID_16868; Position on contig =18686..19222bp; Strand=+

SEQ ID NO: 2210 - DNA, 96 bp, Xenorhabdus bovienii
  Coding DNA location: Contig name=SeqID_16868; Position on contig =19191..19286bp; Strand=+
atggtgctaaatttgcaattaatttttcttgattacttaaatcatcaatatatctttctccggttcttatcatcttttttactctcctatcactga

SEQ ID NO: 2211 - DNA, 93 bp, Xenorhabdus bovienii
  Coding DNA location: Contig name=SeqID_16868; Position on contig =19356..19448bp; Strand=-
gtgtcggaaatacgaaaatcgggcaatgttaatgaaagaggtttctctcacatattaagatcggtgattcacttcctgataatggaggaataa

SEQ ID NO: 2212 - DNA, 237 bp, Xenorhabdus bovienii
  Coding DNA location: Contig name=SeqID_16868; Position on contig =19423..19659bp; Strand=+
ttgcccgattttcgtatttccgacaccattctatgtaccggaaaataccgagatatgttcctgtggattaactataaaagcgatatcaaattccagcattatcatattaacccgacattccgcaccactttcaggaataaaatgattcatagggttgccccaatattttcagcagttcattttgatacacctgtattcccgtcaccatacggtgttcctgaaactcgaaagtactaa

SEQ ID NO: 2213 - DNA, 1617 bp, Xenorhabdus bovienii
  Coding DNA location: Contig name=SeqID_16868; Position on contig =19553..21169bp; Strand=-
atgtctctctctgaacctgccatcaaacgtctcgatcacctcggccttgtcgccgctttttgccatgagatcggtttaccccgcatgattgatgctattttgcctaaatatgcagagcatacggtttctcatggcgaggctcttttagcgatgatcctcaatgggttgggtttccacagccgaacgctccatatgtgccctgatttttttaagcacaaacccgttgaacgcctgattggggtgggaattatggctgaacacctcaatgatgatgtgctcggccgcacgctggacgctttgtttgactgcggtgtctctgaaatttatcaggttatcgctgagcgggttattgataaattggcattaaaatccgattccgttcaccttgatatcacgagttttcacgtggatggtgagtacaaactccccgatgatgacgagacaaaacgcctcgttttggtgcgtggttacagtcgtgatcaccgtcctgacctgaatcaggttgtgctgcaacttatctgtgaaaatcaggcggggatccccgtatacatgcaggcgatgagcggaaacaccaacgacaccaaagcgtttgcagagacgacgaaacatcacattggctgcctgaaagcggcccaaaacagccgttatctgattgccgatgccgcgctttatacccaagagacactggcctcacttcatcaacaaaatcaaaaatttattacccgggttccgttaaccattaaagaggcgaaacagcacctgctgacggttaataccgaccagttacaaccggttacagaaggttatgccggtcattggattgaatcttgctacgggggcgttccacagcgctggttactggtcaacagtgaagcggcgatgcagtgtgaacatcagactttcaggaaaaatacgcggatttcgacggaaaaagaactgaaacagttcgaaaaactcagcaaaaagtcgtttccctgtggtgaagatgctttgcaggcattgtgtgacttcgaagcagaatgccagtttatcggcattgaggcccccaaagttcaaaaaatcgaggtgcataaggggcgaggccgcccggctaaaggtcaacatcccgatagtgttcattatcagctttctgcctcggtctacagccaactggggaaagtggcttatgcccgcctcaaagtcggcatgttcattctggcgacgaatgaaatggacgataaggcgctgaatatggaaactctgctggctaattacaaagcgcaacaaaaagtcgagcggggtttccgtttcctgaaaagtccggagtttctgacttcagcgatttatttgaaaaagccagaacgcatcgaagcgttattaatgataatgacatgcagtttaatggtttatgctgcactggagcataaaatccgcaccggactgaagcaaaatgccccgttctatcccgatatgaaaggtaaacccacccaatctcccacggcgcgttgggtgtttttgaccttcgaagggattagtactttcgagtttcaggaacaccgtatggtgacgggaatacaggtgtatcaaaatgaactgctgaaaatattggggcaaccctatgaatcattttattcctga

SEQ ID NO: 2214 - DNA, 102 bp, Xenorhabdus bovienii
  Coding DNA location: Contig name=SeqID_16868; Position on contig =21131..21232bp; Strand=+
gtgatcgagacgtttgatggcaggttcagagagagacatgttgggcttccggtaaatagaagtaatagatcaaaaccgaagattgccgtcaatctgatttga

SEQ ID NO: 2215 - DNA, 135 bp, Xenorhabdus bovienii
  Coding DNA location: Contig name=SeqID_16868; Position on contig =21498..21632bp; Strand=-
ttgctggctgtttatagcggtgctttcagtgtcttgacatacaccttgatgggaataacgttattggctgttatggtttgttttatgactttgagaaaagtccaaatagcttttaattctagtgtgtcaaagtga

SEQ ID NO: 2216 - DNA, 273 bp, Xenorhabdus bovienii
  Coding DNA location: Contig name=SeqID_16868; Position on contig =21596..21868bp; Strand=-
atgttgctggatgtaggatatttctggatcaatgcggcccgtgtaaggcatatgggaaaggcttatagaccgataaaagaaacgatcatcggctttacacgaggcctcatggcgttcgcattcagagatgtcgatctttcttgtcttggcctggcctgctgtgtgccgccattgggctggcgacaggcaactttgaaaatgccagagggctgtttgccaacttatctgatcatcagttgctggctgtttatagcggtgctttcagtgtcttga

SEQ ID NO: 2217 - DNA, 1428 bp, Xenorhabdus bovienii
  Coding DNA location: Contig name=SeqID_16868; Position on contig =21896..23323bp; Strand=-
atggtgatgtctagagaagatctttccattctatcagcgactgaaatttccaagcttgtgcatcaaaaggatgtttctgtcagagaagttgctactgcggtgattgcaagacttgacggtgtcaaccctcatattaatgcggttgttgaatatcggccggaagagattataagacgtgctgaagagctcgatattgcacttgcaaaaggtgagagtgtgggaactctcgcaggtgtccctgtaaccataaaagcgagcatagatcaaatcgggtttgcaacgacagacggagtccgggccagagaacatgagttccctccctccaacagtgcggttgtcgatcacttgctgaaatctggggcattacttatagggcgtacgaatacagctgcttttagctatcgttggttcaccgaaaatcggctatatggatcaacgagaaatccgcataatccttctttaacacctgggggatcctctggtggtgccgcagcagcagttgctgcaggtcttggtgcaattgcgatagggaccgacttggcaggttctatccggtatccagcgtatgcctgcggggttcacggtttgcgtccttctttcgggcgagtggcgagattcaatccgactgatcctgaaaaagtgccgataggggtgcagttaatggctgtcactgggcctgttgccagaactgtcaatgacttgcgtctagcgatggatgtcattgctagagaggatatccgcgatccttggtgggtaccagcgcccatggtgggttacgatgccccgaaatgtgcagcgttctgcgtgcggccaaatggattggatacccagccagacgtcgcggacgcgctttatgatgcagcaggaaaactgcgtgatgcaggctggacagtcgtcgagttggaggatattccctctctccgttcagcttcggatattcaactgaccctatggttgggtgaagattatgagggtcaactcttagcggtacaggaagacggagatcccggtgcgctgaacttcttgaacatgtaccgtgaatttgcgcattccgtgtctctggtcaattactcttcggcattgagtcgacttcatacgattgcgtgtgaatggcaacagtttctctctgaaaagtttgcggtgatccttttaccgacttcagcagaattgccattctctaacaatctggatcttgaatgtgaaacttcatttatgcgggtctggaatagtcaaatgccaatgcttacgctccctgttacagggctcccttgtgtcaatctccggacaaatttgatttccactccttccggggaaacgataccagtgggtattcagatagtgagtgcacgctttcgagaagatctatgcctgaaagcagcagaggatattgaaaaaaggggagaacctgtcgaagttgtcactccgtga

SEQ ID NO: 2218 - DNA, 96 bp, Xenorhabdus bovienii
  Coding DNA location: Contig name=SeqID_16868; Position on contig =23310..23405bp; Strand=-
atgtcatcgcctatacgttgccgtgaaacatgtaacctcgttctacaaggatacgggcttatctccaatatcaatatagggtatggtgatgtctag

SEQ ID NO: 2219 - DNA, 252 bp, Xenorhabdus bovienii
  Coding DNA location: Contig name=SeqID_16868; Position on contig =23380..23631bp; Strand=-
atgggagggcctcttgtgactaagagaggggtcacgtttttctcaggttcgatggactattatcttcgagctatcgacagtcgtagcggtagcgaactttggcgcagccgattgccagtcgggagtcaagcagctccaatcacatacattgggaaaaaaacgagaaaacagttcgttgttgtgaccgcaggtggcgcgcagcgttcagacaaggatcggggtgattatgtcatcgcctatacgttgccgtga

SEQ ID NO: 2220 - DNA, 204 bp, Xenorhabdus bovienii
  Coding DNA location: Contig name=SeqID_16868; Position on contig =23597..23800bp; Strand=+
gtgacccctctcttagtcacaagaggccctcccatggttggtaatccaatcggtaaatgcaacctattgtggccagtcctcagtgggcgcggaactatccgcgatcaaagcaataggtcaagatactatatgacaagaatggagccacggctgggattccattgtgattgtacaatttcggcgctgattaacggtaaccattga

SEQ ID NO: 2221 - DNA, 909 bp, Xenorhabdus bovienii
  Coding DNA location: Contig name=SeqID_16868; Position on contig =23861..24769bp; Strand=-
atggcaaacattgcatcggcaaccgcaaccagcatgaactggttgttggcggcacgcgtcattgtcggattctgcatggggggaatttgggctatcgctggtggtctggcggggcgcttggtgtcaccaggttctgttggtctggcgacatcgattatttttgggggagttgctgcggcgtctgtattcggagtaccactaggggcatttattggtgacgcttttgggtggcgtgcagcatttctagcaatggctattttagcgatgctggtgctaatcctcctcataaaatcattaccatcacttccggtgaataactctgtaacaataggacagtttgctgaggtgcttgcgaaccgaaaagttttagtcggccttttggtcacgttttttctggtcgctggtcattttatggcgtacacatatgtacgaccactgctccggaccgtctctaagttcgataatagctggattagtccacttttgtttgcctacggccttgctggaatagcggggaattttcttgctggcagcgccgctacgaagcaacttcgctggactctcgtgtttatcgcaattggcataactgctgccgttctccttttttctcctttgggaggatctatcacaggtggtagcctcattactctcttgtggggcgttgcgtatggcggagtttcggtttcgttgatgacatggatgatgattgctgcatcaaagtcaattgaagttgcgacctctctttacatcgcgatatttaatattggcattgcgtcaggatcgttccttggaagccaagttgtcgataaatacggacttctgactaatacaacacttgctggagtggttgccattctggcgctagctgtgctcatattttcaaatataaaagctgatcctgcgcattaa

SEQ ID NO: 2222 - DNA, 885 bp, Xenorhabdus bovienii
  Coding DNA location: Contig name=SeqID_16868; Position on contig =24879..25763bp; Strand=+
atgtctaatttagaagaactttactgctgcgtcgatgacttttgccaaaaatttatccctctctggcatcaacaactcattgaaaatggattacgtaaacggcaccgtgaggcatccctttctctcagtgaagtcatgatgatcctcattttatttcatatgagtcattatcgtgattttaaaacattttatattgaacatgtaaaacaatattttacagccgattttcccggattagtcagctatactcgtatcctcaccctgaagaaaagggcgcttattcctttatgcgcttttctttcatcacgtaaggcgcaaactcaagggattgcttttattgattctaccaaaattgctgtttgtcacaatcttcgtattccccgtcatcgcgtatttgaagggatggcacaacgaggtaaaacgagtacaggctggttttatggctttaaacttcatttggttatcaatgattgcggtgaattgttagccgtgaaactcaccacaggaaaccaggatgatcgtcagccagtcagagcgctgacaaaaggactaacaggatgtttgtatggtgataaggggtatttatcccaggctttatgcgatgagttagaagcggaaggcatcacgttaatcaccaatgtccggagtaacatgaaaaccaaagcattatctctctgggataggttgatgttaagacggagatttttgatagaaacggtcgtcgaccagctcaaaaatatttctcagatagcgcattcaaggcatcgcagtcagctcggttttttgttggaagttgctgccggtcttattgcttatacattccaacctaaaaaaccgagcttgaatctacgggataatgaaatcgctatctttaaacgaagctga

SEQ ID NO: 2223 - DNA, 291 bp, Xenorhabdus bovienii
  Coding DNA location: Contig name=SeqID_16868; Position on contig =25750..26040bp; Strand=-
atgaacagatcccatccggtagaggagcaaacaggaaatgttatgagaccgtggttggctgtgactgcaataggtttgtcaacgttttccgtcgttacaaccgagatgttacctgtcggtctcttgaatccaattgcggatacgcttaactcaactgtcggcactgctggattaatgatttcgttgccggcgctgctcgctgcgttatttgctccgctcgctgttctcgcctctgggggcataaaccgcagaacgatcctctgtttccttattaacctcagcttcgtttaa

SEQ ID NO: 2224 - DNA, 912 bp, Xenorhabdus bovienii
  Coding DNA location: Contig name=SeqID_16868; Position on contig =26215..27126bp; Strand=+
atgcctttcgatcatttatccgacattttagtgtttgtaagagtcgctgatgcccacagtttcacaatggctgccgagaaactcgggatatcgcggtcggctgctgggaagtgcattacccggctggaaaaatgcctgactaccaggcttattcaccgaaccacaagaagcgttagccttaccgaggaagggcaggtgttttatgagcatgctatacgcatcttggccgaagtcgacgaagcgggaaacgtgataaacaagcggaaccaaacaccaaaaggacgccttcgtatcgatcttcctgtggcattcggtcgcttacatgttttgccaattctccgcaatttcctagagaggtggcctgaagttgacgcggaagtcacgttttcggacgagtacagtgaccttgttcgtgatgggatcgatttgaccattcgcattggcggtaacgatgatagccggctcgttcgcaaggttctcgctcctcaccgactcattacatgtgcatccccccactatttagaaacttacggtattcctgaagtgccagatgacctgttgcaccatgacacgttagtgttctcacatcgaggtatgccagttccgtggcactacgaagtgaataaccaacaccgcgattaccctgccaaaggaaggatgcgtttcaacaatacagaagcgttgcgagatgcagccttagcagggtgcggcttatgtcaagttggtgccttcctggtcggcgaacaagtagcagccggcacccttgtccccgtattagatcgattttgccgaactgagccgccaatatgtgccgtttaccccacaaaacggcacctgtctccaaaggtgaaagggtttattgccgcaattgaagattgttggcacgggcaagctgtatgggaacccacttga

SEQ ID NO: 2225 - DNA, 123 bp, Xenorhabdus bovienii
  Coding DNA location: Contig name=SeqID_16868; Position on contig =27074..27196bp; Strand=+
ttgccgcaattgaagattgttggcacgggcaagctgtatgggaacccacttgacaaatttttgtcgaccatttcagttttgaaaaacttaattcttaagaacccgtctatgaacatcgcatag

SEQ ID NO: 2226 - DNA, 111 bp, Xenorhabdus bovienii
  Coding DNA location: Contig name=SeqID_16868; Position on contig =27278..27388bp; Strand=-
ttggtagagcacaaccttgccaaggttggggtcgcgagttcgagtctcgtttcccgctccaatatcttatctataaactttaaacttctactgatatttacacctctctga

SEQ ID NO: 2227 - DNA, 132 bp, Xenorhabdus bovienii
  Coding DNA location: Contig name=SeqID_16868; Position on contig =27465..27596bp; Strand=-
atgtttctaaaatggatgtatactctcattggcgaatgttttttgaacgtttggcataagagtgcatgcaaaggacttgtcatcttctctgagcaagtccataatagcgcctattccggacatgcagattaa

SEQ ID NO: 2228 - DNA, 3369 bp, Xenorhabdus bovienii
  Coding DNA location: Contig name=SeqID_16868; Position on contig =27738..31106bp; Strand=+
atgactcgacattatccatctaaatttgtcacaggtactgatgcccttgctgagcttttactcgctcaggctgaactggataaaagccataatctcaacactgcggggtttgtttctggatatcgcggctcccccttagcccgtttagatcaggcattatggcagcatggtaaagagcttgctcaagccaatattcgctttcaacctgccatcaacgaagatctcgccgccactgcacttatcggtactcaaaaagtcgaatccgaccctgatcggaatgttatcggcgtctttggcatgtggtacggcaaagggcctggagtggatcgctctggcgatgcgctcaggcatggcaacgcctatggctcctcaccacacggcggggtacttgtactcctcggtgatgaccacggttgtgtctcctcctccatgtcccatcaatctgatctcgctttaatggcttggagtatgccgattttgcatccagcatctgtttctgactatcacgatgtaggattatggggctgggcggcatcacgcgcgagtggggcgtgggtcgggtttaaagcaatcagtgaagttgtggaaagtagtgctatcagagaaagcaaaccctttcctgagtatgaaacacctgaaatcgattctgggccagatgggctgcattggcgctggcctgatcttcccggcccacagattgagaaacgcttggcctataaacttaaagccgttgaagccttcgccagagctaatccgatcgatcaactccttgccccgtgcgcccatccgcgtgccctgctggtcactgttggcaaagctcatcgagatgtgctggaagccttacgtgccggaggcttaacgccttcccaactcgccaaacaaggggtggcttttgtccatgtccgcttagtctatcctctgtcgccgcttctcagcgatcttgcttcacaggtcactgatatttttgttattgaggagaagaacgctgttgtcgagatactgctggcacgccatctggttaattcacagaaaaatattaagctgataggcaaacacaaccatcttggccagcaacttttacccgcagacattgagttacgcccttcattgattactcctctgctttctggatggctacacaaactcgatttgtttctctcagttcctctggaatgggcaaccaaaacaacaccacacgatctcacgcttcccaaacgcacgccttatttctgcgcagggtgtccccatagcacttcaacccgtttacctgacggcagccaagcccatattggtattgggtgtcatgtcatggcggcttggatggatcgcaatacgggatttggttttgtccaaatgggaggggaaggtgccgactgggtcggacactcaccttttatcaaccgtccccatgtctttcagaatttaggcgatgggacctatttccattccggccatttatccattcgccaatcagtagccgcaggcaatcgaattacttataaattgctatttaatcaggctgtggcaatgactggaggacagccactagatggcaatcttaccatatcgcagattgcggccttaatgctggctgaaggggtcaaaaaagtcgctatcgttacagataatattgataaatatcaggataaaaacctgctacccgctaaggtgacgctctatcaacgtgattacctcgaagaggtgcagaaacgctttcgagaaatcgcgggggtaaccgtaattatctacgatcaggcctgtgccacagaactgcgccgcaagagaaagcgaggtctggagccgaaagcgacacgacgcgccgtgattaacgagttggtctgtgagggatgtggtgactgtcaggtacaatcaaattgcctcgcagtgatcccggtcaaaacccctttggggactaaacgcaagatcgatcagcacgtctgcaactccgatctatcctgtctgaaagggttttgccccagctttgtcaccgtcgaaaatgccaatccacgccatgatctcagtaaaataatcccgcaaggcgatctagacaaattactccgtgaattaccccagccaacaccgatcattagcgataacccttatgaaatcctgctcgtcggcgtaggtggtacaggtatcgtcacagcagggaatttactggcgattgcggccgaagcggataattattccgtcagtctgctcaattttacgggctttgcacaaaaaggcggtgaagcaatcacccatgtccgattatgccatgatatgaataagctacatcaagtcagaattgaccgtgggcgcgctaatctcgttatcgcggctgatttagtggccacaacgggacaaaattcactgacagtgatgtcaaaaaatgcaacgaaatgcgtcctcaatacccatgaaacgcaaatcggcactatgcttcgggctcccaccctgaatctggatcatcccaagatgatgacgactcttcaccaacactgccaaacattaaattccattgatgccgaaataatggcggctgatctggtcggtgacagaaaccaaacaaatatcgtattaatcggttatgcatggcagctcggcaagattccaatcacgctttctgctatcgaccataccattcaggcactgggcaatgccacagacagtgcacgacgcgctttccatatcggccgcattgctgctgtacagccagatatcctgaatgagcgcctgcacatcaagccgcaaaaaagcattaagacgctggatgatctcattatgcatcgatatcaatttttggttgattaccagaatgaaagatatgcacagcgttatctcagtcgcgttgctcagattcaactggtcacgcaacaaattgatgcagaagaaattgtcaaatcggtctctgaaaacttatttaaactaatggcttataaggatgaatatgaagtcgcgcgactctacgccaaaagcgactttttcgagaatctccgctcacagtttgataatacggataacattcgctttcacctcagcctgccccttttcaatcgcaaagacccacgtacaggcgagagaggaaaaaaagaatatggcacatggatcatccctatcctccgcgttcttgccgcatgtaagccacttcgtggaaccatgttcgatattttcggctatcaggaagaacgcaaacaggaaagaaatttactgctcgaatatgagcgattacttgattttctgatagaaaaactgaaccgcgataatttagcgatctgtcagcaactcgcggagctgcccgatcaagtccgtggcttcggtcatgttaagcaaaaagcgataaaaaacatgatggagcgtaaggaggcattactggaagagctataa

SEQ ID NO: 2229 - DNA, 123 bp, Xenorhabdus bovienii
  Coding DNA location: Contig name=SeqID_16868; Position on contig =31176..31298bp; Strand=+
atgaatgaacggctgcgaaaacatagaagccactgttggcaagttttcatgcagccgtttagcttaacccagataatgcgtcattatcagtatgctttttttgacatgacatcaccctgttaa

SEQ ID NO: 2230 - DNA, 1182 bp, Xenorhabdus bovienii
  Coding DNA location: Contig name=SeqID_16868; Position on contig =31321..32502bp; Strand=-
atgctaatgtctagaaaaccttctgcgctcatcgtcggtactggtatcggtgggttgtcatgcgcgatcgcattgaaaaaaattggttggtctgtgcgtctctttgagaagacggacagtttacgagcgaccggatcgggtctgtcggtaatgtcaaacgccagttcggcgatgaagaagctgcttgatatcgacctcgggttgaagaattatggtgctgaagttcgagactttgagattcgacatagctcaggattgctcttgaagcgtctccctgttcaaaaaatctctgatgagcaaggcgcaccgagtatttgcatatcaagggaaaatctccagagggcgttgttggatcagcttggcgatgctgatattagttttggtaagcgcgtcactggctataacgaaacgagtgatgccgtccatatcaattttgaggatggcaccgtttcatcgggagacattattgtcggggctgatgggttttattctgcaattcgtgatgcgatcggaacagaatctattatccaggaagccggttatatttgctggctcgccttagttaaatactcccatcccaaaattacacccggctatgttgcccattattgggggagaggaaagcgtatggggattgtagatatcggtgatggctgggtgtattggtggggaaccgcgaatatgtcgaatgatgacgccaaaaaatggaaaggtacgaatagggatgtagctgagttttatgcgggttggccggatcttgttcaagacatcattaactcaactgacagtgaatccataatcactgttgacgccaaagatagaaccttccctgaaaattggacaaagggacgagtgactcttctcggtgatgccgctcatccgatgctaaccagtctcggtcaaggtgctggaatatctatagaagatgctgcggtgctggggtatgtgcttaaaaatactgaggactatagtgctgcgctacgccgatatgaagctattcggcaacctcgtgctcgcgcaatcgtcaacacctcgcgatctttgagtgatattgaacagcatgaccgctttttcccttgtttggagcgagacgttggcatgttgcttacatccaaaaagtccatgcgtaaacggcttcaggattcgctgctatttgacgatctcgctattcaagcgcaatga

SEQ ID NO: 2231 - DNA, 7143 bp, Xenorhabdus bovienii
  Coding DNA location: Contig name=SeqID_16868; Position on contig =32489..39631bp; Strand=-
atgagtattgcagaaccgacttcgtacgaaagggatttatgggttgaggagctacatgatccgcactgccatcagttcacagtggctcttagtgaattgttacccagatctatcgatctcgtgaatctcaagagggttgctgaacaagttctggagtcggagcaagcttcccacaagtcttttcacgagcaagaggggcatctagttctgaggaaagctcccgttgtggtttgtgccgagttatatgaattcaagaatgaagacgactttgcctcattcttcaaggagtggcctcgtaagatttgggatctttctgttccacccttgctcgatattgcgataggccaaacagatcaggcaactatattgatgatacgtgcccaccacatcgttgccgacggttggggtctgaatctgttgtccaagaaaatactcggtgcttatgcggataatcatttaggtctaaatgaacagctcaaaggggtgaaacgttacgcgacaaaatatccaaccctggaaggcagtaaacttgatgaggcaatcgacgacgtcgtcgtgaaaatcgctgataccgatcccgtattattcccaaaatctggagcgactctttcgacatcccccagctatatcagaccattcaagatatcagcgcacgaagtcgctcatggtattgaaaatggttttactccttttttggctgtttcaacggctctggcagttctgctgtcaaatgcatacggaagcgagaaatttttcattggagtgccgtttcttaacagaaccgatacagaaattacgtcagtcagtcaccgagctaatattcttcccgtgaaagtcgaggtattacctcaaaatacactcagagcaatttactcgcagatcaaagattttatcgtctttctgaaagacaaagaatcggttccgttagggggtattatttctgctctggcaagttcctctcgtcaactttttgatgtaacaatgtcctatctgcgttatccagaatggggggcaattgctggatttgaagaaaaaacccagaatatcgcgcacatacatacccaggatgcgatagcaattcatctgtacacttatggcaataatgcagatgtttggggagatgtgtgtttgaatagctcagtatttgatactgaggaatcagcgaatgcattcttagatacattcattcatcttatcgataattttggtaataatgttgataagcgtgtgtcggaagtaaacttgctgacatttaagcaaacggagcagctgcgacagtatgaaaatgggccaactaagccatacagcgtgaatgaaaccgttgtttcgctctttgaggctaaagccgaacaatttcctgaaaatatcgctcttcgagatcacactggcacatcgctttcttattctcaattaaatgcatggtcatccaccattgccgctgcgttagaagaacggggaatcggtcagggggatatcgtggcggtatcagtcgagcgatcgccagagatgttggccgcaatatttggcgtcctcaaaactggggcagcctatttacccattgatagcgactatcccgaagatcgtattcaatatatgctcaacgacagcaacgccaagttagtcatttctaatctgccccacgttatgaaatctgatgatcctcgttggtttgatctggacgctttgccaactgaattaccttctcattataaatacaaaagcaaggcccagcctaatgaacccgcgtatgtgatctatacgtcaggttctactggtcgtcccaaaggggtcatcgtcgagcatcactcagtggttaatcgtttagagtggatgcaggaaatacatccgttaaccagtgacgatgtgatcctccagaaaacgtcgatatcatttgacgtttctgtgtgggagcttttttggtgggcgatgacaggagcttctgtcgcactcctaaaacaaggcgcacaacgggatcccagggaattgatccagacaatttctacacacggggtaacggtagcgcattttgtgccgtcaatgtttgaaccgtatgtgcaaactttgaatgatgatagacagtctcttttatcggttagcagtctgaaatgcctatttacaagtggtgaagcgttaacacccgctgtcgtgaataaatacaggaagattttcagtcacgatatctgtccgccaaggctaattaatttatatggcccgacggaggcaacggttgacgtaacctactatgaattaaatctggaacaggattcggatatcaacgcagtaccaatcggttttccgatcaacaatacctcagtgagaatagcctcattgcatggggtcaggcagcctataggtatatctggagaactacagattggcggtgtgcaattagcgcgaggttatttgaatcgtcccgagctgacggcagaacgttttattatcgatcagaatgacagttgcagtcgctggtaccgaacgggtgatctcgcggcttgggctgaagatggatccatcctttacctcggaaggatggatggccaagtgaagatacgcggcaatcgcatagagcttggtgaaatcaagaacgccttgcttaacctgccagaggtgctgaacgcggaggttatcgttgaagatgatgctcggggaaaacacctggttgcagtctatgtaggccgacgagacttaaatgagcgtgatattcgcgcaaaacttgggaaacagcttccttcctttatggttcccgcaagatttgtccgactggggtgcattcctcttacacctaatggaaaatttgatcgcgtcagtgctctcagagaggtcagtggaaataaaacatctccgcagacagtaaaacttgatgaatccgaaacgattgttgccaagatatgggagaaagtactcggtcggtcaaacattagtgcagatgacgacttctatgcgcttggtggcgattccatcttgatgttgaaagtgagatcagaactggaaagtcacgggtatggcgttggcttatccgatctggcgcagtatacgacagtgcgtagcttgggaaatgtcctcgaaagtgtgtcacgtgttctcagtagcccgaaagaagcacttcctccttttgctctcataagtgaaatcgatcaaaagaggctgagttcagcatacgatgatgcttatcccgtatctcagctgcaacttggcttgcttttccatagtcgagagatggagggcgcgagaacttacaaagatgtattccgatataccctgaagttggcgtggaatgaagtcgcgttcaggtctgctttgcaaggattggctcgtaggcaccccgcattacgcacagtttttaaccttagtgactatcatctaccccttcagctaatcagaccggagattctaattgatgatgttttatcaattgaaacgcctgatgtggttgagtatgagcatacagttcttgctcatatggataagtggtcacggtataattattcgttcgcatcgggaccccttttccacgtagcgatatttgctaatagtgaatcaaactacatcgacttagttttcagcttccaccatgcgattcttgacggaggaagcgttgcaaacctgatacgtgagcttcttttgtcctattctcaggggaatgatggtgccaatctcggttaccctgaagacgaactcccaaatccatcagtttttgtccaaaacgaaatagaagtccttgaagcgagtgagcccaggagttactggaaagaatacctctctggcgcgacgaatacattgccaataggcttggctggatattcaactgctccagtgaagcgtattttttcttatcgtttcctaatagatcctgtacttgatgccgcacttaatcagctggcaagaactattcgagtccctataaagcatctttatcttgccgctcattgcaccgccattgcgttaatgagtggtaaagaggacatcgtcacgggtgtagtgacacatacacggccggaaattaagcactcggagcgtatcctggggctatttttgaacacacttcctttaagggttgatataaagagtttgaattggcttcaggttgtcgaagggttgtaccgaaatgaaaaaagaagtcataaacatcggtgttttcccttaagccaaatccaagctgacaatgaattgttttctctccagaccgcatttaactatgtacactttcatatattgcaggatatttctgagaagacagatattgaaatcgtagcctttgatccgaaggaggaaacaaatttcgatattctggtaaacgtaatgcgcgatgttgatggcaaacgtacgagtgttcgcatggatatcaatggaagcgtttatgccagagaacaaggggcagttttttccaggctctttaatcgtgcgttagagcgaatagcctatcaaccagaaatgcccgtatccctcagtcgcccgattactgaagttgggtgccttgtggaaagaatttcggataaggcatttatttcacttccagccacgatccgaaatagcgttcaacgtgatccggatgcagttgccatcacgtatggtgacagcgagtggagctatcagcagttatgggatgcggcgacaaggattgcctttttgctgagtgaacgtggtgtcaataagcaggatgtggttggaattgcactaccacggtcgtttgaacaaattgcaactgtcgtggctattctgaggataggcgctatttgtcttccgatcgatttatcatacccagccagccgaatcgagttgatattgaaaatagcaaatccggcagtggttgtaaccgatcgttctgttacagagctacccgcaagtgagcgagtacttttccttgagtatgactcaattgaggcggtcgctgaaagagacgatgctgcgatagattcgactgatgcggcctacattctatttacttccggctcaacgggtacgcctaaaggcgtgactatgctgcataggggattgagcaatcttgttggctggcaaaataaaataaggagtggcgccaaggttacctctacactccagttttcgcctttgagtttcgatgtttctttccaggaaatactctccaccctttcatcaggtgccacattgcatctgattagcgagatggaacgtcgagatccggtagctttggtcaggcatctcgatcataaaggcgttgagcggatattccttccgtacatcgctttgcagcaactcgctgagacggcagttatgctgggattctttccgaagaaactgcgggtgattgtctcgtctggagagcagttgcgtgtcaccaaagagatacggacgcttgtcgataatctacccggcggcatattggaaaaccagtatggtccaaccgagactcatgtggtgacaagttacactatgagcagtgatcccagccagtttccagcacttccgccgattggtatcccgatcacgggtgtcggcattgtgatccttgacgagagttcaaatgtcgttcccgatggggttcctggcgaaatctgtgtgttcggagaagctttggcatcgggatattaccgttcgccagaggaaaccaagaaaaagtttattgcacacgccgacgtgccaggtgggatgttttaccggacgggggatattggcatccgttcagcatgcggcgagattatcagccttggtcgcaaggatacactggtcaaagttcgtggctatagagtagaactctctgaaatcgagttaaaaatcctcgaattctttgaaaaccgccgggaaagtgttgaagtagcggttgtcgctcggcctcgtgacgatctggattcatacttgatcgcctacctggtgggtaaggaagatcgtattgcgttggaggaacttcggcagtttatcggagctgaattacccgcatatatggtgccgacacacatcacatggataaatgagcttcccaagacaccgagtggcaagcgtgatgatgcgatgctccggaaactggatatacagcttgtatcagaaaaaaattatcgtggcccagaaggcgagtatgaaagccggctttgcgagctgaccgcagagctactgaagatccccgaaatagcccctgagcagagtatttttgattgcggtgcgacttctttgactgcaatgcgcatagtggttcttgtcgaaaaactgtatggcattaacgtaccgctttcggcatttgtcagcgcgccaaccattgcgaagcttgccatgcttattcaagatggtggtggtcagttcaagtttgatccacttgtcccactgcgcgaagcaggtaaccgcaggccactcttcctcgtacatcctatgggaggaaatatcctgtcatatctgcgaatgcttccacacctgccatctgatcagccactttatgctcttcaagcatcgggtgttgatgcgggttcgtcaccaataacgactattgaagagcaggctgctttttacatcgatgcgatcaagagaattcagccgacgggtccttatgtgattggtggctggtcctatggtggatttatcgccttcgaaatggcgaatcagttaatccgatcaggagaaacggtctctaatgttctgattcttgatacgatggctctgagctcacaggcaaaaggtcaggctagcgatgatgctttgctcagttggttcttctgggaattgctgtggacatcgaagggatcttcgttacctgttcaggttgttccttcctatattgaaagtttgcaagagaaattcgaatatataactgatcatgcaacccagataggagcgatcccggaaggcagcacaaaagcagtcatgcagcgccttttcgaggtatataatgctaattggcaagccgcggctgaatacaacgcacaatgcccgaatctcgatgtgacgcttattcgcgcaaggcagcctcttcctcagatattgcaagagatgcacaataccatacgtagtgaatatcatgatcctctgaatggctggggtggcaagacgtctggtcgagttaacttgattgaagtggatggtgatcatctgactatcatggaagagcctttcgttgggccaatggtgtcggcaattattactgagattaataaagtgaaaggggtggatgctaatgtctag

SEQ ID NO: 2232 - DNA, 192 bp, Xenorhabdus bovienii
  Coding DNA location: Contig name=SeqID_16868; Position on contig =39654..39845bp; Strand=+
atgacattagctctacgaataacgacacaaaccgagtatttctgggctgaagctgtccccttgattcaaccaagccaaaccgctccatctcggctcttaatattcgaaaaaattatttcagatgacataatatgttatcgaacgcacaatatgtcactcaatgacatattgtgtcaaatgacattttgctaa

SEQ ID NO: 2233 - DNA, 762 bp, Xenorhabdus bovienii
  Coding DNA location: Contig name=SeqID_16868; Position on contig =39824..40585bp; Strand=+
gtgtcaaatgacattttgctaatagtatcactagtcaactattacataagtgtccttttatgcaataatggaggttcaaacacagatcacttattccagacaggaggaaacaggcgcgtgacagatagagaaaaagttggccgccgtgagcggaagaagcttatgctgagggatgccctaattaagacatcttacgaactttttgctattaagggatttgatgaaactcgagtagaagatatcactgaaaaagttgacgtttctacccgcaccttttttcgatatttttcctcaaaggaagatgttgtccttgactaccaagaggcagaacacaaagactttattgccgcactcatccgccgtccacctcatgaacccgcgttatcagcattacggcatacagctgtcgaaattatgaaaagatgcgaaggaggttcttatggctttaatacgaactgtttcatgacccttcaagacttgataaggaaccatcctttaattcgggcaaaaaatcttcagcgcggagaggatcggaaaccccctatcatttcgttaatcgctcaacgtatgggaaccgaccctaaaatagatattagaccaggcgtcttagccggcgttttagattatgcacattgggctacatatgacgtttggaagcggaaaaaacactcttctatgctttactctgatgttcttgatgaagtatttctaattatcgagaatggtctcaactttccagcaaacaatcagccagatatctag

SEQ ID NO: 2234 - DNA, 108 bp, Xenorhabdus bovienii
  Coding DNA location: Contig name=SeqID_16868; Position on contig =40545..40652bp; Strand=+
atggtctcaactttccagcaaacaatcagccagatatctagtgaccttaccctagataaccgaaaagttcgggtaaacgcaggcagggggttattaacgaccggctaa

SEQ ID NO: 2235 - DNA, 177 bp, Xenorhabdus bovienii
  Coding DNA location: Contig name=SeqID_16868; Position on contig =40649..40825bp; Strand=-
ttggtagagcacaaccttgccaaggttggggtcgcgagttcgagtctcgtttcccgctccaaattcaggactgtagatttttatgaaattctgcaagtcacagaaaaaaggaccgaaaggtccttttttcgttccagtgataatgaccaaaatccactcgcatcctgtgctttttag

SEQ ID NO: 2236 - DNA, 246 bp, Xenorhabdus bovienii
  Coding DNA location: Contig name=SeqID_16868; Position on contig =40740..40985bp; Strand=-
ttgtgtgcaaagggcttgccatcttctccaaacaagtccataatagcgcccatcttggtacgtaaatatagaaaaattcctttaaatcaaatggttataggatgttcgtatctagaaattaaggctgacagtagtcatcagcaatgcgggaatagctcagttggtagagcacaaccttgccaaggttggggtcgcgagttcgagtctcgtttcccgctccaaattcaggactgtagatttttatga

SEQ ID NO: 2237 - DNA, 150 bp, Xenorhabdus bovienii
  Coding DNA location: Contig name=SeqID_16868; Position on contig =40921..41070bp; Strand=-
atgcggcagaaaaatgagggcaacaacgggtgtaaaatgtccatgtcacgtcagttagaatgtattttgaacgtttggtattgggttgtgtgcaaagggcttgccatcttctccaaacaagtccataatagcgcccatcttggtacgtaa

SEQ ID NO: 2238 - DNA, 99 bp, Xenorhabdus bovienii
  Coding DNA location: Contig name=SeqID_16868; Position on contig =41027..41125bp; Strand=+
atggacattttacacccgttgttgccctcatttttctgccgcatagcagggtcaatatgtcactctctgctaaccattgacgaaagattaaagtcataa

SEQ ID NO: 2239 - DNA, 216 bp, Xenorhabdus bovienii
  Coding DNA location: Contig name=SeqID_16868; Position on contig =41153..41368bp; Strand=+
atggcagcatatcgctctatcttcggatggacaccgctcatgacagcaaccgcattcctgccgtttgcaatcgctctcatcgcaacaggacggatagcaacgcctctagtgggccgtatcggtgcagcacgagtgacaagtactggcccgatggtcaatagcgtccatgtatcggtcatcaacagcggcctggcattgccgatggattcccactaa

SEQ ID NO: 2240 - DNA, 288 bp, Xenorhabdus bovienii
  Coding DNA location: Contig name=SeqID_16868; Position on contig =41406..41693bp; Strand=-
ttgtttgctgatttaatcatcaatcagagaaaagaacgcgattttttgtgttggggggcttgtcagggcaatgatttttcgtataatgcgctccccgtaccgatgaagaatttcaacagtacggcataccgaaagtactacgccaaaagtaccacgcatcgatatgtaagcgggaatagctcagttggtagagcacgaccttgccaaggtcggggtcgcgagttcgagtctcgtttcccgctccaattcttattatgtaaacctccacgcaagtctgcgatcctttga

SEQ ID NO: 2241 - DNA, 546 bp, Xenorhabdus bovienii
  Coding DNA location: Contig name=SeqID_16868; Position on contig =41755..42300bp; Strand=-
atgtcaaaaaatgagaacaatcttatctggatagatttagagatgaccggtttggatccagagcgcgatcgcataatcgaaatcgcgactattgtcaccgattcggaactgaacatccttgcggaagggccagttattgcggtgtatcagcctgatgaacaactggcattgatggatgactggaacgtgcgaacgcatactgcaagtgggctggttgagcgtgtgaaacaaagtcagtttggtgatgtggaagcagaaaaagcgacgattgcttttctggagcagtgggttcctgcgggaaaatctcctatttgcgggaacagtgtgggtcaagatcgccgttttctgttccgttatatgccagagttggagaaatattttcattaccgctatctggatgtcagtacgcttaaagaattggctcgccgctggaagcctgaaatgttgtcggggttcagcaaaaaaaatactcatcaggcattggacgatattcgggaatcaattgctgagttggtgtactaccgcgagcactttatccagaaataa

SEQ ID NO: 2242 - DNA, 156 bp, Xenorhabdus bovienii
  Coding DNA location: Contig name=SeqID_16868; Position on contig =42309..42464bp; Strand=-
gtgattggcctgaacacggcgttgctgccctttggagagtttattcttagccaccgaacctcacttatttcatctattttgctgattatcgctgtgagtgatcaaaaacgttatgatacaccactgatacagactatctgttttgaaggaaactag

SEQ ID NO: 2243 - DNA, 1068 bp, Xenorhabdus bovienii
  Coding DNA location: Contig name=SeqID_16868; Position on contig =42411..43478bp; Strand=+
gtggctaagaataaactctccaaagggcagcaacgccgtgttcaggccaatcaccagcgcaggctgaagcagccgctcgacagggctgccaataaaccagaaatggatgacagcctgtttggtgagccacaggaagggctggttatcagccgattcgggcagcatgcagatattgaagccgtagatgcttccatacagcgctgcaatattcgcaggacaattcgctcactggtcacgggtgatcgcgtcgtatggcgacccacattacagctccaaactgatgtcaaggtcaatgggatcgtggaagctgtgcatgaacgcacctccgtccttactcgccctgattactacgatggcattaaacccattgcagccaatatcaaccaaatcatgattgtttccgctatcttgcctgaactttcgctgaatattatcgatcgttatctggttgcgtgtgaaacacttaatattgagcctctgatcgtgctcaataaaatcgatctgttggatgccgaaagtcgtgcatgggtcaacagtgtcatggacatttaccgccacattggctatcgcgtactggaagtttccagccataccggagaaggcgtatccgagctggtctcccagctggtggataaaatcagcatctttgcggggcaatctggggttggaaaatccagcttgctgaataccctgctgccagacgatgaaaaagatattctggtcaatgaagtatcggataactccggcctgggtcaacatacaaccacaaccgcacgcctgtatcacttcccacagggaggcgatgtgatcgactcccctggcgtccgtgaatttggattatggcatttaacgccagaacaggtaacacaaggtttcattgaattccgtgaatacattggcgaatgcaaattccgtgattgcaaacatcagactgatcccggatgtgccttgaatgcagcactggagcaaggagcaattgcagaagagcgtttcgaaaattaccatcgaattctagaaagcatggcgcaggttaaaccacgaagaaatttcacggatgtccaaaaataa

SEQ ID NO: 2244 - DNA, 987 bp, Xenorhabdus bovienii
  Coding DNA location: Contig name=SeqID_16868; Position on contig =43518..44504bp; Strand=+
atggcgggtacaatagtagacttttgcccaatttgcctatcaaaaatccaagaggttgatgtgctggataatattaaaattaaattgcaatatttactgccaaaacaatgtattactaatttggcaggctggttcgccaataaaaaggcgggctggttgacacagcttgcaattcaatctttcgccaaagtctataaggtagatatgaatgaagccaaaaattcttcattcacagcttactcgacattcaatgaattttttgtccgcccattaaaagaaggcattcgtcccatcgtcaatgaagctcaccagttggcgctgccagcagacggaaccatcagccagctcgggataatccgtgacgatcaaattattcaggccaaaggtcactactataccgtagaagctctgctggccggccagcatcaacttgctgaacaattccgcaatggccatttcgtcacaacttacttatcacccaaagattatcaccgtgtccatatgccgtgtgacggcgtactgaaagagatgatctatgttccaggcgaactgttctcagtcaatccattgaccgcagcaaatgtccctaatctgtttgcacgtaatgagcgggtcatctgcctgtttgatacagctttcgggccaatggtacagattctggttggtgcaactattgtcggcagtatcgaaaccgtctggagcgactgtgtcacaccaccgcgtgaaggcatcatcaagcgttgggcttacccagcagcaggtcaggaaggcgcgatttctctcaagaaaggagaagaaatggggcgtttcaaactgggttcaacggtgattaacctgtttgcgcccaatcagattcaatttgccaataatttatacagcggctcacaaaccctgatgggtgatctgttggcgcaggctgtcacagcaaatgaagagcaggcagcaaatgcagatgatgaatctatgaacaaagatatcatcagctaa

SEQ ID NO: 2245 - DNA, 3345 bp, Xenorhabdus bovienii
  Coding DNA location: Contig name=SeqID_16868; Position on contig =44531..47875bp; Strand=+
gtgcgcctgattatcagtttacttttcagcctgtttcttgcgaatccggctttcgcttcgatagcacagttggatgaaacccaactgaaacaagagctaaaacaggttggaggcagtaaaaatccacaggatgctgaaatcgcacaggcacttcaaggggcaataaactggcttaacgatgctaagtccaccaatgaacgcagccagacataccaacagactattgatgattttcccaagatcatcaaagaattgcgtcaaaaaactcttactgaaagtgatattgtcccctcaattccggccaatcagtctatcggtgagttagagcagcagactctccagaccagtagccagttgttggagcaagagcgccaactacaacaggaacaggataagatccgggaaatcagtgattcaatgaacctgctgccccaacagcaggttgaagcgagacgactgctggctgaggcaacttcccgcctccaatccttgggtacgcctccgacacccctgaccgaagcccaattgaaacttgttcaggccgaagtcagtgcccgcaaagcggccaccaatgaactggagatgtcacaactttctgctaataatcggcaggaaatcgcccgcatgcgggcagatttatttaaaaaacgttatcaacgtctggatctcaaactccagcaattacgcaaccaattaaacattcaacgccagcagaaagcagaatcggcccttgaacataccgaaatgctggcggagcaggcgggtggaaaactacctcagtttttgctggatgagctccatcaaaaccgccaactgtcacaactgctcagtcaacaaacccaacgcatggaagccattggctcacaacaacgcaaagccgctaatgatattctgcaagtacgccgaacactcaataccatccgtgaacaagcggaatggctgagtgattcaaccgcactcggtgaagcattaagaactcaattaacccgcatccctgatgtgccgaaatcccagcaacttgaccgaaatattgtggaattacgggtcgaaagactgaaatatgaggaaatgcaggagcgctcccagcaggaaaatgatcaagcattgccttcgcctcaaaacctgacatcagggcaaaagcaggtctatgaatctcttatccgtaccagaaaagagttattgaactccctgctctcaggttatgacaatgaaatattggaactcacaaaactcaaagtcgcaaccaaccagttaaatgatgctttaaaagagataaaggatgctacccatcgatacctgttctgggtcacggatgtcaatcctatttcactagactatccgttgcttgtcgttcaggatctgacacggctgctctctctggatacgttatctcagctaggggtcgcaattcacgttatgctgaccacgaaagataccctgctctatttactgggtacgctattgctggtgattttcagtatcagctcacatcgtcaatatcatgcgttccttgagcgctccagcaaccgcattggcaaagtcacacaagatcatttctcgcttaccctgcgtaccgttttctggtctattgtcgctgcattgcccctgccgatactttggtcagccattggttatgggctgcaaaatgcatggcagtacccgatggccaccgcgattgggctcggtgtcagtgagacaacgccagtcctgtgggttttcatgctcagtgcgtcatttgccaatccgaatggtctgttcatctcccacttccgctggcctgaagaacgcataaaacgggcaatgcggttttatcgtctgtctattttcttggttgtgcctctcatgatggcgttgatcacgttcaataattacagtgatcgcgaatttgccgcgacactcggcaggctgtgcttcctgatgctgtgcgtttccctgagcctggtgaccagcagcttaaaacgcgccggagtaccgctgtacatggacaaacacggctcaggcgaaaatatcatcaattctgttctgtggtggatactgctctctgccccgatcttggccgcgcttgcgtctatactcggctatctgcagactgcacaggcgctgctgggacgtttagaaacgtctgtcgccatctggttctccctgctggttatctaccatattattcgccgttggatgctgatccagcggcgaaaactcgcctttgagcgagcaaaacaacgccgagcagagatcctagctcaacgcgctaaaagcgaagaagagacggccaatactaatagcagcgtggaaggctccattgaagttgaagaaccggtgatcgatctggatgcaatcagcgcccagtctttggggctggtacgctcgatcctgacgatgattgcgttggtttcactgattctgctgtggtcagaattacattctgccttctctttcctggagaatatccggttgtgggacgtcagcacgacggtcaacggggtcaataccatccagccaattaccatggggtcagttctgattgcgatcttagttatcgtcatcaccacgcagcttgtccgcaacctacccgcgctgctggaacttgccctgttgcagcatctggaactgacaccgggcacaggttacgccatcacgacactaaccaaatatggccttacgttgattggtgggattgtaggtttctcgctggttggcattgaatggtcgaagcttcaatggctgattgctgcaatgggtgtgggtctgggttttgggttacaggaaatttttgccaatattatctctggcctgattattttgttcgaaaaacccatccggattggcgataccgtcactatccgtaatttgactggcagcatcacaaagatcaatacgcgggcaacaacgctgtcagactgggacagaaaagaaattattgttcccaacaaggcatttattaccgagcaattcatcaactggtcactgtctgacacgatcacccgtatcgtcttaacgatcccggtgccggctgaaactgattccgcagaagcgactgacatattaatgaccgcatccagacggtcaccattaattattgataacccgatgccagaagtgtatctagttgatttacaaaacggtattcaaatttacgaactgcgcgcttacgcagcggagatggggcatcgtatgcccgcccgccatgaagtgcatcaatatattttgcaggagttccacaaacacggcattaccctaccattcccgccatttcaggcacgtgttgatatcttcggacaagaaatccgcagtgccacaaccaatatttcgggccgcaatccaccgcgtaaaccgggagaactataa

SEQ ID NO: 2246 - DNA, 1206 bp, Xenorhabdus bovienii
  Coding DNA location: Contig name=SeqID_16868; Position on contig =47888..49093bp; Strand=+
atgatgaggcgtataccttttcagataagtggattactggctttaaatggcgtttcgatcttgggaaacgccattacagacattgccatcccttggctgattctagaaatatcaggcagtccactgctggtcgcagccgtgatgtctgccaaaatagtgccgttgatattatccattttctttagcgcacaactggtagataaatacggagccttccatatttcagtcttatctgatttggtgaacttcctgagcgtcttactgatccccgtattttatacaatggatatcatgcacttttacctgttggccactttgcttatattctcgacaattttggattctccgggacgtttagcaaaagacgtaatgctggcgaaagagattaaacagaataaaagtgaacatgagttgatcaatggaatcaacagtaccattgaaaatatttgtgaccttactgggcctgtattgggttcattgattattgccctgttcggtacaatcaacgccctatacttcgatgcggtcagttttttagtggttgcgctggggctgattattctgaagaaacattttgtcaccattatcaatgaagttactgaggttccttccctgccacaccactatttccttgaagcactcaaatacgttaagtcagaaaaggaactgttttctattcttatcctgagttcggtggtcaattttgtcatcgctccattcctgatcgtttatttaccttatgtgaataaggtcgagtttaattccgtcgtcagccttggtgtttccatgacctgctttggcttaggcacaacgttctcttccttgttgtatggtatttatggtaagcatttttccagcaaccaaatcattctctctggctatagcctgctggtattgtctctggtctctctcaatctgttcaatgggcaatatattctttttgcccagctatttgctatcggttgctgcattggtttttctgctccagttgaaatcactttgatccagcgccaagtgccagagaatctgtttagccggataatgacgctgttttcttctacgcgctttcttgccgtacctgttgggtacgtttgttttggtactctgctgggatccagccttgctaaacaaacaccgctgctcatggcagcaatggtattgggtggtttatggatttatctggttatgcgtaggagagcgaaatga

SEQ ID NO: 2247 - DNA, 1455 bp, Xenorhabdus bovienii
  Coding DNA location: Contig name=SeqID_16868; Position on contig =49090..50544bp; Strand=+
atgaagacaactctttttcaaattgacaaactattacaacgccatgtgtctttgcccttataccgccaaatatatcagcgttttattcaagcgattaatcagggcatattgcgacctgaacaacgtgttccgtctattcgtgcgttatccagtgaactgcaagtttcacgcagtacagtggaatctgcctatgcgctattactgaacgaaggctatctagaggccagagggcaggccggtactattgtgtccccaaggcttgcagacagggtattacagccccctgaaacacttatatcatcgtctatcgatgtgactagtatatctttattcgattccgcttcatccattcatccctcaccttatcaactagggctaccagcgttggatctctttccccgcaaattatggaacaccctcaccgtcaaacaactgcgtttgcaaagccgatatatgtcttacccgcaacctgagggctatttgccgttacgagaagcccttgcggcttatcttcaattatcacgtggggtgagctgctccccacagcaaatttttatcaccgctggctatcgcggcgctcttaacctaattgctcacaccctgatacaaccacgggatcaagtttggctcgaagatccctgctttcctcccagtcaacattttctatctcaaataggcgctgaaattattcctgtgccagtcgatcaagagggcatgaatatttcggtggctcaagaactcgccccaaatgcacgatttgctctggttacaccagcacatcaaagcccattaggcgttacgctgtcaatggcacgaaggcagatgcttttagcgtgggcagaacagaataatgcctttgtcatcgaagatgattatgacagtgaatatcaatatgatggacgccctcaccctgcactggccagtttgggatctaacaatgttttgtatatcggcacattcagtaaagttctgacgccaacactccggcttgcctatctcgtcgttcctccccatctgttaacgagatttaatgctgtatgccacactcggcaagatggctgtcctttattacagcaggccgtcgtcacggatttcatgcagggaggtcatttcgcccgtcatttacgtaaaatgcgcactgcctatgcacagcgacgccagatagtcattgagagtttgaatcaagtttttgatagccgcctgaggttcgatattcccgcaggtggcctgcatttgctggcaagacttgcgcattatgaagatgatgtagcactggctcaactcgccagagagcatgggcttggcattaccgccttgtccgcacgaagattgagctcagattgtggcaagggattactgtttagttttgccaatgaaaccacccccgaaaatgctttgaaacatgctcaattactgcaaaaatgcctgcctactacatcaagaaccagtaattaa

SEQ ID NO: 2248 - DNA, 432 bp, Xenorhabdus bovienii
  Coding DNA location: Contig name=SeqID_16868; Position on contig =50549..50980bp; Strand=-
atgagtagtttgcgccttgcctattatgatttatcaccagagctgttacagggtttccgtacaataaagcaagagctggaagaaagtccattgggtctagcactgattgaattggtctatttgcgtatttcccaaatcagtggctgtgctttctgtttgaacaaacacagtcaatctttgcgggaaaatcaggaaactgaacgccgtttgtctgaactggcagggtggcgtgtcagcggtcagtttaccctgcgtgaaaaggtggctctggaatgggctgaatcccttactcatgttgttacaacacatgcggatgactatgcctatttaccgctgaaagaccattttacggataaagaaatcactgatctgaccttcgcgattgcattaatgaatggaatgaatcgccttgcaatcggtatgcgtcagtga

SEQ ID NO: 2249 - DNA, 141 bp, Xenorhabdus bovienii
  Coding DNA location: Contig name=SeqID_16868; Position on contig =50973..51113bp; Strand=-
ttgtttatctgctttttatctaagctaaataacttgtcatggctaaaaacactcatcttgtcccttatccgaattgatggattgttatatcgtttaccatattcacaaagatatgagataaggagttttattcatgagtag

SEQ ID NO: 2250 - DNA, 354 bp, Xenorhabdus bovienii
  Coding DNA location: Contig name=SeqID_16868; Position on contig =51257..51610bp; Strand=-
atgaactggtatcttaatgttttaaagaattacgctaatttctcagggcgtgcacgtcgtaaagagtattggatatttactctgtttaactacattgccattatagttctttgtgttttagggtctgcaatcagtgaaactttaggtgttgggttattggggatttatgcaatagtgatttttattccttcacttgcagtgatgatccgtcgtctccatgataccaatcgctccggttggtggtttttactggcttttgttccgattttaagcatcgcgttattggtattcttctgcttggaaggatctaaaggagataacgattttggagcagatcctaaaggaatgctttaa

SEQ ID NO: 2251 - DNA, 108 bp, Xenorhabdus bovienii
  Coding DNA location: Contig name=SeqID_16868; Position on contig =51706..51813bp; Strand=-
gtgccagaggtatctatgtatatagtgttcctggtttggtatttgggagaatttctgaattcatttccttatgatactgtcataaacaaccaaatactcttattttga

SEQ ID NO: 2252 - DNA, 96 bp, Xenorhabdus bovienii
  Coding DNA location: Contig name=SeqID_16868; Position on contig =51913..52008bp; Strand=+
ttggttatttctgtaaaaaacaaaatcattacaagcaaagataatcctcaatatttacagccaaagctcccactttcatttttaaaaacaaactga

SEQ ID NO: 2253 - DNA, 114 bp, Xenorhabdus bovienii
  Coding DNA location: Contig name=SeqID_16868; Position on contig =51994..52107bp; Strand=-
atggggacgtggaaagcatcattcatgaaagggaggttgtatgacattgattgtcataatagggatgaaaggaattattcccatggacatacagaaaaatcagtttgtttttaa

SEQ ID NO: 2254 - DNA, 1014 bp, Xenorhabdus bovienii
  Coding DNA location: Contig name=SeqID_16868; Position on contig =52141..53154bp; Strand=-
atgaattcacatctgaaacgagtgactcgcagtgatgtcgccaaagaggccggaacctcagtagcggttgtcagttatgtgattaatggtgggccacggcctgttgctgaagcgacgcgtcagcgtgtattggcggccattaaaaaaataggatatcgaccaaacaatattgccaaggcattggtttctggtacgacacagtcatacgggcttattctgccggacatctccaacccttttctctcttcagttgcttatgcgttgcaacaggaggcgttcaaacatggacaggtattactgccgggtgattcaggggacaatcggacgcgtgaaaaagaattgatcaataacttattgaatcgtcaaattgatggtctgttatataccagtgttgatcgtcatccttatattgacttgattcaggccagtggaactccatgcgttatgttggactgggttaatgcagatctgaatgtcagtgcaattcgtgtcaatgaacggcttgccgccttcaaggttacgcaacatctgattcagcatggttaccgtgatatcgctattatttgtgggcctcgaattatgctcaatacacaggatcgactttccggctggagtgatgccttggaacaggcaaatttaaccgtgcgcgaagagtggattttttctaccgagtatacccgccagggtggttatgaagcgacactgcgcatgttaaagggaaaacgtcctcgcgcgctgtttgcttccaatgaattacaggcattcggctgtctgcgtgcattggctgaacataggcttactgttcctgatgacatcgctttggtttgtttcaatgccacacagcaatcactgtttaatgttccttctttgacagcagtacgtcagccaatagataaaatggcacagactgctatcgaaatcttgaggacatggaatggaaaagcgcaggagcgcgaatttgagtttgaattgcagataggagaatcctgtggttgcgggcttgaacaatcataa

SEQ ID NO: 2255 - DNA, 1398 bp, Xenorhabdus bovienii
  Coding DNA location: Contig name=SeqID_16868; Position on contig =53285..54682bp; Strand=-
atgccgtctgaaagtgcaattattgcgggaacgtatgtgcagcatgcatcagaggtatgcctgacaacagaagaagggcgaaaagattttaggcgtgccattttttcctgctggttaggtacaacaatggaatatgccgatttcgcactttatggtttagcggctggtattatttttggtgatgtcttctttcctgatgcgacaccaacagccgctttacttgccagttttgcggcttattcagtgggatttgttgcccgtcctattggcgctcttgtgtttggatggttgggggatcgcaaaggacgaaaaatcgtcatgatgatgacggttatgttgatggggatctcaacaactttgattggactaattccaagttatgctcaaattggtgttttggctcccgtctgtttggttattttacggttcatgcagggtttgggggcaggtgcggcgctgtctggtggtgctgtcattttgggggagtttgcccctccggaaaaacgtggtttgatttcttccatcattgccctcggctccaatagcggaacattgctggcctcgctggtttggctgctggtattgacaatggataaagagcgtttactcgattggggatggcgtataccattcctgttcagtttcttgattgcgatagttgcgctatttatccgccgtcacatgaatgaaacgcctgtatttgaacgccatcaagcggaattgaaagcacagcgcttacagaccctgtctgaaggaaaagcgtatcaagctgactgtgaacgttgtcgcttctggaagcggacaaaagcattctggatcatggtaggtttgcgggttggcgaaaatggcccttcctatctggctcagggttttatcatcggttatgtggcaaaagtgctgatggtggataaatcagtccccacgatagctgtcttcattgcttcggttctaggtttcctgatcattccgctggcggggtacttatctgatcgctttggccgtcgcattacctatcgctggttctgcctgctattaatgatgtatgccttccctgcttttattctgctggatagccgagaacctatcattatcattccaactattgttgtgggaatgggattggcctctctgggaatatttggtgttcaggctgcatggggtgtcgaactctttggtgtggctaaccgctataccaaaatggcatttgcaaaagagctgggtgccattttatcgggaggtattgcgccactgatggcatcagcgctgttatcctttgcgggtcattggcggcctattgcatgttattttatattgatggcggggattgggtttctcaccactttctttgcaccggaaacacgtggcagggatctgaatttgcttgaagatgctatttaa

SEQ ID NO: 2256 - DNA, 93 bp, Xenorhabdus bovienii
  Coding DNA location: Contig name=SeqID_16868; Position on contig =54730..54822bp; Strand=+
atgataagtcgaaaaactttatcgttattaattaacgttttttatatcaaaactatctactcgcgtagaatactaaaaaagaaagttagataa

SEQ ID NO: 2257 - DNA, 801 bp, Xenorhabdus bovienii
  Coding DNA location: Contig name=SeqID_16868; Position on contig =55269..56069bp; Strand=-
atgtatcatgttgttgcttcagacttggatggcacattattgtctcctgaccacaaattaacgccgtataccaaagaaacgctgaatttactgacgaataaagggattcactttatttttgcgacaggccgtcatcatattgatgtagggcagatccgcgatggtttgggcattgatgcttatatgattacctctaacggggcgagggtgcataatactcagggaaaattggtattcagccataacctggcgcctgatattgctcttgatttgtgcttaatggagttcgataaccctaataccctcaccaattattaccgtaatgatgattggttcattaaccgtgaaagtcctgaacagaatgagttttttcaggaatctgtttttcagtatcagatttttccgcgtgataacttccccacggatggcgtgtgcaaggtctattacgtcagtgaagatcatgactatttggaacagttggaagaaacgattaaagcgcgttggggagatagcgttaatgtcagcttttcactgagaaattgtctggaagtgatggcgggtggtgtatctaaaggccatgcgctggaacaagtctgtcaggccatcggatatcaattgagtgactgcattgtctttggtgatggcatgaatgatcaggaaatgttgtctgtggcgggtaaaggctgcattatgcagggcgcacaccaacgcctgaaagacattttgccggaaatggaagtgattggcgctaatgctgatgatgccgtttcatattatttgcggagcatgtatcaagtctga

SEQ ID NO: 2258 - DNA, 1011 bp, Xenorhabdus bovienii
  Coding DNA location: Contig name=SeqID_16868; Position on contig =56091..57101bp; Strand=-
atggcgcctgagatattgaaagcaagctggttaaaccgcgaacctcagttctctgcgtttacgaatggactattactggatttctggaaaaccagagacgaacgggaatttatgggcgttgatgatatccccattcgttatgtctccttccgttctctccatcacgataaaacgctgttgatcctgccgggccgcagtgaaagttatgtgaaatatcctgaaatagcctacgatttttaccacttgggctacgacatttttattattgatcaccgtgggcaggggcgttcagggcgaatgcttgatgatccccaaaaaggccacgttgaaaaatttgatcactatgtggatgatttggccaaatttgttgaattggaaattaccccgcgtcagtcccaccgttgttatgcgttggctcactcaatgggagccgcgatcctcagccgttttctattacggcaagaactcgtacgtcaagaacccgattttcgggcggtagctctgtgtgcgccgatgtttggcatcaacttaccgatgcctcgctggttggcaaattttctggtcaatcaggctgaaccttatcctaaaaggcgtaacagttacgcggtatcaacggggcagtggcgtccgttgccctatcttatcaacctgttaactcacagttatgcacgttatcagcgctatttacgctattatgccgattatcctgaattgcgcctcggagggccgacttaccattggatgcgtgaaagtatgcaaatgggagacgaactgattgaaaatgcaggggtaattcagactccgctcattgttttaaaagcaagtgaagataaggtcgttaataatcgggagttactggcattttgtgaatctcgacaaaaagccagaacaggaaaagcagaaaaaaaacctctggtcatccaaggggcacatcacgaaatcctgttcgaaaaagatgcattacgggcgcaggctctcaatgcaatttgtgatttttttgaccagcactga

SEQ ID NO: 2259 - DNA, 1827 bp, Xenorhabdus bovienii
  Coding DNA location: Contig name=SeqID_16868; Position on contig =57129..58955bp; Strand=-
gtgtctaccgcagaagccatcagcacggcatcgctggctgaacaagtattacgaaaaacattcggatatcagcaatttcgtcccggacagcagcaggttattgatgctgttctcgatgggcgtgattgtctggtagtcatgccaaccggtggcggtaagtcgctgtgttaccagatccctgccctgatcaacaatgggctgacgttggtggtttcgccattgatctcgctgatgaaagatcaggttgatcaattgagggcgaacggcgtagaagcggaatgtttgaattcaacccaaaaccgtgagcagcagattgatatcgttcaacgctgccgtcaaggaagcatcaagcttctctatatcgcacctgagcggctggtgacggataattttctcgatcaactgcatgattggcaccctgtgctgctggctgttgatgaagcacactgtatttctcaatgggggcatgacttccggccagaatatcgcgcgctggggcaatttcgccgacgctttcctgaacttccatttattgcactgacagcaacggcggacaaaacaacccgtcaggacattactcgcctgctggaactgcacgatccgcttatccacctcagcagttttgatcgtcccaacatccgttacacattggttgagaaatataaacctctcgatcagctatggtcatttgtgcgtggtcagcagggaaaaagtgggatcatttactgcaacagtcgaaccaaagtggaagaaactgctgaacgcctgcaaaagcgggggctgagtgttgcaccttaccatgctgggctggataacaatcaacgggcatgggtgcaggacgctttccagcgtgacgatttgcaggtcgttgtggcaaccgtcgcttttggtatggggatcaacaaacctaacgtgcgttttgtggtgcatttcgatattccgcgcaatatcgaatcctattatcaggaaactggcagggcggggagagacggcctaccggctgaagcgatactgttttacgatccggcggatatggcatggctgcgtcgttgtctggaagaaaaaccagcaggtgagcaacaggatattgaacggcacaaattgaatgccatgggcgcatttgcggaagcccagacttgccgtcggctggtactactcaactattttggtgaaagccagcagacatcatgcggcaactgcgatatttgtcttgatccaccaaaacgttacgatggtctggtggatgcgcaaaaagcgctttcctgcatttaccgtgttggacaacgttttggtattggctatattgtagaagtattgcgcggtgcaaataaccaacgcattcgtgattttggccatgacagactgcccatttacggtatcggtaaagaacagagtcaggaacattggatgagcatcctgcgtcagctcattcatctgggattgattagccaaaatattgccaattattctgcgttgcagctcacagaggcggcgcggcctgttttgcggggagaagcgtctttacaacttgctgtgccacgcattcaaagcctgaaaagccggaatcagcaaaacaaatcatacagtggcaattatgatcgcaaattatttgccaaattgcgcaaattgcgtaaatccatcgcggatgaaaataacattccgccttttgtggttttcaatgacgttacgctgattgaaatggcagaacaatgtccgataacacctaatgaacttctgctgatcaatggtgttgggcagcgtaaactggagcgttttggcgatgttttcatggcgctcatccgtgatcatttcgaagggtcagaataa

SEQ ID NO: 2260 - DNA, 141 bp, Xenorhabdus bovienii
  Coding DNA location: Contig name=SeqID_16868; Position on contig =58911..59051bp; Strand=+
ttgttcagccagcgatgccgtgctgatggcttctgcggtagacacgccttccctcaatcatttaaaaaaacaggcagtaaaaaatacagacgcgattcaggcgcctgtacatattatgctatctcactgttgaaacaatga

SEQ ID NO: 2261 - DNA, 144 bp, Xenorhabdus bovienii
  Coding DNA location: Contig name=SeqID_16868; Position on contig =59034..59177bp; Strand=-
gtgacttttttgttttgggatagccgtttttatacgcagctattcagtggatatggagaatccatgatcgatgatgatttcgggaagatccgttttggcatcggcaccatgctgaatgatatgctgtcattgtttcaacagtga

SEQ ID NO: 2262 - DNA, 132 bp, Xenorhabdus bovienii
  Coding DNA location: Contig name=SeqID_16868; Position on contig =59174..59305bp; Strand=-
atggttaataatttgttaagtttatgcttttataactcatcttaccagtttgcgaagcacctcggaaaacaatttattgaaggaaaacttactacagaaaattaccattcagtgtgtagaataaacaggtga

SEQ ID NO: 2263 - DNA, 486 bp, Xenorhabdus bovienii
  Coding DNA location: Contig name=SeqID_16868; Position on contig =59358..59843bp; Strand=+
atggaaacaatacagcgatcaacccagccattaacacaggaagaagcccgtaagattattggtgagttatttgtttatcacatgccattcaaccaattgctggggttcgaattactccgctttgatcacgactatgcagagcttcgattccgcaatcaagataagctggtcggcaacatggcccagaaaatcctgcacggtggcgtgattgcctcaatattggatgttgccggtggcctgatttgcgcaggcaacgctctgactgcaatggaaaccatcacgatagcagagatggaaaaacgcctgccgaccatcggtactattgatttgcgtattgattacctgcgtccgggacgcggtgaagtgttcaccgccagcagcaatatcgtccgtagtggcaacaaagtgtcagtggccagagttgaactgcacaatgagcggcaggtgcatatcgccagcgcaatggcaacgtatttggttgggtga

SEQ ID NO: 2264 - DNA, 186 bp, Xenorhabdus bovienii
  Coding DNA location: Contig name=SeqID_16868; Position on contig =59752..59937bp; Strand=+
gtggcaacaaagtgtcagtggccagagttgaactgcacaatgagcggcaggtgcatatcgccagcgcaatggcaacgtatttggttgggtgatactttattgactcccaaaagccaaaataagggaatgtgccataaaaacacattccttttttacaggataagtacgccaatcattggattatga

SEQ ID NO: 2265 - DNA, 162 bp, Xenorhabdus bovienii
  Coding DNA location: Contig name=SeqID_16868; Position on contig =59994..60155bp; Strand=-
atggagactttatacatacttcaacatcggggtttctatataaaaaaaggtgggtttggaaatagggatgtttgtctgttatcgggtaatattggaatccattatttatcggagacggacaggaatatttattctgctgaattgagctgcgaaattgtctag

SEQ ID NO: 2266 - DNA, 93 bp, Xenorhabdus bovienii
  Coding DNA location: Contig name=SeqID_16868; Position on contig =60379..60471bp; Strand=+
atgaaaaatgagttaggttgtataaatatagtgaattatgttattaacaaatacaaattaagcataaaacgcggtcatgtattaaatagttag

SEQ ID NO: 2267 - DNA, 171 bp, Xenorhabdus bovienii
  Coding DNA location: Contig name=SeqID_16868; Position on contig =60521..60691bp; Strand=+
atgttgattgtcgttattgtcacaaatcagaagatgtcaaaggacatggaaaaggtcatagaggttatccccgctaccgctgctatgcctgcagtaaagtctttcagttggcatactcctatcaagcctgcaaaccgggagtcaaagagcagattattgatatggcgatga

SEQ ID NO: 2268 - DNA, 279 bp, Xenorhabdus bovienii
  Coding DNA location: Contig name=SeqID_16868; Position on contig =60642..60920bp; Strand=-
atgtgccactatccgtttcatacgcggctcccaggcataccagagccagcgctgatttttcttactgcccacaaacgaccactgctcatccacttcacagataagatgtatgttatccccgtcaagaggaagcgtcgtcacgttccgggggttgagtttttaagcgttttcatcacagtagctgttgccaccttcaatacgcgggccgtgtcacggatgccgctgttattcatcgccatatcaataatctgctctttgactcccggtttgcaggcttga

SEQ ID NO: 2269 - DNA, 423 bp, Xenorhabdus bovienii
  Coding DNA location: Contig name=SeqID_16868; Position on contig =60780..61202bp; Strand=+
gtgacgacgcttcctcttgacggggataacatacatcttatctgtgaagtggatgagcagtggtcgtttgtgggcagtaagaaaaatcagcgctggctctggtatgcctgggagccgcgtatgaaacggatagtggcacatacttttggtgatcgcagcagaaaaacatgggaaaaactgctggcactcttgtcaccctttaatatccggttttactgtacggatgattatgccgtttatgattgccttcctgaagaagtccatcttactggaaagatatttacccaacgtatagagagaaccaaccttacccatcgtacccgaataaaaaggctgaatagaaaaacaatcggttattccaaatctgaagaaatgcacgataaagtgataggcactttcattgaacgtgaaaactatatttag

SEQ ID NO: 2270 - DNA, 132 bp, Xenorhabdus bovienii
  Coding DNA location: Contig name=SeqID_16868; Position on contig =61251..61382bp; Strand=+
gtggcaaaattttattcatccctcacggcattaaccccttgtaaatcattcatcccagtgacacattgtatgagtgctaacgattcacaagctcttctgattttcttttacattcagggatattatgactga

SEQ ID NO: 2271 - DNA, 891 bp, Xenorhabdus bovienii
  Coding DNA location: Contig name=SeqID_16868; Position on contig =61375..62265bp; Strand=+
atgactgaccaacagactgccaaaggcgttctatatgccttaggcgcttatcttatttgggggctggctcccatctacttcaagaccatacaacaggtaccgcccgatgaaattgtgtcgcaccgtgttatatggtctgtgttctttatggtgctactgctaacactgacacgccactggcgtaaagtgtgggtcgttgcccgtcaaccgaaaaaactgctgctgttaggcatcaccgcttttacgattgccagtaactggctcgtctatatctgggcggttaataatggacatctgctggaagcgagcctcgggtattttatcaatccattggttaacgtactgttcggcatgatatttcttggcgagcgtttccgccggatgcaatggatcgcggtagggctggccttcaccggcgtattgattcagttatggcaatttggctctatccccgtggttggactgtacttggccatgacatttgccgtttatgggttgatccgtaaaaaattgggcgttgattcccaaaccggcatgatgattgaaactgtctgggtatttccggtcgcgatgatctatcttttctgttttaccagcagcccaaccagtaatatgctagataacacgctatcactgaacatgttgttgattgccgcaggtatcattaccactgtaccgctgctgtttttcaccgcagccgctgctcatctgcgtttatccacactgggatttttccagtatcttggcccaacgctgatgtttttgctggcaacgctggtttatggcgaacagattggtccggagcgcctgatcacgtttggttttatctgggctgcattgatcctgtttacgctggatgctctgtacacccagcaccgcttgcgcaagtaa

SEQ ID NO: 2272 - DNA, 951 bp, Xenorhabdus bovienii
  Coding DNA location: Contig name=SeqID_16868; Position on contig =62303..63253bp; Strand=-
atgctgaacgcatttaaattagagaataatcgcctgctccgtcttgagcttgaaaacggtgatcagttatctgactccatgtgggtagatttagtcggtctgggagatgaagatcgtctccgtgttcagaatgaactggggcaagtactggcaacccgcactgaattggatgatattgaggcatcggcacgtttttttgaagatgaagatggtctgcacgtccattcattcttctactttgaagacgccgaagatcatgctggtaactcgacagtggcatttaccatccgtgacagtcgtctctacacattgcgagagcgtgaacttcctgcatttcgattataccgaatgcgcgcccgcaaccagactatggttgacgggaatgcctatgagctactgttggatttgttcgaaactaagatcgaacagttggcagatgtgattgaaaatatctacagcgtactggaatccctgagtcgagttatcatggaaggcaaacagggggatgaatttgactcagcgctttcaaaccttgccgagcaggaagatatcggctggaaagtccgtctgtgtttgatggatagccagcgtgctcttaacttcctcgtgcgtcgcgcccgcctgcccgctaatcagcttgaacaggcccgtgaaatcctgcgagatatcgaatctctgttaccgcataacgaatctctgttccagaaagtcaactttctgatgcaggcggctatgggtttcatcaatatcgaacagagccgcattatcaaaatcttctcggttgtttccgtcgtattcctgcctccaacgctggtggcttccagctacggtatgaacttcgaatttatgccggaattgcactggacattcggttaccctgcggctattggtgtgatgattgcagcggggctagcaccttatctttatttcaagcggaaaaactggctgtaa

SEQ ID NO: 2273 - DNA, 2175 bp, Xenorhabdus bovienii
  Coding DNA location: Contig name=SeqID_16868; Position on contig =63345..65519bp; Strand=-
atggtaattatggacgtttcttatctgctcgaaagcctgaatgataaacaacgcgaagctgttacggcatcgcgtaccaatatgctggtgctggccggggctggcagtggcaaaacgcgcgtgctggttcaccggatcgcctggttactgtcagttgaaaatgcgtcacctttttccatcatggcggtgacttttaccaataaggcagcggctgaaatgcgccatcggattgaaaacctgattggcaccagccaagggggaatgtggataggaacattccatagtctggctcatcgcctgctgcgtttccatcaccttgacgccaatctgccgcaggatttccagatcctcgatagtgaagatcaacaccgactgatcaagcgtatcatcaaggcgatgaatctggatgacaaacagtggccagcccgtcagggcatgtggtacatcaacggtaaaaaagatgaaggattgcgccctcagcatatcgaaagctacggcaatccggtagaagcgacatggctgaaaatttaccaagcctatcaggaagcgtgtgaccgcgccggattggtggattttgctgaattactgctgcgtgctcatgaattgtggctgaacaaaccgcagatcctgcaacattatcgtgagcgcttcactaatcttatggtggatgaatttcaggacaccaacagtattcaatacgcttggatccgcctgctggcaggggatagcggcaaggtgatgattgtcggcgatgatgaccagtcgatttacggctggcgtggggcgcaggtggaaaatatccagcgttttctcagggattttcccggcgcagaaaccattcgcctggaacagaattatcgctccaccagtaatatcctcaaagcggctaacgccctgatcgctcataacagcgaccgattgggtaagagtctgtggacagaaggcggggaaggcgagccgattgcactttactgtgctttcaatgagctggatgagtcgcgttatgtcgtcagccgtatcaaacattggttggacaacggtggcgcactgaaagagtgtgcgatcctgtatcgcagcaatgcccagtcccgcgtactggaagaggcgttattgcaggtctccatgccttaccgcatttatggcggccagcgcttcttcgaacgtcaggaaatcaaggatgctttgtcttacctacgtttagtatcgaaccgttatgatgattccgccttcgagcgcgtggtcaacacgccgacgcggggtatcggagatagaacgctcgatgttgtgcgtcaagtggcgcgtgatcagcagaaaacgctatgggaaagctgtctgctgttgcttcagcaaaaagtgttggcggggcgtgctgcatccgcattgcagcgtttcattgaattgattgacgcgttggaaacggaaacgcaggagatgccgctgcacgtacagaccgaccgcattatccgtgactccggcctgtgggcgatgtatcagcaggaaaaaggcgaaaaagcacaggcgcgtatcgaaaaccttgaagaactggttactgcgacccgccagttcagttataaggatgaagatgaaaacttgatgccattgcaggcctttctgtcccatgcggcactcgaagcgggggaagggcaggcggatgtttatcaggatgccgtacagttgatgaccttgcactctgcgaaagggctggaatttccgcaagttttcatcgtcggcatggaagagggaatgttccccagccaaatgtctcttgacgaaggcgggcgattggaagaagaacgtcgtttggcctacgtgggcgtgacaagggcgatgcaaaaactgacactgacctatgccgaaacccgtcgtttatatggcaagtcagtgtatcatcgcccgtctcgttttgtcggggaattgccgacggaatgtgttgctgaagttcgcctgcgggcaaccgtatcacgtccggtcagccataagcagctgggaacacctatcagtgccgacgacagtggttacgcacttggtcagcgtgtacgtcatccgaaatttggtgaagggacagttatcaatatagaaggcagtggagaacattgccgcctgcaaatcgcgtttcaaggtgaaggtatcaagtggctggttgccgcttatgccaggcttgaaacaggccaataa

SEQ ID NO: 2274 - DNA, 717 bp, Xenorhabdus bovienii
  Coding DNA location: Contig name=SeqID_16868; Position on contig =65575..66291bp; Strand=-
atgcgtttttatcggcctctcgcgccgtttgctgcgatgacattcgatctggatgatacgctttacgataatcatcctgtaatcgataaaaccgaaaaagaagtgttgtgttttatcaggcggtacgatgtcaagttcaatcattttgagagagaagatctgtatgtgtaccgtcaggcggttcttgagtcggagcctgaaatttaccatgacgtgacatcttggcgccgccagtcagtagaactgatgttcagccaccacggtttcaatcgtgaggaaaccctgcgtggtgcggatgaacttatggcctgctttacttattggcgtaatcagatcatcgtgccggaatccacctataatactttatctgtactggcgaaaaaaatgccgttggtggcgatcactaatgggaatgccgaacttgctgcgtgcggacttgagccttattttgagtttgttctcaaagcgggtgtggacgggcgagccaaaccttacccagatatgtatcatctggcggctgaacggttgaacctgccaataagccagatcctgcatgttggcgacaatctgaaaactgatgtggaaggtgctctgtgcagtggcatgcaggcctgctggattaacctcgaaaataaaaatctgatgcaggagcctgaggggcgccgggttccacatgttgagatttctgatttggcttctttgatcgcactgatataa

SEQ ID NO: 2275 - DNA, 915 bp, Xenorhabdus bovienii
  Coding DNA location: Contig name=SeqID_16868; Position on contig =66291..67205bp; Strand=-
atgactcagccgattgacttgctgcttgaaccagtagaaacctttttgcattatctgcgggttgagcgtcgtttaagcctattgacgatcactaactaccgtcgtcatttggtggttctggcgtcgatttcactggatatggggatacatgagtggcaggcacttgatccggctaaagtcagaatgtttgcctcccgtagccgtcgggcggggttgcagtctgccagcctggccctgcgtctttcttccctgcgtactttccttgattggatggtaatacagggaaaactggatgccaatcctgccaaagccgttagtgcaccgcgtaaaaagcgccatttgcccaaaaatatggatgtggacgaagtcaaccagttactcaatatcaacctgaatgatccattgtccgttcgtgaccgggcgatgatggaagtgatgtatggtgcaggtttgcgtttgtcagaactggttggtctggattgtcggcatctggagttggaaagtggtgaagtctgggtgcatggcaagggcagtaaagaacgtaaagtacccgtgggtcgtacagcacgggaatggctccagcgctggcttgaaatgcgggaatggtttgagccggaagataatgccgttttcatttctaccaaaagcggaaaacggatctctgcccgtaacgtacaaaaacgatttgaacagtggggcgttcgccaaggggtcaacagccatatccatccccataaactacgccactcttttgccacgcatattctggaatccagtggtgatctccgtgcagtgcaggagttactgggtcatgagaacttatcgacgacccagatctatacccatctggatttccagcatctggccaaagtctatgatgtggcccaccccagagccaaacgaggaaaatcataa

SEQ ID NO: 2276 - DNA, 720 bp, Xenorhabdus bovienii
  Coding DNA location: Contig name=SeqID_16868; Position on contig =67202..67921bp; Strand=-
atggggcattggaaaatgggtaaaaatgacgatccactgcacttggaaaattggttgaatgatcaggcggtagtggattatttgctgaataatcctaagttttttgtccgcaatgccaatagggtcgataagatacgagttcctcatccggtgcgtgaatgtgtctccctgatggaatggcacatggatcgccagagaaagcgcatctgtcatctggaagacgatctgatacatttggtggagcaggcgaaacagaatgaaatactgttttgtcgtctgctgcaattactcgctgatctctccgctgccaaaagtttgcaggactttctttcccgcttgagttcatggtcgaaaacccttgggttgagtaatagctatgttcggttattcagtgataaatggcgtcttggtgcgccgctgaattcgccggaactggctatctcgcgtaatttttttgagcctgtccgcattcagcgatttggtgacagtaaccattatcttggcacactgtatggcccagaaattttactgctgataccacaggctcgctatgtaggttcagtcgctatctcccttttgggttcacagggggagctgggcatggtgattttcaacagccgtgataaacagcactatcatgaaggtgtgggaaccgatctacttgatcatctggcgaaattgctaccgggattattgtcccgctgggtagaacgagtatga

SEQ ID NO: 2277 - DNA, 927 bp, Xenorhabdus bovienii
  Coding DNA location: Contig name=SeqID_16868; Position on contig =67688..68614bp; Strand=+
atgtatcagatcgtcttccagatgacagatgcgctttctctggcgatccatgtgccattccatcagggagacacattcacgcaccggatgaggaactcgtatcttatcgaccctattggcattgcggacaaaaaacttaggattattcagcaaataatccactaccgcctgatcattcaaccaattttccaagtgcagtggatcgtcatttttacccattttccaatgccccatatttcaataatgactcagataaaactgaatcaatcacaaatgaatcgtaccttcataaacgtgagttgcaggccccgtcatatagagcggcttgcccggcccgtcccaacagatttgcagagccccccccggcaaatcaacgcgaaccttgctatccagcaggtcttgctggataccgacggcgacagctgcacatgcaccgctgccacaagcccgtgtctctcctgcaccacgctcaaagacacgcaatcgaatatgaccacgatgcatgatctgcatgaaaccaatattcgcccgctcagggaaacggtcatgattttccaatactggccccaaaatctccacttctgcggtgtcgacatcttcaacctgtatcacacaatgaggatttcccatcgacacaacaccgcagagcacggtgcgctcaatagcacggataatataggttttctccgccttattggcacgaaaaggaacatgctgtggttcaaagtccggttctcccatattgacacagacctgatcatcattggtgatgctcagtaccatacggcttgcttgcgtactgaccttaatatcacgcttattggtcaaccctttcaagcgaacaaaacgggcaaagcagcgcgccccgttgccacactgggcaacttcactgccatcagcattaaaaatgcgatagtgaaagtctaa

SEQ ID NO: 2278 - DNA, 150 bp, Xenorhabdus bovienii
  Coding DNA location: Contig name=SeqID_16868; Position on contig =68717..68866bp; Strand=+
ttgggtcaccgcatcaacgaccataaaatcattgccaagaccatgcattttggagaactgcatatactactccaacatatactgctccaagagaaaccacataaatcggctctatttttgttgagtatccgattgtgtattgtgttctag

SEQ ID NO: 2279 - DNA, 216 bp, Xenorhabdus bovienii
  Coding DNA location: Contig name=SeqID_16868; Position on contig =68828..69043bp; Strand=-
ttggcgcatgaattacaggcattaattattatgatgaaaaaacaattccgttggtcactggctatcataacactacttgcggtttctggttgtggcttgaaaggtcctctttatttcccgccggcagagccaactgtgacacaacaggctccagcagatcaggcgaataaagcacagctagaacacaatacacaatcggatactcaacaaaaatag

SEQ ID NO: 2280 - DNA, 318 bp, Xenorhabdus bovienii
  Coding DNA location: Contig name=SeqID_16868; Position on contig =69093..69410bp; Strand=+
atgaacgatagcgaatttcatcaattggccgatcaattgatgcagcgtattgaagagcaactggataactacgatggcgatgccgatattgactgtgaaacaaacggcggcgtaatgacgctgactttcgaaaacggcagcaaaatcattatcaatcgccaagaaccctttcatcaaatctggttggcaaccaaaagtggtggctaccactttggttgtcaggaaaacagatggatttgtgaccgcagtggtaacgattttctatctatgctggaacaggcgatcacagaacagagcggcgaatcatttcagttttag

SEQ ID NO: 2281 - DNA, 255 bp, Xenorhabdus bovienii
  Coding DNA location: Contig name=SeqID_16868; Position on contig =69292..69546bp; Strand=+
gtggctaccactttggttgtcaggaaaacagatggatttgtgaccgcagtggtaacgattttctatctatgctggaacaggcgatcacagaacagagcggcgaatcatttcagttttagcatttttttgctactacgcaacccatctactgcttatgccgtattaaaatacggcatttttattaccgtccataaaccgaatcgccataaagccaatcgcaataatataaaatataaaatatcacaaataatataa

SEQ ID NO: 2282 - DNA, 111 bp, Xenorhabdus bovienii
  Coding DNA location: Contig name=SeqID_16868; Position on contig =69650..69760bp; Strand=-
gtgattcgttcaggctcagaaaggactatcttcgatttcattagtggacgcggtaagtcagtgtattgtattaccgactataacaaaagtgcagataatttcattgattaa

SEQ ID NO: 2283 - DNA, 441 bp, Xenorhabdus bovienii; identical to SEQ ID NO: 2208
  Coding DNA location: Contig name=SeqID_16868; Position on contig =69720..70160bp; Strand=+

SEQ ID NO: 2284 - DNA, 537 bp, Xenorhabdus bovienii
  Coding DNA location: Contig name=SeqID_16868; Position on contig =70186..70722bp; Strand=+
ttgctggataagattaaggccggtgcacgggcaggccgctaccgtttggtctattttgatgaagccggttttgccgcctctccgccggtgcaatatggatggagtccacggggtaaaccccatgaaactgagcctcaacaccatgacagacggtcagttctgggggcgttaaattacacggacaacacgctgttttaccaggcaccgtcaggcagtatcacacgagctgatgtgattgattttttagagcaggtcgccaaacaaggggacaaccgcctgacatttttagtgttggataatgcgcgtatccatcatgggatagagaaaaaaatcagaaatcgctggttacgagaacacaacctgcttttattttatcttcctgcctacagcccagagctgaatctgattgaaatcatctggaaacaagccaaatatcactggcgacgctttatcacttggactcaggataccgtggagtatgagctaaatactctattggaaggttatggtgctaaatttgcaattaatttttcttga

SEQ ID NO: 2285 - DNA, 237 bp, Xenorhabdus bovienii
  Coding DNA location: Contig name=SeqID_16868; Position on contig =70723..70959bp; Strand=-
atggtgtgtttccaccggataatacggaacataatgatatcgcgtgcagtattgatgtacatctggatgactcgtgtaggtcacacgatccttgtcattcgttgtatccctattgatataaagcgaataatttgcaaaatacgtgaattttcggcatatcatctattatattccaagcgtattttattacttgttgaattaattaaatatagatttacactgtattttactaagtaa

SEQ ID NO: 2286 - DNA, 2601 bp, Xenorhabdus bovienii
  Coding DNA location: Contig name=SeqID_16868; Position on contig =70844..73444bp; Strand=-
ttgtatctctatattgaaacgttgaagcagcgactggatgcaattaaccagcttaagttagagcgtgcgaccagctcaatgagtcccgtttttaagcaggtttataatttaattccggtattattgcattatcatcacccaatgatgccaggctatatcaaaagcaacgttcctcatggcgtttgcttcttcacgtctgatgaatctcagcaattttggattaatgatctggcaggccagtctactggtattttgtcacacactcccaacggtgagctgccgattacgggtatttactcgatgggcagcacctcttctatagggcaaagctgttcctctgacttggacatctgggtctgtcatcaatcctggctggatcatagtgaaaaagcgttactggaacagaaatgcactctgatagaacagtgggcggagtcgctgggtattgaagtgacattttttctggttgatgaaaatcgctttcgtcataatgcctgtggcagcctgaacggggaagactgcggaacaacccagcatatccttctgctggatgaattttatcgcactgcggtctgtatggcaggtaagcgcttgttgtggatgatggttcctgtggaagaagaggggcagtatgacgaatatgtgctttctctttatgcccaaggtgttttgacgccaaacgagtggctggatctgggcgggttgaacgaactgtcagcagaagaatattttggggcaagcctgtggcagctctacaagagtgttgactctccttataaagcagttttgaaaagtctgctgctggaggcctattcatgggaatatccgaacggaaaattgctgtcaatggagatgaaacagcatttccatgatggttctattgtttccttcggccttgattcttatagcatgatgcttgagcgtgtaacccgttatctcaccgcaacgaacgatttcacgcgtctggatctggcgcgccgttgtttttacctgaaagtttgcgaaaagatgctgggaagccacgaggataaaggctgtacaggatggcgccatcaggtcatgtcgcagctggcgcatgaatggggttgggatgccagcaaattggcaatgctggataaccgtaattcatggaaaatcgggctagtgcgtgatgctcataatgaattactggataccatgatgatgagttatcgcaatttgatccgctttgcccggcgtaacaatttaagtgtgagtgccagcccacaggatattggcgtactgacccgtaaattgtatgcagcatttgaagccttgcccggtaaagtcactctggtgaatccacaaatttcaccggatctgacagaacaggatctgacattcatctatgttccgcctgggcgtgtaaatcgtagcggctggtatctttacaatcacgcgcccacgatagaaacgatcatcggccaccagccactggaatataaccgctatttaaataaattggtggcgtggacttattttaacggcctgctgacgaaaggatctcgtatccatattcatcacgggaagtcgcaatgtgactggaataacttgtgtgatttggtgagcgatatcgctacccattttccaatccgcctgcctgcaccgacgccaaaagcgttatatagcccctgcgagattcgccatctggcgattattgttaatttggaaaaagatcccactacggacttttccaatcggatcgtgcattttgatttcaggaagctggatgttttcagttttggtgaattgcagcaatgtttggtggggagtatcgacctgctttaccgtaactcgtggaatgaagtgaggacattgcatttcagtggtgaacaatccatgctggaagcgttgaaaaccatactgggcaaaatgcatcaggatgcggcaccacccgctgaggttgacgtattctgctatagcgagcatttgcgtggattgatccgaactcgcgtccagcagttagtttcagaatgtatagagttgcgtctgtgtagtaatcgtcaggatcccaatcgttttaaggcgttgcgcatttcaggccagacgtggggtttattttttgaacggttaaacgtttcggtacagaaattagaaaatgcgatggaattctatggcgcgatttcgaatactaaattgcatggtctgcccgttaagattgatcctaaagaaaaacacttacctcccgtgatcgatggatttgcctgtgaagggattattcaatttttcttcgaagatattgaaagaagtcagggattcaatatttatattcttgatgagtcaaatcgggtagaaatttattcccattgtgagggcagtaaagaagaattggtacgtgacgtcagccgtttttattcttcatcgcatgatcgttttacttatggctccagtttcatcaacttcaacttaccgcagttttatcaaatcatcaggaaaggtgagcgtacccatgtcgctccatttagagatggtgtgtttccaccggataatacggaacataatgatatcgcgtgcagtattgatgtacatctggatgactcgtgtaggtcacacgatccttgtcattcgttgtatccctattga

SEQ ID NO: 2287 - DNA, 162 bp, Xenorhabdus bovienii
  Coding DNA location: Contig name=SeqID_16868; Position on contig =73468..73629bp; Strand=+
gtgcctaaagtagcccccgtttccgataaagcatcgtattgcaagatgacttttaaaaatttttacaaaattattgtcggaaacgtgatcaatttaacaccttgcggtcgaagcgtaaagtacgcactaccacctttccgccttctccgcaacagtcaatga

SEQ ID NO: 2288 - DNA, 93 bp, Xenorhabdus bovienii
  Coding DNA location: Contig name=SeqID_16868; Position on contig =73994..74086bp; Strand=+
atgttaaaactgactctattttctcgcgatttagcggctcaaaagcccctaaataccgttattaatacgattacccaatataattatcaatga

SEQ ID NO: 2289 - DNA, 942 bp, Xenorhabdus bovienii
  Coding DNA location: Contig name=SeqID_16868; Position on contig =74083..75024bp; Strand=+
atgacaatgaaaatcattcgtatcgcgacccgccaaagcccactggctatgtggcaagctcaatatgtccaaaagcaactggaacagtttcatccagaactgaaagtggaactggttcccatggtgacacgcggggatgtgatcctcgatactccactggcaaaggtgggtggtaaggggttatttgtgaaagagctggagttggcactgctcgaaaatcgggctgatattgccgtccactccatgaaagatgtccctgtgggatttcctgacggcttggggttggtcacaatttgtgaacggggtgatccaagggatgcctttgtttcagtaaaatacgcctcgcttaatgagctgcccattggcagtgtcgtcggtacatccagtttacgccgccaatgccagcttcgtcagttacgtcctgatttggtggtccgtgacctgcgtggcaatgtaggtacccgtctgggcaagcttgataacggcgattatgatgccattatccttgcagctgcgggtctgaaaagattagggctggaagatcgcattcgcataccgttggcaccggagttactgctgcccgcagtcggtcagggtgcaatcggtattgagtgccgccttgatgataagcaaacccgtgagttactggctcccttaaaccatataggaacagaaatctgcgttctggctgaacgcgccatgaatacccaccttgagggaggctgtcaggtgccaattggcagctatgctatctggcagggaaacactatctggctgcgcgcgcttgtcggagctcccgatggcagcatgactgtacgtggtgaaaaaaccgtatcaccagaagaggcctgtcgagcaggtgtggaattggcggaagaattattggagaaaggcgcacgccagattctggctgatgtctaccagaggaactctcctgaatga

SEQ ID NO: 2290 - DNA, 741 bp, Xenorhabdus bovienii
  Coding DNA location: Contig name=SeqID_16868; Position on contig =75021..75761bp; Strand=+
atgagcatcttgatcacccgcccaaatcccgcaggagagcagttagtcaagcgactgagggctataggaaaaatggcattcagtgcaccactcattgcgatttatccgggcggcgatttgccgttgctgtcacagaaactccaacggctgtcggcgggtaatttagtcttcctgttatcaaaaaacgccgttcactatgccaatgaacagcttatgcaagaaggtctatcatggcctgataagctatcctattatggtatcggcaaatcaacttccctgatgttttatcaaaaaaccgggttggagatcctctggcctgaacaaggtgaaataagtgaagatctactgcaactccccattttgcagcaggtgaatgataaaaagattttattgctccggggcaatggaggtcgtgaagttatcgcttcaacattgagaagccggggaggggaagtcgattattgtgagtgttattcacgccaacctatcaaatatcatgtcgctgatttcagtcgccattggcaacaatatggtataaaaaccctcgttgttaccagtggcgaaatgctacaactgttatatagcttagtcactgatggtgatggcaaaacgtggttattgagttgcgacttgattgtggtaagcgaacgccttgccaatattgcccaaacactgggctggcaggcaataaaaatagccaagagtgcagataatgacgccttaatgcaggcactagaataa

SEQ ID NO: 2291 - DNA, 1197 bp, Xenorhabdus bovienii
  Coding DNA location: Contig name=SeqID_16868; Position on contig =75773..76969bp; Strand=+
atgtccattatgacggaacaaaagcaatccactgatgcggttgagccaaaataccctcagcagcctgaaacggctccccataaacccaaacgttatggatgggtgggaaatacactctcaattgccattacgctggcgatcggtgcaggtgccatttacctttaccattatggcaagcaacaaaatgcagtattaacagccgaaaaccttgctcttcagcagcaggttgcctctctcgcacaacaacagtctagcgacaaacaagattttgctacccagtttcggaagttagagagcgacttgcaacaggccaaactgcaaaataaacaaacagacagccgcatgttggagcttcagacccgcttatcaaagatttcaaatacggatctcgaaaactggcacttggcacaagcaaattatctcgtgaagatggctggccgcaaaatatgggccgaacaagatacgactaccgcaatcgcactgctgaaaaatgccgaccaaagccttgccgagatggatgatcccagcctgctacacatccgccaagccatcatggaagatatcaatacgctctctaaaattaatcagcttgatttagatggcattattcttactctgaatcgcttatcaaatcagatcgataatttacggctggaagataatggagaacaagaagcgccaatggatgaagacgatggaggaatcagtgcttcactctctgactggcgtaaaaacctgagtaagagctgggacagctttatggagaatttcattactatcaaacgtcgtgacagctccgtagtaccattattggctccgaaccaagacgtttacctgcgtgaaaacatccgctccaaactactggtggcagcccaagcggttccccgtcaccagaatgaagtctataaacaatcattggaagccgtttcaagttgggtgaggtcttatttcgatactgcttccccagatacaaaaacctttttgcaggatattgattcgctggcgcagaaaccgctttctattgaactccctgaacacctgagcagtcagccaatactggcagacctagtgcgcaagcgcatctacaatttgccacatcagtcagacactcaagttcagcctcaatcagaggttcaaccccagccgaaacccccagaaacatctggtcaggcagaaacgcctgttcaggagggttga

SEQ ID NO: 2292 - DNA, 1206 bp, Xenorhabdus bovienii
  Coding DNA location: Contig name=SeqID_16868; Position on contig =76972..78177bp; Strand=+
atgctgaaagtattattgctgttcattatcctcatcgtaggtgttgtgctcggccctctgttgtccgggcatcaggggtacgttttgatccaaacagacaatcacaatatcaccactagcgtcactgcgatggtgattatatttgttctgttacagttcctgctgattttaatcggctggtgttaccgcaggttgatacgtaccagtacgttcacccacagttggctctttggcggatacaaacgcagccgggcacgtttgcagaccaaacaggccctgctcaaattggccgaaggggacttcaagcaggttgaacatttgatgacccgtaatgctgaccatgcggaaaaccccgtcgtcaactatttactggccgcagaagccgcccagcagcgtggcgattacctccgtaccaaccagtatattgaacgtgccgcagaagtcgccgataaagatcagttgcctgtcgatattacccgagtccgtatccaactggcacaaggagaagttcatgccgcccgcaatggtgtggataagctactgaaccacgcaccgcgccatcctgaagtactgcgactggcggagcaggcttatacgcagtcaggagcctaccaatccctcatcgatatcctgccttctctgataaaggttggtttgtgtgatgaagaacatattcatcaattgcgccagcaagcctacatcgggttgatgaatcagatcatggcagaaaaaggcagtacgggattgaaggcatggtggaaagatcagagtcgcaaactccgcaatgatatcgtgctacaagtcgccatggccgaacatctgattgagtgcaatgatcacgacactgcacagcagattgtcctcaatgggttaaagcagcaatatgacgaacgcctgctgctgttaattccacacttaaagacagatgatgccgaagccgtgcaaaaatcactggcgtatttattaaagcagcatggagcgacaccattactgaacagtacacttgggcaggtagccttacaccacggtcagtgggctgaggctgaaaccgcattcaaggcggctcttgcacagcgtcctgacgcccatgattatgcttggcttgccgatgcgttcgatagacagcataagcgtgaagaagccgctcaaacacgtagcaaaggctttatgctgactctgaagcgcgaaagtgatgcagaagaataa

SEQ ID NO: 2293 - DNA, 159 bp, Xenorhabdus bovienii
  Coding DNA location: Contig name=SeqID_16868; Position on contig =78187..78345bp; Strand=+
atgttagatgaaaattcaccaaggttaacggttgcaatacctatcgatactattgaatcgttaaccttggtgcatcatgcaaatctcaggatacaagcaaaaaaaacacctatcaaaaaagacaggtgtataaatacaatcaggtctacagacggatag

SEQ ID NO: 2294 - DNA, 114 bp, Xenorhabdus bovienii
  Coding DNA location: Contig name=SeqID_16868; Position on contig =78312..78425bp; Strand=+
gtgtataaatacaatcaggtctacagacggatagtgcctcactcaacgttgtgtccggttggtgatgaaaagactaaatgcttattcatctataacgtggaccataggcactga

SEQ ID NO: 2295 - DNA, 117 bp, Xenorhabdus bovienii
  Coding DNA location: Contig name=SeqID_16868; Position on contig =78668..78784bp; Strand=-
ttgcacttttataggtgttataactatttgtttttaaatgtcttttatgtatggtgttgtatttccgcgacaaacatactattgaatgtctcggtttggagacatttaactcattga

SEQ ID NO: 2296 - DNA, 279 bp, Xenorhabdus bovienii
  Coding DNA location: Contig name=SeqID_16868; Position on contig =78815..79093bp; Strand=+
atgacaaaaagaaatgaagggctttttgatagttgggaaataacgattagaaatagcatctctcccagagatacaaaaagaaaaagccctacaaaaatagcagggctttctcagaatttggtcggcgagagaggattcgaacctccgacccactggtcccaaaccagttgcgctaccaagctgcgctactcgccgaaatgtacttcttctacaatctcttttttatggtgcgaagggggggaattgaacccccacgtccgtaaggacactaacacctga

SEQ ID NO: 2297 - DNA, 102 bp, Xenorhabdus bovienii
  Coding DNA location: Contig name=SeqID_16868; Position on contig =79083..79184bp; Strand=-
gtgattccagttgtcgtgggttcgagtcccattagccaccccatcttttttatgacacgcgatggtggcggaattggtagacgcgctagcttcaggtgttag

SEQ ID NO: 2298 - DNA, 138 bp, Xenorhabdus bovienii
  Coding DNA location: Contig name=SeqID_16868; Position on contig =79146..79283bp; Strand=+
gtggctaatgggactcgaacccacgacaactggaatcacaatccagggctctaccaactgagctatagccaccataacaactatcttttcgaaagttatcttttcataaactgcttacaacgtcgttcaccacgataa

SEQ ID NO: 2299 - DNA, 147 bp, Xenorhabdus bovienii
  Coding DNA location: Contig name=SeqID_16868; Position on contig =79241..79387bp; Strand=-
cccgtagctcagctggatagagcgctgccctccggaggcagaggtctcaggttcgaatcctgtcgggcgcgccatttaaagcgtgcgagagcagtggcagtgggttatcgtggtgaacgacgttgtaagcagtttatgaaaagataa

SEQ ID NO: 2300 - DNA, 204 bp, Xenorhabdus bovienii
  Coding DNA location: Contig name=SeqID_16870; Position on contig =1..204bp; Strand=+
acatggtatctgcttgatgctcagggaaacaatattcaggatggcttatggctggtggatatcgaaggtatgcacagtatcaagaggattgccaaaattcctgtcagtaaaatccgtgtcagcgatgatgacgtcacttttgactgttcagtcagcgatattcaattcatcggtcgcgtggctctggtgatatccagacaatag

SEQ ID NO: 2301 - DNA, 543 bp, Xenorhabdus bovienii
  Coding DNA location: Contig name=SeqID_16870; Position on contig =286..828bp; Strand=-
atgattatcacactggaaacagaaagattgctactccgtggctggaaagaagaagatcgtgagcctttctttcgcttaaatagcaatcctgaagtgatggagttttttttaaaaagaccgaataaagaacaaaataatacttttgttgataatttgatccgtaagtttgaaacgcaaggtggctgggggttgtgggctgttgagcgaaaacaggatggtgagttcatcggtatgatcgggctgaatattcccagtgatgagttaccctgttatccctgtgtcgaaattggctggcagcttgataaacccttttggggcaaaggctatacgtgtgaagcggctcgtaggatttttgatttcgcgtttacagaagtgggattggatgaagttgtagcacttacttccgtacttaattaccgctcagaaagcgtgatgaaaaaactgggcatgatcagagacgaaaaaacatttctacatcctttagtgccggaaggtcatcgattgagagagcatgttctatatcggattcggcgttcaagttga

SEQ ID NO: 2302 - DNA, 666 bp, Xenorhabdus bovienii
  Coding DNA location: Contig name=SeqID_16870; Position on contig =940..1605bp; Strand=-
atggaaaagtatcgtttttcagataacgcttttttatacagtgtatggctcctttggggtgttgccttagggctatatttgtatggcgctcatctcggttgtgccataacagcaattatatcttttctagccttggtactttactttacaaatatgaaattgagaataaatgctatgtttggaaaaaaaactgaggcacctgttgccagtcctgttacgccaatcatttctacacagcctgaagagaaaaaaaacctcagtgttgaaactcgttccaatacgattattgcgaaaaattcggtatttaaaggcgatattgagatggaaggcgatattcaggtctggggaaaaatcgttggtaatattcgcgtaaaaggcggtgctattcgtgtcatgcatgctggaaaagttgaaggtgagcttaatgcgccagaaattattattgatggccatgttgacggtacgtgctgtgcggaaacgctggatatcctggagcacggcgaactacgtggtatcagccgttgtggaagtatgtcaatccggcgtggcggtttatttattggtcagtctgaaccggtcgaaaacaagaaaaaaccggatattgagcgagttgtttccatcaaggaaaatcaggcagataaagcgaaagccaaaaatagtgcttaa

SEQ ID NO: 2303 - DNA, 93 bp, Xenorhabdus bovienii
  Coding DNA location: Contig name=SeqID_16870; Position on contig =1755..1847bp; Strand=-
atggattttttattctggaaatatgggataattaaacgagaattcagagtgttaaactcaagtagtaacgttatccttgtaatagcgctataa

SEQ ID NO: 2304 - DNA, 117 bp, Xenorhabdus bovienii
  Coding DNA location: Contig name=SeqID_16870; Position on contig =2331..2447bp; Strand=-
atgacaatttttatcattaaaaatctctcagttaatatttgtaattatttgattttaaaaattaattataatttatttgatttattgggcaggtcaatcggctcgtataatgagtaa

SEQ ID NO: 2305 - DNA, 147 bp, Xenorhabdus bovienii
  Coding DNA location: Contig name=SeqID_16870; Position on contig =2686..2832bp; Strand=+
atgttacgcatgctatttcgatatctatcaatactgtttcaccccgcactcgatgctatcagtataattcgagtgccaaatgaaaggcttttccaacatctattaattaataaaataaatacaccatgcactcatcacaaaaaatga

SEQ ID NO: 2306 - DNA, 816 bp, Xenorhabdus bovienii
  Coding DNA location: Contig name=SeqID_16870; Position on contig =2865..3680bp; Strand=+
atgaaaaggacgacaggcttaaaccagaagagtatttgtactcacctattgaccataccggatttcaataccctcgaacataaacaaagagggctgtatgttttactcgatggtgaaatgatatggaaagattgcaccaatacttaccatatcacatcgaatgagatcctttttacccatccggggagctacgtagccaaaaccaatacagaaaactgtcaggtattatggctacccttacaaatggagttcctgcgcagttttttaaaacgtttcgggtcgttactgagtaaaattgaacgacatgattttccagctcgcaggctgattcccttcaatcagttccccttattgacggaaagtatccgtggactggccaatctgctggctcatgattaccctcctgcactgattcagctcagggttgaagagctgctattactgctttctcttagcaaacagggcgcattactgatgtcggtattgcgacagttgagtaaccgtcaggtagagcgcctgcaaacattcatggacgcacattatctcaaggaatggcggctcaatgactttgcccgtgagttcggtatgggattaacttcattcaaggagctttttaacagcgtctatggtacatctccccgcgcctggatcagtgaacagcgtattctttatgcgcatcaattgttactgaacagcgaaatgagcatcgccgatatctcattggaatctggtttttccagccagtcctattttacccaaagttatcgtcggcgttttggttgtacccccaatcgcgccagatatggcaaagattag

SEQ ID NO: 2307 - DNA, 114 bp, Xenorhabdus bovienii
  Coding DNA location: Contig name=SeqID_16870; Position on contig =3952..4065bp; Strand=-
atgcctgctagctattctcccgtttttagggggattaccggcgtcattgttggaaaatataaaagcaaaaaaaaaggcctgcatagacaggccaaaggatacggtgaagcataa

SEQ ID NO: 2308 - DNA, 681 bp, Xenorhabdus bovienii
  Coding DNA location: Contig name=SeqID_16870; Position on contig =4101..4781bp; Strand=-
atgtcactgaactatgaacgtaacccgcttccgttgccaaacggacacaataaagtgttattgcattcgtgctgcgctccctgttccggggaggtgatggaagccatgctggtttcaggaattgatttcacgatatttttctataatccgaatattcatcctctaaaagaatatgaattgcgcaaagatgaaaatattcgttttgcggagcagatggggatcccctttattgatgctgattatgatcgtgataactggtttgaacgtgcgaaaggcatggaaaatgaacctgaacgcggtattcgctgtaccatgtgttttgatatgcgtttcgagcggacagctctttatgctcatgaacatggttttcctgttattagcagctcgctgggtatttcacgctggaaaaatatgcagcagatcaatgaatgcggcgtccgtgcggcttcccgttatcccgacttaacctactgggaatataattggcgcaagggcggcggttcttcccgcatgatagaaatcagtaaacgtgaggagttttatcagcaggaatattgtggctgtgtttattccctgcgggataccaaccgacatcgtttatcgaccggaagggaaagaataaaattgggtacagtattttatcaagcggagagtgataaaaaagatcacgaatcaaattga

SEQ ID NO: 2309 - DNA, 750 bp, Xenorhabdus bovienii
  Coding DNA location: Contig name=SeqID_16870; Position on contig =4928..5677bp; Strand=-
atgtttaacttaacggacaaaattgcgtttatttccggaggcacgaaaggtattggcaagggcattgcccaggtcttcaagcgagcgggtgccattaccattatttccggcactgacaggacaagaggcgaggcgattgcaaaagagctggatattgattttattcctcttgatgtgacggatcaggcggcatgtaaaaatgtgattgatgagattgtcgaaaaatatggcaggcttgatattctgtgctccaatgcgggtatttttccacaacattatcttaaagacatgacggctgaagattgggatttagtgaataccgtcaacctcaagggaacatttttattggttcaggctgcattgaatgtcatggagaagcagcgttatggccgggtcgtgcttacgtcatcggtgacaggggagatgacgggtattccgggttacagccattatggtgccagtaaggcgggtcagttggggtttatgcgcagtgcggcgctggaatatgcaggtcggggtatcaccattaatgccattatgccgggtataattatgactgaaggcttgcagacatttggtgaagattacctacagcatgttcaatctacaacgccgatgcgcgttttagggttgccggaagatatcggctatacggcctgttttcttgcctccgacgaagcaaaatatattaccgggcaggcgattgtggttgatggcgggcagatactgccagaagtgcagggtgcttaa

SEQ ID NO: 2310 - DNA, 150 bp, Xenorhabdus bovienii
  Coding DNA location: Contig name=SeqID_16870; Position on contig =5613..5762bp; Strand=+
atgcccttgccaatacctttcgtgcctccggaaataaacgcaattttgtccgttaagttaaacatagtcgtttccctttatatgagtggatacagtatttttgttacaaacaatataacttttcaatatattttgaataaaatacattga

SEQ ID NO: 2311 - DNA, 1611 bp, Xenorhabdus bovienii
  Coding DNA location: Contig name=SeqID_16870; Position on contig =5962..7572bp; Strand=+
atgactctcaacaattcattcttatatgaatatgatggtattgcattatcacccattttatttctcaaaagagccgtattaagtaacagtgatgatattgccgtgatagatggagatcattgttggacctggcgtcaatatgctgaacgatgtgaaaaagtggcaatcgcacttcaacaaatgggcataggtaaagggagtattatatccgcactactgcctaatagacatgaaatgctcgaattacattttgctgttcctttggcgggtggaattttaaatgcactgagtactcgaacagattcagcaacgttaaattttatcttcgaaaaacttagcccacaaatattattgattgatagaaactatatttcattattggataatatcgctattaataatcaaatgaagatcattattgttgacgaaaacaattcatgcatcccggaatcaacatttgatcatgaatacattcaatatgaatcactgataacgcaatacccatcggcaaccttgtcttttcctcagattgacgagcaggaagccatcagtatcaactcgacgtcaggaaccagcgggcagcctaaactggttgtttattctcaccgcggggcgtttcttaatgccgtttctaatattttggattgggatatgcccaaacaacccacattcttatgggctcttcccatgttccactgtaatggctggtgtttcccctgggcaatcgccgcacgggcaggtacgcatatctgcatgcgtcggtttgatgcagagaaagctatccagctcatgcaacaacaccaggtaacccactattgtggtgcaccgattgtgcactattctctgggaaaagcagcacaaaaccagggcatcgattttgataataaggtttatgggctcatcgcaggcgcaccacccacagcaatggtattttccctgctggatgctgttggcatcacagtgacacatgtctatggtctgacagaaacttatgggcctgtcgttgtttctgaagataaacatgattggaaagcactgccagaatcggaaaggatattaaagcgcatgcggcaggggatcgtctccaatttacaggggcaggtcagcgttattggcgaacatagcggattacccgttccttttgatggaaaaactgtcggcgaaattgctattcgcggaaatatcgttgcagcttatgatcctattcgccatgtgactcccagtacaacaagccaatggttttttaccggcgatttggcagtcgtcgacaatgatggctatatcaaaattaccgatcggaaaaaagatattatcatttccggtggtgaaaatatttccagccttgaattggaaaatgccctgtcaggttatcccggtattttggctgtcgctattgtggcaaaacccgacccgtactggggagaagttccccatgcttttattgaacttgatcaacatacattagtgactgaacaagaactggatgattatatttgtaccctggtcgcacgttataaacgtcctaaaggttatactttttcaacattaccccgtaatgtgaacgggaaaattatcaaagaacaactgagaaatattgtccgaaatttatga

SEQ ID NO: 2312 - DNA, 1056 bp, Xenorhabdus bovienii
  Coding DNA location: Contig name=SeqID_16870; Position on contig =7600..8655bp; Strand=-
atgactcttcaatctttacttgatgcaattcagccactgaatcaggcgaaaatggaaacagcggcgcagcacattgacagtctggtcaaaccgctgggcagtttggggcgtcttgaagcactggcgatccagctttcaggtatgccggggatctgggatcttcgtaatctgcaaaaagagatcatcgtcatgtgtgccgatcatggggtatatgacgaaggtgtggcaatttcacccaagaatgtcacggcgatacaggcacggaatatgctgcaagggataactggggtctgtgtactggcgaaaaatagcggcacccatgtcttgcccgtggatattgggatcgatggtgatccgattgacaatctgctgtccctgaaattggctcgcggctgtggcaatattacacagggggcagccatggaatatgcacaggctgaaactctgttgctggcgagcgcacaactggtacaacagcgtattgccgcaggggtttccgtattgggtgtgggagagttggggattgccaataccacgccagccgcggcagtcatcagcgtgctgacgggcagtgatccccatgatgtggttgggcagggcgcgaatttgcccactgagcgactgatgcacaaaggctccgttgtgcgtcagtcgattatcgtcaatcagccgaatgggaatgatgcgctggatgtattggcaaaagtaggcgggtttgaccttgtcggtatgacgggagtgattctcggagctgcggcgtcaggtgttcctgtcgttcttgatggttttccctcttatgcctctgcattggccgcctgccagatggcgcctattgcacggaattactgtatcccttcacacctgtcagcagaaaaaggcgcagtgctggcattacagcatttgcgtctgcaaccttatcttcatctggatttgcgccttggtgaagggagtggagcggcaattgcgatgtctttgattgatgccgcttgtgcgatctactgcaatatggggcaactggcgagcagtgggatcagtttgccgtcttatacgtcctga

SEQ ID NO: 2313 - DNA, 603 bp, Xenorhabdus bovienii
  Coding DNA location: Contig name=SeqID_16870; Position on contig =8670..9272bp; Strand=-
atgcgtctttttctcgttcgacacgggcaaacggaagccaacattaacggcgttttttgtggcagcacagatttgccgttgacggagatggggatcaaacaggcgcaacaggtcgctgctgcgctgaaacatgttgatttccaatcgctccactgtagtgagatgcagcgggcacagcatactgcacgtattatttccccttttgcaatagagcctgagcatcgccttaatgaattgaatttcggggcatgggaattatgtcatcatgaaatgattgccaaaggcgatccgcaggcgtgggcgcgttggttgtctgactggcaaaatgcctgccctacgggaggagaggcgttcagggattttgctgcccgggtggaaagttatgctgatgaagtgcgttctgccacggcagagggaaatcaactgattgttgcacatcagggagtcctggcactgctattgaccaggctgctcaatctgccgacagaagccatgtggtcttttccctttcagcaaggcgcctatagtgtcgtagataatcacacgggatttaccacattgcgggtcttcaatggacggacagaatatcggcctgaagaatag

SEQ ID NO: 2314 - DNA, 759 bp, Xenorhabdus bovienii
  Coding DNA location: Contig name=SeqID_16870; Position on contig =9304..10062bp; Strand=-
atgaagctgaatctcttttgggcgacattgcaatttatgacacggcttcccgtgcctgcaaaatgggcggaaggggttgatttcagccagtattggcgcggcgtgccgaattttccggtgattggcctgattattggcgggttggccgccctgatttcgctctcgattagtcaatctggcggcggtatgtatatcggttccattggctatgtgctggcattggcactgttgacaggcgggttacatttagacggtttggccgatacctgtgatggccttttctctgcccgccggcgagaaacaatgctggcgatcatgcgcgatagccgtctcggtacgcatggcggtctggggttgattttctgccttttccttaaggttttcgccgtggcagagctttctgatcatcctcctcttgagctatttgccttgctgacgtgcgcgccgattgtcgggcgtactgccgtcgtgctactgatgtatgaacagcgttacgcccgtgaaggtgagggcatgggaagcagttatattggtcgaatgactccgcgatcgactgccctcacgctattaggcggtgcggtattggttatcgcgctcggagactggcaaggattaatcgccatgatggtgacattgatcgtcatttatggattggccttctattttaattatcgtcttggtggtcagaccggcgatacgctgggtgcctcaatcgaggcaggcgaagtcatttttctgctggtcatgatctggaaatag

SEQ ID NO: 2315 - DNA, 546 bp, Xenorhabdus bovienii
  Coding DNA location: Contig name=SeqID_16870; Position on contig =10059..10604bp; Strand=-
atgattttggtgacgggaggtgcgcggagcggtaaaagtgcctacacagaacggctgattgcggggcagtgtgagcaggtactttatattgctacggcgcaggttacggatgaagaaatggcggctcgcatcgagcggcatagacaggagcgcccttcacactggcggacgtgggagggttatcaagacttggctagcgtgatccgccagcatcggcaacccgaagagggcgttatacttgaatgtgtaacaacgttgattgccaacctgctgtttgacaaatcggcgggggcatcacccgatgaatgggatttttcatcactggaggtgtttattcagcgtcagatagatgacttgatcgttgcttgcctgcattgcccgactccggtgtatttggtgacgaatgaagtgggcatgggcattatgcctgaaaatcggctggcacgtcattttgccgatatcgccgggcgcgtgaaccaaaaactggcgcaggcggctaaagaggtctggctgatggtttcagggattggagtcaaaatcaaatga

SEQ ID NO: 2316 - DNA, 111 bp, Xenorhabdus bovienii
  Coding DNA location: Contig name=SeqID_16870; Position on contig =10570..10680bp; Strand=-
atgaagagcatcactgattgcaaaaacagagcgtatcgtgtgagcattgtggctttacggagtttgggatcacaaaatgattttggtgacgggaggtgcgcggagcggtaa

SEQ ID NO: 2317 - DNA, 1542 bp, Xenorhabdus bovienii
  Coding DNA location: Contig name=SeqID_16870; Position on contig =10664..12205bp; Strand=-
atgacattatctctgatgattcagggaacggcttctgatgtgggcaaaagcgtgctggtggccggattttgccggatctttttacaggacggccatcgctgcattcctttcaaagcgcaaaatatggcgctcaattcgggtattaccgccgatggcaaagagatggggcgggcgcagatatttcaggcagaagcggcaggtattgagccggatgtgcgtatgaatccggttttgctgaaacccaccagcgatcgtaaagcgcaggtgattttcatgggaaaagtagtatgcagcatgaacgccgtggaatatcacgtatataagccacagctccaacagcagattttggccgcctatgacagcctcgcagcggaaaccgacattatggtactggaaggtgcggggagtccggctgaaatcaatttgcgtgatcgcgatatcgtcaatatgggcatggcagagttggcggatgttccggtcattctggtcgcggatattgatcgtggcggcgtgtttgccgcgatttatggcacactggcacttctcaggccagaggaaagagcacgggtcaaaggcgtgatcatcaataaattccgtggcgatccggctttactgcaatcagggattgatcagatcgaagctctgacacaagtgccgatattgggggtgttgccgtggttggatctcgatctggaagatgaggacagcgtcgccttacaggtcggcaaatatgatcactctggcaagcacgcagaaaattggctgaatatcgcggttatccagttgccgcatatcgccaattttacggatttcaaagcgctggcggcacaatctgatgttcatctgcgttatgtctctgatccttcggcactgcatggcgctgatctgatcattttgccgggcagcaaaaataccttaggtgacttggcatggttaaagatccacgggcttgatcaggctattatcgccgcgcatcagtcaggtattccgatcatcgggatctgtggcggctatcagatgctgggaaaacaaatcattgatgaggttgaatcaggtttaaaccggatggccggtttgggattactggatgctaacactcagtttgccagtgaaaaacatacggcacaggttaaaggcgttgtcatgcctgagctgacggggatgttgaattcatgcagcgagcagccgattgcgggctatgagattcatatgggaattacacagcttggcgagcaggcaaggccatttgccaaaatgtatctgcgtaatggagaggagacggtctggtttgacggcgcagtcaatcagtcaggatcggtcatgggcagttacctgcatggcctgtttgatcagaatacgtttactcgcccattactgaaccagcttcgtcgccaaaaaggcctcgcgccattagaaaatgtgatgttcaattacgtccagcacaaagaaaaacagttcaatattctggctgccagtatgcgtgagcatctcgatattgatcgtatctatcagttaatgaaagagcatgaagagcatcactga

SEQ ID NO: 2318 - DNA, 813 bp, Xenorhabdus bovienii
  Coding DNA location: Contig name=SeqID_16870; Position on contig =12202..13014bp; Strand=-
atgctggcgacgcaggcactgcatttcagttatcaggatgaacctatattgcaagacctgacacttgatttcagccatcatcaggttaccggaattatcggggcgaatggttgtggtaaatcgactttgttgatgaacctttccggtatcctgcgtccacaacaaggcgctgtctggtgggataatgcgccattggattacagtaaaaaaagtctgatggctttgcgtcagcgggtcgtcacggtatttcaagatccggaccaacagatcttttataccgatattgacagcgatctggctttcagcctgcgtaatctgggtgtggaggaggccgaaattcagcgcaggatagaacgtgcactgacattggtggacgcccatgctttccgcaacaagccgattcaatacttgagttttggtcagaaaaagcgggtggcgattgcgggtgcattagtgatggaatttgattacttgttgctggatgagccgacagcggggcttgatccttccgggcgtcagcaaatgctggagatcatcaccatgattgccgcagggggtaagcggatcattatttccagccatgacatagatttgatctatcagatctgtgatggtttatatgtactggcaaagggtcgggtgatcagttcaggtaaaccagaaaccgtcttactgcaaaaagatctgctggaacaggcaggtttggtgcagccgtggctggtgaaagtacacagtgaagccgggttgcctctgtgcaaaacagagcaggcgctttttgctatcttgcatagaacaagggagaaacgacaatga

SEQ ID NO: 2319 - DNA, 678 bp, Xenorhabdus bovienii
  Coding DNA location: Contig name=SeqID_16870; Position on contig =13050..13727bp; Strand=-
atgatcggcattgataaactgagcgaccagagccgttggcacaataaagatcccagggcgaaattcgccctgtatctgctgtttatggtattggcgatggggctatctccagtatggcaggccgcattgttattcggccttgctctatttacctgctatctgctgcggatcagcctgctgcgttacctgaaatggctgttgatcccgctggggtttctcggtattggcctgattgctatcgtactgtctgccagtttgcagccggacagcctgttgtggggatttaaagtagggcaatattggctagggattgattcacagggcgtaaacatggctaatcagacgctctggcgcagccttgcaacgttggcggcaaccttctggtttatgctgaatatgccctttgagcagatgattaagttactgaaattctgccgtgttcctcatcttttgattgaacaaatcctgttgacatggcgctttatttttatctttgtggaagaagcggccgcgatccaccgcgcacaatcactgcgttttggttatcgctccctgcgaacgagctaccgctcactggcgatgctggtcggtatgctgtttgcgcgggtgatgagccgttatcagcagatgagtgtggcgctgacactcaaactgtatcagggtgattttcatttataa

SEQ ID NO: 2320 - DNA, 282 bp, Xenorhabdus bovienii
  Coding DNA location: Contig name=SeqID_16870; Position on contig =13714..13995bp; Strand=-
atgaaaaagacattaatattgctgtctctgctgattgctctgtgcgttattccgtttttcattgatcacggcggggaatttggtggcgcagatggtcaggctgaagcgcaaatcatggaaattgcgccccattataccccttggtttgaatccttgtatgaaccggccagcggcgaaattgaaagcctgttgttcacattgcagggcagcctcggtactgccgtgattttctacatccttggttattatcgtcgcgaccgtaaagatcatgatcggcattga

SEQ ID NO: 2321 - DNA, 732 bp, Xenorhabdus bovienii
  Coding DNA location: Contig name=SeqID_16870; Position on contig =14008..14739bp; Strand=-
atgcaacagaaactaacgaagttttcgttatctggtgcggctatcgcactgcttttagcgctggcaccgcaggaagcgttcgccatgcatgtgatggagggatttttgcccccgatgtgggcagttgcatggtggctggcttttctgccttttttggcggcaggcattatgagattgcgtcagattgtgcaggaagacagtaaccagaaagtgttgctggcactgtgtggtgcatttattttcgtcctgtctgcgttgaaaatcccctctgtcaccggaagctgttctcatccgaccggagtcgcgctggcggtgatcttgtttggcccttctgtcgttgcggtactgggtgcgattgtcctgctgtttcaggcgttgctgctggcgcacggcggcgtgaccacgctgggggctaacggcatgtcgatggccgtgattggcccgctggtggggtatttggtatggcgtttctcctgcaaaatgggcgtacgcaaagatatcggtgtcttcttctgtgcttttatcgccgatattgtcacctatgccgtcacctctattcagttgggtgtcgctttccccgatccacaacttggcatgggggcagccatcatcaaatttatgggcattttctgcataacccagctaccgattgcggttgctgaaggtttactgaccgtgctgatttacgatcagttggtgaaaagacaattaattcaggctcgcagtttttaa

SEQ ID NO: 2322 - DNA, 714 bp, Xenorhabdus bovienii
  Coding DNA location: Contig name=SeqID_16870; Position on contig =14743..15456bp; Strand=-
atgagcggaaaactgtatgtcataggggttggccccggagcgagcgatctgattactgtacgggctgcccgtattctggccaggctggatgtcatttatgccccttctggtaaaaaaggcgttcagagccttgctcattccattgttgaagaatatctctcacctgaaactgaagtgtgcacttaccattttctaatgaaatcagacaggggagaaaaagaagtcgtgtgggatagagtcgcacaagccttgcaagaagaagtggcgaaaggcagaaaagtcggctttatcacactgggtgatccgatgctgttcagtacgtgggtgtttctgctggagcggatcggtaatccgccgtggctggaaatcgtaccgggcattacctcatttgcggcgattgcggcacgtagcgcaatgccattggcgatggaaaatcaaaccttgtccgtcatcgccggtacggctcccgatgcggttttggagcaagccttgctcaatcatgactgcatcgtcctgatgaaagtttactcgaattttgaacggatacgcgggctgctccagcgccatcaactcctgcaacacacgctgatgatggctgatgcgactttgccgacagaacagtgctggcgccatctcggcgcattggatagcgggcaggggctatcgtatttctcaacgattttgattaataaaaactggcaattattgaggtga

SEQ ID NO: 2323 - DNA, 795 bp, Xenorhabdus bovienii
  Coding DNA location: Contig name=SeqID_16870; Position on contig =15456..16250bp; Strand=-
atgaaaaaagcactcttggtgatcagtttcggaaccagttatccagaaacgcgaaaaaataatattgaagcctgtgagcagcagttggcttctgtctttcctgatagggaactgtttcgcgcttttacctccggcatgattattcgcaaattgcgggagcgcgatggcatccacattgatacgcctcacgaggcgctgaccagactgtatcacgccggttatcacgatgtcgctgttcagtgcctgcatatcatcaaaggtgacgagtatgaaaaagtcctccatgaagtagaaagattccgtccgcgatttcaacgtctggtactgggatcacctttactgagcaattttgaagactatctgcaactgatgagggcgctgcaccaccagctccccagattgggtgacaaagagtatgtggtcttcatgggacacggaacgactcaccccgctttttctgcttacgcctgtttggatcacctgatgacgcattatcattttccggctcgcgtgggggcagtggaaagctatcctgaaatcgctttgattatcaagggactgaaagccgaaggcatgcgtaaagttcacctgatgccgttgatgctggtggcaggggatcatgccattaatgatatggcttctggtgaaagcgattcctggaaatcacagttggagaaggccggtatgacggccatcccttggttgcagggattgggcgaaaatccgatgatccggcagatgtttgttgatcatcttgcggatgccatgaatgaaaaggtcggggagggcgcgtga

SEQ ID NO: 2324 - DNA, 738 bp, Xenorhabdus bovienii
  Coding DNA location: Contig name=SeqID_16870; Position on contig =16265..17002bp; Strand=-
atgatgatggatagcgctggcattgactatcgcctgtctgttgccacgcccacgggagcacagcaggcggctgatatccgcggtgacattgtgattggccggatggaagcggagggcatggtggattatctgcaaaagcagagaacgcagagggtcattgatgcttctcatccttatgccgagcggttgagccaaaacatcgtgcaggcctgtcagaagctggatattcctctgatccgttatatccgtccgagtgatattgatgatgtcgaacatgccttgatccataaagtgacgacccttgatcaggcgtgcgaagtggccgccagattaggcgaacggattctgctgaccaccggcagcaaacaattggccgattatgttagccgtttggcgggaaaaaccgtgctggcgcgtgtcttgccgacggcagaagtcttggcgctatgtgaatcctgcggcctgtcggttgatcagatttttgccctgaaaggcccattcagtgccgattttaatcgggcattttaccaattttgtcaggcggatgtagtcattactaaagaatccggtgaacagggcggtttcaaggagaaagtcgagccgtgccttgcgctggggctgccctgtatcgtgatctgccgtccggtacatccgtttaacggtgagggaattatgcaggccaatagcttggaagagatggcgcagctattggcgaatttccccgtgatagctaactaa

SEQ ID NO: 2325 - DNA, 102 bp, Xenorhabdus bovienii
  Coding DNA location: Contig name=SeqID_16870; Position on contig =16980..17081bp; Strand=+
atgccagcgctatccatcatcatgcaaatctggcgggcatcactcgtgccgccaaaaatgtggatttgtggctgtttcacaatcggtacccccttggtgtga

SEQ ID NO: 2326 - DNA, 726 bp, Xenorhabdus bovienii
  Coding DNA location: Contig name=SeqID_16870; Position on contig =17056..17781bp; Strand=-
atgttaaccgtcattggaataggccccggcagtgaagccatgatgacgcaggaagcgatagccgcactgaaagccgcggacattgtagtgggttacaaaacctacacccatttggtaaagccgctggtgggcgataaagagattatcaaaaccggcatgtgtaaagagattgagcgctgtcaggtggcgattgatctggcagaagaaggcaaaaatgtcgcgctggtctgtagcggtgatgcggggatttatggcatggcggggctggttctggaactgatcagtcagcatgaacgccatgtagaagtgcgtctggtggctggtgtgacggccagtactgcttgtgcctcactgcttggtgctcctctgatgcacgatttctgtcatatcagcctgagtgatttgctcactccgtgggcggtgattgaaaaacgggtacgggcagcggctgaagcggatttcgtggtgtgtttctacaatccgcgcagccgtggccgcgaagaccatttggcacgagcctttgcgttgatggcgccgtggacaccggcagaaacacccgtcggtgtggtcaaggcggcggggcgcaagaaagaagaaaaatggctgaccacttttggcgagatggatttttcccgcgttgatatgcgcagcctggtgattgtcggcaatcaatccacttacgtacgtgatgggctgatgatcacaccaagggggtaccgattgtga

SEQ ID NO: 2327 - DNA, 1083 bp, Xenorhabdus bovienii
  Coding DNA location: Contig name=SeqID_16870; Position on contig =17775..18857bp; Strand=-
atgatgcggggttcagccatgaatatcgtcaagcatagtaaaagaatcgccttgttctgcctgacgatggggggaatggagctggcacatcgtctgcgctcccatttggcggtggattgttttacttcccctgaattggtggaaacggggttcagtgctttcgacagtggctttgccaatacggtacgcaaggcattcagccaatatggctcgctggtcatggtcggtgcgacggggatcgccatccgcgtaatcgcaccactgctcagggacaaactgactgatccggcggttgttgtgctggatgaaaaaggccagtttgccatcagcctgttatcggggcatatgggcggtgcgaatgatctggcgcgacaggttgcggatctgcttggcggacaggcggttatcacaaccgcaacggatgtcaaccaactcgctgcacttgatgtgttatcccagcaaattgacggcgaaatggcagattttcgcgccagcgtcaagacagtgaaccaaatgctggtcaatggcaaacgagtaggtatgtggtggcatccggcactgattggcgaaaaaaggcagtgtgatacccgtgggtttattccggtggaatcccttgatgatctgccggaactcgatgccttggtttacgtcagccaccgacgggcaatacccgtattggcgatcccgaccttcaaattagtgccacgccggattatcgcgggtattggctgccgacgcggggtcgccgctgaacgggtcgcgcagttattggatcgtcatctggcagaacatgattttgaccctctggcattaaaagccatcggcagtgtggaattgaaacaagaagagccggctttagttcaactggcggaaaaacgccgcattccttttcaaattttctctgttaaccagctcgcccaatgtgaacaggcattccctgcctctgaattcgtgcgcaaaaccgtgggcgtcggttgtgtctcccaacccgttgcctggctgatgagccaggggcagctggttggtcataccctgcgtgagcagggcgtcactatcacattaggagtattgcagccatgttaa

SEQ ID NO: 2328 - DNA, 795 bp, Xenorhabdus bovienii
  Coding DNA location: Contig name=SeqID_16870; Position on contig =18820..19614bp; Strand=-
atgactgagcatgttgatactgaacctgcgcgttttgatgccggaaaagtctggtttgtcggggcggggccgggagataaaaccctgatcaccctgaagggatatcaactgctgcaacaggcgcaagtggtgatttatgccggatcgctgattaatcgggagctgctggaatattgccgcgcggatgcagagtgccatgacagtgcaggtatgacgttacaggaaatcactgatttgatggtgaacagcgtcaaagccggaaaattagttgtgcgcctgcaaacgggggatttgtcgttattcggttctattcgtgaacaggccgaagtattagcaagccagggaatggggtttgtctccgtgccgggtgtcagctcttttctcggtgcggctgcgcaattgggagtggaatataccgtccccgaagtggcgcaaagcctgatcatcacccgtatggccggccgaacaccgatgccgccacgggaaacactggaagcctttgcggctcatcagacatctatggcgatctttctgtcggtacaggatatagctggtgtcaccgttcggctgatacagggcggctatccgcaagaaacccccgtcgcggtggtttacaaagcaacgtggccggattgccggattgttcgcggcacattggacacgattgcggaacaggtatgcacggcagggattcagaaaaccgccttgattttggtcggcgcgtttcttggcgaggagtaccactactcaaaactgtatgatgcggggttcagccatgaatatcgtcaagcatag

SEQ ID NO: 2329 - DNA, 597 bp, Xenorhabdus bovienii
  Coding DNA location: Contig name=SeqID_16870; Position on contig =19607..20203bp; Strand=-
atgaaagatgaactgtttttgcgtggtcatcgcattcccatgaccaaagaaactgtcagagcgctggcactggaacggctggaactgaataaagcccgacatctgattgatgtcggggcggggacaggcagcgttagtattgaagctgcattacgttatcccacgctggatgtcctcgcgattgaacgtaaggaagaggcgctggcactgatctatgaaaatgtccggcactttggctgtcacactgttcgtattcaggcgggtgttgcaccactgcccttggaggaagccgccgatgccatttttatcggcggaacgggcggacacttgacggaattaatcgattgggcgctgacacacctgaaccaaggtgggcgtttggtgatgacgtttatcctgctggaaaactttatgcaggcattggtgcatctgcaatcttgtcaggtggtgtcccttgatggccgtgaaattcagatcggggaattgaccccattggggcaggggcactatttcaaacccaacaatcccacctatttaatttcctgccagaaatttgtcgaacatctgtccgatccaaaggagagtgcttatgactga

SEQ ID NO: 2330 - DNA, 621 bp, Xenorhabdus bovienii
  Coding DNA location: Contig name=SeqID_16870; Position on contig =20193..20813bp; Strand=-
atgattacggtcgttggcatcggccccggcgccatcgcaaatcaaacgctggccgcgctggacgccatcaaacaggcggaaatcttggtgggaggcgcccgtcatctggctgaattcccccattttcgtggcgaaacccgccgtttgaatgccgatatggacggattgatgcaatggcttgaacagcgccaatatcagcaggttgtggtgctggcttcaggtgatcccctgttttatggcattggtaaacgcatcgctgaacattttgtcggcgagccgcaaaacattcgcatcatttctggcatcactgccattcaatatctgtgcgcccgaattctgctggatatgaacgatatctaccttaccagcagccacggtcgaaaaccggattttgactggctgctccagcacgaaaaaatcgcaatggtgacggatgagctgattggcccccgccagattgcggaggagattttggcacacgggcagcatcgccggatggtgattggtgaaaacttgtcacaggagaacgagcggattgtttgtctgagtgcgcaacaggtcgccgaatgcggtgacattaattatggcttgaacgtggtggtgatccttaatgaaagatga

SEQ ID NO: 2331 - DNA, 1164 bp, Xenorhabdus bovienii
  Coding DNA location: Contig name=SeqID_16870; Position on contig =20810..21973bp; Strand=-
atgaatgaaacgttgaatgaaacaccacacacgcaggcagaaagcctcggaacggtctggcaccgggggaaacagtaccgtaagggttataccaccggctcttgtgccacggccgctgcgcgggtggcggcgttaatgatcttgcgccagcagattatccatcaggtttccatcgtaaccccttccggcgtcacgttggccttgaacgttgaacagccgctgattgaaggtcagcaggcagttgcggcgatccgcaaagatggcggtgatgatgttgacgcaacgcacggtatgttgatttttgcgcgcgtctccctgaatgacagcggaatcatcacgctggatggcggtgaaggggttggcagagtcacgcgggtcgggatcggtctgccaataggctgggcggccatcaataaaacgccgcggcacaccattgaagaagcggtgcgtgaggtgattggtcttcagcgtggggcggatattgtgatttttgcgccagagggggaggagcgggcgaagaaaacctataacgaccggctggggatcaaagggggaatttcgattatcggtacgacgggcatcgtcatgccgatgtcagaagagagctggaagcgttcgctggcgctggaattggaagctaaacgcgccagcgggttggatcggattatctttgtgccaggtaatcacggtgagcgttttgtcagtcagcagttgggtattgacggaaattatgtggtgacgatgagtaactttgtcggctacatgcttcaggaagcggtacgtttgcagtttagccatgtggtactggtggggcatgtcggcaagctggtgaaaatcgcagcgggtatttttcatacccacagccatatcgcggatggccgtatggaaacgttgatcgccaatcttgccgtaatgggagcgcctttcgaattgattcaggccgttgatcactgtgataccaccgaagccgccatcgaactgatcgcggaacgtggctggcaggcggtgcatcagcagattgcccagaagatctgcggacgcgttgatcaaatgctgcgtttttccagcggcaggccacagtgcgatgccattcttttctcctttgataatcaagtcctgggctgcaatcggccagtggatgagattgtggaggggttccgatga

SEQ ID NO: 2332 - DNA, 654 bp, Xenorhabdus bovienii
  Coding DNA location: Contig name=SeqID_16870; Position on contig =21966..22619bp; Strand=-
atgaactatcctcaacgctcgtatattcaacaacctcagcagattgagcaacatagctttgacattatcacggagattatccgtgaatcgcgccctgattatcgttttgtggatgccgggcaggaagcggtgattaaacgggtgatccacaccaccgctgattttgactggctcgatatcctccatttctcaccggatgccctgcatcgtattcgcgatgggattttgcgcggctgcacgttatacaccgataccacgatggtgttatccggcatcaataaaacccgtctggcgcaatatggcagtgaatgtcgttgttatgtcagcgatccccgtgtcgtgcaaatggcgaaagtgcagcagatcacccgttcaatggcggcggtcaatattgctttacaagaagcaggggagaagatttttgtctttggtaatgctcccactgcgctgtttcgcttgctggaacatcaatccgcgcccattgccgtcgtcggggttccggtgggttttgtcggggcggaagagtccaaaaacgcgcttatatatagcggcttgagctgcattgcagcaagagggcgcaaaggtggcagcaatattgcggcggcgattatcaacgctgttttgtatcggatgccggaggtgcggcatgaatga

SEQ ID NO: 2333 - DNA, 975 bp, Xenorhabdus bovienii
  Coding DNA location: Contig name=SeqID_16870; Position on contig =22634..23608bp; Strand=-
atgaccgttttactttggtttgcggcgtttgtcctcgatatgaaactgggcgatccctcgcattggccgcatccggtgcgctggatgggtcggctgatcaatcaggccgaacacgttattcgtgggcgatgcaaaaccgaagctgatttgaaatggggcggggtggcattgtggctggtagtggtgggcagtgtctggctgatgagttatctggttctgtggttggcttatggtgtggcattctggttcggcctgctggtggaagtctggctgatttataccgtgctggccgggcgtagcctgagtgatgcggccaatgcggtctatcagccattgaaacagggcgatctggcggccagccgtcaacaactggctcagattgttggacgggagacgtcacagttacaaccgccgcaaatcagccgtgccgctattgaaacggtggcagaaaacagcgtggatggcgtgattgctccgttgttcttcctgatgattggcggcgctccactcgcaatggcttataaggcggtaaatacccttgattcgatggtgggctataagactccccgttatcgggcgctgggcatgttctcggctcgcatggacgatgtggcgaacgggatacctgcgcgtttgggctggcttttgctggcgctggctgcgaagtggcaggggctggattttcgtcaggcactgcgtatcggctggcgtgaccgttaccaacaccgcagccccaacagtggctggccggaagccacggtagcaggcgcattgggtatccggcttggcgggccgagtgtctattttaatcagcgggttgaaaaaccgtggatcggtgacgcacggcgtgaagtcacaccggaagatatcccgcagtccgtgcagatgatgtgggtggcatcggtgatggcgctcctgctgtttgcgctgctgcatagcctggtcagcgtaacgccattcaacgtagtgttataa

SEQ ID NO: 2334 - DNA, 1395 bp, Xenorhabdus bovienii
  Coding DNA location: Contig name=SeqID_16870; Position on contig =23605..24999bp; Strand=-
atgcggcagaaatatgcttttgtcattgcaggtacaggcagcggatgtggcaaaaccaccgtcacactggggattatgcgagcactcatgtgccgccagctacgggttcagccattcaaggcggggcctgattatctggatggcggctggcatcgtgcggtgacaggagtggcttcccgcaatctggatgcttttatgctgcctgtccctattctgaatggcctgtttaatcaggctgtagccgataaggatgttgccgttattgaaggcgtcatggggctatatgatggctatggttcagaccctgattactgtagtagcgcggcgttggcaaagcagcttggctgtccggtgattttagtggtggatggcaaggcggtttctacgtccattgctgccacagtgatggggtttcagcactttgatccttccgtcaatattgcgggtgtgctgctcaaccgagtgaaccatgatagccattttcagttgttgaaacaggcgattgaagactattgcggcctgcccgtcttggggcatattcccgtcatgccggatatcgcactgccttcccgtcatcttgggctgatcccggctcaagagcggaataaccaacatgatgaacagtggcagaacctggcgcaccagatagaaacgacggtcgatctggacaagctactggcgttgactccattaccgacattaccgcaaggcgatatcgcttcccttgtcgatccggctagcggtcaggggttgacactggcactggcggaagatgaagcctttcatttttattattccgacaacctgctgttgctggaacacgcgggtgtgaccatcaaacgtttcagcccgttgcacgatagccagttgccggagtgtcagatgatctatctgggcgggggatatcctgaaatgtatgcccagtcactggcggccaattacgctatgcatgaggcattgcgtcaggcgcaacgaaaaggcattgccatttatgcggaatgtggcggcctgatgtatctcggtgaagccctgaccgatgtacagggcgttcgccaccctatggtgggtttgattgctggtgaaagccagatgggaaagagtctgaaacgctttggttactgcgaggcgacggcgatctgcgacacgcttttggtggcgaagggggaaaccttgcgcgggcatgaattccattattctgatttcacgtccgcccagacgccggtattccactgtaccaaacagcgtagcggcatggcgcagaaaagctggtttggcggatatcaaaacggcaatacgctggcggggtatctgcatattcattttgcccaacgccctgatttgctccatcgctggctgacgatagcccgcgagcagatggcaagggggcaatcatga

SEQ ID NO: 2335 - DNA, 99 bp, Xenorhabdus bovienii
  Coding DNA location: Contig name=SeqID_16870; Position on contig =24974..25072bp; Strand=+
atgacaaaagcatatttctgccgcataggatttccccagactatttacttcaaactatttaccctgaaccatttagctaaaactattccctgccattag

SEQ ID NO: 2336 - DNA, 192 bp, Xenorhabdus bovienii
  Coding DNA location: Contig name=SeqID_16870; Position on contig =25406..25597bp; Strand=-
atggattcttttgattcatatgataattaccagaaaatatttttctgtatgaaagttttttgtcatattaatgatctgtattttagtttgttttattgttttcatataaaaaataaatattattcaatctgttatgtttatttttgttgtcggtatatttgtttttctataattatttttatttatctatga

SEQ ID NO: 2337 - DNA, 801 bp, Xenorhabdus bovienii
  Coding DNA location: Contig name=SeqID_16870; Position on contig =25741..26541bp; Strand=+
atgaataaaggcaaagtatggctaatcggagcaggcccgggcgaagcagcgttaattactgttaaagggctgcattacattcaatctgcggatgtcattgtgcatgatcgtctcgtcaatcctgagttgattgcacaggcaccagaacactgcgacatcattaatgttggcaaagagcgcaatcaccacccgatcccgcaggaagaaattaaccagattctggttaaacacgctctggccgggaaacaaatcgtgcgcctgaaaggcggcgatccttatgtatttggacgcgggggcgaagaagcagaaacgctggcacaacagggcatcgaatttgaaattattccgggtatcagttccgccattggcgggctggcttatgccggcattcccgttacccaccgcgattatgcatccagcttccatgtggtgaccggccacctttcccaaggtaacgagccacagaactggcgcgcattggcgcaattgggtggcacactgattattctgatgggcatgagccgtctggccgaaatctgtcagcaattgatacaattcggcaaacctcccgctacacccgcagcggtaattatgtatgccagccagcccagacaggagatgaccatcgctacactggcaacgctggccacagaagttgaacaccaccaactgcatgcgcccgcattgattgtgattggtaatgtcgtccggttaactgaaatactcgcctttacctccatccccattgcgctcagttcaaccgcagtcatgatgaaccctctcacccggcaggtgacataa

SEQ ID NO: 2338 - DNA, 1074 bp, Xenorhabdus bovienii
  Coding DNA location: Contig name=SeqID_16870; Position on contig =26541..27614bp; Strand=+
atgagtgaacacggcggcaatatcatcgaagttgcccaacaattcggcattccagccaacgaactcatcgatttcagcgccaatatcaacccgttgggcgccccggaacgggtgaaggcgctgattaaagataaccttgcctgcatcgaaaaataccccgacatagagtatcgccatttgcatcaggcgctggctgacgcccatcagtgcgataccacttctgtgatagcaggcaacggagcaacagaactgatctacgccgttgtccgttacctcaacccgaaacgcgccctgctcctcacccccggattcgctgaataccgccgagctttgcagcacgttggggctgagatcatcgcgtatccattaacagaagacgcaggatttcaacccgatctacgcctgctggatacactgacaatgacccaacccgattgtgtctttattgctacgcccaataacccaaccggtttaatgccagacagccggtttctgcaatcgttggtgcaacattgtgaagagcaccgcatagcgctgattgttgatgaggcctttattgattttctgcccgataaccggagtctgatcccacacattgccgccacccgccacctttatgtgctgcgttcactgacaaaattcttcgccattccggggttgcgactaggctatctggtcagcggggatagtacaggggtggcgtggatgaaaaaccagcgcgaaccgtggtctattaatgcccttgcggcgcgggtgggtgaagtcttgttggatgatcaggcttatatcaccgccacccatcaatggctaaaatcacaacagcattatctttggacgcacctttcctcctgccctgaactcaccgtctggccaccttccgctaatttcctgttctttcgctgccatcagcctaatcttgatttatggcataccctacttgagcaccggctgctgatccgccattgcaaaaactatgtcggcttggacgagagttactatcggatcgccgtacgcaacgaatgggaaaaccgacgcctgatcgccgccatacagcacgttttcgcacatggctga

SEQ ID NO: 2339 - DNA, 861 bp, Xenorhabdus bovienii
  Coding DNA location: Contig name=SeqID_16870; Position on contig =27607..28467bp; Strand=+
atggctgaagcctgctgcccggcttcctgcggagaactgctgcaagggtggctattcggcggagagaaattgatctcctgccccattaactggttcagttgtgtcgcggtcagcgaaggccatgcctctgctgatgaacggccacgtatgcgccagatggtggaattgctgctggaacactggaatgaacctactgaattatcggcctgcctgcacatcgaataccaatcgacgatcccaatagccaaaggcatggccagcagtaccgcagacattgccgccactgcacacgccacggccaaattactgggtaaatcgttgaacagcaccaccctcgcgcaactctgcgtcaagctcgaaccgactgacagcacggtgtttgcaccattaacgttattcgatcacctgaccgcccaaactcagatccccttcgcctggcagccggatatcgatattttgctgttgggaagtcggcaaactattttgacagaagagtaccatcggcgggatcgccatcaactcttgctggaaagtgcgccgctgctccaacaagcatggcggcaatttcgtatagcgaataaatatcatgacaactatcgtctaggggaagcctgcacactgagcgccatcgcgagccagccaatactgcctaagccccggttttatcaattattggatttggtcgaacgaagtggaatttatggcctgaacgtcgcccatagcggcagtgtcattggcttgctatgcaacaaccatcagcacgatgtggattacctacgctggcagttaggccagaaacttattgctgactactacccacagatacaccctgtcaaaatgattacgggtggcgttcgttaa

SEQ ID NO: 2340 - DNA, 195 bp, Xenorhabdus bovienii
  Coding DNA location: Contig name=SeqID_16870; Position on contig =28476..28670bp; Strand=+
atgaatgaaagcgagaatcacacgaattttatgcctatttttggtgatctgaccgacaaacgttacctgattaccgaagaggatcatattgctgaacacaagctcatcacaagccaacccgctgatatgggatataccaacgctagatcgaaatgggttgaaataaacccgtttcgggtagaaatgaatatgtaa

SEQ ID NO: 2341 - DNA, 141 bp, Xenorhabdus bovienii
  Coding DNA location: Contig name=SeqID_16870; Position on contig =28763..28903bp; Strand=+
atgctgattagttaccgagtcttcctcttaccggaacgaagcgaccatacacgatttgcggcaatacaaccaacaagcccgcaaacattgcttactggggttacatcaacgccctcactttatcaggataaagataaataa

SEQ ID NO: 2342 - DNA, 192 bp, Xenorhabdus bovienii
  Coding DNA location: Contig name=SeqID_16870; Position on contig =29026..29217bp; Strand=+
atgaatataacatgtaatcactgccaaaaacctgttgaagaaatgaacttaaaacaagctaaaattattcaatcggctgagtttattgaaaaaattgttgatttagtcttagcttgcccacattgcagccaggaatacagtgtatttgtacctacatgggatttacagccgctagaaaccgcctgtatgtaa

SEQ ID NO: 2343 - DNA, 117 bp, Xenorhabdus bovienii
  Coding DNA location: Contig name=SeqID_16870; Position on contig =29177..29293bp; Strand=-
atgtgtacttattttattcagtcaggagagtggtcagttcctctcaatgattggctgggtaacggtttgacgctttttacatacaggcggtttctagcggctgtaaatcccatgtag

SEQ ID NO: 2344 - DNA, 99 bp, Xenorhabdus bovienii
  Coding DNA location: Contig name=SeqID_16870; Position on contig =29317..29415bp; Strand=+
atgcctgctgaatactgcgggcattgttgttttaatcacaaacgcaccagctcatcattgcgatcaacattccataaatcagaagccattttgccctga

SEQ ID NO: 2345 - DNA, 354 bp, Xenorhabdus bovienii
  Coding DNA location: Contig name=SeqID_16870; Position on contig =29475..29828bp; Strand=+
atggaaaatatacatctcgaacctgccacctttgacgcctttatgtcgctcgatatccgtgtaggcaaaatcatcaaagcagaaaaaaacgaaaaagccattaagccagcctataaactttatatcgattttggcagtgatatcggtgaaaaacagagctccgcccagatatgccaaaactacacagaagaacaattaatcggcaaacaagtgttggcagttgtcaacttcccaccaagaagagtggcaggctttaagtcagaagtcctcgttctggccgccgtctgtgacgatcaaggcaccgtactgctccagccagaacgagacgtgactctgggaacccggatgctgtaa

SEQ ID NO: 2346 - DNA, 1386 bp, Xenorhabdus bovienii
  Coding DNA location: Contig name=SeqID_16870; Position on contig =29859..31244bp; Strand=-
atgagtcacccagattacacgttatacacgaaaacaccgacggtaatggtattggataatctcggtcagatggttcgagacatccattaccaccgtcatccgaatacgccgcaaaccaccgataagcgtatcacccgccatcagttcaacgcccttgggcaacggattcagagtattgacccacgtctgtttgagttacagcagacagacgcgaccgttaaacccaatttcgcctattttcacgcattgacgggagaagtgcttcgtaccgatagtgtggatgcaggtagcaacgtctcgctggatgatattgctaatcgtccggtgctgaatgtgaatacaaccaatgttattcggacttggcagtatgaagacagcaccttgccggggcgcctgctcagtatcaccgaacagtcggaagagggcgcatctcggataaccgagcgtttcgtctgggcgggtaatagcccgtcagagcaagcccagaatttggcggggacttatacccgacactacgatactgcgggtttaaatctgacaaacagtatttccctgacgaatgttccccagtctgtcagccgtcagttactgaaagatgatgtcaatgcagattggcaggggaatgacgagccggcttggaatgccctgttatcgccggaggtctttactaccacgacgacgaccgatgccacgggtacgctgctgacccaggccgatgcgaaaggaaatagacagcgcatggcctatgatgtggcaggcttactgcgtggcagttggctgaccctgaaaggacaaactgagcaggtgattcttaaatcccagacctactcggcagccgggcagaaattgcgggaggagcatggcaatgggctggtgacaacttaccgctatgaagtggaaacgcaacggctgattggcattaaaaccgaacggccggcaggtcatgctgcgggagcgaaagttctgctggatctgcgctatgactatgatccggtggggaatgtactcagcgtgggtaatgatgcggaagccacccgcttctggcgcaatcagaaagtagatgcaaccaacacgtacacctatgacagcctgtaccagttggttgtggcgacgggcagagaactcgccaatatcggtcaacagaacacttccctgcctcatcctgtcattccattgccgacagacaacagcagttatacccactacacccgcaactatatctatgacgaaggaggcaacctgacgcaaattcgccatagtgcaccaataagcaacaacaattatacgactgacatcaccgtatcgaaccgcagtaatcgggcggtgcttaataccctgacgaaagatcccgcacaagtggatacgttgtttgttgacaccctctga

SEQ ID NO: 2347 - DNA, 129 bp, Xenorhabdus bovienii
  Coding DNA location: Contig name=SeqID_16870; Position on contig =31236..31364bp; Strand=+
gtgactcataactgtttctcctcaagaggctgtgtgggatataggttcggcttggggggaaattctgtaagaactgacattgttttcatccttaatgtcataatgggggtaatattggtcgctttatga

SEQ ID NO: 2348 - DNA, 114 bp, Xenorhabdus bovienii
  Coding DNA location: Contig name=SeqID_16870; Position on contig =31663..31776bp; Strand=-
atggacatttgcggaattaatgaatttcttttttatatattttcgtgtgttaaatttagatcagtcaagccatttagttattatctgtttcaaataaaatactattatcgctag

SEQ ID NO: 2349 - DNA, 417 bp, Xenorhabdus bovienii
  Coding DNA location: Contig name=SeqID_16870; Position on contig =31776..32192bp; Strand=-
atgaataaattaatcgaattagcaagtaaatatggtgaggtttatcaagaaaagcttgatatggctaattgtgccaactttctactgaatgaaggatataatatattttctttatatttagagtttgtaactaattatggcggaattaaaggatatcattcagcatataaagacaatgaagctaaacctgaaaaattccatacagatcctatagaagcttcaaaattaattcctatggattgggttgaggaatatgaagatagaacttcatgtaaattaattccttttggtgagtgttgtaatggatatattacattaatgttaggaagtgatggtaaaatatacggtgcatttgatgattcattatttcaatatggaaatgacatattaagtggtggaatgtcttttatccaataa

SEQ ID NO: 2350 - DNA, 4860 bp, Xenorhabdus bovienii
  Coding DNA location: Contig name=SeqID_16870; Position on contig =32194..37053bp; Strand=-
atggcaaaaggcgcaagaagtgatagcccaacaggcacagggaatacggtgggcgttattgtggggcaggctccacaagccaataaatcgccacaggagtccaatccagtggttaagagaaagaagagaaaggtagctgatttttctgaaaaactgggcagagagaatgaaaacgaaaagtctgactataaagagcatggagatataaacaaagataccgacggtacagtgcctgagcataaaaattttagtcagcgttttggagataaattttctgatggttttcattggggtaaaaagaaaatttctgatggttttcattggggtataaataaaggttctactgttgctcatcagttagtgagtgaatctgctgaagaagctcattggcttttggataaagcgcctgattttagggggaaagatttagctcatcggcttatagataacgctgctgatgatgcttattggcttgtgaataaaggttctgatgcttctcgatgggttgtggataaagctcctagtcttgttggtcattgggttaatgaacaaggatataatcttattgaagcagtcaagcaccctgtcgaagcaataaaaggggggggaaaggatttttttaatactgtagtcgatctggcacaaattatagagaaaattcctgaaatggaaatgaaagcactggggaagacgctttcacttattggagcaaaaaacgcaggtgctgcggtttttaattttggtcaggggtatggagatacagttcaaggagctttaggggctttacatatggagctaagtaacccggctcagcaaggtggagctttaataggtaatattgccatgttctttattggccccggtgaagtaaaaacagtaatgaaagtaggtgctgagtcagtaacttttctctcaaaagtagtaaaaggagaaggagtaataactaaagttctcgaaacagaaaaaggattgtccggcgtcaggactgtaactggagcaaaaaaattaacccaaacagagcagacaggtatccgatctgcaagaacggaaaaagagccgcttattagttccaagaaaccaaagaaaaccaaaaaagatcctccagatgattcgggcaagaatgattcttctaagtgtgaaggtggtagttgtggaaaaggcgaacctgtcgatatcacctctggcgattacttacaaacattctcaatcattaccatccccggcttgttaccaatcaccctaacccgaacctatcgctctgccgcctgtctgagtggattattagggcgaaaatgggctgatgattggtcacgtcaactagtactggacgatgaaaaagtccattttaccgatgctgatgggcaggtttatgatttctcaacaccggaaaaacaggtattggcacgtaatcgtcatctccttcattgtttactgacaggagagcttgatggtgaactgtgtctggttaataaacagatccagaaaacattccattttaaccatattgtgggtaacaggcgtcggttgtctgccatcacggatcgccatcagaatcatattcagtttatctataacgaccagcatcagctgatggaagttgtacgcaatgacggtttccgattaacgcttcactatcaagataatcagctccagacagtagattaccactttcagcagatacaacagcgtctggtcacctgccgttatgaccaatacggatatctggctgaatgtgatgcctttcagcaaaaccatctatggcatgaatacaccgcgcaagggtttatgatccgctggcacgatacggataagaccgatttttatattcactatgatgaacgcgggcgagtcgtttccacccattcttccgctggttattgggacgatcgttttatctatgacgatgaggcccgtgttaccacttatcttgatgccgaagggggaaagaccctttcctattacaaccaaaataatcaagtgatccgtgaggttgatccgttagggcgtgaaacgcggactcagtggcgttacaaccagaaggtttgggaaattgatccactgggtggctataccacttttggctacaacaatgacggtgcattaacagaaattgtattaccaacgggggacgctttttattatgactatgatgaacatggtcaactgatcgaggcaactcagcctacgggcgatacttggcacttccatcatgatgagcagggtaatctggctgctgtcaccaatccgcaaggacacaaagaagaatatcagtacggcactcatggggaactgcggcaacatctgttgccagatggccggcagtggcattatgcctatgatgagcatcagcggcttgccgcaattatgacgccggacggccagactaccggcttggagttagatgaactggggcgtctgcgccgtattaccaatgcactgaagcaggaaagtcgttatcgctacagtaacgtccatgccagcctgaatggcagcgtgaccgaaattgaactgccggatggcgtcacccagcatatggaatatgacagcgagcgacggattgcggctgtcaccgacggagaaggccgcattactcgctatagttatggcgcttttgacctgcttacccaagttacccgccctgatggtacgacattgcactttggttatgatcgtctcacccgtttttgttctgtcactgcgtctacaggggaaacttaccgctatgagcgggatgtcgccggtcagattatccgtgaaatcgattttaccggccgcactatcgactatcagtatgatgagctggggcgtcgtattcaggcacattatcctgataatcatctgctacgctggcattactcctcatcgggtttgttgacccgacaggaaacctggtatcaggatggggacaggtctgaactgaaagcctccaccacctatgagtacaacgctcgccatcagcttactcgcgccgtcaatgacgatgcggtagtggaatatgaatatgatgcggttggtttgcctgtttgtgagcgcatcaatggacgggaaatcacccgtgagtggaatagcctgacagggcaaatcactaccgagactattggtgagcatgccctgcattttggctattccgtgatgggagggctgaatcactttcaatttaaccagcatatgccactgactctgaaccatgatgctctggggcgggaaactgtgcgggaaagtgcggaagggtttatccttgtcagccgttataacgctacagggctgttggcacaccaatccgcaggacgagtcacagcgctgtttcgcgaaaccttggcgcagaatgacccgcacttcccgccgcaggccacggcggttaaccgtagctggcaatatgatcgcgcctacagcgtcagagtgattgatgacggtatctgggggcaaacccgttaccgctacaaccagaatgaccagatagtcagcgcaaccttcaatggccgtttgccctatgaagaacagtttggttatgatgccaacggcaacctgaaccaacacttgccggtggacgcacggggcgcggttgagcagattgaacagcgccagcaggcgggacgggtcgttaaacgaggtaatgtttcttaccgttacgatgacaatggccggcaggtggaaaagactgagcaccatgatggtttccggccacaggtatggcgttaccgctgggatactcaaaatcaactgacccattgcgaaacaccagacggctcacgctggcactatcgttatgatgtctttgggcggcgtatccgtaagctgaaagttcatgatggcaaactgaccgcggtcaacctgcaacgctggctggacggcaagccggatttgaccgcgaagccggataccattacggggtatgactacctgtggagcggcaaccagttagttgaggaaaccccactgtatgcagatggttcgcttgcccatgatcacagcattcgttggttgtatgcgccgggtgcctttacgccttcggctcgttatgaaaagggcaagttacattatatcgtcagtgaccatcaggggacgccccgggaaatactgagcgaagccggtaagctggtatgggcaagtcggctgaccacttggggtaaggccgagaggatgccgctactggcggcgaatgatgaagattattatgttagctgtaatttgcgctttgcagggcagtatgaggatgaggaaagcgggttatattataatcgctttcgctattatgatcgtgatacagggcaatatctgacgccggacccgatagggctacaaggtgggttgaatccgtatgggtacgtgtataattctgtgaattttattgatccactgggattaatggactcctgtaaaggagaaagttctaactctcggactgaacacgatagattcacggatagatatttatctggatatgctgaccaagaagccagggacaggtggagatatagattgccaagtaagccaagagctacatcagtagcagtggatattttgaacggaaaacactatcggggttatagtggtgctggtaaaaacagtagtgaatttcctcaaaatattcatccacatttacagggaagaatagatcatatgcaaaataaatctctgaagttctgggatattcgtaattgtgctgaatttcaatgtcttaataatgctttattggatggagcaaagatagaaaatctaaatgtttatacggtgaaaactactgatttatcacatgagccttttgctatgtgtgaaaactgccgagtaacagttggtggttatggtaatagtaaattaggtattcctagttctattggtgccaatgtaaggagtgggtaa

SEQ ID NO: 2351 - DNA, 357 bp, Xenorhabdus bovienii
  Coding DNA location: Contig name=SeqID_16870; Position on contig =37094..37450bp; Strand=+
atggcgcaatgtcaatttaccgcccgcccgcaccgtttgagtatgttctttcgggtgacacttcccccccaccgtgccacttttaatccctgtagccgtacccgcttcatcccccaatgtctgtgggacgaaactttgcccaaataccaccactggctgcccgtttgcccgtaccgatgtgactggtgcagaggaatcttccagtttggcgataacaggataaggaactggaggagtggccggtcccatcggggttttacagacatcaggaaccagactgataatcagccattgggtatctttacgggcaatatagttatccgccatgattctgctccggttggggtgcaaatgtga

SEQ ID NO: 2352 - DNA, 1221 bp, Xenorhabdus bovienii
  Coding DNA location: Contig name=SeqID_16870; Position on contig =37410..38630bp; Strand=-
atggaattcaggaatctcacccctttttcggtgatgaactaccggatgctggatacagaagatcaggaatacgatgtgattgccatgaaagtgggttatcagctattgcccgcagggaagggtgaatatctggctgaactgctgccggttatgtccttgtgtgtacaggatcagtatcggggggcgctgaatatctcgcaggtgttgcaggaaagtgatctggcaccgtttaagccgaaatgtgacgtgattgtcaatggcaccgcctatgcaccagaaggtaagccgtgtccggcttttcctgtgcgtctgctactgaccgatgccaacggtgacactctgcttgataagacactggagatttccggtgagcgggaatttttccgcacggataacgggcaatggcaactctccgaacccaaaccttttgaccgtctgccccttgattatcgttacgcttttggtggggaatgccggattgaggcggatgatgatgaagttgccaatgctttgacggaagacgataaactctcccctgaacagcgcagccagcatcctgatggtgaacaggcaccgattgctcatgcggttttggaatacaaccctatcggttcaggttttatcttgccctggtatgcacaggccaaagatctaccgcgctatgcagcaccgcgtattacccggccggatgcgcccatcacggcgcagcacttcgccgcgatgctgtccggtcatttaccgacgactgaacccgtctgccagccacaagggatgggcgttatcgggcgggcgtggctgccacggcgaacgctggccggcacttatgaccagacgtggctggacgagcgccatccgtacctgccacaggattttgacttcggttactggaatggtgcaccacaagatcaacagattgactggccgtccaccgatatcacactgcaactgactaatctgacaccggatggctccttacaaaccgaactgccgggacatcgtccttttatcctgttccgtatggaggatggtgatcttcttccggttctgatgaacctcgataccctgattattgataccgatgcaatgacactggaactgacttttcgtctgcatttcagcattgacttactcatcagagtcacagaagcgcggtttgaaataaatcccaaagcccccttaatcacatttgcaccccaaccggagcagaatcatggcggataa

SEQ ID NO: 2353 - DNA, 1890 bp, Xenorhabdus bovienii
  Coding DNA location: Contig name=SeqID_16870; Position on contig =38643..40532bp; Strand=-
atggatggattagtgtttacttgccagataggtgcgctaccggccacgacttttcaggtagtgagtttcagtttacaagaagggctgtcacagctttatcacctgtatctgaccgtggtcagcccgcttaacagtgtggtactcaatgatcagttgggcacttatgcttctctgaccgtcacccgcaatggcaaggtggatcgcacggtcaaagggatcgtagcgggtgccgcgcagggcaatactgacgggcggcagacttactacacgtttactgtccggccggagatgtggcggatgagccttcatcaggacagccgcctgtttcagcgggagtccgtaccggacatacttaaaaaactgctgaaagaacatcgtgtcaaatcggacagcaagttttatgacgatagtgatcaccaccccgttcgggaatacaccacccagaagcgcgaatctgcctatgacttctggtgccggctggcagcggaagagggggttgttttctggtttgaggaggaacaactgtttttcagtgattcccatttggggatgacggcggatcttaatctgacttacaacgtccagcccagtaccgatgataaagataccaccgcctggcagtggcagtacgcagaatacctctgtccggatgagtatattcacaaagactacaactacctgcggccttcccaaccgttgcagacacaggccacgttaccgcagggcgggcgtcatgcggtgtttgaaagttacggccgtttcccagggagcaaagaaggtaagccgctgggcgaggtgcgacttaaccaactgaacagcgaaagtaagctgggttcggctcaaaccaactgcattcagttgcgtcccggcaaaatctttatcctcaaatcccatcccattgcgaccatgaatgaccgctggcaggtggtgaccgtgaatcactatggttcccagccacaggcggcaggtcttgcgggtgaaggcactacactgaccaataacgtcacctttattccggggaaagacgactggcggtcgccgtaccgttacaaaccgctggccgacggggatgaactggcaacagtagtagggccgccgggcgaagagatttttgtcaacgagcacggcgctattaaggtgcattttcactggaaccgccatgatacgccgggggacggctcctcctgctgggtgcgtgtggcacagggctggaacggcaatggcttcggttttatggcgataccgcgtatcggtcaggaagtgattgtctcttacctgaatggcgacattgaccgtcccatcgtgacggggtgtaactacaacggcctgaaccgtcccccccttgatttacccgcacagaaaacccgtaccaccttcaagacgcgtacccataaaggggaaggatttaatgaactgcggtttgaggatgcgaaaggcagcgaagaagtgtttatccatgcccaaaaagacatgaacaccaaggtgctgaataaccggacgacacaagtgcaggggaatcatacggaaacgattgatgggaatcaggccgttatagtgaaaaaaaataagcaggaagtggtacagcataccagcaccgaagtcgtcggactcgccaagacattgacggtgggacagtcttataccatttccgtcggcgccaatatgaatacctcagtttccatgagccagaccgaaacggtcggcacgcaaaaaaccgtctccgtggggcaaacactgactatctcggccggcaaggtgatcgaactgaaatgcggtaacagcacattgcgtatggacaaagacggcaaaattaccatcaaagggaaagcgttcctgtttgatgccagcggccctgtgcaaatccacggcaaagacattgatttgaactaa

SEQ ID NO: 2354 - DNA, 1737 bp, Xenorhabdus bovienii
  Coding DNA location: Contig name=SeqID_16870; Position on contig =40544..42280bp; Strand=-
atggaggcttttcagttttattaccactgggaattggattatctgcggcaactcgaaaaactggtcggtgaggaaaagccccatctggcagatcactttaatggaaatgatccggatattgaaagactgaatcaaggctttgctgctttaatggctcgcttacatcagaaagtagatgatgcatttccggaaatgaccctgcctctgctgcaacgattaaccgcgcaatctatcaaaggcatccccgctaccagtgtcgttcagttcgacaggcgagaagggtttgatttttcctacaccctgccgaggggctccgaagtttcatcaggtacgggggcaacatttgtcacaagccgagactgccctattgaaccgctgatattgctggcgcgggatatcacttatcaggcagaaaccaccctgatcaccctcacgtttcaatatattggcaaggatgatcactggcctatccgcccgcttagtctgtttctcagccctgatgaggcagtagcggataccttgatgctgtccctatgccgcctcttgcagcgcgcagaactgcaccatggcgggttgacttatccggtcgagcctttctggtttgaaccgttgtcaggggcttcccggctgatcttatcaccgccgatcgctgttgcgggtaactgggcgccgcaaatgctgatggaatcgctctatctgccccatgttcatcatttcctgacattatccctgcctacggtgatgcgcagtcggttatccatgaaggaaagccggcagttcagcgtgacgctgaaactctatgacgccctgcctttgtctgaggcgcaactggctgatgcttttcagctccattgtgtccccgtcgtgaaccttgaacgccgattgcaggtgacacagccctttgcgcccgataccgctcgttatcccctgcctttgccacccggacaggggctcttgcatatgactgacctccggttaaaagatgaacccggtaaagagcgcggcaagcgatgtcagttttatccgatgagccaattcacgcatttcttccgtaatgccgatgaagaagtctggttctatgcgctggatattacccgtgatgcgttggggcatctggagtatgcactcatgttttacgacagccatgcccggccgatggaacagccgccggagcaggaatttacctgccattttgtggcattcgatacagggctgccgacattggccgtgggtgatatctgccacgcaagcgaggatattcctgatggcctgcaagtcagcaatctcacgcccaccgcgcctagctatccgccggttaccgactcttcacgctattgggggttgctgtcacaccatgccgccaacggtttctggctgaactcggtatcggctctcaaacaattgttatgggattacgatttttatgcggatcttgaccgtcatgcccatcgcgatatccagcggctaaccacaggcatgttagcgattcaatccacgcccggtgactggctgatccgtggcgtgccttaccgctgtatccatgtcgaactgacattggatgaatcggcttatacccatcagggcgaactgttccggtttgccaatgccttgtaccagtttttgccgttctgtcttaccgaagatatgcgtatgcgaatgaccgtcatcgggaatacttccgatatccgctggcttttagcgccttgtccgcttcaagggtatcgcccaattatgtga

SEQ ID NO: 2355 - DNA, 126 bp, Xenorhabdus bovienii
  Coding DNA location: Contig name=SeqID_16870; Position on contig =42602..42727bp; Strand=+
atgaggataattctaaaatactctcacactgattcgttatttagaacctatccattaggtgcaataattgccgtcagtttaaacacggcctacgcacatccaccgaagcgtacacgtcgcatgtga

SEQ ID NO: 2356 - DNA, 147 bp, Xenorhabdus bovienii
  Coding DNA location: Contig name=SeqID_16870; Position on contig =42798..42944bp; Strand=+
atggcggagaggtctgcggccaatattgcgatgcatctttatcattccctgataaagatgcatcgcagcgcatttaggaggatgtttttcatgtcccagatgatttccggcgacttatttcttccaacagcggtagtaatcacgtag

SEQ ID NO: 2357 - DNA, 1437 bp, Xenorhabdus bovienii
  Coding DNA location: Contig name=SeqID_16870; Position on contig =42912..44348bp; Strand=-
atgaactatgatgtgattgttgtaggatctggcaccattgcaggttcaattgcttatgaacttgctggtcgccaattgaaagtatgcaggttggggtgtcttgatcgtagcaatgcggcatcgagagccgcaggggcaatgaatggttgttttggtgaagtgaccagtgggcttattgcgagcgattatggaaaactgaaactcaaaatggatcgtatcgcgaaggatcgctggtcaacatgggcgcagcgtttggccgcatcttcgggagatacccgccctctgtttaccgcaaaagggactcatgtcattcttaataccgctggaatggaggttgttgatagtgttaattatgatgctatagagagtgttcttcgtgaatataatgagccttatgaagttgttgagccgcgatcgattaagggaatgaaacctaacgatttggcgcgttcgcttaaagggctttatattccagaagaacatgcccttaattcccatctattgcttgaaatgttggatgctgcattgctccgggaaggcggagaaatcgtcgataacaacgttaaacgcgttctcacagagaatggaatcatagtgggcgttgagactgtcgatggagtacgttttactgcaaataaagtgattattgcggcaggcgtgcaatccctcgatatattatcagaccagacttctatcgtgcagaaaattccaccgctctttgccggttatggcgtgtctgttttactcaaagttaaaaatcccgatgagttaccgacatccgttattcgtacgcctaatcgggcatttgcttgtgggctacattgtgttccgcgtagtgatggtgttctctacgtcggcgcgactaaccttttgtccaaccagcctcgtacacatgcgacagttgctaccatacagttccttctggagtgcgcctacaaccagttaaatgttgatttgtttgaatcagagatccttgccattcaggtgggtaacagacccatctctgcggatggttttccattgattgggccgtgtggtatagacgggctgtggcttgtcacgggtacataccgggatggcctgcatcaatccccgcttttagcggattatgttgcgaatgcactcatggggctacctaatctggagattgatttggcggattttacacctattcgtcggcctttagtggggctgagtcgagatatgactatttcggaagcggcaaagcaaacggtagcgatgggttatgaatttatctggaatcttaaaccagggtgggatgaattaatctatgaatctttactcaatagttatggtgcacaagttgaatctattgatgatatctatacgcctcccccggatttgattgcattctcttgcaaggatgagcagataacaaagcggctacgtgattactaccgctgttggaagaaataa

SEQ ID NO: 2358 - DNA, 144 bp, Xenorhabdus bovienii
  Coding DNA location: Contig name=SeqID_16870; Position on contig =44502..44645bp; Strand=+
atgatggtgactatatcaggtgtatttaatctaacagagggttttaagattagtcaaccgcaatataacgcttaccgaatagacataaatatccatatatccataagtgtttatgtggtgtttagctttgatccgatattttga

SEQ ID NO: 2359 - DNA, 936 bp, Xenorhabdus bovienii
  Coding DNA location: Contig name=SeqID_16870; Position on contig =44856..45791bp; Strand=-
atgccaaatgttacataccttaatgataaagatattaattcaaaaaacggatcgtcttatcatgataattcggaattgggagcttactcgaatgaattgagtgaattatctgagaagaataaagataatcgtggagaatatacaaaaaataaaccaaaagcccttgagtatccatataacgctatttcttccccttgtagggataaagttctagcatctgaatcactacaagaaacagaaatacaatttctcatggataagtttaaagaaggagatattctttatggtttagataatcccagagctactgttttagcagatttagcaaaagccggctttaaacgcacgagtaaatctacagttaattcaggtaaagtgttttctgggtgcgtgccatttcgccgaaaaacaaataacaccaaaagaaatatactgatacaaaatgatatcacaaatgcgacttgggatgccagtaaacccagagaatatgctactgataaaagtatcaaaaaagaggtacatgactacgagcgtgtcattaactttagggagtttttatcaaaacatcctaaatacaatgttaaagatgatacggagcttgtaactgcgctaattaataatccatcaatgactacatcagtaccgctttggcaaaaaacaagtaaagctggattagactatcaactctttgtgaataaagcccctgttcattttttggttgataccattggcgatgatattaatacggtgatatcaaaacaaggtcatggtgcaagtataacatctagcgaattacgctggttatatcgccataaagatactaaagaagtgaaagagaatttaaaattttggcgagatgggaaagccgtaccccatagcgaaatattcgctgacactaaatggagtagctatcaacctaaacacagatatagctga

SEQ ID NO: 2360 - DNA, 1161 bp, Xenorhabdus bovienii
  Coding DNA location: Contig name=SeqID_16870; Position on contig =45994..47154bp; Strand=-
atgaccattatagaaaagaaaatagtaggatcttatatgccatatgctacatactttaatgataaagatattaatttaaaaaacgcattttcttatcatgataattcggaagtgggagcttattcgaatgaattgagtgaattatctgagaataataaagagagtcgcgcagaatatacaagcaatgaaccaagagctcctgagcggatgatgacatatccatataacgccatttcctcctcttggcatgctcaaggagaaaatcgtatcaatgttggcgatagtgttaacaagcaaggattgaatacggtattggatgttttgcatcttgataaaccagatacagagaaagtagccgctgattatcaacgtaagtttttttctaaggaaatgacgacattccaaaataaaacggacttaattctcactgaatcccaaaaaacgcctaagacaaaatcaccggggatgaaaaaatataccaaaaatgcattaaaagactttgctgcccatgcaggctacttgcataacggctcctatcaagatgagtttgttaactttaaggataaaaaccaaaacctggctcctggaaaattgtttcccggtgtggaactgctgcctcagaaaaccattgagataaacaggcctgcgggatgctggcaaagcaaacgcagctatgacatagaagatgaatttagaaataacatggcaaatgaatatcaggtacaggacaccagtaaatttatctcggggttaaaaagcatgtatgaaaaaagtgggcaaacgctgcacccgatgactcaacgtctggttgaagagcatatcgcacataatggaaatattttgccgacgatggcaggtattgctgggttgcatgctgaagttcaggcgttgaataaggtatttattgaatcagacgagacatcctgtcagtcttcttcccccttaaatccagctcgttatgctagggcaatgcttcagtcattaatctttaccaaacgacttaccacggctaatgcaggaaacgatttcccagcttgtcataactgttctgggattattcagtcgcccgctaatgtcatcacgggaatggtaggcagtgcaggcagcaatttttctgcgcagcgctcaaaacgtcatcgttcccagtcattgagtgaataa

SEQ ID NO: 2361 - DNA, 183 bp, Xenorhabdus bovienii
  Coding DNA location: Contig name=SeqID_16870; Position on contig =47147..47329bp; Strand=+
atggtcataactcagtccgttcagttatttttagtgattgatcagatcgcaaaaatcggactgaattaccttcaaatgaacgattatcttgagaatttatttatatataaacctcaaatagataaccttattatcatattagccagatgggtatcgtccggcgcaagactacgcccagcctaa

SEQ ID NO: 2362 - DNA, 978 bp, Xenorhabdus bovienii
  Coding DNA location: Contig name=SeqID_16870; Position on contig =47382..48359bp; Strand=-
atgcctatcccttccaataaaacaatagatgaaaaaattgatatgtttaggtcaaatcattctactgatgaagatatagacagcgctacatcagaaataggctgggacactaatgctatgttcagtaacggatctgttagattagatcaaattaaagatcctggattttggaaagaaaatattgccgattattacaaatggatggttgttgtcaaagaagaattaaaaaaattagatctgactttaaaagcgatggagtccccgaaatccgcagtgactaatacagctaaaaacatgggggttgccaccctaaaaaccgcgttaagtacaggatcgagcgcagccagtgcagcgattggagcagcggttggaaccgcggtatttccgggtgctggaactgtggctggcgcgggaattggtttattagtagggattggattaaatattcttagtggtatagctattgacaagttaaagtataaattggagatagcacatccttatcctaaaacaaggaacatgatattagcgatcaataattatgataaaaattttattactaaagtagttaaaaagaatattaacaaagataatctaaaagtcaccggtggcggcatgttaatctcaacaattacgggtaaagccagtccagtaaaaattcccgcctatgaacttattgacctcttggtatcacatgatagagcatcagaaccgttgagagatgataaagtcgaacatatattagaggttactaattatattcgtgaggttttaaatgaaagtcattctgatgcagtcatgtttatgcgtaaaaactatggtgatagtggaatgagtcttcctggggttgtcgctaaaataaagggaagtaaattaacgttagatacaatggccagagcaaaaaataaaatagatattagaactaatagcattgataaacaagtaaaaaatctttcgcgcttaaatggagatcagtaa

SEQ ID NO: 2363 - DNA, 291 bp, Xenorhabdus bovienii
  Coding DNA location: Contig name=SeqID_16870; Position on contig =48486..48776bp; Strand=-
atgtttacttcaaaagagttattaaactttattgctgtagctaagaataaatcaataaacaaagcaacacaggagcgatttatcacacagtcacccatttgtcgtagcttaaaaaaattggaattttcattaggtgtcaaactctttgaaagaaaaagccaaggattagttttaacagaagaaggagaatgtttatataataaagtttcatcaatttgtgagcagcttgaacatattgaaaatgattacaaaaatcataaatcaccctatcatgcagtttatcaaaaatag

SEQ ID NO: 2364 - DNA, 882 bp, Xenorhabdus bovienii
  Coding DNA location: Contig name=SeqID_16870; Position on contig =49079..49960bp; Strand=-
atgttaaaaatgcaaaccattattgatgtcaataaggcaatggatgctatgctgcgcaaatatctgaataaagatattgaaattcgttttgacctgcctgaaattaatacggtgccgcctaatgcgacagtcagtgtttttctttatgatatccatgaagatttgcaacttcgttcagcagaatcaagagggtttaatgccactgccggaaaattattgcctggttgggtcaatgttaaatgcaactatctgattacttattgggaatcttcctgcccaaaatcggacgccagtagcccggaaagccaaccttgcaatcaagctatacaagtgatgtcacaagtcttggaggcattgattaataatcgccaattaaccgatattcccggtgcatatacgaaagtcattccacaacaagaaaatttaaacagcttgggtaatttttggcaggcattgggtaatcgcccacggctttccctgaattattcagtgacagttcctattagcctaaacagtggtcaagataatgtaactcagattattgatgtttcttccagcgtggaacaaactacggcacttagccaagaaacaataagtcatgctttacgggaacgacttattacagaattagggaagggagatgatattaggttagcgctgagcaaagtggaaatattcacggttccaaccaatattgcacaaaacaatctgacacaaatgacgctatctttgtctatctcgggtattacacataagaaatatttgacagatattaataaaatattatctgtctggggaaataatagtgtggttattactacaatcaatgattgcaatatctatattgaaaagatagaaacaggtaatctttttgggatttaa

SEQ ID NO: 2365 - DNA, 2088 bp, Xenorhabdus bovienii
  Coding DNA location: Contig name=SeqID_16870; Position on contig =50044..52131bp; Strand=-
atgaatatcgcacctgttttctctgatgcatttaagcaagataatgaccctaatctcgcgtttttatttagccaactggagcgaatcgatcttgtccttcaataccattttcactgcatatcaggtcagagagatgacctccttgatgagtttctgctaagcgaagaagacgttatcgccagactggataagccactgggcaaaccccattggctcaatgatgattatttggcaataccccagatagtcaaccccgtggcatcccgattaactgacctgattgcccgttttgagctgacagattttgaaagggatgtgctgctgttaggtttattgccccatttcgatagccgctactatcgcctgtttgtgctgattcagggagagcaacaatcccgactcccctgttttgcgctggctttggagctgttttgccactcgctgctggagaaacaagcgcagcaggccagtttcctgcaccgggcgcctttgattggctgccaacttttatccgtcgatagccgtcaaaaaaccttgacctggctccagacttcttttgtaactgacagcggcgtgtatcattttttacttgggcatcactatattacgccggctttagaacattatgctgagtggataacgcccatagaaatcggcggttatccggcaggcttaaaacaaagactgggtaacttattattatctgaccatgatgatattcgacctattgttttattacggggcatggccggtagtgctagagcccatgccgttgccaatatgatggcgtcggaaaagcggcaaacgctattggtggatatcgctaaattggctgacggagatgataaaataacattgctccagataaagcatattttgcgggaaacccgtatgcgtggagcttgtttattattacggaatttctgcttattagccgagaaaaatagacagctactcgattccctatcagcgttattgaatcaacctgaattaagggttgtctgtctggtcgaaccgtattccccactggtatggttgaaaaagatatcgacattactggttgagatgccacttttcacatcagtggaaaaaaccagactactaacggccagtttaccggataactgttcagaggatattgatgtgataaccttaagtcagcgttacacgtttacccctgaaaccctgccattgattttgcaagaggctcagttttatcagcaacagcgagatccttctggggttttgcagcaatgtgatatccgtaaggcgctcaatttacgtgcccagcaaaatttcggccaattggcgcagcgcattacccccaaacgttcactaaaggatttgctggtaactgatgaggttgctcaacagttacaagaaatactcaccgcaattaaatatcgggaacagatcttggcgggcgggtttaaagataaaattggctatggtacgggtatcagcgcgctgttttatggtgattccggtaccggaaaaacgatggcggcagaggtgattgctgattatattggtgttgatttaataaaagtcgatttatctaccgtcgtgaataaatacatcggtgaaacggaaaaaaacttatcccgtattttcgatttggcagaacaggatgcaggggttttattcttcgatgaggcggatgccctgtttggtaaacgcagtgaaaccaaagatgcacaagaccgacatgccaatatcgaagtctcttatctactgcaacggttggaaaacttcccggggttagtcattttatccaccaataaccgcagccatttagacagtgcttttaatcgtcgttttacttttattactcgctttacttacccggatgaaagactccgtaaggaaatgtggcaggcaatctggcctaaaaatataaaagtatcacagaatgtggatttcgataaattagctcaacgagccagcgtgacaggtgcaaatattcgtaatattgctttattgtcttcattttttgccgcagagaatagtaatggagaagttaataacgaaattattgaaatagcattggcacgggaattagctaaaatggggcgattaagtttctga

SEQ ID NO: 2366 - DNA, 1539 bp, Xenorhabdus bovienii
  Coding DNA location: Contig name=SeqID_16870; Position on contig =52168..53706bp; Strand=-
atggaaaaacgtcatagtgataaaacaattgaaaaatgttctaacttatttaaattaaaactacgtcatttaattaatgaagaggtggagaaatggtcaatacagaataatggttctttatttaaaaaaataactttagatcttggagagataacttttgaaaattttgaacaacaattcatctgtcgactggaaagagaattaaaaaacaaaactcatgaattcacacgaaatataaaacagaatattgacaatgatttattttcttcaaaagtagttaaatctacgagtaagatttcatcaatatctcaacataattttatgacaaccaataccttatattcagaacaatctgtgatagagaatattgataattatttaaagcatggtagttggaaatcacctgctttatggcagcagataaaagatgttgaattcagttattggttaatagaacatgttaacctccagccacaacaatggctgcctatgctagctaaacactgtttacaacctacagggctaagtcgcttaattcagatctgccagccagacgttcttagtaggctttgtcagttatttactgaaacaacaacatctgaatgtgttaattcgcagacaatcataaacacaaaagtgacaccagaaaaattgagtttagcggctgaatattatcttctgcatcagatgagatatataaattccacccagcaggtaaaaacagcattacaagatataaataatctgacaccagtgaaaagtgtcacgggaaatggtaatagcccattaacaccagatatttttgaaaccaataccctgatggatgtagcgcagtcgttttcacagcattccatgcaaacgaattatcaaataaatcccatacaactgaattatggcttggttaagaattctggagaacaaaaacacccaatcttacaaaatgaggatcaacataaaattgcactgaaatcagcgccacctgaacaggtattatccatacagcatggctctgataatactattcatccccaattatcaccgtcggttttacccatcaacaatgccggttgcatgattttatggcctctgttaccaacatttttccgctcctttgatttattggatcaaaatcggtttacccgccttgaagcacaaagagaggccgtctgtttacttgattggctgatttggggcgaagaggaaataccggcatggcggttgacactcaataaagtgatctgtggccttcccatcaatgacaaaacgctctggcgtacaccagaaccaaaacaacaaattgcaatcaatcaatggctggaaaaaaccatcgtacaacttccggcttggaaaaaaatggggataaacgatgtgcgtcacttatttctgcaacgtcccggggaattaagtgagttaaacggtatagcaaatatctatattaaacccgaagtttatgatgccctgctaggtgaatggccgtggccaatcaatatggcaagttttagttggttaaaacaaccaataacgatgacgtggttataa

SEQ ID NO: 2367 - DNA, 1269 bp, Xenorhabdus bovienii
  Coding DNA location: Contig name=SeqID_16870; Position on contig =53839..55107bp; Strand=-
atgaaagagattcgttattctgcaactgtacaagagcaacaagcattatctgacacaaaaggtgtcggatctgagactgataaattaaaggataaatttaaagatggcagcattcccttacaaaccgatttcaatcaattaattgatattgctgatattgggcgtaaagcctgtggtcagtcaccacaacaaaatggaccgggcaagggattgaaactggacgatagtggtacgctgagtttaaaaatgggtacaatatccagccaagacttttccccattaatactagagaaagatattttatctgtcgatctgggcagcggcctgattaataacgccaatggaatatctgttggtcaaggtaatggtattgttgtaaataaaaatgatgtggcagttaaattggtaactaataaaggtatggttgttgatgctaatggtatcgccataaaaccaggcgatggggtgaaatttagctcagatggtgcgttggcagcgaaatcggctgattcaaccatcacagttgatagctccggtataaaagtaaaagttaatactggtaagggaattaaggttgataatggcttgcaagtatatcttcatgagaatggcggtattggttataattcggcaggtatttgtattaaaactggtaatggtattaagatagatggtgatcgtgtggctatcgatcctaacaaggtattgccaaaaggtatgattgtgatgttttccggctcgacagtaccacaaggctgggcattatgtgatggaaataatggtacaccaaacttaattgatagatttattctgggtggcaagatcagtgatataaactctaagaataatgctacattatcaggttctggtaatagtaaaaagtgtaataaaaatagtgataataaagtggtttctgtcaatgttaaaataaaggacactgaattaactttatcccagatgcctaaacatgaacacactggggggatgccttatcataatagtacagggttcagaaatggttattataaaacaggtgagaatagctatcagcttgataatcggttagaaaatggttatatgtcaaacaatgctttcattccgagatctttgatttcttatgataataaaaacccatattatccttacacttcctctaagggagatggaaaaggacattcacatggggctgatgccacagctaacgcacataatcatataacagatattatgccaccttactatattttagcatttattataaagttataa

SEQ ID NO: 2368 - DNA, 2898 bp, Xenorhabdus bovienii
  Coding DNA location: Contig name=SeqID_16870; Position on contig =55161..58058bp; Strand=-
atgagtaatcaagaggcactgtttcacagtgtgaaagacgatattcactttgataccttgctggaacaggctcatcaggtggttgagcaacaggccggaaaactgtggagcgacaccgcggagcacgatcccggtatcacctttctggaagggctcagttacggtgtgtcagatctggcttaccgccatacccttcctttggaagacttactgacccctgcgcccaatgagcaggaacagcaagacggaattttccccgctgaatttggcccccacaatacgctgacgtgtggacccataaccactgatgattaccgcaaggcgttgctggatctgcatagcagtgactgggcaggaacaaagtcagcgtcagaacaggataaaggggattttttgttccgtaacgtgcaatgggtacgcgagcaggaagagcaccgctatacctattggtatgatgccaccaaaagggaatatagctttgttgagagtaaagaggcgaaaaagtttaccctgcggggaaattactggctctatctggagccaacccgtcgtactcaggaaaatctaaccaccgccacccagcaattaacggactttttgactcaaaaccgcaatattggtgaatctgtcagtcagattatctggtcaaaaccggttgattttccgctattactggatattgaactggatgacgatgtaaaggtacaggatgttccgggtatttttgctgccgtctatactaccgcagaacaatatctgatgcctgaggcccagcgtttcagtacggtaacgctgcaagatgccggcatgcgcaatgatgaaatttttgacgggccacaactggaacatggctggatcactgaattgccggcagtccgtgattataccaaacggatcatcctcaatctgagccgactggttaacaagctgcttgagattaagggcattcagaacgttaatcgccttcaactggacgataactttgataaaaccctgattgaacgagctaaagaagatgcttggtcatggtcaattaaagaaggctattaccctcgtctttggggtaaagatccactccatcaattggcacaacatgatggcccgctgagagtggtagccaaaggcgggatcagcgtcacggttgatgaaaaccaaattcgagacagtttacccaaccctcccctgattcagaataaaccggtggtattggcttacggccggcatcgtgatgtggatcgttattctcccgtcagcgatacgttgcccgcttgctatgagctacaacagcccttatctgaaagtgaacatgcccaacgcctgttgtcacttcatcagtttctgctgccatttgaacaactgttggcttgtggctgccagcaagctgccatgctgccaaaattgttggcttttaagcgtgaaggatatgaagtctggggcgatcaatggccatttaagccgggttctgtcaatgatgaagctcatcaggattatgcccctgcgttaaagaagttgttagaacagatcgcacataacagtgatcatgaattggatatcgtcaattatctgcttggctattttggcactcagcgggcgccacgtacttttaccacccccattgatgatttccgcgcagtgcaacagggttatctggcgcagcaaccaatattgacttatcaccgggctaatattcgtattgatcaagtctcgtcactacaaaaacgcattgctgcccgcatggggttaggcggtgaactgtttaaaccggaacctgacctgagcaaactgcctttttatctggtggaacatcgggcattgctgccaattaaacccaatagccaatttgataaagagcagaagccagattcggtaacagaagagaaagagagccaaactggtcagcattatgtggtgattaagcaggccggtattaatggcaaactgacacaagggcaggtgatcaatttagtcctctatgaaggcgcccaaggagaaaaccgatttacagtacgtggtcaaatgatagtcaaaaccgagggggatcagttttggctggacgtgggtaatagctctcaactgaaatacaatctggaacgggtgatgaccgccgccaaagcaaaaaaattgttctggcaaaatagcgtagtctggatggaagatatgaactaccgtctggcctacgatagcgaccaatccaagaatggccgcccattgcctgaaaaccaacggcgcttgacccgaacaacacaaacgcctttccctgccttgattactgtaggtaatgaaattaccctgacaaagaactttggagtcattaatttaacacgggaatattctcaggattcagagaaactgtatgccaaagtggtcagctttgatcgcatcaaaggcaccttggttattgagcgtaaagataattcgacattaccttttcctgtatcggaagagtcatggcgatacagttggcatttttcaggtaaagaatatgaaagaactgaccgtttctcatttgtcattagcgtggtggtaaacagtgatttaattaaaatacccggtgttgatccgtataaattagaagaatgggttaaggaaacgattcttactgaatttcctgctcatatttctatgattattcactggatggatcgggaaccgtttttaaatttaggcaatacttatcagcgttggcaaaataatggcgcgccattaggggatgcagcttattcaattttggaaagcttgacgctaggtaaattaccttcctctttaaaaggaatagggacaatgcgtattgctacactgcaccaaagagaggaagttgtcggtaaaaataatgatcagtggaataccgataagataatccagaacgaattattctatgttccgaaagagaacgaataa

SEQ ID NO: 2369 - DNA, 2187 bp, Xenorhabdus bovienii
  Coding DNA location: Contig name=SeqID_16870; Position on contig =58051..60237bp; Strand=-
atggaattaactgagttaaataataaattgtcaaatttggtgccgatgagcgattttaaattagataatcgaaccagtttgcaattactccaatatattgaagagtacaccaaattaattccctttaataaaagtgataaatattggaatgattttttctttatggcgaataatacgccggaaaagctggccgaattataccagggggaaatcgaatccaatggggagttattacctcatcaggcttttctattagcggcactgcgattattggaaacgccaatatccttatttaataccttgcctgcggcacatcgcaatctttattatcgggcgcttttgggattatcccgccgtccggcacaacctgatcaagttgccttatcggtggagctgaatgccaccgtgacagagcaactactcactaaaggcaccttatttgaagcgggacaagatgaccaaggcaatgtcctgcaatatgcgcaggatgccagtttgttggcgaaccgtggctatatcagtgatctgtactggttacggaataaagaaaaacagcaatgggttaccgcgacaccgtgggattctcaggcacagttatcattgccatctggtgggataaggttattcagtgaaacggatcaggataaacctgtgctgggtggcgtgttaatcacctctgcgcaactggcaatggaagaagggataagaaagatcactgttacctttgataaagacgttagtagccaaaatctggtcgcccagatcagcagcggtaatcaatggctaactttgacagcgaaggtggataaagaaggagccacactaacgctttcagataaagaacccgcaatcacggccccggaggatttggataatctggttttcagccagccagtcctcaggctacaaggcaaagacagccaaccactgccagcggtgacagctcttaaggtacaaaaaaacccggtcgataaagccgcattcgagacgtatcacctatctccttttggttatagctctgaaattgaaccattggcagaaagtcccgctttataccttggtatcactgacgtcgaaccggaacaaaccttatcgctatattggaaattaaaatcaccacagcaacctgaaaaagttttctggtattacctgaaccaaaataatcagtggattgcactggatgcgtgggtcaatgatcaaacccaacatctgtatcaggatggcacttggcaggttgtcctgcccgcggatgctgccaagcaagcaacacagatgccaacagaacgctattggctaaaagccgttgtggtcatccctacacacaaaggttcatggggaaaaaacccttggttatgcggcctgatctataacgccataacagccacgttggtcaatgccgatagcatcaacaacaaccatttattaacgcctttgctggccggcagcattcagcgtccggttgaaccgattattgtggtggcatcaatcaaccagccttggccgtcatggggtggacgtgtgccggaatcttataacgccttttttgaacgtacagcgcagcatctgtctcatcgaaatcgcgccttgacgtggggcaatatggcgaccctgttaaaagagcgttatgtcagtatctttgatgttaagtatccgggcgatgatgaactcacccgagtaccggcacgggaggtacagcaactgaccatcatcccggctaaccgatacaatgacagcgatgatccatttcgtccggtactcaacccggcacgcctgcaagaaatggccgggtggttacagcaaaaaagttctccctgggctgagattgagatcagtaatccccaatatgttgatgtgaaaatcaattacacggtgatttttaagccggatgttaacgaagattttggctatcgccagctacggcagcaactcagtgaagcgtatatgccctggagcgttgatgagcagcgccccgtcacgctgaacaacagcattagttattaccagttactggcaaccatccaacagcaaccactggttgaacgagttacttgtctgacactgcgtcggtcggatgccgccaaaggcagtgatatcaccgcatcagtggaagccaaagataatgaggtgctgattttggtctgggaagcagacgataagctgcaatgtcgaggaaataacgatgagtaa

SEQ ID NO: 2370 - DNA, 426 bp, Xenorhabdus bovienii
  Coding DNA location: Contig name=SeqID_16870; Position on contig =60328..60753bp; Strand=-
atgagtgaagccattgtggtggacggggatgtgctacagtttgatcccagctttggagatcggcaggtgataatttccatccccgctaaaatcagcggcaccgggcatgcgcaggtgaacggcaaaaaagtctgcattctgggggatgagaaacaggttagtgtttctgcaatctataccacagcaccgcatacgacaccgggaaaaggcaccattaccatcagcgcgctggatgccagccagcaggctcttcaatgtaccagtggcgccgccttaattatcaaagggcagaaattcacggcgctgtttacgcctgaattacccgccatgaataatacggtaactccaccccaaccggatgtgacgacaccttcatcgggaaaaggcagttttatgacccaacagaattttgccaccgtaaattaa

SEQ ID NO: 2371 - DNA, 423 bp, Xenorhabdus bovienii
  Coding DNA location: Contig name=SeqID_16870; Position on contig =60750..61172bp; Strand=-
atggaaaaccaaatactgacacaactctatggtcgtggttgggcttttcctccggccttttcccttgagaaaggggtggagatggccgaaggtgctgacgatgtgcgccagagtttgcacattctgttcagcactgatcagggagaacgcctgatgcgtgaacattatggctgcgggttaaatgattttatgtttgaaaatatccgtaatgaactgcttgctgacattgaatcccatatccatgacaacgtattacgttatgaatcacgggcagatattacagatatccaagttcgtcagtcgccaaataataagagtactttgcaagtgcaggttatgtatcgcctgcggggaagtgatatcaatcagcaaattcagggtacgctggcgctgagtgaaggtcgggtgatggaggtggtatga

SEQ ID NO: 2372 - DNA, 1617 bp, Xenorhabdus bovienii
  Coding DNA location: Contig name=SeqID_16870; Position on contig =61183..62799bp; Strand=-
atgagccaccaactgaaaattattgcagatggcaaggtactgtcactgttggccgccgtcgatgtggatacctgttaccgtgtcaacagcatcccttccgcaacgctgaaactaagtgtaccggacaggccactctcgtctttcagccagaaggatgttcaggcagaactggctcactgtcaggcagggaaaaccctgcggctggaattgaccaacggcggcagaaaatcagtgctgtttaacggcctgattacccgtaagactttgaagatcaaaaataagcaattactgcttactttggtcgtcaaacatcggttgcaactgctggtggatacccagcattcacaactgtttaaggccagcaacgaaaaaaccatcttaaataccttgttgaatcagacgggcatcaaggctcactttgaacggatagccgcgttggatcaaaaacatgagcagatggtgcaatttcgctgttcagactggcgttttctgttgtgccggctatcggcaacgggtgtgtggctgttaccaacgatagaaggcgttcggcttgtccagcctgaaaccctgaaatccaacgcttcccataccctgaaaagccggggagatgagaaaaaagatatcgtcgtcaaagatgcctgctggcagtttgacaaccatcttaaccccgcttcgctggaagtcagcggttgggatatcagtaaacagcaggcgttatcaggcggtcgctacggcagtgttgctatgggcaaagcggcactgtctcctgacaggctggcgtcgttgaataaagagagttgggacattcgttacagtagcccgttaaccactcaagagagtggctatctggcgcagggattattgctgaatcagcgtatttccggtgtaaccggtgaatttctgctcaaaggcgatgggcgttatcagttaggggacaacattcagctgacggggtttggttcacaactggacggtacggcaagcattactgcggttcgccatcgttttaaccgacgaattgattgggaaaccaccgtaaacattggcttacagcaggaatatttgccgatgttacctgatgcccccgaactgcatactgcgacggtcgcgaaatatcagcaggacgatgcggcactgaaccgcattccggttagtctgcccgtactgaatcggccgaatgaatttctgtgggccagactagggaaaccttacgccagccatgaaagcggtttctgtttttatccggaacccggtgatgaagtgattgtcggtttttttgaaaatgatccgcgttatccggttattctcggagccatgcataatccgaaaaataaagcccctttagaaccgagccaagataatcaggaaaaagtgttggtggttaaaaaaggtgaaaaccaacaacagttattcattaatggtaaagagaaaataatccaaattaatgcgggagagaatcaaatcacgctccagcaagataaagatatttctctgacaacgaaaaaagaattaaccctgaaagcacagactatgaatgccacaatggataaatccgtgacgatatcgggcaaaaacagtgttgaaatcaagggtgcaaaaattaatcttacccagtga

SEQ ID NO: 2373 - DNA, 690 bp, Xenorhabdus bovienii
  Coding DNA location: Contig name=SeqID_16870; Position on contig =62796..63485bp; Strand=-
atgagtctgattgaacgtggtttagcgaaactaaccattaatggttataaagacagggaaggaaaaatacgggcaggcactgtgcaggccatgtataaccctgattccctgcaactggattaccagacggattaccagcagtcccaagccattaatagcgagaaacaaagcagcctttatgtacaggccaaacccgccgggttatcccttgagctgatttttgatgccaccatgccgggtaacaaaacgccggttgaagcgcaacttgaacagcttaagcagctttgcagtgtcgatgccaccagccatgaaacgcgattcctgcaaattaaatggggcaaaatgcgttgggacaatcgcggctattttgctggccgggcgaaaggtctgtctgtgagttacaccctgtttgatcgtgatgccacgcccttgcgggcgcgagtcattctgacattggtggcggataaaagtctggtgttgcaggagacagaacaaaacctgaaatcgccggcgaaaattgccttacgggtacaggatggggtatctctggcgctgatggcagccagtaccgcttcaacgctatcaggtggggtggattatctgacactggcttggcaaaacggtctggataacctcaacggatttgtgccgggtgaaatattgcaggccaccagagaagacgcatcatga

SEQ ID NO: 2374 - DNA, 183 bp, Xenorhabdus bovienii
  Coding DNA location: Contig name=SeqID_16870; Position on contig =63482..63664bp; Strand=-
atgacagtcgaaatcagagaattaatcattcaggcaaaagtggtttcatcagcgcaaccgactgaatccgaaaggcaaggccattctttggttcaggagagtctggatgaagcaacttgggttgaaaaaattaaacgcgaagtgttggccgcattacgcgatgaagaagggtggcgtccatga

SEQ ID NO: 2375 - DNA, 459 bp, Xenorhabdus bovienii
  Coding DNA location: Contig name=SeqID_16870; Position on contig =63661..64119bp; Strand=-
atgaacgatttttacacgcccgtggtatcccaccgttttatggcgagttttatttttaatggcattcccgatccactggatatccactttcagcgtatttccggcctcagtcgggagcttcacgtgacccaacacagccaagggggtgaaaacgcccgcaatgactatctggccgataagatccaacacggtacattaacgctggaacgcggcgtgatgacggtttcacctttgacctggatgtttgatcgcgtattacgcggtgaaaaaatcgcctatgccgatgtggtggtgatgctgttaaacgaaaattcactgcccttgtccagttggacactcagcaatgcgttaccggtacgttggcaaaccagcgactttgacgcgaacagcaacgccatcttggtgaatactcttgaactgcgttatcaggacatgtgctggctgggagtcaaagtatga

SEQ ID NO: 2376 - DNA, 1209 bp, Xenorhabdus bovienii
  Coding DNA location: Contig name=SeqID_16870; Position on contig =64135..65343bp; Strand=-
atggaaagaattcaaccgggcgtaaccttaacggaaagtatcaccaccacgggtcagcaagaaattcccagcgcagtgccggtatttattggctataccgtccatgatctacgaccagcaaaaaccgcggttcgtatcaacaatctggcggaatatatccagttatttggtgatgatcatctgatggcgctgacggtcaggctctatttcgataatggcgggcaacaggcttttattttgccgctgcaaggcaatatgccctcagccaatatcacccagatggaagccgaaatactgatggccgcattaggctctgacgcagtgagagaagcgattggcggggaaacgcagattactctgattctggcaccggatatcgcccggctcaatgacagcgctattgatgatggatcaaccttagtgaatctatggtctcaaggttggatgacactactgcaactgagccagatccgcgccaatctctttgtgctgctggatgcgccggatgaggttaaacaggcacaacaatgtctggaaagtttatcgtcagaatatcgccaatggggagccgcctattggcctcgtctggaaaccacttatcaggataaattcagtcaaaaaggtatcgtgctttctcccaccgccgccattgcggcagttatccagcgtacggatagcgaagctggggtgtggaaggcgcctgctaatattgctctgtctcaggttattcggccggttaaaccttatcttcagggagctgtactgtttaacactaatggcacctcgctcaatgtgatccgcagtttccccgctaaaggcatacgcgtatggggatgtcgcacactggaaaattcggataacacgccgtggcgctacctgcaaacccgtcgtctggtatcctatgtcaccgttcatttggcgcaattagcgcgtatgtacgtctttgagccgaataacgaactgacctggatgaaatgcaagggacaaagctataactggttacggcaattgtggttacagggtggcttgtacggctcacgggaagatgaggcatttaccgtgcagttaggggtcaatgaaacgatgagcgaagaggatgtccgcgccgggaaaatgattatgaaagtcgccttggccgtgttgttccccgccgaatttatcgagatcagtttggtgtttgatacccaaacgggggcgcttttgtcttaa

SEQ ID NO: 2377 - DNA, 1395 bp, Xenorhabdus bovienii
  Coding DNA location: Contig name=SeqID_16870; Position on contig =65410..66804bp; Strand=-
atgcctgctactctaaaagcacccggcgtttatattgaagaagatgcttcccttgcattgtcggtcagcaacagcgcaacggctgtacctgtttttatcggaaaatttaccccgaaaaaggaaaatccagcccaagtatgtacccgtatcagcaactggcttgagtttacttctgctttctctctggcacctacgacagagattgtgatcagatcgagcattgaacctccagctaatcctgaaacaaaagaagagactgacaacaaagagactcctaaagccagaactctctctgaagctgaaaataaaaaaaactggattcacgatattgagaaagtcaatttatcgccagccgtgcaagccttgcagctttatttccaaaatgggggcggagcttgctacatctacccattaaatgatgttaaagacgagtcaattctggcgtctatacctgatgtgattgaacaaaaaggggatatcacgctgctggtttgtccagaaaccgatctggattataaaaccaaagtttacagtgttttgctcccgctattggatgataaaaaagtgggttatttcctgattgcagatagcaatgatggcgaatccgtatcaggggtggggaacaatgctaaagctgctgcctattatccccagctacaaactgacctgaaattttccctcttgcctgaagataaggatattcgtatcagtggttatgaggatgattcaggtaaggatgagccgaagaatttggccgacctgcggaagactaatgcatcgattgcaaaaaggattgatgaaacactgcaagtggagcaacaaagtgctctcatcctttcaccgagcgcggccatcgcgggaatttactgccggacagatagcagccgaggtgtctggaaagcccctgcaaatgttgcactgactggagtcaaaagtctgcttgataaagtcgacgatgaacggcagggagcgatgaatgacaagggcatcaatgtcatccgttcatttactggccgtggcttgatggtttggggagcccgcacgagtgtggaggccaataataccgactggcgttacattcctgtccgtcgtttattcaattccgttgaacgcgatatccgtcaggcgctgcgcgctgttttgtttgaaaccaataatcaaccgacctggatgcgcgctaaggccgccgttgatcaatatctttataccctgtggcagaaaaatgccctgatgggcaatagccctgaagaggcttactttgtgcagattggccagaatatcaccatgtctgatgctgatatcaaacaaggcaaaatgatcatgaaagtaggtctggccgcagtacgaccggctgaatttatcgttctgcaatttacgcaggatgtcgcccagtaa

SEQ ID NO: 2378 - DNA, 1068 bp, Xenorhabdus bovienii
  Coding DNA location: Contig name=SeqID_16870; Position on contig =66827..67894bp; Strand=-
atgacaactgttaccagttaccctggcgtttatattgaagaattaaatagtctagctttatccgtatcaaatagcgccaccgcagttcctgtttttgcggtgaatgaacaaaacaaacatatcaacgaagatactgcaacccgtattaattcctggatggattatcttaatttgacgggtgaatttgataataaagataaattagctgtttctctgcgggcatattttgccaatggcggcggctattgctatctcatccaaactaagagcttagaaaaaattatcccaactttggatgatgtgaccttactggtggctgcgggcgaagagattaaaacgtcagttgatattttatgtcaggcaggaaaagggttatttgccatttttgatggatctgaaacagagttgacgattaacggggcagaagaggcgaaaggaaagtataccgccacccagtttgctgcggtctattacccgtggttgaaagcggattgggctaaagcggccattccaccgagtgcggcgatggcaggggtttatgccgcagttgatttatctcgtggagtgtggaaagcacccgctaatgttgccttgaaagggggtttagaacctgcattcttggtcacggacgaattgcagggggtatataactctggtcgtgccatcaatatgatccgaaatttcagcaatactggcactacagtttggggtgcaagaacgttggaagatagtgacaactggcgctatgtccctgtgcgccgcctgtttaataccgtcgagcgggatgttaagcgcgcgatgagctttgctatgttcgagccaaacaaccagccgacttgggaacgtgtcagggcggcgatcagcaattatcttcatggcctgtggcagcaaggaggattggcgggcagtaaagaagaagaagcctacttcgtgcaaattggcaaaggcatcacgatgaccccagaccagattaatcaagggcagatgattgtgaaagtcggtctggcggctgttcgacctgcggaatttatcattctccagtttacgcaagatgtagaacagcgttaa

SEQ ID NO: 2379 - DNA, 450 bp, Xenorhabdus bovienii
  Coding DNA location: Contig name=SeqID_16870; Position on contig =67933..68382bp; Strand=-
atgtctacaagtacatctcaaattgcagttgaataccctattcctgtttatcgtttcattgtttctgtcggcgatgagcaagtcccctttagcagtgtttcagggttggatattagttatgacacgattgaataccgcgatggtacgggtcattggttcaaaatgccgggtcaacgtcaacctactaatatcaccctgcgtaaaggcgtctttcccggcaaaaccgaactgtttgattggattaattctatccaacttaaccaagtcgagaaaaaagatattaccattagcttaaccaatgacgcaggcaccgaattattgatgacctggaatgtctccaatgctttcccaacctctctgacttcaccttcatttgatgccaccagcaatgatattgccgtacaggaaattaccctgacagcagatcgcgtaacgatgcaggctgtttga

SEQ ID NO: 2380 - DNA, 150 bp, Xenorhabdus bovienii
  Coding DNA location: Contig name=SeqID_16870; Position on contig =68504..68653bp; Strand=-
atgattaataaacaaataatatattcatcttcattctggtgtaaatggaattgtataaaaagcaaaatgcataaaaagcaaattgcattattggcaatgtatttattatggatttttcggcacgatattaccgatgtaagaattatgtga

SEQ ID NO: 2381 - DNA, 159 bp, Xenorhabdus bovienii
  Coding DNA location: Contig name=SeqID_16870; Position on contig =68677..68835bp; Strand=-
atgaatggatttatctacctttcaataattaatttttatgcaattgcaataggattaaaattaattgccattttgtatttattttatattgccacgtctgtaattatattagatgcatttaatcagataggattattattaaatttttccgctgtctaa

SEQ ID NO: 2382 - DNA, 237 bp, Xenorhabdus bovienii
  Coding DNA location: Contig name=SeqID_16870; Position on contig =69076..69312bp; Strand=-
atgaacgtccacacctttttcactgttggcaatggtttcagctgtaagttcgtttggaatgcgcatatcgaaggtaaggccttttctcttgcaactttggtcagagttatacgtattagatcagacacggttaatcccatgccagccagcacatcagcagcttcattttttagtgtctcatctatacgagcacgaacaatagcatttgcggccatgttgaaacctccgtttggttaa

SEQ ID NO: 2383 - DNA, 201 bp, Xenorhabdus bovienii
  Coding DNA location: Contig name=SeqID_16870; Position on contig =69266..69466bp; Strand=-
atggcaggtatattgattgcgccgaatgatgatgagaacaggctcggtttattgatgaaccgggccttaataaataactctactcaatttccctttgtttcatggtctataagatacccagtttatcaaagagatcatcagcgtttttcgctttatgaacgtccacacctttttcactgttggcaatggtttcagctgtaa

SEQ ID NO: 2384 - DNA, 11505 bp, Xenorhabdus bovienii
  Coding DNA location: Contig name=SeqID_16870; Position on contig =69500..81004bp; Strand=-
atgagggtagttgaggcatttcttttcccatttatcgccaggactgattcaaaaagtcattacctgatatccggtcaggtaagcaaatttttatttaataaaaaatccgaagggagtatcgatatggataacattctggcctcgccatttacacgcctattttggaatgaatggattcttgaacctgattcagttaaatacaatatggttatggatcaaactatccaaggcgatttggatgaacgtaaattgagatcggctatacagggattgatgaatcaatatccattatttcaatatcagcttgatgaagaaaatggtgaattatattggaaaccgggtccgaatagtcttaataccctacaaatttttgacagtgaagaaaaactgcgtcagtttgccttacagccctttgatttaaggcaagggacactgattcgatttggattatttcaacaggcagagcgacaatttcaattagtcattgtactgcaccatattgtggtagatggcgggagtaccgaagaattttatcacgccatatcggatctctataatcagcgccccctgcgccacactcctctgacactggatcaaattgccgaaaaatttgcacaatatcgtcagcagataaaaacattggaagaacatcagcctgcacagttctggaaaacatgtttgacggaagtggcagcaacgaatccgttgccttatttatcagaaccggcgaaagatgaacaagaattagtgggagaggttcgtttcaatctgtcattaagtgattggcagcagcttaagcgttctctgcggcactgtacgccatttctggtgtttaaaacgctgtgggcggcactgattgctcaatatatgcctgatggaaaggttcacgtcagttatccggttgccgtgacaggaggagaatcgctttcattgggtgcccaaatcaacaccgctgtttttcccttgcagctggatgatacagtcagctttgcttcgctttaccagcaaacgttacattacacctcatcattgaagacaccctccggcctgcgtttctcatattggccgctttttaaggtgttgcctttaacacctatccgtaagttaaatgtcgtcgtgaaccaagctcatttcaaggatttttgtctggaactggagagttgtgaagtccattacaatcaccgtttcgacaacgatttagcggattcagaatgggcgctggaatatcagcagcaaggtgatcaatggtctttccgtatccgctatccacgccgccgtttccaccctgaacaaattactgccttggccgaacagttccagcaactcctggttaatgccctgacaaatccagaaaaaccgatccgacaatttccgttcctgacacaggatcagcgtatggccttactgaaatgcggtcatcagggagaacagggtgatgttcccgaaacaacgattcatgaaaaattccaacagcaggcttgcctgcatccacaacaaatcgcgttgattgataatcagcagcaactcagttatgcggaattggaacaacgtagtaaccaactggctcatttgatacgggaacgctatctgcaagcaacaggacaatcactgcccccggacaccctattgccgatttttatgaatcgtggggtggatatggtgattgccatgctggcggtaatgaaagcgggagcggcttatctgcctcttgatccgcaagtcccaacgcaacggctggcctatatcctgaccgatagccaatcccggctggcaattacagatatgacgcaccagcccatattgcgcgattacgggcaaaatctggctttgttgacattcggaaacgacagggatgattaccgtgatcagccagacagtgctccgcaaacagcctcagagccgaattcattagcctactccatctatacatctggcacgacaggccgtccgaaaggaactctgctggaacatcgtggggtattactcatgctggatggtctatatgccagagtgattgagggtattgaacggccacaacgttggttgcagtttgcttcgctggcatttgatgctcatgtgttcgaaacctttatggcactgtgtttcggccatacattagtgattgcttcagaagaagagcgtcatgatcctgacctgctgataaaattaatcgaaaattatcaggttgaagtcgccacttttccacccactttgttgaaaacaaaacccgcgttgcctgcccggttacaaaatattctggtgggaggcgaagcaacacctcaagccattctggatcactacgccatgcagggacggcggatatttaacgcctatggccccacggaagccagcgtatgtgtcactatgcaccattatcagtgggatggcgcccaaaatattggccgtccgtttcccggcattcaggcttatgtcttggatgagcagttgcagttagtcccgatgggcatgagcggtgagctttacctctctggcgccgtgctggccagaggatatttggggcagccggaattaacagccaagacgttcattgccaacccatttgctcaacataccgatgatcagcggctctatcgcacgggagatcaggcgcgttggttgccgaatggggaactggaatatctgggacgcaaggattttcaggtaaaaattcatggctatcgcattgagctggctgaaattgagcaggtgtttattgcggcatccgggctgagtcaatgcacagcgcaggtacgcggtcaggatcgctcgcacattgtgctctactatgtgtcagagatgaccttaaacgaagataacctacgccgtactttgcagctttcgctgccggattacatgatgccatctgcattcgtgcaactggcatcgctgccgatgacgattagtggcaaattggatgcagcggcgttaccagagccagattttaaacagagccgctatgtttatcgtgccgcagaaacggagttagaacaccggctgcaaaatatctggcacgggattctgggtttggacgaaatagggattgatgacgactttttccatctggggggcgattctatttccgctatccggttggtttcggaaatgcgtcgccagcagttgccatgcagcactaaactattatatcaatgccgtacgattgctgaactggcggtacaactggctaccactcctgattcccagatgatgcattccgaacagggaatactacagggtgattttcctcttcatcctattcagcattggtttttcgagcaggtgttttctgaacctcatcactggaatcaggcttttttgattcgggtgccgcctttacaaccgcagaaattggaaacagcgattcaggcactggtggaacggcacgatatgctgcgagccagatttattcctgctgaacgccagctttatctggatatcaatcaggtcgcaccaacggcgctggaaatttggcattatgacccgttgaccgatgacgcattccatgactgtctggatagctggcaaagtgatttcgatattacggctggcccactgtggcgttttgcctatattgatggctatccagatggttcagcccgcatttactgtgccttgcatcatctgattgtggatgccgtgtcatggcgcatcctgcttgatgatttaaaacagctttatcatggtaaaaacctcggcgccaaaacagccagctatcggcaatggcaggctgccttgactgaacagctttccggctttgaatctcagcgtgaattctggcagcagcaatgtgtttcacaatctgattaccggccattattggaggccagccatactcgtcaattcctgcaacaatctttagaccctgccaccagtattcgattgctggatgtgaccacaggtgcggcaagttttgcgcctaatgaagttttactgactgcgctcctgcacgcattgggtcatctcagtggaataacgaaccacacgttgcttctggaaggtcatggtcgccatctgccatcggtacagttggatgtgggtcgtactgtgggttggtttacggctctctatcctctgcatttttctgttgagggtgaagagacgatttcattgcagcaagttcataccactcttggcggcgtacccgattcaggcatttcatacggggcattgcgtcatttgggggctgaggcgtcggcattgtctttgccctatcccggggtgatattcaattatctggggcagttacaggcgcctgaaaatgattggcagatcagtgcagaatcggccggacaaaccatcagcccacacaatgttgattccggtttgcttaccctcaatatctggcttatcggccaagagctgcattatcgttgggatggcttactcagccagtcgcagcttgctcagttggatcacggtttccaaacagccttgatatcgcttatcgacacgatggcaccatcagccagtaagattcagcaggcagtggacgatgggattgatgccgcattactggctcgattaccggcaggattggcgcccgtggttgcttatcccgccaacagtctgcaacaaggatttatccatcattatctgagttatcccgataactcaacctaccactttcagtttgtcctggattacgaacaaccgatcgatctgaatgattactaccgcgcttgggaatacgcccagcagcgatatccggtgttgcgtacaggctttgactggcaggaacagccacagcaaattgtgttcaggcaggctgaattattatggcaataccatgatttcagtaccagtccgacacaggagcagacactgactgcgctttgtcagcaacaataccacgaatctttcgaactgaataaaccagagctgatgcgggtttgcctcgttaaactggctgccgaccgatacagcctgatccacaccagtcatcacattattattgatggctggagcagccagatattgctggaatacgtccatcgcacttatcagcagctacaggcgggacaaatgctcgatacctgcattgatacagcctatctggcgacccagcgttattacgccagtcaggttgcagagtgccgtcatcactggcaggaattggggactcagcattgggagagtacggatatttccctgttgctggctcgtggtgcacggaatacctccggcaatgaaacgcctgatactcaggcggtagtgcgtcaggtattgcctcatgcagtcgctttgtcattacaggaaaccgcccgcaatcatggcttgacactcaatgtcatgcttcagttcgtctggcacaaattattacatctgtttagccaacaatcacagactatcgtgggtatcaccttgtctggccgcaaccaccccgtatcaggcatagagagcagtgtcgggttattcatcaataccttgccactggtgatggactgggaaccgcaatcgacttgtctgcaacagcttcgcacgcttcatcaacgcatgattgatttggatacttacagctatcagccactggccgaattacaatccgcgggtgaaaagttgttccaaactatttttgtctatgaaaattatccaacgacagaattagataccctgcgagccaatctgcgggctaccagtgacaatacgaccgactaccccttgaacctgattgctgagggcgatgtagaacaaggtttgacgctatctctgtcctataaccagaattgccttgatgctgaacgtggcaacgccattttgcagatgctgggaacattgctggcgcgtcttccttcccatcttcactatccacatcagcggttattggcgctgagtgatgacaaacgccaacaactgttagaagaatgggcttttgcagttgatcaagacttggaactgatgactctgcatggtttgctggaaaggcaggcgcgattaacaccgcagaatccggcgttaatggatgattaccggacattaagctatcaagagttggatgagattacatcacatcaggctgttcggctgcgggcggcatatcgtcgtcttttccagcgtgaattagcgtcaggtgagctgataggtctgtgttgcgagcgcagtatcgacatgattgtgacattgctggcgatcctcaaagccggggctgcttatgtgccgatggacacaaatgttccggcagagagactgaattacatcctacaggacagccaaataaggttggtgctgacggaacccgctttggcaccgctgtttgagcgccccgatctacaacagctatacctgagcgaattggccgatccagaggccacagacgaaatacaatcgcggttgccgcaggtggaaccaaggcaattggcttatgtgatttacacatcaggcacgacaggcaagccgaaaggtacgctggtggaacaccggggttctgctgccatggcgcgtagtttgtttacccgaatggaaatgacgcagtcaggcatgcgcttcctgcaatttgcttccattgtgtttgatgcccatctgatggaaattttcccggcatttgtgggtggacattcgctggtggtggcatctgacgcgcagcgttatgacttgcaggaattgcaaacgttgttgcagaagtggcagattggttatgcgatgttgccgcctgtgctgctcaaactcaaaccgacgctgccggatagcctgcaatggctggcggtaggcggtgaagcctcctctcaggatgtattggatcattatgctgcacaggggcgtaatgtattcaactgctatggtccaactgaaacgagtgtctgctgcactgttaacccttatcgctataatggcgcgtgtaacatcggcagaccattggcgcagtgtgcggcttatgtgctggatagtgatttgcagccgttgccagtgggtgcacccggtgaattgttcctatccggcgtggggttggcgcgtggctatttgaatcaatcagaattaagccgtgaaaaattcattcctaatccattccagcagcacccggatcatgcccgcttatatcgcacgggcgacattgtgcactggctggatgggggctcgttggaatatctcggtcgtaatgatagtcaggtgaagattcggggacatcggatcgagcttggggaaatcgagtgtgtgctcgccaatatcgatggtgttgatcaggctgtggcgatcattcatggcaaggaatccccaaaaatcgtctgctactatacattgagcgacaacacattgaacggtagtacatcgaccgataatgagctttcgtccgagatccggcagacattggcacaggtgttgcctaactatatgcaacccagtgcgttgattccattgccccgtattccgatgactatcaatggcaagctggatcgccgcctgtgtcctgcgcctgtttttacggatgtacagcaggagtacactgctgctgagacgccgctgcaacagcagtgttgtgatatttgggcggagttgctgcaatgtgaacgtatcggcatagacgataactttttccggctgggcggcaactctattatagctatccagttgagtaatcgtttgagccagttattgcagtgcaccatcccattagtggcgttgaatcggcatcctactgtcagatccctgagtgccttcctgtccgataattgcacacaccttgaagtgatcccgcaagctgggttgcaacgtggtgttctgtctttttcacaaatgcgactctggtttatcgaaacgctgatgcaggaaaacaatgtttaccacattcccctgttattccgcttgcagaccgatattcagatggacagttttgttcatagtttgcaagccgtggtgcatcgccatcagatattacgttgtacttttgagcaagatgagcacggagaatctttcctgcaagcccatgatgaggcgctggctgttgcccatgcggaagtgcaggcggatgagtggcatgatttcttacagcgggagattttccgtatctttgatttacgccacgaatatcccatccgggcgacgctgttacaacgggtagaatcagatggacatgtgtctcatttctgtctgctcaacattcatcacatcagttttgacggctggtcgttgaatgtgtttttaaaggagttggccgagttttatggtgctgaattggacaaacgtccacccgcactaccgccgttatccatccaatatatggattacgtcgcctggtaccaacaaatgttgtccagcgataaactggaacagctaaaacaattctggctgaaacagttgcaggattgtcctcagttggaacttccctgcgactatccgcgccctgatatttttgaccatcgtggcagtacgactttcttctcccttacgcctcagttaagccagcaactgcggcaactggcgcgccaattggatgtgaccttgcatgcggtcttattgacaggcatgaaccttttgttggtcaggtattgcggcaagcacgatattgtcatcggtagcccgatagccaaccgctcacacccgcagttggagccactgattggcatgttcgtcaatatgttggtactgcgtaatcagatatcgccagagtggagcgtggctgaacaaattcgtcaggtctttgccagcacgattaccagccagcagcatcaagagatgcctttcgaaaaactggtcgaattcctgaagttaaatcgtgatttatcacgccatccgctgtttcagatctctttctcgctggagcagaaagcgacggatgttgatgcccctttcagcatgcaaaatctggcggagttatatgacgttgccaagtttgatctcagcttcgggtttgaagaggggaatgatgcgctgtccggcaacattaactacaccaaggcgctgtttgcgccggaaaccatcagtgaaatggtcaggcacttccagaatatattgatgcaaatggtggctcatccggaacaattagtgcaagacatcagtctgtattcaccggaagagagaatggctctgttgcaaccgccgatggaaacgcagaatgcggctctctacagccatccattgtatcaggggatcctcgattggactcggcagcagccgaatgacatcgccctgattgatactatcggccagtgcagctatgccgaaatgcttcagactgcgcagatattggccgcgcagatccatcaacatccgcgtaatcaatctgaactgatcgtcattcaggtaagcaaaggcagggcgcagattattgctgttctggctgtcttactggcgggacgagcctacgtacccgtcgatatttcctggccgcagcaacgctgtcagcagatcattgatcagactgaaacgcagttggtaatcagtagcaaagcgtggacaaccgaaacctgtggaatcatccaacttgatccgtacggctgtgccattcacctgactgagcctcaaccgatgtcattacccgtgccgatcccctgtgacagtctggcctatgtgattttcacctctggctccacggggacaccaaaaggcgtggctgttcgtcatgacacggcctgcaacaccttgatagacatcaaccgtaaattgaacgttgtgcggggagataccttactggctcttaatgccctgtgctttgatttatcggtttatgacatgttcggtattctgggcgtggggggaaggctggtgatcccaagtgaagagcagcgataccagccagagaccttactcagattaatccgtgaacacggcgtcacgatctggaatgcggcaccggcgttgttcgaattgctattgcaggaagtagaaaatctggtagagcggccaactgttgcgatggatcgcgttctgttatccggtgactggataccggttaatcatataccgcgctgccgtgactggctccccggttgccgcgtctttagcggtggtggcgtcacggaagcttcggtatggtcgattctcttcgaagtaccacaaggcgccggctatagccagagcatcccttatggcaaggcactggttaatcaatacttccttatcttggataaagatctggaacctgtacccgctcaggccatcggtgagatgtatatcggtggggtcggtgtggccattggctactatcgggatccggcacgtacagaagaacgttttctgcaacatccgatcagtggtgaacgcctgtaccggacgggagatttagggcgctggttaccggatggcaacattgaatttctgggacgaatagacagtcagatcaaaattaatggttatcggatagaactgggggaaattgaaaatacgctgatggcaataccgggcattcgccagtgtgctttggttaaagtcagtggcttatctgatagcctggctgcctattatgtcagtgacgaaccgctggatgaagccgatgtgcgtcagcgcctcgcacaagtgttgccgccgtatatggtgccggctgtgttgacgcatctgccaaaactgccgttgaatgccagtggcaagatagaccgtaaacaattgtcggcgttaaattacatcgcgccaagacagcatcagtatcaaccgcccgagaccgaacaagagcagcaactctgtcagttatggcagcagaaactggagctggatcacgttggtgtaaacgatgacttttttgaatgtggcgggacttccattctggctattcctgtttgccagcagatgtcggccttgctggggcaggcggtcactgtgatggaactgttcaagcggcgtagcatccgtggcattcttgcaagccttgaatatcaactgatccagccattgaataacggttcagctaaagaaacgttatggatgatccatccggctatggcgggatgcgaagtttatctggacatcgccagaacgctggatggcaaactgacctgtttgggcgtggataattataacctgtaccaccggccgttaatcatgtcactgcgtgacatagccagtttctatctggagcagatggaacggtatcagccattgacacaaggcccggtacgtatgttgggatggtcaatggggggattaattgcgctggagattgcggcacaactggaagccagagggatacgtgatacccatatctacctgctggacagcttctatcgagtcagtctgggggctttacatccaagctggcggcagatgctattacaggagctggggctggaaggggatgccgcggtacgagcgctggaggccggccctgcggacgatgcgatttgccagcatgagctttcgcaacctctacaacatagcccggtcactctattcaaagcgactcagttgccggagttccacgctcaattaaacgagcagggaaaaataccggcagcactgcacgctgatgataaccagatagggcaggcttgccggcatctgtctgtcataccactgctttgtgaccaccacaatattatcgagctgaaagcacagattattgaaggtgtgttggagcgggtggattga

SEQ ID NO: 2385 - DNA, 138 bp, Xenorhabdus bovienii
  Coding DNA location: Contig name=SeqID_16870; Position on contig =80974..81111bp; Strand=+
atgggaaaagaaatgcctcaactaccctcatacctaaattggctgacagatagatatcgtgaattatcgtcgttatcggaatttttaattaggcaggcatcctgctttcgagacatattcagccgattatttgattaa

SEQ ID NO: 2386 - DNA, 228 bp, Xenorhabdus bovienii
  Coding DNA location: Contig name=SeqID_16870; Position on contig =81104..81331bp; Strand=+
ttgattaaatatggcctcttactgcctctttttttattagtcttcgtccttgatatagccgtgcatagaattgaaggttgccctagttactcaattatttttttgaaaataatcaattatataaatagtaacaaatggaaaattaacttaatgttattaattaataaaatggcgtttcatacggtaatagctttattattctgcatagcggagttaattcagaagtaa

SEQ ID NO: 2387 - DNA, 114 bp, Xenorhabdus bovienii
  Coding DNA location: Contig name=SeqID_16870; Position on contig =81832..81945bp; Strand=-
atggttttagcagaagaaaagatagctgacgcccatttcgggcgttattattttattccctccacaaatatcttattttcctctcctttcctctcctctccattcatcctctaa

SEQ ID NO: 2388 - DNA, 531 bp, Xenorhabdus bovienii
  Coding DNA location: Contig name=SeqID_16870; Position on contig =81917..82447bp; Strand=-
atgagtaaattgaggggaggtggtggattaccgccaaagccggatcttgttcaattaatgaaaggattatcaggcggttttttggggatcttgttgctcagttatttaagccaaacgacggaatatccttggttaatggcgccttttggagcgacatgtgccattttgtttgctgcacccacttctccgcttgctcaaccccggaatgttattggtggacatttactcactacggctgtggggcttgtcgcactatatacattgggtaattccatgattgtgatgtctctggcagtcggcattgcgattatgctgatgcagttatttcgggtagttcatccgcctgcaggggctaatccgttagtggtacttctcgcagggcaagaggccgtaggttttgattttcttttaacgcctgtcttaacgggtagtctggcgctggtcatcattgcatcttttattaataacataggaaaagaaaactgttggccattatattggtatggttttagcagaagaaaagatagctga

SEQ ID NO: 2389 - DNA, 555 bp, Xenorhabdus bovienii
  Coding DNA location: Contig name=SeqID_16870; Position on contig =82624..83178bp; Strand=+
atgagcaaagaagaacatatcttagatatcgctgaatccctgtttaatgaattcggctataacgcggtgggagtcgatttgatccgagataaggcgaatgtgtcaaaaacatccatgtaccgctatttcggttccaaaaataaactgatagagagtatgttaatcagacgacataagaggtttgaagaggaacttaatacggtggtgttcgccaccaagggaatggaaaataagctgaatgctatccttgactggcacttctcatggttcagatcagccgattttcaagggtgcttatttatgcacgccttagccgagtttaaaggccacgatgagcttattgtcaaacaggctcaatgccataagacgtggttaaaatcactcttattttccattttctctgccaatcagacggatgcagaaatcaaaacagaagcccttatgacatttatagaagggatgatagtgagagcagagtttggcgaaatgacaggccacgaggagatctatcgactatctgccaagatgatagcctcaatgtgttttctgagctga

SEQ ID NO: 2390 - DNA, 93 bp, Xenorhabdus bovienii
  Coding DNA location: Contig name=SeqID_16870; Position on contig =83372..83464bp; Strand=+
atgaaaataatttgtctgtttaaagggaggtcagacttcccttatcaggacccagacaaaaaacttaattataacttatattttaacgattaa

SEQ ID NO: 2391 - DNA, 141 bp, Xenorhabdus bovienii
  Coding DNA location: Contig name=SeqID_16870; Position on contig =83755..83895bp; Strand=+
gtgacacatagcaaaagtgtcaacccatcacatgacgacgatgcaaaacaaaataagacagggttttatcaaaaaatggcatggagaagttccccatgccattcattagtttgctgttttaccaacccaccgattaaataa

SEQ ID NO: 2392 - DNA, 858 bp, Xenorhabdus bovienii
  Coding DNA location: Contig name=SeqID_16870; Position on contig =83860..84717bp; Strand=-
atgggaaaaaaatataaattactgggatttaacagtcaagatagtacagcgaatgtattaattttatcaacaggaaaagttttaaaaataaacgtaaaggagcttgagaaaagtgaaatagcagacgatctagacaatcacgaaataaaatcactttatagaaagatatattctagctttccaaatgtcccctcagtctatgaaattgaagaacgtaatgaaaaatcttgggttgtttattcatttctcgcgttactactgacaattttctacactttcagtaatatagcggcagctaaacccgtttacattgattatcttgatatcattgttaccccaggtactttcatttatcctttttcatttttagtcattgatttactgagtgaattttatggattcaggctagcaagaaaagcgatatatatgtcattggcttctaatctgatcattgtatccttgctgagtatctcgacaagtctacctgccatcgcaaactgggatttaaatgatcagtacaatgccctgatgaatcatattttatcggcgatctttgcttcttcactgtcatttctagtttcagagcttgtcaactcctatatcttatgcaagctgaaggatatgacaaactcccgatttttagcgttaagagtattttttagtacctttatcgcatcaattcttgacagttttgttttctgtttcatcgcattctatgggaaactgcctgtaaatcaaattgttgtcatgatgcttgttcagattttaattaaaattttctttgcattatttaatattttccctgcttacggctcacgttatttatttaatcggtgggttggtaaaacagcaaactaa

SEQ ID NO: 2393 - DNA, 615 bp, Xenorhabdus bovienii
  Coding DNA location: Contig name=SeqID_16870; Position on contig =84701..85315bp; Strand=-
atgtataaaaaacaaaaaatggaacacctgagaaaaaatttgcaatacttacttgattccagaggagagagtagggtatcgatctgtgatcgaaccgggcttaaccgcacgactatttataatattctggatgggagagttcaaaacgttcattcttcaacgatacagaaagtatccaacttttttggggtgtcgtatagagagatagaaacgatcgatattgcagaaaaagaacgcattgatgccattgtttcttatgaaggaaacatgaacccctgtgccgttccgctatttatgcaatctgaatgtattatctctgggttttttgacagtaaaatcggctcgcttattgttgaaagaaaactcacttattattttggttctggcccgaatattgttgctattctacttgagaatgatttcccaggtaaatataatgcgggtgatttattaataatcaaaagaggtaattaccagaacaataatccaaagttatgtttcgatcaaaggcagcaactgtttcatattaaagagtttaatagtgaagttacgacaaatttgatggtgattggagatataatggaagagcggttcggatatgggaaaaaaatataa

SEQ ID NO: 2394 - DNA, 138 bp, Xenorhabdus bovienii
  Coding DNA location: Contig name=SeqID_16870; Position on contig =85344..85481bp; Strand=-
atgatagttttattatattattatataattctgttcaaaaataaattgctatcactttttatgttttacgacaagggtatttttcactctttccagacccaacaaaaagtgtttatcctaaaaagtcatgtaaattaa

SEQ ID NO: 2395 - DNA, 696 bp, Xenorhabdus bovienii
  Coding DNA location: Contig name=SeqID_16870; Position on contig =85723..86418bp; Strand=+
atgagtttttcctataaaaataatgaaccctatctcaagggattgatcgccatgatggaacatctaagcgatccttggggcattaaggatttagcgtcccgacatatctatatgaataaagccgcttatctttacaccaacacaccagaagattttgacatagagggtaagcttgactgtgaatttccaacacattggtctgaggatcaattttcacaagacctaaaagaacatgacaggagaactgaagaatctaaagacaaagtttctatcattgagacacattattggtatggaaaaaacagcttagctcctttcatcagtgagaaattccctgtgtataacgataaaaaagagtgcatcgggatagtttggaatgccaaaccaatgagtactctctcccctctaaaatatattaatcgccaaaaaccaagcgttctcactacagaagctacaacagatctatttaccaaaagtgaactggataccatcttctttatgttgcaaagacgttcaaataaggaaatagcccagatatacaatgtcagccataagacgatagaaaacagaatatacaccatctatcagaaggctaatgtccactccatccagcaatttgaagaattttgcaggcactttcaattagatagctatattcctgaacgcctcattgaaaaaggcgtcctctttatctaa

SEQ ID NO: 2396 - DNA, 1296 bp, Xenorhabdus bovienii
  Coding DNA location: Contig name=SeqID_16870; Position on contig =86435..87730bp; Strand=+
atgatagtgctcaaaattgaacactgtccattaagccgagtgccacaagatcagcgcttatccctgctgtgtgtggccgtcgttcatatgggcatgttaacggcattggatcagtttatgcttggtgctgtactcggcaactcgatgactctgatcgatgcatttctcgccgtttttatcggcagtctgatctttggcgttgtcactttcgggctaggatttgcgggtatgcgcgaagggctgtctggcagtttgctggctcgctggtgtggctttggccgaatgggttcggtgttaatcggccttatcgttgctgtcagtttactgggctggtttggtattcaaaatgccatttttgccaagtctcttaattttgcctctggtaataaattgggatttggctgggcggcagcaatatccggtacgttattaacaacgctggtcgcttttggctttaaggcactgcgctttaccgccagcattgccgttcccttgtttattctactggtcgcttatatctcaactatcgtgctatcaggcaaagcaggtcagcctctgcatgaggtcataaacctgccccattctggagaaactttatccattagtgccggtatcacaattgttgtaggtggtgcgattgttgccagttttatgacccccgatctgactcgctataccaaatcaggcaagcatgtttttgccattacactactgaccatcatcgcaggagagtttgtgattaatggtctggcgattctaattgcaaaagcactgaatacggcggatgtcgtcactattatgtcgcaagccgcgggtggagcaggtttattagttgtcgttttttcaacactaagggtcaatgacttaaatctgtattcttcttcattgggaattatcaacgccgtagagggcatcgcaggcaaaaaactgcgttacccgccaacaactgtcgtgatcggcgtgttgggcactgtgctttccattttaggtattctagaccgatttgtagattttctgactatacttggcgtcgtattcccgcctattcttgggattatgctagttgattactatatcctgcgtacccatcgcaaagtgctggacgaaagtcggcagaaaggaaaccttcccaatgaaacacccaccatcggctgggcagctattatcgccagtattatcggctgcattgttgggttagcgacggaatggggtgtaccaacaataaactcattactgatggcgagtgtggcttattggctatttaagatcgcctttagccgccgctctctgccataa

SEQ ID NO: 2397 - DNA, 831 bp, Xenorhabdus bovienii
  Coding DNA location: Contig name=SeqID_16870; Position on contig =87774..88604bp; Strand=-
atgtctaagctactgtcaaaataccatgcgcctgatcaggacaaacgtacacagcatatcacgccagaaacagcaaactggggatatgtccactttgctgtttatgaactgaatgcgggagaatctattacattgcccgcctcggaaaaagaaacctgtttagtgttggtagcgggaaaagccaccgtaatcactcccttgcagcgatttgaccagattggcgagcgcatgaatccatttgaacgtaaaagaccttatgcagtttacgttacgccgaatgaatccatagaaattattgcgcagactaaccttgaactggctgtctgtcaggcgaaaggcaggggaaactatcccactcgcttgattgcgccgaaggatattaatgctgagcagcggggcaacgaaaataaccgccgctatgtccataacatcctcccagatgacaaatcagcggatagcctgctggtggttgaggtgtatacagacgaaggctgtaccagttcttatcccagccacaagcatgacactgataacgaaccacaggaaacctatttggaagagacttattaccatcggttaaatccatcgcaaggtttttgtttacagcgtgtttatacggatgaccgttcgttggatgaaacgatggcggtttataacaaagatgttgtcatggtgccgaaagggtatcaccccgtggcgactattgccggatatgacagttattacctgaatgtgatggctggccctagccgtaagtggttatttacatgggaaaaagaccatcagtgggttaatggtgcagagtatgcggaaaaacatacccgccgttaa

SEQ ID NO: 2398 - DNA, 891 bp, Xenorhabdus bovienii
  Coding DNA location: Contig name=SeqID_16870; Position on contig =88664..89554bp; Strand=-
atggctgttcaacttggcatcaatcctctgacctggactaatgatgacttgccttctctgggcgcagaaaccccactggaaacttgtctgaccgaaggccgtcaggcgggatttgctggttttgaactgggcaataaatttcctcgtcagtctcagatcttggggccaatactggcttcccataacttgaaactggtgtctggctggtactccggtaacttgctgacacgtagtgtagaagaagaaattgctgccgttcagccgcatttgaccctgctacgcgaattgggtgccagtgtgatggtgtttgccgaagtgactgactgtatacatggtgatcagggaaaaccggtacacctgaggccattatttccagtcgaacgctggcaggaatatggcgaaaaactgacggaattcgctcgttatacccagtctcaaggagttcagattgcttatcatcaccatatgggaaccgtgattgaaagtgcggaagatgttgatcacttgatggagcatacaggtgaagaagtcggcttgttgctggataccgggcatttgacctttgcgggagatgatccgctggctgtggcaaaacgttggtgcacacgtatcaatcacgttcattgtaaagacatacgcccagaggtgttgaaagatgtcaaaaaccgtaaaaccagctttcttgacgcggtgttgagtggcgtctttactgtgccaggtgatggttgtgttgattatcctgctattttcaatgtattgaagactagccactatgacggttggttagtggtggaagcagagcaggaccccacgattgcccatccactgacttacgctacgctcgggtataataacctgcacaggttcgcgaaagacgccggattgatttaa

SEQ ID NO: 2399 - DNA, 1905 bp, Xenorhabdus bovienii
  Coding DNA location: Contig name=SeqID_16870; Position on contig =89627..91531bp; Strand=-
atggatcagtataaaaagtttgatgttatctgcatggggcgaatcgccgttgatctgtatggccagcaaattggtacccgtctggaagacatgggaagtttttctaaataccttggcggctcttcgggcaatgtcgcttatggcactgcgcgccaggggctgaaatcttctatgctggcaagggtcggtgatgaacacatggggcgttttctgcgtgaagagttgcagagggttggctgtgataccagccatttgatcaccgataaagaacggctgacggcgctggtattgctcggcattaaagataacgaaactttcccgttgatcttttaccgtgataattgtgcggatatggctatcacccgtaatgatttcagcgaagactatattgcatctgcccgttgtttggcgattacaggaactcatctttcccatccacaaacccgcgatgccgtgctgacagcgttgcaatatgcccgccgtaatggagtaaaaaccgccattgatatcgattatcgtccggtattgtgggggctgacgtcacttggcgatggtgaaacccgttatatcgcatcagagcaggtgacagcgcaattgcaggaagtcctcccccaatttgatctaatcgttggtacggaggaagagtttcatattgcgggtggctccacagataccgttgaagctctgcgttgtgttcgggcattgactgaggcgactcttgtctgtaaacggggcgcattgggatgctctgtgttcaacgcaagtattcccgatacactggatgagggcatcaccatacagggcgtcagagtggaagttctcaatgttctgggggcgggtgatgcttttatgtctggtttactgcgtggttatctgaataacgaaagctgggaacaggcctgtatttatgccaatgcctgtggcgcactggtggtttcccgtcatggctgtgcgcccgccatgccagataaaattgaactggataactaccttgctcgggctaaggatgtactgcgcccggatttggatgttcatcttaaccacttgcacagaattagccgccgtcacaaacagtggggagaattgtgtgttatggcgtttgatcaccgtatccagtttgttgaaatggcgcgtaaggttaacgccagtctcgaacgcatcccgcaactgaaaaaactgttattccgtgcaagtcaggaagtgatcgcggaagcccatcttgaagggcaggcaggaatattatgtgacagcaccttcgggcaggatgtgctcaattccgcgacaggaaaagggttatggattgggcgtccgattgaattacccggctctcgtccactgtgtttagaacacggtgacattggctctcagcttgtcagttggccactggagcatatcgtgaaatgtctggtgttcttccatcctgaagacaatcatcctttacgtctggagcaggaaaaaaccgtgcaggaagtgtacgccgcctgctgccaatcgggtcatgaattgttgctggaagtgattttgccatccgatatgacacattctgatgaattttacctgcgcgccctccagcgtttctacaatcttggcatcaagccggactggtggaaattaccgccaatgcaatcagcaacgtgggatcagattgaagccttggttgtacaacgagattgctattgtcgtggtgttgtgatccttggtcttgatgcatcagaggcaatcttgaaggcgagtttcaatgctgcggcaggtaaatccatcgtcaaaggttttgctgtcgggcgtacactattcggtcaaccctcactgaaatggctggctggcgaaatcgatgatcaaacactcattcttcagataaaaacgaattaccacaatctgattagctactggcgtcagcgtggataa

SEQ ID NO: 2400 - DNA, 1701 bp, Xenorhabdus bovienii
  Coding DNA location: Contig name=SeqID_16870; Position on contig =91543..93243bp; Strand=-
atgttagcttttctttcttttattgggtttaccctgctggtagcagggattgcctattataaaacgcgaaataaacacttaattgattctaccgaaggttattttcttggcgggcgttctctgaccggaatttatattggtagctccatgctattaatgaatttatccacagagcatttggtcggcttgaacgggttggcattcagaaccggatttatcgttatggcctgggaagtcatcgcggcattgaccatcgtgctgtttgccgtctatttcctgccaagatatctgaaattgggcatttcgacgatccctgaatatttagaacgtcggtttgataaaaacaccctgctgattacctcaattttatttctggcaatgtacgtaatttcgttattacctatcgtgttatataccggagcaattgcgctggaaagtttgtttcaggtgtctcaggtatttcaggtcgatagaactactgcgttatggattatggtttggggtgtcggtgggctgggcgcagtttatgctattttcggggggattaaggctattgccgttgctgatactgttaatggcgttgggctgattgttggcggattaatggttacggtttttgccttgttgtatgtcggggatggcaacgcgtggaaaggttttactgatgtttatcaggcacatcctgataaattcaattcgattggcagtgaagattcgctggttccattctccacgctgtttacggggctgattgtctccaatatgttcttctggtgtaccaaccaatccatcgtacagaaatcactgggtgccaagaatctggcagaagggcaaaaaggcgtgatgctgtgtgccttatttaagctcatcattccctctattattatcctaccggggattatcgcattccatattttcagtgggcagatagataatccagacaacgcttatcctgcactggtgcaattggtactgccaaaaattctggttggcttctttgctgcggtcgttgtgggagcggtattttccacattcagtggtgggctgaactcttccgtgactctgtttattgtcaatatctacaaaccgcgaattaacccaaacgcgactgaaacacagactgtggcggtcggcaaatatctggggcttggactggcgttggcaaccatgatcattgcgccactcgttgccaacgcgccggatggtttgttttacctgattcagcagctacagggtattttcaacgcaccgatcctgagtgtcgtactggtcggattaatgacgaaacgggttccaccgattgcagcaaaactggggctgttgtttggcgtatcggcttatatcatctgcaactttatcctgcacatcaatattcacttcttccatttggtcggcattttattcgtactgaatattatctttatgctgactatcggttatttcttcccggctgaaacttatcaggaagtgtatacaaagcaggtcgatattacgccgtggtcgatggtaaaaccgatgggatggttaatcacactggctgccatttccatgtatgttttcctcgcacataacgtgcctgcatatgtaatggtgctctactctgtatttgccgcaggtgttctgggctatgtcttctatcaaataggcagtgcactgtttaaacggcctgtcgcggcgaaggcgccataccgtattcggtaa

SEQ ID NO: 2401 - DNA, 993 bp, Xenorhabdus bovienii
  Coding DNA location: Contig name=SeqID_16870; Position on contig =93303..94295bp; Strand=-
atgttcaatattgcattatttggcgctgggcggattgggcaggttcatgcggttaacattgctaatcataaagaaacttgcctttattccgtggttgatccccatcgggcaagtgctgaaatgttggtacagaaatatcaggcaaaaatacagaccatcaaagaagcgatgtccgaccctgatgttcatggtgtccttatcgcatcagcaacgcatacccatgccgatctgatcgagctggcagcccggcacaataaaacgattttctgtgaaaaaccggttcatcttgatcttgagcgagttcgtcagtgccttgctacggtaaaagagtgtcaggttcctctgtttgtcggctttaatcgtcgctacgatccccaatttcggcggctgaaaaccctgtttaatgcaggcatgatcggtaaagcggaatccctgctaatcacttcgcgcgatccgtcccctccgccagttgaatatgttcgggtgtctgggggcatgttccgagatatgaccatccatgattttgacatggctcgttttatcattggtgaagagccttgcgctatttatgcacaaggcagcaatcttgttgatcctgcgattgggcaggcaggcgatattgataccgcgtttattgttatgaagtttccgtccggggcaatggcaaccatcactaatagccgccgttcgggatatggttatgaccaacgtctggaattgcatggtgagaaaggtttgctgactgccggcaatatcaaagaaaacagcgttgaactctggggtgaagaagggtgtcttgctgctaaacctgagcactttttcctgcaacgttatcgtgaggcctatattgcggaatggagtcactttgtcgatgtcatggcaggcagagcgatacctgaaaccaccgccattgacggtgaacaggctctgtatcttgcagacaaagcgctcgaatccctgctatccggccaagaaatcaaactaccgctgtag

SEQ ID NO: 2402 - DNA, 111 bp, Xenorhabdus bovienii
  Coding DNA location: Contig name=SeqID_16870; Position on contig =94298..94408bp; Strand=+
atgctccttaatgcctcggtgtctgtttttggtatgaataaaaatatatcaagcaaaatatttatttcaattttttactctttgaaaattttattttttagagatggttag

SEQ ID NO: 2403 - DNA, 99 bp, Xenorhabdus bovienii
  Coding DNA location: Contig name=SeqID_16870; Position on contig =94405..94503bp; Strand=-
atgtttttaaaggttattctttcatttatcaaaagtgattattttaactttcatgacaggtatgacactgaattcatttttttcatcacaaaatgctaa

SEQ ID NO: 2404 - DNA, 1950 bp, Xenorhabdus bovienii
  Coding DNA location: Contig name=SeqID_16870; Position on contig =94638..96587bp; Strand=-
atgaatacagcggcaattaataccaagaaaatgaccatggcgcaggctttggtcaaatttctcaatcagcaatatattgacgtggatggagaagaatatccttttatccgtggcgttttcacaatatttggtcacggtaacgtcgtgggattggggcaggcgctggaacaggaacccggtcatctccgtgtctatcaaggatgtaatgagcaggggatggcgcatattgctactggctttgccaagcagaaaaaacgccggcagatttttgctgtcacatcttctgtggggccgggggctgccaatatggtgactgccgccgcaacagcgacagctaaccgtattccattactgttattgccgggtgatacctttgcctgtcgccagcccgatccggttttgcagcaggttgaacagtatggtgatggtactatcagcaccaataattgtttccggcctgtttcccgttattgggatcgtatttccagacctgagcaattgatgagtgccatgatccacgcgatgcgggtattgaccgatcccgcagatacgggggcagtcacgatctgcttaccacaggatgttcagggtgaagtgtgggattatccccattacttcttccaaaaacgggtacatcgtcttgaacgccgcccagcctctttgccaagtattcaggatgcgctggaactgattcagcgcaagaaaaagccgctgttaatttgtggcggtggtgtgcgttattccgaagcgcatgacgcttttcgccagtttgctgaaatattcaatattccatttgctgaaacgcaggccgggaaaagtgcgattgtggcggctcatccattaaattgcggtggtattggtacgacgggctgtctggctgcaaacctgctggctaaggaagcggatttaattattggtgttggaacacgttttactgatttcaccacggcatcaaaatccctgttccagaacccagaagtggaattccttaccatcaatgtggcggaatttgacgcctgtaaactggatgctgtcggtgtcgtcgcagatgccagagaagggctgagtgtcatcgtgcagtcattggcaaaaacagcatggcgttcaggctggcagcaggaaatttcgcaggcgaaagcagcttggcaacaagagttggagcggttgtttgccattcagtatcaggccggagataaaccagaaatctcgggtcatttagatgacaaactaggcgaatacagtgaaacgctgcaaaccaacctgactcagacgcgggtactcggcctgatggctcactatttggagccgaacgcgatcattgtgggagcggcaggctctctgccgggggatttacagcgcgtatggcagccaaaagagcctgatacttatcatcttgagtatggctattcctgtatggggtatgaaatagcggcctcgctgggagcaaaacttgcctgtccggatcagccagtttacgcgatggtaggggatggttcttacctgatgctgcatagtgaattacaaacggcgattcaggaaaacatcaagatcacggttctgttgtttgataatgctgggttcggttgcatcaataatttgcagatgagtcaaggcatgggcagtttcgctacggaaaaccgttatcgcaatcagcagagtgggcggctggatggggggctggtgcaggtggattttgccaagaatgcggaaagttatggctgcaagagttatcgggtgcatgatgagcagcaattaattaccgctttgctggatgcccaaacacagccgtgcgcgactttaattgatattaaagtgctgccaaaaaccatgacccatgattatgaatcatggtggagaacagggacagcccagatcgcggataacccagcgattacacaggcggcggaaaacatcagggaatatgtggagaaaaagacgcgccaatattaa

SEQ ID NO: 2405 - DNA, 165 bp, Xenorhabdus bovienii
  Coding DNA location: Contig name=SeqID_16870; Position on contig =96591..96755bp; Strand=-
atggagcaggttaaaaattttgttggtgggcaactcattggccgtcaaagtgatcgccgctcatccgtgtttaatccggctactggtcaggaaatccgtcaggttacattgagcacggttcatgagactcacgacagcagctttgtcatgccagcgatggagtaa

SEQ ID NO: 2406 - DNA, 195 bp, Xenorhabdus bovienii
  Coding DNA location: Contig name=SeqID_16870; Position on contig =96821..97015bp; Strand=+
atgaaatatacgtttcattttcaatggaaattgaaatgcactttaattaatgtgatcaacacgctatttttatgcaattgcattcatcagaaagtggtaacttgcgagcatcttcagcaggcttgtctgatgagtgaattatctatttcattacaatttattatggaggcattatgtctgctgcgtcgaacctga

SEQ ID NO: 2407 - DNA, 834 bp, Xenorhabdus bovienii
  Coding DNA location: Contig name=SeqID_16870; Position on contig =96994..97827bp; Strand=+
atgtctgctgcgtcgaacctgaatgagctgcaagaacaaattcgttcacgttatggtgagttaagcaaacggttacagcaagttgcaaaatatgtactggataataccaatagtgtcgcatttgatacggttgcggttatcgcaaaagcggccaatgttccgccttctacactcattcgcttcgccaatgcctttgatttcagcggcttcaatgagatgaaacaattatttcgtctgaatctggttgaagaaaccgccagttatacggatcgggcgcggttatttaaggagttggatggcgatcagcagataccggaagatccgcagcatattttgcaggaattcgctaattccaatgcacaggcaatgcagcaactcgccgctcgcacgccagcggaagatttaaacaaggccgtggatttactggtaaacgcccacaatatctacattattgggctgcgtcgctctttcagcgtggcgtcgtatctcacttatgccctcagtcatttggagtgccgctccttactggtgaatggtctgggcggaatgtttcgcgaacagatgaataggattggttctgatgatgttgtggtgtcaatcagttttacgccgtatgccgaagaaacggtgatggtcagtgaaagggccgcacaggcgggggcaaagcagattgtgattactgatagccaaatcagcccactggccagtttcagcgatgtctgctttgtggtgaaggaagcgcaggtggatgcattccgttctcagtcagcaacgttgtgcctggtgcagtcattaacagtggcgctagcgtatcggcaaggaaatagaaagtga

SEQ ID NO: 2408 - DNA, 105 bp, Xenorhabdus bovienii
  Coding DNA location: Contig name=SeqID_16870; Position on contig =97849..97953bp; Strand=+
atgctcagaaactattgcttttgggcaaaacgcattccagacaaaagtgggcttttttgcttgttatcttcacatttttgggaacgtgtcaccagtttgtattga

SEQ ID NO: 2409 - DNA, 1284 bp, Xenorhabdus bovienii
  Coding DNA location: Contig name=SeqID_16870; Position on contig =97980..99263bp; Strand=+
atgagatgccgcaggaatatattactacagcgacagcatccaaagataacgacagaatgtttcaacaataaccccattattcatcactcattaggagtttcccctatgcctgcagctatttgggctctagccatagcaacatttggaattgctacaaccgagttcattatcgccggattacttcctgaaattgcaaccgagtttaatatttcaatacctatggcggggtatatggcaaccagttatgcccttggtgtatttgttggtgcgcccgttttgattatattggggagacaggtagaaagaaaaaagatgctcgccatattaatgctattatttattattggaaatgctttgactgctttagctcccacattctatctggcaattgttggccgcatagtaacatctcttacccacggcgcttttatgggaataggcgctattattgcggccgaactggtgccagaaaataagaagacaagcgctatcgcatttatgttcagtggaatgacgcttgccaatcttattggcataccgttgggtacatggataggaaaagttatttcatggcgtgtcacttttgcaattattacctttatcggcattatctcattactcggtattttaagattattacctaaattcattcaacaaacgcctaccagtatcaaaaaggaattgctggcctttacaaatatccatgttctactggcgatggggatcacggttttaggccctgctgcattctttactgctattacttatatcgcgccattgatgacccatattgcaggtttttcagaaagcgcaatcacatggattcttgtcgtcttggggctgggatttttctctggcaatatcgtcgggggaaaactcgcggacaaggcgatgatgccattgttatattggacactggggttacaagccttagttttatttattttctggctttatggcgacaatccattcattgcctgcttgagtatatttctgatggcggcgtttggctttgctacagtatcgccaatccagcgtctggtgatggataaagctcaagaagccggtgcgcctaatctcgtttcttcagtcaatattggattttttaatttaggcaatgcagtcggtgcatggttgggtggggttgttatcgccgctaattatggttacgcttcactcaatttagtgggcggtctgctcgcctctacagcattactattggcggtaatttcaggtttccttacctacaataaagcgcgtgtagaagcgcttaaatctgcttaa

SEQ ID NO: 2410 - DNA, 510 bp, Xenorhabdus bovienii
  Coding DNA location: Contig name=SeqID_16870; Position on contig =99384..99893bp; Strand=-
atgaaaaaagataatcaattatgtaatgaaaattgcaatacaaacagaatcgatagtgagacagatagcgcaacagtgactccattcgaaaatgcattaggtcggctccagtgtgttcttgttgccagacgaacggcgactaatccggaaggtgtctcatgggctcaatacgataccctgcattttttgcgacagtttcaacctatgatcccaagtatgattggtgaaaagcttgggtttacccgatcaaaaacatccaaaatactacgttcgctcaaagaaaaggaattaatcgaacaagaatcgggtgaaaatgacaaaagagaactcgtgacacgtttaagtcataagggattgatgtttttgcaaagagctgagttgagtcgccataatatggcggatattgtcgcctccagcatgtcgcaaggggaaatagcaatatttacagagttgtgtaatcgggcctctaatctattgtattcagaaatgcctgtgaaacatgatgattga

SEQ ID NO: 2411 - DNA, 396 bp, Xenorhabdus bovienii
  Coding DNA location: Contig name=SeqID_16870; Position on contig =100098..100493bp; Strand=-
atgttaaacgttttatttgataagtatatcgaagccgttattgaaaagtcacctttaaagctggcttcattattctgtgatgatggtattttaaagttaccatttagaacaggtcgacctataattgagggtaactccaatattcttgaacattatttagcgagttttggtcaggcgccattagtatttatttcaattgaagatgtggaaatatatgatacggctgattgtgacacatttattgtcgaataccgattaaatggaaaaactttgccggaaaagaggggtttttattgtttatatatcaatgtgtttaagattaaaagcggaaaaattaaagaattacacgattacgaagatgtgttaaatagagagttaatactattaaataattaa

SEQ ID NO: 2412 - DNA, 1248 bp, Xenorhabdus bovienii
  Coding DNA location: Contig name=SeqID_16870; Position on contig =100581..101828bp; Strand=-
atggcagtgaatgaatcgcaggataaggtaactgagatttacatagatcagattcgtcaatctgatcatcgcgaaggagaattaagtttaaaacttgttctcgtgttgggcatgcttagtgcgatagcggcactttcaaccgatatgtacctgccattattccccgctatttcacatgcattaaatacaactccagcaggtgttcagttaagcctgacttcgtttatggcgggtctcgctgttggtcagttaattatagggccttggtcagatgtgatcgggcgtcgaaacctcctattggggggtatggtattgctcactgttgcttcaattgcttgcgcgctatcgaccagtattcaggcgctgattgtgggtcgtttttttcaaggggcaggaggggcggctggcatcgtcctaacgcgagctatcgtgtcagaccttagttttggaaataaggcggcatactatttcaacctcattttagcgatacaaggtgttgcacccattgtcgctccgttaatgggaggtgtagccgcattttttccttggcctgttgtatttatctttatggcaatcacttcattcaccctgactattttggctttcatctatgtgcctgaaagcctgccggaaaaaaggaatagccatgcggagggtgatggttttttaagtcagttttttaagttgtttaaaaaccggatttatatcggatatacattaatctttgctgcaacgtttgggatgctatttgcctatatttcatcttccccctttatttatcagtccatgtttggatttactccgacgtctttctccatcattttcgctatcaatgcagggattatgatgctgagtagtatcatgagtgcacggtgggttgtgcgcgttggggcaaaaaaactggtcatgatgggggttgtgagttcgtttggtttagcctgtatgttgctaggtgttaattacattgatgcttatcagtctgagctgaccattataattttcatgttgctcatgtttacgatggcatttgtgttcgggaatgcagcaagtttggcgttggctgctgtgccggaagttcgggggactggctcggcggttcttggcgcgtttcaatttggcgttgcttcgttgaccgctgtcttagcaggtcttggtcattcaatttctcttttccctgttgccaccgtgatgatgggatgtggggcgctcagtattttttccttaatgttagtgcgcgcaatgaaatga

SEQ ID NO: 2413 - DNA, 174 bp, Xenorhabdus bovienii
  Coding DNA location: Contig name=SeqID_16870; Position on contig =101760..101933bp; Strand=+
atgatcagattgacgaatctgatctatgtaaatctcagttaccttatcctgcgattcattcactgccattcatcccatataaagaaacatggtacgactatagcactggcaaaatatgatttcaatttggaaatcatattttacaacttcccgctaaaaatttataaaaattag

SEQ ID NO: 2414 - DNA, 759 bp, Xenorhabdus bovienii
  Coding DNA location: Contig name=SeqID_16870; Position on contig =102087..102845bp; Strand=-
atgagcactgtttttgatttcagtggtaaaaatgtctggatcacgggggctgggcgtggaataggttatcaaattgccagccgttttagccaggctggcgctaatgttactggatttgatgtggcttttcctgacgccgaaatcccttttacctcttatgtgttggatattagcgatcatctggccgtcagccactgttgccgtaagttgctgacacccgaaaatcacttggacgtattggttaatggtgctggcattttgcggactggccacacagaaacgttgagttgggaagactggcagcaatgccttaatgttaacgccggcggagcttttaacttctttcaggctgtgatcccacaatttcagcggcaatgcagtgggaatatcgtttctatttgttccaatgcggctcatgttcctcgcgtagaaatgtcagcttacggagcgtctaaagccgcgcttcgcagcctttgcctgagtgttgggcttgaattggcaccctatggcgttcgttgtaatttagtctcaccgggttcaacggatacgccgatgctacaaagcatgtggcagacaccggcatcaagacagcatactattgatggttttcctgaaaaatttaagttaggcattcctctgaaaaaaattgccttaccggatgaaattgctgacacagtcctgtttcttgcctctgatcttgccagccacatcactttacaggatatcgtcattgatggaggcgctacgctgggagcctga

SEQ ID NO: 2415 - DNA, 888 bp, Xenorhabdus bovienii
  Coding DNA location: Contig name=SeqID_16870; Position on contig =102845..103732bp; Strand=-
atgagcatccccaaactaaacgattatcctctgcctgctgctcaggaattacctgttaataaagtgaattgggcatttgatagcaaacgtgcggctttgctcatccatgacatgcagaattattttctcaatttttggcaacctgatagtcagctagtgacgcaaatcatcgataatattgcccgcctgaaaatacagtgccagaaacttggcatacctgttttttataccgcgcagcccgaccaccagagcgatgctgaccggggcttacttaatgatatgtggggggcagggctgaataaacaccctgaacagcaaagtatcactgacgcattagcacccgaaggtgatgacacgttattagtaaagtggcgctatagtgcttttcaacgttctgatttggaacagttactgaaaaatagcgaacgggatcaattaattatctgtggtatttatgctcatatcggctgcatgacaacagccactgatgcctttatgcgtgatataaaatctttcttcgttgcagacgcactggcagatttcagccgcgaagaacacatgatgtctctgcgttatgtcgcaggacgtagtggccgtgtactgacgactgcaacattgctcaatgaaatgtcaccttcttctctaggggagaataaatgggatcgggaacaccttcgtgctgaaattttaccgttattagacgatgattgtggcgacattgatgatcatgaaaatttacttgattacggcctcgattcggtacgaatcatgtcgttgataacgcgctggaataatcagggtcatcaactagatttcatcacactggttaaaacaccaaccttatcgaactggcttacgctgttgactgataaacaggaggtcagataa

SEQ ID NO: 2416 - DNA, 1629 bp, Xenorhabdus bovienii
  Coding DNA location: Contig name=SeqID_16870; Position on contig =103729..105357bp; Strand=-
atgaatattgaattcaatcactggcctgagaaattagcgcaacactatcgccaacgtggttactggcttgacttgcccctgagcgacatactcagccgccaagtcgctagtgaaaatatcgcccttattgctggcaaacatcagtatagttaccaccagctcaattgtctggtcgataatctggcggctggcctcaagcatcgaggggttcagtacgggcaaacggcgttagtccaattaggcaatgtcgcagaattttatattactttttttgctctgctgcgtttgggagtcgttcccgttaatgcgatattcagccatcaacgcagcgagctgttagcttatgctgatcagattacgccttcattactgatcgctgaccgtagtcatacactattttctgacaataattttcttcatgagctgcaacgacgttaccccacgctgaaaaaaatcttcctgcgtggtgataaccatagcccaatcgatttggctctattgcttgatgaaaaagcacatggcttcacagcttcccctacgccagcggatgaagttgcattcttccagctttcaggtggcagcacgggcattcccaagctgattccccgaacccataatgactactactacagtatccgcgccagcgttgaaatctgtcattttaatcgccatacgcgttatttatgtgctctgccggctgcacataattacccgatgagttcaccgggggccttaggcgttttttatgcaggtggtcagctcgttctggctaatgaccccagtgcatcaagctgttttcccctgatccagcaacaccagattaatgtgactgccttagtgcctcccgcagtaagcctgtggttagaagcgattagcagcacaggagacaactcgcccctcaagagcctggaattattacaggtgggtggtgcacgattgagtgaatcatcagccagaagaataccttccgagattggctgccgcttacagcaggtatttggcatggcagaagggctggtgaactacacacggctggatgacgatgaacaaaccattttcacgacccaaggccgcccaatcagcgctgatgatgaagtatggatagcggataaacaaggcaaccctctgccacatggtgtcgccggcaggttaatgacccgtggcccatatacttttcgtggctattaccgaagccctctgcacaacgaacaggtatttgatgaaaacggcttttattgctctggagatatcgttattcaaaccagcgaaggctatttaaaagtggtgggcagagaaaaagatcagattaatcgcggcggagaaaagattgctgcggaagagattgaaaatatcctattacgtcatcctcagatgattcatgctgccctgattgctatcccagacccactgatgggagaaaaaagctgcgcctatattgttacccgtgaagagataaaatctgccgtattacgccgtttcttacgtgaacaaggcattgctgattacaaactgccggatcgatttgaacgcgtcactcaccttcccatgacgcctgtcggaaaaatcgataaacaaaaattacgccaaatgacacagcacactccatttcaagtcggagaaacccaatga

SEQ ID NO: 2417 - DNA, 1185 bp, Xenorhabdus bovienii
  Coding DNA location: Contig name=SeqID_16870; Position on contig =105354..106538bp; Strand=-
gtgcctaatttagcaactgaattccgcatatcccaattgcaggatttttgttgtgatgattttgtgttcctgtcatctaataaaagtctacatgcacacggatgctttaccaaaataaccacgccagtcggttataatacagatactgactgccaattacatcgcgatatacctgagcttttccgtcaggctaaaaataaaggtattgaaaaccccattatagtgggtgctattccatttgataaacgtcagccttctgctctgtttattccggaggattactcttggctagagcgtgaggcattatctttttcatctgtttcttcctgccccaaattacagcagatacattcactgccggataaagacgaattctgccagatggttactcatggcgttgatgcaattcatcatggtttgctcgataaagttgtcctttcccgcctgctgaacatcaaatttgaccaacagcctgatgctacgcagttatttatgcgattgaatcaacaaaacccttatagctataacttccatgttccacttggcaacagcacccttatcggtgccagcccagagttactgctgtgtaaacaggggaataccattatctctcaacctctggcgggttcttcgcgcagaagcagcaacgtcatgcaagacaatgagttgcgccaatcgctattgcgttcagcgaaagatcagcatgaacatcaattagtgattaccgcaatgagaaaagcattagctgaacgctgtactgaattagctattcctgagacgccttcgttactcagcactcccttgctttggcatctcgcgacagaaattcgtggtgaattagccgataaccagatagatgccctctcgatcgcttgcttgctccatccaaccccggcactgtgtggtgctcccagacagcaggccgcgacgctgatttctgaattggaaccgttcaagcgcgactattttggcggtattgtcggttggtgtgatgccagaggtaatggcgaatgggtcgtgacgattcgctgtggtgaagtgtttgaaaaccatattcggctttttgcaggagcaggggttgtcgctgactcgaaacccagtgccgaatggcatgaaacagatgtgaaatttggcacgatgctacaggcgctgggattgtcttatgataaggaacgttgtttatga

SEQ ID NO: 2418 - DNA, 2199 bp, Xenorhabdus bovienii
  Coding DNA location: Contig name=SeqID_16870; Position on contig =106719..108917bp; Strand=-
atggtaatgcccacgaaaaaaacgctaaaaaataaaacaatcaaaagttacaataataaagtaccgttaatattaatttctgtattatttttatctcctcacgccgtaatagccaatgaaacggctaatgagaaagacaccatcatcgtcaccgcatcaacacagggcggctccagcggcttcgttgaatcagaaagttctgcgggcacgaaaagtgctgcaccactgataaaaacacctcaggcgatcacggtagtgaaccgtgcacaaatagaggctcagggcgcgacaacagtggctgatgccctgaattattccagtggtgtgattactaactatcggggttcttccaaccgtagtgatgaagtcattacacgtggtttccgttatgcgcccaaatttcttgatggattgagctatggtttaaacggccagggggctacggcaggccaaattgacccttggtttttggagcgtgtggagctcgttcacgggccagcatccgtgctatacggccaagtcagccccggtgggttggttagcatgaccagcaaaagaccgacggcacaatctattcataaagtgcagatgaaagccggtaatcagcgtcttggtgagtttgcctttgattttggcggggcagtacatgacgatattccccttttctatcgcttgaatggaattctcagtactcaacagcaattcgtcaaagactataaaaaggagcgtattgcaattgctccggcgctgacatggataccgaacagtgacacgacctttacgttactgactagttatcaatacgatcctaaaatgggattccgtaacttttaccctaaagtcgggactgttacgcctatccccaatgtgggctatatgccctatgatatgaatctcagtgagccttcttttaatcaggccagacgggagcagacttctatcggctatattcttgagcacgatattaatgatattttctctttccaacaaaccttacgttactcaagctcggatgaacgcactaaattgtttgtttatacaaaagatgttaccagttccatcattgggcgtcgcccacaacgtgaacataataaagcgcaggaatttggtatagataatcaactgaaggctctgttttcaacagctaacattgagcataacattatcagtggaatagattacaagtggggagacaggcacaataaaacatggaatgataaaaacccgggcagggaaccccaatatcgttttgactggtcaaatcccactaggaacgttcacattgatgagaaaaacctctcacttgactcaaatgataaaaagaaacttcatcagttaggtctctatttacaggatcaactcaattgggaaaactggaacttagttctttcagggcgttatgactggactgaagtcaagcaacaagatctcatcaagcacacatcaaaaaaacagaatgacagtgcgtttacaggacgagcgggtttattgtatgcgtttgataacggtatttcgccttatatcagttacagcacctcttttgaacccaacctggatacaggtgcaccaggtgccccggaattcaaaccaacaatgggtgaacagaccgaaataggcattaaattccagcccaaagaccacgataccctgctgacgctttctctgtttgatatcacccagaaaaacgtgacaacccgtgatccagttacccgcattagcgaacaaattggcaagattggctcaaaaggcgcggaagccgaaattcattctcaaatcaccccagaaatcaatctgatggcgtcgtatacttataccgataccaagacgaaaagcgatagaaaccctgctcgtgtcggtaaaagagtgcctgcggttcctgaacatgcggcttctgtatggggtagctatagcttcaaacaatccgtactggaagggcttacgctgggtactggcgtgcgttacctcggcaccacttccggtgattttacagaaaaattcaatgtaccgtcctacaccctctatgatctgatggcaaaatataatcttggtgaagcgtcacctcagttaaaaggtgctagcgtacaactgaacgtgaataacctgaccgacaaacgttatgttgcttcgtgctcgaatgacggagcctgcttctatggcagcggtcgcagcatttttgccactgtagcgtatagctggtaa

SEQ ID NO: 2419 - DNA, 108 bp, Xenorhabdus bovienii
  Coding DNA location: Contig name=SeqID_16870; Position on contig =108966..109073bp; Strand=-
atgagcgaagtttatcgattaatggaattaataaggtcgtcgcagaggagaataggactggaatcctcttatagagacttagggaaaataagagacataataatctga

SEQ ID NO: 2420 - DNA, 1350 bp, Xenorhabdus bovienii
  Coding DNA location: Contig name=SeqID_16870; Position on contig =109169..110518bp; Strand=+
atgccagataggggcattaatggaacaactagatggggcaattattttgaagaggataagggaatgaaattagcatttcagccatccggtactataagtaatttattatcagcatcttacgctggcagtgaattatggtgggagcatattgcagctttagggactccgttagtggaagcaaggccggagcatcaggttcaactcacgtttttctggcgagatcctgccggaaatgaacagaattcagatattcgccgggtttatattgatattaacggcatcacagatcaccacagtccacagccacaaagtctgcaacgattgcccgaaagtgacatttggtattggtctgtcacgattgatgatgactggagaggaagttacagcctgatccctgccactcatgcccatctcccctctgatttttacggcgatacacagcagcgtaaccaacagcaacgcgaatggtggtgttcactttttcccctgtctattccagatcctctgaatttacaaggctgtcatcgtaatgggctcggaatgtctttatcggccgctcatatgccccatgctcctgagcagtcagcttgggtatcaatcgggagaaatagtctcgctcagtcggatacacaacagcctattctgttgaattggcagagtcatcgcctcggtaatcagcggcgtatctggctttacgctacgggagaggaaccggagagaccacgcccgctggtcattcttctggatgggcaaaattgggcagaaagaacccctgttttttctgccttagaagccgctaccgaacagcagcacataccgggagccgtctggctacttattgatgtgattgatatgtcccgacgggagcaagaattaccctgcaacagagatttttggctggcggttcaggatgaacttttgccgcttgctgcacagcatgccacgttcagcgattcccccagcaatacggttgtcgccggccagagttatggtggtctggccgcactttatgcggcactacattggccgcaacgctttggctgtgtactcactcagtccggttctttctggtggccctacagcaaaatgatgaagtcatctgagcgtcaaatcggttggctgacacagcaggttattgagcaaaaagttcccccatcctcattgaaaatctttcaggaggcgggttcccgcgaagatgatatcgaaggtgttaaccagcaaatgtatgaagcgttaaaaaatgccggatatcacgtgagttatcgtgtttttaatggcggacatgattctttgtgctggcgtggcgggttgattgatggccttagctggttactgtctgaaaacgcataa

SEQ ID NO: 2421 - DNA, 243 bp, Xenorhabdus bovienii
  Coding DNA location: Contig name=SeqID_16870; Position on contig =110557..110799bp; Strand=+
atgtctcaggaacaaaaaaacccttttgatgatgataacgcgaccttctttgtgctgatcaacgctcaacagcaatacagcctctggccagcttttgcggaacagccggctggctgggaacaggttgccgggccagattcgcggtcaacatgtattacatacatagaagaacattgggtagatatgcgccctgcccgtttgcgtgacttattagttagtcgagaatcggttaatcaggactga

SEQ ID NO: 2422 - DNA, 8595 bp, Xenorhabdus bovienii
  Coding DNA location: Contig name=SeqID_16870; Position on contig =110840..119434bp; Strand=+
gtgtccagtagattacaagaggttggggttgaaacaataaatttgacgctaccactggttgctgcccagccagggatttggatagccgatcaactcgctgacccacgtaacatatttaccattgcacattatattgaaattaaaggggcattagaccagccattatttgatgccgcccttcgtcaggggttgtctgaagccgatacgatccatgcccggtatttcctgaatgaagatggaataccggtacaacagatcccgctttactgtgacccacagcaagtcattgcccctgaatggattgatttttccagagagccggctgaacaggctgaaatagcatcacatacattgatgcaggaggatctctcggctgaattacccgcagatggagaacgtgcgctgtaccggcaggtggtaatgaagattgatgagcaacctgaacgctggttctggtatcaacgctttcatcatctcatgctggatggtttcagttttgatgcactgactcgtcggattattcagatttataatgcactgagagccggctatcagcccgctgagacccctttctgttcctttactcaggtagtggaggaatatcaggattggcaaagttcgccggcaaaagcaaaggctgcggcattctggcaagaatatacccgtgagccgggtgcctgtgtctctctttcagttgaagatattgccgcttcggggaacagctcgcctttaaattatcactgccattttccggcagctcagctgacttcattaatagcagaggattcactacgccaatttcaacctgctgaaattgtcatggctgcactcggcatctatttctaccgcatgtgcggagaaaagtatctctctattggttttccgtttatgcggcgtatgggatcagccgcgctctgctctaccggccctgtggttaacctgctaccgttacaaatcaaactgcaagacagcatgacactggccgatgtcgtgaaggcttttgtggcagaaataaaacaagtccgccgtcaccagcgttatgacgccaaacagctacgctgcgatttggggttatcgggaagcagcaacctgctctatggccctgtttttaactataaaatatataacgagacgctgaaattagacggcaggccgattacgactcacacactcgccacggggccagtggatgatctggaatttgaattgaatttccaggatgacgttcttcatctgaccttcattgccaatcggacaaaatatagcgaacagactttacgctggcacagtgaacgcatccgttatctattagatcaactgctcattcagccgaaacaaccgattgcttttataccgatgattcccccacaggaacaacagcgtcttgatgaatggtcccgcgggccatgcgtaacaccgccatcaggtagggtttctgtgcttgatttcttcttatctcaggtgaagcagcaaccagataccttcgctgtccgctgtggtgatcaacaacttagctatcatcaattaatggcaaaaagtatgcagcttgcgcgcctattgctggcgcagggtattggtgccgaggatgtggtcgcgataggtgtaccccgctcagtagattcggttgtcgcgattctgggggtattagccagtggcgcggcttacatgccacttgatctcgattatccgcgggaacgcttacaattaatgagcgatgatgctcaaccggctctgttgataacctgcattaatacactgccacaaatgcctgatataccgaaggtaatctgtctggatgatcatcagatacaggagcggtgtgccggtctgtcttcccttcctgtcacagatgaagaaaggcgtgaaacgctgtgggacgaacaccttgcttacatcatctatacctctggttccactggcaaacccaaaggggtgatgagtacacatggtgggttactgaatttgctggcttcccatgctgcacggttgtttgggccagtgattgacaattttcatcttcagcatcaacggcgtatgcgcgccggtcacacagcctctttctcatttgattcgtcctgggagccgctgttctgcatgatgttaggcagcgaactttatatctttgatgaagagttgcggcgagatgcctggggtgtggtacagcaaatgaatcaactgcctgttgacctcatggatattaccccatcgtttttgactcagcttattgacagcggtttgctggaagaaggcaatcaccagcccgcgtttattatgattgggggtgaagcggcgacgccgcgattgtgggatctgttaaagcaatacccacaaatgaatatccataattactatggcccatcagaatataccatcgacacgctgggggccaatattcaggtcgctgatcagcctgttattggacggcccgttgccaatacggatgtctggcttctggatagtcatctgcaacccgtaccagttggcgccgtgggggaactttacctttccgggccaggcattgcccgcggttatctgcgccgtcctgatttaactgcggcgcgttttgtcgccaacccattcaagaatggtgaggtgatgtatcgcagtggcgatctgatgcgttggcggcctgatgggcagctctcatttgttggccgagtggatcaccaaattaaagtacgcggttttcgcgttgagttaggagaggtagagaatgcgttggctgctttacctgaagtcagctcggccgtggttattgcagaacccatgggagtcacctatcggctgattggctattgctcggttcctgataataaactgcgagccttagcagatatttctgcacgattgctggctgaactggcaaaacagctacctgattatatggtgcctgctttattggtgattttggaagagctgccattaacagtcaatggcaaggtggatcgcaaggcgctgcccaaaccgcagcaacagcatttttctatagggcggcaagctgaaaatgaaaaagaaaaatatatttgtgaagcgtttgcaaccttattagggatggttcaggtcagtgccgatgatgatttctttgcgctcggaggcgacagtatctctgcaatggcactgggaacacaattgcgtcgtgttggctggcagcttcgtccacgagatattttcagtgaacggacaccagcgcgtatggcgctgaaaatgtctccggtcgctattggcaagcgaacatctagcgccaataagatatctaaaccagtacaaatcggcgagatcgatcacttacctattttgcattggtttgcagaatctcatggcatcaatacccgtttcgcccacggtgtattcatccgcgtaccgactgaattacggccagaacatttatcatccgcccttctcgctttgagccagactcacccggtacttcatgctgttacccgcaataatcgccttattatcggtgaaaaacctgtacaggcagacggatcgtattacagcgttatacaaaacagtggtcatatagaaacgagtgcagaacaggctttccacgaggcggtgatgcgcttggatccggccacgggtcatttattccatgcctgtttactgcaacaagatgaagagactcagggattagtatgggttattcatcatctggcaacggatggtgtgtcatggcgggtactactggatgaactgcaacaagcaatagaagctgccatggcgggtaaaacaatcgctttgccaccagaagagtacacattgtatgactggaaccttcagctaggtcaaaatttagcaagccgtgccggagagctgtctttctggcaagccatgcttgacgaaaaaattcccctgttaggaaaacgcccgttggatgcgcatcgggatcggcaagtcgctgtccgtgagcaacgaacactattaaccggcaaacagaccacggcattactgggagcgttgccgcagcagtaccatgccaatattgaagagatattattaacaatattggctatagcctgtaaccggtactttggtgtcagcaaattacgtttccaattagagtcgcatggtcgtattgaattggaggatgacgttgatttagcacgaaccgttggctggttaacggcggaatatcccgttgtgctggcgttgccacaggcagaatgccaatccacagaaatcgctgccgaaaatccctcaaaaatcgtacgggcagtgaaaagcgccctgcgtacaatacccgatcgtggcataggttatggcctgctgcgttatctggatcaaactggccgacaagtattagcccaacaggatacgccagagatcttatttaactatttggggcgttttgctacgactgataacttatgggcgccacagcgaactgaaaacctgttccgtgatacttttgctgtttatcaagatccgcaaatgtcccccaatcatagcttggaaatcaacctgtttgttgatgaacagggaagtattccgcagttagcaattaactggcaatgggtagatggtatcttcagcgaacaagacatctctgaattacagcgcggcatggaatgggctaccgactgcctaatcaattttgcccgacagcagccacagcaggcggccgcgacgctggttgccgcagaaattgttttaccgagacttgaagaaagtgatctgacgcaactgactgaacgttatgggcctttgacgactgtgttaccgctgttaccgctgcaacaggggctactctttcacgctcagacagcaacagataagggtaattataattcactcacccgcctttctctgcatgggccattagatcgggttaaactgcaccgggcactgtctggcctgatccgccaccatcctcagcttgccgcacgttttgatactgagcaaagtgcttctcctctacaactgataccccttttatcagaggatagcgagatttggccgcttgatttttatcagctccccgaattatctgagcaggaagaagaggcggcattattagaactggaaggaactgaactggcgcgcgatcttttccaccagcctcaagccatgctgcatgctttattggtctgtcacggtgaaggttcacgttatacgttattgttgaatattcaccatctcgtcgtggatggctggtcaacacctatcttaatacaagatcttttaaccttgctgaatcaaggtgagcaagcgttacctgtacccagagtcagttatcaagagatcgtccatcaattggcggcacgagaaacggcaacggcgcgccaatgctggcaagatgtgttgaagggcgttcaaccaaccaaactgttcagtgatcaaccccataacggcaaagtgagagagcttgatatcgtgctcgaacctgaaatggaacaggcactattcagcttatgtcagcaacgtggtttgacactcaatacgctgatgcaggggatctggtctgttctgctcagtatacacagtggttcatccgatgtggttttcggttcccccgtgtctgggcggtttggccagattgaagggttagaccagcatgttgggctgttcagcaacaccctgccggttcgaatgacgctggatatcacgttacctctcttgcctcagctggaacaattgcaggcacagcagatccagttgattgaacacgacaatatcggtctgggtgaaattcaacatattgcggggacaagtacgctttttgataccttactggtagtggaaaattatccagaaaccgatactgaatcagattgcacccaaacgatcatttgtcagcagattaataaccgtggttacacgcattatcccttaaccttgctggttctgccgggtaagcggctgcgtttattaatggaataccgggaatgtgtcaaacaacctgaattattggttcaacgtatccttctcctgattcagcaactgcttgagcaacccgatacggctctgcgggattgggttttacaatcaccggatgaagctgcattgattaccgaagtgaatcggacacaccatgaaattccttctggtacactccaccagtttgtgattgaacaggctgaaaaaacgcctgatgatttaacattactggataaccagcatcaactgacttatcggcaaatgcgtgttcaaactcgtctattagttgatcgtttaattgaagcaggggttcagcccggtgatattattgggattgctttaccccgttcagtaagactcagcctggcattacaggcgatactggaagcgggagcagcctggttacccctcgataccggttatcctgatgatcgtttggcgatgatgctggaggatgcccagccacggttagtcattacggaaagtgaacttcaagcgcgttttgctcatcaggctcctttgctggtactggatcagttggcggatgaaaatcagcagccggtgcatcccgcagcccaagtgatgccacagcacacggcttatatcatttacacctcgggttcaaccggacggccaaaaggtgtgatggtcagccatcaatccattgtgaaccgtctgttatggatgcaggatgcttacccacttacccgggatgatgtggttttgcagaaaacaccatgcagcttcgatgtttctgtttgggagtttttctggccgctgatgacaggcgctaaactcgtgatggcgccgcctgaagtgcatcgcgatccagaagcgctaatgcagcttattgatgactatacggtgactacgctgcactttgtgccatccatgttggcgacgttagttgactcattggcatcacgtcagcaaagtactttattctgtcatagcctgcgtcgggtgttttgcagtggtgaagcgttatcctgtgaactggctcgccgctatcaaacattcatcgctgcacctttacataatctctatgggccaacggaagcggcagtcgatgtcacatggcagccggcttatggtgaggcattagatcactgtacaggttcaggtgtgcctattggccgaccggtatggaatacccaattgcgtattttggactcttggctgcgtccggttcctgttggtgtagcgggcgatctctatctctgcggtattcaattggcgacgggctacctgaaccgggctgatttgacggccagccgttttgtggctgatccttttgcctgtggcgaacgcatgtatcgaactggcgatattgcctgttggttgccaaatggtgaagtggaatatcttggacgcagtgacgatcaattaaaaatacggggtcagcgtattgagctgggggaaattgaacaggttctactggaacagcccggcgtcgctcaggcggcggttgctgcgtgtgaattaggcaaaacagccaacaccgttagtaatgcagatgcccgtcagttagttgcctggttaattcctcaacccgatgtttcactggatacagaggcattacatcaagcacttacccggcgattgcctgcttatatgctgccggtcagttatgtgcttcaggacagtttcccattaagcgccaatgggaaattgaatcgcaaggcacttcctatgccacagaaacttactactgggcgcttgcctgtagcaggcacggaaagccaaatggcagccctttttgctgaaattctggactgcgacaccgtttgggctgatgatgatttctttgcgctgggtggccactcactattagctatgcgcttggccgcagaaatacgccgtcgttttaatcggtctatttctattggtcatatcatggttgctcgcagcgtcgagaaactgagtgcactactgtctgatgaaaatggacaaaattccgcagaaaatcgtggcctaggggaagtattcccgctgagagacgggcacggcccggcactattctgcctgcaccctgcatctggctttgcctggcaatatagtgggctgctgcgttatttaaaaggcgactggccgatcattggactacagtcacctcgcccgctgggcgttattgccgactctgataaccttgaagagatgtgtacacaccatttagcgacattacggcagatccagccacatggcccttattacctactcggttattcgttaggcgggatgctggctcaaggcatggctgcgcgcttgcgacaagagggagaagaagtggctttcctcggattattggatacttatccaccggaaggccaagactggactgtcttaagtgaagaagaagccaaagaagaagctgcgcgtgaacaggccgaatttatggccgccacggaagatgagcatgattcgctgctgcgtgctgaaaagcaggccatgttcgccgatattgtggctaactataaggattctgttcgtatcctttcatcagccgccaatcaaaaatatgatggcgaagccattctgttttcggcaacacgcacattgcctgctgatatggatgttgcagcgacatgggcgccttggatccggcagttaagcatctattggcaagattgtgaacatgcggatattctttcgccaacatcactgaaacagttagggccattgctcaatacactgttgaaaacgcatcgcgattga

SEQ ID NO: 2423 - DNA, 804 bp, Xenorhabdus bovienii
  Coding DNA location: Contig name=SeqID_16870; Position on contig =119514..120317bp; Strand=-
atgacatatcgcctcagcgcttcacatttgacattaggctatgaacgaaaaattattactgaagatttaagtatcagtattccggataaacagttcagcgtaatcattggcccaaatgcctgcggcaaatctacgttactgcgtgcgctttgtcgtttactgaagccccatcacggtcatattttgctggatggaaaagatattcaacaaataccgactaaggcattggcacgtcagttaggtttactgccccagcaagcgatagtgccggaaaatatcacggtttccgagctagtcgcgcgtggccgctatccccatcaaagcctgctgcgccaatggagtctggatgatagaactgccgtggctcaggcgatgaaagccacagggattgcacaattagctgaacgctatgttgatgagttatcaggagggcagaagcagcgtgtctgggtagctatggtattagcccaacaaactcccttactgtttcttgatgaaccaacaacctggctcgatattgctcatcaaattgacctgctggatcttttcctgcaacttaatcaggaaagcagccacacccttgttgcagtgctgcatgatattaatcaggcatgccgctatgcggatcatttaatcgtcatgcaggcagggcagattgttacacagggtaagcctcaggatattatcagtacagaacttatcaaatcggtgtttggcttatcttgtgttgtcattgaagatccggtttcccacacgcccctgattattccctgcggccgctaccattcggtaaaagacatttaa

SEQ ID NO: 2424 - DNA, 1032 bp, Xenorhabdus bovienii
  Coding DNA location: Contig name=SeqID_16870; Position on contig =120354..121385bp; Strand=-
atgccgaaaatgttgcaagtcgggcatccagaagggtggataaatggccgcattccccttcgggttctactggtgaatactctccagctatttttaattatgttattagcgctgttcgctgtttattacggaacgctgaaactttccttctggcaaatctggcaggcttttcaaggtgaaggtgatcccggcattattgctgtcgtcacgcaatggcgagccccccgtgttgccattgcgctggtggtcggagccgcactggcgataagtggcgccatctttcagtctgtcatccacaaccctttgggcagccccgatattatggggttcagtaccggcgcatggaccggcgtactgattactctgatttttctaaatggcggttattatcaaatgaccctgggcgcgctgatcggcggttcattaactgctgctttaatttatttactcgcctggcgccagggtatccacggttttcgcctgattattgtggggattgctatcagtgccatgctgacagcggtcaatacttggcttatcgtaacgggttcgctggaacatgtcatgagtgcagcactttggggcaatggttcgcttaacggcatcacctggcaaaaatcggcctcagccctgtttgttattcctttgcttactttcggcgcttttgctttggcaaagtcgctgaaaataatggaaatgggggatgataaagccagcgccttgggctgtaatgttgaaactaaccgtatgcagcttattctctatggcatccttctgactgctgtcgtgacggcaacgacaggcccgatatcctttatttcccttgctgcaccgcaaattgcccgaagattaacaggtacaagttatgttcctctgttttctgctgccatgacaggtgccttgctattgttaactgctgatttagttgcgcagcatactttttcaaatgtgcagctacctgtgggtgctgtcaccgtcagtattggtggtatctaccttatttggcttcttattcgggaagctcgccaataa

SEQ ID NO: 2425 - DNA, 1047 bp, Xenorhabdus bovienii
  Coding DNA location: Contig name=SeqID_16870; Position on contig =121402..122448bp; Strand=-
atgcctgctgccccaatgcatcgtgagataacctcttcaaaacccttgcctcaatttcatacttatcgcacccgtcggttaactggtcccataatctgtttattactcctcattattttttctatagcgagtctgttattaggcagtaaatatattgcccctgagaccgtctggaatagtttaaccggtgagctgcataacaatgagagcatcattattctcgaatcgcgcctgcctcgtacccttgtcggtattttggtcgggatggcattaggtggcgcgggggcattaattcaggcactgacacgtaaccctctggcagacccgggtatactgggcgtcaacgcaggagccagctttgccatcgtagtggcaatcacattatttggtttaagcagtgttatggcaaaagttagcgtggcctgtctgggcgcttttcttgccagcctggcggtctggttaatcagcatgcagtctggtgataaatccaatcctgttcgcttaacactgtcgggagtcgcgatcagcgccctgttaaccggggtaacaaccaatattgccctgctcaatccttcaactttcgatcaattacgcatctggcaggcgggtacgctggatatccgatctttacaggttactctccttgttgctccgctcattcttatcggttgtgcgctcaccttattgatttcaaggccgctcaatacgttgagtatgggggaagaaatcgcaacaacattaggcgtcaaaatcctctgggtaaaagtttcagccatcatagccattatgctgctatgtggaacggcaaccgcattggctggcccgatcgggtttgttggattgatgatcccacatatcgcgcgctggtggtgtggcccagaccagcgctggatcattctgcattcattactcatggctccggtgttattacttagtgcagatatcgtcgggcgtttattggttgccggtgagctgcgcgtatcaatcgtcacggcctttattggtgcgcccgtgctgatctggcaggtacgtaagcgtaaatactga

SEQ ID NO: 2426 - DNA, 123 bp, Xenorhabdus bovienii
  Coding DNA location: Contig name=SeqID_16870; Position on contig =122423..122545bp; Strand=-
atgtttccagaaaaagctgtgctagcatatcgaccgttaatgataatggcaatacaaatgattatcacaatcaataacgaatggagtctttccggttatgcctgctgccccaatgcatcgtga

SEQ ID NO: 2427 - DNA, 1266 bp, Xenorhabdus bovienii
  Coding DNA location: Contig name=SeqID_16870; Position on contig =122617..123882bp; Strand=+
atggctaagtcatcaatcctgctggacttcagtttacttaaaaataatgcacacttccgcgctatctttatcgcccgtatgctatctgtttttgcattaggcatgctgacagtgggtgtcccagttcaaatgcagtttctgaccggttctaccttgcaggtagggatcgtagtggcattggatgggatcggcatgtttatcggattgatgctgggcggaatactggccgaccgctatgacaggcgtaaactgattctgtttgcccgaggcacttgtggcttgggttttgttgcattgagttttaatgcgtttttggattccccttcactgtttgtactctatttcctttccgtctgggatgggttctttggcgctttaggcatgaccgctttaatggcggcgatcccaaacttagttggccgggaaaatctggctgcggcgggtgccttgagtatgatcacggttcgcattggtgctattctttcccccgcattagggggtcttattatcgttgccagcggaccgggctggaactttgccattgccgctgcagggactttggctacactgatcccgctggtgagactgcccaagatgaagccacagtcaaccctgcaagagcatccactcagagcgttagtgagtggtgtccgatttgtctgtcagcataaaatcgtaggcagtgtgatattaatcggtatgttgatcagcatggcgggggcagttcgcatccttttccctgcgttatctcaagaggtttatcaccaaggtccttccgcgacaggtttgatgtattcagccgttcctctgggtgccatgctaggagcatttaccagtggctggataggacgaagcgcccgacccggtcttttacttattatttttgcgctgggctctttcctcgcattatccctgctcggtgtcatgacgcatattgtcccggcattactcgcattggtgtgttatggctacctgaatgcttttgcttccttattgcagtttacactcatccaaagtcatacaccggatcacttattggggcgggtaaatagttttgtcacagcacaggatgttaccggtgattccttgggagcattgggattaggcgtaatgggacgcctgttatctcctctcataacggcgctttcgtttggttcttttgcggcaattacctgtctattgcttgcagcactggtaaaacctctgcgccattctactctgcatgataatgccgcatcattagagggcggtgcctctgaaaagtga

SEQ ID NO: 2428 - DNA, 1047 bp, Xenorhabdus bovienii
  Coding DNA location: Contig name=SeqID_16870; Position on contig =123917..124963bp; Strand=-
atgcagtgcaaatttactttttcttattaccgattaatcaccgttatttttgcttttatcgcactaattcttaccagtggctgcgatgaaaaatcgacagaagttaaatccggacatcctcaaccttctggggaaaccaccagcatggcgggctggccacgaaccttcgaaacagtaaaaggccctctcacattaacacagccacctaagcgtattgtttctaccagcgtgacgctcagtggcactttgctggctatcaatgcccctttaatcgcttcaggtgcaacaggcccaaatactgatgtggctgatagccaaggcttttttattcaatgggccaaagtcgcttatgaacgtggtgtaaagcttctctatatcagtgaacccaatgccgaagctgttgcggctatggtgccagatctgattgttatttcagcgacgggaggggattcagccatgaaactgtatgaacaactctcaaccattgcccccatactggttattgattatggcgataagagctggcaacagcttgccctgcaacttgggcaaataaccgggaatgaagctggtgccggggaaatcatcgcgcgctttgagcaacgtttgcagaaagtgaaacaagatatcaccttacccccgaatcctgtttctgcatttgtctattatgctgatgggagaggtgtcaatctttggacgccatcatctgcacaagggcaattactgcatcaattaggttttacactcgccacattaccgaccagcctgaaaacagaaaccagtatgggcaaacgtgaagatatcattcagctttctgctgaagggttagcagatggtttaaacggccaatcctttatgctgttcgctaccaatgacagcacaattcaagctgtgaatgctaacccttttttacagcacctgcctgctgtcagcacccaacgcctctatgcgatggggccggatactttccgcttagactattacagtgcaaacaatatgcttgatcgcattgaacactatttctcaaatcaagaattaaaaaattag

SEQ ID NO: 2429 - DNA, 105 bp, Xenorhabdus bovienii
  Coding DNA location: Contig name=SeqID_16870; Position on contig =124993..125097bp; Strand=+
atggaattctggcatgggaatacccaaaactttcattcgaactatttgaataaagggaaagagtacattttacccagaagtaagggacacattacgcaaccataa

SEQ ID NO: 2430 - DNA, 495 bp, Xenorhabdus bovienii
  Coding DNA location: Contig name=SeqID_16870; Position on contig =125178..125672bp; Strand=-
atggtcaaacgttatcggcggagtcagcctacggttgggcgtcggtggcgaatggacgaaaccgatatcaaaatcaaagggcaatggcgttacctttaccgtgctgtggattcagatggcaatacggttgattttttgttgacagcccatcgagataaggaggacgccttgcgtttctttaagaaagccatacgccagcatggacaacccgacggggtgacgattgataaaagtggcgccaataaagccgcagtggacgagttaaatcagggaaaaccgaaggataacgacatccttatccggcagaataagtaccttaataatctgattgaacaggatcaccgcaacgtcaaatggcgaacacatcctatgctggggttcaaaaacttcagacgagctcagaccgtgttggcagggattgaattgatctgtatgttgcgcaaagggcaataccgacatcataacgcacagcaaaaacatattcgtcataaatag

SEQ ID NO: 2431 - DNA, 162 bp, Xenorhabdus bovienii
  Coding DNA location: Contig name=SeqID_16870; Position on contig =125694..125855bp; Strand=-
atgtcccttatccgaaaagcgttcaaacgcgtccattatcctgttgatattatcgctcagtgtgttcgcgggtatttggcctacgcgctgagcctgcgtaatctggaagaaattatggctgaatgtgggattgccgtcgatcattccacgctttcccgctga

SEQ ID NO: 2432 - DNA, 1758 bp, Xenorhabdus bovienii
  Coding DNA location: Contig name=SeqID_16870; Position on contig =126353..128110bp; Strand=-
atgaataaattctcggtattaaccgcattaatcggtgttccgctcaaggggctgaaaagtatggtctgcgttgctatcgctgacgctttcctgacttctgcgccttacgcatttctctattacatcattctggatatgctctcggcccagccggatatccattaccaatttatgttggccgccgcctgtgctgtgttgatgctgatacggattttattggtgcggatcctctatttcaatgtgtcattgattgggtttaatgccggcgcgtcattgagaaagcacttaggggaacatttacggcgtttgccgatgggttttttctaccgttcagagatgagcagtgtcaataacacactgctgaaagacattgatatggttgagcggatcttcactcacctgtatgcgccgatgattgcaaccgtatccgtgctctgcttttttgcttttgggttgctgttaaaagattggcgtatggcattagcgatgttatccaccttgccattagccgtctgtgcctacttcctcacccgtcgttatgcccgtctctggcagacgcgtgtgcaatcatggatgttccgcttaaatgatgggttgatggagtatattgacagcttaaaggaattaaaagcctaccaaatggtgggcggtgcatttcagcgtctcaaccaagtcttggacaccacgtataaaaaatcattaaccgcagaaaaagcaggtgtatggccgatatacagttttaatctgctggtggaatgtggctttattgtgctgctggttgcgttgacatggggctggctggggcattcgctctccctggcggaagtattggtctttctgatcgccgccgtccgttttttccgcccgttattgaacatgtcgatgtttttagccgaactgaattattttggcttggccgttgagcgtatccaaaaagtgtttgagatacctgaactttctcagggaaacttgcggcccgatatcaccgccatgcggatcagactggaaaacatcggctttgcttatcccgatcaaccggctttatttaacaacctgaatttgttgattgaagaaaacaaaattacggctttggtcgggccttcgggatcaggcaaatcaacattggcttcactgattgcccgtttctgggatatcgagcagggtaatatctgggtgggtgagcaacataatcccattaaccttgcagagatggatgcagaatattggcagcgttttttaagtgtcgttttccaaaaaaactacatgttgaatgacacgattgccaacaatttaaaaattgcccgtccagatgcgacagaagaacaattactttccgtctgccgttcagcgcagctattaccactgctcaacaaactgccagaaggtttggatacctatatcggtgcaggtggcgttcacctttccggcggagaattgcagcgcctctcgattgccagagcattattaaaagatgcccctctggtgattttagacgaagccacggcctctcttgatccagaaaatgaacgtgagatccagctcgcaatgcaatcattaattcagcgaaaaacggttctggtcattgcgcataaattatcgtccatacaatatgcggataaaattgtggtgatggatcagggcgatattgttgaagaaggaacgcatagcgaactgatcgacagacaaggcttatatcatgaattatggcaattacagcaacagacacagagctggggtatgaggactggtcgtgagtaa

SEQ ID NO: 2433 - DNA, 1788 bp, Xenorhabdus bovienii
  Coding DNA location: Contig name=SeqID_16870; Position on contig =128103..129890bp; Strand=-
atggtaggtaaagaaccggaaaatcaacaaactgccttcagatggttaatgaaattggtcagtagtcagcataaacggctggctgctgccatgtttctggctatctgttattcgctgctggcattagttccttatgtgatcgtttatcaattgattgtcgatttcctcaatcagccagaaatcgccgctcaacatgtctggtggatggtgatcatggcggcgttggcactaataggaaaaatcctgctacaactggcatcggggctgctatctcatcaggctgcattccaattgctgtttgaattacgcaagcaggtgatagaacgggttgggcgcctgccattaagcacctgccatcaacataccagtgcgaaactgaagaaaattattgccgatgatatcggccggatcgaaacctttgtcgctcatcatctgcccgatatggccgccgcggtgatgacccccgtgggcgcggccgttctgctatttttctttgactggcgtctggcattaatggctttactgcctttgccggtagccattgcgatgcagggctggatgtttaagggattcaatcaacgcatcggcgcttatcaccgtgtcgttgcggatctgcataccagcgttgtcgatttcgtgaaaagcatgccgctggttaaagcctttaatatgaccgtcaattcacatcagcgctatacacaggcggtcaatgaacaccatcaactggtcacgaactggctacgggatacccgtacagcgacggcactgtttaaaatttcccttgaattggggttactgtgcattatgcctgtggggatctggttatttgccgacgggcaggtgacattatctgtcctgtttatttttatgctgttgggaattggcctgatggagccgctgtataacctgtctcagtttgccaatatgttcagcgatttactcaaaggtgttgagaatatccgtgagttctctacctcgcctgcacagaaagaaggcaaacaatgggtagcgatcgataattacgacatctgctttaatcaggtgagttttcatcatcccggctctgaaactcagactattaatcagttctcatttgtggcaaagcagggagagatcaccgcacttgtcgggccttccggcgcgggaaaaaccactgcggcacagttgataccgcgtttgtatgagtatcaatcaggagagattctgctgggaaatacgccgattgatgctatgccccttgaacaactgatgtccttgaccgcctttgtttttcaggatgcgttcatctttgaggatacggtttttaacaatatcagaatgggcaatgaggcattgtcggaagagcagatcaaagccgcggctcaagcggcctgcgcagatgattttattgaccgattgccggaaaaataccagactgtcatcaggccggaaatcttaagcggaggtcaggcacagcggattgccattgccagagcgatagccaaaaatgcccccgtcatcattcttgatgaggcgacggcttatgctgatgcgcgcaacgaatcgcgtattcagcaggcgctggctgcgctgatcaaagataaaacggttattgtgattgctcaccgcctgaatactctgactcacgttaataaaatcgtggtcatggacgaaggcaaaaaagtatcggaaggcacccacccgcagttactctcccattgtgctctataccaaaagatgtggtcagcgcatcaggcagcgaaagaatggcatttcatcacacggccaaaggcggtgattcatgaataa

SEQ ID NO: 2434 - DNA, 1269 bp, Xenorhabdus bovienii
  Coding DNA location: Contig name=SeqID_16870; Position on contig =129890..131158bp; Strand=-
atgaaatataacggcaatattgcgagtttatttggtttatattgtgggcagggtgcacctttagggtttgcgatttttgccttacccggcatcttgcgggcgcagggagcggatatgcagtttatcgggctggtgggtttaagtatgctgccgtgggcgtttaaattcttatgggcttcatggattgaaaaccataagccgtgggggtttggctcactccccgcaggggtaggctggattcagttatttaagggattatccctgcttctggccgccttgctgtggttcttttctccagacactgacattatcggtttattggtcttaatcaccattatcaacttctgctacgccagtcaggatgtcgcggtggatgctttggccgttcgggtgtttgccggtagccggcatgttaatgtgaacgtcagccagatcgcagggttcagtttgggcatgttattgggcggtgtgctcagtctgtatatcttcagtgcggcagggtggcatatgactgtgctgtcattcctgttaatccagcttatttgccatctgccgtttatgtgccatcagggtagcttcacgcaagacaatcaactgccggttaaaccgggcagggcgtcattgtggaaaatcttccgtcgcaaaggctggttgccgattattgctatggcactgtgtttcaaatttaccagcacgatgggcgtggctttagtgtcgccactgctggttgatatgggcgtgaatctggaactgattgcgttaatatccggcggcgtgctgattatcagttatatcgccggagcggtatcgtccggtattctgcataaatggttctccagcccgcaattgaccgtattcgggctgaccggaagcgcctgctgctggctgggaacggcattatccctcatggcctcggcaaaaagcccgacgatggtattcctgttctttattctggaaggtttcttttttaacctctgctgtgtttctcttttctcttggtttatgcgctggagtgaaggcgaaaaagatcacaccatcgtccagccaggcacggatttcacactattgcagtgctgcgaagttctcggcagtagcatggcgatggttttgaccggtttattggctcatcatttgggattcacacaagcatttactttggctgcggccagtggttttgccgtggttctattgacaatcgtctgcttccgctacagtcgccgctcttaccgcggatttgacgaaccccgttgcattacggagagagaataa

SEQ ID NO: 2435 - DNA, 747 bp, Xenorhabdus bovienii
  Coding DNA location: Contig name=SeqID_16870; Position on contig =131179..131925bp; Strand=-
atgaatgaccgcactttcagattgattaaatccggcacccatcaacaaatggtctgttttcaccatgcagggggaaccgccgagtattttatgccttggaaaaatggtattgcagatgataccgctgtctatgccgttcaacttccggggcatggttcccgtattcaggaacccttgttgcacgatctccatcaaatggcggatcagattgcggctgcgtgttcatttctgcctgcccgtccaacggtattttttgggcatagcatgggggcggctttggcctttgaagttgccctgaggatgcagcggcagggaaaaagcattgctggcctttatgtttccggacggcttcccccgcataaaaataccggtaccgatttttatcgccagagcgaagaaacactgctgaacaaaattatctcgctgcaaggtgcggatatggattaccggcagcctgagctgaaatcgctgctggtgccaatttttcgcgctgattttgccgcgatagaaacttatcagcggcgctgcgaacagcgactgaattgtccggtgattgcctgtattggtgaggcagacagtgaagtttctgtcagtgatttcaggcaatggtgtcaaatttccagtggaacatttgaactgaacgtgttttccggtgggcatttttatctgaatgaccagaggggatcactctttgattttctcaatcaatgtttggcaaataaaaatcagccagtgatgaacgtataa

SEQ ID NO: 2436 - DNA, 1143 bp, Xenorhabdus bovienii
  Coding DNA location: Contig name=SeqID_16870; Position on contig =131931..133073bp; Strand=-
atgagccagccattaaaagtcgtcgtctgcggcaccctgttcgggcaggtttacctttctgccttcaaaagtgcatttgccggatttgaattggcaggaattctggcgcagggcagcgaacgctcgcaacaattggcacaggcttacggcgtaccgctttatcaccgtgttgatgagctacccgatgatattgatatcgcctgtgttgtgattcgttccgcgattgtgggtggaaaaggcagcgaaattgcccgagcgttattacaacggggcatttctgttttgcaggaacacccggtttacctgcgtgacgtggctgaatgtttaaaactggctcgtcaacatggctgcggttatcaggtcaatacccattacccccatgtgccggctgtccgtcaatttattgcttatctgcgggaagccttgcagacccagcaggcgctgtttatcgaagcaacctgcggtgttcaggttatctgtggattattggatattcttggccgtatctttggccgctttaccccctgtgggttcagccaaccggaaagctatgacaataaattgctcggcttaatgaaccacacaccgccttatacccaattgcgcggtgtgattgcaggtgttcccttaacgctgaatttacaaaatcagcttgatcctgccgatcccgataaccattttcatatcatgcatcgcatctgtgtgggattacccagcggcaacctgctgctggcgaatactcatgggccggttatctggaataactgttttcatattcccagagtgaaaacggcatcgggatgtcgtgaactgattgcgccagaattagcgccggactattttctaccgcccctgaatcagtccttctcaaatcatgaagacaattatcatcaagacaatttgcaggacatattaaatcgtcattggccatcggcggtacgccatgcactgcgtgaatttgccggccaatgccagacgtcggcacccgcggatgcacaatatttgctatcgctgaccaacgcgtggaaatccttgatggaacaagcgggcaaccctgaaagcgtttcccttgctgatccgatgatggcgtcacctgagatcgcgcgttttttatctaaatggaaaagtgagagggaggagtaa

SEQ ID NO: 2437 - DNA, 1083 bp, Xenorhabdus bovienii
  Coding DNA location: Contig name=SeqID_16870; Position on contig =133070..134152bp; Strand=-
atgacgacaaggaaatccgtactggtgattggcgggcagggtgccgtaggacgtgccgccgttgacgtactttcccgactgggctatcgggtcatgattgcggggcgcactgagcgccctgaatatcacgattattatcagctagatctgtttgaccgaacggcattagctcactgctgtcaacaggccgatttagtgctcaataccgccgggccggcttcactgattgaagatgtgattgccgaaacggcacttaacgcgggcgtccattatgttgatgtcgcgggtgatccggcggttgagaagaaaatcttacaacagatcgccatgcgccaagagccgtgtcgttctgcctgtgtgctgggcgcaggttttattccggggctggcaggaatgctgcccttatatgctgcggaatacttgcagccagtctcgaaaatccgcctgtatacaggcggtatcgaagcctttaccgcaacatcggcacaagatttctttgccagccagcaaccggagcgggagcagggcaaaacaggatatatcctctccggcggtcaacttatcagagcggggatagaaaaaactaagtctatctcaacagcagaaagaatgtttgatgcactgccttatttcagtttcgaacaggaaagagtcgcgcaaaaactgtcacttgctcatttggcggcatataacctactggcggacagaaccttgttactgaccgcgcctgcaaatcaggccgatgcgattcaacgcttaataaccttgagccagcagcttgtggagaaagaaggtgagcagcagcatctgctgatggaagcgcatggcttactggcaggtcagccgaccatgctcagacttcaaatccgctttaacaacagctatcagctgacgggcagcattgcggcactggcggctcatcagctactgaaacagccagtgacagggctttactggctgccggatatcatcaacatcagaaccttgctgacccaattagatgaattgtctcttttcagccattttagctcagattttctgcctgacgatgaaatcgtgctctttcaggagggggaaatatga

SEQ ID NO: 2438 - DNA, 5451 bp, Xenorhabdus bovienii
  Coding DNA location: Contig name=SeqID_16870; Position on contig =134149..139599bp; Strand=-
atgaatcaggaaatgcagcatcaggctaccgaacttcttttcagtcttgaaaataaacaggctcgtttttggctggagggagaaacattaaaattcagggcgccggaaggcgtcatgactcccgagattatttcccggctaaagtcactcaagcctcagcttattgagttattgaaaaactggcagcatcacagccaattcctgatccatcctgaaaggcagcacaaacctttcccattaagcgatgtacaggcggcttattttgtcgggcgtcaaagcttgttcgaatatggcggtgtcggctgtcatggctattttgagattttatccccggcttgggagatcaataaattagagcaggtgtggaaccagcttattgctcgccacggcatgttaagagcgataatcatgcccaacggtgagcaaatgatcttgccttatgtggagcctttttctattgaggcggtttcgcaatcgccggaatcactgcgtgaaactatgtcgcatcgggtataccagcctgacacatggccgctgtttgatttaaaagtcagtcaggtcaatggcaaagcctgcctgcatttcagtattgacctgttgattgccgatttcctgagtgtccagatcttactggctgaattactgaacggatacagcggcaagacgctagatcaggctccgttagcgatcagcttccgtgatgttattcaatatcagcgccagcagaagcacgggcgtgattatgcccagtcacgtcaatattggttaaatcgcattgcagatctgcccgcctgcccgcaattacctgttttgcgcacggaattgcaggacaccccgcaatttgttcgccacgactaccagcttctgcctcagcaatggctggaattacagcgcatctgccagtcacagggcgtttcgccttccgcgttactgttgacgctatttagtgaagcaattgccaaatggtctgaaagccgtcatttcagcctgaatctgacggtcatgaaccgccctgatgcgcatccggagatagcaaaattagtgggcgattttacttccgtcagcttgctggaagtggatttgcgcgactcccgtctgttgcgccagcgtgtcgaacagatccagacccggctctggcaggatctggaacataacgccttttccggtatcgaagtgattcgcgaatgggtacgccagcgaggtaaagaacaggcaaaaatgccggtggtgtttaccagcgctttggtaggcgagggcaaaacgcaggcgcaggaagcgattattgcctcacagatggacattgaatttagctacggcatcagtcagacgccacaggtctggattgactgtcaggtgatggaactccagtcagggctgcgcattaactgggatgtcctggccgatattttcccggctggcatgattgacgccatgtttgcggcatttattgatgccgtcatgcaggttattaccgatgaaacggtctggcaacattcactgaccttgtcgttgccacaagaacagcagcaggttcgccagcaggtcaatgccaccgcagagccgattgaacccgcgctgcttcatcacaatattctgcgtcaggcagaacaaaccccagaagccactgcgctgattgattctcagcgcgtgatgacttacggcgaactggtggatcaggcgcagaaactggcgaaaaaactgtcgggtaaagggcgttatgccatcttactggaaaaaggccacccgcaggttgtggcggcgctggctattttgttggcgggtggcgcttatgttccggtggatgcaagccagccgtggccgcgaatcgtccagattctgtcggacgctcttgtggaaaccgtcattattgcaggggaagaagagcaggaaactaaacttacggcggcgggttttcatgccctcaatcttcaccgatcagaggcgtatcccgatctgccaagtctggagcctgtcagcatcacaccgcaggatctggcgtatatcatctacacctcaggcagtaccggacagccgaaaggcgtgatgatcagccatgatgcggcttacaacacgatttgcgatctgcggcagaggatctccctgagcgccgatgattgcgtgctggcactggcgcgtctgagttttgacttatccgtttttgatctgtttggggtattgggtgcaggtggaacgctggtatttcctgatgagggggatttacagaatccggctaaatgggcgcatttagtggcacagcatcaaatcaccctgtggaactccgtaccggcacaaatgaaaatgctgacagcgtatttgtcagccgaaaatctcgttctgccttcgctgcgctacagtttactttccggcgactggctgcccgtcagcctgcctaaagcgatggcgcagacgttacctaatgccgcgcaactcagtctgggaggcgcgactgaagcagcgatctggtcaaactgctggccggtcgatccgcaggtcgattatcaaaccagcattccttacggcattccactgaccaaccaacaattcagagtggttgatcctcagggagcagattgccctgattgggtcgcaggggaattgtggattggcggccgaggggttgcgctgggatactggcacgatgaagagaaaaccgaacaccatttcttcactgacgctaacggcgtgcgctggtatcgcacgggtgatcttggccgctatgccattgacggcgttatcgaatttctgggcagaatggatcatcaggtcaaaatccgtggctatcgggtggaaacgggagaaattgaagcattgttgttgaagtcctcgcctgttgctcaggcggcagtgattaaatccggcgataaacatcaggctgaattacatgcttacgtagaacctgcccaattgccggctttatcacctcaaagccagcagcacgccgattattgccgacaggcagtgcaagagatccgcgcgatagctgaacaaaccgcagaatcgctggataaggcactgatcgaaaaactgttcttcttattggatcaggtggcattgatgcagatggtgaaagccttatcagcaatgcagaccttgccaatgcatcaaaccgtaacccttgatgaaatcattcagaaaggcaacattgcagaagaaaaccggcaactaacccgacgctggctgcgcgcgttggtacagcacgattatctggaacagacaggcgatcattaccgtttaatcaaaccggtctctgagagcgagatcaatgacgactggcagcaatgcgaacggctcatggcgcaattggatgacgatcgcggtttattgacctatctggaacgcagcagccaatgtttacctgaattgctacaggggaaagaagatccccttaacttactgttcccggatggcaaccttgacgtcgcgacccatgcttatcagaacaatttgatcagcaaattcatgaaccgcttattgatcagtgccgccgagaaaaaagcgattgaagtaaatcagcaacagcatcgttgcctgaaagtgctggagatcggcgcgggtgttggcgggacaagtaatgtgctgatcccgcatttggccggatggaacgtcgaatatacctttacggatgtttcaaccttcttcctgaatgaagccaaaaaacgttatcaacaatttgattttgttcactatcagctgtttgatttcaatcagtcacccacggaacaggggctggattgcggccagtttgatctgattatttctgccaatgtgctgcacaacgccattattgcccgtcagggactggataatctgcgacagcttctgactcccggtggctggatgctgatcattgaagccacccgcgataactatcaattaatgacatcgatggaatttaagcacggcttaacccagtttgccgatgaacggcttgaattggattcgccatttatgccgcagcaaaactggctgaatgcgctgcacgatgtgggaggcgaaaccgtttgggcctatccgcctgctgatgacgcgttatatcagatggggcaaagttttatgctggcgcagttcaactcacgtcgccagcattgtgaacctcaggcgttactggccagcctgcgggatcaattaccggaatacatggttcccgctaaactggcgatcctggatgccttacctgtctccgcaaatggcaagttagatcgcaaacggcttcctgccttgcctgatcagacgcaaaaccgggcagagatagtatcaccgcagaccgatgatccgctggagatgaccttactgacgctttgtcgcgaagttattggcaatccggccatcggggctgatgatgatttcttcaccagcggcggcgattccttgttaattacccaatggatcaaccgcatccgggaaacactgggcgcggatcacgttccctgggaagggagcttaaggcaggtactgcaacagccgacagtcagggcactggccgcgtatttgcgcagccagtcagaacagcaggaaactcagcagagccagcgtacccgcgtcacctgcctgaaaccaggcgatggcgagccggtgattattctccatgaaggcagcggcaccattttgccttatctgccattggtcgaaaaattatcagggccagtgtatgggttgagcgtgggagatattgaggcattcctgtccattccggccgacaacctgatcccacaactggccgcccattacttacaggaaattcaggcgatatcaccgcattgccatcttgtgggctactgcatgggcgggctgctgacattcgaaattgccagacaggcgatggaaaacctgacaccggtcagatccgtaacggttgtcagcagttaccagatcccctatcgcatagaagatagcctgatgatcgatatgtcgattgtctgggcgctgggcattgccagcccgtggccatttgagaaaacccaacttgacgcgatttatgaggaaattttggctgagaagccggatgtcattacccatgatgtcgtgacgcagcgtgctcacgcaaaagggttacatcaactggcggccgcgtatgcacaagttcagcagcaacccgaagaccagcgcttatcgcagttattggctgctattcagggaaccgcatcggctcaatctgacgtcagccagacccagtggaaacagagggttgaagtgttccgccacagtattcggggcgtctgtggctaccagccggaatattttgccggagacatgacctttgcctgccagcagggaaatacccacctgttaccggccttgcagcaggatatgaagacgttctggcagaccaactgcattggcgatgtcacctatctcgatctgaatggcgatcattttaattgcatgaatgtcagcaatattgatccgctggtgcatcatattgaacagggcaaaatgagggaagcagaatga

SEQ ID NO: 2439 - DNA, 11097 bp, Xenorhabdus bovienii
  Coding DNA location: Contig name=SeqID_16870; Position on contig =139596..150692bp; Strand=-
atgaatagtataaaaaattcaacccgatgggtaagaaatactttatttaagcaggcggaacaggcaaaagaaggtattgccttacgttactgcattaaaaacacaaatgggactcaagataaaaccgaaatttatacttatcaggatttattatcgcttggctgcaaattagccagtcagctaacgctaagatcggaaaagcagtcttcggcattattattaatgcccggtgactcatcatttgtcataagctttatcgcctgtattattcgtggcatatcggctattcctgtacatttagcgagtcatttgcggattaatcgtagcagtgaaacgattgaccatattattgaagatagtcagcctgagtttattctgactttcagccattttgccgatgaaattgcggaacgaggctggaataaagatcgccaattaatttttgtcgataaagtcatagcggctcttgttgattctgagcaggtattcccgacagaggaagaatatcacgcactttatcatctctcactttgtcataatagtgatgctcccgtttatcttcagtattcatcaggctcaaccgcaaaaccgaaagcggtctgtaattatgatgacaacatgcgggtgcagcatgaaatattgctggaattacatcagcattgtcagccgaaaatcatcacggctaactggttgcctttttatcacgatctgggcatgttctgcgggttgttattgcctctgttatcagggggatgctgcaattttatgccgcctgttcatctggtttcggagcctttccgctggttaaaaataattcatgattatcaggccaattcggtagctgctcctgattttgcctgggagctctgcgcttcaatggtgacggatgagtggattacacaattagatctgtcttctgtgaaaatggcgatgaatgccgccgagccgatccgagccgaaacgatgaaccgatttgcttgccggttttcggcaacgggatttcatccgcaaagttttacaccggcctatggcatggccgaatcgactttagtcattagctataaaccgattggcacggactatgttagcagacgctttaatgcagaagagctggcaaaaggcagagctatcccctctcctgacggacgggaattaatcagttcaggtcaggtcgctcatcagtggcaattacagattgttgatcctgaaacccatcggccattgccggaagggcagatcggtgaaatatgggtcaatggggcttcaacggcggggggatactggcaaaatcaggcgctgacggaaacggtctttaaaaacacgctggcaggcgatcactcaggcaatcactatctgagaaccggcgatttagctttcctgtatcaaggtgagttatttatttgtggtcgtttaaaagatgtcattatcgtgggcggtcaaaactatatgcccaatgacattgaaacggttattgaacgtttctgccccggcgtaaaaatcgggggaatttgcgtttgccaggattttgataatagcgaattaattatcatggcggaagtttaccgccatcttaatcacgatgaattagattcgattgctaaatctatggtggcggaagtcgcgaagcactttcaattgatggttggcaacgtggttctgctggcaaaaggaaaattaagcaaaacctcaagcggcaaaatccgtcgtcgtcatatgttatcgcaatatctggcgcatcagcttgaagtggtatcgatctattctgctgaagaaaaatctgccgcaataacgtcttcacccctttttgacgggttacagcaaacactgtgtcatttattgggcattgattcatttgatccccatcgcggttttagtgatgcggggctgaatagcctgctggcggtaaaattctgccaaaaagtcaatcagtaccttgatggcaaatattctgactacaaattgagggtgacggatttatttgcttatccgactttagcccaattagcccattatattgagcagcatcgtagtcaaatcaacaccaatgagacgttggcagagccaaaaaaggcggataaggaaatcgcaatcattgccattagttgccgtttacccgggcagaccgatgaacactggcagcactatggcaaatggctggcagcagggcaatctgcggtacgtcatgaacagagtcgttatcgtcattttgttcagccaatcggggcaatcaataatattgaaaagtttgatgcccattttttcaatattgccgatagagaagcgctattactcgatccccagcagcgcatcctattagaactgagctggcacttgtttgaacagacagattggttgccgaaggcagtcaaacagcgcgatatcgggttttatatcgggcagagtggcagtgaatacgggcaactgttgttgcagcagaataaccctgattatgccaaaagttatctggcgacggggatcaataccagtgcgacgtctggccgactggctaaattctatggaacaaccggcccggcattgaccattgatacggcgtgttcttcttcccttgtcgccttgaatagtgcgatgaatgccctgcaacaaaaacagtgctcggcggctgttgtgggcggcgttaatctcttactgtcaccgcaaattgaacaggccctgattaatgcgggtatgttgtcacctcatgggcgttgtgccacattcagccgtgaagctgacggttatgtcagaggtgaaggggcggttttatgtttgttgaaaccttatcaacaggcattggctgatggtgatcccgtactggctgtcattgaaggcagtgttgtcgcacaagacggcgaaagcagcagcttaaccgccccgaatcccaaagctcaggcagctatgatgacacggttattaaccgatgcagcactgacgccggaggatatttcgttactggaaacgcatggtacagggacggcgttaggcgatcccatcgaaatcagcgccatcaatgccgtatatggtcagcgaaaaacgccactgcgtttaggggcaagcaaaagccagacgggtcacttggaagccgctgccggcctgtgtgccgttgtgcgggcagtggcgcagatccagcagcagaaagcctttggccatcctacctttacccaatgcaatccgctaattgcagactattttgaccattatcattttgagcgtgaaacggtttcttgcgagatcaatcgggtcgcggtgaatgcgttcagttttaccggcacgatggccggagtcgtactgagaaaaccggaagtacgctcagaaaatctgactgatggcgtaccgtcagtgtttttaccttctttgtatccttttaaccgacaaagttactggccagaagcgctgttaatcggtgatggcgataaagcagaaaaccagccgctattgccagagcatagtcgcctgaattttgattttgttcgttcatgggttgcagacacgttatccctcgatatcagtacattatctgacgatgaagacttgctcaatttagggctggattctttgcagatgctggatctggtggacgaatgcaagaaactgaatgtctctctgacgctcgcgaaattgttcgaaaacaccactttgtcagcatggcggcagtattggcagagcataaatgtgactcatgagctacaaaaagagcctgcggtttcttccggccggtggaatggtgagccatttgcattaacctctgttcagcaggcttactggcaaggacggcaacaagggcaggtgcttggcgacgtggcctgtcaggtctatctcgaactggactgtgtttcactgccagattcagccatcaatcaggcggtcaacaagctgtttcaacggcatgacctgctgcggatgcgcattaacgagcagggattggcggtgatccgcgatgatcagccggttactgttagcagtcaccaatggttacatttatctgatgaagcctgttctgccgagcgtatgaacttaagacgtcagttatcgcatcgaatggcggatctgactcaagaaagtggcttccagttaattgccagccacagtgctcagggaacttgcttacatatcaatgttgatatggtgatagcggatgccatgagccttcagatcctgttggatgaactgagcgaatttattcgccagccggaattgtcactcactcccctgaattacaatttcccacagtatttgctggatcaggatttaaaaaacgtcaataacactgaacatgcagcctattggcagcaacgtgttacagcaggattacccttggcgcctcaacttccgctggcagtgcaacccgcagaattgaatgaacagaaattcagccatcgtaactggcggctggaggcggaaagttggggtcggttaaaaaatatcgcccgccgttatggtgtcaccccctccatgttattggcagggtgttttgctgaaaccttaagaggctgggcgaaagagcctgatttttcactcaatctgactatttttaatcggcggggagaacatccggagctatcgaagctggtggctgattttacgtcactgttattgctggcctgcaaaacacaggcggacgatagcattctgacccatgtgcgtcgtttaaatcagcaattcatgagggatcttgatcatgctgattacagtgcggtgcaggtcttgcgtgactggtcacagcagcggggagagcaggtgactatgcctgtggtcttcaccagtaaccttgggcgggatctgttgagtgaaaaaacactgggcacactcagttacctgacttctcaaacgccgcaggtgtggattgattgtcaggtaatggagcatcaacaggaattactgatcagttgggatacggtcgatacgctatttcctgtagacatggtcgatcagatgttcagctttatgacccgactgattatggcgatagttcaggatgaaacggtattacatgcaccggtcacggcctatattgcgccttcgcgattagcactgcgtagaaacccgcctcaaaacgagccaatcccgccgttggctccccggcttttacatcagcaattctggctctgggcagagaagacaccgacgaatattgcggtgataagccaagggatcgccctgacttatcaggaaatcagtgaacaggtgcgtgaactggcgtggcgtttaaaggatcgacatatccagcatggcgatcatattggcttgctgctgccgaaaggcgttgagcaaatcgtggcggtactggcctgccactccgtgggcgcggtgtatgttccgctggatattgcaatcaaagcgcagcggttgcagcagattatcagccagtctgatatccgtttagttattggtcatcaagagtgtgaaatacaggacgatcaaaccgattatggctggctgaatatagccgcaaaaagcccgaacatgctcccgattgagcggattgttttcggccatccttccgatgttgcctatatcattttcacctccggctcgacgggtgtaccgaaaggcgtggtgatctcacatcagtctgcggccaataccgtcgatgacatcaatttccgttatagcgtcagtcaaaataacgaaaagcagcgcataactatttttgcgttatcagcgctgaattttgacttatcggtctatgacatttttggccctctctccctcggcggaacccttgttttaccgaatgcgggacaggaaaaagaggcgaagcagtggcttgctctgttacatgagaatcaggtcacgcactggaatagcgtaccggctctgtttgaaatgctgctggtggcggcagaacaggaaccgcgagggctgcctgcttcgctgaaccagatcctcctttccggcgattgggtcgggctggatctgttaccgcgtttgagggctttgggcagcggggcgaactttaccgcgctgggcggcgcgaccgaagcggcgatatggtcgaatgccatcgacgtttcagtgatcccgtcgcattggaattcaattccttacggctatcctctggcgcatcaatattatcgcgttgttgataaccaggggcgggattgcccggattgggtaacgggtgagctatggattggcgggcaaggcgttggattgggctattacgctgatcccgacaagaccgccgcgcagtttgtgatccaagggggagagcgtttttaccgaaccggagactttggccgcttctggtcagatagttgcctggaatttctggggcgtcaggacaggcagataaagctgcatggttatcggattgaactcggcgaaattgaagcggttgccgaacgtttgacggaggttaaacatgcagtggccttgtttttggataagccgcaaaaacatatccagctatttatcgaaggcaaagaacagcacagctcccgtgaattaaccgcgccagcctatgctgtgatgagcgaactgcccgatcacatcactgccattgatcagcgtcatgatgaaaaagaaatcacaagtcatctgctgcatcatattctgaccgatgtttttgcccttgattttactgactgtcaatccagcgaagtattactggaaaaagcgggtattacggcgcaatggcaaccgctatttggcgcttggttggcgtggctggttgaacagaaaatgctggagtgtcattcagaccgtttcaaggcaactgcacgttggcaacaacgccgattggctatccatgatgagagattattatcgatccatcatgccatcgaacagaaagccacatggctggtggcggtcttaacgggcaatgaaaatccgctgttattactggataatccggtcatttcgccggagaacttagttgcttattcaccggatacgctggcaatggcggatgcgctttgccagcaaattgaaagcttatcggcacagttacaacgtccggtacgagtggctgaattaaatggccgcagtggcatactggcaagttatctcctcagccgtctgaaagcggagagcgtccattattgcctgatggaatcggcgggttctctgagaaaactggctgaatatcgtctggcaggctatcagcatacggttgacgtgatatcggcgccggagcaggtggtattctctgccgatattgtgatcaccaacaatgccttgcatcggtttagcgatattgctcagggaatcgaggcgctcaaattactctgtggcacggattctctcatttatgcgtatgaaagtctgacactcagcccactggcgttgctgaccgtattattgttgcaagatcagaatggctttagcgatcagcgcaaaggtgcgttttcaccgctactcaatcagcaggactggcagcaaaccctgagcgatgccgggctggttctccatgctgtcaaagctgttcagcctcattctatgctgtttatctgccagtgccgacaggcgaaaacactgatccaccgtgaaacactgatgcagcatctgcggcagtatttgccggtgtatatgctgcctgcgcagatcacgtcattaacgccgttcccgctcacggccaatggcaaaattgaccgtaatgcactggcggcacaagcggcggctgtacgacctgagatatttactgatccggcggaaaaagcggctttatctgatgagcgtgaacagtgcgttgcgcgggtatggcagcagatattgggtgttgtgccgcaggctgacagtaactttttcctgtcaggaggcgatagcttacatgcaacccgcatcgtcgctcagttggaaaaagaaggcgtggtggatgtcacactggcacagatcttctcgctgcccgtgttgcgtgattttgccagttccatcacattcagcgcgaaagtatcgccgtcagctcagttaattcatcagccggaactgcgttatgcgccgtttgaacccacggatgttcagcgggcttatttgatgggacgccaggcggggttccatctcggtggcgtcgccacgcattattacaatgagtatgaatatcacgggaatgagggaacggcatttgatccgatcaggcttgaaaaagcgctttcacaactggtcgcccgtcatgatgcgttacgcatcgtatttgatgaacacggcgctcagcgggttctggcgcagcagccttcatcagcactcacgatgatttcttgtcgtgctgatgagtgggaaatcgttaccgcaacccagcgggaatatctgtcacaccgcgtgctggagccggcacaatggccgttattccacgccacactgattcagtccgatgacggcagaagccgcttctgccttggattggataatctgatactggatggcctcagtatgcagatcttcttcaccgagctggcggttttttatgccaatgccgccgttgatttgccgtcggttgatatcggcttccgtgattatctgactgcaacgcatctgaaaccagaatcagagaacaactcagaaaactactggcgtgaaagattggaactattgcctgatgcgccgcgtttgcctctggtatgcgatcctaaatcgctggggacgccaaaattcaaacgctggcagtccgttctgcccgcggctcgctggcaaaaactggccgccaaagcgcgcagctatcaaatcacgccctcttgcctgttactgacctgttatgcgcaagtactggcgaaatggtctgaatctgcggctctgacgatcaacgtgacgctgtttgatcgccagccttgccatcctgatatcaaccatattatgggggatttcacctctctgctattactggcctgtcagcaatatcaggacgaaagttggtttgagcgtgtccagcggactcaacagcagctctggcaggatctggaacattcagatgtttccgccgtctgggtaatcagggaactgaatcgccagcgtggaaccacggatgtcacgatgccagtggtatttaccagcgctttgggcgcgcaggtgacagattatcctgatgttgatttccctgcttcgatctggggaatatcacagacgccgcaggtctggattgatcatcaggtctttgagcgggaaggcgagctgcatttcaactgggatggggtggaagcgctgtttcctgcccagatgattgatcagatgttcagtgcttattgccagttactggaaaaactggcggatgcggaaagttggcatgttcctttggctgtaccgctgcctgcctctcagcaaatcagccgccagcaggtgaatgaaacccgcgcgccgtttgatttttctccgctgcactgccgtgtagctacagcgatgcagaaatttgccccgcgaacggcactggtggagggcgatagcgtaatcagctatcagcagctagagcaggcggtcagaaaattggcgcagtatctgaccgagcagggcgtcagagaaaaagatttggtaggtattgtactgccccgcagtggtgaacagatcatcgcgttactggctgtgcaatggctgggagcggcctacgtgccgctatcaagccaatggccgttatatcgcagagagcaggtgattgagcaagcagaaatacgctacgtcatcagtcaccctgcactgacatggccggatacggtcacggtgctgtctgtacaaggggagcctgattccgcatcgcgtcctgaaccgctggcggtgacatcagaagatcttgcctacattattttcacttcgggcagcacaggaataccaaaaggtgtggctatcagccacggtgcggcagtgaataccattgaagcggtaaaccgtcagcatcatctgcatgaagcggacaggggaattgccctctcagcgctgcattttgatctttccgtctgggatatcttcgggctgctctcggttggcggtgcgctaattaccgtcgcagagcagcaggaaaaagatgctgctgcttggttgtctctggtcagtcggcatcgggtcacggtctggaacagcgttcctgctttgctcgaaatggcgctgctgatccagcaacatgaggagaccgacggtgcgctggcgagtttacgcttagtcatgttatccggtgactgggtggctccggcattgccgcagcgcctgaaaacattcgcaccggatgctcagtgtgtggcgatgggcggcgcgacggaagcagccatatggtctaactactgtttagccgatgagtggttagccaacgagtggcaagaggatgaatcggcttctggctggcgatctgttccctacggcgttcctttgcctaatcaatcattccgcatcgtgaatgaaatcaatgaagattgcccggactgggtaacaggagagctctggatcggcgggaaaggtgttgctctgggctactttggtgacagggaacggacagaacgccagtttgtcagccatcagggacagcgttggtatcgtaccggtgatacggggcgttaccgtccgggtgcggtgatcgaatttctgggacgcaaagatcagcaggtcaaaatttcgggttaccgtctggaactggaagaaatccagcatgtgctgaaaacctgccctgatattgaagacgctttggtttttgtcactcaacaacatgatcgtccattgttgtctgccgttgtgatgtcccacgatgaaccgaattggggcgatatcatggacgcattgcgtcagaaactgccggaatattcgataccgactcgcgttggtcactgtcagcgctggcctttaacggataacggcaagcgtgatcatcaggcacttgaaaccctgctgcacccttatgtccgtgccgtggaaaccacacgtccgttaacggaagcggagcaacttctctgtgatcagctcaaactcttattagacattccgcacattaattttcatgacaacttctttgccattggcggtgactccttcattgctacccgtttaacgtcggcactgcgtcggcatcatggcattgaattaccgctgtggaaaatatttagcttacagactatttcacacatcgcccagaccattgaatccacattcatggatgaagcagatattcaatttgaggaaggttcactatga

SEQ ID NO: 2440 - DNA, 2067 bp, Xenorhabdus bovienii
  Coding DNA location: Contig name=SeqID_16870; Position on contig =150865..152931bp; Strand=-
atgatgatatttaaccgggatgctgtgacgctggcagctttaatctctattcctttcaattcatttgcagaaacgaatgaaaaagatcagaagattgaattagacactattaccgttaccgcgcagaaaatcaaaacagaacaacagaaaacacctgtcagtatgagtgtattaactgattttgatcttgagcggcagaatattgaaaatatttctgaagcaataatgcgtatccccaatttttatatggtaaaggcaggcaatccatctgatgccggttttttctctatgcggggaattactcccggtatggaaggggagcaatctgttggctttttcattgatggtgtgaataccaatacttacgattcagaattactcgatattgataaaatcgaagtattgagaggcccacaggccactttatacggccgtaataccgaagcgggtgtggtgaatgtcatcactaaagacccggatttttcacctgaatataatttcggcctttcttatggtaattataatcgcacgcaggcaaatgccattctgggcgggagtataaaccaaagtgaagattgggcttatcgtgccgctctgaaatacctttatagcgatggctattttaaacgtgattatgatggtaagaagaacgtagataataatcgtgacttcagcggccggttaaaactgcgctggcagccatccgattataactgggatgtgattacgacttttgatatgcagaaccgccgtaacggcaacatgtcttttgccgcattggatgatatcaaaaaagggcgtaaatacgttaattccaattatattggtaaagtcaatgttgattcttataaaggtcaggtgaaggccgtctattcttgggataatcttgatttcacttcaatcagtgcttataccgatgaaaagaaaattgataatcaggatttagattttaccaaaaactccatcagtgagttactgatgaagagaaaaacgaattacttatcgcaagagtttcggttaaattcaaaaaatgagggcgcctttaactggttgattggtgcttatacattccatcagaaagacaaaaatattattgattatcgtaatatccccaataagttctcgatgttaagggactctgatataaaaacagataactacgcgctgttcggtaatgcaagctattatttgctggataatgttgagttagtcgcgggtcttcgctatgactacgaaaagaaaaatatcgactttaaactgagtggcatgggcgaatcccaagacaataaccgcctgtcatttgatacttggttacctaaagttggcgttaactattacatgaccgacaatgtcatgtcttatgccagtgtttcgcgtggttacaagagcggtggctttaataccctagggccaaaatccagccgttcttatggagctgaatataccaccaactatgaaaccggctttaaatccgaatggtttgataaacgtgtacgctggaatacctcattcttctggattgatttaaaagatcagcaggttgaagtggcttcttacccactgtcttataccgtcaacagtggtaaatctgtcagccgtgggattgaatcagaattggcgtggcgtattacgcgtagcttaacggcatctgttaatgcaggttatacccatgctaacttcaaagatttcccaaccgaaatcaaaaccactgaaggtaagtttgccgcggtgaattacaaaaataatcgcccggctaactcaccagattatacttatggtgtgggtgtcgactataacttcctcaatggctactttgtccgtgccgattacaatgtaaaaggaaagacttatttcgataacagtaacagcaaaaaacaatctgcttatggcttattagatcttggtgccggttatgaaaccaatgactatgcagtgaaattgtgggttaaaaatgcgcttaatcagaaatatgctacccgtgcattccagatggacgatggaaaatggtatgcgcgtgccggggaaggaatgaacttcggcgtgaatgtaaatattaaattccaataa

SEQ ID NO: 2441 - DNA, 102 bp, Xenorhabdus bovienii
  Coding DNA location: Contig name=SeqID_16870; Position on contig =153119..153220bp; Strand=-
atgaataagggtgatttcgctttgttactactaactattgtgaatgagaatcatttgtgttttaatgccgacgctttagataaagaaaatatatggcattaa

SEQ ID NO: 2442 - DNA, 447 bp, Xenorhabdus bovienii
  Coding DNA location: Contig name=SeqID_16870; Position on contig =153547..153993bp; Strand=-
atgcatgaatccctgacaattgcattgcttcaggcacgggaaaccgcaatgggttttttccgtcctattttgaaaagctataacttgactgagcaacaatggcgtattattcgcgtacttgcgagtagccgttcgattgattttcatgacttagcttgtctcacctgcatcttgcgcccaagcttgacgggcattctgacgcgtatggaacgtgatggtcttatcttccgcctaaagccaatgaacgatcagcgtaagctgtatgtttccctgacaccggctggtcaggagctttacgaacaggccagagggcaggttaatgagggttataaggcgattgaggatgctttttctccagcaaaattggcccagcttttagcgttgctggatgaatttacttccatcggaaacccctctcaggaagatatagagacagagaatgagtag

SEQ ID NO: 2443 - DNA, 663 bp, Xenorhabdus bovienii
  Coding DNA location: Contig name=SeqID_16870; Position on contig =154381..155043bp; Strand=+
atgaaaggcactgtttttgccgtcgccctcaaccaccgcagtcaactcgatttctggcatgaggcatttgacgagctaccttataaaacaccaccaaaaactccaatttggtttattaaaccccgcaatacggtgattggctccggtgatattattcctcatcccatcggggaaacggtacaaagcggtgcaacgctggcactgctgattggcaaaaccgcccgtaaagtttctattcaggatgcagagcaatatatcgcgggttatgcattggccaatgaggtcagcctgccagaaacttcgttttatcgtcccgctatcaaagcaaaatgccgggatggattttgtccaataggccagataatcacaacaaaatcagtgaattcactcgaaatcatcactgaaatcaacggtcaggaagttgatcgctggtcaacccgcgatcttatgcgttctgctccggaactcctggcggcattaagtgattttgccacgttaaacgaaggcgatgtcatcctgctcggcaccccccatcagcgtgttactctccaccctaacgacaccgtcacggtcaaagctgaaggttttcctgcgttggaaaataccgtagtttcggaggatatcgttttggaaggaatggcgcaggcaggaggtcagtcatga

SEQ ID NO: 2444 - DNA, 765 bp, Xenorhabdus bovienii
  Coding DNA location: Contig name=SeqID_16870; Position on contig =155040..155804bp; Strand=+
atgagacaagccagagttcgttatcagaatcaagaaatgagtgtcatcgtcgatgaacaggaaaatgtcctgctgtctgatggatgcgtcgtcagcggacacgatgttttgtggctccctcctgccaatggcaccctgttcgcattggggctgaattatgccgatcacgccacggagctggaatttaagccaccggaagagccgctgatcttcatcaaggccgccaatagcctaaccggccatcgtcaagtttccgtccggccggacaatgtggaatacatgcattatgaagcggagttggttgttgtgattggcaaacccacccgcaatgtttccagagaacaggctatggattatgtcgcgggttataccgtctgtaatgactacgccatccgtgattatctggaaaattattaccgccccaatctgcgcgtgaaaagccgcgatacgctcaccccgataggcccgtggatcgtggataaaaatgaaatagccgatccccataacctgatattgagcacctgggtcaatggggaattacgtcaacgcggcacgacggcagatctgatctttgatattcccttcctgattgcctacctgagcagttttatgacactacagccgggagacatgattgccacaggaacgccgaaagggctgtcagatgttgtgccgggtgatgaagtgattgtgtcagtcgaaggtgtcgggcgtctggtgaatcacattgtcagccagcaagaatataaggagaacctgtcatga

SEQ ID NO: 2445 - DNA, 1467 bp, Xenorhabdus bovienii
  Coding DNA location: Contig name=SeqID_16870; Position on contig =155801..157267bp; Strand=+
atgaccaccattaatcattggatcaacggcaagaacgttgccagcaacacctattttgaaaccaccaatcccgccactggcgaagtgctggcacaagtggcatccggtgggcaggcagaaattgatcaggctgttgcagccgcaaaagaagcgtttcccaaatgggcgaatacaccaatgaaagaacgcgcccgtctgatgcgccgtttaggggagttgatcgaccagaatgtacccgatattgcggcgatggaaaccaaggatactggcctgcccatccaccagacgcaaaatgtgctgatcccgcgtgcttcccataatttcgatttcttcgctgaaatttgccagcagatgaatgggcggacttatccggttgatgacaagatgctcaactatacgctgatccagcctgtcggggtttgtgcactgatttctccgtggaatgtgcctttcatgactgcaacgtggaaagtggcaccgtgtctggcgctgggcaataccgccgtgctgaagatgtctgaactttccccattgaccgccaaccgtctgggcgaactggcgctggaagcgggtattccggctggtgtgctgaatgtggtgcagggatatggcaataccgcaggcgatgcactggtaaaacatcatgatgtgcgggcgatctcgtttacgggaggaaccgcaactggccgccggattatgcagagtgcgggtctgaaaaaatattcgatggaactgggtggcaaatcccccgttctgatctttgaagatgcggatattgaacgggcgctggattcagcgctgttcacgattttctccctcaatggcgaacgctgcaccgcaggttcccgtattttcattcaggaaagtatctaccccgaattcgttaagcgttttgctgaacgcgccaatcgcctgcgtgtaggcgatccacaagatccgaatactcaggtcggcagcttaatcagtcaatcgcactgggaaaaagtctccggctatatccgtctcggtattgaagaaggggcaacgctgctggctggcggccctgataagcccgccgatctgcctgaacatctgaaaaatggcaacttcctgcggccaaccgtgctggcagatgtggataaccggatgcgcgtggcacaggaagagatcttcggccccgttgcttgtctgctgccttttaaaagtgaagaggatggcctgcgcatggcgaatgatgtggagtacggcctggcgtcttatatctggacgcaggatgtcagcaaagtcttgcggctggcgcgtaacattgaagccggcatggtgttcgtcaattcccagaatgttcgcgatctacgccagccgttcggcggtgtgaaagcctccggtaccgggcgcgaaggcggggaatacagtcttgaagtgtttgccgaagtgaaaaatgtctgtatctcaatgggagatcatcccattcctcgttggggagtgtaa

SEQ ID NO: 2446 - DNA, 891 bp, Xenorhabdus bovienii
  Coding DNA location: Contig name=SeqID_16870; Position on contig =157319..158209bp; Strand=+
atgggaaagttagcgttagccgcgaaaattacacatgtaccctcgatgtatttgtccgaaatgccgggcaaacatcatggctgccggcagggggcgattgacgggcacaaagagatcagccgacgttgccatgaaatgggcgtcgatacgatcatcgtgttcgatacccactggctggtcaacagtgcttatcatatcaactgtgccgagcacttctccggcatttataccagcaatgagttgccgcattttattcgcgatatgacttatgaatataacggcaatcctgaactcggccggatgattgcggaagaagcccgccagatgggggttcgcgctcaatcacatgagatctccagcctgaaattggaatacggcacattggttcccatgcgttatatgaacagtgaccgccatttcaaagtgatttcaatttctgccttttgtaccgttcatgcctttgaagacagccgcaagctgggagaagccgtgttgcgggcgattgaaaaatatgatggcatggtagcagtgctggccagcggctcgatgtcacacagtttcattgatgatcagcgcgcggaggaagggatgaacagttacacccgcgagtttgatgagcagatggatcgccgcgtggtgcagctttggaaggaaggtcagttcagggaattctgcaaaatgctgccggagtatgcgcaatattgccgtggtgaaggcaatatgcacgacactgtgatgttgctcggcctgctcggttgggacaaatacaacggtaaggtggaatttctcaccgaattgttcgctagttcaggaacagggcaagtaaatgccgttttcccgctatccgatgatgcggttaatgaacaaaccgccgaaaaaatcagagcctga

SEQ ID NO: 2447 - DNA, 390 bp, Xenorhabdus bovienii
  Coding DNA location: Contig name=SeqID_16870; Position on contig =158222..158611bp; Strand=+
atgccacatttttacgctgaatgtaccgaaaatatccgtgaagccgccagattaccggcgctgtttgccaacgtgaatcaggcgctggccgatacgggaattttcccgctgggcggcatccgcagccgtgctatttggctagatacatggcaaatggcagatggcgaacaagattacgcctttgtccacatgacgctgaaaatcggcgcaggacgcagcctcgaagatcgtcagcaagtcggcgaaatgctgtttacgttaatcaaagcacactttgccgatttgatggcacagcgttatcttggcctctctttcacaatggaagaacttgatccgatactgaattataaatcgaataacgtgcatcagctgtttaaatcaaaagattag

SEQ ID NO: 2448 - DNA, 1485 bp, Xenorhabdus bovienii
  Coding DNA location: Contig name=SeqID_16870; Position on contig =158675..160159bp; Strand=+
atgacaaatcatctagagacattactgctgcgccaacaggcttatatcaatggtcaatgggttgatgcgcataataaaacgacttttgccgttaccaatcccgccaatggcgaagttattgccaatgtcagtgatatgggttccgcagagacacagcaagccattgaagccgcccagactgcccttcccgcatggcgagcattgactgccaagcagcgcagccaaaagctcaaacaatggttccagctaatcatggataaccaaaaatcgttagcggaactgctgagtgccgaacagggaaaaccccatgcggaagcgatgggagaaattgcctatggtgccagttttatcgagtggtttgcagaagaaggtaaacgcatttatggcgaaactatcccatcaccgatgccgggtcgccgtctcgcgaccatcaaacagccgattggcgttgtcgccgcgattacgccgtggaatttccccaatgccatgatcacccgtaaggttagcccggcactggccgctggttgtacggttgtactgaaacctgccgcagaaactccactgtctgcgctggcattggccgttctggctgaacaggctggcattccggcgggtgtcctgaatattgtcaccggtatggatgccaaagtgattggcgaaacactgacttcaagccagatcgtgcgcaaactctcttttaccggctctacccgcgttggcaagttactgatggcgcaaagtgccgataccgtcaagaagctttcccttgaactcggcggcaatgcgccttttattatttttgatgatgcagatcttgatgctgctgtggaaggcgcgatggcgacgaaattccgcaacagcgggcagacttgtgtctgtgccaaccggattctggtacaagaaagcgtctatgatgcatttgctgaacgtctggttcatgccgtcaaacaacttcgcgttgggccagcccatagcgattcatcacaacctgcgtcacaacaagggccgctgattaatcaggctgccgtggaaaaaatacaggcgcatatcagcgatgccgtttccaacggcgcacgcattctggccggcggcaagtcccacacattgggcggattattctttgaacccaccgtgctggccgatgtggatggttcaatgcgggtcagccatgaagaaaccttcggcccactggcgccgctgttcaaattccgcgatgaagaagaagccattcgcctcgccaacgatacagagtttggcctcgcggcttatttctattcccgcgacattggccgaatttaccgggtggcagaagcactggaaagcggcatggtcggcattaatgaaggtttgatttccaacgaagtggctccattcgggggcataaaacaatctggtctggggcgtgaaggttcgcgccacggtatcgaagattatttagaagtgaaatacctctgttttgggggattgggcgctaaaggagcttaa

SEQ ID NO: 2449 - DNA, 813 bp, Xenorhabdus bovienii
  Coding DNA location: Contig name=SeqID_16870; Position on contig =160166..160978bp; Strand=+
atgcaacagcagctacagcaagaagtcgtatcacaggttgcacgccgtttacatcaggcagaaaaaaaacgagagcagatccggcaaatttcactggattacccagagataacgattgaagacgcctacgccattcaacgtgagtgggtcaatctgaaaatcgcggaaggccgagtactcaaggggcataaaatcggcctgacatcccgagccatgcaagtcagttcacaaattgaggaaccggactatggcgcattactggatgatatgttttttcaggacggcagtgatattccctgcgaacgctttattgtgccgcgcattgaggtagagctggccttcgtgctggcaaaacctcttcgtggcccgaactgtacgctgtttgatgtctataacgcgacagattacatcattcctgcgctggagttgatcgatgcccgctgtcacaacatcgatcctgaaacccagcgcccgcgtaaggtgttcgatacgatttctgataatgccgccaatgccggtgtcatcatgggcgggcgtcccatcaggccggatgagctggatctacgctgggtcagcgccctgctctatcgcaatggggtgattgaagaatccggcgtagcggctgcggtgcttaaccatcccgccaatggtgtcgcatggttggctaataaactggctccgcatggtgttcagcttgaagccggtcagatcattcttggcggctcctttacccgcccggtgcctgcccgcaaaggcgatacttttcatgtggattacggtgcaatgggttcaatcagctgccactttgtttaa

SEQ ID NO: 2450 - DNA, 807 bp, Xenorhabdus bovienii
  Coding DNA location: Contig name=SeqID_16870; Position on contig =161015..161821bp; Strand=+
gtggatctgttaaccaatagatttaaacaagccctgcaagcagggcatccacaaatcggtttatggcttggcctgtgcagttcatacagcgcggaaattctggcaggaacagggttcgactggctgctgattgatggcgaacacgcgcccaatcatatcccctcaatcctgacccagttgcaggcgattgcgccctatccaagccagccggttgttcgtccaccgtggaacgatccggtgcttattaagcaacttctcgatatcggcgcacagacgttgctggtaccgatggttcagaacgcggagcaggctcgcgaagcggtgcgcgcaacccgctatcctcccgcgggcattcggggcgtaggcagtgcgctggccagggcttcccgctggaatcgtattcccgattatctggctcgtgccaacgatgaaatctgtgttttggtacaagtggaaactcgcgaagccctgcacaatctgccggaaattctgaccgtcgaaggtgtcgatggcgtgtttatcggccctgccgatctcagtgcggatatgggctattccggcaaccctcagcaccctgaagtcaaagcggccattgaacaggccatccgtcagatagcggcatcagacaaagcagcagggattttaatgacccatgtcgaaacggcggaacattaccttaatctgggcgcacggtttgttgccgtcggggtcgataccactttgctgacaacagcggctcactcgctggcggtacgcttcggcaaaaaacaggagaatgtaaccccgccttcattgagcacttattaa

SEQ ID NO: 2451 - DNA, 159 bp, Xenorhabdus bovienii
  Coding DNA location: Contig name=SeqID_16870; Position on contig =161832..161990bp; Strand=-
atggcttcaggtgggctgctcattgtcgttaccttttttattatacgatgcgtgtcgcgtttttatggaaactggcatgaaaactatcactgtgctggcagatgcggcgatcgacatctgccatgtaggaataccgattgtggtgttatttatcagtaa

SEQ ID NO: 2452 - DNA, 1368 bp, Xenorhabdus bovienii
  Coding DNA location: Contig name=SeqID_16870; Position on contig =161968..163335bp; Strand=+
atgagcagcccacctgaagccatacaagaaccagagaacccggcttacccacctcaaaaactcacctaccggcagcaaaatgtcatcaacaaattgttccgacgcttgatcctgtttttatttgttctatttgtgttttcctttctggatcgcatcaatatcggctttgccggtctgacgatgggaaaagatctcggcctgtcgtctacgatgtttgggctggctgctacgctgttttacgcaacttacgtgattttcggcattcccagtaacgtgatgctcagtattgtcggcgcccgtcgctggatcgccaccattatggtgctgtgggggatcgcttctactgccacgatgtttgccattggcccgacaagcctgtatatcctgcgtatgctggtaggcattgcggaagcgggtttcctgtcggggattctggtctacctgacttattggtttcccgcctattaccgcgcccgcgctaatgccctgtttatgatcgcgatgccggtcacaatggcgtttggctcgctggcctctggttatattctggaaatggatggcatctgggatctgcgtggctggcaatggctgtttttgctggaaggcttcccttctgttctgctcggttttgtcgtctggttctatctggatgactcaccggaaaaagccaaatggctgacgcgtgaagataaacagtgtcttcaggaaatgatggagcgcgatgaactttcgcaggtacaatccaatggccctgccagccccaaaaccagcctgtggcgtgaagttttaaccccgattgtactgatgtataccttcgcttatttctgcctgaccaatactctgagcgccattaatatctggacgccgcaaattatgcagagttttaatcaggggagcagtcacgtgatgattggcctgctgacggccattccccaattctgcactatcttgggcatgatttactggagccgccgctcagaccgtctgcaagaacggaaaatgcacaccgccctgccctatctgttcgcagcggcaggctggattttgacctcactgactaaccacagcatggtgcaactgctggggattatcatggcttctactgggtcatttacggccatggcggtattttggactacgccggatcaatccatcagcctgcgcgcccgtgccattgggatcgccgtcatcaatgccacaggtaatgtgggttctgctgtcagcccgctgttgatcggctggctaaaagatcaaacgggcagtttcaactcaggcctctacttcgtcgccgggttgctgattatcggggctttgatggtctcatttatcccgatgaagcaaacgcagcgctcaggagataactattga

SEQ ID NO: 2453 - DNA, 948 bp, Xenorhabdus bovienii
  Coding DNA location: Contig name=SeqID_16870; Position on contig =163335..164282bp; Strand=+
atgccgacctctaacacaagcaaagccattattaccaatattgatatcagtaaagactatgatgaaacgcagggatctgacgatgtgcattatcaaacttttggtcgcatggccgcgttctttggccgtgatatgcaggcgcatcgtcatgatggtttttttcaacttcactatctggtgaccggacggattgaactgcaactggatgagctacgttattcagtacaagcaccgctgtttatcctaacgcctccttcggttccccacgccttctttacgcaggaagataccgatggttatgtcctgacggtacgtcaagcattgattacgccgctgctcaattcgctctaccccacccatcgggaactggttgatattccagccatctgcctttctgtggcagataagcccgatgaattggcgacattcaatcactattgggcgctgatcgggcgtgaatccgccaaccaattcgcaggacgtgaacaatcactggcatttctggcgcaatcactgtttacctttctgctgcgcagcattctccttgatgatcatcgctctggtggggtaagaggcgaactaaaactgtttcagcgttttaaccagttgattgatcagcattatcatcagcatcttgctgtaccggaatatgcggaaaaactgggaattacggaatctcgcctcaaagatatgtgtcgaaggtttgccaatcggccacccaaaaaattgatttttgaccgactgttacgagaatcaaaacggttgctactgtttagtgacagcccggtgtttgaaattgcgtatcagcttgggtttaaagatccggcttattttacccgtttttttaatcggttaatggggtgtgcaccgagtgtttggcgggagaggagtgtgggtgggggggtgaaaaacaccctgcttttgcctagtgacacatctcgcatttaa

SEQ ID NO: 2454 - DNA, 294 bp, Xenorhabdus bovienii
  Coding DNA location: Contig name=SeqID_16870; Position on contig =164407..164700bp; Strand=-
atgaacattgatttttcagaaaaaagtgggatgatcatttttaatgatttttctattagtgatgatattccgtttgagaatcaacttgatgaattaaaagaagatatgttgcaggtagaatttcctaatggatatcttttagacataggctggagaccctcattcgagattgatggacagtttaaattggcgttaattaaagactttaactgggaaaatcctgtttatttagattcagcaagtaatgtatttgaactaaaagaaaaacttcaattagcaatgcacaaattataa

SEQ ID NO: 2455 - DNA, 264 bp, Xenorhabdus bovienii
  Coding DNA location: Contig name=SeqID_16870; Position on contig =164700..164963bp; Strand=-
atgtcttggaaagatattgtcaaatcaacgaaatctgggcctgctaaatatacgccagagattaacattgaagcattagaacgctctgtttataagacaggtcaaccggttacaaatggtaaaccttggaaagttcaagatatgggggaaattatcggggctagtgaaggtaaaccaagtcaatggatgagagttgaatatagcggcggtactattcatggacatccaatctctctaaacgaatttaggaagctgacaaaataa

SEQ ID NO: 2456 - DNA, 1734 bp, Xenorhabdus bovienii
  Coding DNA location: Contig name=SeqID_16870; Position on contig =165045..166778bp; Strand=-
gtgacccgacccgatggcactatcttgcgctttggctatgaccgtctgacccgcttgaagtcagtgaccgcttccactggcgaaacctaccgttatgaacgggatgtggcgggtcagattatccgggaaactgattttaccgggcgtactattgattatcagtacgataagctaggccgccgcattcaggcacaatatcccgatggtcaacaactccgctggcactactctgctgccggttcactgattaaacaggaaagctggcagccggaagaaaaccaacgggtgcttaaagacaccaccacttacgaatacaatcaacggtatcaattggtgaaagccactcatgccgatgctaccgtcgagtatgagtacgacaaaactactggcctaccgacttgtgaacgtatcaacgggcgggaaatcacgcgtaaatgggataacctgaccgggcggccagtcagtgaaagtgtggatggcaataccctgcactttggttataacctgtcgggaagtctgaatcactttcagcttaaccagcatgtgccactgacattccagcatgatgcactggggcaggaaaccgtgcgggaaagtgccaacgggtttatccttgccagtcgctacactgccaccggcctgctgacacaccagtcggcggggcagacgaccccactgtttcgggaaacgctggcgcaaaacgacccgcacttcccgccacaggccaccgccgttaaccggagctggcaatatgaccgtgctcataatgtacgggtgattgacgacagctgctgggggcaaacccgctaccgttacaatgccaatgaccaaatactgaatactctgttcgagggggcgcgtccgcatgaagagcaattcagctatgatactaacggtaacctgagccaacatctgcctgtagatgcctacggcgcaatggcacaaattacacagcgtcagaaagccgggcgcgtggtgcagcaaggggatatccgttatcgctatgatgacaatgggtgtctggtggaaaaaaccgaacaacgtgacggattccgcccgcaaatctggcgctaccgctgggacacccaaaaccagctcacccactgtgaaacaccggatggatcgcgctggcattatcgctacgatgcttttggcagaagaattcggaagctgaaagtgcacgatggtaagctgactgccgccaatttacagcgctggctgaatggtaaaccggatttaacgccgagagccgatgccatcatgggacaggattacctgtggagtggtgaccagcttatcgaagaaacaccgatttacgccgatggtactctagtagaagatcaacgcatccgctggctctatgaacccggttcattaacgccgtcagcacgtgttgaaaaaggcaagctgcactatattgtcagtgatcatcagggcacgccccgcgaaatgttgtccgaggaaggggtactggtctgggcgcagcggctgaccacgtgggggaaagcggagaaatcgcaggtcatcgcttccaataatccggattatcatgttagctgtaacctacggtttatggggcagtatgaggatgaggagagcgggttatactataaccgctttcggtattattcgccggaaaccgcgcagtatatttcgcccgacccgatagggctgttggggaggggaaatccttacgggtatgtgcataatccgacaggatggattgacccgtaa

SEQ ID NO: 2457 - DNA, 255 bp, Xenorhabdus bovienii; identical to SEQ ID NO: 422
  Coding DNA location: Contig name=SeqID_16870; Position on contig =166855..167109bp; Strand=-

SEQ ID NO: 2458 - DNA, 252 bp, Xenorhabdus bovienii; identical to SEQ ID NO: 421
  Coding DNA location: Contig name=SeqID_16870; Position on contig =166986..167237bp; Strand=-

SEQ ID NO: 2459 - DNA, 276 bp, Xenorhabdus bovienii; identical to SEQ ID NO: 420
  Coding DNA location: Contig name=SeqID_16870; Position on contig =167286..167561bp; Strand=-

SEQ ID NO: 2460 - DNA, 1425 bp, Xenorhabdus bovienii
  Coding DNA location: Contig name=SeqID_16870; Position on contig =167603..169027bp; Strand=-
atggctaccggtgacttcctgcaagtctggccggttattgctatccccggattattgccgattaccctgacccgtacttatcgctccacagctaacttaaacggcttgtttggccctaaatgggcggatgactggtcacgtcagttgaaacgggtcaatggtaaggtaaatttcaccgatgccgacggcgtgatctacgatttcagcacaccaaaaaatcaggtgctcgcccgtaaccagcatattcctcattacgtgctgaccggtgagttgaatggcgaactgcaactgaccgatcgccagtcccagcttacctaccacttcaatcatgccgtcggatctatccgtaaattatccgcgatcaccgatcgccgtcagaacgcgattcggtttatctacgataaacagtcgcaactgattgaagtcacgcgcaccgatggtttccggctgattctgggttatcagaatcaatacctccgaaccgtagactatcttgaccagaaaaagcaacaacggctggtgacctgtcactatgatccgcaaggttacctgcatgaatgtgacgcgtttcagcataaccacctgtggcatgaatacgacgcacaggggtggatgatccgctggcacgataccgaccagaccgatttaagcctgacttatgatgaacaaggacgggtactcagcaccacttctccccgcggttactggtgtgaccatttccactatgatgatcaggcgtgtatcaccacctatcgggacggcgaaggcggtgaaacccaataccattacgatcacaacgggttggttgtccgtgaagtcgatccgctggggtgcattatccgccgccagtggcgccatagccaaattgtctgggaagccgatcgggcaggtgggataaccacattcgattacaaccctgacggtgcgctgaccgaagtgaagctgccgacgggcgaaactttcgcctatggttatgacgaacacgggcagctcatcgaaagtgtccggccgacgggtgagcgttggcaatttcactatgatgagcagggtaatctgacggcactgactcatccgttggggcacaaagaagaataccaatacggcacccacggtgaattacgtcagcgcctgctgccggatggtcgtcagtggcattacgcctttgacgaacagcagcggctggcggcggtggtgacgccagatggccagacaaccaatttgcaactggacgagttgggtcatctgcgccaactcaccgatgccctcaagcagcagactcactaccgttatagcgacgcccacgccagccttaacggcagcctgaccgaagtggaactaccggatggcaccacgcagcaactggcctatgacagtgaacggcgcgtggtggcggttactgacggcggtcatgctcccaatagttag

SEQ ID NO: 2461 - DNA, 219 bp, Xenorhabdus bovienii
  Coding DNA location: Contig name=SeqID_16870; Position on contig =168958..169176bp; Strand=-
gtgccaaaatcgaaggccaatagtcgaaaactgccacgtcctcacacgataaaccccaaaacgctaaagaagaccaggttgataacaagtctaccgacaaagacggaagctgcaacgggacttgtaaaacggaaggtgaacctgtcgatatggctaccggtgacttcctgcaagtctggccggttattgctatccccggattattgccgattaccctga

SEQ ID NO: 2462 - DNA, 1020 bp, Xenorhabdus bovienii
  Coding DNA location: Contig name=SeqID_16870; Position on contig =169154..170173bp; Strand=-
atggcagaaaaatcttcgacgctggttgtgacacccactgtttatgcaggcaaggaattttgtgaggaatttaatattcggacacaggctgaggcggaaaccgcactgggcaaggtcgatacgctctatccacaaagcagcaaatattatggtgcttacggggacgatccggaattagatgaatactacaatgacgaagacgcaaaattcgaagagcagtattttaaaaaaaccgcacaggatgccgttgacaaattcaaaagcggtgagtttccgctgaaggagtgggaagaaaaggaaaaaacaaaagggcctgaataccctcaacccaattcccccttaccggccaaagcccgcgatgacagtccgaccgggacggggaacacccccggaataattaccgctcaggccggcccagcgcaagtacccgcgaccgaagccaatccccttcctcaagcagaaacaccagcagaaaaaagttggcgggcaaaagcgtgggcggcaatggtggaagccaaagacagcgtcgttgattgggcgtatgagaaggcgattaatcatgttgaagggataaaacatccgcttgagcgggcgaaaggccagctaaaaggtgcctataataccgtggttggcacagcagaatcctatatccagggggcttattttgaaggcgccaaagattcggaggatacagcccggtggcttgaaatctatggcgaaaccgaaaaagcgaagacggtccgtgaagtcgcagacattcagaaaaagcaaagtggggaatttaatctggatgactggaaagccacgtccagcaaccgggcacaagaagcggggatatttgatattcaggttctcgaaaccattggtttgcctgccaggaaaatcgacgttatcaaaaagggcgcgactgaattagcttctgccgccaacaaagtcagtactgcggcgaccaaagctgaaagaaaagtgcttactgaggaagccaaagccgtagaaggtgccaaaatcgaaggccaatag

SEQ ID NO: 2463 - DNA, 357 bp, Xenorhabdus bovienii
  Coding DNA location: Contig name=SeqID_16870; Position on contig =170185..170541bp; Strand=-
atggctgataactacatcgcccgcactgcgggcaactggatgattgtcggcatgctgccggacgtgtgtaaaaccccgatgggcccctcaacgcccccgataccttatccagtggtagcaaaactggcggacagctcgtcaccggtgccctccgtgcgtgccaatggcaagccggtggtggtgtttgcccgcagttttgtccccaccaccatcggtgaccagcccggtgtggcgaatggtgtcaaaagcggcacggtcggcggtaaatgccatccgcaggagcataccaagacggtacgggctggcaacaaactggtgctgcgtcacggggataaattttggatgaacggggcataa

SEQ ID NO: 2464 - DNA, 1218 bp, Xenorhabdus bovienii
  Coding DNA location: Contig name=SeqID_16870; Position on contig =170534..171751bp; Strand=-
atggaatttcgtaacctgactccctttgccgtgatgaactatcagatgctcgatatcgaagataccgagcatcacgtcgcggtcatgaaaatcggctaccagctactgcctaccggacagggggaatacagtgcggaattattgcccgcgcctcccttgtgtttacaggatgaataccgtggacagatgaatgcctcacaggtgttgcaggagagtgaccttgccccgtttaaaccgcgctgtgacgtgattgtcaacggcacggcgtatgcgccggaaggtaaaccctgtaccgaatttcccgtgcagttgcaggtacaaaccaagcagggccagatcctgctcgacaaaaccctgactgtgaccggcgagcgggagtttattcgcgatgcggatggcaactggcaactaaccaacccgaaaccttttgcaacgctgccgttggattatcgctatgcctttggtggtgaatgcaaaattcaggcagatgataaagcgaacgaatacctcaaggaaagtgatcgtctgacaccggaacagcgccagcagcattcagacgggaaaaatgcgcctgctgctcatgccgtttgtgaaaccaatccgctgggaacgggatttatcacgccatggtacgccagcgccaaacaactcacccgttacccggcgccgcgtattatccggccggatgtccccttcaccgcgcagcattttaccgctcaattgagtggtacgtcggcgcctgatacgccggcctgccagccgcagggtatgggctttatcggccgtccgtggctgcctcgccgccagcttgccggtacttacgatgctgaatggctggagcatcgtcacccttatctgcccaaagacttcgacttcagatactggaacggcgcccccactgaccagcagatcgactggccggaaaccaacctctcgctgcacttgcagggcatgacccccggtggcaacctacatgtcaccttgccgggacaccgcccgtttattctgctgcggatgcacaacggcatgttgctgcccgtcccgatgcgccctgacacgttaattctcgacagcgacgctaaaacactgtacctgacctgccgactgaattttaaaaccgacctgcctgtacgggttgccgaagcgcggtttgaaatcaacccggaggcaccgttgcttaaactggcacccctggaagaggagaaaaaggatggctga

SEQ ID NO: 2465 - DNA, 2259 bp, Xenorhabdus bovienii
  Coding DNA location: Contig name=SeqID_16870; Position on contig =171767..174025bp; Strand=-
atgtcaataaagaagaacatcaataaattgaagaaaggacacgcccttgttcaacaggggcaagaggctgttcagaaagcgaaacaggttgcaggcaaattgggcggcggcatgtcaggtacggcaggcttaattccgggtggcggttttaccggcggaataggcggacattcagggagcggcatgtcaggtgcggcgggcttaattccgggcggcggttttaccagcgggataggcggacgttcagggagcggcatgtcaggcacggcgggcttaatcccgggcggcggttttaccggcggaaaggggctggcagaacgcgcagccggggggcagaatgcggccaccaaagcgctggaaaaagccgctcagatgctgatgggagggcgtgacccgagtggcctgcaatttaccctgaccgcaggcggcttaccgccgcagacgtttgtcgtgaccgatttcacgctgaacgaaagtttttcccagccgttcagcctgagtgtgggactggcgagcgccgacccggctatcgattttccggcagtactggatcgcaccgccacgctgaccattctgcaaaacggtatcgaacaacgcagcatcacggggatcgtttcccgctttgagcagggtaataccgggttgcaccagactacctaccaaatgactatccgccctgacctgtggcgcacgaccctgagacagaactcgcgcattttccagcagcaggatatcgccaccatcctcaccaccctgctgaaagaacacaacatccgcgatgtgatcttcagcctgcgccatcctcatccggcgcgcgaattctgcgtgcagtatcaggaaagtgactttgccttcctgcaacggttaacggcggaagagggcattttctacttcttcgaatgcagtaacgggcgcaacacgctggtctttgccgacgactgcggttcagtcccgccgggcatagtgatcccttatcagcccggtgaagtcagcaccgggggtgaacctgccatcagcagcttgacatgcagcgcacaggtgcggccggcgcaggtccagcttaaggattacaccttcaagaatccagcgtggccggcggaatttcaccaacagatgcgggacgaaaatctgcaacaactgtactacgagcactacgactaccccggtcgcttcaaggacgaagcacatggcaaggattttacccgctaccggctggaagcgctgcgtagcgatgcaatgatgggacagggcagcggcaatgcgataaccctgcagccgggcaagctgtttatccttgataaccatccccgggcagacctgaatcagtcatggcagaccgtctccaccagccacagcggcagccagccgggtgcccttgaaacgacaaccggcgacagcggcaccacgctgcacagccacttctatttcatccgtcagaatcagaactggcgcccggctccgctgtccaaaccggtggttgatggcccacaaatcgctaaggtggtcggcccagccggtgaagaaatcttctgtgaccagtacgggcgcgtgcgcctgcaattcccgtgggatcgctacggcaaatccaacgaccagagttcctgctggatacgggtgactcaaccgtgggcagggcaaggctggggaatgctggccatcccacgtatcggacaggaagtggtggtggatttcctgcacggcgaccccgaccagccgatagtgaccgggcgtacttaccatgccagcaacatcccgccgggtgccttgccgggcagcaaaacccagatggcgttccgctccaaaactcacaagggacagggctacaacgaactgctgtttgaggatgccaagggcagcgaacggctgtcactgcacgcgcaaaaagacatgtacaccaaggtgctcaacgaccgcgatacccatgtgatcgccaaccacaccgagaccgtggagaaaaaccaaaccatcaaggtcaatgagaacaaagaggaaacggtcacacttaacagtacagaaacggtgaaagaggtgcgcaaactgatcaccggccagaactacattattgaagtcggtgcacacaagacagagaccatcaccaataccctttccatcacggccggcgatgtaattgagctgcgctgcggcctgagtgtgttgcgcatggacagtgccggacgtatcacccttcagggcagtgagctcaaatttgaagccagtggcccggtgcaaatcaccggtaaagacatcgacttgaactaa

SEQ ID NO: 2466 - DNA, 222 bp, Xenorhabdus bovienii
  Coding DNA location: Contig name=SeqID_16870; Position on contig =174006..174227bp; Strand=+
atgttcttctttattgacatgatgtgtctccctgagatgatggaacgttatgtaataggcatcccgcctgatagcgacgcaggccataacatttgggcaccggatttaaatctaactcaccttgtctccgacaaattggttaattcaggacgcaatacgttgtctttcgataatttgatgggactctgtgtccgaatatatcggctgatccgtgataaataa

SEQ ID NO: 2467 - DNA, 129 bp, Xenorhabdus bovienii
  Coding DNA location: Contig name=SeqID_16870; Position on contig =174464..174592bp; Strand=+
atgatcattcttattttaagatctttatcacaaaaaagactatttttagcaatgaggttttttattttctgtcttttttatttaaaaaaaatcataataacaaatgatatatttgcattgaatatataa

SEQ ID NO: 2468 - DNA, 144 bp, Xenorhabdus bovienii
  Coding DNA location: Contig name=SeqID_16870; Position on contig =174759..174902bp; Strand=-
atggggatcagttctgagatgagagataggttacagaaccataaaaaacccggtgtctcaaccaaacactacgatcgctacgactatctgaaagaaaaacgggaaattatagcgccatgggaaagtaaattactatcactatag

SEQ ID NO: 2469 - DNA, 105 bp, Xenorhabdus bovienii
  Coding DNA location: Contig name=SeqID_16870; Position on contig =175180..175284bp; Strand=+
atgctattggatcgaaagatccttctgtccaaaaaagtcatcaaatatgtcaacgccaaagttgatattattgctatgagtaaactaactatttatttcccttag

SEQ ID NO: 2470 - DNA, 1563 bp, Xenorhabdus bovienii
  Coding DNA location: Contig name=SeqID_16870; Position on contig =175496..177058bp; Strand=+
atgagattagaagatttgcgtgccgaccataaacgcccgtttaccagcaaagagtacctgaaatcgcttcaggatggccgggaaatttatatttacggcgaacgcgtcaaagacgtcacgacacatcccgctttccgtaattccgcagcctcgataggtcaactgtatgatgccctgcatgagccggaaacccacgatatactctgctgggataccgataccggcagtggcggctatacccacaagttcttccgctttgcaaccagcccggatgaaatgcgccagcagcgggatgccattgcagaatggtcacgccaaagctacggctggatgggacgcactcctgactataaagcagcattctgctgcgcactaggtgcttatcctgaattttacgggcagttcgcggataacgcccgcacatggtataaacgcattcaggaaagcggtatctatttcaaccatgccattgtgaacccaccgattgatcgacataagccagccgatcaggttaaagatgtttttatccagatagaaaaagaaaccgatgccgggattatcgtcagtggtgccaaagtcgtcgcaaccaattcggcgctcactcactataacttcattggttttggttctgcacaagttatcggcgataaccccgatttcgccttgatgttcgtcgcacccatggatgccgacggcgtgaaattgatctcgcgctcttcttacgaattggttgccggtgccatgggttcacctttcgattaccccctttccagtcggtttgatgaaaatgacgccattctggtcatggataaagtgttaattccgtgggaaaacgtgttaatttatcgcgattttgatcgcgcccgcaattgggctgtccaaggcggttttgcccgtctgttccccatgcaggcctgtgtacgcctggctgtcaaactggacttcatcacgggattgctgcaaaagagccttgaatgtactggtgtggtggatttccgaggtgttcaggccgatctgggggaagtcgtggcgtggcgcaatctgttctggtcactgacggatgcgatgtgggcagaagccaaaccgtgggaaggcggcgcttatctgccggatactcaggcgattcagacttatcgtgtcatggcaccgatggcttataccaaaatcaagaacatcattgaaaacaatgtcaccagcggcttgatttatctgccatccagtgtgcgcgatatgaataatcctgaaatcaataagtatcttgagaaatatgtacgtggctctaacggtattgaccatgtagagcgaatcaaaattttgaaattaatgtgggatgccattggcagcgaattcggcgggcgccatgaattgtatgaaatcaattatgccggcagtcaggatgagattcgcctacagtgcctgcgtcatgcctatggctccggtaatatgaagaaaatgacggaattggtggatcgctgtctctcagactataacttggatggctggacaaaaccccatttacacaataaccgtgatattaacctgttagataagctgctgaaataa

SEQ ID NO: 2471 - DNA, 519 bp, Xenorhabdus bovienii
  Coding DNA location: Contig name=SeqID_16870; Position on contig =177080..177598bp; Strand=+
atgtctgtagaaaatgaacatcgcctgcgttttcggaatgcgatggcaagcctttccgctgcggtaaatatcatcaccacggatggtcctgcggggcgatgcggtataactgcaacggcggtgtgctctgtgacagatacgcctccgactctgatggtatgcatcaatcgcaatagcgccatgaatccggtatttcaggaaaatggacgcctgtgtgtcaatatcctgaatcatgaacaggaattgattgctcgtcatttcgccggaatgacgggcgtcagcatggaagagcgctttggctggaatatctggaaaacaggcgctttgggacaaccgatgctgaaagaaacgctggccaatctggaaggaagtattgagcaaatacaagaaatcggcacgcattatgtctatttagtggaagtcaaacagatggccgtcaaggaagaaggccacgggctgatttattttaaacgtgattttcatcatgtgatggataaaagcctggcggatgcggtttaa

SEQ ID NO: 2472 - DNA, 159 bp, Xenorhabdus bovienii
  Coding DNA location: Contig name=SeqID_16870; Position on contig =177546..177704bp; Strand=-
atgggaaaagtgaaatgttcagttgatgaaggctcccggatggagccttctacttctcttggaaaaatattggccggggaaatattggataaattaccgtataaaattaaaccgcatccgccaggcttttatccatcacatgatgaaaatcacgtttaa

SEQ ID NO: 2473 - DNA, 354 bp, Xenorhabdus bovienii; identical to SEQ ID NO: 1741
  Coding DNA location: Contig name=SeqID_16870; Position on contig =177857..178210bp; Strand=-

SEQ ID NO: 2474 - DNA, 492 bp, Xenorhabdus bovienii; identical to SEQ ID NO: 1438
  Coding DNA location: Contig name=SeqID_16870; Position on contig =178147..178638bp; Strand=-

SEQ ID NO: 2475 - DNA, 165 bp, Xenorhabdus bovienii
  Coding DNA location: Contig name=SeqID_16870; Position on contig =178730..178894bp; Strand=+
atggatgatatcaataagaatagctcaataaagagtcgcaggcgaattcaacgggtctattcatcttattgcacggtatacgtacagttaaataagatgaatttaacatttgttcaaattctattactgcactgcctcaaaaacaggcatacatcattgatttaa

SEQ ID NO: 2476 - DNA, 1491 bp, Xenorhabdus bovienii
  Coding DNA location: Contig name=SeqID_16870; Position on contig =179153..180643bp; Strand=+
atgacaactaacagaggcacctctatgagtaaaaccgcacccgtcggtttatgggatcaaccaaaaccctttttcatgatcttttttgttgaactatgggaacgatttggtttctacggcgttcaaggcattttggccgtttatttcgttcaacaactgggtttttcagaagaacaatcatttattacctttggtgcgttcaccgctctggtgtatggcctgatttctatcggtggttatgttggtgaccacatacttggaactaaacgaaccatcgttctgggtgcgattgtcatggcaatcggctattacatgatcggcctgtctatcatgaaaccggaactgattttttatgcattaggcaccgttgcggtcggtaatggtcttttcaaggccaaccccgccagcctgctggctaaatgttaccgaccacaagacccccgtctggatggggcatttactctgttttatatgtccatcaatctcggctctctgttttccctttccctcgccccggtgattgctgaaaaatatggttataccgttacttacaatatctgcggtatcggcctgatcatcgccctgttggtgtatatcgcctgccgtcgtatggtacataatatcggctctgcacctgatcatcatcctgtcaagcccatcagtctgattgccgttctgataggttctgtagtcatgattggtgtctgtgcatggttactgcacaatatcaaggttgccaatatcgccctgttcgcgattaccaccatcgtcgtactgattttcttctggcaggcattcaagcagaaaaaagtcgcccgtaataaaatgttcgtggcgtttattctgatgcttcaggccgtagtgttcttcatcctgtataaccagatgccaatgtccctcaacttcttcgccattaacaacgtccatcaccagatcctcggttttaatgtcaatcccgtcagtttccaagcacttaacccattctggattatcatcttcagcccaatactggcggtggtttacaccaagctgggagcgaaaggtaaagacttctcgatgccggcaaaattcaccttcggcatgttcctgtgctctctgggcttcctgacagccgccgcctccggtttgtttgccgacgcccaaggcattacttcaccgtggtttatcgtgctggtttatctgttccagagcataggcgaattgatgatcagcgctctggggctggcaatggtcgctgcatttgttcccagttatctgaccggctttattctgggaatgtggttcctgtcacaagcggtggcatcaatgctggcgagtcatgtggcggtactcactgcgacccccgtaggcgtgactgatcctctgcaaactctgccaatttatatgagtgtgttcggtaaaatcggtgttgccactctgattgtcgccgttatcatgacctttatggttccgtggttgaaccgtatcatgagagaagaagtgaaggcttaa

SEQ ID NO: 2477 - DNA, 126 bp, Xenorhabdus bovienii
  Coding DNA location: Contig name=SeqID_16870; Position on contig =180604..180729bp; Strand=+
gtggttgaaccgtatcatgagagaagaagtgaaggcttaatctgccgggctctgattgaaaagaccctccactcgatatttattcagagaacgagtggaggacgctctcaccctttctacgattaa

SEQ ID NO: 2478 - DNA, 1329 bp, Xenorhabdus bovienii
  Coding DNA location: Contig name=SeqID_16870; Position on contig =180726..182054bp; Strand=-
atgacaggtttttctcaatctaaacgcatacctcacggcaatctgtccgatgcagaaatccgggagcaataccgttactggcgcttgcatattatgttgaatctatacgtgggctatgcgctattttactttacccgtaaaagcttcaactatgcgatgcctgccatgatcaccgatcttggccttgataaaagtgaaattggcctcatcgggacgttgttttatatcacttacggttgttcgaaatttttttccggcattatttctgatcgttccaacccccgctattttatgggaatagggctgattgccacggggatcatcaatatcttgtttgggctgtccagctccattgtcatgtttacctttctttggatattaaatgcctggtttcagggatggggttctccctcatgcgctaagttactcacgacttggtattctcgctcagaacgtggcttctggtgggcgatttggaatacttcacaccatgtagggagtgcgttgattgcattgatcgtcagtttcttaaccttgcattttagctggcgagaaggatttatcgtaccgggctgtgtcgggatcttggcaggcatactcttatgctggcgattacgcgataagccgagcacgatggggctaccgaccatcggtcagtttcgcaatgatctgctggaaaaggctcaggaaaatcaaggcaaaggcctgacgaccagagagatcctgagaatctacgttttccgcaacaaatatatctggttgctttcctttagttacgtgctggtatacatcattcgcaccgtcatcaatgactggggaaacctctatctgactgagtaccatcattatgatttagtgagcgcaaacgccgtattatcgctctttgaagtagggggatttatgggatcgctggtcgcaggctggggatcagataaactttttggcggcaatcgtggcccgatgaatctgatattctcgatgggtattttcttgtcagtagcggctttatggttgatgcctgtcacagggttggtttttcaatcgcttggcttttttgcgattggtttttttgtgtttggcccacaattgctgatcggtatggctgccgcagagtgttcgcataaagattctgccggtgctgcgacgggttttgtcgggctttttgcttatacaggcgcggccattgcaggctatcctttcgccattatcctggaaaactatcactggtcagggttatttatgaccatttccgtctgcgccgtcatgatcggtttattattgctgcctttcctgcaagcacagtttcctaagcaaagggtacaacgttaa

SEQ ID NO: 2479 - DNA, 1524 bp, Xenorhabdus bovienii
  Coding DNA location: Contig name=SeqID_16870; Position on contig =182064..183587bp; Strand=-
atgcgtcgatatctgatcaattcattttgtggctggttattgttctcatgttgttggttctgcttgtgggtgatcgcctactattttgttaatgacccagaactggccattttattttttccttttgctctgcgccttggcatcgtattacatacgccaaaacattattggccaaccatttatggtgcagaatggtggctgaccatctgtttggcgctattaatggggcagcctcaatggctcactgtgctcactgccagcatagccagcctccctgttgtctgggttgccagccgttattatcgcggaagtcaatggcagcggctcgctgtcatggcaatggtgatcacagcaaccgccattattaatgtcgtggcagtgagtaaccacaatccatctttgatcatcgtgtttctggtcagcttaaccggtggcgttatgttggtgcccacatgctatttagtctggcactatctgttccaaagcatctggttgcctctgacagccaacgtcgtgtcgcgtcaaatccagtttcgccttcatcacgttatgctgtatgccctgctatttgtactgaatattctgttacaaattggttttcccaatgaattacgctattttgcgccgttctgtctggctatccccattattttgttggcctttcgttatggttggcagggtgccttactggggacattactgaacagcatcgtattgattgctgcgcgcagtggtgtttcgaatatggaaatcaccgacttactgttatcgctcttggcacaaaccatcaccgggataatgcttggcatggcagttcagcgtcagcgtgatcttaatacacagttaaagcgcgagctctatcgtaaccgtagtcttgcgggccaattagtcaaagcagaggaatcggtacggcgcgatattgcgcgagaactgcatgatgaaattggtcagaacattactgccattcggacgcaggctaatattattcagcgggtcgaagtgacacctattggctcgaattgtgccaaaactatcgaatcattatcccttaatgtttatgataccaccaaaaggttactcagttgtttgcgtcccaaaatccttgatgatcttggtctgaaagaagcgatcgaacaattgctgcgggatatggaatttgaaaactgcggcatatcagtggaaatccattgggaagctaattctgccgaggtcattgagcaattgagtgacacaacaaaagtcacgttatatcgtctctgtcaggaagccctgaataatgcattaaaatactctcaggccgatcgcattgagctgcatttttctgtcagggaaatgatccgtttattaattaaagacaacggcattggctgtaaggctgaagataacatgaaaggatttggtttacggggtatgcgggaacgcgtacaggcactcggtggccaattctccattcatagcgaaaaacgacagaatgactcgacaagcgctggtacagatttatcgatcattttgcccaaactttaa

SEQ ID NO: 2480 - DNA, 609 bp, Xenorhabdus bovienii
  Coding DNA location: Contig name=SeqID_16870; Position on contig =183587..184195bp; Strand=-
atgattaaagtagcattagtcgatgatcatgttgtggtacgctctggtttcgcccaattaatgagtttagaacccgatatcgaaatcgtcggccaattcagttcatgtgctgaagccagaaatgggctgccaggctcaggagcaacggtttgtattcttgatatttcgatgccagatgagagcgggctttcattgctgcaagatctcccttccggtattcactgcattatgctcagtgttcatgattctgtcactatggtagaaaatgcattgaaggcgggggctcgtggttatctcagcaaacgctgtagcccggatgagctgcttcaggcagtgcgtacgacggcaaataatggctgttatctcacgctggatattgcgctgaaactggcgtcatcaaaaaatagtcagacttcattagattacttgaccaaccgagagcgacaagtgggtgaaatgcttgccagaggcatggatgtcaaggttgtcgcggccgagttgggattgagtcataaaacagtgcatgttcatcgcgccaatatgatgagtaaattgggggtgacaaataacgtgggtttagtgaattattttacgactagtgatctctaa

SEQ ID NO: 2481 - DNA, 99 bp, Xenorhabdus bovienii
  Coding DNA location: Contig name=SeqID_16870; Position on contig =184243..184341bp; Strand=+
atgtcgcttcgcaatagactgaacattgagataaaagataagcagaaaacgccactgcgttcaggcagtggcgtcagtgtatttcttcaaggttattga

SEQ ID NO: 2482 - DNA, 1380 bp, Xenorhabdus bovienii
  Coding DNA location: Contig name=SeqID_16870; Position on contig =184335..185714bp; Strand=-
atgtttaaaattctagatcaaattcgcaagccgacgctggatcttccggtcgaagagcgccgcaaaatgtggtttaagcccttcatacagtcgtacttggtggtttttattggctatatggccatgtatctggtgcgtaaaaactttaacatagcccaaaacgacatgatctccacttatggtctgtcgatgacggagctgggtttgatcgggctggggttctctatcacttacgggattggcaaaaccgtagtgtcttattatgccgatagcaaaaataccaaacaattccttccctttatgctgatcctgtctggccttgccatgatcggtttcagtatgagtatgggcagttccaacatcagcgttttcctgatggtggcgtgttatgccctcagtggctttttccaaagtattggcgggccggccagttattccaccattactaaatggactccccgtaataaacgcggaacctatcttggcctttggaatatgtcacacaacgtgggtggcgcaggagctgccggggttgcgctatttggtgctaattacctgtttgatggccatgtggtagggatgtttgtttttccttctatcattgcactgatcattggttttattggtttacgctacggcagtgattcgccagaaagctatggcttagggaaagttgaagaattatttgatgaagccatcagcgaagaagatatcgcggcagaagaaaatcaaatgaccaaacgcgagatctttgttgaatacgtattgaaaaacaaagtgatttggttactctgcttcgccaatattttcctttatgtcgtgcgcattggtatcgaccaatggtcaaccgtgtatgcgtaccaggaattaggtcactcaaaagaaaccgcgatttccggttttaccttgtttgaagttggggcactggtgggtacgttgatgtggggatacctgtcagacttagccaatggccgtcgtgcgctggttgcctgtgtttctctgggtttgattattgtctgtcttgagttctaccaacatgccaccagtgagttcatgtatttgtcctctctgttcgtactcggcttcttggtatttggcccacaattgttgatcggcgtggctgctgttggttttgtaccgaaaaaagcgatcagtgtggccgatggggttaaggggacttttgcttacttaatcggtgatagctttgccaaactcggcttgggcatgattgccgatggcgtccccatttttggtttaactggctggaaaggtacctttgttgcactggatgcttcggcatttatctgtatcggcttgcttgcttttgttgtcattgcggaagagaaaaaaatccgaaaagcaaaaaaaaacagtcaataa

SEQ ID NO: 2483 - DNA, 114 bp, Xenorhabdus bovienii
  Coding DNA location: Contig name=SeqID_16870; Position on contig =185759..185872bp; Strand=+
atgcaggaggaagcaaaaaagggagatcgcagaaaagcgagagttttcgtcggtattgtcattacccagaagtttaaaaaagtggagaaagattggcttgagctacagtcttag

SEQ ID NO: 2484 - DNA, 255 bp, Xenorhabdus bovienii; identical to SEQ ID NO: 422
  Coding DNA location: Contig name=SeqID_16870; Position on contig =186032..186286bp; Strand=-

SEQ ID NO: 2485 - DNA, 252 bp, Xenorhabdus bovienii; identical to SEQ ID NO: 421
  Coding DNA location: Contig name=SeqID_16870; Position on contig =186163..186414bp; Strand=-

SEQ ID NO: 2486 - DNA, 276 bp, Xenorhabdus bovienii; identical to SEQ ID NO: 420
  Coding DNA location: Contig name=SeqID_16870; Position on contig =186463..186738bp; Strand=-

SEQ ID NO: 2487 - DNA, 906 bp, Xenorhabdus bovienii
  Coding DNA location: Contig name=SeqID_16870; Position on contig =186795..187700bp; Strand=+
atgaccaacaaagtgagcagcagcgacagccttgaagagtatcgctatgacagcggcggtatccggatgctgaaaatcggtgaacaacagcgagtcacttatctggcaggcttggaactgcgtacgactaaaaatggcgggaatatcaccgaagatttgcagatgatcagcgttggtgaagcaggtcgggcacaagtacgtgttctgcattgggagagcggtaaaccgacggatatcgataataatcaactgcgttacaactatgacaatctgcttggctgcagtcaacttgaattggatggcacaggacagattatcactgaggaagaatattatccctatggcggtacgtcagtatgggcgacaagaaaccagaccgaagcccattacaaaacgattcgttattccggcaaagagcgggatgcgacggggttgtattattatggcttccgttattatcagccgtgggtgggaagatggttaagtgctgatccggcaggaactatagatgggctgaatttgtatctgatggtgaggaataatcctatcaaattgttagatgttaagggactagcaccagtacatagaacagaggatgctgcaatagcaaaaggttcttttactggtctggaagagcgtttcttccaaaaaatgatgaaatctcaaccattcaaaaggcaacgggccatagctgctcagaccgaaaaagaatctcatgagctattaacccagaatcctattggtaaagatagccagtttcttaaagactacacgaccagtagtaaagctattaatgaggatatccggcaggggaaaacgggtacaatcgttcaacaaggcatagatagggcattatcaccctgcaaagtaaaaataacgaaaaaaaggtcgtttaccgcgttatga

SEQ ID NO: 2488 - DNA, 438 bp, Xenorhabdus bovienii
  Coding DNA location: Contig name=SeqID_16870; Position on contig =187754..188191bp; Strand=+
atgaatgtcggagatattgtttcagaccgtacttatttatctacatcagaacatcgtggttttttagattttaagcataaagaggataaaggtgaaactcgatatgtcaaaatggctttgttatcaaataaaggagttaatatcgctgatatttcacaatacaataatgcgattgaaaaaatggcttttgatcgggcttcaagcaagactttgaccgaacggcttaaaggcccaccagcaggacaggctgagattctcttccccagagaaacacgttttaaaattcattcaattaaacaggatggcagaaatgttcatgtcttgttgagtgatataaccgctaataacgccatgaatgtggatataaaagagatgttttccggggaaagttataaaaaatcttgtttaattataatatatgaagtacataaatattaa

SEQ ID NO: 2489 - DNA, 93 bp, Xenorhabdus bovienii
  Coding DNA location: Contig name=SeqID_16870; Position on contig =188159..188251bp; Strand=-
atgttttactatatttatatagaaaaatggataactcttatttttagatgctgttttaatttaatatttatgtacttcatatattataattaa

SEQ ID NO: 2490 - DNA, 1077 bp, Xenorhabdus bovienii
  Coding DNA location: Contig name=SeqID_16870; Position on contig =188422..189498bp; Strand=-
atgtctaaaatttttgatttcgtaaaaccgggtgtcatcactggtgatgatgttcaaaaagtctttgctgtcgcaaaagaaaacaacttcgctttaccagctgttaactgcgtcggtactgattccatcaacgcagtgttggaaacagcggcaaaagtacgtgctccggtaatcatccagttttccaatggcggtgcggcattcgttgcaggtaaaggtttgaaggcagaaggccagcaggcggcgattctgggttcaatttctggtgctcatcatgttcatcagatggcagaatactacggcgttcctgttatcctgcataccgaccactgtgcacgcaaactgctgccgtggattgacggcctgctggatgccggtgaaaaacattatgcgcagaccggaaagccgctgttctcttcccatatgattgacctgtcagaagagtctctggaagaaaacattgagatttgcagccagtatctggcgcgtatggcgaaaatcgacatgacgctggaaatcgaactgggctgtactggcggtgaagaagacggtgttgataacagtcatctggacagctcttctctgtatactcagccagaagatgtggcttacgcttatgaaaaactgaacgctatcagcccacgtttcactatcgcggcttctttcggtaacgttcacggcgtctataagccaggtaatgtcaaactgacgccaaaaatcctgcgtaactcacaagactacgtgtctgagaagttcaacctgccacacaacagcctggatttcgttttccacggcggttctggttctaccgcagaagagattcaggaagcggtcagctatggcgtagttaaaatgaatatcgataccgacacccagtgggcaacttgggaaggtattctgaactactacaaaaagaacgaaggctatctgcaaggtcaattgggtaacccagaaggcgcagacaaacctaacaaaaaattctacgatccacgtgtttggctgcgtgctgctcaggtttccatgatcgttcgtctggaacaggcttttaaagaattgaatgcggttgatgtgctgtaa

SEQ ID NO: 2491 - DNA, 99 bp, Xenorhabdus bovienii
  Coding DNA location: Contig name=SeqID_16870; Position on contig =189461..189559bp; Strand=+
atgacacccggttttacgaaatcaaaaattttagacatgttacgtggtcctgtattgacattgaacaggcagcaaatgctgcccgttatcacaacttaa

SEQ ID NO: 2492 - DNA, 1167 bp, Xenorhabdus bovienii
  Coding DNA location: Contig name=SeqID_16870; Position on contig =189556..190722bp; Strand=-
atgtctgtaattaagatgactgatttagatctggcgggtaaacgcgtgctgatccgtgctgatctgaatgtgcctgtaaaagatggcaaagttacctctgatgcacgtattcgtgcgtctttgccgacgattgtgtctgcgttgaatcagggagccaaagtcatggttacttctcacctggggcgcccgactgagggagaatacaacgaagagttctcactgcaacctgtcgttgattacctgaaagaaaaactttcatctcctgttcgtctggaaaaaaattatctggatggcgttgaagtggcggaaggcgaactggttgtgctggaaaacgttcgcttcaataaaggtgagaaaaaagacgatgaaacgttatcaaaacaatatgcagccttgtgtgatgtgtatgtgatggatgcctttggcaccgcgcaccgcgctcaggcatccacccacggcgttgccaaatttgcggagattgcctgtgcgggtccactgctatccggtgaactggaagccttgggtaaagcgctgcgcaaccccgctcgcccaatggtggcgattgtgggtggttctaaagtctcaactaaactgactgttcttgattcactgtctaaaattgctgaccagctgattgtgggcggtggaattgccaatacgtttgttgccgcagaagggcataatgttggccgttctctgtatgaagatgatttgatccctgaagcgaaaaaactgctggaaagctgtgatattccggttcctaccgatgtccgtgttgccactgaattctctgaaacagcagaagcaacgctgaaatccaccagcgaaattaaagacgaagagcagatcctggatttgggtgatgcttctgcggagcgtctggctgaaatcctgaaagatgccaaaaccattctgtggaatggcccggtgggtgtttttgaattccctaacttccgtaaaggaaccgaaattattgctcgtgcgattgctgaaagtgacgctttctcgattgcaggtggcggtgataccttggccgccatcgatctgttcggcattgctgataagatctcttacatctctaccggtggtggtgctttccttgagtttgtcgaaggcaaaaaactgccagccgttgtcatgctggaagaacgtgctaacagtaattaa

SEQ ID NO: 2493 - DNA, 1020 bp, Xenorhabdus bovienii
  Coding DNA location: Contig name=SeqID_16870; Position on contig =190810..191829bp; Strand=-
atgacaatcaggatagcgattaacggttttgggagaatcgggcgcagtatcttacgtgctctctacgaatccgggcgtcaagctgaaatttcggtgatcgctattaatgagctggctgatgcggaaggtatcgctcacttattgaaatacgattccagtcatgggcgttttgcatgggatgtacgcctgaacaacagcttattgcaagtgggagatgacagcatccggctgtttcatcaaccggatatttcagcgttgccgtggaaagagttggacattgatatcgtacttgactgtacgggcaaatacggcgagcgggcggatggtgaagcgcatattgccagcggtgccaaaaaagttctgttttcccatccgggagggaatgatctggatgcgaccgtagtctatggtgtgaatcaccatgagctggtggcggaagattgtatcgtttccaatgcatcctgtacgacaaactgcattattccaatcatcaaattattggatgatgcgttcaatattgaatctggcacggtgacaaccattcatgcttctatgaatgatcaacccgtgattgatgcttatcatagtgatttacgtcgaacccgcgctgccagtcaatccatcatccctgtcgatacaaaactgtctgcggggatcacacgtatcttccccaaattcagtgatcgttttgaggccatttcggtgcgggtgccgactatcaatgtgacagcgattgacttgagcgtgacggtcagcgccgcagtggatgtcagggatgtgaaccagctactgcaagaatcagcggtaagctcgtttcgtggtatagtggattacactgatttaccgttggtttcaacggattttaaccacgatccccacagtgccatcgtggatggtacacaaacgagggtcagcgggaaccacctgatcaagactctcgtgtggtgtgataatgagtggggctttgccaatcgtatgcttgatacgacgttggtaatggccgcaacgggtttcaaataa

SEQ ID NO: 2494 - DNA, 117 bp, Xenorhabdus bovienii
  Coding DNA location: Contig name=SeqID_16870; Position on contig =191856..191972bp; Strand=+
atgcaaccgcttagaataactgagcaactgctgattgtacggatgattcatcacaaaattaatcagattgtgacagacaagacattttacgagccaaaactgaaacggttcagctaa

SEQ ID NO: 2495 - DNA, 1995 bp, Xenorhabdus bovienii
  Coding DNA location: Contig name=SeqID_16870; Position on contig =192105..194099bp; Strand=-
atgaccactcgtaaaacccttgctaatgctgtccgcttcttgagcatggatgctgtgcagaaagcaaaatcagggcatcctggcgcaccaatgggaatggctgacattgccgaagtgctgtggcgcgactatctgaatcataacccggtgaaccctaactgggctgatcgtgaccgtttcgtattatccaacggccacggctctatgctgatttacagcttgctgcacctgactggctatgatgtttctatcgatgatctgaaaaacttccgtcaactgcattccaaaacccctggacatccagaatatggctatactgcgggcgtagaaacaacgactgggccactgggtcagggcgtcgccaatgcagtgggttttgcaattgcggaacgtacactggcagcacagttcaaccgcccgggtcatgatatcgtcgatcaccacacttatgtattcatgggtgacggctgtatgatggaagggatctcccatgaagtctgctctttggcgggtacactgaaactgggcaaactgattgcgttctatgatgacaatggtatctccatcgatggtgaagtcgaaggttggttcactgatgataccgctgcacgttttgatgcgtatggctggcacgttatccgtggcgtagatggtcatgactcagacgctatcaaagccgcaatcgaagaagcacagaaagaaacaggcaaaccttctctgctgatgtgtaaaaccatcatcggttttggttcaccaaacaaagcaggcaaagaagagtgtcacggttctccgctgggtgatgcggaaatcgaagcgacccgcaacgcgctgggctgggaacatcctgcgtttgaagttcctcaggatatttatgctggatgggatgctaaagcagcaggcaaagctaaagaaacgacatgggaagaaaaatttgccgcttacgcaacagcacatccagaactggcagcagaatttaaccgccgtacccgtggcgagctgcctgcaagctgggaagccgaatccaaagcattcattgagaatctgcaacagaatccagcttctattgccagccgcaaagcatcacaaaatgcgctggaagcattcggtaaagttctgcctgaatttatgggcggctctgctgatttggctccaagtaacctgaccatgtggtctggctccaaacccctgaatgaagttcaggacggcaactatattcactacggtgtccgtgaattcggtatgtctgccatcatgaatggtatcgctctgcatggcggttttgtaccttatggcgcgacattcctgatgtttgttgaatatgcccgtaacgcggtgcgtatggctgcgctgatgaaaatccgcagcattttcgtatatacccatgactccatcggtctgggcgaagatggcccgacccatcagccggttgagcaaattgccagcctgcgcgtgacgccaaatatgagcacatggcgcccatgcgaccaggtggaatcagcggttgcgtggaaatatgcgattgaacgtcaaaatggcccgactgccctgatcttctcccgtcagaatctggcacaacaggcgcgtacggctgaacaactggcgaatatcgagaaaggggcttatatcctgaaagattgcgcaggccagcctgaactgatcctgatcgcgactggctctgaagttgaactggcggtgaaagcggctgatcaactgagcgcagcaggtcgccaggttcgtgttgtctctatgccatctactgatgcatttgacaaacaggatgcagcataccgtgaagctgtactgccagctgcggtttctgctcgtgttgccatcgaagccggtatcgctgattactggttcaaatacgttggcatcaacggtgctatcgtgggtatggaaacattcggtgaatccgcgccggctgatcttctgttcaaagagtttggtttcactgtcgaaaacgtggttgccaaagcgacatctctgttgaaataa

SEQ ID NO: 2496 - DNA, 225 bp, Xenorhabdus bovienii
  Coding DNA location: Contig name=SeqID_16870; Position on contig =194086..194310bp; Strand=-
atgaaattatctcccatttgcgcaaatgcaccttcagttgtacgaattgatctgaaaatttgtcataacaacgggataaagcaaagaattgatgccagaggaaaattaagattgttcccgttatctggcattaatgattgcggtttgtatgccgcgctgcgaaaattagttcttatgtacattaacgctttcatccgacttggagtaaagaatgaccactcgtaa

SEQ ID NO: 2497 - DNA, 546 bp, Xenorhabdus bovienii
  Coding DNA location: Contig name=SeqID_16870; Position on contig =194497..195042bp; Strand=+
atgtcaaaattcaatcttacatctgactcaacctcaactccggctatcatgcgattggattctattcatacaaaacgtgacgggcttattaacttactgcacgattgtgtcgaaagcgacgcttctgtcggttttattgctccacttgatgtgaacgaagcagagcaatactggcaaaatgttgaagcagatatggtgtcgggtagtcgcgtgctgttgatggctctggagggagaagaagtcgctggttcggtacaactgtctttctgccagaaaaagaatggcctgcaccgtgccgaagtggaaaaactgatagtgcataccgcttaccgtcagcgcggcattggccgaatgttaatgaatgaattggaacggctggcaaagcaatatcagcgtcgtttgctggtattggatacccgtactggtgaccccgcgtcagcactctatcgaaaatgcggttttattgaagccgggcagatcccacaatttgcgttaaattccggcggggaattcgcgggaactacatttttttataagctgatttga

SEQ ID NO: 2498 - DNA, 135 bp, Xenorhabdus bovienii
  Coding DNA location: Contig name=SeqID_16870; Position on contig =195096..195230bp; Strand=-
atgctgaggctcgtattatccaccccgttctcaaccagaacaccatgcggtgcggtagttcagttggttagaataccggcctgtcacgccgggggtcgcgggttcgagccccgtccgcaccgccagaatatttaa

SEQ ID NO: 2499 - DNA, 750 bp, Xenorhabdus bovienii
  Coding DNA location: Contig name=SeqID_16870; Position on contig =195321..196070bp; Strand=-
atgagcactgcaattacccgccaaattgtcctcgatacagaaacaaccggtatgaacaagctgggtgttcactatgaaggacacaatattatcgaaattggagcggtggaagtgatcaaccgtcgtctgacggggcgccattttcatctctatattaaacctgagcgtctggttgatcctgaagcgtttgaagttcacggtatcagtgacgaatttttgcaggataaaccaaagtttgccgatattgccgatgagttcatcgaatttatccggggcgccgagctgattattcataacgcgacgttcgatatcggctttatggactatgaattccgcaagcttaatcgtgatatcccgccaaccgcagatttttgtacgatcacggatagcttggtgctggcaaggcaactgttccccggcaagcgaaataaccttaatgcattgtgcgaccgttatcagatcgataactcgaagcgtactctccacggggccttgcttgatgccgagattttgtctgatgtctatctgacaatgacaggtggccagacatcgctgaccttttcgatggaaggggagatttcaggtggcgctcagatggcagaaatccagaaaattacgcgtccccaaacgggattgaaagttatctatgcttctgatgaggaattgcttcaacatgaatcccgcttggatctggttgaaaagaaagggggaagttgtctatggcgttcaaaacctgaacaattacagtga

SEQ ID NO: 2500 - DNA, 471 bp, Xenorhabdus bovienii
  Coding DNA location: Contig name=SeqID_16870; Position on contig =196134..196604bp; Strand=+
atgagtaaaaaggtagaaattttcaccgatggatcttgcctcggtaatcccggacccggtggatacggtgttgtactccgttaccagcagcatgaaaaaaccttgagcaaaggctattttcgtacgaccaacaaccgaatggaattgatggcggccattgcagggctggaatcgctcacatgtccatgcaatgtgatcctgactaccgatagccagtatgtccgtcaaggaattacccaatggatacacaactggaaaaaacgcggctggaaaaaagccgacaagtcccccgtcatcaatgttgatctctggcagcgactggagcaagccatagcagaccatgatatcgattggcgctgggtcaaggggcatgcaggacatcgagaaaacgaacagtgtgatgaattggctcgtaccgccgccaattcacccacgttgcctgataatggttatgctgaaagtgaaaattaa

SEQ ID NO: 2501 - DNA, 105 bp, Xenorhabdus bovienii
  Coding DNA location: Contig name=SeqID_16870; Position on contig =196679..196783bp; Strand=-
atgcttcctccaaaacgaaaagcgatgctggacgagctatcaaaagacatcccgaaaatggtaagagtagggtttaaggtgctggtggatgaactcgatctataa

SEQ ID NO: 2502 - DNA, 180 bp, Xenorhabdus bovienii
  Coding DNA location: Contig name=SeqID_16870; Position on contig =196734..196913bp; Strand=+
atgtcttttgatagctcgtccagcatcgcttttcgttttggaggaagcatttttctgtcttccaaaatcaaatcaccatctttaagcaatctaacccaaccttccagaaccgaccttaagcggggaaatcgtagcttaacgacatcatatacagcaacaaaaaaacgcgatttaatttaa

SEQ ID NO: 2503 - DNA, 279 bp, Xenorhabdus bovienii
  Coding DNA location: Contig name=SeqID_16870; Position on contig =197031..197309bp; Strand=+
atgcttaatgtatgtacatcaagaggtgatgttatggaaaagattaacatctacgatgcgaaaactaacctgtccagaattgttcaggaagttgctcgcactggagaatctgtggtgattgccaagaatggccatgcactggttaaagttgtcgcatacagagaagagaaacctaagcgtaaattaggcttcctcaaaggcaaaggtcgtattcccgacaattttgacgatatgaacagcgctgaaattgttgatatgttcgaaggaaaagactcttaa

SEQ ID NO: 2504 - DNA, 402 bp, Xenorhabdus bovienii
  Coding DNA location: Contig name=SeqID_16870; Position on contig =197309..197710bp; Strand=+
atggaattgttgttagatactaacattttattgtttatggcatatgaaccggaaaaactgaaagccgatgttattgatcttctcgaagataccgacaaaaccctttgttttagcgcggcgtctatatgggaggtggtcattaaaagcaatctgaacaagcctgatttttccatagatccaaaacagttcagggatggactgtttcaagctggtttgattgaaatccccatcaaaagcgaacacacgcttgttgtatgtgatttaccggaaaagctacataaagacccgtttgaccggttgattgtcgctcaagcgaaatacaacaagatcccactcattaccagtgatagcaagctgatagattttgtcagtgattatattactgtaatccctaacagatag

SEQ ID NO: 2505 - DNA, 93 bp, Xenorhabdus bovienii
  Coding DNA location: Contig name=SeqID_16870; Position on contig =197716..197808bp; Strand=+
atgagtatgggtaatgtaactcgtttattacctccccgccttaaaagacggggctttacgatgcaccttggtaaaaattattggcgtcggtga

SEQ ID NO: 2506 - DNA, 717 bp, Xenorhabdus bovienii
  Coding DNA location: Contig name=SeqID_16870; Position on contig =197793..198509bp; Strand=-
atgcaatcagcgcgttcaatcaagcaaataacatcccctgcttcttgggctgagttgccgtggggagagtattaccgcgtcgctctggaacgtcaattggaaccgtggtggccgaagatttttgggcttcatttggcgaagctgggtaatctgagtgcagaaattgacagccgtgcctgtccgatcagtcatcagttcaatatcggcttactggagggaagtatggatgttattgctgatccttactgcctgccttttgaagctaaatctgttgatgcctgcctgctggcgcatatgctgacttacagtgctgatccacactggctgctacgggaagttgaccgtatcataactgatgatggctgggtgattatcagtggttttaacccgatcagcctgttgggattaagaaaagtgctcctgccgatacaccgtcgtcaggcttatgaggctcaaatgttttccatgcttcgccaagtggattggttaagcctgctcaattatgaaattgttcatcatgccagctttcatgttttaccgtggcaaagcgggaaaagtttttgtaaccgttccacgtcgatatttggctgtatgaatttggtaattgcccgcaagcggacaattcccctgacattaaatcccatgtgggcgacatcgctgaaaccgaagttcagaaatgtattgggagcggcaaaagatcttcaccgacgccaataa

SEQ ID NO: 2507 - DNA, 756 bp, Xenorhabdus bovienii
  Coding DNA location: Contig name=SeqID_16870; Position on contig =198550..199305bp; Strand=+
atggagcttatcaggatccccgccctttcagataactacatttggttactttgtgatgaagacaaacattgtgtcattgttgatccgtctgaatcacaacctgtcattgatatcttagcagccaaccaacttattcctgcggctatcctgctgactcaccatcaccacgaccatgttggcggcgtggctggcctacttaaacaatacgccgaattacccgtatatggcccggaagagacccggagcaaaggtgccactcatattgtccatgaacatggcaccattgagatcggtcattattgtttccacatcatggaattacccggccataccctgggccacattgcattctatcaggctccctatttgttttgtggcgacactctgttttctggtggctgtggtcgattgtttgaaggtacagccgaacaaatgttttcttctcttgagaaaatcatatcattaccggatgagactttaatctgctgtgctcacgaatatactgccgccaatatgaaatttgcacgggcagttttacctgagaataaaactattcatgattattataataaaattataagtattcgcgaaaataataagccaacagtgccaacaactttacaaatagagaaaaaagttaacgttttcctgaattgtcacaacattgatttacaaaaaaatatcggcattaaacctaattcaaaaccactttcttctgtttttcagcaattaagaatttataaagatcgattttga

SEQ ID NO: 2508 - DNA, 1332 bp, Xenorhabdus bovienii
  Coding DNA location: Contig name=SeqID_16870; Position on contig =199378..200709bp; Strand=+
atgaagacaaaagcgatcttattcgcctctgttctacttgccgggtgtcaatcgggtctgcaatcaaaaaccccttcccagcaaaatacacagaagatgtcttcaacgaatcagcagacagacggtattgcagaaccaaaagatactgcaaactggaaggagagtccgacaacccaacaagatttgtggggacatatccgtgatgagttgaagatggaaattcctgacaataacagggtgcgcgagcaacaaaattattatctgaaacacaagagttatctccaaaatgtgatgttacgggcagaaccgtatatgtattggatagttgatcagcttgatcaacgacatatgccaatggaagtagtatttcttcccatagtggagagtgcttttaatcctcatgccacttcttatgccaaagcggctggcttatggcagattattccgagtacaggccaccattatggcttgacacagaataaatggtacgatgcccgtcgtgatgtggctgcatcaacgacagcagcgctggagatgcttgagtatctgaatgcacggtttaatggagattggttgttgactatcgcggcttacaacagcggcgaaggtcgggtcatacgtgcaatcaaagacaatcaggcgaagggcagaccaacggatttctggtctttgtcgctgccacgcgaaacgatgcagtatgttccaaaaatagtggctctcagcaatatcattcgccataacgacaagtttagcttgaagctgccacagctcaacaatcagcaggcactttctaaagttgaggttggtcagcagatcacgctgtcacaagcggcggagttatctgggctgtccctgacatcaattagggcatataactctggttataagcagggcataacatcccctgatgggccgcattacatcatgctgcccaaaaggaacgtcaaacagtttaaaaacttgctgacagatgaaaaagtcttgaaggatatccggctggctgttgctcaaaatactcgccagctactgcaacagagccaatatacggttcgttctggtgatacgctgtctgccattgcaaaacgttttaagacatctcaccgagaattacagagattaaacagtttgaaaactgtagatcgactcaagatcgggcaagtcttgaaaatcaatagcagtggccctgtcacgtatcaggttcgcaagggagactcctttttcagcatcgccaaacgccacggcgtcaatctcaacgacctgatgagctggaataaaagcatcagaatcaaggatattaaaccgggtatcaatctgacgctttatcctaattaa

SEQ ID NO: 2509 - DNA, 561 bp, Xenorhabdus bovienii
  Coding DNA location: Contig name=SeqID_16870; Position on contig =201170..201730bp; Strand=+
ttgttaccattagaaaatggtagttggtcattaccatcagatacagataatattcctaattcctttactgaaatagaaaaatccttcttacgccccgctggatttcaattcagtgccattccctaccaagaaaaagaaagccatgaatacaatgccatgcgctttgggattaatggtaaaacgatagttttccgccaagcaaagacaacaccgaataaaatggggcaatttgtcacactatggaaaagacctactcctgactcagaaatcatgccctttgagcaaagggataatatcgatttctgcatgattgcaacacactccggtaaccaaaaaggtatttttttgttcaacactcatattctgattaaaaaaggcattttttccactcaggataaagcaggaaaaagagccatacgaatttatccatcttgggtatcccctatttcaaaacaagcgattcaaacgcaaaaatggcaatcttcatattttatcaatctggataaccagatagcagctttcgaacaattccataaactattttcttatcgtgattattaa

SEQ ID NO: 2510 - DNA, 303 bp, Xenorhabdus bovienii
  Coding DNA location: Contig name=SeqID_16870; Position on contig =201892..202194bp; Strand=+
atggaaaattctatgtatcaaagcggatattttgtcacagcagaaattaaagccagagataatgttgatctcaatatcgttgtcaaagaacttaagtcactacaagaaaaaacattattggaacctggatgtgaaatattttccatacagcaatccaatgaaaatccagccatatttgttatgtgggagaaattcattgaccgtgatgcattaaaaaaacactatgaatatgaacatactaagtattatttttcattaaacttcactgatgtcgtacaaatttttaccgcagacaccatttga

SEQ ID NO: 2511 - DNA, 147 bp, Xenorhabdus bovienii
  Coding DNA location: Contig name=SeqID_16870; Position on contig =202215..202361bp; Strand=-
atgcgtgaccccggttcttgttctcccggaacatcattgggattacgtaaagggcagtctgtcagtgaaagactgccacagcagagcagctatcgctggtgtctgagtgcagttgtggcgtgccattcatctattttggcattctga

SEQ ID NO: 2512 - DNA, 282 bp, Xenorhabdus bovienii
  Coding DNA location: Contig name=SeqID_16870; Position on contig =202486..202767bp; Strand=-
atgaaaaaaattatattaccactactattatctatgtttttggttggctgtggtggcgaaccaacatttgatgcttcgaatgatgaagcgatgaaagcctcggctgaaaaaatggcgaaaaatatgtcacctgaagaaatggcaaaatttgaaaaagcgtttttgaaactctccatgcagtctgttttggttgccaaagatggagatgatgcgttaacgcttatgaaggaaaaacttaacggcaaaacggcaaagcaaattattgaaatggcagagaagtaa

SEQ ID NO: 2513 - DNA, 135 bp, Xenorhabdus bovienii
  Coding DNA location: Contig name=SeqID_16870; Position on contig =202924..203058bp; Strand=-
atgactataaccatcagatgggctgagttatttttcattaaaacacttgccgcggcgttacatccaccttttatccatattaataacctgtctattatcaatcagaagcacaacaaagactgtcagaagatatga

SEQ ID NO: 2514 - DNA, 483 bp, Xenorhabdus bovienii
  Coding DNA location: Contig name=SeqID_16870; Position on contig =203138..203620bp; Strand=-
atgcgtatattgatgatgttagtaatcagcatggcactgaccgggtgtgtcactaatgcacaagagtgtgatcccacgacaggggatatgagtattattgcgaaatttaattgtaattactctgggacttgggatcagagagtcgttgataaagaaaaagtgctacagcatgaacagacactgaataaagagttcaaagcggtttatgacgctatcgagcgcgagaaaaaagcaggtcaggcgaatctggaaagtagaaaacgctctcaggccgcattgcaaaagtcgttgaatcgcctgtttagccagttaaaaactaaagccgcaggcaaagtgaaaatggaaaaacagatcgctgaactggaaaaacgtatgcgtgaagcgcagcagaaaccatcgcaatctgaaatgcaaaaacaactggaattacagcagttgcagaaccagcttaatgaacttcaggacagcctgatgataccataa

SEQ ID NO: 2515 - DNA, 708 bp, Xenorhabdus bovienii
  Coding DNA location: Contig name=SeqID_16870; Position on contig =203633..204340bp; Strand=-
atggtattgcaatccatgcgttctatgatttctctctgcatgatttttctactggtcgcctgccaaacgccgcaaggcccttccgcgcagacgggagaagtcgattctcgtctgactcagagtcaggacgttgagttttttaataaatcaggctggcaggcttgtgcggcaggcgcggcggcaggggcacttgcctgtctgctcgtcaatggcgaccatcaagcgatatgtattgcggccgccgctattgtgggctgtggtgtgggggtgggtgccaacgcctatctggataaccagcgcaaaaaatatgccagcgaagaacaactactggccgcctcaattaatgatgttaaagcagaaaatcaacgtattgaaaacgtgactgctacagccaaagaggtgattaagacagataaactcaccctggcacagattaataaggacatagcggcgaaggtcgtgaaaaaagatcaggtgcaaaaacaactgaagggtcttgatgccaatattgtttatttgcgcaataccattaaagaaatgaaggaacatgaaaatcagtggcagagtgtctctactcagatcgcggaagacggaactaaaaccaaggatctgaataaccaaattgtccaaatgcgcaaaaatatcggctcgctgcaacaagagctggatagtctgtatgaacaacgtaccgcgattaaagtgagctga

SEQ ID NO: 2516 - DNA, 1527 bp, Xenorhabdus bovienii
  Coding DNA location: Contig name=SeqID_16870; Position on contig =204377..205903bp; Strand=-
atgacattggcagggctttttctggcaatgctgccgttttctgccagtgccgtctgggaagaaaaatactacaaccccaagccactgccagatgatgtgatattgccgatgccctgtgagggcgcgatggcgtttcgtaaagtttcgattccccttagtcagccgttgcaggattacagcattacccttggcggtggtgcaaatgacgaatggggttatttagaacaggcacgtgcggaacatattgcgggtagttttgccgaaggtaaatccggcaaggggcgttatttcctgatggcgaagtacgagctgacagatttgcaatatcaggcactgacaggccagtgtcctacaccgaatatgaaactgcgtttgcccaaagtgaacataggttgggttgatgcgatgaattttgctaatcaatacaacctttggttgctgcaaaaccagcctaaagcgctgccggttgaagatggaaaaccgggtttcctgcgcttaccaaccgaaacagaatgggaatttgctgcccgtggtggtttggctgtttccacggctgaatttcgcgatcaacgtttcccgatgccggaagggataaccagctatgcgtggttttctggcacgcaatcctccaacggtaaacttcagcttgcgggattgcttaaacccaatccgctgggtttgcatgatatgttgggtaatgcttctgaaatgatgtttgagccttttcacttaaataaattggatcgcccgcatggtaaagcggggggatatatcgtcagaggcggaaatttcctgacgccgcaaagtgatatacgtagctcactgcgtggagaagaaccctattacaccgggcagagtgataataagaacaaaactctcggatttcgtctggtgctggtttcgccgacgttaacttcgcgcgatcgtatcaaagaaatcgccgaagagtggaaagcattaggcacagaaaatccacaagctaaagagaaaaaatcgcctgattccattgataacctgagcagcatttcgtctcaagtgcaagatacagtgctgaagaaacagttggagcagctgcgtgctgatctccgtgcgaatgcacaattgcgtgacgaacaacgcgatcaggcgatacgcacttccctgcaacttggggcatttttgtgtacaaaattaaaggatgatggtgaattttacgatcggttgaacgggttgtatgaaaaaacctgtaaggcgggcagtgagctggatgcgaattgttcccgtcgccaatcacagttagatcagcataaaaaggtgctcaattttattgtcaattattatgctgacaccttggtggatatgggcgtcacctataacgcggagcttattgctccacaaattcgtgttgttcagcaacagatgtccgctcgtggaaaaacgaatctgaatggttatctcaatacttactggaagaatcttcaggagtactggaagaacggaagagttgcacgggatagttggctggagtcatgtaagaagaataattaa

SEQ ID NO: 2517 - DNA, 1251 bp, Xenorhabdus bovienii
  Coding DNA location: Contig name=SeqID_16870; Position on contig =205917..207167bp; Strand=-
atggaaaacaaagtgtctttacaacctgttaatgccgatgcccgaccctctcgcttgcttttgccccgtatggcgctggccgatctgattcacgatcgcaaggttgcgctttgtatcattttttcgctgattgccgtgatcacgcctttgttactgctattcgggctgaaaaatggcatcgtgagccagcttcgtcacacattgctggatgatccacgcacgcgggaagttcgtatgctgggtaatggtaactatgaccacacgtggttgacgcagcttgcggctcgtcctgatgtgggttttgtcattccgctgactcgttccctgaatacgcaggccgatctggtcagagataaccagcgttttgtcagcaatgctgaaattattccgactgctttgcatgatccgctgttggtgaatgccaaagagccacaaaatgaacagcaggttgtgctcagtgccagtgccgcagagcgtttacagataaaaacgggggatagtctgcggttagtgattgcccgtaaacggaatggtataaacgaacacgtacaacatacgctgacggtcattgatgtggttgacggagcaaaattcgcccggcctgctgccttcgtcacgctgcctcttctggtggctatggaagattaccgtgatggttatcaagttaccttattcaaggtacatgatggcacgccaacccgtgaacgcaccacttttgccaaagcgcggctatacgcaaatagcattgatagcgtggcggaattagcagagtggttacaacagcagcacatcgaaacggtaacacaacaggcggagattgaatctgtacgcgctattgatcatgttctcggtttgatttttactgttatcgcctggatatcagccactggctgtattgcttcattggtaggggcttttatggcaaatatcgatcgcaaaagaaaagatatggcggtgctcaggttattgggcttccgtcgtcaggctgtggtgatgtttgtcttaattcaggcgttgcttcttactggcagtgcctggggagtgggtttattgctctattttgtcgccagtcagttatttaataacgtgctgggcgcttcattacctgaaacggcgtttgtgtgtcatttggaaccctggcacctgctgatggctttattgagtgttctagtggtcgcactgggtgttgctgcggtgggagccttacgcgcgttgaaaattgaacctgcggagagtttacgtgagatttaa

SEQ ID NO: 2518 - DNA, 696 bp, Xenorhabdus bovienii
  Coding DNA location: Contig name=SeqID_16870; Position on contig =207136..207831bp; Strand=-
atgttgtacatccaatcgatgcagatacagcgcgggcaggcagatcagggttttaccgtcagactgccccggttgtcgctgaacgcaggagaagtcgctgcgttaacggggccgagtggctgtggcaaaagtactttgctggagatgatcggcgggatactccagcctgacagtttggaatgttaccagttgggaataccgccgcgtgatattaccgcctctctgctggagggtgaggaaaatcagcttgcccaagtgcgtgccaaggatcttggttttatgttgcagcatggcgggctgcttccttggctctcagtcgaacaaaatatccagttgccccgccaaatagccgggttggtagcgcgttctgagtggctggatacggctattgcccgtttaagtattgccggactgatgaaaaaaatgccttctcaactttcgattggggagcgtcagcgcgtggcctttgcccgtgcgattgcccatcagccgcaactgttactggcggatgaaccgacggcggcactcgaccctcacaacgccgaaacgcttttcagcctgatagtggaaatggtgaaagcactcaatttagttgccattatcgtgagtcacgactggcagcgggttacggattttggccttaaacgctacgccgctacagtggatggaaaacaaagtgtctttacaacctgttaa

SEQ ID NO: 2519 - DNA, 1992 bp, Xenorhabdus bovienii
  Coding DNA location: Contig name=SeqID_16870; Position on contig =207831..209822bp; Strand=-
atgaaacaccttaactgtctgaaggcgggttttgctgccctggcgttgatggcatcggcaggggcattggcagcacaaaaaccgcttttacaggaaggaaagcaaacgctctatcagcgtgtactgacctatccaggctgtgaactgtcggcgaaggtcggtgaaaaagggaaggtacaacctgctttcagccgtttttatgtctaccagcgccaaaaacagagtaacgaagaatggctacaggttggccctgatagctatggaaattcccgtggctggatgaaagccaattgtagcgtagattggaaaatgcagctcactttggcttttaccaacccttcaggtcgtaacccgatgctgttcttccgcgataaaacggatgtggaaaagatcctgaacaatgcgaaaccggcaacacaattacagccgctactgaatgatctgaaagcgggtaagaccgtcccttctgtgctggcgcgtgaaccggattatatgatcgatcagcagaaaaacttttatctgctgccggtcctgggttccgatgatatttttactgacacgggctatcaggttcgggtacttaatgtcgcttcggtgagcgaagctggcaaaacggccagtgcattatcgggtaagaatgccagtacctctcccgataaagaaaaaaacatgatgaaaggcttctcggcatcggtcgtttttgtgattgattccaccatctcaatggggccttacattgatcgcactaagcaggcgattgaaaaaatttatcagcgcattgaaaaagaaaacttactcggtcaggtgaagtttggtctggtcgcttatcgttcaaacgttgctgctgttcctggtctggaatatgacagcaaaatgtatgttgatcccaatacggtcaaagatggtaaagattttctggctaaagtacgcgatcttaaacaggccaccgtttccagcagtaaagtgaatgaagatgcttatgccggagtcatgaccgcgctggataaagtggactggacaaaattcggtgcccgttacgtgattctggtgacggatgcgggagcgctggaaggggatgataaattatcttcgactcagttggacgccactcaggtgcgtttggaagcaacctatcgcggcgtggcattgtatgcactccatttgaaaacgccttcaggacataaaaaccacgcatctgcggagaatcagtaccgtgatttgacgctcaatgctttcttgcacaagccactttattatccgattaactccggtgacgtgaacagttttggcacgatagttgataaccttgccaatgctattaccagccagattaaaacagcatggcgcggtgaagaaactgtaggcagcgcgctgggtgccaacgaatcctatatgggtaaaaaatcggagttgtccaaagagcctctattacatgatgctgcgttgttgggacacgccatgcgattagcgtatctgggtgacaaacaggggactcaagcgccgcctgtgtttaaatcttggatcagtgatcgcgatcttgtgcatcaaaacattccggcgacagaggttaaagtgctgctcaccaagagtgagttaagcgatctgagcgaagtcatgaaaaaggttgttaatgcagcgaatgaaggtttgatttcgccagatgatatgtttgccagcctgcgttcattagctgccacgatgggaaatgatcctaaacaggcaaaaaataaacaggcaaccaaactgagtgaaatgggattactgggtgaatacatcgaaggtttaccttatctcagtgaagtgctgagtctggatgaagagacgtggaaaagttgggatggtctggagcaagagcgctttatccgccgtttgaatactaagctgaattattaccagcgttataacgaagatgtagatcgttggatttccttggcgccagacagtgatccgcgggataacgtctatcccgttccgttggaaaatcttccgtaa

SEQ ID NO: 2520 - DNA, 1002 bp, Xenorhabdus bovienii
  Coding DNA location: Contig name=SeqID_16870; Position on contig =209832..210833bp; Strand=-
gtgattaaaccagagctgaggccttatgaaccggttgaacccggatatgctgtgttacgcattgaggattggcagggtgccactgaaggcgtcaagatatccatccagcgtaatcaggatcgctgttttctgaatggtcaggggcagtgggtcaacaatgaagagtggctgctcttgcctgagttacaggaagtcgatggcgcggcagaagcccgtgttggccctgaattggttgatgcgctgctggcggaacgtcaggtggcgtatcgcgttacggtaatagacgatatacagcgtgaggttggtgggctgaaaattgccaatggggttttaagttccttagccaaaggggagcataccccttctgacaatgtgagtgaacatgtgcctccggatcaggaaccgccagtctcaatgccgacggaaaccccctctgttgaatcattcgttgaactcactgtgtcagaatcccatgggctgccggagcctcagccaatacccgtcgatgaacggattggcgcagcatcatctgcatcagccaaaaaaccgaacaaaggaatgctgattgtcctgaccttgctggtcgttgccggggtgctttggtggttgctgaaaccgcaggaaaagcaggcgcctgtcatagctagcgcatcagtaactgctccttgtgcgatggaaaatatggccaaaggcaacgggctggagtttgttaaaagttgtctgcgcagccagccttccagcctgcaagtacaggaaattatcagtcaggcgaaaaatgctggacagtgtgacatcgcacagcggctttatgcttataaatcgcagtcgggtgataagcaaatcgcgctgcgttatgcccaagaatacgatccgaaaacagcgacaaagaagggttgttttgttgcggatgctcaaacggccatttattggtacgaaatcctgattaatcaggacccgcagaacagtgaagccaaagcgcgtttagcggcactgaaaaaatag

SEQ ID NO: 2521 - DNA, 2682 bp, Xenorhabdus bovienii
  Coding DNA location: Contig name=SeqID_16870; Position on contig =210840..213521bp; Strand=-
atgaaatattttactcccgaacaattaaaacaagcgtggcttgacgtggcgcaaggggcaggtcaggcgattgaatgggttgaagaggtgcgtggaaatgccccgcgtctcaacacagaagctgatcggttgaaactgaagctgcgccgtagccgaaataccgcgcagagattggccaaaggggctactcatcccatgaccattggtttttttggtttatctcaagcggggaaatcttatctgatttcctcattggcagccggggagaacgggcggctggaaacccagatggggccgtatcagcttgattttatcgaacatatcaatcccccgggtggcggaaaagaagccactggcctagttacacgttttagccgccacgcgcggccatctaaccctgattggccgattgagctacaactgttcaacgaagcggagattgccaaaatcttcgctaatacgtttattcatgatttcaatcaggagaaaatcgactggaattatgatgaaaaacgcatcaatacgctgcttacctcactgaacgagcggcgtcaggcgcataaagtcccgggggtggcggaagatgatgtggtcgcgctatgggactatctgatccgtcatgcagcaaagagccagagcaaaatgactttgcaatactggccagcggcggtagagctggcaccttggttgtcgattgatgatcgtgctcagttatttggtgaattatggggcaatatccatgaattcacagaggcttatcgccgatttgcgcatacgctacaacgtctggggggcgccagcgttgtcagagcaccacttaatgtgttggtcactgagcagaatggcaggttggtacaaactaacagcattatgaacgttgatatgctggagcgcctgaataagagcaacgatttgcagattacggtgtgtccggaacgagagaatgggctggctgcaccggtatcagtttctctggcagaactcacggcactgactgtggagttgcatgttccgttactttcctccacgcgagaacggttatttgaggaagtcgatttgttggacttccccggttatcgtggccgtctgggtgtggaatctctgaattatctccagaacgcggctgaaagcgacgacagcaatccactggcacagttaatcctgcgtggcaaagtggcctacttgtttgagcgttacaccctcaatcaggagatgaatgttctggtggtttgtacgccttcaaatgaacaatccaacgtgaaagatgtgggaggtgtactggatgaatggatacgttatagccagggcgctgatgctgacagccgcgcacgtcgcccagcaggattggtctgggcgatcaccaaactcgatttacgtattacccaggagctgaccaaatcagaagatatgttgcgtgaggtctgggggcagggcgggatgatcaaaatcgccatgaccgaacgtttcggccattttccttggatgcaggaatggcatcccggtcgtgcctttaacaatgcatttctggtacgtaaaccgtgtcaggccacgccattcatcacaatgaaagagggctgcgaggcggagttcagtcaggagactgcttccaagctgaccctgatgaaaaaaactttcctcgaagatgctgcaatccaacgccatattgcctcacctgagcaagcttgggatgccatgctgcaattaaatgatggtggtatgcgccggttagcggattatttaggcatcgtcgcccagcgtgaaatgaagttagagcgcattactgaacagttaaatgaaacgcgccatgaactggtggaaggaaatttacacgcttggtatcagcctgatggcgcagaagaagtggagaaaaaaaggcttatctccgaagagatcctgaaggcattacaaaaccgtgccggaaggcatggcgaactgctggcgggcttagtgcctcaacgaaaagcactgcaagagctttatatgcaggaagctgaacttgatttacccacagagggtaaagatgcaaacgaatccgttgctgccttcgggattggcagtgattttgatctcttcagtgatactccggatgaaaccgtctcggctcacagccatgaacaggagtttgctcatcgagtgatcaaactgtggatcaattacttgcgcactgtacctgaacaaaccagtatgacggattttatcgggctttcccgttctattgtcgaagtgctggtggatgaattaatcaccgcgatccagcggatgaacgtcgaaggtgagctgatgaaggtgttggcgaatactgagcaggcgggtgtacggcgggaaaaaatgatggagcgtcaggtatcccgtgtgatgcacattatgaatgatttcattacttggttgggctatcagaatgtaccgagtgagaaacgcccggcgagccgcattaacaaagggcagcctatttttgcccgtccggacaaaaaagatcctgccttgtggaaaggtgacgaacgcctttatcggctgacaaatgaacaactgaactacagcgctatgtttatctttgactggttattcggcttcggcgaaataatcaaagaaaacgcgggtcattctgcgggacgcgaaattaccgccgttcagaatgaacggttgggcaccattattcatcgtattcaactgtcgtcggagtaa

SEQ ID NO: 2522 - DNA, 3021 bp, Xenorhabdus bovienii
  Coding DNA location: Contig name=SeqID_16870; Position on contig =213521..216541bp; Strand=-
atgctggcaacgattaccgatttcaaagaaaaagtgacattgattcgtgacagtggcattcagtttctggattttgctttcgcgttacccaaaaagaaagaatacggtgaatttctactgactgaggaagataacccggtcattcgtctggtatataacgaaagagatgagaattttcttgtaccttcagcgtcaggttcgtctgcattcgcagcggactccgattactcgctggtactggagaaatctcttgaaatatacaatgacatttggttaccgctgccctttttccgctttaactcgtcacggagttttgcgcaggggccgactaactggtcgcgagtgaaatttcatgcactggatacaccggatgagcaggggaatacctggcgcgtgactttggcttttgataccaaagtgtctccagataggcgaaatacccagtatctggagcctgtcgatgatgatgtgcgttccggtgtgggctttgcgctggcagagactcatcatgagatgggcgattttctgttgctgaaatgggtggatgactggctgcgggaaacctataccgaacgtgccaccgcattgtggcgtcaatatcatgaagatactgaaaactgtttgaaccggaaggaacatcaagcgcattatctcaatttgattaatgcactcaatgcgttgttgcaggttcctgaagttcagctcaacgatgttaaacttcaggataatcctattaatgtcgatttagtgctcgatattggtaactcacgcagttgtgggatcttaattgaagaacacagagatggcgatcaaggtctgtcgaatctctatcagcttcaattacgtgacctgagtgaaccgcagtatatttatactgatccttttgacagccgtctggagttcgctcaagccgaattcgggaagcaggatttttctgtcaaaagcgggcgcagcgatgcgtttacttggccgaccattggtcgtgtgggcgaagaagcgtttcgtatggcctcacagcgtttgggtacagaaggctcaacggggctttccagtccaaaacgctatttgtgggatgacgcaccttactcccctggctggcgtttcagccgtgcttttgtgaaatcggatcgtgaacctcaggcgacggcagcgccgatgacctacatgatcaatgacaaaggcgaagcgctttatgcacttaagccttctgagcgtatgccggtgtttacgccggaatatagccgcagtactttgatgaccatgatgttgtctgaagtattggcacaggcattgatgcagattaacagtccggctcaacgtttgaaaatgcgtcatgccagtacccctcgtcagttaaaaaatatcattctcaccgtgccgccggcgatgccaaaacctgagcgcgcgattttccagaaagccatgacacaggccatcaggctggtgtggaaggcgctggattgggaagagatggatcagggtgttgatgaaaacggtcgggaagataaaaacgtctcccgtaaacgtaccttgcctgacgtgcatgtgaaatgggatgaagcgacctgtggtcagttagtttatctctacaacgagacgcaaaactattttggtggccggagtgaagagttttttgcagccacagtgcggcctgataataaacgggaagcgggtaatgatcgcacgttgaaaattgcctctatcgatattggtggtggcacaaccgatttggtgatcacccgttataccttggatgaagggagcggcagtaatgtgcgtatcgttccgacacagctattccgtgaggggtttaaagttgcgggtgatgatattctgttggatgtgatccaactctatttgcagcctgcattcgaagccgcgttgctcaatattggctatcaagatttagatgctgaagcattaatgtcacgcttattcggcagtgaagcattagaggcaggcaaacaggtgctacgccagcaactgacactgcaaatatttgcgcctgtggcacttgctattttgcatcgttatgaaaaatttacgccagaggcgggtgagcaagttattagtgcaacgttcaatgatctactttctcatcaaccgacggataaagtttgtgaatatgttgatgaagaagttaagcgcagtttaccagagggaatagaaaacccattttccattctcaatgtgccgttaaacatcaatttgatgaaactgcataacgaatttatcgatgcccgtcataaccgcatcaatatttgcggtagcttacgcgggttgtgcgaagttctctggcactacaactgcgacattttgttgttaaccgggcgaccttcccgtctgccggggattcaggcactgatccgccacttacaacccgtaccgcctgcacgcattctccccttgcatggttacgaaacgggcggttggtatccgttcaataaaaaaggattaattgacgatcctaaatccacggcggcggtgggcgcgatgctttgcctgctggccgagaaatcacggttgagtaacttctatttccgtacggccaattttaagccttattcgactatccgttatttcggcatgctcgacagcaataatttgctgaaagacagcaacgtgttttatcgggatattgatctggacaccccgggattccagttggataaccagcaatattttgagtctcgtggcgaaatgcggcttggtttccgtcagcttgacaatgaacgctggcctgcgacgccactatacaccttgaaaattccgggaacgcgcttagcgacagctttatctggtgatgcggtattgcgactgaaactggaggtggaagaagggcgtgggcaagaagctgaaactaacggaagtcctgaaaagttccgtatcagcgagatggagatcgtcgaatctacgcagaacccgcgtccacaggacgtgagtttcaaattgaatactctggtcgggaacggcttgggtgaaactcattattggctcgacagtgggagcattaaaatctga

SEQ ID NO: 2523 - DNA, 1434 bp, Xenorhabdus bovienii
  Coding DNA location: Contig name=SeqID_16870; Position on contig =216546..217979bp; Strand=-
gtgaaaaaaacttttttacgtggtgataaactcgaaagttatctgccgctgggagaaaatggccaggctgtgcatctttccgcattacagttgcgagaaaccttgcgcctgcggcagctctctgatgttgctaattcactggcaatcccacagggcaatgagcagggtgatcggatagattggtatgccggcttttcaggtaacgtcgttccctggtcggccgcaacgtatgatgaacgtcagtcagcattgcggcaactggaagctcaccaggccgctatcgaacggctcagtgcacaaatgatccagcaaaaggcgcctgaaatgcgtctttttggcgctttgctgagtaaaactatccagtttcccgatcaggatcacatctatttggtcgatggtaaacccgtggtgactttttggggatttgtcaatgcgaagcagcaggctcgtcccaatcctcttgagtgtttaaggacagtacgttctgtgacgcaatcagttgcttcggttgcaccaaccgaacccacggctgaaactgtggttgcaacgccgccgcctgtgtccgaacgttctcgacgttggctattgcctcattggttgtggtggcttctgcctctgttattgattttgttcgctctgttgttactgcgtggttgcgtaccggatgtctatatttgggggatgacaccttccactcattctacaccgccacttcaaggtgaaataatctcgaaagaggggaaacccgtaccagaacgatcagttccagctctatcagtgaatgaatctcattctttacctcttgtgaaaggaatgagttccgtcaatggcacggcttctgttaatagtacggtgcctgttaacggtgcgatgcctatagatggcgcatcttcctccgtcgatggaacttcccctgtttcaccagaagtgaatccgattgaaccgatgatcccaactcagccgataccgccagttgcggatggggtatccaatggcacgccaaaaccttccctgcctgagattaatctccctccagtacaggtttctccgcctgctgaggcgcttacaatcccagacatcgcggtgcggcagggtaccactgattttctcaatggtagctggcacgcaggtgccggaattcaggatagtcgtactggcaaaccactcagtctgacgtatcagatggcagatggtaaagggcaggttgaaatggcgcgcggtgacggtattcgttgccaggctcccgttaaggcagcgatgaattcaggggcgctgcaactggataatattggtgaagcgaagtgtagcgatggttcggtttacacgatgcctgaagtggtttgtcaatcaggcagccaaggtacagcggagtgtaaaggacgttatgacgaaaaaactttatttcccatgtcgatgaagcgagaggcaaattaa

SEQ ID NO: 2524 - DNA, 1377 bp, Xenorhabdus bovienii
  Coding DNA location: Contig name=SeqID_16870; Position on contig =218153..219529bp; Strand=-
atgataagaataacgcgtacagtagcgcatgaaagcgctcaaagtgagtatctattacgtcactatgatgccctacattctgcgttagttcagcatctaccgataaatttttctacattatttgctaaacctgtcaaaagcagtgatggtgccattgaatggtacagtgatttacaaggccaacccgtcccttttgctcagttatctgcgatagaacgcgataagctccaggcgcaaattgcccgtcaattgacggtattagctcgcctgcgtgaacagctaagtgaaaaagagggagtggatagcgaattactgacgttactgggaaaaatcagccagtttcctgctgaggaacacatttggagtgtggatagccaacccgttatcctttgggagccgatgagcgcatctgcatctcaaaatattgccggaagcgggactgcttctcccgatcttgtcgcatctcagccagaacagaaacgaaagccgcgctggttatggtggttgctgttgttattgttcattctattattgctgtggttactgcgaggctgcctgccacgcagtcacactcatattgcgataaaacaacctaatccccctgtggcagtaaaacctccgcaggtaaagccagtagaacagccaataaagcaaccaatagaacaacccgcgccaacagtgccagaggtaaaacctgaagccgtggtgatccccccgccagtggatgtcagaaagcgatgtccgtctcagcgaaaacggaatcaggctccagaggttgtggtggtttttgatgcttctggctcaatgtctatcagtgtggatgtcactccacaagaactacagtatttgttgcaaaggaaagccttcgaatacatcgagcgagaacccagccgtattactctggccaagaagtcggcgaaaaagattatcgataaattgccttcagatatgaatgtcagcttggtggaggcgttcgattgcaggcatgtttccgcgtcattacctttttcgcctacgcagcggccagcactgaaacgggcgattgatcgtattacaccggatggaaaaacgcctctggcactggctttggaaaaggctggggctttagtggatggtgtgaatcgcgatgcgataatcttattaatttcagatggtgatgaaacttgtggcggtgatccctgtgctgtcgctcgtgcgttgaaagagaacaaaccccggctacaggttaatgttgtcgatatcatgagtagtggtgcgggaaattgcattgccagtcagactggtggcaaagtattcacagcgaatgatgccaatcagtttaatcaggtaataaatcaagcaatgcaggattatattccggaaaattgcaatgagtaa

SEQ ID NO: 2525 - DNA, 105 bp, Xenorhabdus bovienii
  Coding DNA location: Contig name=SeqID_16870; Position on contig =219526..219630bp; Strand=-
atggaggagactgtttttcatgtattaaatcacattcccatacggattagcgattttgggtgcattaaaaggacttacacatccgcaagcgggtcgcaggcatga

SEQ ID NO: 2526 - DNA, 99 bp, Xenorhabdus bovienii
  Coding DNA location: Contig name=SeqID_16870; Position on contig =219866..219964bp; Strand=-
ttgttttatagatttggctacttgtatgtttacgatgtcaggatcgcatgtaatggtgaattggacattaataaaatctattcttctatggctgactga

SEQ ID NO: 2527 - DNA, 933 bp, Xenorhabdus bovienii
  Coding DNA location: Contig name=SeqID_16870; Position on contig =220087..221019bp; Strand=+
atgagcactcaagataaaaagcctgagttaaaagccttagaagaagaagatgaagttgtcatagtgccgaccagaaaatatgtaaaagactccattcaaaaccacgcccagagccgtgatcaccctgatgcaacacttaaagataaaggatttgtgatcctaagcaatgatgtcggtagtgatagcgaaactaatgcagcaacaccaaaagcagtcaaagctgcatacgatttggcaaataccgctaataaaaatgctagcaatgcaaataataacgccaatactcgattagagaaaaatcgaaatggggaggatattcctgacaaagaaacatttgtgaaaaatatcggattagcggaaaccgtggaacgggcaaaaaatgcggtaactattgatatagtatatcctgtcggtattgttttatggtttgcacaaaataaaaaccccaacaacctattccctggtacaacttggaaatatattggcgaaaataaaactatcagattggcatctctaaatggttcagacgttttatcaacaggagggaatgactctatcactttgagcgctgcacaaatacctgctcataatcactcattctcagccacaacagacccatttgattatggaacaaaaacaacgaatagcgccggtgagcattttcatgatagtggttggggagaagcatataccgatacaggtaaagcacgatatggagtttatgataatacgaataataattatggctccggttcctctgattgggataattataaatataacaccagcactgatggagctcatcaacatgaagttgatattggtagtcatacccacaccatatcaggtgcaacatcaaacactggtaacggagaagcaatcgatattaccaacacatatattatgttgatgggatggtatagatcggcataa

SEQ ID NO: 2528 - DNA, 153 bp, Xenorhabdus bovienii
  Coding DNA location: Contig name=SeqID_16870; Position on contig =221054..221206bp; Strand=+
ttggggcggttctttacgccccttctgtctccctctgcctcaaatttcacatcgaatcttccggcatctggacacggacatctaaccgggtgccggcaggtaaatcacacgcctcatcatcggtgtaataggtctacccatccactgacttga

SEQ ID NO: 2529 - DNA, 378 bp, Xenorhabdus bovienii
  Coding DNA location: Contig name=SeqID_16870; Position on contig =221187..221564bp; Strand=-
atggaataccaacaattgagtatgagtaaccaagatgccgaatggctggcttcccaccgtttcacgattgacgatatcgctcgtatgttcaatgtcagcccgatcttgctgcaagagtattcaaacagcacctacagtaattttagcgaagcgtcccgcgcctttctgaccattaccatgcgcccgtggctcgccaactttgagcaacaaataaaatcggccttgctgatggcattcccgaaacgggggatttgttatcgagtggagtttgataaagtgctgccggatggggctattgaaatcaaggtaacccaccgacagaatgcgcatatgcctgcccgattgcagaacaggcacatcaagtcagtggatgggtag

SEQ ID NO: 2530 - DNA, 159 bp, Xenorhabdus bovienii
  Coding DNA location: Contig name=SeqID_16870; Position on contig =221748..221906bp; Strand=+
atggcgaagttcatcattgctgagttttttactgatcggttgggttttacctgcctgactgcgttcttcatcagacagtgcttcataatgggtaatttccgtattcagggtgtcggactggctgcgcagttcgtcgaactgttggcttcattcaaataa

SEQ ID NO: 2531 - DNA, 93 bp, Xenorhabdus bovienii
  Coding DNA location: Contig name=SeqID_16870; Position on contig =221937..222029bp; Strand=-
atggagctatataagagggcttattctttatttcctgtggaaaattcaaggttagtggaagaaatcagcctgtctaatttagtcagaatatga

SEQ ID NO: 2532 - DNA, 165 bp, Xenorhabdus bovienii
  Coding DNA location: Contig name=SeqID_16870; Position on contig =222078..222242bp; Strand=-
ttgttttttcaatcaagagaaaaaattattgagaaaagaaagtcttttagaaggatatcaaataacgaaaaaatctcagaagatataagagcattggaaaaaaatgaggaggttaggataataaactcctattatttaaagtgtgatcttagcgttgatgcttaa

SEQ ID NO: 2533 - DNA, 162 bp, Xenorhabdus bovienii
  Coding DNA location: Contig name=SeqID_16870; Position on contig =222211..222372bp; Strand=-
atggatttcgttaaaactgtggagctaataattaatcatggatggataggttttttattatgtgttttcacgttcttactttttgtttttaccattgtaaatatacatacaaccttactgtataaggcatttgttttttcaatcaagagaaaaaattattga

SEQ ID NO: 2534 - DNA, 510 bp, Xenorhabdus bovienii
  Coding DNA location: Contig name=SeqID_16870; Position on contig =222406..222915bp; Strand=-
atgtactatcgtgataaattcggtgttttgcttttagataaaaaagataatctaggttattatagtcagcagaaaatttttattgaaaacaaaatgactgcccttgatgtttataatcaaatgacacaaaaaacaccattatggttacgcttgtctttttcaataagagataaaatatcaagtcttgctggtttagaaaaaattcatggattctcagatgaaaatttaaataaagaatttcacgctggaagctatatcgatttttttaagattgtacgtatcagtgatgatgaaatatgtctattgtctaaggacatacatttgacggtgctgatatctctgaatgttttctctgatgataatcataaaggcggttgcatagctactgtgactgcatctgtaataacgcataatttttttggaaaagtgtatatgataccggtgtctcttactcatggcagcattgtgagggggatgttatctaaagttggtcaggtattaaaagattaa

SEQ ID NO: 2535 - DNA, 192 bp, Xenorhabdus bovienii
  Coding DNA location: Contig name=SeqID_16870; Position on contig =222982..223173bp; Strand=+
atgtcatatgatctgagcagtcaccagtttgtatctttattatacttccatatctctatatcatcatttatatataactacatagattttcacgggataacgggatatatagatatttttttatttatttcaaatagttatcctaccccattttatcccacttatcccgtagcacagaaatactatttttaa

SEQ ID NO: 2536 - DNA, 420 bp, Xenorhabdus bovienii
  Coding DNA location: Contig name=SeqID_16870; Position on contig =223360..223779bp; Strand=-
gtgataaagcaaagttttgatgactggttagaagattttggtatcgggaaccgtgaaaaatatcaggttgtcacccgtgcccgtgattttatccagaaatacggcttatcgcgttttcagccttattcctatggaaaactgaatggtaatatagacaccgctaacgccatgaaaattaacaatttcgcgggttatctggtacataaccgccgcagtgatggacaggtggaatatcacattatccccagtgtgtttgaagaggaaatattgcagggattacagaagaaatcaggctttgaggctctggaaaaagctgggatgttgattaaaatggagaaagaccgctttatcagtaaaaccatttcagtgaatggcactcaggggcggtttgtggttttgattttcaaggatgaagattag

SEQ ID NO: 2537 - DNA, 207 bp, Xenorhabdus bovienii
  Coding DNA location: Contig name=SeqID_16870; Position on contig =224045..224251bp; Strand=-
gtggggatccctcagagcataagcggctctattattatattcatcctatcattaatacttgctgtaatatttttattgctaggtaagtatgcttttagtactgcatattatgcaaatatagtaccagcagtgttagcactatggggattgaaacgcttgatcctaccaaacgattgtatttatttgaaaaataacattattacttag

SEQ ID NO: 2538 - DNA, 453 bp, Xenorhabdus bovienii
  Coding DNA location: Contig name=SeqID_16870; Position on contig =224261..224713bp; Strand=-
atggtacgaaaatctcaggtcaaagatggacgttcggcagcaatggaaccttggcttatttttactagtatggatgattttaaacctcgtcaggttatgaaaatttacagccgaagaatgcaaatagagcaaaattttagggatgaaaagagtgaacgttttggatttggtcttagagcaagttatagccacggtactggtcgtttatcagtattgagtctacttgctacactgagttcagttgtactttggctgattggtttttatgccgaaaataaaggaatacatcttaattatcaggcaaatagtattaaatcaaggcgagttatctctcatcttacattagcggagaatgtattacggcattccccgctaatattatttgaaatcgttcttaataacacactcaaatatctcgccaaaatctaccaaaacatggttttgatttattag

SEQ ID NO: 2539 - DNA, 216 bp, Xenorhabdus bovienii
  Coding DNA location: Contig name=SeqID_16870; Position on contig =224876..225091bp; Strand=-
ttgttaagtcaaatagttccctcatgtgaacaacaaaatgtaaccatccaaaatgcatttcttgacatgctagcgagtgctgttaaccctaaagctagagtaattattgttacggatgcaggttttcaaaatgcagggttcaaacagataaaaacgctcggttgggatttcgtcggacgcattcgaggaaatactcaactaagacttgaaaaatag

SEQ ID NO: 2540 - DNA, 339 bp, Xenorhabdus bovienii
  Coding DNA location: Contig name=SeqID_16870; Position on contig =225116..225454bp; Strand=-
atgcctgtacgtgaaatatgtcataacttctttaaagatgctttatcaccatttcataaatatcgtcagaatgcattaatcgatgccactatcgctttgattaatggtgcttctcttacgttaaccagcattgggcgctttttaccaggaaacgctcacgtcaaacataaaattaaacgtattgatcggctactcggtaatgaagctcttcatagggatattcctgatatctttcgtaatattattgctatgctgactgagtcactctcattgtgtgtcatagctgttgattggagtggatatccctcacaagaacatcatgtactccgtgcgagttga

SEQ ID NO: 2541 - DNA, 162 bp, Xenorhabdus bovienii
  Coding DNA location: Contig name=SeqID_16870; Position on contig =225431..225592bp; Strand=+
atgacatatttcacgtacaggcatagcagtgaccttattgacttggtggaacaatcagtagatcacacaacgctatgcctgtctattttctggggattcctcagcgcccagtgcgaggttttttattacctgaataataggaggatttatggattggattaa

SEQ ID NO: 2542 - DNA, 141 bp, Xenorhabdus bovienii
  Coding DNA location: Contig name=SeqID_16870; Position on contig =225579..225719bp; Strand=+
atggattggattaaaactagcgatagattgccaaatgacgatggatattatttagtgtacgaaacttttaataataaagtaggtgatgattatttctttcataacggaagtggcgatcattggaagttatttcatgaataa

SEQ ID NO: 2543 - DNA, 249 bp, Xenorhabdus bovienii
  Coding DNA location: Contig name=SeqID_16870; Position on contig =225767..226015bp; Strand=+
atgtttatattaccaaatatgccatgctttccagatacgtctgatattacaaatataatagagagcgaattaaatgaattaaaaaaatccctgactagagataactacccaaaacttgaaattggttacacggttatcttgttgaatggtgatgtcggggttgttgaagatatttttcatgacggcacttatgattgccgaatggaaagaacagaaaagttacacatgttgccacctacaggtatgtag

SEQ ID NO: 2544 - DNA, 783 bp, Xenorhabdus bovienii
  Coding DNA location: Contig name=SeqID_16870; Position on contig =225961..226743bp; Strand=+
ttgccgaatggaaagaacagaaaagttacacatgttgccacctacaggtatgtagcgaccaaggcaaagcacttagcattgatgaagtctctgctaagggcggctgaacgggattggaaatggttagagaaagcacccgtgatcaaggttccagccgtcagagataaacgtgtcagatggttagagccttgcgaagcccaaagattagttgatgaatgccccgaacctttacagtcaatcgtcaagttcgcactggcaacgggattaaggcgctcaaacattatcaatcttgaatggtctcaaattgatatgcagagacaagtagcatggatacacccagaccaaagtaaatcggctagggctataggggtagccctaaacgaaaccgcttgcagggtgttacgtgcccagataggaaatcataataagtgggtgttcgtccatactaaaccatcaactaatcccgatggaatagtaatgcctaatatcagaaagatgcgtgttgatgataacacagcatggaattccgcattaaagcgagcaggaatagaagatttccgcttccatgatctgagacatacgtgggctagctggctggttcagtcagacgttccattgtcaattttgcaagagatgggcgggtgggaatccattgaaatggtaaggcgatatgctcatttagcacctaatcatttgactgaacacgcacgtcaaattgatgagctttttggaaatctcgtcccaaatccgtcccagtcgggaaaaattgtagttgcaaagtag

SEQ ID NO: 2545 - DNA, 810 bp, Xenorhabdus bovienii
  Coding DNA location: Contig name=SeqID_16870; Position on contig =226933..227742bp; Strand=+
ttggaaaaatattttcagagctatattgtgaaactaactaaacttcaaattaaaaatttccgttcactgaaagatcttcaggttgaccttgaagaatatatttcaattatagtcggcaaaaataactcaggaaaaacatcactactcctagcacttgaacgcttccttggtagcacaaatccgcattttgagttggacgatttcaacattgactttcaaaaagacctcgttaagctcattgaaagcgagatatttcctactgagccttgccttaatatgtcacttcgattgttcattaaatatgaagaggatgacgatcttgctaatgtcgggaacaagataattatggatcttgaccccgcaaataactggatcgttctggactttctgtaccagctttccccagagaaccttaattttctcaaacgagactatatagctcacagcaagaaaaaaggtgcaaaagcccaatccacacttgattttcttcgagaaaaccatagcttctactttaagcttgcacgtagaagtatccaattcgatcacgtatcacaagcagcccaagaggatgattatgtcgatctaatcaaagaaggaattcgtttcgaaaacatcatttctttcaagcgtattaatgctcgacggtctgtatcaaataaagactcagaccgaagcttatcgacgatgtcagcaaaaatttattcagcaattttaaacaatgccgatgaagaaaatgtttttgacgatttcaaggaagcactaaacaatacagacggacagctagatagcatctatatccgtcgtcattga

SEQ ID NO: 2546 - DNA, 1050 bp, Xenorhabdus bovienii
  Coding DNA location: Contig name=SeqID_16870; Position on contig =227773..228822bp; Strand=+
atgatcgcgctcatgaaaattaatctgacagatgcccaaaaagaagccctcgaattgatgcatgatacgactcgcgatggacgagtacgtgaccgcattaaggccgtgcttttggcctcagaaggctggactgcccagatgattgcccaggctttgcggatccatgaaagtacggtgagtcgccatctgaaagattacttctctgaggaaaaactcgcccctgaaaatgggggctctgaaagccgtttgtctgccgaacaaacgacagcattagtggagtatctgatggcaaatttgatgcacactaccgcccaaattgtggcctatgttcgggctcgatggcaggtgactttcactgttgcaggaatgacgaaatggcttcaccgtcagggtttcagctacaagaagccaatgggtgctccgcataaatttgatgcggataaacagcaacagtttattgaaacctacaacgcgttgaaagaagaatgtggccagaatacgcctattttgtttattgatgcggttcacccgaccctgtccacaaaattaagttatggctggatgaagagcgggcggaagcacgtcaaagtggttgaaaccacgggcagtcgtactcgactcaacatcatgggtgcccttaatttacaacggattgaagagactattgttcgtgaatatccgacgattaacgcgaaaaatgtcgtcctttttttcggctcaatccgggaaacctacccactttcgcaaaaaatccacattattctggatggtgcgggttatcaccgttccgcagtcgttcaattttttgccgaggttttgaatattgagttgcactacctgccgccttacagccctaacctcaacccgattgagcgattatggaagtatgtgaatgagcaggtacgaaacaatgtctattttccggataccaaaacattccgtgaaacgctgcgtcacttttttcatgtcacattgccagaaaaagcgaaagagctcaccactcggttgactgataacttccagattttaaaacccgcctcttcaagttaa

SEQ ID NO: 2547 - DNA, 1332 bp, Xenorhabdus bovienii
  Coding DNA location: Contig name=SeqID_16870; Position on contig =228959..230290bp; Strand=+
atgtacgggcaaggagaagaagcttatgccttacccgaaaattttaacgggttaggctatctgaatttaattagcattatcttcgatatcaaaattattctaaatgagtttaagcgaaataagtctccaaagcccgcagatataaatttgctatttatcgaagaacctgaagctcatactcacccacaaatgcaagcaacattcataaaaaacatcaagaacttgataggcagagatatagtcaatactaatggtatcacgaggccattacagacgattatatctacacattcggctcatatcgttactgaatctgatttcgaagatatccggtacttcaagagaggcagtggaggaacgtactccaaaaaccttaaggatctagaaacacattataataatgctggacataatgagcattacaagttccttaaacagtatctaacaattcaccgatcacagcttttcttcgcagataaggcaatccttgtagaaggtgagacagaacgaatattactacctgctatgatgcgaaaaaaagatcaatccgatgaagcagaggcttgggaaacaggtattcagtctccagtgcctttgctttctcaaaatatctcagtagttgaagttggcgcacactcacaaattttcgaaattttcttagattttattgggataaaaactctcatcatcacagatattgattcagcggtggaagagaaccgtaccgcagaagatgggcaatctaaaacaaataaggagggccatcctatcaaagatctgtgcgctcatgaggtaatgggcgcgacgcatactacaaacaaagctcttcagttcttcttcaatgtaggtcccgaactcaactattttcttgaattgaaaagtgaggaaaaaagagtccataaaaacaaagctaccaaccaatggggaaataatcccgctgggcagatcatgtgtgcctatcagatttcagaagctaatgcagatagtacagcctatcatgctcgtagttttgaggatgcttttcttcatgttaatcggcaattcatgggtaacgcttgcgatgggaatggtgatattgacaagacaaaatttccaagtctagttaagaagcatctaatacaatatcttaacggtgattctccttttgagatggctgaaaacggtattactaaaaagccatcattcgctattgaaatccttcttaatagccaatccactacagttacgaagaaaaattctgccggagatctgaaggtgttctacttagaatttaataattggcaaacaccacaatacattgatgagggactcacatggctcaaaaaggaatga

SEQ ID NO: 2548 - DNA, 1899 bp, Xenorhabdus bovienii
  Coding DNA location: Contig name=SeqID_16870; Position on contig =230272..232170bp; Strand=+
atggctcaaaaaggaatgaaattagaacctgaggtagttgatatcctcaaacatattactgaaggaaaaaattttcttctaagcggaggtgcaggaagtggcaaaacatattccttagttcaagttataggcgagcttctgaggattgatccgtgctcatttattgcatgtattacctatactaacgctgctgttaaagagatagaatctcgtatttccagtaagcggctctcagttagcactattcacgatttcttatggaacgcaattaaaccctatcaaaaagaactgcgcaatgttctaatcaaattgatgaacggggaagatcctaggattaaaccaagtaatacaattgtatctgaagatatgttcgatagaaaatctatagaatacaaagaattcagaattctagaacaggggattatttctcatgatgaagtcataattcttgcacgaagtattttcgaaaaatatccgaaaattcgggatattttgagagataagttccgctatattctagtcgatgaataccaagatacatctcctgacgttataaatattcttctcgattttctccccttaagctctcgcaaaggagtatgtggcttctttggtgacagcatgcaatccatctatgacgagggagttggaacaattcaaaattatattaataacggtatagtaaaagaggtgcgaaaagagcagaaccgccgtaacccgaagctcgtttatgaactagcaaataaacttcgtgatgatagcttaatacagcatgcttctgacgatcaaaacgcgcccaatatgaacaatggtataattaaaaagggtactatatgtttctattattcttccggagaaatagataaactggattctgttcgtaatcatctaaattggaattttgatgatgtactcgaaactaaagaacttaacttgactcataatctcattgcacctcaagcaggttttggggatttaatggaaatatatgacaaagatggtgtactagattttcgagatcgaatcgtgaaatttgtccaaaagcatggtgacttcaataaatataatgaattgacgttcggtgaagtcattgaggaggtccaaagaggcaaaacggacaaagaactaaacgctgttagcccaacacctcagatgcaaaaatttattgatactcaccctgatttattgaatgaggcaaagaagaataattttcatctacttaggcatatgtatgtcaacaaagatcaacttatcgatgataacaagcttagtgaaaatgacattcgacgaaaaggatcacaacggtgtaattttattaaacatatcttcaagatacaaacagtcatccatctttatgaacagcgacgatacaacgatttcttgcgaaaaacagaatttcaactcaagcgtgtcaatgacaaagtacgtttgaaagagtgtatagaaactatttgttcaatgaaaaattgtcctattattgatgttattaattttgctcatgagcataaaatttgtattaaagacgaccaatttcacaatttttctcaaaagaaagagtatctttttaatagactaattaatgttaaatacgcatcttttcaaaaactttacgaatatctggaaggacgcactgcattttcaactcagcataaaattaaaggaagagagtttgatagagtactagtcgttttagattcaggaggatggaataaatataattttaaccatttttttgaaaaaatcggtacagaacctgttcgattaagaacgcaaaagttattttatgtttgctgtacacgtgcaaaagaaagtttagcagtttattttcgcgatccatcagatgcaacgcttacacaagcaagagattggtttggggctgaaaatgtcattaaaatttga

SEQ ID NO: 2549 - DNA, 282 bp, Xenorhabdus bovienii
  Coding DNA location: Contig name=SeqID_16870; Position on contig =232459..232740bp; Strand=-
atggaaggggtagcaggaatgaataacgttagaaatgactggcatcaagctgacattattgctgcattacgtaagcgtggtacgaccttagcggctgtttctcgtgaggcggggcttagttcatctacgttagcaaatactcttattcggccttggcctaaaggggagtggattattgcgaattacctcggaatacatccttcggaaatttggcctagtcggtatattgatatggacggtcagcttattgaacggacagctcgcaaggtttctactgaatag

SEQ ID NO: 2550 - DNA, 219 bp, Xenorhabdus bovienii
  Coding DNA location: Contig name=SeqID_16870; Position on contig =232765..232983bp; Strand=-
ttgaacttagtagttcggttattgagtcagataatacaatcagttaaagtaatcgtgccattggcaaaatccaatggtcaaggcgtcgcggccttgcgttcacgggcactggtaaataatctttttgccagtgtgcctgctatcgtccctcaatggcggttcaggcagggaaggctttgccttgccggaagtgaacgccggtccgcgaaccctgtttga

SEQ ID NO: 2551 - DNA, 189 bp, Xenorhabdus bovienii
  Coding DNA location: Contig name=SeqID_16870; Position on contig =233017..233205bp; Strand=-
atgacaaaaattaaaacactttctcttgcacaagtaatgcaaaaaactcgtttatcgaagttgtggatttatcaattgatgcaacaaggcaatttccctcagccagtcaggaagaaaattggagttgatgtatggcaagaaaaagctattaccgactggctcgctattgatgaaagcaacacagagtag

SEQ ID NO: 2552 - DNA, 1059 bp, Xenorhabdus bovienii
  Coding DNA location: Contig name=SeqID_16870; Position on contig =233209..234267bp; Strand=-
atgacctgtttatgcaggcggcagtacagcgtactcaaccgataccccgcaatacctcaacccgcgttcactctggcgcacagatatccgtcaaggacaaagcaggcatctcctgttttgtcagcattgtcgcgcgccagagatggcatgttgtcaggtataagtagggagaaacagatgagcagattgattaaggaattaaagttttttgcccgtcagggtggcggtagccataaaacctgtcatgaccgcattcggatcgcagggcgtttgggtgcattgttattgagcctgaatattcaggttaaaagtctcagccatttaaaagctaaacatgttgaacattatgttgatgcccgtttatctcagggcgttaccaaacgaactgcgcaaaatgaaatgtctgcactgcgtaatatcttccgcatggcaggcagggataaactggaaacttctccgcgtttgagtaatcaggcattgggattaagcggagccagtcgtgctggaacaaagcaggcaatccctgatgtaatgtttcaggctgtttatcagaaagcacttgaacgtgatgcagggtttgcagtcactctgaaacttgcccgcttaatggggctacgttctcaggaagcggtgcaatgtagtgcttcgttgaaaagctggcgaaagcagttagagcaacctgagccaaaacttcatgttgttttcggtacaaaaggtggtcggccaaggcaaactcgtgtactggatgtcgctgttgtgaaagaagctgtagagcaagcaattgccattgcagaacaacggggcggcaggttgattgataaaccggatctcaggcaggccatgaactactggcggacacataccacaaggattggtttaaagggctgccattctccccacagtttgcgttatgcgtgggcgcaagatgcgctaaatttctaccaacagaatggttttagccgtcaggaagcaagagcactggtttcaatggatttgggacatggtgatggtcgcgggcgttatgttgaacgggtttatagccaagggaagggggagtga

SEQ ID NO: 2553 - DNA, 159 bp, Xenorhabdus bovienii
  Coding DNA location: Contig name=SeqID_16870; Position on contig =234315..234473bp; Strand=+
atgctttttcaatctattaaatgcagtgtcagattcactgcgctgttaaacaggcatgagcctgtaatagtcatgttgtccttttgctgcggcgtcactttcagcgataaatccgcaaaaagtgacgccttaagcaccgcatacggtcagcaaaagtag

SEQ ID NO: 2554 - DNA, 114 bp, Xenorhabdus bovienii
  Coding DNA location: Contig name=SeqID_16870; Position on contig =234583..234696bp; Strand=-
gtgatcccatcagcctctcgcatagtgggattgagttacatcttaatctcatttcacttcaatgagcaggattgctttcgcgcgtccagttcatgcttagctatgcctgcttga

SEQ ID NO: 2555 - DNA, 111 bp, Xenorhabdus bovienii
  Coding DNA location: Contig name=SeqID_16870; Position on contig =234645..234755bp; Strand=+
atgagattaagatgtaactcaatcccactatgcgagaggctgatgggatcacctgacgctaatgtgaaaagtaagcgagcgcgtgtttcagctcacttgaagttaagataa

SEQ ID NO: 2556 - DNA, 132 bp, Xenorhabdus bovienii
  Coding DNA location: Contig name=SeqID_16870; Position on contig =234880..235011bp; Strand=+
ttgttcatactggcgatatctgcttccaaaggtgcgcagacgtaccgcaattcttactctccctttcaggctacaggagtttttctagtcgctcgaaagcgcttcctctcagacctatggaagcattggtga

SEQ ID NO: 2557 - DNA, 96 bp, Xenorhabdus bovienii
  Coding DNA location: Contig name=SeqID_16870; Position on contig =235154..235249bp; Strand=+
atggataattttgcaaatatcaggaaaaatgtaaaaatcatcatattttttgtgaaaactaagtacaattacaaaatcatctctacccccaattaa

SEQ ID NO: 2558 - DNA, 999 bp, Xenorhabdus bovienii
  Coding DNA location: Contig name=SeqID_16870; Position on contig =235354..236352bp; Strand=-
gaaattgataaatttgtatattatcaatgtgaagacggcggagctgaacttttttttattgaaagtgatgaggttgtattttcagagtggaactatcatttattcccagaagatccacattatcatcaagaatgtaattggaaacctattttatctgataggtttgataatataaatttgtacgatgaacaagtttttggttatttattatttactataaatagcgccacaactattaatgaaataaataataataatctaattagagattttgtaaaaagttactcattttttcagttttctaaaatcaacgaattccaattcctttcaaaaagggataaaaataaattaaggaatttcttttttcatttctttctgtatgcacaccctgttaactacgaaactttacatgcattttctattaaaaatgatgaaatttttcatattaaaagtggggtatctgttagaaaatattttgaggagtattatgatttttttgttaataattatgagcagtataaaaataaaataccaattacaattgatgaattacgtagttgtaagaaattaacagtttctctattagataatatcgaaggtaaatgtaatggatttgaagtacattgtgaagatagaggtagcagaataattgatagcgttaataattttgcttctctcattaatgtttaccatgaagataaagataaattttatgatgagtttaaaaaaattgtattagaatgcaatagaaaaagtattttactggacttttttttacaagattatgtttgttatgttctttattttgacatggatgagattaataattttgttgaatgtttctcaagaaatgaggcactctgcaagggattgataaataaacttttttccattcctgtttttatcaaggaaatacttgataatcagaagaaagatttattttcatatggcagagtaacgtgtttttttgatgaaaaaataattaatatttatagctag

SEQ ID NO: 2559 - DNA, 594 bp, Xenorhabdus bovienii
  unsure (1)..(594): unsure at all n locations
  Coding DNA location: Contig name=SeqID_16871; Position on contig =347..940bp; Strand=-
tacctnnnnnnnnnnnnnnnnnnnnnnnnnnnnnnnnnnnnnntatatgatggagttaaaggtaaacgcaaaacaaaatcccttctgaataatgaacattcagcctgtatgttaatagcgtggttagctaaatatattcctgccctgcaacaagtcaatatcgttatggaagccaccggagtctatcatgaacggttggcttattcccttcatcaggctgggggaaggattgcaatagccaaccctttacgcgtgcgtgattttgctaaaggtatggggatactgactaaaacagacaaagtagatgcctatattttagcctgttacagtgccttaaaacaacccgatgtctggcaacctcctcctatagaaattcgcgaattgaaggctctcctatgccgtcgggatgcgttattagaagatatccagcgtgaacgtaaccgatatgaaaaaagcggctcaacccataccccaaaaagggttattgagtccatagaggcaatgatgcatcacatgaaaaatgagttagccgagcttgaggctcttattgccgagcatataaaccagcaccctaatttaaaaaaagatttttga

SEQ ID NO: 2560 - DNA, 378 bp, Xenorhabdus bovienii
  unsure (1)..(378): unsure at all n locations
  Coding DNA location: Contig name=SeqID_16872; Position on contig =220..597bp; Strand=-
atgcatcacatgaaaaatgagctagccgagcttgaggctcttattgccgagcatataaaccagcaccctaatttaaaaaaagattttgaacttttaacctcaataaagggggatggaactcagattggacttaacatgctgattatcttacgtacgaatacctttactcgtgcaacgcaagtcgctgcatatcttggcgttattcctattgcaaagcagtcaggtacatccgagcatggccgagtgcgcttatctataacgctgactgctaagatccgcgctaagatgtttatgtctgcactcactgcagctcgttttaacccccacataaatgatctatataatcgattgcgtaataaaggcaaggctanaatgtag

SEQ ID NO: 2561 - DNA, 198 bp, Xenorhabdus bovienii
  Coding DNA location: Contig name=SeqID_16872; Position on contig =653..850bp; Strand=-
gtgcgtgattttgctaaaggtatggggatactgactaaaacagacgaagtagatgcctatattttagcctgttacagtgccttaaaacaacccgatgtctggcaacctcctcctatagaaattcgcgaattgaaggctctcctatgccgccgggatgcgttattagaagatatccagcgtgaacgtagaccgatatga

SEQ ID NO: 2562 - DNA, 96 bp, Xenorhabdus bovienii
  Coding DNA location: Contig name=SeqID_16873; Position on contig =1860..1955bp; Strand=+
ttgactcctggccctttccagggttacccggtgcggatgcagcggtgtttctgccttgaaacggcgggcggggaaacggtctgtccagtcgtctga

SEQ ID NO: 2563 - DNA, 138 bp, Xenorhabdus bovienii
  Coding DNA location: Contig name=SeqID_16873; Position on contig =2065..2202bp; Strand=-
gtgtcttcgggtgtgcgttttgagagactcaccagtcctgtcattgacagcactgattgtttcaaattttcagcttgttccagattgttaaagagcaaaaatttcacaacacacgggcgtgttccccatgggttctga

SEQ ID NO: 2564 - DNA, 135 bp, Xenorhabdus bovienii
  Coding DNA location: Contig name=SeqID_16873; Position on contig =2247..2381bp; Strand=-
atgaattcaggccaggatagtgcaacggattgcactgggtttccccattcgggtatcgtcggttataatgcttcatatcagcttaccgacgcttatcgcagattagcacgcccttcatcgcctctgactgcctag

SEQ ID NO: 2565 - DNA, 96 bp, Xenorhabdus bovienii
  Coding DNA location: Contig name=SeqID_16873; Position on contig =5169..5264bp; Strand=+
atgaaagacagcagcttgttcgggattgaaaacagaatttgtctggcggccatagcgcggtggtcccacctgatcccatgccgaactcagcagtga

SEQ ID NO: 2566 - DNA, 129 bp, Xenorhabdus bovienii
  Coding DNA location: Contig name=SeqID_16873; Position on contig =5207..5335bp; Strand=+
ttgtctggcggccatagcgcggtggtcccacctgatcccatgccgaactcagcagtgaaacgccgtagcgccgatggtagtgtggggtctccccatgtgagagtagggcactgccagacacctatttag

SEQ ID NO: 2567 - DNA, 354 bp, Xenorhabdus bovienii
  Coding DNA location: Contig name=SeqID_16873; Position on contig =5387..5740bp; Strand=-
atgataaaacccgtcataaatataataaaaaatgtattggtaatctttcctctcctatttacaaccgcgtgttccaatatgtatcaggccaacgatatttggacaggtaaagataaagctcaacattttctattttctgcagctatggcggctgcgggtaatgcttatggggaacgtcaaaattggacacatcgggaaagtgcacagtttggcctactcctgtctattagctttggtgcagcgaaagaattttatgatagtcgtccaccaggaacaggctggagttggcaggattttgtttatgatgtcgccggagcaatggctggctatagtttgtatcagtctttgaaatga

SEQ ID NO: 2568 - DNA, 123 bp, Xenorhabdus bovienii
  Coding DNA location: Contig name=SeqID_16873; Position on contig =5724..5846bp; Strand=+
atgacgggttttatcattgtgatttacgccatgatgtatatttctgtaaatcatagcttgttgataaataagatacaaaaaatcccctctagcgatagcgagaagggattgatgaaccgataa

SEQ ID NO: 2569 - DNA, 1356 bp, Xenorhabdus bovienii
  Coding DNA location: Contig name=SeqID_16873; Position on contig =5860..7215bp; Strand=-
atgttgtctaaatttaaacgagcaaaacaccaacaacaccttgcacaactgcctaaattaccgcagtcagttgctgacattaagacactttatcaatcaaaagtgttccgcagcaccttactggaacacattgcgaacgctgaaaaatatatttatatcgccgccttatatttagaaaatgacgacgcagggcgagatattatgaatgctctgtatgtcgccaaacaaaaacgccctgagctggatatcaaaattctcgttgactggcatcgtgctcaacgtggccgtatcggcgtagaagcagcggcaacaaatgcagattggtattgttccatggccgaaagctacccagatgccaacatttccgttctaggcgttccggtgaatacccgcgaagcactgggggttttgcatctaaaaggctttatctttgatgatacggtaatttatagcggtgccagtattaatgatgtctatctgcatcgccatgaaaaatatcgttatgaccgttaccatttgctgcataatgcaaaactcgccgctattatgaagcaatttattgatgataatattcttaccgccggtgccgtaaaaaatttagccagtcacagtcgccctcgtagtcttgaaattaaaaatttgattcgacagtttcgtgcttcattacgcagtgttgaatacagcattgagaatcaggcttcaaatgaggaattggcagtcacacctcttgtcggattaggtaaaaagaatctgctgaataaaacgatatgccacctgatctccagtactgaaaataaattggtcatctgcacaccttatttcaatttaccggcggttctggtgcgcgcaatatcacgattgctccgacaaggaaaacaggttgagattatcattggagacaaaacagccaatgatttttacattccaccggaagaaccatttaggatcatcggggcattaccttatctgtatgaaattaatctacgtcgttttactagccggctgcaatactttatcgatagccagcaattaaccattcggctatggaaagatgcagataatacttatcacttaaaagggatctgggttgataacaaatggcaattaattaccggcaataatctcaatccacgagcatggggactagatctagagaatgctattctcattcacgacccttatcaggaaatgcaagaacaacgcacgttagagctggactgcattcgtactcatacaaaaattatcaatgattatcaggagctggaaagtatacagctctatccggtcaaggttcgcaaactgatacgccgtttacgccgcatccgagtcgaccgattaattagccgcatactgtaa

SEQ ID NO: 2570 - DNA, 96 bp, Xenorhabdus bovienii
  Coding DNA location: Contig name=SeqID_16873; Position on contig =7177..7272bp; Strand=+
gtgttgttggtgttttgctcgtttaaatttagacaacatcacagtgcgttttttctcttagtttggatggtgggagttccatcatcaggtgtatga

SEQ ID NO: 2571 - DNA, 2643 bp, Xenorhabdus bovienii
  Coding DNA location: Contig name=SeqID_16873; Position on contig =7381..10023bp; Strand=-
atgagtcagcgcggactggaagcattattacacccaaaatccatcgcagtgattggtgcttctgaaaaaccagagaaagctagctccatgttgatgcggaatctgctaatggggcattttactggcccaattcttcctgtaacgccgaataaaacagctattctcggagtactggcttatccctctattgataaattaccactgacgccggatttagccgtgatatgcactcatcacagccgtaacctatctttgctggaacaattggcgcaacgaggatgcaaaacggttattattctctcctcaccgccttcacagtttgccgaactgaaacagttcagccaaaaacatcacatccgcatgctgggacctaacagcctcggtattctggctccatggatcgggctgaatgccagtttttcccctattcctatcctcaagggcaaactggctttcatctcacagtcagcagcaatatccaataccattctggattgggccaaccaccgtaatattggtttttcctatttcattgcattgggagacagtgttgatatcgatattgacgatctcctcgattttctggcgcgagacagcaaaaccagtgcgattctgctacaccttgaacatatcagtgatgcccgtcgttttctgtcagcctcacgcagcgcttcgcgcaataagcccattctggttgtaaaaagcagccgcacccgcaaagctcaggaattattgggagaacaacagaatttcgatgcggcttatgacgctgcgattcaacgtgctggattgttgcgggtacaggatacgcatgaaatgttttctgcggtggaaacattaagttttatgcggccactgcgcggggaacgcctattgatcgtcagtaacggttcagcacctgcggctatggcgctggatgagctactcaggagaaccggcaaacttgcagtgttaggagacgaaactagcaataaattgtctgctattctccccgataccctgatcctgcgtaaccctctggatctcggtgatgattcttcatccgaacaatatattgccgcacttaaactcctgctcgatagccatgattatgatgctttgttgttaatccattcaccctgcgccatctcccatagtatgaatactgcaatcaaagtcattcagattattaaggaacatccacgcgggaagtggctgacaatctttaccaattggtgcggggagtattcttctctggaagcgaggcgtttattcagtgaagcgggtattcccacctaccgcacaccagaaggtgcgatcacggctttcatgcatatggtggaatatcagcgcaaccaaaagcaactcaaggaaacccccgctatgccaatcggcattacatcaaatactgcacgcgctcatgagtgtatccagcaagcccttaatagcggaaatacgctattagatacccacgaagtgcagcctattcttgaagcctacggcttaaataccttaccgacatggatcgcatataccagcgatgatgcagtcaatatcgccgaaaagattggctatccggtcgcattgaaactacgttcccccgatatttcccataaatcagaagttcagggggtaatgctctatctgcgcaattctgatgaggtaaaaacctcagcacaagcgattattgaccgcgttaaacagaacttcccccaggccagaattcatggcttattggtgcagagcatggctaaccgtgctggcgctcaagaactgagggtagccattgagcaagatgagatattcggccccttaatcatgcttggagaagggggtatcgattggattaatgaaacgcagactgctgtcgccctgcctcccctgaatatggcgctggcccgttatttggtgattcaagcgattaagggcggcaaaataaaatccgggggctcgctgctgccactggatattcctgcactcagtcaattattggtcagagtatccaatcttctgattgactgcccacagatctctcgtatgaacattcatccactgctggcatcaggtagtgaattcactttattggatgtcgcaatggaattaacgccagtaacaggtgatcctcacaataaactcgcgatccgaccttatcccaatgaattggaagaaactatttatctcaaaaaagattttgaatgtctgctgcgcccaatcctgccggaagacgaacccctgttgaagacatttattagtcaggtaacaaaagaagatctctattaccgctatttcagtgagatcagcgaattcacccatgatgatctcgccaatatgactcaaattgattatgaccgtgaaatggcattcgtcgcaattcgtcatgcagcaactacaccagaaattattggtgtcgcccgagcgatggccgatcccgataatatcgaagcagaatttgctgtattaattcgatcagatttgaagggtattacgttaggctatcagctcatgactaaattgatccattatacaagaggccatggtatccagatgctgaccgccattaccatgccagaaaaccgtaatatgattcaacttgcgaagaaactgggatttactattgatattcaattagaagacggcgttgtcaatcttgtactaagactttaa

SEQ ID NO: 2572 - DNA, 102 bp, Xenorhabdus bovienii
  Coding DNA location: Contig name=SeqID_16873; Position on contig =9987..10088bp; Strand=+
ttgggtgtaataatgcttccagtccgcgctgactcatttctgggattcctcattagttatcacatcaataaacaatcacccttgattaaacaattactatga

SEQ ID NO: 2573 - DNA, 708 bp, Xenorhabdus bovienii
  Coding DNA location: Contig name=SeqID_16873; Position on contig =10114..10821bp; Strand=-
atgagaaataacaacaccgtttatcaacttcgccaacagcgtctagcccgctctacccgtccctttcaggcaaggggctgccgagtgcagcgttgcctgcattgtttattaccccaaaaaagctgcctgtgtgaaacaatttcaccagtaaacgcgactagccgcttctgtctcatcatgtttgatactgagccaatgaagcccagcaatacgggaaagttgattgccgatattctgcccgatacacacgcttttctctggtcaagaaccgagcctgatcaacgaatgcttgaagcgctgcgcgacccaactcgacagccctatttgatcttccctgagagttatgccacacctccccgtactgtatatcagcaactccctgataaccagaaagcgccgctattcattatattggatggcacttggccagaagcaaggaaaatgtttcgaaaaagcccatatttggacgatatccccctattatctatcaataattgcgccaaaatggattatttactgcggataccatccagaaaagaacagcattgtactgccgaagtcgcagcagctgcacttgagctggctaatgaccttgaggcatcacaaacactactcagccatttcaatcattttcgtgaacaatatctggctgggaaacctcatcgtcaagaggagtcaatcacagtaattcttgacaatccccgctaa

SEQ ID NO: 2574 - DNA, 126 bp, Xenorhabdus bovienii
  Coding DNA location: Contig name=SeqID_16873; Position on contig =10811..10936bp; Strand=-
atggcgcgcagattacccgatgtacgcgcccgaagctacctctggcaacgacaatccattaaaatacccgctaattttttatcggctttattcacaaacatgtttgagttcctaaatgagaaataa

SEQ ID NO: 2575 - DNA, 1023 bp, Xenorhabdus bovienii
  Coding DNA location: Contig name=SeqID_16873; Position on contig =10956..11978bp; Strand=+
atgaacgattcctatagtggtaagaatggcaaagtcaaagtgatgtatgtccgtagtgagggcaacaatgaccgccgcagcaacaatgacagtcgtaataacaataaacgcccgtcgtctggtcagggacgcgatcagggggggcgccgtcgtgataatgaacgtccagcgtattcaggtgatcgttctccttggaaaacagtctcccgcccggtagaagaatccttgacgcctgatcatggcggtatcagcggtaaaagccagattgatcctgaacagcttcgccgtcagcggctggaagagactcggatctatggtgaaaatgcctgtcaggcgatgttccagaaccgtccagaagccattgtccgagcttggtttgtccaatcagtgacacctcgttttcgtgatgctttgaaatggatggcggcaaatcgcaaggcttaccatgtggttgatgatgaagagttagttaaggcatcaggcactgagcatcatggtggcgtatgcttcctgattaaaaagcgtaatgggctggatgtagaaacttatttgcagcaagcaccagcaaaagactgtgttctggcattggaaaatgtgggcaatccgcacaaccttggggcaattatgcgcagttgcgctcattttggcgtgcagggcgtgatattacaggatgtggcgatgctggaatcgggtgcggctgttcgtactgctgaaggtggggcggagcacatcaaaggtattgatgctgatggtttcacaacgacgttgaaccaattccgctgtgcaggttataccattgtgaccacctcaagccataagggaagcacaacgctagccaaagcggatcttccggaaaaaatggttttggtcttgggtcaggaaagtgatggtttgagtgacagtacctgggaagatggtgatatccgtctctcgattggtggcacgggtcgagtagaaagcctgaacgtttctgtcgcaacaggtattatgctggcggaatggtggcgccagaataaagcctga

SEQ ID NO: 2576 - DNA, 117 bp, Xenorhabdus bovienii
  Coding DNA location: Contig name=SeqID_16873; Position on contig =12298..12414bp; Strand=-
atgactgacagggtagatacacctatatataaactttggatattgctatccagctctgggggggtgaattctagctcactaaaattacgatctttctattttttcttgcatggatga

SEQ ID NO: 2577 - DNA, 102 bp, Xenorhabdus bovienii
  Coding DNA location: Contig name=SeqID_16873; Position on contig =12407..12508bp; Strand=-
atgcgaggtttgaggactcaatttagtgtacaacggactcatttaataaaacccttcattcatatccagcatcatcccgtttccatgcataaacatgactga

SEQ ID NO: 2578 - DNA, 1821 bp, Xenorhabdus bovienii
  Coding DNA location: Contig name=SeqID_16873; Position on contig =12467..14287bp; Strand=+
atgagtccgttgtacactaaattgagtcctcaaacctcgcatttaactagagaaagctggttacatgccaacaggcatcttatagcaaaaatattgcgtgaacttttgcatgagaaattaatctttccggtaaatcagagcacggataaatcttattcgattaaaattgatcaatttcaataccatttcaaggcacaatcctaccaacttgaccatctggatattgatgttgcgtcaataacgaaattcagtcataaccaaccgcagcctcttgatgccattcaactgattattgagttgcatccactgttggatatttctgagaagatgctgcctatttatcttgatgaaatatccagcacgctttatggctacgcttttaaatatcaaaataatcggctgaccgcacagaacttggctcaagctgattatcaggctgtggaaacagcgatgactgaagggcatcctgtctttattgctaataacggccgtattggttttgatgctgatgattatttacactatgcaccagaaagcgcaaatccagtgacattaatttggattgccgtgcatcggaataaaaccgttttttctgcattatcttcgctctcttattcacagctggtggcagaagaactggaaaaatatttgccagcccgttttgaacaacacatgcagacattgggattaaatctgtcagattattacctgatgcctgtgcatccttggcaatggctgcaccgtattgccatcagttttgcggcagatattgccaaccaagaaattgtttatcttggtgaaggccatgatcgctaccttgcccagcaatctattcgcacatttttcaatatcagccagcccaagaaaaattatgtgaaaacggcgctgtcagtcctcaatatggggtttatgcgtgggttggacccgcatagcatggtgacgacaccgcaaattaatgagtggctcaatcatttagtagaatccgatgttttctttcaggaaaaagggttcaccatattgcgggaacgtgcagcaataggctatttcaatcattactttgaagcagcaattaaaaaagataatccgcataaaaaaatgttgtcagcgttatggcgtgaaagcccaatgacgattctgaaagaaactcagcgtctgatgaccatggcttcattgttacatgttgatagagaaggtgatgcggtcgttgctgccttggttaaggattcaggtttatcggcggaagcgtgggtaacgcgttatcttgatgcctatttttctccactgctacattctttcttcacttatgatctggtctttatgccacatggcgaaaacctgatgctggtattggaaaacaatgtaccggtaaaaatgttaatgaaagatattggtgaagaaattgcaattttgaatggagatatccaactccctgaagagattgatttcctgcatgtcaccatcaaggatgaaatgaaaattaattatattttccttgatatctttgactgtttcttccgctatctgacccctttgttgcaaaaacatcttgcattgccagaagcgcgcttttgggagttagtggctcagtgtgtttacaactaccagtcacaacatctgaatcagatagaaaaattccgcaaatttgatctgtttaagcatgattttgtgcgtacttgcttgaatcgcctgcaaatggcgaataaccagcagatgattgatctcgatgatcgtgaaaagaacctgaaatttgccggaactttagttaatccacttcacgccctacgcgaaaaatacgctgtcactgttgagacagataactga

SEQ ID NO: 2579 - DNA, 2313 bp, Xenorhabdus bovienii
  Coding DNA location: Contig name=SeqID_16873; Position on contig =14271..16583bp; Strand=+
ttgagacagataactgatgggtacgtcaaagtaaaaataataacaaatcaatttggtaatgggataagtagagtgataaatccaattttgcaaccgaatcatttgaccaagaaaaaagtgctttctctcatgatcccgctgattttggcgggaaatagcacggctatggcagaagaaacacagagtaaaaacgataaaattatcgtaacggcaggagcgccagggcatgaaggtgtaacggaagacactggaatgtacaacacctcctcaatggtgaccgcgacaggtttgaatatgtctgcccgtgaaacaccacaaagtgttagcgtaatgaccaaacagcggatggtggatgaaaatctgagcagtgttgagagcgctattggtagtattaccggtatgactgtccgccaggctgacagtgatcgttttactttcacttcaagaggtatgacggtcaaagacatgctacgtgatggcgtgccgactttttatgatatccgttttaattatggtgataacctgatggataccaccatttttgatcgccttgaagtggtgcgtggagcggctggcctaatggtggggccaggcacaccttcagcagcggttaacgtgatccgtaaacgtccaacccaagatttccgaggtgaaatgacgctgggcggtggttcttgggataaatggcggactggccttgatctgtctggcccattaaatgaagacgggacagtcagagggcgttttgtcaccgcttatcaacgttccaattcttttattgatcgtgacaaacatgagaagtatcccttctatggcattcttgaagcggatctgacagaaaatactttgctgaccgtcggtgcggattatcagattaaccatacccgtggcggtatgtttggtggtttgcctatttattttaaagatggcagtaaaaccgattacaaacgcagtgacagttatgcgcctgattgggcgttttctaaagtccgctcattctctacctttaccagtttgcaacaccaatttgataatggctggagtgtgaaaggaacctttacttatgatcacggtactcttgaccaaaaagtattgtgggcaacgggttttcctgatcgggtgactaatgagggaatgtatccgggcaacatgacgctgattgatggaactcgtcgccagcgtaatttcgatttgcaggtaaacggtgactatagattgcttgggcgtacccatcatgccagctttggtctgaattatcagaaacagaatttccagaatgattactattacgccacctgtatgcgtgagggaaattctaataaagaagatcaagataaaacagggaaaagaaataactgtaattacctaggggattttactcaatcttcatggggttatgctgaaccaacgtggggtaaaaacagaacaactggctctgatggttataacgagcaaactgcgggatatgccgttacccaaatctcactggctgatcctgtaacattgattcttggtgggcgagtcaccagttggaaaactcgtggtgataatttcggtatgccacaaaatgccagctacagtgatgaatttgtaccgtatggtgggttggtttataacattacgccagacttctccgtttatggcagttataccaaaatttttgatccagaaagtcgaattaaccgtaatggccaactccttaaaccagtcacaggtgaaaactatgaactgggtctgaagggtgttgctctggataacggtcttgattactcattggcaatttttgatatccgtcaggataattttacggaatgggatagtactgctccacgacgtccagataacatcagaacttattatgtgctcaatggggtaaaaacccgtggtttcgaagctgaagttagtggtcaaattaccgatgattggcggatttatgcgggttacacccaattccgagcgactgatccaaagggtaaacgtatcaatacggataacccaagtcggttattcaaactgttcacaacttatactttaccgggtgtcatgagcgatttaacgcttggtggaggtgtcaactggcaggacaaaacgtggttggagcttgatacacctactggtaaacgccaagatgagcaaggtagctttgccacggttaacctgatgggacgttatcaatttacaccggatctctccctgagcgtgaacttgaaaaacctttttgacaagaagtactacacctcgttcggtggctatacccagtactactacggcgcaccacgtaatgtcgaagcaacattgagttataaattctaa

SEQ ID NO: 2580 - DNA, 1029 bp, Xenorhabdus bovienii
  Coding DNA location: Contig name=SeqID_16873; Position on contig =16654..17682bp; Strand=+
atggtattaacacgttgcaaaatgctggtcgccgtgccgttgatattgctggtaagtttgctggtaggctgtgataagccagcggtctcaaaaaatttaccgacggatgccgttggttatcctaaaacgatcgccaccgcgctgggaacggcggtaataaaccaatcgccgcaaaggattgtagcgttgggaacgggcagcgaagatatcttgctggatctgggaatcattccgattgggattgaatctcatcgctggggcggagacgctgaaggctatttgccctggtttagggacgagatagaacggcgtggcgaaaaactgccagctattatcgagatgtaccctgaactggatatcgaaaaaattatcagtctgaagccggatttgattttggcaatgcaatcgggcatcacgcaggaacagtatgatcatctgtcccattttgttcccgtgattgcttatccggaaaaaccgtggcagacgacaccacagcagcagatagcgctggtagctcatgcattggataaaatacaactgggagaaaaactcagtgccgaactggatacaatgctgtcacaggcaggcagcacggttcctaatgtagggcgttatcgctttgcttatattaaggcgggaacgacagggaacattttatcgatctatgtcaaaaatgatccacgcgttgatacgatggtacatcttggcctgtctttgctcccgttggctgacaccttaactgcgccttttggtagtttttcagccaatatcggtttggaaaacgccgacttgctcaatggtgcggatattctggtgacttggtattccagcgaaaaagagcgtcaggatacggaatcacagcctctgtttagttctatccgcgctgttcgccaagggggatatattccgttgactgatcagtcaatcgtaatgtccatgtcctatggctcaccactcagtctgcgttgggggttgtcaaggtttatgccgttgctgaagcaggagatagcaaaacataatgaacgctaa

SEQ ID NO: 2581 - DNA, 1008 bp, Xenorhabdus bovienii
  Coding DNA location: Contig name=SeqID_16873; Position on contig =17672..18679bp; Strand=+
atgaacgctaaacggcgaactgccctcatattgggtttagtattaatggcattgctaacctgtctttgcattgttgccagcttgagtttgggttcaaaatcattgccgctgtcagcgatctggcagcattattggttgggagatcaaggcagttattacgatttggtcattaatgcccgtgaacctcgcaccctgattggtttaatggcgggagcggcactggcgcttgcgggaacagtaacccaagggctgttacgcaatccgctgggtgatcccggtctgctcggtatcaatgcaggtgcggcaactgccgtagtctgcttttcttttattcctgctctggacatactgccgcgtttttggaccgcttttattggtgcaagtctgtcaacattgctgttctatttgttgagtggagggcctcgcaatacaaactctgtacgtttggttttgacgggagcggctatccatgcctgcctgtttgcgttggtgcaaggtatcgttctgataaatgcacaggccatggacaactatcgtttctggacaattggttctttaagtgcaatgtcgttgaacgaagccagtttgttgatcccttatttgctggtggctgtggtcgtgacactttcgctcagtgcttctctgaatgtgatggtctttggtgaagggattgccagttctctgggggcgaatgttgcccgtacccgcatattatcgctggtgatggttaccatgctggcagccacagcgacggcaatggccggcccaatctcatttattggtctggccgcaccgcacttaatgcgtgcactggtaggcagtgattttcgttggttgttaccttactgcctgttcgctggcccctgtctgctgcttatctcagatgtcgtggcccggttgctgattgcgccacaagagatcatggtgggtattattacggctggcatgggtgctccgttgctttatctggtcgctaaaaatcgttcacagaaaataatggcagagtag

SEQ ID NO: 2582 - DNA, 1047 bp, Xenorhabdus bovienii
  Coding DNA location: Contig name=SeqID_16873; Position on contig =18683..19729bp; Strand=+
atggcgcagataaatttcacggcagggcagccaaaaatcaaaatcttcacgttgggcaatgccgtctttattgcaccttcatcgcatacgagcagagtgactctgtcaatgttgctgctgcttgtggtgctcttttatctggctttgtcgttaggccgagaaggcatggataatccttttctggcgatggagacgccttatcaggaatttatcctgttgcagatccgcttacccagagcgctggtggcaataggtgcaggtatgacgctggcactgtccggttccctttttcagttgacgacccgcaatgcacttggtagcccggatatcattggcattaatgcaggagcggctgtcggtatcatggttgcattgcttttctggccaagtatattgccggttcctttgggggcgttattgggtgcctgtcttgctgtattgctggtttatatcggcaatggttcgggtgttggcaacatgcaggctaacaaaatagtgatttcggggattgccgttgccacattttgcatggcatttgtcgattttgctatctcgagtattcgtattgagcaggctcagcagatcagctcgctattgcgtggcagccttgccagccgacgctggcaggatgtcgggcttatcagtggcatggtgattttcattccctttttgtgttggctgggcaggcaattgaactatacccattttggtgatgatattgctaatacccttggtgtacctgtccgtttcatccagattgtcagcatactactggccgtaacctttgccacaatgtcggtattagtcgtggggcctgtcgcttttattgcgctgtctgcaccacaaattgcccgacggttggtacgagcgaaaggagcagcattgttttgctctgccttggtgggggctttattgatgctggcttctgatttaattaccctgatattaccaacggtagctcgcttgcctgtaggaatgattaccgcggtggttggtggtatctatttaatgtatttactgtatgccgaattaaggagaacgcgataa

SEQ ID NO: 2583 - DNA, 816 bp, Xenorhabdus bovienii
  Coding DNA location: Contig name=SeqID_16873; Position on contig =19729..20544bp; Strand=+
atgtcatcggatgctaattccccagtggttacttcacggctgaaagcccatgatctttcactggcatacggtaaaagaaccattattgagggggtgaatctcgcgattcacgatagtgaattcagtgtcattattggctctaacggatgtggaaaatcaacactgttgcgcgctatcagccgaaatatgcagccacagcgaggtgaagttcagcttgatggaatcaatatccatcgttataagccaaaggcggtggcgcgcgagctatcactgctgacgcagggcgccaccgtgacggaggcactgacaatctatgatttagttgcccgtgggcgttatgcctatcaatctttcctgcggcaatggtcagcagaagatgagcgcgtggttaatgaagcattgcaggctgtggatttagatgagatgtcgcagaaattggtcagtgaactttcaggcggtcagcgccagcgcgcttggtttgctatgacactggcacagcaaactccgatcattctgttggatgagccgaccacttatctggatattacgcaccaaattgagttactcgatttatgtcagcgtctgcacagacaaggaaaaacgctggtgttggtattgcatgatatcaatttggcgctgcgttatgcgtcacgtttgatcatgatgaaaaatggtcaaatttatgccgaaggcgtacctgaagagattgtcactgaacaaagtattgcagatgtttttggtttggaatgcagaattatctgtgaccctgagtctggcaagccattgattattcctaaatacaaaatgaataaataa

SEQ ID NO: 2584 - DNA, 768 bp, Xenorhabdus bovienii
  Coding DNA location: Contig name=SeqID_16873; Position on contig =20612..21379bp; Strand=+
atgataaataaaaataatgaaatctccaatgaatgggtatctaaaatagagattgaagatattattaaactatttgatggcgcattcagtcactttaattcatcaatgaaagtgaatgcggaaaatattccttcagatagtatggaattttatcaatggtcgaacgaaaaagaattctcattattgatgaaacgctatcaagatgcatattatggtaataatgaacagaaaccaaatcagaaagggctttattctttatgggcacaatggtattttggtttaactattcctcctatgatgctaatgttgctggaatattcccaacctatagatacagattatcatctttttcagattgaatttcatgaaagtggcaggccagatattgtgtattatcagttaacgtggctgaacgaatctttatcattattggaacgttatcattctttgcttgatcgtcatattattcctgtgtgtgagaaaatcgaatcttatcggggaataaatgggcgcttattatggaacaatattggttatgtgattcactggtacttggataatttcaagggaagaatgagcactgaacaatatgaatcgttgatacagaatcttttcttcgagcaaacgctaccagatggcagggataatccgctttatcgtacgatgattttgaaaaataatatcatacagcgtcgcagttgctgccaaagaaacaaattgccgggtgtggggaattgtcacgattgtcctcttgaatctacagcataa

SEQ ID NO: 2585 - DNA, 156 bp, Xenorhabdus bovienii
  Coding DNA location: Contig name=SeqID_16873; Position on contig =21503..21658bp; Strand=-
ttgattatctatattcaaaaaaatttgatagaaataactatctttaaaataattaaaatcccattaatgaggcgtttttcaccaacggattggcggttatttgaacctcttaagacattatatatccttattgtttatataaattatcttagataa

SEQ ID NO: 2586 - DNA, 105 bp, Xenorhabdus bovienii
  Coding DNA location: Contig name=SeqID_16873; Position on contig =21664..21768bp; Strand=-
atgaatgtagctaacatatttatgatgctaaaaataaaaggaaaatttatcttatttaatattctttttatcttgacaataacatcactggtgttttcaaaataa

SEQ ID NO: 2587 - DNA, 1320 bp, Xenorhabdus bovienii
  Coding DNA location: Contig name=SeqID_16873; Position on contig =21849..23168bp; Strand=+
atgacaactaaaacttatgattttatcgcgattggaatcggcccatttaatctgggattggcttgtctggtgcaaccgataaaagagattaccagcctgtttattgatcagaaagccggctttaactggcatcccggcatgatgcttgagagttccaccatgcaaacgccgttcatggcagatttagtgacattggcatctcctacccatcctttgagctttctcaattatattaaacagaaaggccgtatttactcgttctatattcgggaaagttttttcctgatgcgcaaagagtataaccaatattgtcagtgggcggcggagcaactatctaatttgcgttttaatacgcgggttgagaatatcagttatgacgcctctacttcactttataccttgcattgcgctgatactctgactgggcaaaaacaccaatttttctgcaaaaaattggtgttgggaaccgggccttcgtcctatattccaaaatgttgcagaccgtttgctgatcatatggtgacatcgggagattatttagaaaataaggccgccttacagcagaagaaatcgattactgttctgggaagtggccaaagtgcagcggagattttctacgatctgcttgaggatattgatgcccatggttatcaactcaattgggtaactcgttccccacgttttttccctctcgaatataccaagctaacgttggaaatgacttcaccagaatatgtggattacttctatagcttgccagagaacaaacgtgaagcattgaatcgttcgcaacagccactttataaaggaattaacagttcgcttatcaatgaaattttcgacttgatgtataccaagcgattgagtggggaattagatgtttcgttgtataccaacagcgaattgcgacaagtacatttcatagcagaaagacaaggcgtcgcagaagaacagaaattgatactggatttattccagcatgaacaggaagcggcattttctttggaaacagagggattggtgctcgccacgggttatcaataccagatcccaagttttatggagggtatccagcatcttatccgctgggataagcaggggcgttatgatgttcagcgtaattacagcatcgattgtagaaacgaaatttttgtacagaacgtcgagcttcatactcatggttttgtgacgccggatttgggcatggccagttaccgtaactctcgcttgattcaggaaattactggaacggaacattatgtgatagagaaaagtattgcgtttcaacagtttggtgttgcgagtgaaggagtattctga

SEQ ID NO: 2588 - DNA, 2409 bp, Xenorhabdus bovienii
  Coding DNA location: Contig name=SeqID_16873; Position on contig =23168..25576bp; Strand=+
atgtctgccgttgctactgtttcatttgaaaaaacgctgcctgatttgggcaccttttcattgcgtccactgaatctgacagaggatattgttgctattaccgattgggttaatcaggaatatgcctattattgggggatgcaaagccataccgaacaacaggtaaaaaccttttatcaagatctgttgaatcgccagcctgattctgtctttatcggaatttaccaagaacagccagtatttttgctggagtgttattgggcgcaggatgatcaaataggaaaatactatccagcccgtccgggtgacatgggaatgcatattctggttgcgccatctgaacagaaaatcagtcaattcacatggggaattttccagacaattatcgcgtttatttttaaaaatcctgctgtgaacagaattgtcgtcgagccggatatacgaaatgaaaaaatccatcggctcaacttgcgggctggctttgtttacgacaaaactgtgcagttatcccacaaaactgcagggttggcattttgtactcgggagcaacatcaaatggcattacaatcagcgaaattagcagtaccttctaaccagactcattatcttgtcagccatttacatcccgccatttggcagaaggttaatcggctgcatttgaggaaagccatttctgaattttcccatgaatgtttactgttccctgaacaattgacagaaaaagcagatcaagacggttatcaccactatcgtttggataatcctgagtactcagttaattatcatttcagagcgcgccgattggctttagatcactggttgattgatgttgattcgttgcgaaaaatgcaggcaggtgactggtgcgagctggactttatcagctttatcattgaattcaaacaacagcttggtatcagtgatacagtgatgccgacttacctggaagaactgacgagcacattgcatagcagtgcattcaaatatcaccgaaacggtattgatgtagaagagctggtcaatgctgattttcagacaatcgaagctgaaatgatggaagggcatccgatcttcgtcgctaacaatgggcgtatcggctttgatgcggaagatttccagaaatttagtcctgagtcagcttctgacatacgtttggtatggttggcggcgcataaaagtaaagctcactttgcctgcattgaacaactcagttaccaacaattgatggaacaggaactgggggaagcggaaatagccaagtttaatcatcaactgatccttcttgggcttaatccagaagaatatctgctgatgccattccatccgtggcagtggcaaaataaactgccatccgtatttgcgcacgaccttgccaaccgaaaactggtctatttggggcaaggaacggatgtatatcaggctcaacaatcgatacgaaccctgttcaatcgcagccatccacagcggtattacgtaaaagtagcattatccatcctcaacatgggatttatgcgtgggttgtcaccttattatatggcaacaacgccaggcattaatgactggctgtttgatttggtacaaaaggacgctgttttacagagctacggttttcggttgttgagggaagttgcgagcatcggttttagaaacagttattatgagcaggccattcatggtgatacgccttataagaaaatgatggcgatgctgtggagggaaaatcctctgccattgattgaaccaaatcagaagctgatgacaatggctgcattattacatcatgatcagcaggggaaagccttcctgccagccttgatatctgcatcaggtctgccgactcaggaatggatacgtcgttatctggattgctatctgtcaccattactgcactgtttgtatgcttacgatttgatgtttatgccacatggtgaaaatatcattatggtgctggagaatcatattccgcaatacatcttcatgaaagatctggcagaagaaattctggtcgtgaaccccgatgcggatttgccagaaaaggccagccgagtgaaagtcagtatgccggaagagatgaaaacattgaccattttatctgatgtgttcgatggtgtgttccgctatttatcggcaattcttgatgagcagggcggatattcgcaagaacaattctggcagactgtggcggattgcattctggattaccaatctcattatccagaatttagtaaacaatttgtgcgttatgaactgtttacgccagaaataaaacgctgctgcttgaacagattgcaaattaccaataatcgacaaatgctggatttatctgatcccgcactgagttttaagttttctgataatctgactaatccaattgccccgtttgttaagaatattgtaaatgttgtttaa

SEQ ID NO: 2589 - DNA, 117 bp, Xenorhabdus bovienii
  Coding DNA location: Contig name=SeqID_16873; Position on contig =25759..25875bp; Strand=+
gtggctaggtttaataatatatttattatattaaaatatacgccaattcatctaatatataatgaaatgattttattaaaatactattttattatgatgtcattttatgataaataa

SEQ ID NO: 2590 - DNA, 132 bp, Xenorhabdus bovienii
  Coding DNA location: Contig name=SeqID_16873; Position on contig =25850..25981bp; Strand=-
ttgcataataactccaactgttggggcagaactgttcttagcagcgattttgaagcattcttactgatgtgtccacccgatggttataaaaattctgttcatttaattatttatcataaaatgacatcataa

SEQ ID NO: 2591 - DNA, 648 bp, Xenorhabdus bovienii
  Coding DNA location: Contig name=SeqID_16873; Position on contig =25976..26623bp; Strand=+
atgcaagggcttgaattatatgaagagaaaatcgaacgtgaccaatttcgtggagaaattattaaaaacagtaagtttttaaattgcgacttttcgagtagcgatttgagagatacccagtttatcgattgccagttttatgagccaacaaattatctgggctgtaatttcaaacacgccatgctgaaagaggccagtttcaaaaactgtgatttgtccatggcagacttcaggtatattaatgcccttggtatagagattcgcgggtgcaggcttcaaggagccgattttcggggcgccagttttatgaatagggtgagtgccaacatccagttctgctctgcttatatcactaaaagtaacttaagctacacaaactttgcggatgttattcttgaaaaatgtgaattatgggaaaaccgctggcatgaaacccatattttgggagcgaggttcagtggttccgatctttccggtggtgaatttatctcttttgactggaatgcggccgactttacttattgtgatctgaccaattctacactgggtgagcttgatattcggaaagttgatttgaaaggcgttaaattagagtcttatcaagtcgcagaactgttagaacgaattggtattgtggtaatggcttaa

SEQ ID NO: 2592 - DNA, 1542 bp, Xenorhabdus bovienii
  Coding DNA location: Contig name=SeqID_16873; Position on contig =26734..28275bp; Strand=-
atggtgacacgagaaccacttacaggcgctaaactggcgctgctgaccatttcccttgcaatggctactttcatgttggttctggactccactattgccaatgtcgccataccgacgattgcgggcaatctgggggcatcaaactcacagggaacatgggtcattacctcctttggtgtcgcaaatgcaatatccattcctattactggctggttggcaaagcgcattggcgaggtcaagctgttcatttggtctaccgcactctttactttctcctcatggctatgtggtatctccaacagtttggaagtactgattttatttcgcgttatccaaggagtggtcgcagggccgataattccactttgtcaaagcctgttattgaataattaccctcctgccaaacgaaacatggcactggcactctggtccgtggtgatcgttgttgcgccgatttgtggcccgattctggggggatatatcagtgataactaccactggggatggattttctttattaacattccccttggcatcgccattatctttgtcgcaagacaaacactgcggaatagagaaactaaaacagaaatccacgccatagatactgtcgggttagtgctgttggtccttgggattggttgtctgcaagtcatgcttgaccaaggaaaagaacttgattggttcaactccactgaaattattgtccttaccgtgatcgccgttatttcattaaccattctaattgtctgggaactcactgacgatcatcccattatcgatctatcactgtttaaagagcgtaatttcaccattggtacactatgcctcagccttgccttcatgttttactttggcacgatagtcttgctgccgcagctattacaggaagtcttcggttataccgcgacatgggcaggtttagctgccgcaccaatcggattgatgcctttactgctctcaccgctcattggaaagtatggccataagatcgacatgcgttatatcgtgacagtcagtttcattatttacactgtttgtttctattggcgggcgtatacatttgagccaggcatgaattttgccgctgttgcatggcctcaattttttcagggatttgccatggcttgcttcttcatgcctctgaccacgatcactttgtcaggtttaccaccggaacgcatggcgtcagcttccagcctgtccaactttatccgcatattgtcaggttcaatcggagcctccattacaactacgatatggacacaacgtgaagctatgcatcactcctactttacagagcatatcaatccgtatgatccgaattatcagcaaacatatcagcagttgacacagttgggcatgaatgaccagcaaatttcagcttatctggcaaagcagatcactcatcaagggttaattatctctgccaatgaaattttttggcttgcggcgggaatatttttggttttggtgctactggtatggatggcaaaacccccatttagcgcaggaagtaaagatagcggaggcgcacattag

SEQ ID NO: 2593 - DNA, 1179 bp, Xenorhabdus bovienii
  Coding DNA location: Contig name=SeqID_16873; Position on contig =28291..29469bp; Strand=-
atgaatattaaagaggaaataaaatccccgacagctacgagccgcaataagaaaagacagcgccgaagtatcatcatattactgaccttactctttcttatccttggtgccgtttatactgtttattggttcctcgttttacgtcatcatcaggaaaccgacaatgcctatgtgacaggaaatcaggtacaggtcatgtctcaggtcactggcagcgtgactaccgtctattttgacaataccgattttgtaaaaagcggtagtgttctagtgcaactcaatccccttgatgctgaactggtactgaaaaaagccgaaaatgagttagccacagccgttcgaaccacccaccagcgcatactcgataatcaacaatatcaagccgtcatcaacctgaaaaagattgctctcagcaaggcacaaaacgatctaaaccgcagggaaatacttggtattaaggaagtcattggtaaagaagagctgcaacatacgcgtgagagtgtcgcgattgccaaagctgatctggatgtagcaatcgcgcagtacaacagtaatcaggccaccattctggatactccactggataaacaacctacggtagaaaaagccgcttcaggggttcgtgatgcctggctagccttacagaggactaaaattgtcagtcctgttgatggatatgtttctcgtcgtaatgttcaggtaggctcccgcattaattcagggacacctttgatggtcatcgtccctgccagcaatatgtggattgaggccaatttcaaggaaacccaactcgccaacatgcgtatcgggcagacagtaaaaatcatcagcgatttttacagtgatggtgtcgtatatacgggcaaagtggcaggccttgatatgggaaccggtagtgcgttttctctattacccgcccaaaacgccagtggcaactggattaaagttgttcaacgcttgcctgtccgtattgagcttgatcctgagcaattgaagcagtatcccctgcgcattgggttatcgacaaaagtcacggtagatacagcagatacccgtgaaatgacactggcaacctctgaacgccatcaccccgcttatcacacgaatgcactgacgatcgatatggctcctgccaataaaatagttaatgacgtcattaatagtcattcaaggaattag

SEQ ID NO: 2594 - DNA, 144 bp, Xenorhabdus bovienii
  Coding DNA location: Contig name=SeqID_16873; Position on contig =29544..29687bp; Strand=+
gtgtgcatttacactactggaaagggtgaattacatggattcaaatattatctgaggataatagttagccatatgaggtatcagatgatacaggctagcagaaaagattttttaggtcatgttgccataacacgtttttcttga

SEQ ID NO: 2595 - DNA, 528 bp, Xenorhabdus bovienii
  Coding DNA location: Contig name=SeqID_16873; Position on contig =29713..30240bp; Strand=-
atggaaagttcattcactcccactgaagagttgcttaattgccgtgttacacagcaaaaagagttgaacaaaagtttgccctatcaagagatattactcactcgcttatcgatgcatgtccagggtaagatactggaaaatcgtaataacatgctgagagcgcaaggaatcaatgaaaccttgtttatggcactgatgatcctggataccaaagaaagtcgtagcattcagccatcagaacttagtgctgcattgggttcttcccgcacaaacgcaactcggattgctgatgaattagaaaagcaaggctggatagaaagaaaagagagccataacgatcgtcgttgcctccatcttcatctaacagagaaaggtacaaatttcttgaatagtttacttccacctcaacatgactgcctgattaaactttggtctgcgcttgaacaggaggaacaaaaacagttagagaaattgatgagaaaattattggctcgattggataatatcggagattgttttaaaaagtga

SEQ ID NO: 2596 - DNA, 153 bp, Xenorhabdus bovienii
  Coding DNA location: Contig name=SeqID_16873; Position on contig =30174..30326bp; Strand=-
ttgctaaatttaacttttaatatagtatttgtagggtttttaacagaagttactttaccggttgaaactaataaggtatctaaacaatggaaagttcattcactcccactgaagagttgcttaattgccgtgttacacagcaaaaagagttga

SEQ ID NO: 2597 - DNA, 336 bp, Xenorhabdus bovienii
  Coding DNA location: Contig name=SeqID_16873; Position on contig =30370..30705bp; Strand=-
atgattgataatagaatacttctaatcggtattgttgtaggggtagccaattttttattccgttatctacccttgcgctttggtgtcaatcgctcgcctatgaccaaagcgggaaatactggggttgtactggacagtattggtattgcatcaatttgttcgctccttattgtttcaggtattcctgaagtcatacgcgaacataataaattttttccgactttgatcggctgcctgactatctgtttactgttctataaaacacgaagtatcagcattgccacactgtctggagccactgtttttggattaacattcaaggtatttatgaattag

SEQ ID NO: 2598 - DNA, 792 bp, Xenorhabdus bovienii
  Coding DNA location: Contig name=SeqID_16873; Position on contig =30698..31489bp; Strand=-
atgccaatacctgataaacctgcgcccgataccccaaaatctgggacatccatacctgagctccccattccgaacaaaatttcttcgttctcagaaggcattattgatagcttacccattgccattggctatattcccatcgccttcgcatttggcctgagtgccgtaaagctgggctttactcccctcgaagccatatttttttcatgtgtcatctatgcgggggcaagccaatttatcatcaccgctctgcttagtgcaggtatgtctctgtgggtttctgctttgaccgtcctggcgatggatatccgccatattctatatggcccagctctgcgttatcgcatcaaacaaaaattatcagaaaagaaaactgcgatctgggcttttggtctgactgatgaggtttttgccgcagcgaccgctaaattgattaaagaccagcgtagctggagtgaaaactggatggtcgcgatcgctatgtgttcatggctatcctgggtactgggaaccgtagcaggctccctgctggggaatggttatctggactcatatccagccgttgaagccgccatgacctttatgctcccagccctgtttttaagttttttattggcatctgtcaaaaaacaaaatagctactgcgttactgcgtctctggcgggtgcgttgataggtgtcacatgcttttccatcccggttgccattcttgcgggaattttgggtggttgcctgacagcacttcttcagtttcataccacacagttgaataagaataaaactgatgattga

SEQ ID NO: 2599 - DNA, 264 bp, Xenorhabdus bovienii
  Coding DNA location: Contig name=SeqID_16873; Position on contig =31365..31628bp; Strand=+
atggcaatgggtaagctatcaataatgccttctgagaacgaagaaattttgttcggaatggggagctcaggtatggatgtcccagattttggggtatcgggcgcaggtttatcaggtattggcatggagctgattgtttttttgttaataggtgaaacaacattaacaaaatatggtgaaagtgaaaatatgaaatgtataaattatttaattaatattattaagacccgtgttttttataggtttttagcagtgtggagataa

SEQ ID NO: 2600 - DNA, 1035 bp, Xenorhabdus bovienii
  Coding DNA location: Contig name=SeqID_16873; Position on contig =31681..32715bp; Strand=-
atgcgtatcataactcggtgtaaaaagatcatgaataagaatacgatcttgggattaaccctgtcatcattagtgagcatgccgctatttgccgttgaactacccggcaaaggcatcagtgtacaaccgctgcaaagcaccatcagcgaagaaacttttcagacactgattgtctgcaaggcgttggaaaaactcggctatgacatcaaacccatcaaagaagtcgattataatgtcgcttatgcttccattgccgctggtgatgccacattcatggccgttaattgggttcccctccataacgcgcaatacaaagccgcaggtggtgataaaaaattctatcgcaaaggaacatatgttgaaaatgctgttcaaggttatttgatcgataaaaaaacggcagaaaaatatcgcatcaccaatatcgcacaattacaagatccccaacttgctaagttgtttgacagcaatggagacggtaaggcagatttaaccggttgtaaccccggttggggatgcgaaaaggcaattaacagccaactaaaagcctatggattggagaataccgtcgaacataatcaaggaaactatgctgctatgatggctgatacgatcgctcgctatcgagaaggcaaacctattttctattacacgtggacaccttactggatcagcgatgtactgaaaccaggtacggatgtgatatggctacaggttcccttctctgcgctcaatgatgacggtgtggttgatacccaattgccaaatggccgtaactatggttttcctcccagtactatgcatattgtggcaaacaagacctgggcagagaaaaacccggcggctgcaacactttttgctgtcatgaaattgccagttgctgatatcaacgcacagaatttgcgcatgcacagtaacaaagtttctgatattgatattgaacatcatgctgaaggttggctcagagcacaccagacaatcgttgatgaatggcttgaggctgccagaaaggcgactggacaaaaaacaggctaa

SEQ ID NO: 2601 - DNA, 1095 bp, Xenorhabdus bovienii
  Coding DNA location: Contig name=SeqID_16873; Position on contig =32730..33824bp; Strand=-
atgagcagtaaaaccccgcagacagcatctgatcaggcaaccttcagtgatccttggatcaatagcgccacagtcgatccatcatcaaataatgattggctggatacttccgcaactgagatttcatcagaacacttcaatatcatggcgccttttcagcataaactgattccgtttgattcatgggtaacccacgctattgactggctcgtcctgcatttccggcctatttttcaaggtgtacgtgttccggtcgattttatcttaaacgggtttgaacagtttctggtttccatgcctgctcccgtgaccattctaattttcgcactgctggcgtggcagcttgcaggaacgggtataggggtcacttccttcatttcactgatcctgatcggtgctattggcgcatggtctgaagccatgataacactggcactggtgctcacggctctgctgttctgcattctcattggcttaccgctcgctatctggctagcacacagtgaacgggttgcccgaattgtccgccccttgctggatgcaatgcagacaacaccagcttttgtctacctcgttcctatcgtgatgttgttcggcatcggtaatgtgcctggggtcatggtcacgatcatttttgccttgccgcccattgttcgcctgacaattttagggatcaaacaagttccggcagatctcattgaggcagcccgatcctttggtgcaagtccacgccaaatgttgttcaaagttcagcttccccttgccatgcctacaattatggcaggcgtgaatcaaacattaatgctggcactctccatggtcgtcattgcttccatgatagccgttggtggtttgggacagatggtactgcgcgggattggccgtcttgatatagggctggcagccgttgggggcgcaggaattgtcattcttgccattatccttgatcgactgacccaatctctggggaaaaacagccgtgtcagaggcggactctggtatcactcggggccgatagggctgttcatcacactttttgcccgaaaatgggcacgaaaatcctcctgtgacaataacgttcaaaccgacaaataa

SEQ ID NO: 2602 - DNA, 1203 bp, Xenorhabdus bovienii
  Coding DNA location: Contig name=SeqID_16873; Position on contig =33814..35016bp; Strand=-
atgacaattaaactcgaagttaaaaatttatataaaatattcggcgatcatccagaacccgcatttaagttattagaatccggtctcaacaaggaacagatttttgaaaaaaccgggctggcaattggagtgcaaaacgccaatctggccattgaagaaggcgaagtgtttgtcatcatggggttatccggttcaggtaaatccacgctggtacgccttctcaatcgtctgatagaacccaccagaggtcaggttctcattgatggaaaagatattgctgctatttcagacatccaactgagggaggttcgccgcagtaaaatgagtatggttttccagtcatttgcactcatgccccatttaaatgttctggaaaataccgcgtttgggatggaacttgccggcattcccaaaaaagagcgtcactacaaggcacttgaaaccttgaaacaagtgaatctggaaaactacgctctgtcatatcccgatgagctttccggcggtatgcaacagcgtatcgggttagcgagagcattagccaatgatcccgatattctattgatggatgaagccttctctgctctcgatcccctgatccgtaccgaaatgcaggacgaagtactacgtctgcagggcgagcaccagcgcacgattatatttatttcccatgacttggatgaagcaatgcgcatcggtgatcgcattgcaatcatgcaggggggcatcattgtacaagtgggtacacctgatgagatcctgaataatcctgtcaatgattacgtcaaaacgttcttccgaggtgtagatattagccatgtattctcagcaaaagatgttgctcgtcgtcggcaagaagctctgctccatatagccacaggttttggccctcgctcggctctgaaagttctggatgatgaagacaggagttatggatatctgatcgaaaaaggccagaaatttattggcgtggtttcggtctgctccttacaaaaagcgctgacagaaaagcaatcgattgaatatgccattttgaaagaacccgccgccgtctcggctgatatgccgctgcatgaattgatatctatcgtggcgcaatccccctgtgctgttcctgttgtgggtgataatgaccgttatttaggtgtcatttccaaagggatcctgttacaggctttagataaggaaacaccgaatgagcagtaa

SEQ ID NO: 2603 - DNA, 198 bp, Xenorhabdus bovienii
  Coding DNA location: Contig name=SeqID_16873; Position on contig =35010..35207bp; Strand=+
ttgtcatgcaataaatattttccgtttgttaatgatatattttctttattactccgaatcattcgaatcattttttcacatatctaccctagcacactgaaatatgttgacaaccccttgtttagaattattaatcaaaatggatatttattatggcgtaatgtttgtgactataatttgatttttaatcttttttaa

SEQ ID NO: 2604 - DNA, 138 bp, Xenorhabdus bovienii
  Coding DNA location: Contig name=SeqID_16873; Position on contig =35438..35575bp; Strand=+
ttggtgaaagcaatacaacttactcccttcatttttcaagtcgctgttttgttgactacttttacttactctatccacatcgttatctatatctatgctttgggaattcgttttacttgctaccgtactgcaacttga

SEQ ID NO: 2605 - DNA, 219 bp, Xenorhabdus bovienii
  Coding DNA location: Contig name=SeqID_16873; Position on contig =35600..35818bp; Strand=-
gtggcttttataaaaaaacacaacatatattgtatttatttcataaatagattatccgaatataatacaaaaatgttagtttttattattagctacagcagtactcagaaagtaattttaccagaagcgttatcatttatggcaaacacagttgtgtttggtacaattttgccagccttctctacaacgcaagatctgtctgatgagatatataagtaa

SEQ ID NO: 2606 - DNA, 486 bp, Xenorhabdus bovienii
  Coding DNA location: Contig name=SeqID_16873; Position on contig =36031..36516bp; Strand=+
atgtatcatcattacctgaatactccagaaggttttcctaaaccttatatacatatcactgcagatgatgaaggagtcactagcatctactttgttaatgaaaagaaagaattagaatctaaaaacacgattactaagcagtgtgtaaaagagttacaggaatatttcaaaggaaaacgacatacattcacggttcctttgagcatgaagggaacagaattccagaagcgagtctggcagcagctctgcaacatcccttttggcgacatgtggagttataaacaattggcattgactctggggtccgttaattattgccgtgctgtaggaatggcaaactcacgtaatcccatttccctgattgtaccctgccatcgagtgattgggcatgatggtaagttagtcggctatactggtgggctggatatcaaagtatggttgctggaacatgaaaagaataaaaaaattaaagctaaacagagttga

SEQ ID NO: 2607 - DNA, 93 bp, Xenorhabdus bovienii
  Coding DNA location: Contig name=SeqID_16873; Position on contig =36479..36571bp; Strand=+
atgaaaagaataaaaaaattaaagctaaacagagttgaacaaaatactagtttatttatgaaattactactaaagtataaaataactttatga

SEQ ID NO: 2608 - DNA, 102 bp, Xenorhabdus bovienii
  Coding DNA location: Contig name=SeqID_16873; Position on contig =36680..36781bp; Strand=-
ttgctaccatcttctggagtgataaaaccgaatcctttagattcattaaaccacttaacgttacctttaatttttgacatcaaacttacctttaataaataa

SEQ ID NO: 2609 - DNA, 249 bp, Xenorhabdus bovienii
  Coding DNA location: Contig name=SeqID_16873; Position on contig =36736..36984bp; Strand=+
atgaatctaaaggattcggttttatcactccagaagatggtagcaaagatgtttttgtacacttttccgccattcagtctaacggtttcaaaactttggctgaaggtcaaagagtcgagtttgaaatcactgagggtgcgaaaggtccatctgctgcaaacgttgtcccaatctaatttctatccccgtattttgaaaacccgtttactacaacgggttttttatgtttttaaacacaacttgatttag

SEQ ID NO: 2610 - DNA, 375 bp, Xenorhabdus bovienii
  Coding DNA location: Contig name=SeqID_16873; Position on contig =36981..37355bp; Strand=-
atgataaatattatttttgctgtatttataggtggtggcttgggcagtgtattgcgctggttaattagcttccgcctgaataatgcctctactcctcttgccgttggtacgctgacggctaactgcgttggggcatttatcattgggttgggattggcttattttaataaggccacacaccttgatccagtttggaaattgatgctaaccacgggtttctgtggtgggttgacaaccttttccaccttttctgttgaagttgtttatttgttacaggctggaaaaatcggctgggcattgagcagtattctggcaaacctagtgggctcattattgatgacaacgtttgcttttgctgtgatgaataggttctaa

SEQ ID NO: 2611 - DNA, 966 bp, Xenorhabdus bovienii
  Coding DNA location: Contig name=SeqID_16873; Position on contig =37371..38336bp; Strand=-
atgagtaaaccaattcagatggaacgcggtgtcaaatatcgcgacgcagataaaatggctctgatccctgtaaaaacagtggccacagaacgtgaagcactcttgcgtaaacctgagtggatgaaaatcaaacttcctgcggattccagccgcattcagggcatcaaagcggcaatgcgcaaaaatggtttgcattccgtctgtgaagaagcctcctgccctaacctggccgagtgctttaaccacggaacagccacctttatgatccttggtgcgatttgtacccgtcgctgcccattctgtgacgtggcacatggtcgcccgactgcaccagataccaatgagcccaccaagctcgcacaaaccattcaagatatggctctgcgttatgtcgtgatcacctctgttgaccgtgatgatctgcgtgatggcggcgcacagcattttgccgactgtatctctgccattcgcgaaaaaaacccatcaattaagatcgaaacactagtacctgatttccgtggccgcatggatcgtgcgctggaaattctgacagcgacaccacctgatgtatttaaccacaatctggaaaacgtaccacgggtatatcgtcaggttcgcccaggtgctaactacgagtggtcgttgaagctactggaaaaattcaaggaaactcatccaaatatcccaaccaagtcaggtttgatggtgggattgggcgagaccaacaaagaaattttagaagtgatgcgtgatttacgtcgtcatggcgtcaccatgctgacattaggccaatatttacagccaagccgccatcacctgccagtccagcgttatgtcagccctgctgaatttgacgagatgaaagaagccgcactggagatgggctttacccacgctgcctgtggtccatttgtccgctcttcttaccatgctgatatgcaggccaaaggtatggaagtcaaataa

SEQ ID NO: 2612 - DNA, 651 bp, Xenorhabdus bovienii
  Coding DNA location: Contig name=SeqID_16873; Position on contig =38454..39104bp; Strand=-
atgatgaagttcccattgcaacataacaccgttattttacgccagctgggtatccagccttacgggccagtttctgatgctatgcaccagtttactgagcagcgtactgcggaaacatccgatgaaatttggctcgtccagcacgaaaaagtgtttacgcaaggtcaggcaggtaaagccgagcatgtgcttacgccaggtgagattcccgttattcaatccgacaggggcggtcaagtaacctatcatggccctgggcaacaggtcatgtatgtcttagtcgatttaaagcgggcaaaaattggtgtgcgccagttggtgaccgcaatcgagaataccgtaatcgaaaccttggcttattttggtgtagaagcgcatgcccgtccagatgcgccgggtgtctatgtccagaacaacaaaatatgttcacttgggctgcgtatccgtaaaggatgctctttccacggtctggcactgaatattgcaatggacttacagccatttttacgcattaatccatgtggttatgcgggaatgcagatgactcaactcagtcacctcgcagcagaggtaacggttgaagatgtacaacctgttctggtggaaaaattctgccggatcttgggatttcaactaatcaatgaaagatga

SEQ ID NO: 2613 - DNA, 207 bp, Xenorhabdus bovienii
  Coding DNA location: Contig name=SeqID_16873; Position on contig =39101..39307bp; Strand=-
atgccccacaatcaggagttggttttttctgaccatctgttagctcaaacagagattaaaggagaaatcatcgaaatatataaccatcataatataaaatttaaatatattcgtctaattaacaatattattgcattaaagcattctcaaactggtgggaatccttttaggacgttatactggcgggtaatttttgttaacgaatga

SEQ ID NO: 2614 - DNA, 1461 bp, Xenorhabdus bovienii
  Coding DNA location: Contig name=SeqID_16873; Position on contig =39272..40732bp; Strand=+
atggtcagaaaaaaccaactcctgattgtggggcatctttgtagttttctggtgctcctttacagcctctctatgttgctgcctatttttgttgcactattttataaagaaaaaagtgtgtttgccttttttgagacgttgctcattggattgagtgtcggaagcgttggttggtattttactcgcaaaaccaaggcacaacccagtacccaagatggatttcttatcatcgtgttgttctggctgctcttttcgctgctcagtgctttgcctttcgttcttgataaaagcctgaatatcaaccttgtggatgcggtgtttgaaggtgtgtcgggtatcacaacgacaggagcaacggtactgaatgatgtgtctgaattacccaagtctattctctattatcgtgcacagcttaattttattggtggattgggagttatcgtgctggctgttgcgattctgccattgctcggtattggtggggtaaaactctatcaatcagaaatgcctggcccttttaaagaagagcgcttgacccctcgccttgccgacagtgctaaaagtctatggctggtttatctgctgttgggggctctatgttcggtgagttttaaagtagcgggaatgtcgtggtttgatgccgtttgccatggaatttcgaccgtttctttaggtggattttcgacccgcaatgaaagccttggttattatgacagtgccgctattgaaatggtggggggcattttctcggtattggcggcagtcaactttacgctctattttgttgcactgacacgcagaagcctaaaaccactgttgaaaaatgccgaactgaaattttttctgctggtgctggcggcggtagtttgcattatctggttggagttatatcgctcgggtatgtatggtgtgaaggaagctttcgttcatggttttttcatgaccagttccatgatgaccgataatggcttggcgacttcagattatgcccaatggccttcccacacgatattgatgctgttggcagtcagtttctttgggggctgtgtgggatcgacatgtggcggtattaaggcactccgtttcctgatcctggcaaagcagagtatcagcgaaattaatcagcttgttcatccgaatgccatttcaacgattaaagttggccagtcttcggttcatgaaagggtactgcgctctgtctgggggtttttctttttgtatgtctttttcagttgtttctttatctgggcattgaatctgttgggttatgatttagtgacctcgtttgctaccgttgctgcctgtatcaataatatgggagtcggttatggcgcaaccgcgcaaggtttcggtgatcttgatgctgtcgcgaaatggatgatgtgtgcggccatgttattggggcgtcttgaaatttatccgatcctgatcctctgttcgaaggcattctggcgtttttga

SEQ ID NO: 2615 - DNA, 111 bp, Xenorhabdus bovienii
  Coding DNA location: Contig name=SeqID_16873; Position on contig =40687..40797bp; Strand=-
ttgataataattatcaatatcattaatgatgtagcgaacacaaccagctcgtgttcactgccacctcaaaaacgccagaatgccttcgaacagaggatcaggatcggataa

SEQ ID NO: 2616 - DNA, 927 bp, Xenorhabdus bovienii
  Coding DNA location: Contig name=SeqID_16873; Position on contig =40887..41813bp; Strand=+
atgtcttcaacctactctatttttactctgttcttaaaagaacgaatcttggtatcaccatccatattacgctgtgttttccaagggcctgacgtacacaggatgcgaagatatgcacctgatcagcgtattaagttactatttcctgttcaaaataaccctgcactaaagttagagggtggggaagagtggcgtcgtgattacatggcgatacctaaagagcagcgtccattgatgcgaacttacacattgagagcgttacgaattgaaaagcacgaaatggatgttgagtttgttctgcacggaaaaaatagtccggtatccaattggttatcccatgcaaacttgggggatacactccaaattgttgctccgatggcaggtttggatggctgtatggaaaatagcgggggagggtgtgaatggaatcctcctgagcacatgtgtcagacactcctgatcgccgatgagactgccttgccagccgctttgggtatcctcgaacaattagctcagcgtgataacccaccttatgttcaggcattctttgaagttcttgagcaaggggattgtgtcaatgtagaacatttcacatttgctgatgtgttctggttgccccgagatactgaaggaaagtatcagtatggtaaacggctgatagaggaagtcccccagcacgtcactattccagaatcagcgtttatcaaagaacaagctctggatgagaagaccacatcagagggtgaattatgggaaagggcgacaagtgaaaataatgagactcgtttttacggttggattgcagcagaatcctctgtggtaaagaaactgcgccagtatttgcttcaggaacgtcatttagatcgttcattaatcaatttcatggcgtattggtcgaaatcttcatccaaggatgatcacgcatga

SEQ ID NO: 2617 - DNA, 264 bp, Xenorhabdus bovienii
  Coding DNA location: Contig name=SeqID_16873; Position on contig =41901..42164bp; Strand=-
atgaaaacaaaattaaatgaactgcttgagttcccctgctcattcacttacaaagtgatgggtttagctcgacctgagctggtggatcaagttattgaagtggttcagcgccatgcgccgggcgattactccccagttgtgaaaccaagcagcaaaggcaattaccactcggtttccatcaccatcaatgccacacatattgaacaggttgaaacgctgtatgaagagttaggtaatctggagctggtgcgagtggttctgtga

SEQ ID NO: 2618 - DNA, 108 bp, Xenorhabdus bovienii
  Coding DNA location: Contig name=SeqID_16873; Position on contig =42122..42229bp; Strand=+
atgagcaggggaactcaagcagttcatttaattttgttttcatgggcactcctagtttacttgccacggcaacgtggtagtttttgccgtggcgtgattattttctaa

SEQ ID NO: 2619 - DNA, 1209 bp, Xenorhabdus bovienii
  Coding DNA location: Contig name=SeqID_16873; Position on contig =42274..43482bp; Strand=-
atgaaatacatagttcttccccgttttattaaaaataccaccttaggcatcgctctggctgccagcgcttctgcattcgccaacacggatgataatttcaaaaccatgatccccggcgttccccaaaccgatgcagaagcctatattctgattgattacaattcaggcaagatattggcagaaaaaaattcggatatccgacgtgatcccgccagtttgacgaagatgatgaccagctatgtgattggtcaagccattaaatcagggaaaatcggtccgaatgacactgttaccgtcggtaaggatgcttgggcaacgggcaatccggtgtttaaaggctcctcactgatgtttttgaaacccggcgatcaagtttctgttgccatgctatcccgtggtatcaacctgcaatccggtaatgatgcctgtgtcgcaatggctgactatgtggcaggcagtcaagatgcgttcgtcaacctgatgaataagtatgtgcagaatctagggttgcaaaacacacactttgagactgtccatggcctagatgcagcaggtcagtacagttctgcccatgatatggcactgattggtcaggctctgatccgtgatgtaccggatgagtatgcaatctataaagagaaagaatttacttacaacaatatccatcaacccaaccgtaacgggctgctatgggataagagcctgaatgtggatggcatcaaaaccggccacaccagtggcgccggttataaccttgtttcttccgccaccgaaagtaatatgcgcctaatttctgtcgtcatgggcagcccaacattcaaaggccgtgaaaccgacagcaaaaaactgctgacttggggcttccgcttcttcgaaacggtctcaccattgcaggtgggtaaagaatttgcctcagaaccagtctggtttggtgatgctgataaggtacaattgggcgtcgataaaaatgtttacctgactattccccgtggccgcctgaaagatctgaaagccagctacgtattgaacaataccgaactacatgccccactcgccaaagatcaagtcgtcggtactatcaacttccagcttgatggtaaaaccattgaacaacgtccattggtcgtgatgcaggaaatcaaagaagggggtttcttcagccgtatgatcgattacatcaaattgatgttccatcattggtttggttga

SEQ ID NO: 2620 - DNA, 1044 bp, Xenorhabdus bovienii
  Coding DNA location: Contig name=SeqID_16873; Position on contig =43664..44707bp; Strand=-
atgcatcaacaatggcttatactcggcatcgtggctgtactgatatcaggctgtacaacaacaggtaataaaagagaggactcctccattcctcctgttccaacccgtgaggtattgggtgcagaacctcaatatgagccttatcacccaagtgccaaccaagactatcaaagggatcggcaatcctatcgcatcgtgcaggactcagctaacttcacccagacgggttatgccagtgggttcggtgaagaagcgaatggaaaactgacagcaattggtgaacgagccagtccttatgctttagcggctgcgcaccccacattacctattccaagctatgtccgggtcactaatttgagcaacgggcgcatgatgattgtcagaattaatgaccgtggcccttacaataagccgggcaaaatcattgaattatcgcgggcggcggcggaacgcctgaatctgatgccacaaagcagagtcaaactggatggaattcaagttgcacctgatggatcagtttctggcttggggacagaaggcgcgactatcgtcaaacaaagctatgctttacctgacaggcccaatattggcgcaccagccatgatgagcagcccatctgaacaaaatatcgcagagcaaaatactgtggggcaacctgctgttgatcagaatctgtctgggaatacagaaaatccgtttctcacttcaccgcccgtgggaacaccatctgcaccaaagcaatcagagacaaaatggatattgcagccacagactgaacctgttgcgacttcccccgtgacacctgagcctgctgccacatcaacgggcggtttcatggtacaagttggtgccatcagttctgaacagaaagccaaagagtggcaacaatcattaagccagcgctttaatgtacaaggtcgtattatgcaatttggcaatgtccatcgcgttcaactggggcctctcagccgccagcaagcaacggaactgcaaaagaaattgactgaccagatgcatcaatcctcctttattgttgccccctga

SEQ ID NO: 2621 - DNA, 1113 bp, Xenorhabdus bovienii
  Coding DNA location: Contig name=SeqID_16873; Position on contig =44720..45832bp; Strand=-
atgacagactctcagaaaaaggttcctttctggaccagagtacatatcgatatcccactgctactgtgcattctggcattgttagtctacagtcttttcattatgtggagcgccagtggacaagacgttgacatgatggagcgtaaagccggacaggttatcatggggctgatagtcatgatcgtcttggctcaagtcccgccacgcatatacgagaactgggcaccttatctttatattggatgcgtgttcctgctaatccttgttgatgtttttgggcaaataagtaagggtgcgcaacgctggctggatctgggcattgtgcgcttccagccatcggaaattgctaaaattgccgttcctttgatggttgctcgtttcatgaaccgtgatctttgccctccctcattgaaaaatacggggattgcactgattctgacattcttgcctaccctactggtcgccgcacagccagacttgggaacctctatcctgattgccgcctctggtgtattcattctgtttctggcaggaatgaactggcggttaatcaccattgccattttactgattgcctgttttcttccaatattatggttctttttgatgcatgactaccaacgtgccagagtcatgatgctgctggatcctgaaagtgatccactgggtaagggctatcacatcatccagtccaaaatcgccattggctcaggaggggaatttggcaaaggctggttgcaaggaacacagtcgcaattggaatttctacctgaacgccatacggatttcattttcgctgttctctctgaagagctggggctggtgggtgttcttgtcttgctggctctctatctgctgctcatcatacgtggtttggttattgccgccagagcacaaaatacttttggtcgggtgatggtgggtggtttaatactaattctatttgtctatgtcttcgtaaatatcggcatggtgagcggtatcctgcctgtagtcggcgttcccctgccgctgattagctatggcggctcggcattaattgtcttaatggcaggattcggcattattatgtcaatacatacgcatcgcaagttattgtccaaaagcttataa

SEQ ID NO: 2622 - DNA, 1896 bp, Xenorhabdus bovienii
  Coding DNA location: Contig name=SeqID_16873; Position on contig =45841..47736bp; Strand=-
atgaagaataaacgaaccccttttcgcgatcatacggctgaatcagccctttttatgcgccgcgcactcgtggcgttcattggcattatcattttaacggggattctgattgccaatctttataatctccagatcattcgccacgaagattaccagacccgctcaaatgggaaccgcattaagctcgttcccattgccccaagtcggggtattatttatgaccgtaatggaacaccattagcgactaaccgcactatttaccaattagaaatcattccacagaaaatcgataatcttgacaaaacgctggatgagttgcgctccatagttgacctgaccgatgaagatatagaaaacttcaagaaagaacgtcaacgcgcacgtcgttttacctccgttcctttgaaaacatccctgaaccaagtacaggttgctcggttttccgtcaaccaatatcgttttccagggctggaaatcaagggctatcagcgtcgcgagtatccttttggttccgctctcacccacgtgattggttatgtcgccaaaatcaatgacaaggacgtagaacggcttgagaaagagggtattctcgctgactatgcagctacccatgatatcggtaagctgggcattgagcgttattatgaatcaactctgcatggcaaacccggctatgaagaagttgaagtcaacaaccgtggcagggtgatccgccagttacatgaacaacccccacaggcaggtaaagatatttatctgtcgatagatttgaatctgcaaaactatattgaacaaattctgacaaccagccgtgctgctgtcgtggtcactgatcctcgtactggtgaagtgttggcaatggtatcgaacccaagctatgaccccaacctgtttgtggatgggatttccagtaaggattataaaaatctgctcaacgaccctaaccgcccgctaattaaccgcgcaacccaaggggcttacccaccggcatcaacggttaaaccttttattgctgctgcggcactgagtagcgatatcatcacgaagaataccacgatattcgatcccggctggtggcagctacccggctcagaaaaacgttatcgtgactggaaacgctggggacacggtaaactgaatgtgcataaatctatcgttgaatcggcagatacttttttctatcaattagcctatgatatgggcatcgataggctttccgaatggatgtcaaggtttggttatggtcaatttacaggtattgatttgagggaggaaactcccggcaacatgccaacccgagaatggaaagtgaaacgctataaaaaaccgtggtatcaaggtgacaccatttctgtcggcatcggtcagggatactggacagccacccctatgcagatggtgaaggctctgatgatattaatcaatgatggcgaagtaaaaacgccacatttcttgctgggtactcgcgtgaatggcgaaatgcatccttaccaacctcctgtaaatcattcgattggtgatatccattccggctactgggaaattgccaaagatggcatgtacggtgtcgccaatgccccaaacggcaccgcacgcaggttctttgccggtgcaccctacaaagcagccgtaaaatcaggcaccgcacaggtattcagctatgaaacctataatgcaagcaaactggcagaacatctgcgtgatcacaaactaatgatagccttcgcgccctatgacagcccaacggttgccatttctattattctggaaaacggcggctcaggacccgcggttgggacgataattcgtcaaattctggatcatattttaatcaaggatagcgagcgcatcactcccgttgcggctcaggccgtaaccggaacacaagctaattga

SEQ ID NO: 2623 - DNA, 438 bp, Xenorhabdus bovienii
  Coding DNA location: Contig name=SeqID_16873; Position on contig =47773..48210bp; Strand=-
atgccggactgggttcagaccggctttatcgattatttgcaccgttttcccaaggatacgccttttgagctgattgaagtccctgcagggaaacgaggtaaaaatgctgacatcaaacgtattcttgaaaaagaaggcgaacaaatgctgtcggctgtcggcaaagacaatcgcattgtgacactggatattcccggatctcgttgggataccccacagttagcacagcagctagaacgctggaaacaggacggcagaaatgtcagtttgcttattggtggcccagaaggtctggctccggcctgcaaagctgccgcagaacaaagttggtcactttctccactgacgctgccacaccctctggtacgggttctggttgctgaaagcctttatcgggcgtggagtatcacgactaatcacccttaccatcgggaataa

SEQ ID NO: 2624 - DNA, 405 bp, Xenorhabdus bovienii
  Coding DNA location: Contig name=SeqID_16873; Position on contig =48246..48650bp; Strand=-
ttgccgctgagtcgcttacttttacagagattggcatgctattattctgcattattcaaccaatttgatgaaattaaggtgatccttttgcaaggcacagaactacaaaaatttgttattgataaacttgaagattccaaagcacaggatattgtttctatagatgttcgtggaaaatccagtattaccgactgcatggttatctgcacaggcacatcaacccgtcatctgatgtcagtggcagacaatctggttgatgactgccgcaaagccgggtttatgccgctgggtgtcgaagggcagggcatctcagactggatagtcgttgacctcggcgaaataatgatacacgtcatgcaagaagacagccgtcgcatgtacgaactggaaaaactctggagttga

SEQ ID NO: 2625 - DNA, 681 bp, Xenorhabdus bovienii
  Coding DNA location: Contig name=SeqID_16873; Position on contig =48668..49348bp; Strand=-
atgcttcattccactgattcaacaatagacccgagctccccgattattcaagcactgtttggtggcacattcgatcccattcattatggtcacttgcgccctgtggaggcattagcgaaacaggtagggctaaagcaggtcattttactgccaaaccatgttccaccacatcgtccacaacctgaagcaaccgccagtcaacggttggagatggttcgtctggccgtacaggacaacccgctttttaccgtcgatacccgtgaactggaacgtcagacgccctcttatacgatagaaacgctgaaatcctttcgtcaagaagtcggcgagcaacggccactggcattcatcatcggacaggattcactgcaatctatccatacatggtataaatgggaagaattactgggtatctgccaccttctggtctgctcacgtccgggttatcaaagccaactttcaacctcagatatgcaaaaatggcttgaacagcacaaaattgacactccgatatcattgagacaaaagccacacggttgtatttatctggccgctactccgttattaaacatctccgcaactgatattcgtcaacgccatcagcaagggctgagctgtgatgatttactgcctccagcgatacaaaattatgtcgattcacgggggctatatcgacaataa

SEQ ID NO: 2626 - DNA, 1041 bp, Xenorhabdus bovienii
  Coding DNA location: Contig name=SeqID_16873; Position on contig =49332..50372bp; Strand=-
atgatccgactctatcctgaacaactcctttcgcagctcaatgaagggctgcgaaacaattacctgctatggggcaacgagccgttgctgttgcaggaaagtcaggacagcatccgcagagtggctgaacagcatggttttctggagcatttcaccttttctttggataaccatactgaatgggaagaaatattcagcctgtgccagtcactcagcctgttttcctctcgccagtcacttaccctgctactgccggaaaatggcccaaatgcagcaatggtagaacggctaaccaagctgtctggattgctgcacgcagatatcttattgatattacgtgggcataaactcaccaaggcgcaggaaaacagtccgtggttcaaaacacttggccaaaatggtgtgtacgtcagttgtctgacacctgaacaaaaccgtcttcctcaatgggtggcacaacgtgccagaagcatggggctatcactggaagatgaagctaaccaactactatgctattgctatgagggaaatttattggcactggctcaggcactggaacgcctttctctgctccatcccgataatcggctgacgcttccccgtgtcgaagaagctgtcaacgatgcggcacattttgccccctatcactgggttgatgccctgctggcaggcaaaatcaaacgggcgtggcatatactgaaacaacttcgacaagaagatactgaagcgatcatcctgcttcgcaccatacaacgagagctaatgctgctgttaatcctcaaacgtcaggataagacgacccctttgaagacactgtttgatcaacacaaagtctggcaaaaccgtcgatcactgctgacaaccgcattacagcgcttgtcacagcaagatctgcaatcagccatacatttgctgacccagatggaactgtgcgtcaaacaggattatggccaatcgatttgggctgacctggaaacactatccatgctgttatgcggaaaaacattaccagagagcttcttgaatgcttcattccactga

SEQ ID NO: 2627 - DNA, 561 bp, Xenorhabdus bovienii
  Coding DNA location: Contig name=SeqID_16873; Position on contig =50369..50929bp; Strand=-
ttggtaggaaataatgtgcggcatggtattttcacgttgtttctggggttagcggtgctggtcaccgctggctgtggttttcatcttcgtggcacaacacaggtaccaaaagaacttcaaacattacaattaagttcaggtgatccctacgggcctctggccagagcagtacgccagcaacttcgcctgaacgacgtcaagattgttgaacgtggcgatgcctcagtaccgatcctgaaactcttgggttctaatgagcacaaagaaaccgcttctgtatttcaggatggtaaagcggcggaacgtcaattagtactgtatgttgatgctcaagtactcatgccgaatggcggtatctatccattgcaggcaagggttgatcgttctttcttcgataacccactggaagcactggcaaaggatgcggaaaatgaactgattcagcaggaaatgcgcgagcaagcagcccaccagcttatgcgccagttgctgaccgttcacagtgcagaactcttgaaaactgaagaaaaacagcaagcagtgactgcacaaaagcaatga

SEQ ID NO: 2628 - DNA, 2583 bp, Xenorhabdus bovienii
  Coding DNA location: Contig name=SeqID_16873; Position on contig =50947..53529bp; Strand=-
atgcaagaacaatatcgtccagaagacatagagcgacaagtacagcttcactggcaagagaagcaaacttttaaagtgacagaagacagcaacaaagaaaaatactattgtctgtccatgctaccttatccttctggccgactacatatgggccacgtccgtaactacaccattggtgatgtgatttcccgttatcagcgtatgcttggcaaaaacgtcctgcaacctatcggttgggatgcattcggtctgccagcagagggcgctgcggtcaaaaataataccgcacctgctccatggacctattccaatattgaatacatgaaagcccagctgaaaactctgggattcggttatgactgggatcgtgaagtcacaacctgtacgccagaatactaccgctgggaacaatggttctttaccaaactgtacgagaaaggtctggtttataaaaaaacctctgccgtcaactggtgtccacatgacctgaccgttctggctaacgaacaggttattgacggctgctgctggcgctgtgatagccaagttgaacgcaaagagatccctcagtggttcatcaaaatcactgattacgctgaagaactgctgaacgatttggataagctggaagattggccagagcaggtcaaaactatgcagcgtaactggattggtcgttcagaaggtgtcgaaatcacctttaatgtggctgacagtcaggaaacattgacggtttatacgactcgcccagatacattcatgggaacgacctatgttgctgttgcggctggtcatcctctggcaaaacaggcagcggaaaataatcctgaactggctgagttcatcaacgaatgccgtaataccaaagttgccgaagctgatatggccactatggagaaaaaaggtgtgccaacaggcatgttcgcaattcatccattgaccaacgaaaaaattgccatctgggtcgctaactttgttctgatggaatacggtacaggcgcagtgatggcagtcccagcccatgatcagcgcgactgggaatttgcaaccaagtacagcctgccaatgaaaaccgtcattctggacaacgacggcaatgtgccaactgttcaggaaggcgcagctactgataaaaatgcactggttaattccggtgaattcagtggactgagcaatgaagaaggcttcaatgctatcgcagataaactggtcgagatgggtgctggcaaccgtaaggttaactatcgtctgcgtgactggggtgtttcccgtcaacgttattggggggcgccaattccaatggcgacactggaagatggtactgtcgttcctgttccagaagatcaactgcccgttatcctgccagaagatgttgtgatgaatggcatcaccagcccaatcaaagcagatcctgagtgggccaaaacgaccatcaatggtcaaccagcgctgcgtgaaaccgatactttcgatactttcatggaatcatcatggtactacgcacgctatacctgcccagattatgacaaaggtatgctcgatccggccgccgctaactattggctgccagtggatcaatacatcggtggtattgaacacgccatcatgcacttgatgtacttccgtttcttccacaagctgatgcgtgattctgggatggtcaattctgacgaaccagccaaacgcctgctgtgccaaggtatggttctggcagatgcgttctattacaccggcaacagcggcgaaaaagtctgggtatccccagctgacgcgattgttgagcgtgatgataaaggccgcatcgtgaagtcggtggatcaagacggtcatgagctggtctatactggcatgagcaaaatgtctaaatccaagaataacggtatcgatccacaaattatggtcgataaatacggcgctgataccgttcgcttgttcatgatgttcgctgcgccaccagaactaacactggaatggcaggaatctggcgtagaaggtgctaaccgcttcctgaaacgtgtctggcgcctggtgtatgaacacagcagcaaaggtacaacccagccgctggatatcgccagcctgacgactgaacagaaagatttgcgtcgtgacttacataaaacccttgcgaaagtcaccgatgatatcggccgtcgtcaagcattcaataccgcagttgcggctatcatggagctgatgaacaaactgactcgtgtcccacaggaaaccgagcaagatcgcgctttaatgcaggaagcactgactgcggttgtacgtatgctttcccctatcacgccacacgcttgttttgtgatgtggaaagaacttggtaatgaaagcgacattgacactgctgcatggccacaggctgatgagcaggcaatggtggatgataccaagctggtcatcatccagattaacggtaaggttcgtggtcgcattaccgtacccgcagatgcgacaaaagagtatgtccaagagatggcggcaaaagaatacagcgttgcgaaataccttgaaggcgtcagtattcgtaaagtcatctatgttccaggcaaattgctgaatctggtcgtcggctga

SEQ ID NO: 2629 - DNA, 120 bp, Xenorhabdus bovienii
  Coding DNA location: Contig name=SeqID_16873; Position on contig =53473..53592bp; Strand=+
ttgccagtgaagctgtacttgtcgctctatgtcttctggacgatattgttcttgcatggcaccgataatcctatggtgagtaataaagctgcgcctgtaacgcgcatagtttgtttatga

SEQ ID NO: 2630 - DNA, 126 bp, Xenorhabdus bovienii
  Coding DNA location: Contig name=SeqID_16873; Position on contig =53649..53774bp; Strand=+
gtgagatcgctgaaatttacctattttcgaagcagattaaggtcggcggaagtcgtgttatccgccgacagggagaaaatcagtgtagaattttcgccagaaaatcacgggcgcgttctgatttag

SEQ ID NO: 2631 - DNA, 726 bp, Xenorhabdus bovienii
  Coding DNA location: Contig name=SeqID_16873; Position on contig =53728..54453bp; Strand=-
atgatttccctgaaaaatgtatccaaatggtatggccaatttcaggttctggctgactgctcgactgaagtcaaaaaaggcgaagtagtcgtggtctgtggcccctcgggttccggtaaatccacactaataaaaacggttaatggccttgaacctgtccagcagggtgaaattcgggtaaacaacacgccagttaatgataaaagcaccaacctggctcaattgcgttctaaggttggcatggtgttccagcactttgagctgtttccccatctgtcaatcattgagaacctgacactggctcaggttaaagttttgaaacgcgataaaaaagccgctaccgaaaaagcgttgaaactcttggaacgagtcgggttgaccagtcatgctgataagtttccttcccagctttctggtggtcagcaacagcgtgtcgccattgcccgtgcactctgtatggaccccatcgccatgctgtttgatgaacccacatcagcgcttgatcctgaaatgatcaatgaagtactggatgtcatggttaagctggctaatgaaggcatgaccatgatggttgtgacccatgaaatgggatttgccaaaaaagtggctcatcgcgtcattttcatggatgaaggaaaaattgtcgaagacagcaaaaaagaagatttctttgccaaccctaaatcagaacgcgcccgtgattttctggcgaaaattctacactga

SEQ ID NO: 2632 - DNA, 675 bp, Xenorhabdus bovienii
  Coding DNA location: Contig name=SeqID_16873; Position on contig =54453..55127bp; Strand=-
atgtatcagtttgactggagttccattattcccagcttgccatttctgctgaatggattggtgataaccgccaaaattaccgtgatagccattatcattggcattgcttggggaaccttgctggcaatgatgcgcctatcttctatcaaaatactgagctggtttgccaccctgtatgtcaacctctttcgctcagttccactggtgatggtattgctgtggttctacttaattgtgccgaacttattacaaaatgttctaggcatatcaccaaaaaccgatatccgtttaatttctgcaatggtagcgttctcgctatttgaagcggcctactactccgaaatcattcgggcaggtattcagagtatttcccgggggcagtcatctgctgcgctggcgctgggtatgacccacatgcaaagtatgcgtctgattatcctgccacaagcattccgcgcaatgatcccattactgttaacgcaaggcattgtattatttcaagatacatcgctagtatatgtactgagtctggctgattttttccgtacagcaacgaatataggtgagcgtgacggtactcagattgaaatgattctgtttgccggcgttgtttattttgtgattagttttgccgcttccatgctggttaactatttgaaaaaaaggactgtttga

SEQ ID NO: 2633 - DNA, 741 bp, Xenorhabdus bovienii
  Coding DNA location: Contig name=SeqID_16873; Position on contig =55132..55872bp; Strand=-
atgtctgttgattggaattggggcatctttctacaagctgccccttttggtaataccacctatttggggtggattatttctgggtttcaggtgacgattgcactttccgtttgcgcttgggttattgcgctcgttgttggatcgttgttcggtatcctccgcaccgttccgaacaaatttctagcaacgctaggcgcttgttatgttgagctattccgcaacgttcctttgatcgtccagttttttatatggtatctggtggtaccagaattcctgcccaaaaatttgagtaattggttcaagatggaactggatcccaatattcaattttttatttcctcggtaatctgtctggggctattcactgccgcccgtatctgcgagcaggttcgagctgccatccagtcactgccacgggggcaaaaagccgcaggccaggccatgggcctgactctgccacaaacctaccgttatgtcctgctgccaaacgcctatcgtatcattattcctccgatgacctcagagatgctcaatctggtgaaaaactctgctattgcctccaccatcgggctggtggacatggcagcacaggcaggcaaattactcgattattcagcacatgcttatgaatcatttacggcgatcacgctagcttacgttggcatcaatctggtgatcatgcttgccatgactctgcttgagaaaaaagtgcgcttgccaggcaatctgggagggagatag

SEQ ID NO: 2634 - DNA, 1011 bp, Xenorhabdus bovienii
  Coding DNA location: Contig name=SeqID_16873; Position on contig =56027..57037bp; Strand=-
atgaattacttttttacagcatataaacaaaaagattcaggaaatcgtttctacaaaaatgtaaacgccactatctgcaagcaaacccaatcttcaaagaataacccgataaaggagctgtatatgcgtaagttgatgttaaccatgatgttgcttagcgcggtaggagctgcccatgctgaggaattaactggaacactgaaaaaaatcaaagacaatgggattatcgttgttggacacagagaatcttctgttccattttcttattatgataatcaacaaaacgttgtcggctatgctcaagattattccaacttgattgttgatgccgtcaagaaaaagttggatatgcccaacctacaagtcaaactaatcccgattacctcccaaaaccgcattccgttgctgcaaaacggcacttatgattttgagtgtggctctaccaccaataaccttgagcgccaaaaacaagctgcattctccaacactatctttgtcgtcggtactcgtctgctgaccaataaagattcaggaataaaagggtttgacgatctggccgggaaacatgttgtcgttacttctggtacaacatctgaaattctgctgaacaaactcaatgacgagaagcaaatgcagatgcgcataatcagtgccaaagaccacggtgattcattccgtactctggaatcaggccgtgctgtcgctttcatgatggatgatgcattgctggcgggtgaacgcgcaaaagcgaaaaaacctgatcagtggatcattgttggtaaaccacaatcagaagaagcttatggctgtatgctgcgcaaaaatgatcctcaattcaagaaattgattgatggcacgattgtgaaagtacagacctccggtgaagcagaaaaactctttgatctctggtttaaacaaccgattccacctaaaaaactgaatatgaacttctccatgtcagatgagatgaagaccttatttaaatcaccaaatgataaggcgttaaattaa

SEQ ID NO: 2635 - DNA, 126 bp, Xenorhabdus bovienii
  Coding DNA location: Contig name=SeqID_16873; Position on contig =57061..57186bp; Strand=+
atgtttctatttcgcgacctgcctcgcactataaataaacaattttacttatgtacgattaaagagaaaataattttgaactctgttcacagtttgtgttttttaggtcaatatatttatttttga

SEQ ID NO: 2636 - DNA, 1593 bp, Xenorhabdus bovienii
  Coding DNA location: Contig name=SeqID_16873; Position on contig =57351..58943bp; Strand=-
atgtcaaaataccggatgatgctgacgttcctggccttgataaacaataataggatctggatgaacaaagcctcattactgagttgccagcggctgcgcgccttgctggcacttttcttaggagccagtggaacactggctttttcaccttttggtttctggcctgctgcattcctgtctcttttcggcctgcaaattctgacactcaacagaaccactcgacagtctctctttattggtttctgctggggatttggcttatttggcagtggtacaaactgggtttatgtcagcatcgcgaattttggcggcatgcccactgtcgtcaatatctttctggttatcctgctatctacctatctcgctctttatcccactctgtttgctggcctgctcaaccgtttttttccggccgccaacgggatcaggctggtcgttgccagtccagcactatggcaattgactgaatttctgcgtggttgggtattaactgggtttccatggctgcaatttggctacagccagatcgatggcccaatgaaagctattgcccctattctgggggtggaaggcatcaccttcctgatactaatgatcagtggtctgctggtacttgccactatccggaaaaaactttcactggctctcgccgcggttattctgctgctgctgccgtggccaatgaggtattatcagtggtataccctactgccggataagtctgccgatatcgcactggttcagggcaatattccccaagtcataaaatggaatccctcagaactggaaaatacgctggacatctatctgaataatagccgtcctttcatcggtaaaatacccatcatcatctggccggaatctgccattactgcttacgaaatcacccaaggtagtttcctgaccgaactggattctttgctaagacagcgtaataccagactgattaccggaattcctgatgctcgtcccacattggaaggctataaattctataacagtattatcgtgttgggagataaaaccccttaccgatatccggcatcgatccgctatgataaacatcatctcgttccgttcggtgaatttgttccgctggaatcaatattgcgcccattggcccccttcttcaatttgccaatgtcttccttcaatcgtggtgattatatacagccacagctttctgtagcagggcataacataactgctgcaatctgctatgaaattattttgggcgagcaagtacgtgataatttcaagcccgatactgaatttttgctgacaatttctaatgatgcctggtttgggcgttctattggcccgtggcaacatttccaaatggcacgaatgcgctctcttgaattgggacgcccattgcttagaggaacaaataacggtattactgcggttatcaggccagatggctcaatacaagccaagcttccacagtttacccgtcaagtgttggaagctaaggttactccagctagtggcagcaccccttattttcgctttggttattggccgatatggggattagcactgctgttcattggtttcggattgataagcagcaaccgccgccgaacttaa

SEQ ID NO: 2637 - DNA, 903 bp, Xenorhabdus bovienii
  Coding DNA location: Contig name=SeqID_16873; Position on contig =58894..59796bp; Strand=-
atggggaattttcattcaaacgccatgagcgacgaccatccttcaaataacgatagccctggccctaagaaaggctttcttgcgcttcttaatcaactttttcacggtgaaccgaaaaaccgtcatgatttggttgaactgatccgtgattctgaacagaacgatctgatcgatcccgatactcgagagatgctcgaaggggtaatggatattgctgaccaacgcgtgcgtgacattatgatccctcgctcacaaatcgttaccttaaaacgaaatcaacctttggacgaatgtctggatgtaattatcgattcggctcactcacgctaccctgtaatcagcgaagacaaagaccacatcgaaggcattttgatggcaaaagatcttctgccattcatgcgcacgaatgcagagcctttcagcattgataaagtgctacgtcaagctattgtggtgccagagagtaaacgtgttgaccgcctgctgaaagagttccgctcccagcgttaccatatggcaattgtaatcgatgaattcggtggtgtttccggtctggtcacgatagaggacattcttgaactgattgtgggcgaaatagaagacgaatacgacgatgatgaagataacgatattcgtgccttaagccgccatacttattcagtacgggcattggctcaaatcgaagatttcaacgatgttttcggcaccaatttcagcgatgaagaagttgataccatcggtgggctagtgatgcaggcatttggtcatctaccttcccggggtgaatctatcgacataaacggttatcttttcaaagtagcaatggcagatagccggaaaatcattcaggttcatgtcaaaataccggatgatgctgacgttcctggccttgataaacaataa

SEQ ID NO: 2638 - DNA, 468 bp, Xenorhabdus bovienii
  Coding DNA location: Contig name=SeqID_16873; Position on contig =59846..60313bp; Strand=-
atgaattcagttatattagatttacaaattgcatgtaaaaatccagaagggcttcctgatgaagcccttttccagcgctggctggagagtgttctgccacaatttcaggcagaaagtgaagtaacaatccgtctggtcgatgaggcagaaagccacgatttaaacctcacttatcgcgggaaagataaaccaaccaatgtgttatcctttccgtttgaagcaccgcctgaagtggaattacctttgctcggtgatttaatcatctgccgtcaagttgttgaacaagaagcagaggaacaacaaaaaacagttgaagaacactgggcacacatggtaattcacggttctctccatctgcttggatacgaccatatcgaagacgatgaagcagaagaaatggaatctctggaaacagaaattctacaaaaaatgggttatgctgatccctatttagcggaaaaagaataa

SEQ ID NO: 2639 - DNA, 1047 bp, Xenorhabdus bovienii
  Coding DNA location: Contig name=SeqID_16873; Position on contig =60310..61356bp; Strand=-
gtgacacaaataaactcacaagtagcaacacaagagatctttctggaacccgcagataatcaacgtcttatgagtctgtgtggcccacttgatgacaatctgaaacaacttgagcgtcgtcttggaatcgagatcagccgccgcgacaatcgtttcaaactggtgggtaaaccactgtgtgtcagtgcagtagccggtattctgcgccatctttatgtcgaaaccgcacctgttcgcagcgtgatcccagttcttgaacctgaacagattcatctggccatcacagaaagccgcgtgctggaacaatcggcagaaagtattcctgactatggcaaggctgtgaatatcaaaaccaaacggggtgttgtgaagccccgtacgcccaatcaagcacagtacattgccaatatccttgattatgatattacctttgggattgggcccgcagggacagggaaaacttatctggccgttgccgccgccgttgattcactggaacgtcaggaaattcgccgtatcctgctaacccgtccagcggttgaagcaggtgaaaagctgggatttctgccgggcgatctgagccagaaagtcgatccttacttgcgtccgctttacgatgcgctgtttgagatgttgggatttgaaaaagttgagaagttgatcgaaagaaatgttattgaagtggctccactggcctatatgcgtggacgtaccctcaatgatgcctttattattctcgacgaaagccagaataccaccatcgaacagatgaagatgttcttaacccgcattggcttcaattccaaagcggtgattaccggtgacgtgactcagattgacttgccaagaggccagaaatccggccttagccacgcagtagaagtcttgtctgaagttgatgaattaagctttaatttcttccatagcgaagacgttgtccgtcatcctgtggtcgccaaagtcgttatcgcctatgaagcatgggaatctgcggaacagaaacggaaacaagagcttaatgataaacgcaagcaggaagcacaatga

SEQ ID NO: 2640 - DNA, 1431 bp, Xenorhabdus bovienii
  Coding DNA location: Contig name=SeqID_16873; Position on contig =61381..62811bp; Strand=-
atgtcgacgataaaaaaactgtatatcaaaacttggggctgtcagatgaacgaatatgattcatccaagatggccgacctactggaaaccactcacggttatcagttaaccgatgtcgccgaagaagcagatatcttactcctgaacacctgttcaatccgtgaaaaagcccaagaaaaagtcttccatcaactcggacgctggaagggtctaaaagacaaaaatcccgaaattattattggtgtcggtggctgcgttgcctctcaggaaggggatttcatccgccagcgcgctcctagcgttgatattatcttcgggcctcaaaccctgcatcgcctgcctgaaatgattaatcatgtgaaaggcacccacagcccaatagttgatatcagcttccctgagatcgaaaaattcgaccgaatgccagaacctcgggcagaaggcccgagcgcattcgtctccatcatggaaggctgcaataagtactgtacattctgtgtcgttccttacacccgcggagaagaagtcagccgtccttgtgatgatattctgtttgaaattgcccagcttgcggcacaaggcgtacgtgacgttaacctgctcggtcagaacgtcaacgcctaccgaggcgcaacattcgacggggatatctgcacatttgcggaattactgcgtctggtcgcggccattgatggtatcgaccgcattcgcttcacaacgagccatccaattgaatttactgatgatattatcgaggtctacgaagacacaccggagttagtcagctatctgcacctacccgtacaaagtggctctgaccgtatcctgacccagatgaaacgtgcacataccgcgctggagtacaaaggcatcatccgtcgtctgcgcaaagcacgtcctgacattctgatcagttctgacttcatcatcggtttccctggtgagacacaggatgacttcgaaaaaaccatgcaactgattgccgatgtgaatttcgacatgagtttcagcttcatctattcagcacgtccgggaacccctgcggccgatttgccggatgatgtgagtgaagaagagaaaaaacagcgcctgtatctgctccagcagcgtatcaatcagcaggccatgagcttcagccgcgcaatggttggtagtacacagcgtattctggttgaaggaacatcccgcaaaaatatcatggagctttccggccgtactgaaaataaccgcgtggttaattttgagggaacgcctgacatgattggcaagttcgttgatgctgaaattgttgacgtgtatgccaactccctgcgcggtaaaattatccgtactgaagatgagatgaatttgcgcatccatgagtcacctgagtcagtcatcgcccgtacccgcaaggaagatgaaatcggcgttggcatttatcagccttaa

SEQ ID NO: 2641 - DNA, 204 bp, Xenorhabdus bovienii
  Coding DNA location: Contig name=SeqID_16873; Position on contig =62895..63098bp; Strand=-
ttgtacgagtcccaaagccgtcgctgcaccaaccatacccgcacccacgacgacgatatcgaatttttgctgtggattattcatattcatcacgccattaacttcctgattaaaatagtgtaccggaattttccctttccggctgtgaatatccgatgttacagtctggtcactggtgcctcaaatgactacaatagcctgtaa

SEQ ID NO: 2642 - DNA, 1194 bp, Xenorhabdus bovienii
  Coding DNA location: Contig name=SeqID_16873; Position on contig =63009..64202bp; Strand=+
atgaatatgaataatccacagcaaaaattcgatatcgtcgtcgtgggtgcgggtatggttggtgcagcgacggctttgggactcgtacaagagggctggcgtgtcgcattactggagcaccagccgcctcagccttatgatgaaggtaatgaaccggatcttcgcgtatctgcaattagctgcgcttccgtggatttattgaaacaattaggcgtttggaaccatgttttgcggatgcgcagtgcgccttaccggaaattggagacgtgggaacagcatgattccaacgtgactttcgatgcccaaagtctcgggctgacagagttgggctatatggtagagaaccgcatcctgcaattggcactgtggcaggagtttgaacgttacccgaatctgacgctgttttgcccggccgccctgaaatcgatgcaacggcagaatgcacatcaaatgtggcaaataacattgactgatggcacggaaatgaatgcacgtctgatcattggtgcagatggtgcccgctctcaggttcgacaactggcaggcattggcagcaatgggtggcaataccagcagtcatgtatgttgatcaccgtcaaaaccgagcaacctcagcaggacaccacatggcagcagtttttcccttctggcccgagagctttcttacctctgtttgatcagtgggcttcattggtctggtacgattctcctgcccgaattcgtcaactacagtcgatgacgatggtacagcttgagcgagaaatttttcaggcatttccctcccgcttgggcaaagtgactccaattgctgtgggttcgtttcctcttactcgtcaccatgccagccactatgtgcgtgagggattggccttgcttggcgatgcggctcataccattaatccattggccgggcagggcgtgaatttaggttatcgagatgttgaggttttgcttaaagtgctgataaacgccaaagaattacaggaagagtgggattctcaagcggtattgatgcgttatcaacgtcgcagaatgccggataatttagtgatgcaagcgggtatggatctcttccacaccgcattcagccatgatttgccaggattgaaaaccatgcggaatttagtactgatggcggcacaacgttcaggggcgatgaagaagctggcgctgaaatatgcattgggattgtag

SEQ ID NO: 2643 - DNA, 384 bp, Xenorhabdus bovienii
  Coding DNA location: Contig name=SeqID_16873; Position on contig =64028..64411bp; Strand=-
atgatattagtatctccatcgtcaaatctgaccaatgcagagccagttcaaaggaatcataggctcttttcattagactcaacaataaattgtgcaattccatcatactcaatacgaccagagccggacttcgtagccatccaagccctgtctcttcaaaatcactttctatctcccagcactgatccgtttgaattactacagattaactacaatcccaatgcatatttcagcgccagcttcttcatcgcccctgaacgttgtgccgccatcagtactaaattccgcatggttttcaatcctggcaaatcatggctgaatgcggtgtggaagagatccatacccgcttgcatcactaaattatccggcattctgcgacgttga

SEQ ID NO: 2644 - DNA, 96 bp, Xenorhabdus bovienii
  Coding DNA location: Contig name=SeqID_16873; Position on contig =64387..64482bp; Strand=+
ttgacgatggagatactaatatcatactttgtagtgtcgctatcgccgtatgaaaagtgttccatctttaggatatctattgggataggctcttag

SEQ ID NO: 2645 - DNA, 366 bp, Xenorhabdus bovienii
  Coding DNA location: Contig name=SeqID_16873; Position on contig =64552..64917bp; Strand=+
atgaaaataaaggagttatctagtaaaactggagttagcgctagaatgatacgttattacgaagaacaaggtttacttaagcctgatagaacaaattctggttatagaagattcacatcaaaggatttaatcaccataagaagtatacagtcccttcaagaagcaggtttaacgttagatgcagtcagagtcctgatgccatgtattgttagtgaaccaatcaaactctctccttgtcctctcattattgcaaccctaaagcaacatagagataaaattagagcggatcttaacaaaaatacacgagctctttcgttgctagatcagtttatatctgacgtcacaatttttagtacaaatgtataa

SEQ ID NO: 2646 - DNA, 102 bp, Xenorhabdus bovienii
  Coding DNA location: Contig name=SeqID_16873; Position on contig =64922..65023bp; Strand=+
atgttagtatctttttttaaaactcaaataaaaaaggtctgttacattatattttttagtaaaaaactggcgtgtttctcatgccagtcatggtttttataa

SEQ ID NO: 2647 - DNA, 96 bp, Xenorhabdus bovienii
  Coding DNA location: Contig name=SeqID_16873; Position on contig =64993..65088bp; Strand=+
gtgtttctcatgccagtcatggtttttataatttcgtcggtagtagatttactagctaaatctattcttatattggcattccttgctaatttttaa

SEQ ID NO: 2648 - DNA, 1209 bp, Xenorhabdus bovienii
  Coding DNA location: Contig name=SeqID_16873; Position on contig =65462..66670bp; Strand=-
atgtcaattgaagagaatgattgccaaggcgctgttactaagccagttcgtaaaacaagctggttttcaataattatattatcgctggcagcaataattttcgtaacagctgagctccttcctattggagtactacatgaaattggaaatacttataataaatccgcaggtaatatagggttgattgttaccggatatgcttgggtagtagcattatctgcaataagcgccacttctttttttatgaaagtggaaaagaagaaacttgttataggtattctcttagcattctcaatatcaaatctgatagtttcttttgcaccaaatttattctggctatatataggaagagtgataggcgcattctttcatggtgtattttggtcaattgtaggccctcttgcagtaaggttagttcctgacagtggaaaagctaaagcgacgtcattagtgtttggtggtattgcgattgcctctgtagctgttgtccccatagcaacgtttgtttcgcaaaatattggttggcgattgtcttttataagcctcgctattatgggattactcattaccattgcagcactcttttcgatgcctaaagtacatcaagctgatgcgagcaaaaaaatagctataaaagaaatcattactcagccttatctaagaagaacatttccagttacagccctcgccctgagtggaaattactgtgcttttacctatataagtccactactggagaatagagctggaatcagccacgaacaattaccattctttctactgctttttggtatgtttggagtaataggaaatataatttcaggatttataacaaattccagactggttgctgctacaagagcaatattagccgtcttaattatttctgtcattggtattggttatttttcagaaggtaatgtcgccctgacctactcttttattgctatgtggggtatagggatctgtttgttaacagttacccttcaatctcttgttcttaatttagcgacagacactggagaacgagcatcttcagtccatgtcgcgatgtttaatacaggtattggctcaggtgcatttataggcggaattttgatagatagatttaacaccgaaactacagctttgacaggaggaatactattaacaatcgcattcgttattttaattcctcaaataaaactaaataacaacagttcatcttaa

SEQ ID NO: 2649 - DNA, 117 bp, Xenorhabdus bovienii
  Coding DNA location: Contig name=SeqID_16873; Position on contig =66852..66968bp; Strand=+
ttgggagacgtgtattcactcgttgactggctttttaaatccgacaaaagaggagaattcctacctttccacaatttcctgcttttcttttcggtgcgtgtagagaggcgagcctaa

SEQ ID NO: 2650 - DNA, 216 bp, Xenorhabdus bovienii
  Coding DNA location: Contig name=SeqID_16873; Position on contig =66912..67127bp; Strand=-
atgcagaaggccaccgaaaggtggctttttgctttccttccatcaaaataccaacacctaaaaatccattttaaagctcaccaagcgattatctgtttaaagggtagtcatctggcgttaaccaattatctccttctaccgttgtttctatggcgaattttaggctcgcctctctacacgcaccgaaaagaaaagcaggaaattgtggaaaggtag

SEQ ID NO: 2651 - DNA, 1386 bp, Xenorhabdus bovienii
  Coding DNA location: Contig name=SeqID_16876; Position on contig =123..1508bp; Strand=-
atgagtgattcaaaacaaagcctgcaaaggggacttgaggcacgtcatattgagctgattgcgctaggtggcacaatcggcgttggactgttcatgggatctgccagcacattgaaatgggcgggaccttcggttctgttggcttacatcatcgctgggatttttgtttttttcatcatgcgttcgatgggggaaatgctgttccttgaacccgtcactggctcattcgccgcgtttggacataagtacctcagtccttattggggatgtctgacggcttggggctactggtttatgtgggtttcagtggggatttcagaaatcaccgctgtgggggtctatgcagaattctggttcccagatctgccccaatgggtttctgcattggttgctgtcgggttggttgccctagcgaacttggcggccgtgcgtttgtatggggagctggaattctggtttgccatgatcaaagtgactacgattatcgtaatgatcctgattggtatcggtttgatctttttcggactgggtaatgactggcagcctattggcttggataatttgaccgcgcatggcggctttttctctggtggctggaaagggttcttgtttgccctctgtatcgtggtggcctcgtatcagggagtggagctggttggcattacagcaggggaagccaaaaacccacaggtaacacttaaaaaggccattaacaatattctgtggcgtatcctgatcttttatgtcggtgcgatttttattgttgtgaccctgttcccgtggacagaagctggcacgcatggcagcccgtttgttatggttttttccaaagtagggattgcttctgccgcagcggtcattaactttgtggtgctgactgctgcgctttcgggatgtaatagcggcatgtacagtggtggcagaatgctgtatgccttggcgaagaatcgccagttaccggcttcattgctgaaattgtcaaaaaatggcgtacctgtgagatgtattgcgatcaccattggctgcctgattgtaggttccaccctgaactacctgatcccaaatccacagtcggtattcgtttacgtttatagtgccagcgtattgcccggtatggtaccgtggtttgtcattctggtaagccagttgcgtttccgccagcagaatcaggaagcattgaaacagcatcggtttaagtcgctccttttcccttacgtcaattacctgactctggtatttctgagttgtgttctgatagggatggcgattaacccggatacgcgtttttcactgatggtaggtggcgcatttttactatttgtgtcactggcttattggctggggaaatttatttgcggcaaaacgcaaaatagttcattagattaa

SEQ ID NO: 2652 - DNA, 738 bp, Xenorhabdus bovienii
  Coding DNA location: Contig name=SeqID_16876; Position on contig =1785..2522bp; Strand=-
atgacactgaataacattccaaaataccgtatccgtggcctcagtctctggggctttcgtggaatgtcgcatttcctcgatcatctttttcaggatgggcaggtaaaaacaggcacattggttgcgattaatgcagaaaaagtcctcactgcggaaaaagacaatgcgctgaacatattgctggatgaggctgaatacttatatgccgatggcattagtatcgtgcgcgccattcgccgcaaatatcccgatgcgcacgtgtcccgcattgcgggggcagatttatgggaagctttgatggaacgtgcgggtcgggaaggtacgccggtatttctggtaggtggaaaacctgatgttctggcgcagacagaaaacaaactgcgtagtcagtggaacgttaatattgtcggcagtcaggacggttattttacccaggaagggcgtgatgcggtgtttgagcgtatccatgccagtggtgccgccattgtctcggtagccatgggatcgcctaaacaggaaattttcatgcgtgattgccgtaaagtgtactctggcgcactgtatatgggcgtaggaggaacgtatgatgtctttaccggacatgtcaaacgtgcaccgaaaatttggcaaaatttgggattggagtggctttatcgtctgttatcgcagccaagccgcatccggaggcaaatcaagctattgaaatttctgggctattattacggtggtaagctgtaa

SEQ ID NO: 2653 - DNA, 1197 bp, Xenorhabdus bovienii
  Coding DNA location: Contig name=SeqID_16876; Position on contig =2519..3715bp; Strand=-
atgctggcttctggctgtttttatgctatttattatgtcagttataaaacacgtctcagttataagacgccagcccgtaagacagcctcgtttagcacaccatcttctgtcgtgtctcgccggccgctgttcaccatgaatcgggtggaaactaacctgacgtggctgttgttggccagcattgctatctttacagttggctcgttctttatgcagaacggcttcttgctgtttaagctacagtcgtatagccagatattttccaatcaagtttccggcgtggcactcaagcggtttttctacttttttattcctgccatgctggtggtgtttttcctgaaacccactaaaacccgctggttgtgctttttggtggcgacagtcgggtttggcatactgacttatgtgatagttgggggaacgcgggctaacattattctggcttttgcattattcctgtttattgggattgtccgtggctggatcactttgtggatgctacttttggcgggtgtcatcggggttgtcggcatgttctggctggcattgaaacgttatgggcttgatgtgagcggttcggaagcattttatacgttcctgtatcttacgagggatactttctcaccgtgggaaaacctcgccttgctgctggataattacgataaaattgattttcagggactggcgccgattgcccgtgatttctatgtttttattccaagttggatgtggccggacagacctaatctgatattgaacacggcaaactactttacgtgggatgtgctggataatcactctggtctggctatttctccaaccttgataggctcattggtggtgatgggcggcgtattctttatcccctttggcgcgattgttgtcggattgattatcaaatggtttgactgggtctatgaagcgggaaaacaggaagttagtcgctataaggcggcaattttgcaggctttctgttttggggcgatttttaacatcattgtccttgcccgtgaaggaatggattcttttgtttctcgagtggtgtttttttgcctcatttttggtttgtgtctggtggtagcaaaattgttgtattggttgtttgaaagcgtggggctggttcgaaaatttgtcatcagtaatgtgcctgcgtcgcagaaaatatccactattgcggatgttaaggaagaaaaatga

SEQ ID NO: 2654 - DNA, 963 bp, Xenorhabdus bovienii
  Coding DNA location: Contig name=SeqID_16876; Position on contig =3937..4899bp; Strand=-
atggtggtgtccaaagaccacacatggctatctaattacccggccttggcgatcacggtttatggcagcaaagctgctttggcacgggctgtgatagagaaagcgcaggcagacagaaagacccgtttctttttccacggccagttcaatgcggctttgtggctggctttactggttggcaaaatcaaacgccatcaattctggtggcacgcttggggggctgacttatatgaagactcccgccagctaaaattccgtttgttctatcagcttcgtcgtttggcacagaaacgggtagggcaggtttttgccacgcatggtgatctccagtattttagccagtccaaccccaatgtaccgtcaacactgctctattttccaacgcgtatggagccatcactaaccgtaacggaaaagacatgcccgtcagaggggatcaccattctgctggggaattccggtgatcaatctaaccgccatattgaagcgttaaacaagattcacggtcaatttggtgatgaagtacgagtgattatgccaatgggttatcccggcgataatcaagcctatgtacaatgtgtggagcacaccgcattgtcgctgtttcgggcggaaaacgtccatatgttgaaaaataaaatggcttttgacgactatctgtcattactgcgtcaatgcgatttaggctatttcattttcaatcgccagcagggagtcggaactctttgcctgttaattcaatttggtattccgtttgtcctgagccgtcagaatccattctggcacgatctgacagaacagcagatccccgtactgtttgatggagatgaactgaataaacactgggtgcaggaagcacagcgtcaaatgctgtccctcgataaaaaggcgattgccttttttgatcccaatttcattgaagggtggaaagccgccctgtcggctgcattgggagagtattaa

SEQ ID NO: 2655 - DNA, 1251 bp, Xenorhabdus bovienii
  Coding DNA location: Contig name=SeqID_16876; Position on contig =5013..6263bp; Strand=-
atgtcacttgctaaagcttctgtatggacggcgggttccacactaatcaaaatcggtgtggggctgctggtcattaaacttctggcggtgtccttcggcccagcgggtgttgggcaggcgggcaactttcgccaactgattaccgtactgggcgtgctgtctggtgcggggatttttaacggtgtcaccaaatatgtagcggaacaccatcagcagccggaaaaactcagggcgatactgggtacttcgtcttcgattattctggggttttccaccctgttggcggttatttttctcttgttcactgacgccatcagtatcggcctgtttggtcacaataactacaaaacagttgtacaggcgctcgcatttatccaaatgggtattgcttacgccaactattttctggccatcctaaaaggtttcagggatgctcagggcaacgcactgtcgattattctgggtagcctgacaggaatgattgcctatggcctctgttattggctgggaggctatgaaggcgcgctagcgggcttggctttggtaccggctttggtggttctgccagcggggttgatgatcctgcgcagtaaggtgattacgttttcagcattaaagcccatgtgggatcgcgtgattgccagccatctggggaaattcacgctgatggcgcttctgacttctatgacgctaccagtggcttatatcatgatgcgaaatctgatggcagagcgttatagctgggaggaagtcggaatctggcagggtgtgagcagcatttcggatgcctatttgcagtttatcaccgcctctttcaccgtctatttgttgccgacactttcccgattggaaagtaagcaagaaattactggcgaaatcgtcaaggcgctgaagtttgtgttacctgccgttgccgcagccagcttttcagtttggctgttgcgtgattttgtgatttggctgctgttttcagataaattcaccgcgatgcgggatctattcgcatggcagctggtgggcgacgttttgaaagttggcgcttatgtttttggttatctggtgatagcgaaagcggcgctgcgtttttatgtactgactgaaatcagtcaatttctgctgctgacaggcttctctcattggctgatacccgaaaatggagcgttgggggcggcgcagtcatacatggcaacttacattatttatttcatcctttgttgtagtgtatttattatttatcgcaggcgagcatga

SEQ ID NO: 2656 - DNA, 1167 bp, Xenorhabdus bovienii
  Coding DNA location: Contig name=SeqID_16876; Position on contig =6265..7431bp; Strand=-
ttgagagcaccgcatattggttatacagaggatgagatgattccatttaacaaaccaccagtagtcggcacggaactggaatatatgcaacaggcgatgggcagtggcaaattatgcggcgatggccacttcactaaacgctgtgaagaatggatggagcagcattttaactgtctgaaggtgttgctgacgccctcttgtacagcagcattggaaatggcggccattttgttgaatatccagccgggtgatgaaatcatcatgccgagctacacctttgtttcgacctccaacgccttcgtcctgcgtggtgcaaccatcgttttcgtggatatccgcccagacacgatgaatatggatgaaaccaagattgaagcagccattacagacaaaacccgtgccattgcgccagtgcattatgcgggtgttgcctgtgaaatggatgtcatcatggcgctggcggaaaaatataacctgtatgtggtggaagatgccgcccaaggcgtgatgtccacctataaaggccgcgcactcggtactattggccatatcggttgtttcagcttccacgaaaccaagaactactcttccggcggtgaaggtggtgcgatattaatcaacgatgaatcgatgattgcccgtgccgaaattattcgtgaaaaaggaaccaaccgtagccaattcttccgtggacaggtggataaatacacgtggcgtgatattggctccagttatttgctgtctgatctgcaagctgcatacctttgggggcagcttgaaattgctgagaatatcaaccagcgccgcttatccctgtgggataactattatcaggccttgcagccattcgcagaagcgggacatctgaccttgccagttgtgccggagggtctggaacataatgctcatatgttctacatcaaactaaaaggtgtcgaggagcgcggcgcattcaaccgctacatgcaagaagcaaatattctgacagtgttccattacgtagcattgcatacgagcccggctggcgaaaaatgtggtcgtttccatggagaagatcgttttacgaccagcgatagtgagcggttggtgcgtttgccaatgttttacaacattactgatgaagagcagcaggtagttatcaaccgtatcaaggaattttttgcctga

SEQ ID NO: 2657 - DNA, 729 bp, Xenorhabdus bovienii
  Coding DNA location: Contig name=SeqID_16876; Position on contig =7397..8125bp; Strand=-
atgtctattcgcgctaatattgaatcactggcatgggatagccaatttttcggtttgcccactgcccgtttgaacttttcactgcaggcatcagtgctgacgacggctcagttagatgagtatgcactggtgcaggcgaaagtccctgcccagcagatggacaccattgacggtttatctgccttggggttttcattggtggaaggtgaagcagattttttgctgccggtggattctggcgcgatgcgttgtaggaatgcgaccggaattcagtcgaaacaagcgctgatttccgcaacaccgcaggatatacctgtattgacggcagcagcagccagtgtattcaaggccagccgctttcgggcaccttggtatcagcctgatgatagcggccggttttatgcggcttgggttgaaaaagcagttttgggtacttttgaccatgaatgcttgctcgtcaacgatgagtacggtcaaattatcggctttgtcaccctgagagatatcggtagccatgaagcccgtattggcttactggcagcccttccgggcaattatcaccggggcattggtaaaaaattaatgtcggcggcgcagcggtggtgtgaaaaccaccagatacagcggctgagagtggcaacacaaatcagcaacatcactgccttgcgtctttatacacgtagtggtgcaaccattgagagcaccgcatattggttatacagaggatga

SEQ ID NO: 2658 - DNA, 876 bp, Xenorhabdus bovienii
  Coding DNA location: Contig name=SeqID_16876; Position on contig =8109..8984bp; Strand=-
atgaaaggaattatactcgcgggaggctccggcacccgtctgtatccaataacacgcggcgtctcaaagcagttattgcccatttatgataagccgatgatctactatccactgtcagtcttaatgctggcagggatacgcgatatcctgattatttccacgccggaagacttgcctgctttcaaacgcttattgggcagtggtgaacagtttggtattcgcctgagctatgccgtgcagccttctcccgatggtttggcacaggcatttatcattggtgaagaattcattggcaatgatgcctgctgtctggtgctcggagataatatctactttggtcaggcgtttagtccgaaactgcaaagtgtcgttgcccgtcagactggagcaacggtattcggttaccaagtgatggatcctgaacggtttggtgtcgtggagtttgatgagcaataccgcgtactctcgattgaggaaaaaccagcccagccgaaatcaaactgggcagtcaccgggctctatttctacgacaacaaagtggtggatttagctaaacaagtgaagccttctgtccgtggtgagctggaaatcaccagtattaaccagatgtatctggaatgcggcgaattgaacgttgaactattgggacgcgggtttgcgtggctggataccggcacccatgacagcctgattgaagccagtacttttgtgcagaccgtcgaaaaacgacagggattcaaaattgcctgtctagaagagatcgcatggcgtcacggttggttgaatgatgaacagttaaaagccgctgctgccaacttggcaaaaacgggttacggtaaatatctgatggacttgctccatgtctattcgcgctaa

SEQ ID NO: 2659 - DNA, 1071 bp, Xenorhabdus bovienii
  Coding DNA location: Contig name=SeqID_16876; Position on contig =9003..10073bp; Strand=-
ttgaaacgtattctgattacgggtggtgcaggtttcattggttctgctgttgttcgccatattatcaatcataccgaagacagcgttgttgtggttgatagtttgacttatgcgggtaatcttgagtcactgtcatcggtggttgatcatccacgctatgcctttgagcaggttgatatctgccagcgtgatgcattagatcgtgtatttcagcagtatcaaccggatgccgtcatgcaccttgcggccgaaagtcatgtggatcgctccattgatgggcctgctgcctttatcgaaaccaatatcattggtacctatgttttgctggaagcatcccgcgcattctggcagcaactggatcaggaaaagcaggctgcattccgtttccatcacatttcaaccgatgaagtgtatggcgatttgcatggcgacgagggtttcttcacagaaaatacgccttatgcaccaagtagcccttattccgcgtcgaaagcatccagtgaccatttagttagggcctggcgtcgtacttatggcttaccgaccgtgatcaccaactgttcgaataactatggtccttatcactttccggaaaaattgatccctctgatcatcttgaatgcattggcaggaaagccattgcctgtctatggcaagggagagcagatccgtgactggttgtatgtggaagaccacgcgcgcgcgctgcatctcgtcgctaccacggcagaaccgggtgaaacttataacattggtggtcataacgagcgcagaaacattgatgtcgtagagaccatctgtgaactgctggaagagctgcgtcctataaaacccgcaggtattgtctgttaccgtgacctgattactcatgtggctgatcgtccggggcatgatatgcgttatgccattgatgcggcgaaaattgagcgcgaattgggctggactccgcaggaaaccttcgaatccggtattcgcaagaccgtgcaatggtatctggagaatgagaattggtggcggagagttcaggacggttcttatgcgggtgaacgtcttggtctggcgaatgaataa

SEQ ID NO: 2660 - DNA, 1263 bp, Xenorhabdus bovienii
  Coding DNA location: Contig name=SeqID_16876; Position on contig =10070..11332bp; Strand=-
atgagctttgaaacaatttctgtgatcggccttggttatatcggtttgccaactgctgcggcattcgcttcccgcaaaaaaaacgtcatcggtgtggatgtcaaccaacatgcggtagagacaattaaccgtggtgcgattcatattgttgaacctgatctggacaaagtggtgaaaaccgctgttgaaggcggttacctgaaggccgtgacttgtccgcagcctgcggatgctttcctgattgcagtaccaacgccgtttaagggcgagcatgagcctgacatggcctatgtgcgttctgcggcagaatcgatagcgccagttttgaaaaaaggggatttgatcattttggaatccacttctcctgttggtgcgaccgaacagatggcagaatggctagcagcggcacgtcctgagctctcattcccacagcaggcaggcgaaaatgcagacattgatatcgcgtactgtcctgagcgtgttttaccgggtcaagtcatggtggaattgatcaagaacgatcgcgtagtgggcggcatgacactaaaatcgtcccgtagggcgagcgagctgtacaaaattttccttgaaggcgagtgcgttgtcactaatgccaaaacggcagaaatgtgcaaattgactgaaaacagtttccgtgatgtcaatattgcctttgccaacgaactttccctgatctgtgccgaacaggggatcaatgtctgggaactaatcagtctggcaaaccgccatccacgcgtcaatatcctgcaacccggccctggcgtaggcgggcactgtatcgcggtagatccgtggtttatcgtatcccagaacccggcacaatctcgcttgattcataccgcgcgtctggttaatgatggcaagccgctttgggtggttgaccaagtgaaagccgcagtcgcggactgtctggtggagagcggtaaacgggcggatgaaattaaaatagcctgttttggtctggcttttaaaccaaacattgatgacttacgggaaagcccggctgtttatatcacgaagatggtggcacagtggcatgttggtcaaactgtagcggttgaaccgaatgttcatcaattgcctaattcgctgaaagatcgtgtggaattagttgatatacaacaagcattgaatgaagctgacgttgttttgatgctggtggatcacagccagttcaaggcaattgccggcagagaaataaaacaaaaatgggttgttgatacaaaaggagtttggcgttga

SEQ ID NO: 2661 - DNA, 1131 bp, Xenorhabdus bovienii
  Coding DNA location: Contig name=SeqID_16876; Position on contig =11329..12459bp; Strand=-
gtgaaagtgttgactgtgtttggtactcggccggaagctatcaaaatggctcctttggtacacgcattggccaaggatgctgcctttgacgcaaaagtgtgtgtgactgcacagcatcgggagatgttggatcaggtactgcatttgtttgagatcacgccagattttgacctcaatatcatgaaaaaagggcaggatctcacggatatcacgtgtcgtattcttgaaggcatgaagccagtattagaagagttcaaaccagatgtagtgttggtgcatggtgataccgcgactacaatggcgaccagcttggccgctttctatcagcgcattccggtaggccatattgaagcgggcttgagaaccggcgatctttactccccgtggccggaggaggccaaccgtaaaatcgcaggtcatctggcgatgtatcattttgcaccgacagaaaactctcaaaataacctcttgaaagaatccattgccggaagctctatttttgtgacgggcaatacggttattgacgctctgctgtgggtacgtgatcgcattgtgagtgatgacgcgctgagtggtcagcttgctaaactttacccctttattgacccgaataaaaaaatgattctggtgacaggtcaccgccgtgagagctttgggggtgggtttgaacgtatttgtgaagcgttggcacaggtagccagagcgcaccgtgaagttcaggtcgtttatcctgttcacttgaacccgaatgtgagtgagcctgttaaacgtattctgcatgacattgataacgttattctcattaatccacaggactatctgccatttgtctacttaatgaatcatgcctacatgattctgacagactctggtggtattcaggaagaagccccttctctaggtaaacccgttctggtcatgcgcgacaccacggagcggccagaagccgttgatgcgggtacagtgcggctggtgggaacaaaaacgcagaccatcgttgaggaagtcacgcgcctattaacggatgacatcgcttatcagcaaatgagccgcgctcataacccttatggtgatggtcaggcttgccagcgaattcttgaagcattgaggaaaaatcaggtgacattatga

SEQ ID NO: 2662 - DNA, 1056 bp, Xenorhabdus bovienii
  Coding DNA location: Contig name=SeqID_16876; Position on contig =12622..13677bp; Strand=-
gtgataaactcagaaacgaaatctaagcaggatcaatctgttatagagcatgagttggatattcgtgcactgtgtcatgctctgtggcgcggaaagatatggattatcgcactggcaatgattttcgctgccgttgctttaggtgcatcgtacctgatgcagcagaaatggagcgcaaccgcgattgtggatttaccgacgaccaatgatctggggagttattattcacaacaacaatttctgcgcaacctggatacccacatcaatgcctctccagaggcacaactgccgactatttcagatggtgcatacaaagaattcatcacacaggtggtggcgtatgatacccgccgcgaattctggcttcagtctgattattacaaacagtacagggaaggtaatgagaaagcagatgcggtattgctggaagagttaattaatacgattcaagtgttacggcgtgatgataaaaaattaccgaatgaagtcataaaattgacggcagaaacggcagtgaatgccaatcagttcctgcgagagtatatggcgtttgctaatcaacgtgcgagtactcacctgaacaatgagattaaaggtgcgtgggcaacccgtatccagtcgatgaaagcgctggtcaagcgtcaggaaatggtcgccaaggcgatgtacagccgcaaattgaatgtcttgcagcaatcattgaaaatagctgaaaaacaaggcatcaaccgtaatcaaacagacactcccattgaagaattacctgaatcccagatgtttatgatgggggcgccattactgcaatcacaaattgaaaccttggaagtcactgggcctaattacagcatcgattatgatcaaaacatagcgatgttggctacattgaatgttggcccgactctgcaaaatactttccagacctaccgttacctcagaacccctgaggtgcctgtcaaccgagacaccccccgccgtgtattcatgatgattatgtggggagctattggtctgttagttggagctggagtcgcgctgacaaggcgttcgcacacataa

SEQ ID NO: 2663 - DNA, 1035 bp, Xenorhabdus bovienii
  Coding DNA location: Contig name=SeqID_16876; Position on contig =13710..14744bp; Strand=-
gtgtttctgtttctggcacgcaaggtggcaaaaattatcggccttgttgataagccgaattaccgcaagcgccaccatggattaatccctctggtaggtggtatctctgtcttttttggcgtttgttttgcttttgctataacaaaagaatttatacctcataaatggttatatctggcttgtgcgggaatattggtttttgtcggcgcgttagatgaccgttttgatatcagtgtgaaaattcgggcagcaattcaggcactggttgggatcagcatgatgtattttgctgatctcaaaattgaaagtttgggcagtgcttttggcccatgggaaatgacattgggcccattcagctacgttgttactctgtttgctgtctgggctgccattaacgcctttaacatggtcgatgggattgatggcttgttgggaggtctgtccagtgtttctttcggggcattgggaattttgctatatgcaaacggtaatacggcactggcattctggtgttttgcgtttatcgcggggatattaccgtatatttttctcaatctggggctactagggaagcgcttcaaagtatttatgggagatgcgggaagcactctgatcggctttaccattatctggttgctgaccgaaacgactcagggcgaacacagttcggttaatccagtgactgcattgtggattatcgcgatcccattaatggatatggttgccattatgtatcgccgactgcgcaagggcatgagtccgttttcgcccgatcgccagcatattcaccacttgatcatgcgtgcgggtttcacttcccgtcaggcatttatcttaattactgtggccgctgctttattggcatcgatagggatcattggtgaacaactgagttttgtgcccgagtgggtcatgttggcattgtttttgcttgcatttatgttgtatggctattgcatcaaacgagcatggcgagtggcccgttttattaaacggtgcaagcgtcgtatgcgccgggcagtcagccatcactaa

SEQ ID NO: 2664 - DNA, 1260 bp, Xenorhabdus bovienii
  Coding DNA location: Contig name=SeqID_16876; Position on contig =15130..16389bp; Strand=-
atgaatcttaccgaattaaagaatacgccggtatctgagttgattactctcggcgaaaatatggggctggaaaacctggctcgtatgcgcaagcaagacattattttttctattctcaaacagcatgcgaagagtggagaagatattttcggagatggggtactggagatattgcaggatggatttggtttcctccgttccggagacagctcctaccttgcaggtcccgatgatatctacgtttctcctagccaaatccgccgttttaacctccgtactggtgataccatttcaggtaaaattcgcccaccaaaagaaggtgaacgctattttgccctgttgaaggttaacgaagttaactttgacaagcctgaaaacgcccgtaataaaatcctgtttgagaacctgactccacttcatgccaacaatcgtctgcgcatggagcgtggcaatggttctactgaggatttgactgcccgtgttctggatttggcagcacctattggccgtggtcagcgtggcctgattgttgctccgccaaaagcgggtaaaaccatgctgctgcaaaacattgcggctaacattgccaacaactacccagactgcgtcttgatggttctgctgatcgatgaacgtccagaagaagttactgaaatgcagcgtctggtaaaaggtgaagtgattgcttcaacctttgatgaacctgcttcccgtcacgtacaagtggctgaaatggtcatcgaaaaagcaaaacgtctggttgagcacaaaaaagacgttattatcctgctggattccattacccgtctggctcgtgcgtataacactgtagttcctgcttccggtaaggtactgaccggtggtgtggatgctaatgcactgcatcgcccaaagcgtttctttggtgcggcccgtaacgttgaagaaggtggcagcctgaccatcatcgcaactgcgctggttgatacgggttccaagatggacgaagttatttacgaagaatttaaaggtacaggtaacatggaactgcacctgtcccgtaagatcgctgaaaaacgcgtcttccctgccattgactacaaccgctctggtacacgtaaagaagaattgctcactacgcaggatgaactgcaaaaaatgtggatcttgcgtaaaatcatccatccgatgggcgaagctgatgcgatggaattccttatcaacaaactggctatgacaaaaacaaacgaagaattcttcgactttatgaaacgttcatag

SEQ ID NO: 2665 - DNA, 234 bp, Xenorhabdus bovienii
  Coding DNA location: Contig name=SeqID_16876; Position on contig =16748..16981bp; Strand=+
atgcttaacatagagacgctgtcagcaccaagctatataccgaatgattcccgtatatatgctctcaaatactttgccaaatgcgatatgccatcagatacttcagatgaaccagagataacagatttatcagacactacagattgtttagtatgtaacacgcttaatgtcaattctttatataaattgaagaatccactgatgcaatgcttcatacaagcacatgactgctaa

SEQ ID NO: 2666 - DNA, 342 bp, Xenorhabdus bovienii
  Coding DNA location: Contig name=SeqID_16876; Position on contig =17073..17414bp; Strand=-
atgaacgagaagattataagtgatcgtatcatccatttggctgatgcggattttgatgcaaaaaaattaaacgtaaaaggcgcagttctcgtcgaattctgggctgaatggtgtggtccctgtaaaatgattgcccctattttggacgaagtttccgaagaatacgcaggcaagctgacagttgccaaactgaacgttgatgatcacgaacaagcaccaaaagctcatggtattcgcggtattccaacactgatcttgtttaaagatggtgaaaaggccgcaacgcaagtaggtgctttgtcaaaaacgcaactgaaagcgtttttagactcacatatctaa

SEQ ID NO: 2667 - DNA, 1284 bp, Xenorhabdus bovienii
  Coding DNA location: Contig name=SeqID_16876; Position on contig =17535..18818bp; Strand=+
atgagcaaaacacatttgacagaaaagaagttttccgacttcgcattgcaccccaaggtcattgaagcccttgataaaaagggcttttccaactgcacgccaatacaggcgctaactttgccttttactgtcgaaggccgagatgttgcggggcaggcacaaaccggaacgggcaagacgctagcatttctgacgtctacttttcattatttactgacccatcctgctgcggcagatcacaaaaccaatcagccaagggcgctgattatggcccccacccgcgaattagccgtccagatttactctgacgcggaggagttggcagaagccacgggactgaaaatggggctcgcctacggtggcgacggctatgataagcagcttaaggttctggaatctggcgtcgatatcgtgattggcacaaccggtcgtttaatcgattacaccaaacaaggatatgtcaatcttaatgcggttcaggttgtggtactggatgaagcagatcgcatgtacgatttgggctttatcaaagatatccgctggctgttccgccggatgcctgttgccgctcagcgaatgaatctgctgttttccgctaccctgtcttatcgagtgcgtgaactcgcctttgaacagatgaatagccctgaatatgtagaagtggagcccttgcagaaaacggggcatcgcattcaggaagagctgttttatccttccaatgaagaaaagatgcgtctgttacagaccctgctggaagaagagtggccagatcgctgcatcatttttgccaataccaaacaccgctgcgaagatatctgggcgcatctggctgccgatgggcatcgtgttggtctgctgacgggtgatgttgcgcagaaaaaacgtctgcgtattctggaagagttcagtctgggaaatctggatattctagtcgccactgatgttgctgcccgcggtctgcatattcctttggtaacccatgtatttaactatgatctgccggacgactgtgaagattacgtccaccgcattggccgtacgggtcgtgcaggagagagcgggcattcaatcagtctggcatgtgaagagtacgctctgaatctaacgtcgatcgaagagtatatccagcatcagatcccggtaagcaaatataacagtgatgcactgctgatggatttacctgtacccaagcgccgtaaccgcgctcgttcaggaggacacccacgccgcaccaatatgtcgcgccgtggaaatccaactcgcaaccgtaaacatccaggctga

SEQ ID NO: 2668 - DNA, 1509 bp, Xenorhabdus bovienii
  Coding DNA location: Contig name=SeqID_16876; Position on contig =18827..20335bp; Strand=+
atgctgagttcttcttcgctctatgccgctatcgatttaggctcaaacagttttcacatgctggttgtccgtgaagtgtctggtagcattcaagtggtcacccgcatcaagcgcaaggtcaggctggccaccgggttggataaaaataatcatttatcacaacaggcaatggagcggggatggcagtgccttcgcctattttccgaatatttacaggatatccctgcctcgcagatccgcgttgtcgctacggcaacattgcgattggctgtaaattcggctgattttgtcgggaaagcctctgaaatattggggagtccagtcaaagtcatcagtggtgaagaagaagctcggctgatttatcaaggtgttgcccacacgacaggtgggtctgaaaagcgtcttgtggtggatattggtggtggcagtacagaattggttacaggcaccggagcaaaagccaatcagttgttcagccttgaagtgggctgtgtcacttggctggaacgctacttcaatgatcgcagcctgacagaagaaaactttgcacaggcagaatccgctgcccatcatattctcgcccctatcaccacaaccctgcttaagcagggttggcagatttgtgttggtgcctccggtacagtacaggcgttgcaggaaatcatgattgcacaggggatggatgaacttatcaccctgccgaagctacagcagcttaaatacaaggcgattgagtgcggcaagctggaagagcttgaaatcgacgggctgacattggaacgggcattagttttccctagcgggctggcaattttaattgccatctttcaggcactgaacatcgaaagcatgatccttgcggggggcgcactgcgtgaggggctggtttatgggatgctggatttacccattgagcaggatatccgtacaagaactctgtgcaatattcaacaccgttttcaactggatattgaacaagctctgcgcgtcaaacaactggccgaacatttttgtcagcaggtcgccacggtatggaatctggatgcacgatgtcgcgatttgttgaccagcgcctgtctacttcatgaaatcggcctgtgtgtcgattttcgccaaggcccggctcattcagcgtatctcatcagtcatttggatcttcccggttatacccccgctcaaaaacgattgctggcaacgctgttgaacaatcaaagcggccctgtcgatctggcctcactcagtcagcaaaatgccttgccaccgttacaggcacagcaattatgccgcttgttgcgtctagccattatttttgccagccgtcggcaagacgatactttgccggccttgcggctgcgggttgaaaatgagacgctcaccatcaccctgccctatcagtggcaaatgcagcatccactcagggctgaagccttacatcaggaaatccagtggcaaagttatattcagtggacattgttccttgaagagcagaataactcccatctcggataa

SEQ ID NO: 2669 - DNA, 2031 bp, Xenorhabdus bovienii
  Coding DNA location: Contig name=SeqID_16876; Position on contig =20383..22413bp; Strand=-
atgcgattaaatcctagtcaacaacaagcggttgaatttgtcacagggccttgtctggttctggcaggtgcaggctccggcaagaccagagtgatcaccaataaaattgcccacctgatccgtgcctgtggttatcaggcgcgtcatattgccgcagtgactttcaccaacaaggcggcacgggaaatgaaagaacgtgtcgctcagactttggggcgtaaggaaaccagagggctgatgatttcgactttccatactctgggcctggaaatcatcaagcgtgaatataaagcgctgggcatgaagagtaacttctcgctgttcgatgatcaggatcagagggtattgctgaaagatctgacggcggatttactggaagaagataaagatctactgcaaaaactgaactccagcatttccaactggaaaaatgatctgatgtcaccagagcaggtgattagacaggctcgttcggcgcaggagcatcaatttgcggagtgttatcgccgttatgatctgcatttgaacagttgcaacgttctcgactttgatgacttgattaccaaacctacgttgctgttaatgcagaatgaagaggttcgggaacgctggcaaaataaaattcgttatctgctggtggatgaatatcaggataccaacaccagccagtatcaattggtgaaattattggtgggcaatcgggcgcgttttactgtggtgggtgatgatgaccaatccatctattcatggcgtggtgctcgcccacaaaacttgatcctgctgaatgaggattttcctcagttgaacgtgatcaaactggaacagaattatcgttcatcagggcggatattgaaggccgcgaatattctgattgccaataatccccacgtatttgagaagaaactgttttcagaactgggctatggcgatccgctcagggtgatcgaagcgaataatgaagatcatgaagcagagcgagtggtgggagaattgattgctcatcactttattaataaaaccgaatataaagattacgccattctatatagaggcaatcaccagtctcgtatttttgaaaaaatgctgatgcaaaaccgtattccttatcgcatttctgggggaacttcattcttttcccgccctgaaataaaggacttactctcttatctgcgggtgttgaccaatcccgacgatgacagtgcatttctacggatcgtcaataccccacgtcgagaaatcggcgcggtgacaatccagaaattgggcgagtgggcaaatcagcgtaacaaaagcttgtatcacgccagtttcgatctcggtctggagcagagtcttacagggcgcgggttggctgccctacagcactttacccactggatggatgaaatttcccgccaggccgagcgtgagccattgctggcagtacgggatttgctgcgcggtatggactatgaaagctggctgtatgaaacgtcacctagcccaaaagcggctgaaatgcggatgaaaaacgtcaatcagctttttacttggatgagtgaaatgtttgaaggggatgatctgaatgaaccgatgaccctgtcgcaagttgtggcgcgttttaccctgcgagacatgctggaacgtggggagaacgatgaggaattggatcaggttcagctgatgacattgcatgcatccaaggggctggagttcccttatgtttttttggtgggcatggaagaaggtttgttgccgcatcaaagcagcattgatgaaaataatatcgacgaagagcgacgtctggcttatgtcgggattacccgagcacgacgagagctattttttaccctcagcaaagagcgtcgtcagtatggtgagctgattcggcctgaaccgagccgatttttgctggagttgccgcaggatgatttgcactggccgagaggcaaaaagatgatcagtgcggaagatcgaatgaagcaagggcaatcgcgtcttgcggatatcaaatcccgtttggggcttggtcagaaaaacagcgataaataa

SEQ ID NO: 2670 - DNA, 969 bp, Xenorhabdus bovienii
  Coding DNA location: Contig name=SeqID_16876; Position on contig =23378..24346bp; Strand=+
atgaaaagcttaatggatgtttccggtttaagtcactcattagagctaatgagtgcagagcctattgatgaagcaacgttaaggctcgttcacacagaatcttatttacagcgctttaagtacctgagcgataacggtggcggtacattggggtctgaagcgtcactgggtgcaggcagttatgaaattgccaaactgtccgcggggctaacctatgcagcagtaaaagccgtcttgcaggatgagctggataatgcctacagtctttctcgtccccccggccatcattgcctacccgatcaagccatgggcttctgtttcctcgccaatatttctcttgcgattgaaaaagcaaaagagcaacttggccttggccgagtagcagtcgtcgactgggatgtgcaccacggcaatggaacacaacatatcttttggcaacgggataatgtactgacaatttcactgcatcaggatcgctgctatccggcaggttacagcggcgaaagcgatatcggtgaaggtccgggtgaagggttcaatatcaatattccactgatggctggggcgggtcatgacagctacatgtatgccatggatcaaattgtgataccggcactgcgacgctaccagcctgagttgattatcattgcctgtggctatgatgccaatggctttgatccgctggcacggatgcaactgcatagtgacagtttccgcgagatgacccgcaagatgcagcaaatggcggatgaactctgtcatggcaagctggtgatggtgcacgaaggcggttattccgaagcttatgtgcctttctgtggcttggccgtaatggaagaattgtctggcgttcgcactgaagtcattgatccggctcttgccatgatggaattgcagcagccgagagcacattttgaaactttacagcgtcaggcaatcgatgatctgaaacaacagcttagtctgtaa

SEQ ID NO: 2671 - DNA, 1479 bp, Xenorhabdus bovienii
  Coding DNA location: Contig name=SeqID_16876; Position on contig =24432..25910bp; Strand=-
atggctaattattttgatacgttgaacctgcgccagcaattagcgcagttaggcaaatgtcgttttatggtgcgggaagaatttgctgacgaagcaggatatttaaaaggcaagaaagtggtcattgtcggctgtggtgcgcaagggcttaatcagggtctaaacatgcgtgattctggtttggatattgtctatgcattgcgtcaagcagcgattgaagaaaaacgtgcatcatggcgtaaggcaacggaaaacggcttcaaggtcggcacctatgaagagttgatcccacaggccgatttggtcattaacctgacgccagacaaacagcattctgcggtggttcaggcagttcagcctttgatgaaagaaggtgcagcactgggatattctcacggttttaatatcgtggaagtgggcgagcaggttcgtaaagacatcaccgtcgtgatggttgcgcctaaatgcccaggtacggaagttcgcgaagaatataaacgtggtttcggtgtccctactttgattgccgtgcatccagaaaacgatgtgaaaggtgaaggcatggccatcgcgaaagcatgggctgccgcaacggggggtcatcgcgctggtgtgctggaatcttctttcgtggctgaagtgaaatcagacttgatgggcgaacagaccattttatgcggtatgttacaggcggggtctctgctttgttatgacaagctggtggcagagggaacagagccgggttatgccggtaagctgattcaatttggctgggaaaccatcacggaagcattgaagcaaggcggtataacattgatgatggatcgcttgtccaactcagcaaaactgcgtgcttatgccctttccgagcagttgaaggttattttagcaccgctgttccagaaacatatggatgacatcatttctggaacgttttcttctaccatgatggcagactgggcaaatgacgataaaaacctgctgacttggcgtgcagaaacaggccagacaccattcgaaaactacccggatcacagcggcaatatcagcgagcaggaatactttgatcatggcgtgctgatgatagcgatggtcaaagctggggtggagctggcgtttgaaactatggtggatgccggcattattgaggaatcagcctattatgaatcgctgcatgaactgccattgattgcgaataccattgctcgtaagcgtctgtatgaaatgaatgtggtgatttccgatacggcggaatatggtaattatctgttctctcacgttgcggttccattactgaaagagaaatttatggctaccttgcaggcaggggacatgggtaaacccgtggtagacagcagtatcgacaatgcccaattacgtgatgttaacgaagcgattcgtcaccatccgattgagactattggtcgtactctgcgtggttatatgaccgatatgcaacgcattgcagtgggtggataa

SEQ ID NO: 2672 - DNA, 882 bp, Xenorhabdus bovienii
  Coding DNA location: Contig name=SeqID_16876; Position on contig =26056..26937bp; Strand=+
atggatatacgcgatttaaaactgtttttacatcttgcagaaagttgtcactttggacgcacggccaaagctatacacgtcagtccatccacactttcacgccaaatccaacgacttgaagaactattagggcatccgttatttctgcgggataaccggacagtcaagctcactttcgcaggtgaacagctaaaacaatttgcccaacagacgcttctgcaatatcagcagttacgccattcattaaatcaccagagtccctcattgagcggtgaattacgcctgttctgttcagttacggcggcttatagccatctcccgcaggtgctggataaatttcgggcagagcaccctttggtagaaataaagctgacaacgggagatgccgctggtgccgtcgataggatccaatctgaccaagccgatttaggcattgcaggcaaaccggagaaactgccccataatgtcagttttaccaagataggcgaaatccctttggtattgattgccccttccctgccttgtgctgtgagaacacttgccacacaggaacaacctgactggaattccattccttttattctgccggaacatgggccttcacgtacacgcatcgaactgtggttccgccggaataaaatccctaatcctttgatttacgctaccgtttcaggccatgaagccattgtttcgatggtcgcgttaggttgcggtatcgcgctgatcccggcggttgtcgtcgaaaatagcccagaacctgtacgcaatcgtatatccctattagagaatattgcgctggtcgaaccatttgaattaggcgtctgtacgctgagtaagcgcttacaggaaccattggttaaagcattttgggggatgttgtga

SEQ ID NO: 2673 - DNA, 1548 bp, Xenorhabdus bovienii
  Coding DNA location: Contig name=SeqID_16876; Position on contig =27004..28551bp; Strand=-
gtggcagtttatcctcttaatgctgagccaaagggagcggaatacctcaaagccgccttgagtgcaccggtttatgatgtcgcccaggtcaccccgctgcaagaaatggaaaaaatctctgcccgtttagcgaataccattttagttaaacgggaagatcgtcagttagtacacagtttcaaactgcgcggtgcatacacgatgatcgcgggtttgactgaggagcagaaagctaaaggcgtgattaccgcttctgcgggcaatcatgcgcagggggtggcactttctgccagcaaagtgggtaccagagccatcatcgtcatgccgattgctacagcagatatcaaagttgatgcagtccgcagttttggtggtgaagtcctgttatacggtgctaattttgatgaagctaaagcaaaagccatctcggtggcaaaagagcacggttatacctttgtaccgccgtttgatcaccctgccgtgatcgcggggcaggcaacactggcaatggaacttttacagcaggatgtccaccttgatcgcatttttgtgccggttggtggtggcggtttgattgcgggtgttgcagtactgatcaaacaacttgtaccggaaatgaaagtcatcggagtggaggccgaagattctgcgtgtctgaaagcggcactggaagcagggcgcccggttgacttaccgagagtggggctgtttgcggaaggcgttgcagtcaagcgtatcggtgatgaaacattccgtttatgccagcagtatgtcgatgatgtcattacggtggatagtgatgccatctgtgccgccatgaaagatatttttgaggatgttagggcgattgccgaaccttccggtgctctggcactggcgggtttgaagaaatatgtacagcagcatcagattcagggagaaaggctggcgcatattctctcaggtgccaacgtgaattttcatggtctgcgttacgtttctgaacgctgcgaactaggagaacagcgcgaagcattactggctgtcacaatacctgagcaaaagggaagtttcttgaacttttgccagacgttgggaacgcgtgttgtgaccgaatttagttaccgttattcggatgcgactaaccctgctgaagcctgtatttttgttggtgtacggctgaatcgtggcaatgcagaacgtcttgaaatcatcaatgagttgaaagcatcgggttatcaggtcgctgactttaccgatgatgaaatggcaaaactgcatgttcgttacatgatcggtggccgtcctgccaagccattacaggaacggctatacagtttcgaatttcctgaatcgccgggagctttattaaagtttttgcagacactgggaacacactggaatatcacactattccattaccgcagccatgggatggattacggtcgcgtattggctgcctttgaactttcaggtgcggaagtgcgttttgatcgccatcttgatgatttgggttatgaataccatgatgaaacgaataatccttcttttaacttattgttgaaatag

SEQ ID NO: 2674 - DNA, 1851 bp, Xenorhabdus bovienii
  Coding DNA location: Contig name=SeqID_16876; Position on contig =28554..30404bp; Strand=-
atgcctaaataccgttctgccacgacaactcatggccgtaatatggcgggagcacgagccttatggcgtgcgacgggtatgaccgatgaggattttggaaaacctattattgcggttgtgaactcatttactcagttcgtgcccgggcatgttcacctgagggatttaggaaaactggtagcagaacagattgaggcatcaggaggcgttgcgaaagagttcaacacgattgcagttgatgatggtattgcgatggggcatggcggaatgctctattccttgccttcgcgtgagttgattgctgattctgtggaatatatggtcaatgcccactgcgcggatgcgatggtgtgtatctccaactgtgacaaaatcacgccgggcatgttgatggcatcaatgcgcctgaatattccggttatttttgtttctggcggcccgatggaagccggtaaaacccgcctgtctgatcagatcatcaaactggatctgattgatgcgatgattcagggagccaatcccaatgtcagtgatgaagaaagcaatcagatagaacgttcagcttgtccgacgtgcggttcctgctcaggcatgtttacggctaactccatgaattgtctgactgaagcattggggctttcgcagccgggtaatggttcactgctcgccactcatgcggatcgcaaagcgctgtttttaaatgcgggcaaacgcatcgtcgagctgaccaaacgctattatgagcaaaatgatgatagcgctttgcctcgtaacatcgcgaccaaagctgcctttgaaaatgcgatgatactggatattgcgatgggcgggtcgaccaacacggtactgcatctgctggcggcggcgcaggaaggcgacgttgatttcactatggcggacattgatcgtttatctcgtctagtacctcatttgtgtaaagtggcaccaagcacccagaaatatcatatggaagacgtacatcgcgcagggggagtcatcgggatcctcggtgaactggatcgtgcggagcttttgaatcgtgatgtgaaaaatgttttggggctggatctgccgcaaacgttggctcagtacgacatcatgctgacacaggatgaaggtgttaagagcatgtattctgcggggccagcaggtattcgaaccactaaagccttttcgcaggattgccgttggccgtcattggacacagatcgcaaggaagggtgtatccgtgaacgcactcatgcttatagccaagatggtggtttggcagtgctgtctggtaacgtcgcggctaatggctgtatcgtaaaaaccgctggggtggatgaaggaagcctgacttttcgtggcccagccaaggtttatgaaagtcaggatgatgcagtagaggcgattctgggaggcaaagtcgttgcgggtgatgttgtggttatccgctatgaaggcccgaaaggcggtcccggtatgcaggaaatgctctatccaaccacctatttgaaatcgatgggactgggtaaaagctgtgctcttatcactgatggtcgtttttcaggcggaacatcagggttgtcgattgggcatgtttcccctgaagcggccagtggtggtgtgattgggttggtttatgatggcgatatcatcgacattgatattccgaaccgtaaaatccatctggatgttaacgaaacagaactggcagtacgtacacaggctgaactatctcgtggagatcaggcatggacacctaaatcccgcgatcgtcaggtctcttttgccctgcgtgcttatgctttactggcgaccagtgccgataaaggcgctgtgcgcgataaagcaaaattagggggctga

SEQ ID NO: 2675 - DNA, 927 bp, Xenorhabdus bovienii
  Coding DNA location: Contig name=SeqID_16876; Position on contig =30491..31417bp; Strand=-
atgacaaagcaagctgattatatttggttcaacggtgaaatggttccttgggccgatgcgaaagtccacgttatgtctcacgccctgcattacggaacttccgtatttgagggcgttcgttgctataactctcacaaagggccagttgtttttcgtcatcgtgaacatatgcggcgtttgcatgactcagccaagatttaccgtatgcccgtgagccagagtgttgatgaattaatggaagcctgtcgtgaaacactccgtaaaaataaattagtcagcgcttacattcgcccattggtttttattggtgatgttggaatgggggtcaatcctccagacggttataaaacagatatcattattgcggcttttccatggggggcttatttaggagaagaggcgctggatcagggtattgatgcgatggtttcttcatggaatcgtgtggcagcaaatacgatcccaacaggggcaaaagcaggtggtaactatctttcctctctgctggtgggcagtgaagcacgacgccatggctatcaggaaggtattgcactggatgttcatggctatatttcagaaggtgcgggggaaaacctgtttgaagtgaaagatggggtgctgtttacgcctccatttgcgtcatcagcgctgccggggattacccgtgatgccattatcaagctggcgcaggatcttggtctggaagttcgtgaacaaatacttacccgtgaatcgctttatttggctgatgaagtatttatgacggggacagcggcagaaatcacgccggttcgtagtgttgatggcattcaggtgggtattggtaaatgtgggccaatcactaaaaaaatccagaatgccttctttggcttatttgatggtacgacagaagataaatggggctggctggacgccgttaatccttaa

SEQ ID NO: 2676 - DNA, 258 bp, Xenorhabdus bovienii
  Coding DNA location: Contig name=SeqID_16876; Position on contig =31442..31699bp; Strand=-
atgatgcagcatcaacttgctattcaggcccggttttgtcctgagattttggaacgaattctgagagttgcccgtcatcgtggatttcagatatgtgctttgaatatggatcatacaacagatagtgataatgtaagcattgaactcacagtcgccagccaacgctctgtaaatttacttttttctcaactgatgaaattagtcgatgttgctggtgttgagatccgaaacaaagaatcacaattaataagcgcataa

SEQ ID NO: 2677 - DNA, 1647 bp, Xenorhabdus bovienii
  Coding DNA location: Contig name=SeqID_16876; Position on contig =31696..33342bp; Strand=-
atgaacggggcgcaatgggttgtacaagcattacgaacacagggagttgaaaaggtttttggttatcctggtggagcaatcatgccggtttatgatgcgctgtatgacgggggaattgaacacttgttgtgtcgtcatgaacagggagcggtgatggcagcaatcggctatgcaagggcgaatggtaaacccggggtttgcatcgcgacatcagggccaggggcaacaaacttaatcaccggattggcggatgcgctgctggattctgtcccagttgtggctatcactggtcaggtgagttctgaattgattggcactgatgcctttcaggaaatcgatatgttggggctttcccttgcttgtacaaaacacagttttctggtcgattcgctggataaattaccccaggtcatagctgaagcctttaccatagcaacaagtggccgccccggccctgtactgattgatttaccgaaagatattcagttagctcaaagcgatttagcgccttacctgatacctgttgtgtccgaatctttcctccctgaacaagaattggaacaggctcgttacatgatgcccatggcccaaaaacccattttgtatgtaggtggtggtattggcatggctgatgcagtacctgagctgcgacgttttgttaccgaaacaggattacccgttgtttctacgctgaaaggcttgggagctgcggatgccgagcatgaatgttatttggggatgttggggatgcatggcacaaaggctgccaatcttgctgtccaatcctgtgatttattgattgccgttggagcccgttttgatgatcgcgttacagggaaattaaatacttttgccccccatgccaaagtgatccatgtagatatcgatcctgttgaattcaataaattacgtcaggcacatgtttcattactggggaatttaaaaacattgttgccccacttacagcaacctttatcgatcgaatcctggcaacaggaagtcaaaaaattaaaaaacgaacatacatggcgttatgactatcaaggcgtaagtatttatgcgccatcactattaaaacaggtgtctgaacgcaagccatccaacgcggtaatcacaactgacgttgggcagcatcagatgtggacagcgcagcatatgacatttgatgggccggaaaatttcattacttccagtggattaggcacgatgggctttggcattccagcggcgattggcgcccagatggctcgtccggaagatatggtgctctgcatatccggtgatggttctttcatgatgaatgtacaggagttaggtaccatcaaacgtaagcagttaccgatcaagattattttattggataaccagcgtctgggcatggttcggcagtggcaagaactgttttttgacaaacgttatagcgaaacgatcttaaacgataatcctgattttattaccttggcaaaagcttttgatattcctggtcagcaaatcactgatgaaacccaaatcaatgcagcactggatgctttgttcagcagcgaaggtccgtatttattacatgtatccattgacgaattagagaatgtctggccattggttccaccaggctcaagcaatgcaaccatgttggagaagtcattatga

SEQ ID NO: 2678 - DNA, 1527 bp, Xenorhabdus bovienii
  Coding DNA location: Contig name=SeqID_16876; Position on contig =34155..35681bp; Strand=+
atgacactcgccgtcatttatactcgagcaacaataggcgttgattcccccattgtcacgatagaagcacatatcagtaatggcctgcctggcttaacgcttgttggtctacctgaaaccaccgtcaaggaagcgagagatcgggtcagaagcgcgttgctcaacagcggttttacttatccaccaaaaaggatcaccgtcaatctggcgcctgccgatctccctaaagagggaggaagatatgatttacctatcgccatcgcgattttggcagcatcagaacagataccgacagataagctgcataattatgaatttttaggggagttagcactgtctggcgaaatacgccgagtcatgggtgccatccccgccgcactgagtgcgaaaagagcaggaagacaattgattttgtccatagaaaatcaagctgaactggctatcttatcccagaatgaaacattggtggccaatcacttacttcaagtctgccacttcctgcgaggagaaaccgccattttatcctccccacctcccattacgttacaggctgaccctcttgttttagatatacgggatattatcgggcaagagcaagccaagcgtgcactggaaattaccgccgctggaggtcataatcttcttctacttggccctcctggtacaggtaaaactatgctggccagccgattgtgtggcttactaccacccttaacgcatctagaggctctagacgtcgctgcaatcaacagcctaacgggtaactcggttaatcctcaaaaatggcatacacgcccatttagagcgcctcatcacagttcatcaatggcagctctcgttggtggaggttcaattcctaaaccaggggaaatttcccttgcgcataatggtatattatttttggatgaattgcctgaattcagccgaggtgccctggatgcgctacgtgagccattagaatccggcgaaatagtcatatcccgtgcaagagcgaaagtctgtttccctgctcaagtccaactaattgctgccatgaacccaagcccaacgggatatcaccaaggattgcacaatcgcagtagcccacagcaaatattacgctatctctccaaattatcaggtccttttctagatcgttttgatctctcaattgaagttcccttacttcctccaggtatcttaagccagtcatcagaaaaacatggcgaaagtagctatgaagtcaaaaaacgggtactaatcgccagaaaagtgcaaatagaacgatgtggacatgtgaatgcttatctcaatcgcaaacaaactgacagcgcctgtaaacttaagatggaagattcaatttttctggaagatacactactgaaattaggcttatctgttcgtgcctggcaccgaatactcaaagtttcacgcacgattgcagacctgaaagaacaaaaaagaatagaaagaccagatattatggaagcactcagctaccggagcatagataggttacttattcaactacagaaacaagcagggtaa

SEQ ID NO: 2679 - DNA, 339 bp, Xenorhabdus bovienii
  Coding DNA location: Contig name=SeqID_16876; Position on contig =35738..36076bp; Strand=-
atggctgaaagcttcatcacgactaatcgtttttttgataatagaaattatccacgcggattttcccgtcatggtgatttcaccatcaaagaggcccaattgctagaacgttatggccatgcgttcaatgaattggatcttggtaaacgtgaacctcaaacagaagaagaaaaactgtttgttgccgtttgccgaggtgagcgtgcccctgcaacgacagaggaaaaagtatggataaagtatttggcaaaaatcagccgtccaaaacgttttcatactctttccggcggaaaaccgcagatagattctgcagaggactataccgatactgatgattaa

SEQ ID NO: 2680 - DNA, 837 bp, Xenorhabdus bovienii
  Coding DNA location: Contig name=SeqID_16876; Position on contig =36193..37029bp; Strand=+
gtggacactgaattactgaaaacctttttggaagtcagtaagactcgccactttggtcgggcagctgaatcactctatctaacacaatccgctgttagctttcggatccgccaattagaaaatcagctgggtaccaatttatttacacggcatcgcaataatattcgcctgacagccgcaggggaacgtcttttaccctatgcagaatcactaatgaatacttggcagttagcaaagaaagaaatcagttatgtctcacagcatacagaactctctatcggtgctactgcgtccctatgggagggctacctgatatcttggctgaatactttttatcagcatcatcaagggatgagagttgaatctcgcgtttctacacgccaaattctagtcaaacagctacactcccgtgaattagatctcttaatcacgacagaaccgcctaagatggatgaattccaaagtcaattgatcggtaacatccagctcgttttattgacaacgcaacataatcttaaacaaggcgtagaaaattacatcaagttggagtggggagctgattttcaccagcaagagcaacagatcttaaaaaatgactatccgccgatcattacaaccacatcagcacatattgcccgagaattgctaaatagcgtaaatgctgcagcctttctgcctattcattggcaggaagattatcctaagctggtgacgtcacctaatagagaacaaatcaaacgcccattatatgcggtatggttacaaaacagtgatcaacaaacatttattcagcagttgttaaaaattcctgtcgaaaaagcgcctataacaagctaa

SEQ ID NO: 2681 - DNA, 883 bp, Xenorhabdus bovienii
  Coding DNA location: Contig name=SeqID_16879; Position on contig =48..930bp; Strand=+
atggggagggattttagtgtcaaatcgttgggactaggtattgtagaaaacctcggtttggcggaaaccaaaaaccaagcacaaaatgcgttgccacgcagtgggggcgaagtcaccggtgatatcacgatttctactgacagtgagatagcttggcgcaaaaatacagatatggccgcaattggttttaaaaacaccggagatggtgataccgattcttatatgtggtttaaaaccgcagataatggtaacgagtatttcaaatggcagcatagcctctctgggggaggaaccaatgagtggatgagcctgaaatcagataatctccgagtgaaagggcatcaggtttaccatgaaggatataaaccaactgctgcgattgttggcgcttatacaaaatcagaggctgaaagcaaatatcagccgaaaggaaattatgccgttcgtggggaaaattacacgaaacaggagtctgatggcaaatatcaaccccgaggtaactatcaacccattggtaattatatattgaggggagattgttataccaaaggggaatcagacagccgatatttatcatttcaaaatagaagtccccgcacagttttatctggtgttagcctaaatgatggggaaacagccaatttaggtgtagattgccgagggaaagttatgtgggtatggtgtacagaacgtgaatttccagccgcaatgacagtgataccgatagataactatggagtatcaactcactatggatatcaagcctccattgatttaacactcatcaatggcggtagaactattaaagttatttttacgcgaaaagatacacgattatgggcgtatagacatttgggattaggttttaattttaagggggtat

SEQ ID NO: 2682 - DNA, 339 bp, Xenorhabdus bovienii
  Coding DNA location: Contig name=SeqID_16880; Position on contig =151..489bp; Strand=+
atggcgaatacggaaaaagaaaaatttgcccagattaacctcggccaacggctagaagggttgaaccatttgtcgcggatcagggcaatatactggggtgacgatgaaaaagagttaaaccggttttttgctgatatgcgcgacaaaaaggacagttattacgaagagaacaagcgggcattatccgccattttttatttggcaaatattccgcgtgtacgccacgagagtgagcttgaacattttacccaagaggaaaaacaggctctgatcaaagcaatgaatcatattaaagtcgttgtcagtcagtttccgaagtacttgaagttatctaagtaa

SEQ ID NO: 2683 - DNA, 1992 bp, Xenorhabdus bovienii
  Coding DNA location: Contig name=SeqID_16880; Position on contig =568..2559bp; Strand=+
atgaatagtggttttatcactactgaacataacggtgattatcctattgccaaaggcagacagtctggcctgtttcagccaggcataccgcagggtgtgtcaatggctgaacgtttattatgggaagtcaacgcggaagatcaccaatggcgccaccagtatatcgggcagatgccggattttctggcaaagtatttcagccgccgttatgttggcatctttaaccattcaggccgccgcgatgcgaacgcctttctgagaagaacggttggacaaaatgtcttgccacggttgcagttggttaaggcaagatattcattcacccatcatatatcaggcataacaccttttccttttattgagcaattggaaaaggtggtgacatgcgatcgcaaacagcttttgaaactcgctcatgaaatatctatttttattgcaggcaactatgagcattattccttgcagtcttctcaacaatatcaagctgcgccggttgacagtgaaagtgaattgttcccccgtgtcgctaagttataccaattactggcgaagctgactttgcaatgtggtacaaatcctccttactggcagcgttttaatcatggacgtaaagtaccgtctgttgatcaactttgtgctggtatgttgcggatgatgtctgcccgctggtggtattttcggttaaaacgtctgcgtgaaatccagtctgagcatatggcaattgcggttgggcaagtacaaaaagccgcatcgccttatgtttcgaactatgccttgcgtgaatggttggaacagaaacgccgtaaccgtgagtttttcaaacattttgatttggaaaatgagaacggagaacggatttcgctggcggaaacggtggttcatagtaatgcgaatcccgctattcgacgttgtgaattgatggtcagaatgcgcggttttgaagatgtcgccaacaaaatgggatgtgttggtgaattctataccatcacggcgccggcaaaataccatgcggttcagcatcagggcgggtttgtcagacattggaatggcgcgacgccccgcgatactcaacgctacctgtgtggcatatgggcaaaagcccgtgccgcaatcgcccgtgccggcattaatctatttggtttcagagtggtggaaccgcaccatgacggcactcctcattggcatattctgctgtttatgctgccggaacatcagtggcaggtcagggcgatccttgagcattacgcttgccaggaagagaaagctgaattgcagcgcgatgatgccaaaaaagcgcgttttgattacagaacgatagatcctaataaagggagtgcgacaggctatatcgctaagtatatatccaaaaatattgatggttatgcgctggaagatgaaaaagatcatcaaaccggggcacctctgcgcgatatggcgaaatcggtgacggcatgggcgagtcgctggcgcattcgccaatttcagcaaatcggtggagcgccggtttccgtttggcgagaactgcgtcgtcttggggaagtgcgtttaacggataacaaagtcaatgcggttttgcaggcagccgatgaaggcaattgggcagcttatattcaggcacagggtgggccgtgggttgctcgtcgtgatctagttattcgtttgtcttataaacacatcccgtttggtagcccttatggagaagatgtttacaccatacaaggagtgacatcaccatttctatcatgtgtggaatttatctgcacacgtattcaccaatggactattgtaccgaaatttgatgctgctccgacatcaggacatattgtctataaaagaaacactaaatggccctcttggagttctgtcaataactgtacggatggacaggtagataggtcaatgaagaggtatgtaaactaccggattgatgaggatgataaaataatcaatatggcaaatatttctgcaaaaacagtacataataggtattaa

SEQ ID NO: 2684 - DNA, 225 bp, Xenorhabdus bovienii
  Coding DNA location: Contig name=SeqID_16880; Position on contig =2662..2886bp; Strand=+
gtggactctcttatggaatcattggtagcgcaacgtattaattttattgccagaatggcaacaagttgcgaatgcaatcatgcggaagacaaagaactggcgttggtctggatagctgagttatctgcacctcatgaaaatcgacttaatgtccatagaagtgacttagaaaataatttattgatcgagaaagcgttaagaaattcaggttcaacagacgaataa

SEQ ID NO: 2685 - DNA, 237 bp, Xenorhabdus bovienii
  Coding DNA location: Contig name=SeqID_16880; Position on contig =2905..3141bp; Strand=+
atgagagtggagatacttttcgataaacgagctaatgtttctgaatcagtgatgtctgcacttgaaagtgaactgaaaaaaagaattttaccgcagtatcccgatacgcattttagaattgcagttagcagcagtagctccgtaagagtgacaggaaccaaagacagtagtgaacatgaccagatgatggaacttattcaaagcgtctgggaagatgatagctggctgccagattaa

SEQ ID NO: 2686 - DNA, 204 bp, Xenorhabdus bovienii
  Coding DNA location: Contig name=SeqID_16880; Position on contig =3377..3580bp; Strand=+
atgcaagttatcgcacaacaaaatgagacggttgatgccctgtgctggcgtcattatggccgaacgctggggatgacggaacgtgtgctgttgtcaaaccccggattggctgcttttggcgcggtattgcctcatggaacgaaagttgaaatgccggagttcatgcccgctgccaccaagccgattatccagctttgggattaa

SEQ ID NO: 2687 - DNA, 276 bp, Xenorhabdus bovienii
  Coding DNA location: Contig name=SeqID_16880; Position on contig =3590..3865bp; Strand=+
atggataaatacagtcacgcaacttatgcctgcgccagtatcacagccattttttctggcctttctttatatgagtggagttttctgctcggggcgttcgccagcatttccctcggtatcctgacttatcgacttaaccgtcgggagcagatgaaacgtaccttgattctgaaaaatatcctgaaaaacatcctggaaaatctggatatcgagtctgcgtcgaaatcagccaagatagtcagcgagctgatacatcacgcaccaagagagctgtga

SEQ ID NO: 2688 - DNA, 540 bp, Xenorhabdus bovienii
  Coding DNA location: Contig name=SeqID_16880; Position on contig =3867..4406bp; Strand=+
atgcaggatatcaaaaccagactcagtcgggtggttattggtcttattattggtggcgccagttcttctgtcattctttcgcagtttttggatgagaaagaaggcaatcgactgtctgcctatcaggatggcggcggcatctggacaatatgtcgcggcgtgacgcgcattgatggcaaagtggtatataaaggaatgaaactagcgcctgaacaatgtgatgttttgaaccggatcgaagccgacagggcgattgattgggtgaaaaagaacgtccacgtcccgctgactgagccgcaaattgccggtattgccagtttctgcccgtataacatcggccccggaaaatgtttttcttccaccttttatcgcaagctcaacgccggcgataaaaaaggcgcatgtgcagagatcaaacgctgggtctatgacggcggacgtgactgtcgaaaaacccaaggacagccgaatggctgttatggccaggttctgcggcgtgatcaggaggctgaactggtttgctggggattaaatcgatga

SEQ ID NO: 2689 - DNA, 501 bp, Xenorhabdus bovienii
  Coding DNA location: Contig name=SeqID_16880; Position on contig =4403..4903bp; Strand=+
atgaagaaagtacctttacttgtcagccttgtcattgggggatgttttggctggtggggacaccgttcactgttcctcagtgaagtgacgggtttgaaacagcaacatgctgctcaaattgttactatcagtcagaaagcacattcggagacgttggccgccatccaacagatgaagaatgcacagagccgggttgcgcaattggatgattattattcaggaaaattaacctatgttaccgaagaaaatgccgctttacgcgctgacattgccgctggtcatcgtcgggtgcaaatcgccgccgccaaccttgctacctgtcagctcacccaaaaccgagataccggctcccgcagcgtgggcgatgaaacccaagtcgaactcactgcaaaagctggacgtgctatttacgatatccgagccggaatcatcagcgatcaggccaaattagattacctgcaacagtatgtacttgaagtcgttcgtcaatgtaaaccgtaa

SEQ ID NO: 2690 - DNA, 636 bp, Xenorhabdus bovienii
  Coding DNA location: Contig name=SeqID_16880; Position on contig =5072..5707bp; Strand=+
atgaacacacaactcactgaactgctgcgcttaatgcgcaacctgatccgaaccggcgtcatcacccaagtggacaccacaaagggtatgtgccgggttgcaacaggcaaccttgaaaccaactggctgaactggttgacatccagggcgggaaactcccgcacttggtgggcacccagtatcggtgagcaggttttattactgtccataggcggagaactgaccaccgcctttgtattgcctgcgattttttcagatgagtttccggcgccatcgacatcatcagaagcgacgcatatccagtttccggatggtgcagtgatggaatatgaaccgcaatcaggcgcattgactgtgaccggcatcaaaaccgcgacagtgactgcttcggattccgtccatattaccgcaccggaaatcacctgtgtcgccagtaccagaatcacactggatacaccggaagtcatctgtacacagctaatgagcacggggaatttgatcgtgcgcaatggcggcaaaatgacgggcaatattgaacacaccggcggcacattcagttccaacggcgtggtcgtggattcccataaacacaccggcgtcaggtcaggcggtgacacatcaggaggccccgtatga

SEQ ID NO: 2691 - DNA, 348 bp, Xenorhabdus bovienii
  Coding DNA location: Contig name=SeqID_16880; Position on contig =5707..6054bp; Strand=+
atgtatctgggaatgaatcggcagacgggccgagaactgacagatctggctcacgtccggcaatccgtcagcgatattttattaacttccgtgggcagccgcatagcacgccgtacttacggttcgttgctgccagaactgatcgattggccacagaacccggcgctccggcttcaggtcatggcggccagctataccgctatcagccgttgggagccacgtgtgatgcttacgtcaatcacaatggagacccggcagaacggtgaaatggtggtggatattgcgggaacttatcatcaatccgccaaagaattttcactttctattccggtgagccattcccggtga

SEQ ID NO: 2692 - DNA, 909 bp, Xenorhabdus bovienii
  Coding DNA location: Contig name=SeqID_16880; Position on contig =6063..6971bp; Strand=+
atgccaacaatcgatttaagccagttgccaccaccggatgtggtggaaccactagattatgaacaactgctggaagagcgcaaagaaggattgatctcgctctatccagaagaacagcaggatgcgattgcacgaactctgcaactggaatcagaacctttggtcaaattgctggaagagaacgtttatcgcgaattgctcttgcgtcaacgcgtcaacgaagccgcccgtgcggtgatggtggcctattcgacaggtagcgatctggatcaattaggtgtgaacaataacgtagcccgaatggttttgagccctgcggataactccaccgtaccaccgacaccagcgctaatggaatctgacaacgactaccgtgttcgcatcccacaggcttttgaaggtttgagtgtggctgggccagttggttcctatgaattccatgcccgcagtgcggacggtcgggttgctgatgcttcggctatcagcccgtcaccagccaatgtcaccgtgaccattatgtcccgtgaagataaaggcgtggcatcgaaagagctgctggataaagtcgaaaaagcgctgaacgacgaaaacgtacgtccggtggcggatcgcctgcaagtccagtcggcgagtattgtggaatatgaaattgatgcggtgctgtatatcttcccgacaccggaatcagaaccgatccgcaaagcggctgagcagaagctgaaatactacgttgaagcacagcatcgtctggggcgtgacattcgcttgtcggcaatttatgccgcattgcatgtggaaggcatccagcgtgtggagttgaaagccccgctgaaagatgtggtgctggataaaactcaggtgtcttactgcaccaaaaccacactgatgatgggaggttcagatgaatga

SEQ ID NO: 2693 - DNA, 609 bp, Xenorhabdus bovienii
  Coding DNA location: Contig name=SeqID_16880; Position on contig =6964..7572bp; Strand=+
atgaatgatcgccttctgccgatgggctcaacccagctagaacttgctgcggccaaagcctgtgccgagttgcagaagattaaagtgccgctgcgtgaactgtggaacccagacacctgtccggcaacgttgctgccttatctggcatgggcgtggtcagtggatcgctgggacgaacactggtcggagagcatcaaaagagaagtgatcaaaagctcgctattcctgcataaacataaaggaacgattggtgcaattcggcgggtcgttgaaccgctggggtatctcattcgcgtaaaggaatggtggcagaccaatgatgtaccaggcaccttccggctggatattggtgtattggaaaacggcatcacccatgaaatgttcgaagaactggaaaaactgatttctgatgccaagccagtcagccgacatttgattggattagacatcaatctggatacacgcggtgagtattactactcggcagccagttacagcggtgacgagctgacggtttacccctatttcccagaacaagtaacagtatccggctcagacgttgtgggtatgggcatacatattattgatgacatgaggattagaccatga

SEQ ID NO: 2694 - DNA, 1953 bp, Xenorhabdus bovienii
  Coding DNA location: Contig name=SeqID_16880; Position on contig =7569..9521bp; Strand=+
atgagtaccaaatattttgcgctgctgacgcagctaggcgcagataagttggcgaatgctgcggcattgggtacaaaaattgaaatcacccatatggccgtcggtgatggtggtggcagcctgccaacaccagatactaagcagaccaaactgattaatgaaaagcgtcgtgcagcgatcaatacgttgagcatcgatcccaaaaacactaaccagatcatctctgaacaggttattcctgaaagcgaaggtggctggtggatccgtgaaatcggcctgtttgacaaagatggcattctgattgctgtcgggaactgcgcggaaagctacaaaccacaattacaggaaggttccggccgtacccagacaatccgcatgattttgattgtcagtagtaccgagtcggtgaccttgaaagttgacccgtctgtggttctggcaactcgcgaatatgttgatgactccattcagaagcattcgaacagccgtaatcatcctgacgcgacactgaaagagaagggatttgtcatcctgagcagcgcagtggatagcaacagcgaaacccatgcggcaacaccgaaagcggtgaaggcggcatatgactttgctaatgcggcgaataataatgccaacggtcgagtgccatctggtcgcaaggtgaatgggaaagcattgtcggaagacatccgtcttaaggcttctgatgtagatgcatataacaaaactgaaaccgatgcacgggtgaatgatgccaaagcgcaggcgaaagctgcgaatgataatgccgatggccgcgttccaacggggcgtaaggttaatggtaaggcgctgaatgcggatatttcgctgaattctggggatgtgggtgcatattccaaaggcgagacagatattcgggttgatggagctaaagagcaggctaaagcagcaaatgaaaatgccaatggccgtgtgcctgcgggacgtaaggttaatggtaaggcattaaatgcggatatttcgctgaattcggcagatgttggtgcatatagcaaagacgaaacagatacgcgggttgatgaagcgaaagcgttggctaatgctcgtctggagaaaaaccagaatggcgcggatattccgaacaagccgaagtttgtagaaaacctcggtttggcggaaaccaaaaaccaagcacaaaatgcgttgccacgcagtgggggcgaagtcaccggtgatatcacgatttctactgacagtgagatagcttggcgcaaaaatacagatatggccgcaattggttttaaaaacaccggagatggtgataccgattcttatatgtggtttaaaaccgcagataatggtaacgagtatttcaaatggcagcatagcctctctgggggaggaaccaatgagtggatgagcctgaaatcagataatctccgagtgaaagggcatcaggtttaccatgaaggatataaaccaactgctgcgattgttggcgcttatacaaaatcagaggctgaaagcaaatatcagccgaaaggaaattatgccgttcgtggggaaaattacacgaaacaggagtctgatggcaaatatcaaccccgaggtaactatcaacccattggtaattatatattgaggggagattgttataccaaaggggaatcagacagccgatatttatcatttcaaaatagaagtccccgcacagttttatctggtgttagcctaaatgatggggaaacagccaatttaggtgtagattgccgagggaaagttatgtgggtatggtgtacagaacgtgaatttccagccgcaatgacagtgataccgatagataactatggagtatcaactcactatggatatcaaggctccattgatttaacactcatcaatggcggtagaactattaaagttatttttacgcgaaaagatacacgattatggcgtatagacatttgggattag

SEQ ID NO: 2695 - DNA, 1092 bp, Xenorhabdus bovienii
  Coding DNA location: Contig name=SeqID_16880; Position on contig =9919..11010bp; Strand=+
atggattcaaaaaaaatactatttgttggttacgatatgcctggatttggcggaaaggaaactgtttgtaaaaatgtatactatatgatgatggataaaaatccttcaatcaatattgaatttttatttatacaagattttcgacaaggccctgatgaaattagtgatgaatggttaggcgatatttcatttagccgaatatcatctggggtttataacactaagataaggcgtattcatttttcttacaaattcgcaaaatttttaaagaaaaaaaaacctgatattatcatcagtatagatccattaagttgttatgtaacaagcttgggaaaaaaactcgccatggtaaaaattcctatatattcatggattcattcatctttggatcaactatataaaagcacttattctctaaacgctgactaccaccttgctatcagttcaggaataaaatcacaatttatccgaaggggtgtcagtgcagataatatttttacaatatttaatcccataaaaagaagtagtgaaataatgactcgacctagcgatatcattacatttctctatgttgggcggctaactgatgatgataaaaatattagtgaaatgtttactgccctatctaaggtaaatggaaattttgaattacatattgtgggtagtgggcgagatgaaaatgaattgaaaaatttagctaataaacttaaattacaaaataatattatttggcatggttggaagaaaaaaccatgggaatttattgaaagtaatataaaagaaataacaacactattgttaacctctaattttgaggggtttccaatggttttaggtgaggctatctccagagggatttattgcataagctcaaattgcattactggccctgaagatattattatcgatggtataaatggtgagctttacccattaaacagtgttaactgtttggttgaaaagctccaatatataattgatggaaaacaattgcctaataatattattataaaagagtcaattgaagatctttatgaagaaaaatacattgaaaatgtattttacgcattagaaaacagcaacaaaaagtaa

SEQ ID NO: 2696 - DNA, 903 bp, Xenorhabdus bovienii
  Coding DNA location: Contig name=SeqID_16880; Position on contig =11021..11923bp; Strand=+
atgataacattatcaataatagtaactgcacataatttagaaaaattaatactacaatgtttattgagcatcaaaaattgtatagaaaaaaacacaaatagagatatagaggtattattagtagatgattgctcatctgacgacactagttgcctaatgaatgatttcgctaatttacatgatggctatacatatataagaacagaatatggtaacataggaaaagtcagaaactatgctataaatatagcaaatggaaaatatatcactttcatagatggtgatgatacaatccctaattttagcattaaaaatttactttgtttcttgaaaaataaagagccggatttattattatcaaaaatgcatgaggttcgaaatgaaaaagataaaattattttatccaatttaaataaacctaaaataatggataaggataaagctatagttgaatttcttcttcataagaaatttcaagctcatttatggggtaaattttttaaaaaagaattatttaaaaacaaaacgataccacctctaacatgttatgaagactcatatattttccctgaattattgaatgatagcactaaaatattctatacagattctgttatgtataattatattaaaagagaaaatagtttatccgctaagatagataatgtaaaagcagagataaaagttgatataataaatcatatgaatacaattttcagtaaaagaaaatactacaatttaatcatttgccacgccatcgatttactcttaaagaatagagaagtactgtctatacagaaacaaaaagagctaaaaagcctcataaaaaacacgagaaaaataaaatttcttttagatagaaacataaggtttagtttcaaaaagaaactgttgaaatgctaa

SEQ ID NO: 2697 - DNA, 510 bp, Xenorhabdus bovienii
  Coding DNA location: Contig name=SeqID_16880; Position on contig =12166..12675bp; Strand=-
ttgcaagcgggtgacataggggcacaacccgcaggtaattacgctattcgcggggagagctatacgaaagaagaatcaggcggtagataccagcctcgtgggaattaccaacctgcgggtaactaccaacccgccggaaattatcagcctgcggggaattatgcggttagaggagaaatctatactaagtcggaatctgatagtcgttatcaaatgcgaagtacggggcaaagatggagaaagattggtgattttggtggtcagtatgacatttcggccacattagctgaaaatatattgggaaagttaatttttgttcaaagggataaaggggatgaaacttaccatggaatcaatgttccaccaatagcagggattagattcggatattcaatggcgtctgaatcgtggtgggattttattgtgtctcctgatggtaaacagttgacgatggttgattctagatatggcagtgctaatggagtttatttatctgaattaattatttag

SEQ ID NO: 2698 - DNA, 309 bp, Xenorhabdus bovienii
  Coding DNA location: Contig name=SeqID_16880; Position on contig =13466..13774bp; Strand=-
ttgcaagcgttgcgtgattttgagtccggatgccagtttatcggtattgatactcctggggcagaggaaatcaccacttatgaaggccgtggacgtctggggaaagataagcaacctcaagttcattatcagctctcaggccggacttacagccaacaggataaagctgcttatgctaagcccaaggtgggtatgttcatttttccaccaatgaaattgacaatgaattgcttgatatggggcgttactcgccaattacaaagctcagcaaaaggtggagcgtggcttccagtttctgaaaagccctga

SEQ ID NO: 2699 - DNA, 1734 bp, Xenorhabdus bovienii
  unsure (1)..(1734): unsure at all n locations
  Coding DNA location: Contig name=SeqID_16880; Position on contig =14274..16007bp; Strand=-
tttttttcattttgcctattctgtgctgncctgcaggtccatctggtcgcaggtgaatgggaaagcttgtcggaagacatccgtcttaaggcttctgatgtagatgcatataacaaaactgaaaccgatgcacgggtgaatgatgccaaagcgcaggcgaaagctgcgaatgataatgccgatggccgcgttccaacggggcgtaaggttaatggtaaggcgctgaatgcggatatttcgctgaattctggggatgtgggtgcatattccaaaggcgagacagatattcgggttgatggagctaaagagcaggctaaagcagcaaatgaaaatgccaatggccgtgtgcctgcgggacgtaaggttaatggtaaggcattaaatgcggatatttcgctgaattcggcagatgttggtgcatatagcaaagacgaaacagatacgcgggttgatgaagcgaaagcgttggctaatgctcgtctggagaaaaaccagaatggcgcggatattccgaacaagccgaagtttgtagaaaacctcggtttagcggaaaccgtggatcgggcaaaaaacgcagtgccgaaaggcagttttggatttggtggagatggtgggacagttcttagcaaaaatgacaatgattttttagcatgggtacgtagaaataatgctagccctgaatttttcagaaattctactccttcaaaatatacattcacatatggtgtgggtgttctattgaaagctagtgatacttatgcatcgctctctgttgactattctactgctcgcgtaaaagtagtagcaggaaataattcaggtaacgccaactcccctgttagagaactggcatttactgatgaaagctataccaaacctgaatcagacaatcgttttattcgctcaaatgttaatacaaaaacatccggttatatcttatctaagactgcaaattatctggaagacactaattcacgtcatttagggcgttctggttttttacggcctaatgggatggataaccttggagacttagcaattcatgttgctcatccaagtgtagaaggacctcaacatgcaagaggtatttctttttcctatggaagtgattcaaatggattcggcatatctacttatgcatttgataaaaatggtaaatttcaaggaaaaaagagaatattaacggaagatgatattgcagatatgctatatcctgtaggaatagttgtatggtttgctcagaataaaaatccaaatactctttttcctaaaacgcaatggaaatatatcggtgaaaataaaaccattcgtttagctaaccaaaacggttccgatgtgctctctgtcggtggaaatgattcaataacactcacaggtgcacaaattccatctcacaatcaccagattaacgcaactaccagcagttttgattatggagctaagactactaattctaatggaaatcattttcatgatagtggctggggggaagcatttgcagaaggtgcccgatatggaacttatgataacacgagaaataatataggttcaggcgaaactgataacgataattataagtataaaaccagcactgatggtgctcatactcatacagtacacattggagcgcatactcattcaatttcaggtacaacgggaaattctggtagtaattcggctatcaatataaccaattcgtatattatgttaatgggatggtttcgagtagaatag

SEQ ID NO: 2700 - DNA, 214 bp, Xenorhabdus bovienii
  Coding DNA location: Contig name=SeqID_16881; Position on contig =2..215bp; Strand=-
ttgtgggtagagcctaaagaaggtttaaactgttcagatgattctatagcaaatcatatcattgatgctctacagacacacattgccgttagtctaacggtgagagttgtcaataagggcattattggctctctaaaaagcacggctcttagctgctcaaatggtgttaaaatccctcaattaattgatatcagtcatccaaaagaatacattt

SEQ ID NO: 2701 - DNA, 165 bp, Xenorhabdus bovienii
  Coding DNA location: Contig name=SeqID_16881; Position on contig =270..434bp; Strand=-
ttggtcagccagaactcttgtgaacctctttttactatggttagcaggagctgggatgcgtttgaccatcctagtactacatccgtaaagattgcaaaatcaatgtattatcagatacgcgataaactgagaacttatatgacttcaatctgttgtatgaagtag

SEQ ID NO: 2702 - DNA, 156 bp, Xenorhabdus bovienii
  Coding DNA location: Contig name=SeqID_16881; Position on contig =366..521bp; Strand=+
atggtcaaacgcatcccagctcctgctaaccatagtaaaaagaggttcacaagagttctggctgaccaaaatccttgtgcttctgtgtgctttgcatacattgtcttaccattacgttatgagttaatagaagcggctttttctcactgtttttag

SEQ ID NO: 2703 - DNA, 678 bp, Xenorhabdus bovienii
  Coding DNA location: Contig name=SeqID_16881; Position on contig =518..1195bp; Strand=-
atgaacctcgcacaagcagtactactcgcactctatcaccgagaaaaaataggtgaagggcagtgggtatacacatttcttcttgaatcaacattgacgattatggactttcaagtcgctcgctggcttgcggatggaaaaacacctgaattgatgggaaacgaccaccctacgttaatgcctactgggatcgtaaaaactaaagatggtgagataaatatcgcagccgcagaagatgataagtttaaaatactatgccatcttattgatataccgattatttattcaaattctcaatactcagatatccacagtcgctcaatacacagaaaacagctcatgagcgaaattgaagccgcgacgatcaagtatgagagtaagcaactgatacaaatgttaaatgcgggtggaataccaagcggttatgtttatgacattgcacaagcgatgtccgatccacaaatgaactacttgaacatgaagtgtcctattaatcacccatacttaggtaatttgacattggtaggtcaacccatgcacttaagtgctttccctgactttgatgctgttcgcactccagctcccgaacacggccaacacacaggtaatctattaaaaaattaccttggttttaatgacgacgaaattgcgtcatttcgtgagatgcaagtgatctaa

SEQ ID NO: 2704 - DNA, 276 bp, Xenorhabdus bovienii
  Coding DNA location: Contig name=SeqID_16881; Position on contig =1192..1467bp; Strand=-
atggattttttacccttgtcgggcattgttgttattgatttaacatggcatcgagcgggtccagtgacatcccgattactgggtaactggggagctgaaattatcaaaattgaggcacctaccgatcaaggtgacagtatgggaggttcccgtgaaggatttgactatcaaaaccttcaccgaaataaaaaaagcttatcagtcaatctgaaaacagagcaaggtcagcagattctccagcgtttggttcgcaaagcggatgtcgtgctggaatga

SEQ ID NO: 2705 - DNA, 300 bp, Xenorhabdus bovienii
  Coding DNA location: Contig name=SeqID_16881; Position on contig =1501..1800bp; Strand=-
atggcaaaagaccgggcatccgctttatcgggttctatttattttagagacagagtacagcagcgaatagtttctaacatattgctgacgaaagttgagcgtggtgggaacaagatactcgcccacgtaatgacaatatttgccattcatgaaaatatttgcggtcaggacaataagttattggtcagtggtactacgcaggacatcatcgaataccaagataatgttgccttatttaaggaacgtctctgtatttgtacaccagacatcattactgattcaattgtatatccaatttaa

SEQ ID NO: 2706 - DNA, 135 bp, Xenorhabdus bovienii
  Coding DNA location: Contig name=SeqID_16881; Position on contig =1906..2040bp; Strand=+
ttgtgtgtagtaccgttttgcaagatagatgactttagatgcattgttaattatttaattgtcattattattttttttcttggtgtggttcacatatttcacattaatacggaattgactattttgtttttctaa

SEQ ID NO: 2707 - DNA, 132 bp, Xenorhabdus bovienii
  Coding DNA location: Contig name=SeqID_16881; Position on contig =2431..2562bp; Strand=-
atgatggtgactttttgcatatgctattctcctcttcagcttctgcttacccagcataatgtctctataaaagccaagattacacgtatagagctgttccaggatataggtatactctgcattattgactaa

SEQ ID NO: 2708 - DNA, 747 bp, Xenorhabdus bovienii
  Coding DNA location: Contig name=SeqID_16881; Position on contig =2543..3289bp; Strand=+
atgcaaaaagtcaccatcattacgggtggctcccgtggtatcggtaaggcaacggcgctttgtctggcacaacaggggcaccatgtctgtattggttatcgcagccgcgaagatgaggctgatgaagtcgtggatattctgcgtggcttcggtcagtcggctatggcagtgcgggtggatgtgactgatgaaaagcagattatggagctgttccaacggacggaaaaagaattgggttatatttccgggttagtgaacaatgctggggtcttaaaacctcaggcgaccatcgaacagttaacggcagaacggttaaatacaattttcacgaccaatgtaacaggctattttctctgtgcccgtgaagcggtaaaaagaatggcttttcgtcatggtgggcgagggggagcgattgtgaatgtttcatcggcggctgcaagattgggttctcctcatgaatatatagattatgcggcatcgaaaggggctgttgatacgttgacaattggattggctcaagaagtcgcagcacaaggaattagggtgaatgcagttcgtcctgggttcatctataccggcatgcatgcagatggaggggaacctgatcggattgagcgaatcaaagattctttgcccatgaaacggggtggacagccggaagaagtcgcgcaagctattgcgtggctgctgtctgataaggcatcgtacgtgacgggaaatttcatcgatctggcgggtggaaagtag

SEQ ID NO: 2709 - DNA, 345 bp, Xenorhabdus bovienii
  Coding DNA location: Contig name=SeqID_16881; Position on contig =3388..3732bp; Strand=-
atgagcctccatgtttcatttcgccatactgatattcccgaattaatgcttaatggcagcacactcagcaatgctggatttagtgcggatgcgttatttcatatctcacaattttccaatgagataattatctctctcgttgatcctgatgttgatcttgtcagtttgatccatgaagtggaagatcatgcagatcaaggtatcgacaacattcgtgaaaacggtgagctttatattgctggtgattggctgacgagcagtcagttagtggagcagcccatcaatattgaagtggcacctggcaaggttattcttaaacccaaattgacggaatcgttagattaa

SEQ ID NO: 2710 - DNA, 189 bp, Xenorhabdus bovienii
  Coding DNA location: Contig name=SeqID_16881; Position on contig =3671..3859bp; Strand=+
gtgctgccattaagcattaattcgggaatatcagtatggcgaaatgaaacatggaggctcatttgtacgttccttgtgttatttaggcatattgcgatactttatcagtacttcgccgatactgcactgcgaattcatacgtgttttcaaattcatgcgtgtttgatttgtaccgcatgtgttgattaa

SEQ ID NO: 2711 - DNA, 132 bp, Xenorhabdus bovienii
  Coding DNA location: Contig name=SeqID_16881; Position on contig =4067..4198bp; Strand=+
atgaattttttcattagttcaattttttattctttttattgtgaattagtcttttttaaattttttagaaaaatgtattttttcattgtgattgaatgtgatgatggcgtttttatttattatttttcataa

SEQ ID NO: 2712 - DNA, 105 bp, Xenorhabdus bovienii
  Coding DNA location: Contig name=SeqID_16881; Position on contig =4300..4404bp; Strand=+
atgtcattgttgtataagtacatgttgtatagattaattagttttaggttaatatatgagttgtcagttgatgttattcagaaggtcttttcaagcttattctaa

SEQ ID NO: 2713 - DNA, 1410 bp, Xenorhabdus bovienii
  Coding DNA location: Contig name=SeqID_16881; Position on contig =4593..6002bp; Strand=+
atgaaaagaattcctgagcccttccgtattaaaatggtagaaaatatccgcatgacaaccgcagccgaacgtgaagcggcattggaggaggctgggtataatccattcctgctgccttcagatatggtttacattgatctgctgactgattctggtacgggttcgatgagtgatcgccagtgggcaggtatgatgatgggggatgaagcttatgcgggttcccgcaactattatcatctggagagtaaagtcaaggagttgattggctacgaatatacgatccccactcatcagggacgcggggctgagcagattttatttcccgctctgatcgccaacaaaaaagccaaaggcggtgctgaaaagccggtgtttatttctaatttccattttgatacgacagcagcacatgtggaattaaatggtgcatgtgctatcaatattgttaccccgaaagcgtttgatacaacaacctattatgactggaaaggtaattttgatcttgatgcgctcaagaataccatcaaggaacatggggcggataatattgtcgctatcattactactgtcacttgtaatagcacgggagggcagccagtttctctcgctaatatgaaggccgtatatgatattgcgaaacagcatgatatccctgtcgtaattgattcagctcgtttttgtgagaacgcctggtttattaaacagagggagaaaggttacgaaaataaatccatcaaagaaatcgtcaaggaaatgtatcaatatggcgatatgctcactatgtcagcgaaaaaagatcctatggtaaatattgggggtctttgttgtttccgtgatgatgaagcgttgtttaacgaagtacgtattcgctgtgttcctatggaagggtttgtaacttatggcgggcttgctggccgtgatatggcggcgctggcgattgggcttgaggaaggaatggatgaagatttcctatcttaccgtattaatcaagtaaagtatttgggcgaaaaattacgggaagctggtattcctgtacagtaccctattggtggtcatgccgtctttgttgatgccaaattgctcctgcctcatattcccagcgatcaattccccgctcacgcactgaataatgaattatatctggaagcagggatcagaagcgtggaaattggttctctattattgggtcgagatccacaaaccgggcaacaaaaaccctcaccgatggaactcatgagactggctattccccgtcgtgtttataccaatgatcatatggattatattgtgggagcttttatcgccttaaaacagcgtgctacacaaatcaagggattaacgtttacttatgagccgcctgtattgcgtcatttcgtatcgagattaaaaccgattgataacgataaataa

SEQ ID NO: 2714 - DNA, 165 bp, Xenorhabdus bovienii
  Coding DNA location: Contig name=SeqID_16881; Position on contig =5986..6150bp; Strand=+
ttgataacgataaataatcagaaaacgatagctttatttctcgtaccggagagccgttatcgcgccagcaattctataaaattattaggaacacaagtatcaaagcagaaattgcgatttgcgcgaatccgcatatgttgcgtcattcgtgtggttatgcgttag

SEQ ID NO: 2715 - DNA, 225 bp, Xenorhabdus bovienii
  Coding DNA location: Contig name=SeqID_16881; Position on contig =6120..6344bp; Strand=+
atgttgcgtcattcgtgtggttatgcgttagcggataatggcgtcgatacacgattgattcaggactatttaggtcatcgcaatattcgccatacagtcagatataccgcgagtaacgcaggtcgctttgatggaatttggagagcaagagggaagagaaaaggggttacatttagtgccaaactgttaactaccgatgaattctctggttcagagctgtcctga

SEQ ID NO: 2716 - DNA, 99 bp, Xenorhabdus bovienii
  Coding DNA location: Contig name=SeqID_16881; Position on contig =6330..6428bp; Strand=-
atgatgaaaaaaccctgcttggtaatatcggcggggttttttggcaagttattactgataaacatgactattcaaagacaattttcaggacagctctga

SEQ ID NO: 2717 - DNA, 576 bp, Xenorhabdus bovienii
  Coding DNA location: Contig name=SeqID_16881; Position on contig =6441..7016bp; Strand=-
atgggtgtatctctggttaaaggcggcaatgtatcactgacaaaagaagcccctgcgatgaatattgcgctggtgggtcttggctgggatatgcgtgccactgacggagcggcattcgatcttgatgcctcagttttcatggttggggaagatggcaaagttctgtcagacggccactttgtcttcttcaacaataaagtcagcccttgtggctcagtcagccatcaaggggataaccgtacgggtgaaggcgccggcgatgacgagcagattaaaatcgatctggcaaaagtgcctgctgacgtgaaaaaagtggtgtttgcagtcactatttatgacgcagacaacaataaacagaatttcgggatggtaagcaacagctttatccgcgtagtcaacaacgacaacgatcaggaaattgcccgtttcgacctgtctgaagatgcgtcaacagaaacagctatgattttcggtgaactgtatcgccacaatacagaatggaaattcaaagccgtaggtcagggttttgccggcggcttgtctgcccttgctatccagcacggtataacaatttaa

SEQ ID NO: 2718 - DNA, 579 bp, Xenorhabdus bovienii
  Coding DNA location: Contig name=SeqID_16881; Position on contig =7094..7672bp; Strand=-
atgggtgtatctctttctaaaggcggtaacgtttctctgagcaaagaagcgccaacgatgaaaaatgttctgatcggtcttggctgggatgcccgtgccaccgatggacaagattttgaccttgatgcttctgcatttctactgtcagcaaacggcaaagtacgcggtgatgccgatttcattttctacaacaacctgaaatctgctgatggttccatcatgcatactggcgacaaccgtaccggtgagggagatggcgatgatgaatcactgaaaatcaaactggatcaggttccggccgatgtggaaaaagtggtgtttgttgtgactatccatgacgcacaaacccgtcatcagagcttcggacaagtttccggtgccttcatccgattggttaacgatgatactcaagttgaagttgcccgctacgacctgactgaagatgcttcaacggaaacagcgatgctgtttggtgaactgtatcgccacaatacagagtggaaattccgtgctgttggtcaaggctatgcgggtggtctggcatctgtttgtgctcagtatggcattaacgcttcctga

SEQ ID NO: 2719 - DNA, 138 bp, Xenorhabdus bovienii
  Coding DNA location: Contig name=SeqID_16881; Position on contig =7629..7766bp; Strand=+
ttgctcagagaaacgttaccgcctttagaaagagatacacccattattatttcctcacttattaagtcgcatacccttcatcttttaagttgctgctttgtgggctgcaacttgaaatctattgggtatattgattaa

SEQ ID NO: 2720 - DNA, 1032 bp, Xenorhabdus bovienii
  Coding DNA location: Contig name=SeqID_16881; Position on contig =7791..8822bp; Strand=-
atggtatccacgcacataggttttccgatggaaaccgttgctgtattcattattctgtcggttggtgcgctctttatcgacctctttatgcatcgtcatgataagccgatttcgctgcgcagcgctgctctctggtccgtcttctggatcgctattgcctttgttttcgccggattcctgtttgtccatcacggtgctgaaaccgcgagcctgtttgttaccggttatgcactggaaaaagtgctgtctgtcgataacctgtttgtcatcatggcgattttctcctggttcgccgttcctgatcgctaccgccatcgtgtcctttactggggcattatcggtgcaatcgtcttccgtggcatctttgtcgccatcggaacgagcctgctgatgctcggcccttgggtcgaaatggtttttgccatcatcgtgggctggactgcggtcatgatgctgaaaagcggtgatgatagcgatggaatcgaggattattcacagcaccttgcctaccgtctggtgaagcgctttttccctatttggccaaaactgcgcggccacgctttcatgttgaatcaaaaggaagtgaatgccgaacttgccaaaccggaaaacgcagatgtgaaagtgggtcgtacgggcaaagcagcgctttatgccacaccactgatgctatgtctggcggtggttgagctgtcagatgtgatgtttgcctttgactctgtacctgcggttattgctgtcagccgggagcctttaatcgtttacagtgccatgatgtttgctatcttaggcctgcgtacgctttacttcgtgcttgaagcactgaaaaagtatctggttcacttggaaaaagcggttatcgtcctgctgttctttattgccatcaaactcggcctgaacgcatctgaacatatgttccaccacggttattcaatttcggcgacaaccagcttgttcgtggtgattggggtactgactgtcggcattattgtcagcctgctgtttccccaaaaagaagaaaatgaaagttaa

SEQ ID NO: 2721 - DNA, 456 bp, Xenorhabdus bovienii
  Coding DNA location: Contig name=SeqID_16881; Position on contig =8851..9306bp; Strand=-
atgtcctttttaaacaaaatcaagacggctttcagcgcgggccgtgaagagctgaccaatcaagtcggccgcttcaagaaccgcaagttcatggaaggcaccgtagccgtgtgtgcgcacattgcgatggcaagcaacggcgtcagctcagaagaaaaacagaaaatggtggggttcatcaaaaactcccctgaactgaaagtcttcgataccactgaaattatcgaattcttcaacaagctggtcagcagctatgaatttgatgctgacattggcaaaggtgaagccatgaaattcatcatggtgctgaaaccgcagccggaagcggcacagcttgccttgcgcgtaggtattgccgtcgccaaaagtgatggcgattttgataacgacgaaaaaacggctgcccgtgaaatttgtacaactctgggctttacacccgcagatttcgaactgtaa

SEQ ID NO: 2722 - DNA, 1161 bp, Xenorhabdus bovienii
  Coding DNA location: Contig name=SeqID_16881; Position on contig =9338..10498bp; Strand=-
atgaacctgacaccggggggaaatgcccccgtatccaaccagactctcactgtgagagtcctttcaggcacggcagtagatgtatccgccttctgcctgtatgccgatggcaaagttcagggcgatcccgacatggtgttttacggccagccggtcaatgatgacaacaccatccgtctggcagggggcaacgttaatacttcgttctttgttaacttgccagccctgcgtcaagatgtccaaaaagtggcgtttacggcgacctgcgacggcaaccagaccatttccagcctgcggactctttctattcaggtagaactaaacggaaacacggttctacagggcagtgttgacgttcagggtcggacagaatccgctctgatcctcggtgagttatatcgccgcaacagtgaatggaaattccgctttattgcccaaggttttaatggtggccttaaaccactggcggaacattttggtgtgaatatcgttgatgatgcgccagccaaaacgcctgcgccgcctcctgctcccgcatcaaatagtgttaatttaagcaaggtttctctcaccaaagaaaaaccggcgattagcctgagcaaacgtgacaatttcggtgaaattcgcgtcaatctgaactggaatcaggcagcgtccccggcaaaaaaaggggtattgcagggtatattcagcgccaacaaaggcgtggatctggatctcggcgcattcattcggctgcatgacggagaacgttatgtcgttcaggcgataggcaaaagctttggggattatcatcgggaaccctacgtaaaattgcagggtgatgatcgaaccggtgccgtccgtgatggtgaatggctccacattaatggcctcgaatggaaaaacatcaatgaagtgttggtttatgccttgatctacgaaggcgttcccagttgggacaatacagacggcgtggttacaatccatatcagtggccaagcccctatcgaaacccgcatgacggaaggcaataaccagaaacgtatgtgtgcggtcggccgccttgtcaatgaaaacggtgcaatcaaagtagaacgcatcaaccagtacttcagcgggcataaggagatggaccgagcattcggttggggctttcgctgggtcgcaggcagtaaataa

SEQ ID NO: 2723 - DNA, 588 bp, Xenorhabdus bovienii
  Coding DNA location: Contig name=SeqID_16881; Position on contig =10498..11085bp; Strand=-
atggtttcgttaaacaaaaatcagtcagtttcgctcgccaagcagagctcttcactggctaaagttgattttggcctagggtgggatccagtttccaagaacaaaggctttatggctcgtatgttcggcggtggcagtgacgaaattgatctggatgcaagctgcatactgctcgataacgctggcaagactatcgacacggtgtggttcggccaactggactcactatgtggttccgtggcacacagtggcgataacaggacgggtgaaggtgacggggatgatgaagtcatcagcgtcgatctcgtcaatcttcctgccaatatcgaatacttggtttttaccgttaacagtttccgcggccaaaccttcaatgatgttgaaaatgccttctgccgtgtcgttgaccaaagcggcaaagagctggctcgctaccagctaaacgagcagggtgcccataccggcgttatcatctcttccctgcgccgcaataagggtcaatgggatttcacggcacatggtgccgcttgccgtgggcgtaccattgaggatatgtatcctcaaatcgttgaaacggtggtgcgctaa

SEQ ID NO: 2724 - DNA, 135 bp, Xenorhabdus bovienii
  Coding DNA location: Contig name=SeqID_16881; Position on contig =11141..11275bp; Strand=-
ttgacttttgggcttggaaaagaaatcataaaaaaagaaatcagattgttttctatcatggacttaaacacaagacatgctgtttatgggaatcataatatgacagaatttcgccacatttctgtcatattatga

SEQ ID NO: 2725 - DNA, 1155 bp, Xenorhabdus bovienii
  Coding DNA location: Contig name=SeqID_16881; Position on contig =11505..12659bp; Strand=+
atgacagcatttaatgatactcagagttatcaaggccaggtttccaaatggaagttgaacagcgggacgttgactgtaacggcagcccgtggcacagcatctctggaaactctgtttgatattgctgagcgccgtaaccccaaaagggcatttttatttgtcagcaaggtattgggacgccacattccggtcagcccatcgatcatgcgctcggtttaccggcagttatctgaacagtttccgacccatcttcccggccctgtgctgtatatcggtatggctgaaacggcagttgggctggcagcaggggtttttcaagaaacccgggaaaaggttgaagctccggtatttctgacgtcgacacgccaccccgttgagggggacttgctgtgtgaatttaaggaaaatcacagtcatgccacggatcacctgatttactggccggaagaaaacagattgcgccaacgggtggttgatgcccgtacccttattttgatcgatgatgaagcgaccacgggaaatactttcctcaatctactcaatgcactgagtcatgccggccttaatcagattgaacatatcgtcactgtgacgttaacggattggagtggcaaagctgttatagaacgttgtccgctgccagtctctacggtttctttgatcgagggaaactggcattgggatgcggatatttccgccccgatccccgtcatgccgcaagtcaatgtcacggcgcggggagatgtcagcattattggtaagcagagttggggacggctcggattggatgacattcagtgtgatatcggcacggaaattcatgctatagcgggtgaaaaagtgctggtgctgggttccagtgagtttgtctggcaaccattcttgctggctgaacggctggagcaggaaggcgcacaggtgaaatttggttccacaacccgctctcccatttcctgcggtcatgctattcagtcagtgatgtcttttatggataattacggattgggcatcccgaattttctctacaatgtggcacaccagcaatttgatcgcatactgctctgccttgaaacgcctaaaaccgccgtcgatccggcactgataacgcaacttgcccgtgtttccccgattgtcgagattgtctcctatgattaa

SEQ ID NO: 2726 - DNA, 795 bp, Xenorhabdus bovienii
  Coding DNA location: Contig name=SeqID_16881; Position on contig =12652..13446bp; Strand=+
atgattaagcccgtttttttgactgatcttgatgacacgttatttcaaacgcgtcggaagataaagaaagcaccgggtattgagtcttgtcgtgtgggcgcattggatcgagaatattctccttgcagctacatgaccgaagagcagtcaatgttgattgactggttgctggcttatgcggaggttatccctgtgacggccagaaatacagagcaacttagccgggtgaaaatcccttttaattcatggcggattgcgacacatggcgcagtgatcttgacaccagaaagcacggtggataaggaatggcaggcacatattctggcagcactgacgccttaccgtgatcagtttcgggaactggatcacttgagtcatcgcttgatcgctgctcatggtatggaagcatgggcgcgtattgattatgaatatggcgatgttcccgtctatctggttattaagcacagagactgtaatcggctggaagagcttgatgtgcttgctgaaaatattacccaagaaatggctgatatttttgattctggtggtttttatcttcatcaaaataataacaacctgactttgttgccaaagtgcgttgacaagggattggcaacccgtcaccttttgacaaagcttcgtactgagagaggcgtttttcctattattggtctgggggatagcctgagtgaccaccgtttcatgaaactgtgcaattggttcggtatgccccagcacagccagtttgctaacaccttgatgacctctttattcggaactgtaaataatgaatag

SEQ ID NO: 2727 - DNA, 1080 bp, Xenorhabdus bovienii
  Coding DNA location: Contig name=SeqID_16881; Position on contig =13439..14518bp; Strand=+
atgaatagctttccccttttttctggttcatatgatcccgatgatgtccagtttctgctaaaacccgttcagattgagatgacacccgttgatatcaaagagcagcttattcagtctggcgttcgtcactattcagagatgttgagtcaagagccagagccaacgccttatcatcttgatttatttgacagggcgcttgaacagggcgcagttcgcttggcgactgaagtggtgatgctcgctaatgcgttgatatcacgctttggtgatacgccgatagtgctggtcagtctggtcagggcaggggttcctctgggggtgatgttgcaccagacactcagaaaaatgggtaagcaatcttatcactatggcatcagcatcatacgggatcgcggtatcgacagtacggcgctgtcgtatattgagcagcaacatggtacggatgggctggtgtttgtggatggctggacaggtaaaggcgcaattacggctgagttatcccgttctctggcgggtcggtctggctattcaggcattccccgtctggtggtactggccgatccttgtggatgttcatggctggcggccagtgacgatgattggctcattccctttggcatcatgggcgcaccggtatcgggtctgatatcgcgttcgatctggcgtgaagaagggatgcatggctgtgtgcaatgtgatcacctgagtgagtttgaatgcagtcgtctgctggtggataccgttgctgattgtcgcgatcgcttggagctgaatgcgataccggtggtggattggcagccgcaggaaaaaatatccttgctggaattgagcaaaactgtgatctcaacccttgccgaaacgtaccagatcgacagtattaatcgcatcaagccgggcattgcagaagcaacccgtgcggtattgcggcgcgttccagaacatgtactggttcgatctcaagatgatcctgatgttgctctgctggttcatctggcacgtcagaaaaacgtcgttattactgaagtcggcgatctgataggacaatatcgcgccgtgactatcattaagaaggtagcttga

SEQ ID NO: 2728 - DNA, 954 bp, Xenorhabdus bovienii
  Coding DNA location: Contig name=SeqID_16881; Position on contig =14518..15471bp; Strand=+
atgaaaccgatcccttccccgcatcaacttggtgcaacgctgtacatcccggccactcgtcaaggtattgcagaaattgtgctgcataataaaattcccggtctgcgttctctggtgatctgcctggaggatgccgtcagtgatcaggatattcccgacgctattgaaaatcttggttgtgtactgcaagcactggcgggagctgatatctcttcttcccatacagagcgtcattaccccctgatttttatccgcccccgcaatgaagagatggggcgttatctggtagacaacgttaacctcagcgccgttgatgggctggttctaccgaaatttacctgtgcttcactggctggctggtgggatattgtgggttcgacccatctcagcatgatgccaacactggagaccgaagaggtctttgatgcccggcagatgaatcagcttgcggacagtcttaaaacccatccttgttatgagcgtattatcgccctgcgcattggcggtaatgatctgatgaatgtgatatccctgcggcgttcgcgtgacttcaccttatatgaggggccgatgggatatgtgataaaaatgctggtgactgtgtttgctgcgcggggtttctccctgacggcacctgtttgcgagcatatcgatgatttgcggttgcttgagaaagaactgatattggatattgcacatggccttgtggggaaaacggccatccacccggggcagattgaatatattcagcgggcgttgatggtcaatgggcatgattatgcggatgctctgcgtatcctcaattccagtcaggccgtattcaagtctcaggggacgatgtgtgagcctgctacccatcgacgttgggctgtgaatatcctcgaccgggcgaaatactatggcattgcgcctgaattcaatgaagaaacctgtaaaacttttaatgtgttttga

SEQ ID NO: 2729 - DNA, 117 bp, Xenorhabdus bovienii
  Coding DNA location: Contig name=SeqID_16881; Position on contig =15437..15553bp; Strand=+
atgaagaaacctgtaaaacttttaatgtgttttgatattgatttacttgtgataggagctatgctggacgctatgcctatgattaacattagggattttttgtttagttatccctga

SEQ ID NO: 2730 - DNA, 477 bp, Xenorhabdus bovienii
  Coding DNA location: Contig name=SeqID_16881; Position on contig =15570..16046bp; Strand=+
atgttacttagccccaagcaatttagaaatttcaggttgaccttattactgtcgcatgagaaacccgttagcaaagtgagaatgattcgagagctgaattgttcagaaccgacactgacccgcgcattgagggaactacgcgatctctattgtgctgatatccggttcagcaaaatggggaatacctatcaattggtcgataaaggcacactgactaaaaaggatgtacgcagaattgaagagttgctcatccagaataatagtctcaaggccgaagaagctatcagccatgttttccttgataaggagaagaagaagcctgtttctctctccttgaggatgtccgtcattcgaaaaattgacgggctggccaatcggcttgagacaacccgaagtgatgtggttgaaatggtggtggacaggtttatggagacgctacagaaagaggccatggacgtgggttcgcagaagagatga

SEQ ID NO: 2731 - DNA, 561 bp, Xenorhabdus bovienii
  Coding DNA location: Contig name=SeqID_16881; Position on contig =16121..16681bp; Strand=-
atgtatttcgtagctgtcatattcttgatctatactatcgccccttttttaacagacaaaaacaccatggaacgctttctcgaaaacataatgtatgcctctcgctggctacttgcccccgtttattttggtttgtcactggcactgcttgcccttgccgttaagttctttcaggaaattattcatatcctgccgcatatcttttccattgctgaatccgacctgatcctgacactactttctctgattgatatggcgttggttggcgggctgctggtgatggtcatgttttctggttatgaaaactttgtttcaactctggatatctacgaacacaaagagaaattgagctggctggggaaaatggatgccacttctctcaaaaataaagtagcggcctcaattgttgctatctcatccattcacttgctgcgtatctttatggatgccaaaaatattccggacaataaactgatgtggtatgtcattatccatctgacttttgtgatgtccgcatttgtgatgggctatctcgataagcttacccgccacaagcactaa

SEQ ID NO: 2732 - DNA, 108 bp, Xenorhabdus bovienii
  Coding DNA location: Contig name=SeqID_16881; Position on contig =16741..16848bp; Strand=+
atgaagagagtactttaccgcgaagaaggaacagatggcattagcaacccgcagttacgttactgttatgaccatatcccaggcagtagggcgctggaaacggtttag

SEQ ID NO: 2733 - DNA, 387 bp, Xenorhabdus bovienii
  Coding DNA location: Contig name=SeqID_16881; Position on contig =16852..17238bp; Strand=-
atgaacaagaagacaacaacacaatggctcatttctgatgaactgtggcaaaaaatggaacccttactacccgtgcctaaaacccaccatcccttaggatgtcaccgccatcgagtggataactgggcagccatgaatgccatctttcatgtgttacgaacgggatgtccgtggaatgccctgaatgtgacaggtttctgttcttcaagtagtgcccatcgtcgttttcaggaatggctggcaacgggagtatttgagcgcttctggcaaaacgggctgcttaccagtgaaaaaatcggtgatattgatttgacaaaactgggtctggataaccacctccccaaaacgccccctgcgaggtcgaaaaaacagaagattgccagataa

SEQ ID NO: 2734 - DNA, 126 bp, Xenorhabdus bovienii
  Coding DNA location: Contig name=SeqID_16881; Position on contig =17397..17522bp; Strand=-
atgctgtacttgcttttgttagctctaacggcctataagaatgcatgccaaatcataaataagttaataattggcgcgactataagcttcgcaaggttaataatactgcgttttttatcacgctag

SEQ ID NO: 2735 - DNA, 123 bp, Xenorhabdus bovienii
  Coding DNA location: Contig name=SeqID_16881; Position on contig =17548..17670bp; Strand=-
ttgttctgtctctttacgttagagaacgagattattgacgttcgaacccacactcaacccttttctggatgcctgttcaatctcctaaacttttcctctaaaaacgctaccgcccttaagtaa

SEQ ID NO: 2736 - DNA, 108 bp, Xenorhabdus bovienii
  Coding DNA location: Contig name=SeqID_16881; Position on contig =17649..17756bp; Strand=-
atgaagcctcttaatgcgtataaaagaaagtggggtactttctttaccatcaaaacagtagtaatcgctagatcaatgagcagattttgttctgtctctttacgttag

SEQ ID NO: 2737 - DNA, 198 bp, Xenorhabdus bovienii
  Coding DNA location: Contig name=SeqID_16881; Position on contig =17707..17904bp; Strand=+
atggtaaagaaagtaccccactttcttttatacgcattaagaggcttcatccattccatccttcatctgatatacattctgcttcgttaccctaatgactccggtattaacaagcgaactaaaaccgttaatatagcgattaaaatacttactttttccccaatcaaaaaacttagccattggtgctcctccccgtag

SEQ ID NO: 2738 - DNA, 819 bp, Xenorhabdus bovienii
  Coding DNA location: Contig name=SeqID_16881; Position on contig =18092..18910bp; Strand=+
atgggattagatactgcgatggtatgcgcagcctatgatcatgatgtattactgatagataaagatcctcatgtattagaaaacattgcatcgcgaatttctagtgaattccgtttataccgtatgctcgaacctacattaaaatctgttgacatctcaaagctaaaggaacgaattcgcattactcagtgctatgaagagatagaaggcagtgattgggtcatcgagaatgttaaagaggactggtctgctaagaaaagcgtttatgaaaaattaaccccttatttaaacgcaaaaacttatgtggcagcgaacactagctgtatatcaattactaaaatcgctgcaagtcttccatttcctcaacaagttattggtttgcatttcatgaacccagtgctgataaagaaatgtgtagaagtcatcaaaggcttccacacatctgaacagacactcgattctgcaaaacagtttttagctagcctcaaaaagaatgctgtggtggttgaggatttccctgggtttgtctccaaccggctatctcatttattcatgaatgaagcggcttttctcgtgcaggatggtgtagcgactccccaagacatcgatcgaatttttaaagatggctatggtcattcaatggggccattggaaaccgcagatttgatcgggctagacaccgtcgttaattcattacatgtactttatgaaagttaccaagatccaaaataccgctgctgccctcttttaaagaaaatggttgaagccggcaatctcggcagaaaaaacggtaaaggtttcttcaattacaaaaattag

SEQ ID NO: 2739 - DNA, 1059 bp, Xenorhabdus bovienii
  Coding DNA location: Contig name=SeqID_16881; Position on contig =18926..19984bp; Strand=+
atggacgatttaatagaaaaaatagaactcaataaaaagcccgtcaaatgtgtcatctgggatttagataatacaatatggacgggtatcctatcagaacaagatgatctgaaattaaaaaatgggatagaacagttaatcgaccaattagataaaatgggaattttacaatctattgcgagtaggaatgatgccagtgacgcactagatatgttgaaaaaattcaatttagaacagtatttcgtttaccctcaaattaactggggccctaaatcttcatcaattaaaaaaattcagaagagtctgaatatttctgccgatacatttattttcgttgatgatcagattttagaaagagatgaggttaattcaaaattccctgaagttacctgcattgacgctttagaatatgaatcaatattaagtttaccgcgtattgctaatatggaggtatcagacgatgcaaaattaagaaggcaacgttatcaagacgatatacttcgtaaagaagaagaagagacatttgtcggtgcttctgaagaatttctcagccaacttgatatgaaattctatatttccaaagccgagcccgaagatctgctcagagcagaggaactcactcagcgtacgaatcaacttaattctaccggtataacctatagccgcgagcaattgagtcaactcatgaactcggaagaatatgcgcttttcgtgtttgaactggtcgataaatatggttcttatggaaaaataggtttggctttagtccactataaagataataccgactatatcaaactcctgttgatgtcttgtagaacactttcgcgaggggtgggtagtatcgcgttaacttttattatgcaacaggcgaaagaacacggccgtaaattgcatgctgagtttaaacggactccgcgcaaccgccagatgtttgtcacttaccaattttcaggatttaaagaaatagagaagcatcctgacgatactattatattttataatgatctagagcaagttcctgatttaccacactatgttgatgtcattataaagtaa

SEQ ID NO: 2740 - DNA, 258 bp, Xenorhabdus bovienii
  Coding DNA location: Contig name=SeqID_16881; Position on contig =19997..20254bp; Strand=+
atgaaagattcagacgtaatatctaaagagatccgtgaatttattgaaaataatatgacagtgtttgatgatgatattgaattgttagatgacacgaatatatttgaaaatggtttggtaaactcgcttttttccatgcgtttactttgttttattgaagataaattttccatctcaattccagatgaatatatagaacgggaaaattttgtttctataaataaaatgctggaattagttaataaagtaagaggatga

SEQ ID NO: 2741 - DNA, 1149 bp, Xenorhabdus bovienii
  Coding DNA location: Contig name=SeqID_16881; Position on contig =20265..21413bp; Strand=+
atggaatatgatattcaccctttagtcggaatagccaagaaattttcagatgaagtactgcgaccatcagcaggtttatttgatgagcaaggcgaagtaccgcgggaaatcatgcgtgagatggccgatcttggtttgctcggttctatcctccctaaagaatacggtggacaaggaatagatcctctctcttatggttatttaacagaagagataggtaaaggctgtaactcgactcgtgctctattgaccgttcacaccagtctggtcggggaaacgctggtaaagcttgggacacaagagcaaaaagagaaatacttacccgcaatggcaaaaggtgaaaaaatcgcttgttttgctttatcggagccagaagcgggcacagatgccaatgcaattagcaccatgtacgagccaactgaaaatgggtttgtcattaatggtcataaaaaatggatcacctattcaggcgttgctgatttattcctggtatttgcgaagcacgatgaaaaagtcagtgcttttatcgttgagatgggaactcaaggattaacgcgtaagccaatgcgtggtttgatggcaagccggggagcccatttgtccgagctgcattttgataacgtagaagtgccaaaggacagtttgattggccgtgagggcacgggatttagcttcgtagcgaacgctgcactgttttatggccgctatagcattgcttgggctggtgtggctatcgcacatgcggcgctggaagaaatggtcacttatgcccgaaaaagagagcaatttggcaaaaaaattggccagcatcaattaattcaagggctgatcgccgactcaacaacggcattttatgcagccaaatcggcttgcgaaaaaattggttatctgaggaatcaaggtgatcataattcgcttatggaaattaacatagcgaaatactatagctcatcggttgcgatgttggttgcaaataacgcggttcaggttcttggcggaaatggaatatctaatcgcttcccggttgaaagattatatcgcgaagcaaaagtattagaaattatcgaaggaaccaaccaaattcaacaaatactcatatcacaacatgctttgagaaaatttttccgcaaagactctatcgttgcatag

SEQ ID NO: 2742 - DNA, 123 bp, Xenorhabdus bovienii
  Coding DNA location: Contig name=SeqID_16881; Position on contig =21363..21485bp; Strand=-
atgggaaccttccccatagcctcttacagaacggtacatgaatctctcagtatccgcgctgttctcttatttctatgcaacgatagagtctttgcggaaaaattttctcaaagcatgttgtga

SEQ ID NO: 2743 - DNA, 141 bp, Xenorhabdus bovienii
  Coding DNA location: Contig name=SeqID_16881; Position on contig =21447..21587bp; Strand=+
atgtaccgttctgtaagaggctatggggaaggttcccatggcctactcaccataaacttcactgtaaaatacaaggcacttggtaattacgctatagggattattaattttaatatttcgctacctactgactataattaa

SEQ ID NO: 2744 - DNA, 10260 bp, Xenorhabdus bovienii
  Coding DNA location: Contig name=SeqID_16881; Position on contig =21597..31856bp; Strand=+
atgggaaataattttactgggcttgaggttgccataattggaatggcaggtcagtttcctggtgctgacaatattcgtgactattgggaaatgctccgagatggaaaagagggtgttagcagattcacaaatgaaatactaaaaagcaatggcgtatcagaagaatattatttaaacaaaaattacattccagctaaaggcgtcattaataagccatttcatttcgccgcagattatttcggtataaatcattcggacgccaagaaaacggatccacaaatccgtttaatgatagagagctgctggcaagcgctaaaacacgcaaatattgatactgagacttaccccggacaaattggcgtgtatgccggagcaagtagtcagtggtcatggtttaaagcattaaacacggaatttaattcttccgcagagcagtttcacgttgcaacgctaaatgatctttctttttgtactcggatttcctatctgcttaatttacgcgggccgtctataacgatccaaacggcgtgttctacctctttagttgcggtacatacagcatgccaggcacttcaagcgggtgaatgcgatgttgcattagccggtggtgtcagcataacccatccccatcaaagtggttatttgtaccaagaggggatgattaatagcccggatggtaaaacaagagtattcgatgcaaatgcatgtggcaccgtcttcagcaatggtgtgggtgttgtcgtgcttaaaaggctgagtgatgccattgaagataacgacaaaatttacgccgttattaaaggcagtgctgtcaacaacgatggtagtgataaaataagctttactgcaccaagcgtcttaggacaacaaaatgttattcgatccgcactcgattttgctgaggttacgcctgatcaaataagctatatagaagcacatggcacgggaactttactgggcgatcccattgaaatttccgcgcttaacgcggttttcaaaaatagccaatcttgtgctatcggctctgtaaaatcgaatgtgggtcactgtgatgcagcggcagggattttatcactgataaaatcagcgctttgcgtttactttaaaaccttggtgccttcgattcattttgaaaaggcgaatgcaaaattagaactggaaaacacgccattttatgtcaacacagagactaaaccttggcacagcagtgataacgagctgatatgcgccggtgtcagtgcatttggcgtcggaggaaccaatgcgcacgttgttttgcaagagtttccaatgcgcactgaaatggtttcggtcgaagacttagaatacgaagaactccccaatagaattgaatttaaacctacaatagccgctgaaaccacggacgttttacatgcagaagtagaaagtgacagtgtgtttgttgacgatgaaattgatattgaaggtttaccacagaatttattaaagatttttcaggaatatttctccaatcaaaagatctcacaaaatgataactttttcgatattggcgccagttctttagatattgtccaactacacgaaaaaattaataacacttattcggtaaatttatctatcagcgatttttatcgttacaccaattgccagaagatgactgaaaagttactcggcatgatcggtaataaatctcaagggcagccaaaaaaatcgaaaataactaaaaagcgcaaggtactgaataacaaaaacagaacttatcaagattatccagagcatgccatcgcggtagtcggtatgagtggacgctttccgggaagtaaaaatatacaagaatattggaataacctgctacagggtaaagaaggtatttccttttttactgacgatgaattgattgatgccggaatctctgctcacacgttaaaggcgaaaaactatattaaggcaaagggaattgttgcagattcactgagttttgatccgaccgcgttcggctatactgcacgtgagtcacaatatatggatcctcagtttcgcttgctccatgaagtgacatggcaagtgctggatgatgctggatacggaaactcaaaatatcgcccggttactggcttgtttgcttcttcaggttcaaatcatgcatggttagatttactaaaagaagaaatacaagacaccacagagcaatttggcgttgcactcttaaatgatcgcgaattcctcaccacgagaatcgcctataagttaaatctcacggggccggctgtcacggtacaaagtgcctgttcgagttcggcacttgccatcactcttgcctgtcaaagtttacagatcaatcaatgtgatttagccttggctggcggtgtttctgtcgtgacaccgataaaaagtggttatacctatgctaagggcatggtgaatagtgcagacggccattgccgacctttcacccaagatgccagtggaaccgttttcagcgatggtatcggcatggtcgcattaaaaaggctggatgatgcaattagagataatgatcatatctatggcgtcattgcgggttatggtgttaataatgatggccatgaaaaagctggattcacagcacctaacgcagacggtcaggcggcctgtgttaagcaatcattaaaaatggcagcaattcaggcgagtgatgttgaatacctggaggcacacggtacagcaacacaggttggcgatgaagtcgagctggaaggcatcaaagacgccttaggtgtcacggaaataaatgccagagattgttttattggcagcgtgaaatccaatattggtcacacgaatacggcatcgggtgttgcgagttttattaaaacactgctcgcgttgaaacatcaaaagataccgccatcgtgtcatggcacagaaaacaaacatacgtctctcgaaaacacgcgattccgtttaaccgatgttgctgccgattgggtaagtcatggccgtgtcagaacggcgggcgttagttcgtttggtataggtggaacaaatgttcacatcactgtgcagtcaattgaagagcaacccgccagcagtcagtgtcaagctgaactgattacgttgtcgagtaagagccgcgaaggtttggttaagaccatggcgagactaggcgacttcttagacgaagagcagcactcgtattctctgagtgatattgcctacacacttcaggttggcagaggtgactatgactaccggacttcacttgtcgtcgagaatgtcgaagcactcaaagatgcgctgcatagcctcaaagattcgaacacgttgccggaagctctgccagatcaaacgtcgggtatcgtattcatgttccccggccaaggttctcaatatgtcaatatggcaaaagatttataccaagagctagagatctttaagatcctccttgatgaatgtcacgaacgactaagcagtcaatttagtatcgatctcattgggttactttattccggggacagtgaagaggattctgaaaaactccagaatacgcagattacccaacccgtcattttcgctatttcctattcattagccaagactctcgaattattggggatcgaagctaaggcaatgattggccacagcatcggtgaatatgtggcggcgacaatggccggcgtcatgacgttagatgaggggcttaagcttgtcgctacccgcggcattatcatgcaggaatgtgagcctggcgtgatgctaagtgttgctgcgggtagagatgatctcgaaccgtttttgacggataaagtggcgttagcgacggtgaattcaccgaactcctgtgtcatagcgggttcacaagctgatattgagaaggtacaacagcgtttagttgacaaaaacttccgtactcgccttttgaagacgtcccacgcattccatactccgatgatgaagccaggggcggaaaaattcaaagccgcgttggctgaggtcaattggcagaaaccgactaaagcctatatctctaacgtaacgggccagtggattacgctaagtcaggctaactcagtggattactgggttgaacacttgtgtcaggccgtcgagtttcacgcaggcatcatgacttgtctggaaaagccggggctcaatgtatttttagaagtcggtccgggaagaacgctgtcaacgtttgtcaaacagattgcggcaagcgatgccaatatcttgacattcaatatgatgcgacatcctttggaagcagaaaatgatagaaattatttgctgaaattggttggtcaactttggatgagaggcatttccgttaattggccattactctatcaaaacacccacccgaaacggatcagcttacccggatatcaatttgctggtgagaacatggtaatgggcgcctctgttttagctgcaaagggtgttgaaaaagcgtcagaaacgaaaatccaaaagaatgaaatctcggagtggctatatacggaagcatgggaagatatctccttgccggatgaagcgactcagtcggatatcagagtcgcgttgtgttttgtgcccgatataacgtggtgtcaaccgctttgtaacagtctgaaactagacgaaaaatcaataaaatttgtgttacccgctgatgcttatacctctgctgagaatgtcatcacgcttgttccgggagataaaagacatttcggcaaactgattgatgaattgaagcaagacgcactgctgcctgattcagttatatttgcctggcctctgtctggacagagtgatctagaaacatcgtggttttctgttatcacgctcatacaatcctggacaacttcaggaagtatgacggatttccgcttattgctggcaaacacgaaacaacctgaacatactatgctcaatgggcttgttaaggtcatcacgcaagaagtcagcaaatgccatcctcggttagtccaaatctctcctttagaatccattgaaagacaatgtgaaatactcactgaagagctgttagcgactgatgaacgttttattgtcaatcgaacgcaaacgggtcgctcaacgctggcatatcacaaactgagagctggtttattaaaagagaacacgctgctcaaaaatgagggtgtatatctgatcaccggtggactgggtgatttaggtttactgtttgcggaatatctgattaaggaatacggcgcgaaggttatattatctggtcgacgggtacttccgggtaaacatgaatggaagcaattagcctctatcgataattctgaagcggaaattctgcaacgccttgatgaactctcagagctaggtaaaggggaggtggcctactattcttcaaatgtgagcgataagcatgaaatgcaggttttattagatgcgattgaagaacagtatggttgtttgcacggcattatctgtgcagctggggtgacccgtggcaactctttccaagggatcaacaaactaacgctagaagattgcactcctcagattgagactaaagttgaggcttataagattttagctgaactgacagaaaacaaacccttagatttttgtctactctgctcctcaattgcctcagtactcggaggattgagcttctcagcctatagctcggtcagttcgtttgccgacgcttttgcaaagcaacaaaatagtcagggcaagccttggatcagcgtcaactgggacgggtgggtgttcgaacgcaatgacgcaggagatccaatcggttcatctcttgaccagcttttaatcgagcctgatgaaggtctgaaaatcctggagtgtgctttacagtctcctctgagaggccagcttattatttctacaggggatttagataaacgatttgagcaatgggttggcgggcatttaaaaccgttcaaactcaatgaatttaatcattctcaaagagccgtcgtctcaaaagagcaaatagtcggtaccatcgtctctgtttggcaggactttttaaaggtcacaaatattagccgtgacgataacttctttgagctaggtgcaaactctctggatatggttcaggtcaacaagcgactgacagatgctctggatatggatttttcagttgtcgatatgtttagctatccgacctctgaattgcttgctgactttatcgtgaaccagtatgggatcacccatgatactggcgagcaggcagaacattcagacaccttaaatcagcaccgcgacccgtcagcacaacttaatcagtccagtaccccgattgacagacaaattgctatcgtaggtttagccggcacttttccgggtgcagagaacattcatgagttttgggagaatttgacgtttggcaaggagtcagtcaccactttcagtaaggaagaattaagtgaggaagggattgattcaggcttgctggaaaatcctaactatatccgtgctaaaggcgtcttcccaaatgcaggcgaatttgatgctgaattctttggctataccccttatgaagcccgccagatggacccacaagtcagagccttacatacttgttgctggcaagcattgcaggatgccaggatagcaacgaaagacaaccgcgcaaaaattggactgtatgcctcagcatcggggaatttgcaatggttggcacaagcgatggctacagcggaagggagtgcgggtcaatacagcgcgatgaccgtcgcggacaaagattatatgtcaaccatcgtgtcatataaactgaatctcactgggccaagcatggtgctttcaacggcatgctcatcctcgctggtggcggtcaatgaagcggttaagtcattgcgtgcaggtgaatgcgatattgcgttagctggcggtgtttctatcactttgccaataaaggcgggatatgtctttgaagagggcatgattcactcaaaagatggaaaatgtcgcgcctttgatattcaggccagtggcacggtatttggtgatggcatcggtatcgtagtcctgaaacctttaaaacaggcgttagccgacaacgacaacatttacgccacgataatcggaacggcgattaataacgatggcggaatgaaagtgggttataccgcaccgagcaccaaggggcaggtcgaagtcattcaatccgcactacgtgacgcgaatgttatggcagaaagcattcattttgtcgaagcacatgggacgggaacaacgttaggtgatcccatcgagtttaacgccctgaaacaggctttttcgacagacaaaaagaactattgcagaatcggcagtgtgaagtcgaacattgggcaccttaattccgcggcggggatcgcaggcctgattaaagccacattggccgtcaaaaacagaatcttaccccccacgctacattatgcccggcctaataaagaaattgatgtcacaaacagcccgtttatcgtcaacaatcaatatactgaacttaacgacacgagaaacccgatccgggcaggtgttagctcctttgggattggcggcacgaatgtccacgttgtgcttgaagaagcccaagtcaacaaagataagtcattcaataaaaaggtcgataaccgactgcccatcgtgctatcggctccagatgacaaatccttgcaatgttacaagcaacaactaaaaacctttgtcgagaacaaccaacagcaaatgagtgtgagtgacatcgcttacagtctgatgcaaagagagcctatggcatctcagtttgtggcttctgcatgtgactatgacgcattgatcaaggcgctatcttctggcgagaaagataacgttaaggtgaaacccggtacgacgaaaagaaaagtcgtatttttgttcccgggacaaggggcacaatacgtcacgatggggcatgagctataccacagcaatgggttgtttaaggaatggtgtgataaaggatttacccttgctgataaatactgctcaatcgatttgaaatctctgtttcatagccgggatgaagatcgaaacctgtacaataccgagtttgctcaaccattactctttattatcgagtatgcgctggcacaggtactcaaatcctacggtgttacaccggacgcaatgataggccatagcttgggtgaatacgttgcagccgctcttgcagaagtgttctctttcgaagacgccatcaaaatgatctgtgtgcgtggcaaactcatgcaatctaccgaagatgcagtcatgctttctgtcatgtcttcttcagagagtgttaaagaaatactgacaggcagccttgaaattgctctggataacagcagtgatctctgtgtcgtcgcgggatctgatagtgatatatcgagttttgaaagcgattgtgaagcgaagtcgatcaagacaaaacgcctgagagtcaataaagccttccatactcgctatatggaacctgtcttaggcgattatgccggcattatcagagaaatagcctttaacaaaccgcaaattgctttcatttcaaacgtgacgggcaaatgggcagagacagacaaagtggtcgaatatgactattgggtgaaccatattcgccaacctgttcgtttcaaagaatcgattactgaagtgctaaaagaaggcaattgtttgtttatcgaggttggccctgggcatggactttctaccttggctgaaaaccactcagactatcatgctaatcatatctgcatttcctgtttcgatcgcaaaaatgaagaaatcaacaaacacagtgaactggtacaaaaattagggaaaatggctctgctcaaaattgatgtaaactggcatgccgaaatggcagatttgcaaccccgcttagttcatctcccgccaacccccctacggggcacaaaatatccgacggatattaaaaggttacaggcgctattctcaggtaataaaaatcttggatatcaagccgataagcccgaagagccggttagccagtctaaagcaggcagcaatccacatccaaaggcaaagcgtagcgtgattgatgagttaagcgcgatttggaaacttatccttggggtagacaccattaaagaggatgatgattttatttctatcggcggctcctcactttcagcggtacaagtgattgctaaggcaaaatctgtcaacctgccggtcaacatgagcatgttgctatcagggcaaacgctggttcagatcagcgcatcgttacaaagtgacgatgaaactacgcataagggctggcagttcaatgaacatttttcacctgaaatgtaccctggctctgccagttgcctctattcggctgtccgggaaaagctgaaacatgaacatggcctgacctctgatgatgccatcatgcaggttgtagacggaagcccgctgctcggtatcggggtacaacagttcgaaaatgccactaaaatagtcagcaagcctgtcaactacggcactctgtcaggttggccttcgctacaagaatgctattccttctcttacgataaacagtttttcgaagattatgaggcatatcgccactattgcgaaagtgagctggcactgggtcatttagtgattgtgactggaagcgattattacttacccttttcaccatcatatggcttgccggaatcagaatacatcaagagacctttgttcgagaatattgaattgggtgacgatgatattatcccgcacgctttcgtgcttgttggaaagacaccgtctggatatcagatatacgatggcagctttcaatattttggtgaaatcacggagcaggaatttgagaaaaccgtcataggatttaaaggactcgacttcatgcagtcacatgaagtttataacaagtctcgatccttcatggtgattacagtgacctgtgatggaaaattccataaagataatgatctaaaagagcagactttaaatcggctggtgactgatttccaaacaaagcaggcaatagaaagtaatgaaagtcacttatcttactacgtaggattaacggcgttagataaactcattgaaaaccccgggctgatagcaagtagctcgaattttgacttagcagagatcttctctcgttggtatcagcagatgctcttattgagaaaatttttaaaaatttctaagccagaagtttcaactgaatgtgatcatgcattttctataatcagcgaagagttggacaaagtggttgcctgttgcaaaaacagcagtgacgataaaacgataatagacagtctattattagttaaatctaatctcagcgacatcattaaaaacctatcttaa

SEQ ID NO: 2745 - DNA, 117 bp, Xenorhabdus bovienii
  Coding DNA location: Contig name=SeqID_16881; Position on contig =31937..32053bp; Strand=-
atggatttgtttaccatttcgttgttatttttcaatgacaattcctttttacactcttggttatcaatcaaacccagtttaaattttggtattggtatacaagctattcataaataa

SEQ ID NO: 2746 - DNA, 1368 bp, Xenorhabdus bovienii
  Coding DNA location: Contig name=SeqID_16881; Position on contig =32037..33404bp; Strand=+
atggtaaacaaatccatctttaccgtttacatgaaattatccttcccgatcatattcggtatgtcaattcaagggctttatggtctttttgatgcgatttttattactcgttatattggcacatatgcaatggcaggattctcgatattctttcccgtcttactcattatcagcgcaataggtgtgatgttcggtacaggtacagctgtcctggtttcacgccatttaggtgccagtaataatggtgatgccaatcaagtcgcaataatcagcctgatatcaggattaataatatctctatttttcactttagtcgggttgataaatctagacagtattctttatgcattaggcgcaaccgaagatatcattagctatgcatatgattatgcttatcctctgatactttgtatgccaattttaattattaccattatagcgggtgatctcctcagagctgaagggaaaaccaaacaaatgtttgcaataatgctgactgcatcagtggcaaacattgtatttgacgcattatttatcgttgtacttaaaatgggaataggaggcgctgcaatagcgactatcgttgcaaacctcatcgctttgatatgggcattcctgctatttagatctcatcacacggctatcaatctttcattgataaactttaattttaaaataagtatagtcatttcagtattgatcttgggtatacctacattaatcagcaatctctcttatggcacaatcatattcttagtaaattctcttattaaagaaagtggcttagataatgcgggaagcttactcagtgcatatggtattatatttagaatactcagctttttaatacttccattaattgcaatgatggcagcattacagactttatcaagttataattttggtgccggaaagtacttgagatctttaagtgctttgaaagttgcttgcctaatatcctgtatatattcgattattttaactctctcaatgtttttatctttcgacctggtgtttaaaatttttaccgatgatccttccttgatcaaagaaacaacagacattgcatcatctattttcattggactggcatttttggggcttaccctaatctttatcggcttctttcaaagcatcggtgaagtgaaatatgctacatttatcgttctctctaagctttttgttcagctggccctgctttggtttatatataaaatgtttggtgttgaaaatatggcgttatctttcgttataacagatatttcagtatttgttttatcccttatctatctaagaaataaaataaataaatggcggagaaatactgatatttttctcgaaaatgaaaacagaaacgtcgcattataa

SEQ ID NO: 2747 - DNA, 1518 bp, Xenorhabdus bovienii
  Coding DNA location: Contig name=SeqID_16881; Position on contig =33379..34896bp; Strand=+
atgaaaacagaaacgtcgcattataatcgtattgtcaatctcgtttataagagtatatataaaatgaaatttaagtatctatttatatttttcagttttatattcataaatatttcctatgcagcaactgaatcgaccgggaatgatgccttagaaaagcagctcgttgagtatatgaacgttggcaagatcccagggttgtcaatagttattttagatagcaaaaaagacgcaaaatttattttcctgggcaaagaaaggatgaacgctgataaaaacattgatggaacaaccctgtttgaattagcgtcaaccagtaaggcgtttactgggtttatagcagcaaggttaattgaggagggaaaaataaagggtgatactaaggtttcatcaattttacctgctctgtcattctactatgatagtaaaccggtcgaagttacatttttgcagttattacatcatacatccggtattccattttcaagtatcgattttgtctacggcggtcaagataatacgtctctggcagatatgctcaataagatcgacaagattgaactccagagtgtgcctggaaatagtcactcctactcaaccattaattatggcatcgcagccagaatgatggaaatcgtgacgcaaatgtcttaccaacaactattacagacctatgttttagcgccgttcaacatgaaccagacctctgtagaggcttttgttgaaaacaaatctacaggccatcaaataagttaccttgcacccagaccgtataatgcgccttttgttgtagccaatgttcctgccggatatattcaaactaatgctatagatatggaaaagtggctgcgttttctgagtggtgatgattatccagcattagagcgcgctaaaaaacggatgtttacgccagataaagcggtggtgacaaatgaagggaataacagtcactatgcaatgggatggtatgttgatggagagaagatactccatactggcatgaacccaagcttttctagttttgttggtgttcatgtgggttccggtgccgcagttgctgtcatggccaatgtaaatagcaatgtgacttttgctattggcgagcagatattagatcaactttcttcaaatcaacaaatattaaaattaacttctcccgatgacgttaagttatttgattcatttgatcgtgtttttttaatcataagcctgattattttagcctttattctatttattggttttagaatttatcgaaatattttcgtgaaagaaagagcgagttttcccaagaaaaatcgttttattctaattttattaattattttttgtatgttttgtaccgtactgagtctcattttgccgatggcaatattaaatatttcctggaaaacatttgttatctggatgcctggtagctttttattgatgagtgcacttttaatttccagcttactggtaagtatacttaattgttcaattgtactcgttcgccgcattcagtttgctaaggaataa

SEQ ID NO: 2748 - DNA, 4467 bp, Xenorhabdus bovienii
  Coding DNA location: Contig name=SeqID_16881; Position on contig =35063..39529bp; Strand=+
atgtcttgcggtaataaattatatagtatgacaaggatccagagaggtatatgggctacagaagaaaaataccaagggacgggtatgttcaatattggtggcacctgtagcgtcgaaaagaatctggatttagttaagttacgcgatgcaatcatacaggttattagagaaaaccagtgcttaaattttgttctgaataatgaagttcccccaaagcttgtaacttcagaacgaaccgaatttatgataggaaaattcgattttagcgcgaatgacaagcccgatgacgcatttgatcagtggcgtcatcaagtattgtctgctcaaatgcaaacggattcatcactatatgacttctccgtctacaaggtcactgaaagaaaatatgggtttttgattaagttgcatcatattattgctgatgcgacaaccatgcaaaatatgatcaccagaatttgtgaatgctatgaaaatagcgttaataacaaagaagatgcaaaaattgttgaagacgaccaacagtactttctggacagagaagaaaagtatctttcaagccactctcactctaaagatagcgaatactggcaatcagcgctttctaatctggatgggggtactcactttattctgggaaataaaagcttagccaccgctgcaaagaggaaagtctatgatattcccaatcgagtatccgatcatgtgaaggcgcttgcctccctatgcggttgttcggaaagttcgatatatcttgctgcattgtacctgttactgggaaggttttcggggcaggaaacgttgaccgttggcatgcctttacatggtagaaaaaagactgactctcatcgaaactcaatgacggtatctacaattgccctgcaatgtgaggtcgatgaggagcaatcatttgaggatttgttacaccaagtaagtaaaaacacccgagaagcttaccggcatcagcgattcgattattcagatctgcttaaaactgtcagtaataataatgaaagaagcgaagagatttttgacgtaagttataactactcaaatacaaaatatgaaataacgctggaaaacttacctttgattgtcgaggatatatttcccggtgaacagcaatattctatacagtttctcgttaaagagctgtttaatgaaaagatcacaaaaatatattgtgacttcaaaacaaacgaatattctgaacagcaagtagattctattatcaaccaattcatagtaacctgcgaacaggtctgccaattcccatcgcgtaaactggtcgaattcgatttagtgagtcagagtcaattaaaagaaattgaatcggctaaatataatgctgcgcgtactcatctgactgtcatcgagctatttaatcaaacggcgtgtactaacccagaacgtgtcgcggtgatagagggtgacactgaagttacttatgcagacttgcagtataaaatgaatgcaatcaggaataagcttaaagaatatggcatttcgacagactctcgtgtcgccgtattattaccaaaaagttcgctgcaaattgcagcactgctggccattatgcatattggcgcgacttatgttccgctggaacgggatttaccggacgaaagaatcgcgtacatactcaatgatagtctgtgtagtttagttttatgtccgacagaatgggcatcatccttacctgagcattttcctcatcatgacctgacctcactacagacgagcgacgggattcacccggaaacggtgccctgtgaatgccagagtgaaacagcggcttatttgatatatacatcaggttcaacgggcttgcctaaaggcaccgttattcgtcaggctgaattagttaattattgtcagtgggcggctaagacttattaccctgaaaaatcagatgtcgccgcttactacacaccgctgacgttcgatctgacggtcacctctatcttcccgccattgctggccggtgcaacaattaaaatctatcgggaaagtactaactttgtactgagcgagattattcatgatagcaaagcgacagtcatcaaatgtacgccttcgcatttgcaggccatcaagcatgaaaatatagagcgacactgttctgtgcgccggtttgttgtcggtggagaaagcttaaaagtggaagtggcgagccacactgatacgcagtttcatggaaaagtcgaaatattaaatgaatatgggcctaccgagacagtggttggttgtatgatccacaaatataacccccaccatgacaaggccatctctgttccaattggtattccgatagacaatactcaaatttatattttagacaaacatggcagacattgtacaccgtatatcaaaggtgagattgttatcgcaggtaatggcatatcggcgggatactggaataaagaagaactgaccagagagaaattcgtaacagataaatttcatcctagtcaacggtcttatttatcaggcgatttagcctaccgagatgcgacaggaaacatcatctatatcggaagaatagataagcagataaagattagaggacatcgtattgagctggatgaaatagagagtcggttgttaaagcacgaactcgtcaaagatgccgtggttctggtcgatgaaatcgaaagtggctctgcgatattgaaggcttttatcgtagcggctgataagaaaacggccagcaagcctctgctttctgactatttgtcatcctaccttcccgcttatatggttcctcaatatttcaaatttatcgatgaaatacctttaacatttaatggtaaagtgaataccgatgttttatctcagattaaatttgaggttgaagaaattgatgatgagatagagaacagtgatattgaaagaaatgtactcgatgaatttaagcatattctgcgttgcgaagagctaaccgtaaacagtaatttctatcaatacggtggtgattcgattaaggccattcaattagtcacgcttttacaaagaaaaggcttggtggtaaaagtgaaagatatttttcagttaccgacaccaagagcattatgccgactcattaatgatagaacccctgtatcttgtgaagaggaagacattgaagttaatgagtttgctttaacacccattatgaaatggtttactggtttaggtttagatagaaaagatatctaccatcaaatgttgactctgaaaatatccagtcaactggataattcagatcttgaaaaaatattcaatagacttatctcttctcatccgatattgaatacgtattttgatgaaagtagtcgtaagttattggttaaagacaacgacagcttagtaaaaattgatgtgctggatgtgatttgtttcgaagagaaagagagtattgtacgaaatagattgaatgaaacagaatggcctcaaacacctttatttcaagcggttctgttacggaaagagggcgaacaggagctgatggtttttgcccatcatttggttgtggatggtgtgtcatggagggttttacttgatgatctcaacctattagccagccaacgggttcagggaaaaacgctctctctgccaaaaccaaacaaccgttttgccaagtgggttagtctggttgaagatcattatcgtgatcttgatgctgatgaacagtcttactggcaagcacagagccgttcgacagcgcttgcagacatcgctaaatactcttcagaaaagccggaaataaagtattttaatgccaacctgacgaccagggatcaggggcaatttttgcagttatgttcctcaatgaaaatcaagccgaatgaattattctttgcaatttttacttatgcgctatttaaacagttcgacaaaaataattttgcggttgaattagaaggtattggtcgaagcttacattccagcgatctcgatctaaatagaacggtaggctggtttacctcaatttatcctctggttattgattgcaacaaagatattatcagccatatcaagcaagctaaggaaagattacgtgcagtgaaggataatggtatgggatatcaatctattcgctacagccctacaggaagtcaatacgaatatgaacataagttacccagatttaattatcttggggactttgatcaaagcgaaacaaccgatctgatccaaataaaatcgattcatcccaatatcatctcacatgaagataatctatatacagacctgctggactgtaatatctactgggaaggttcttgcaaactcagcatgagctacctgaatacgcatgtgaatgaaagtgatatcaccaatatcactaataccctgcgagatacgcttgaatctctacttaatctggaagaccaattatatcagcgtgtatatacattgactgacttcccgactatttccttatcatccacagagcttgaagacttagtctctcaattatctatataa

SEQ ID NO: 2749 - DNA, 5775 bp, Xenorhabdus bovienii
  Coding DNA location: Contig name=SeqID_16881; Position on contig =39547..45321bp; Strand=+
atgacagattcatttgatattgccattgttggcatggcttgtaattttcctgatgcaaaaacccccgaagagttttggcaaaatctgatttcaggcaaggaaagtattaaaaaattcccccatgaagagttaataaaaagcggttacaaagaggaggagataaacgatcccaactttgtcgccgctaaagcggtcctcgatgattataagtctttcgataacaatgtattcggctatcttaaagatgaagtggataagatggatccccaatgccggttactgcacgagtgctgttggcatgcattagaggatgcggcctatgctccgagtcatagccgtgaaaggatagggctgtttgccggtgcggcatctaacatcccctggatttcaaacttgcttaaacaaaagcttacgcctgccgaaacgtttgatatcgtaaactggaacctgcctgaatcaatcattaccaggacggcctaccgattaggcctgaatggtcccgtaatggcgattcatacggcgtgttcaacgtcgctagttgccattcatacggcatgtcagtctattctaagtggtgattgtgatttagcgttggcagggggggtatcaattaccctgcctcaagagtctggctatctgtatcagcagggaatggttcgttctgccgacggtcattgccgtccttttgacatcgattcgaatggtacggtgggggggagtggagccggtattctcctgttaaaaccgttagacagggctttggaagacaatgatcacatacacgcgatcataaagggttcggcaatcaataatgatggtcagcgcaaagtcggcttcaccgcacccagcgtagaagggcaggcagaagttatttcgagtgctcaaatgctggcgggagtagaagccgaagacgttagctacattgaatgccacggaacagcaaccgaaattggcgatcctattgaagtttctgccttgtcacgagtgttccgaaattccggcaatgtctgctggttgggggcagtgaaaagtaatattggccatttagatgaggcagcgggtgttgctggcgtgattaagacggtcatgtcactgaagcataagcagctagcaccgactcttcactatcaccagccaaacgataagcttcacatagaagaaacgccgtttaaagtcgtagataaactcatggactggtctgtgtcggctaacgaaaagcgcattgccggcgtgagttctttcgggattggagggactaacgcccatatcgtgctcgctgaagccgataagcaagaagcgcttcatgaagatgaataccctaacgtcttcttgatatccgctgagacacctgctgcgcttaatcataatcaacaaaatatccttactgcgcttcgatcctcacaaaaacacagattgtgtgatattgcctatgtgctacaagaggggagaacccaccaccgttaccgtaaggcttttgtgggttcaaatattcaagagataggtgaagcactggaaaaggtcaccgcgaacccaacgaaagcaaaagattcggaacgtcatattgtatttatgttgccaggacaaggtgcacaatatacaaatatggcgttgtcattgtatgaaaaacatgcggtattccgctcgcaagttgatcgctgcttgacgatagcttcaaggtatcttggtgagtcattgaaagaaaaatggtttcacaatgataaggtcaattatctcagtgaaacgcaatatgcacagccggcaattttcattgttgaatatgcactggctaattgcttaattgaagcgggtatcaagccctcggccttattaggttatagttttggggagctggttgcagccacaattgcagaagtattcacattagaagatgcactaaaatttgtcgttaaacgggggcagctgatgcagagcctgcctaccggtgccatgctgagtattccgcttccggcgtcagaggtattagcactttgctctggtggtatcgttgtcgctgtagataataaagattcctgcattgtttcatccgatgaaaaatcaattgaggaattttcccaggtattaaagaaaaaacgtatcttaacaaccccgatcaagtctaagcacgcagctcattctccggctatggcggcgataaataaacaactgttgcgggtactttcgggtttcacattaggtgaacctaaaactcctattatttcatcagttaccggtgaggaactgaccgccgccgagtcaacatcaattcaatattgggctgaccaggcggaaaaaacagtctgttttattcgtggtctggaaaatattctcaataataaatcttgtgtgttcattgaagtcggagtgggaagagatctcgttaatctcgtccgccgatatgtcccccaagatgcttcacagtcgatcatacaattgctgcctgaggataataaagcgcaaactcagccgtatttattctggtctgggttaggcaaaatatggcaacagggaattcagatacaatggcgaaaagttagcgctgcacaagattgtaggcgtatatcattaccgggttatgcttttgaaaaaagtgttttctggcccaaaaacgccaatttcttgagcttattttctggcattcaacacgtagagaaagatcaactttgtattaaaaagaatgacaatatgtcagattggctttatcaagccgcttggcagcaacatattttgcgatctacaaagccggtggaatgcacaaaatcggcgctaatcttcaagcttggctcttctaatgatcaaagtacaacctttgaaaaagcattattaaatcattatcaaaaagcggttcgagttaaggttggctccgaatgtgagctagaaattgaagcattgagcacccttcgctgcctaaactatggcgactacaaaaatctctttgatttgctcaataataacgaaatctcgatagaagaaatggtcatcgattgtatcaatgttgacttgtctctcaatgagcaactggccgctgtactctatttattaaaatcgcaccgtgcattttccagtcaccctaatttaatgaatgtcacattgctgattcagaatggcgttgtggtatgcaatgaaccggacattaatccatttgctgctgctatgatgtctatcagcacggttattcggcaagaattccatgagttgtgctgtaaggttattgatgtcggtgcgttgaatgattgctctgatgataagttgatccgcgaaatagccgagcgtgacaataaaaatgtcgtttaccgcaacaaccgaagatgggctgaggtgtttttaccttactcaccgatcatgaatgatgagacttctcgattgaaaaaagagggtgtgtatctcctgattggcggacgaggctttatcggacacactttcgcgcaatatcttgccactgaatataacgcaaacctcattattacctcacgatcccggcaaaatatcgatgacaaatggcaacaagtgtccaatgatgccgctaatttagaattcgctcaagtcgatgcgagtgatcgggtcgcgatggaagcatttattcaggataccactgccaaatatggtcgcattgatggtgtattttacttagcgggtttgaccggtgaggcctctctgagatcaatcaatgaaactgagagtgattatattgatagtcatcttacctctaagcaaaaaggaatagaggttttagagcaggtattggaacccgttaattacgatttttgtttaatcctttcttctctggcacctattttgggtggcttaggcttttttgcctatgcagcagccagctcttatttagacgcttttgtattacggcacaaccggcaaaatgacaaaaaatggacattgattaattgggatggctgggaactggctaaaaaaacagaacttaatgcgaaaatcggtagcagcctgtcacaccttctggtgacgaaagaagaggggatctcattattagaagaggtacttaagtatcaggaaaaggatgcggttgtcatttcaaccgcagatatcaatgccagaattgcacaatggtcaaatccttctttaagtaaaaatgaggaggggtctgatgatagcggttattcagcaagacctgatttggactctgagtatgtcgcaccgaacagtgagattgagaaaaaactcgtttcaatttggcaagaatttttaagaattgaatcgataggcatgaaggacgatttctttgatctgggtggaaattctctgaaggcgataacgctattatcaagaatccataaaagctgtcagatcgacgtgtcgttaacgcatttctttaaaaacccgacgattaaagacattgttgctttaaccgattctcaatttggcaaatcggagtatcaggcgatactgccggcagaagagcaagagaactaccccctatcaccaggccagagaagactctatttgcaacaaatattagataaaaattcggtggcctataatgagacagccgcttttagcatctcaggtaaattagacaaagacaaattcaacaaaacactacagtcactggttaaacggcacgactcattgagaacatcatttgtactcattaacggagagccaaggcagaaatgtcatcaagatcttgagatcaatttagaacatgtaaagttgaactcatcaggtttgagcaatgaggaaataaaaagtcaggttcaaagtctcattaaaccctttaacctaaatgagcttccgttaatgaggccgatcttaattgaggtgaaagaagatcaatacattttcttcttagatttgcaccatattatttctgatggcctttctcaggatatttttgtaagagattttttagagatataccaagataagcgactgaaacctttagatgttcaatataaggactacacggtttggcaacataatatggcgaatagttgtcggatacagaaacagcaagaattctggatttcaaatttaaagcaggtatcagaactgcaattaccgactgattatcccagaactgacagccatagccataaaggtcaacgtatctattttacaattaacaaaaatttgagcgatagactggatgaatttgccaatagagaaaatataacgagatttatgctgtttatctcatcatatgctctattccttaaagatatttctggccaagatgcgtttgcagttggcacgcctatattaggtcgtccgcaaagcgagttacaagatataataggtatgtttgtcaacctattacctatcacatttaaacttgacgacgatttatcttttaaatgttttgttaataatgtggctgaaaataccattgcagcatttgaaaattcagattttcaatttgaagatatggtcaaagcgctcaatattaagccaaggttaaatagaacccccatctttgataccgtgttttcgtatatgaacattggaatggcggactttacattaccggatgttaaattcagccgctatgatataagccaggaaagttcacgatttgacttggcgttctttgtcaaagaaacagaaacagggtatgagtttagcttcgaatacaaaagcgagctatttagagatgaaagtattgaacgcttcaaagataaatatattgcactcttagaaggcattgcctctaaacccgatgacagtatcaggctgttattaggcaaaggtgaatgggataaaaataacacgttgcaaacagaagagttgttggactttaatttttaa

SEQ ID NO: 2750 - DNA, 732 bp, Xenorhabdus bovienii
  Coding DNA location: Contig name=SeqID_16881; Position on contig =45450..46181bp; Strand=+
atgccaaatctaattaaattaaatacccctaaaaatgcaaaattgaaattataccttttgcatcatgctggtggctcacacatgttatatagagcatggcaacgagaattaccggactggattgaatttaacgctttagaacttcctggcagaggaatgagtttcggggagcgcagcttggaatcaatcgaagacatgattgaactattcctttccaagattgaaactgataagccatttgcattttttggccatagtatgggcgccttgcttgcttatgaattaacgctcagattacaaatgcagtctttataccctatatggcttggcctttctgcttataaaccgccgcatttgagaaatacggaagctgcccgtcgcggcacaatgacagaccctgagcttttagaatatttaaaaacattaggggatgtcagtgagttaatcgcaaatgagcaagtactgaaaatcatgcttaatattatcaggaatgatttcaaggccattgaaaactggaaaatgagtgagtctattatccaccctgaaatattagttagcctatattccggccaagaggataccgcagtcacacctgaaattatgaaagactggggtagatatatttcaggtcaaagtcagataagcgcgtttccgggaggccatttttacctgcaaaaatacacattggatgtcatcaacagcttatctcgtgatatcgctaacattatatag

SEQ ID NO: 2751 - DNA, 324 bp, Xenorhabdus bovienii
  Coding DNA location: Contig name=SeqID_16881; Position on contig =46190..46513bp; Strand=+
atgaaatatgtcattatctggactttagtttttaacgaaaaatggaatgcacttaatcgttcagagcgtcaacaactccagaacgaatctctgccggaaatactcagtaaatacaaaaattcgattaatatgcgaaccatagacaccgaaggattcacggctgattttcaagattttgccattatcgaaacggaaaaactggatgactactactgtatgttacaggatatgagaaataccagagtactatcggaggggtatttgaaaatatccaaagtatttatgggcatagaaaatgctcatgaaatttatgaatccaattaa

SEQ ID NO: 2752 - DNA, 3156 bp, Xenorhabdus bovienii
  Coding DNA location: Contig name=SeqID_16881; Position on contig =46542..49697bp; Strand=+
atgcctgtgaattacaacattgttgccttaagccctttgcaagaagggatgctatatcactccattaaagaagaaagcaaaagtatttacgtcaccaatttcactctagtccttaatggcgatattaatgataaacgattagagaaagcctggaataaagtggtatctgagcatgattctctacgtacgatattaaggtggcgtggtttaagccaacccgtacaaattatatttaaacataagtataatccattatcagttatacatgtaaacccagatcttgttcatgatatcaatagttacaatgatagaattaagttttgtgagactgaaattgatttagaaaccaacccagtaaagttaacactgcataaactaagtacgtataaatcactactccatctacagtatcatcatatatctttagatggttggagccttgggatcctgatcaatcaactttggagttattatgataacgaacacctaagtgatgaagactgcaaccttaattatgaacattatattcaacatttgaataaggtacgcgattgtaagggcaccagagacttctggattaacaaaatagacgttgacgcagcaataagtctgccttcaatcaatgactctgaaacgtatagcatcaagtgcctgactcactccctggataaaatccttttacaatcggttgacaaattctgcaaaagcaatgaagttacgatagcaaccgtattttatacggcctggagtttgatcttatccaaatataatgactctaactctgtttgttttggaaccaccgtgtcaggaagagataacttgttggccggtattgaagatagtattgggctttatattcaaacgcctccactcgttgtggataatctgaatggctctctcagtttaaaaagtctggtaaaaaaactgcataatcaaattctcgaaagagatggctatactgaatatccgatatcagaaatacaacatgttaaccaagtccggcaaaatctcttcgatagtatcgttgtcattgaaaattatccactcgccaagcgattaagtgcgctatcaactcacgttagtgtcgagtcatatgatatttttgaaacaacaaattttgaccttactttggaaattaatttacttgatgatgccctattaaaatttagctttaacagtgccaaatttgataaagagataatggataaagttttgatccatttcagcaagattattgggtatatcgctacacaacccaatttaaccttaagtgaattgaatttactagatgatgaagagtacaagaatattgtctttgattttaatgataatgatattgtttcagataaacctcttcactcagtagacgcttggaataaatctgtagaaaaccatagtaatgaagttgctattcgctcagctaatgacgtatttacctataatgaacttgatagaatagtcaataaaattgcgcaaggcttaatttcaaaagggattacgtctaaagatttagtcgctgttaaatgtaagccgagtgctcatactatttctttatttattgccattaacaaaataggtgcggtatatgttcctttggacatatcaaccccagaagaacgcgtcagtaatattattactcaaggtgttaaatggttaattgaggatacagaactcagaagttttgttgcattaccgacggtagaagcaaaaattccggagcatgatcatcaagaaaatgatttgatgtacacgatatttacttcgggttcaacgggtgaacccaagggagtcatggtcgagcatcaaacagtgatgaactatgtatactgggctatagagaaatatcattacgacagtaaaaaaacagtctatcctttatttacgagtctggcatttgatttaaccgtgacctctatatggtgtccactgatatccggcggcaccattgaaattgtagggaaaaattcactggaatcaatacaggaggtcagtaagctggcggctacgacgcatattaaactcaccccctctcaactcaatctactgagtcaaacaaccgatttctgccatagcaatttatcaaccttcatagtcggtggtgagcaacttgaaacctcattgtgccgtcaggtagcaaattcgttagttaacccatctgggatttttaacgagtacggcccgacagaggcaacggtcgggtgcatgtattatcaatatgatccgcaggcagacaagaaaaagttgtcagtaccgatcggccgcccgattaataacgcgcgtatctatgtgttagatcggttcttacagccacaacctgagggagtacccggcgaactttatatcggggggaaaatactggcacgtggatatctcaataaggatgagttaacctcagagcgctttatttcaaacccgtttatccctaatgaaagaatgtataaaacgggagatttagcggttatcagagccggagggattatcgaatatattggtcgcaatgataatcaagttaaagtaagaggctatagaatagaactagatgaaatagcctctgttattaggtcgtataaagattgccataatgcggcagtattggtgaaagatattcatggcgagagtcagattgtggcatattatgttgctgacgttcatattcctgaaagcgatttaagggcctatatcaacgccagattacccgattacatgacgccaaacatttttattaaactggatcgtatagtattaactagcaatggtaaaattgaccaacacaccttacccgaagtgaccccagaaagacagagtaaatttgtctttaatgacaaatcagaacacaaacaaaaagttattgaggtttttgagaatgttttagctgtatctgatatagatcaaaaccaaagtttcttcgagctaggggcaaactcaattaaaatccttcgtatagccaatatattaaatgaatttttgccacgaaaaattaaaattgtagatttttttacttacaccaatataaataagttagtatcatatattgagcataatacatcggatgatagtgtaataaatattaagtccgcgagtgagacagtttctagacgcgcaaaattagctaaccgtagaaagactcttatagagaaagcgagtttagagcactga

SEQ ID NO: 2753 - DNA, 459 bp, Xenorhabdus bovienii
  Coding DNA location: Contig name=SeqID_16881; Position on contig =49798..50256bp; Strand=+
atgagtaataaatattctggtgatataaaattgagaccgattgagattgacagtgatgtacaagcagtagtcgatgtttggtttaatacttcaattgagtgccatgaatttgtatcaaaagacttttggtattcatgtaaaaaagatatgaaagaaatttatattccaaattccgagacggttgtcgcgacgataaacaaggaaatcgtcggttttattagtcttcttgataatattttggcttcaatttttgtacttcctgagtatcaaaaccgagggatcgggttgcaattattaaatcatgcatttgaagtccgtaattctttaacgcttaatgtctatgaaaagaataccaaagccagacagttttatgaaagtcagggctttgaagaaaaagagcagggtatcgatgaacataccggcgagcctgaaattacgatggtatggagccgctcatag

SEQ ID NO: 2754 - DNA, 102 bp, Xenorhabdus bovienii
  Coding DNA location: Contig name=SeqID_16881; Position on contig =50207..50308bp; Strand=+
atgaacataccggcgagcctgaaattacgatggtatggagccgctcataggttcccgctgagtttttcagatgataaaataattaacactgaaataacttaa

SEQ ID NO: 2755 - DNA, 2577 bp, Xenorhabdus bovienii
  Coding DNA location: Contig name=SeqID_16881; Position on contig =50504..53080bp; Strand=+
atgattaatgaagtagaagagctaaacaaaattcaaaaaaaggaacatttctggagggggtttatcaataactgtaaacacccggagttttctaactactttactaaaagtaacgataattcaggtgtagataagatttacctttcaagtgaaatatctaaaaacttgttatcgatagccaacggatctgataaaagattaagtgcattacttatatctttaatcggatttatccagtcgacaatgcttcgtactaatgaatcggtcattttaaccacgagctatcattgcgaggacgaaagcgctggcatgttgtgtgttccagtaaagcttatctacgagaaaacattgatagatttaataaaatcgacatcaaaaagcatacaggatgttttaccgtacggggttaactcttttacctctatttttgaaggagctgttcagttcacgtcagcagtaatactcaaaaactgccagagcgttaataaagaaatagaggacttttcctgttcacagcttatttttgagcatgacggcgaaaatattttttgtgagattcattcaccctatgatgccaactattataacgaaattataaagatggttgagttgttggttcggcagatacgatctgaaaacccgctttcttcactcaaactatcagaatcctctcacatagacgttaataaaacagtacctgaaatagaaagcggctctacgatccctgctttgtttatgaaaagagtcaagatgcatcccacacggattgctgtaacggatgcgcacgcttctttcagctatgcagagttagatgaactgagtaatctttttgcatttgaaatgttaaaacaaggcgttgcaaaaaatgataccgtcggtatacatatgaaacgctcatgttcggccattatcgtcatgctggctgttttgaaaattggcgccaagtattgcccatttgatgtaaattggccgatcaaacggaagatctatgttaaagatacggccgccattaaatatctgattgtctctcatgacacggcctgtgagctcagtgattgtaatagcattatttacggatcgactgacagcaccaccaatacaaacctagacgctgaatttaacgacgcagaggccggtgattctgcttacgttatcttcacttctggctcaacaggcaatcctaagggagtggaagtttcccacggagccgtcatcaacctggtgcaagggctatacgaacgcgtctataaaaattattcaggctctctgaacgtatcgatgatctcggcattgagctttgacgcatcagtacaacagctttatccatcgctgttactgggacataccctgcatatcgtgcctgatgacatgaggagagatgggcgtaaagtcgttgaattctggaatgaaaataatattcacattgctgattgtacgccaactcatctcagaatgattcatacacaatttaacgagcaggccatttgctgttctgtgaatcaccttatgataggtggtgaattactggaaaaacataactggtataactttgcaaaatgctggcaatctgttcctaacgcatctaatgcgtatggccctaccgagtgttgtgtacaatctacttcgtttgaatttaatgacagccgtcaaattcatacaaccaccattcccattggctttccgatgccaggtgaaaaagtcgttttgattgatgatttcttgagaatattacctgagggcgccattggggaaattgctattgcaggacagggtctcgctaaaggttatatcaataacccagaattaaccgctcaaaagtttgtcatgattgacggagaaaggtattacagaacaggtgacctggctcaatatgttggagacgtgggtttagtctatctcggtcgtttagacaaccaggtaaaaattaacggttatcgcattgaattaggtgaaatagaaatagctattcaacaagtgatgactgaactcagtagcacaaatcaatttgatgcaaagccaatctgcgatgtctttgtaaccgttaactctcaagactcagataataaattcctcgtggcttacctatatagcaatattgaatttattagtgatgatattaaatcagcccttgctgaacggctgccagattatatggttccggcctattttattcagcttgaagcgttcccgcaaaatagcagcggtaaaattgatatcgccagattaccagaccccagtaactttatcgttaacaagagagtaattccttgcagtaatgaaacagaagagaaaatactggggctgtggtccgaaatattaaatacaaaaaaagaaaatataagctcatgtgacaatttctttgacttgggcggttcttcgtttaagttagttcaacttagtctaagtttaggtgaactctttaataaagaaattgaagttgttgatttgttccaatacacaaccataaaacagcaggcagaattaatcgataacaacggagaaaatgacaatattgtcatctcggaagatcactcagttgaacaatttgatgaagctttgaaaatgtttggtaattaa

SEQ ID NO: 2756 - DNA, 4464 bp, Xenorhabdus bovienii
  Coding DNA location: Contig name=SeqID_16881; Position on contig =53196..57659bp; Strand=+
atgagtcaacgagaaaatctgaataataagtcacatcaggatctgacaggccttgaaatagctattgttggtgtttcatgccggtttccaaatagcccaacgattgaaagcttttggaaaaactgtctcgagggcaatgattgtatcacccggttttccgacgagattcttgcaaaaaatggggttcccaagcaggattattccagcaataactatgtcaatgccaagggggttatcgataagcccatggcattcgacgcggatttttttaattacaacaaacgagaagccgagtttcttgagcctcagatacgtaaattgcacgaatgtggctttgaagcattaggttctgccggcttggttcctgcggtttacgccggtaaagtgggttgttatttaaccgcgagtgcccagttgcaatggcagatggccgcttatgaggaatgcgaacaagatggtgccagtctgttttcggcatttaatttagttgagaaagattttgcagcaacgcgtttagcctacaagttaggcttaaccgggccagcggtttcattacaaactgcgtgttcttcttcattaaccgccatacatatggcggctcgcgctttgttactcggtgaatgtcaaatggctttggttgcggctgcggcactggtaacaccgaatcaacaggggtatttatatcaggatggcatgatcacgtcgccagaaggcgtttgccggccatttgatgaaaaggccaacggcaccgtgggcggggaggggattggtgcggttgttctgcaaccgttgaaacaggctcttgcagataagcgccccatactggctttgattaaaggtactgcgataaacaatgatggcgcgagaaaagtcggttataccgccccgagtattgaaggacaggccgatgtcattagcagtgcaattaaaatgtctaagattgaccctgagtcgatttcatatattgaggcgcatggtacggcaactaagttaggtgatccgattgaaatttcagcgttaaagaaggcctttcctggctgtccagcgcaaagcattgccataggttcagtaaaatctattgtcgggcatttagatagcgcagcgggtatggcaggtttaataaaaacggctttaatgttgaaaaataaaatgctgtgtgcaaatcagtattttaccaaccctaatcctcagataaagcttgagtcatcccccttttatatcaatcaaaatagccaggaatgggtgagtcaatcaattagaagagcgggagtgagttcttttggtattggggggactaatgcccatatcgtgctggaagaatcattatttcagccttcaggatcggaacccgcggaacgtctgacgctcttacctctatcggcaaaaaatgaatcaagcttggcgatgatggaaaaagcgctgcttgataggctggcagataaaaaagatacattgtctgatatcgcttataccctgcaaaatggcagggaatactttagccataggtcagtattaatttgttcagaaagtcagggatcctactgtgaatctgactttatccgcggaaaagtggaatacaccggcaagaaaatcattttcttatatccggggcagggtacacaatatcagggtatggcttatggtctgtatcagcatgaaaaaacatttaaagatagcgtccatcagtgcctgcatttgttaccagaagaccaacaaaaagagttaactgacttttttatcggcgcttcggaacaaaatgacgcctcttccgaaatcactcagcttgcgatattcgttgttgagtatgcaacaacaagactgcttgagagtaaaggttttaaaccttatgccttactcggacatagtttgggtgagtatgtcgcagcaactgtatctggcgtattttcattagatgatgctctgcatttggtcagccagcgagcaaggttaatgcaaagaatgtcaccgggaacgatgctcagcgtgccattgggaatggagaaactgcaagattacttagatgacacacttgaagtcgcggcaatcaatggaagagaatccatcgtggtatcaggcgctcccgcagatattgaaagactggagtcgctgctgcaaaacgcggggattatttgccgaagattaaagacatcgcatgctttccattccaggacgattgatgagatccaaacggaatacgctgagacattaagtacaatcaacttcagtaaaccctacatccccgtcctttcgaacttaacagggacttggcatagtgaagaagagattatgcagcccgattactggctgtcgcatcaacggcagaaggtggatttcttagggtgcttagaaacactgtctgagtctaatgatctcatttttattgaggtcggccctggaaacaccttatccagtttcactcaaaaatactttcaaagtaaaaacgaaaataaacctctcgtcgttaacgcacttaggcaccctaagttgccagaagatgaccaagaatatttttacggtcaactggcaaaaataggctgcgccagcaatgaaatatattggcaaaatatcaatcagcaaaaaggcaaccttattcatttgcctgtatatcaattctcacagacagaatacagtaagataagagacaggcttatttcaggcccgaataaaaaacgtcattctgtcgatcctgaccaaagctctacctatctgccgggctggcaacgtgaagttaattttcaaacggaagaagttaagcaaagccaaagcgttttcttactttgtcctcgaacggccgaacctaatcgtcgtacattagctaaagtattatggcctgatagcgacgtgttttttattgatgaattagataaattagcctcactcaaggtgacggctgaatgcactttcgtgcttattccagatcaaagagaattcagcaccgatcctattgaacattatttgcaatgggtggatagccttagaactctattatcttcgatacctttgcaatccatgcggtttattctctttacacccgaaattgaaaatgtattgggatatgaacaagctttacccgccatttcattattaaaaggcttggtatggtctattccgcttgaataccaaaaacatcaagcgatgcagatagatttcgctatgcaggatttggctgacaataacaaattgaaggcactaatacggacaattgcaagttcagataaataccgtcaggctgcaatacggcacggtcagttgtggataccggaatttaaaccattaccagcccatcaattagttcatgttaataaatgccatgaattaaatgtgggtggcttggtattcattagcggcgggttaggtggaataggtttaaagatggcagaatctttggccgaccaatataaagcacgcctgattttagcctctcgctctgagttccctgacagatccaaatgggaagccattaaaaatgacccgacaaaagtggaaacggctagcaagatcgcgagcattgagaggatagaacaacttgggggtgaggttcacatccatcaagttgatgtttcctgtaaaacagcccttcatgtgttgctcaccgctattgagagcgaattagggaagtttagcatggtgattcattccgcaggttctgatgccggagcattaatcatgcaacccgatctcgctcttcaccgtgagatcatggcagcgaaagtcacaggggcagacaatctcatctcttattttagcgataaggatctccgttctatgctgttttgctcttctttactgtcatatcacggagcgtcaggacaatcggcttatgtggcggcgaatgcctatctggatgcgcttacagataatcaggaatctccttttagaattcattcaatcgcttgggatcgatggttagaagttgggatggccgctaagaatattcaagatagcaacgaaactataggtttgaccaatcaagagggtcaggcgctatttcttcaggcaatagcttattaccctgaaagaatggcggtgtccgtgttgcctataaacaagcgattgcaggaaagcgaacgttcaaaagtacgggttaaaagcggccccgcagagaaggcaattttagaggctaagacatcagtaaaacaaacaatcttagaggtattgaaacatcaattgggtttatccgaaattgatgagcgtgccagattcttcgatttaggggcaacatcactcgatatagttcaaatcaatgaaagactaaagcaaaaattaaatgccgatattccaattgctatgatgtttacctacagctcggtgattaaacttgaaggggcattgcggcctgtactcaacaaagaggatcatttatcggaagataaaatagacgacctgcaatccgggggaagaaatttggctaaaaatcggatgaataaacgacttaaaagacaggctccattaaagaacgaataa

SEQ ID NO: 2757 - DNA, 189 bp, Xenorhabdus bovienii
  Coding DNA location: Contig name=SeqID_16881; Position on contig =57628..57816bp; Strand=-
gtgttactgccggcttttaattacaagtatggcctgtgtgcgggtatgacgcttacaacgtggaagcacgcccgccattctgacgggcttatcactacagttaaagcgcggggatgcctacttcaaggcaacgaacaattaggaacagcaactgaatttattcgttctttaatggagcctgtcttttaa

SEQ ID NO: 2758 - DNA, 174 bp, Xenorhabdus bovienii
  Coding DNA location: Contig name=SeqID_16881; Position on contig =57840..58013bp; Strand=+
atggctccatatcatgacccgcccctcttctctgctgtttggtcagttgaatcaaatgggggagatactctctcgcatcaccccaatcaccaagaacaactttcctacagaaaaggtgacataagactactatttgttaatggtaagttaaaatatatgtgtaaaaatggataa

SEQ ID NO: 2759 - DNA, 126 bp, Xenorhabdus bovienii
  Coding DNA location: Contig name=SeqID_16881; Position on contig =57976..58101bp; Strand=-
atggattatgatcaaaaccgcgacattgactgccttgaatacatttcatcagcactgccgatgatgcttaataacatgccacaatctgttatccatttttacacatatattttaacttaccattaa

SEQ ID NO: 2760 - DNA, 114 bp, Xenorhabdus bovienii
  Coding DNA location: Contig name=SeqID_16881; Position on contig =58087..58200bp; Strand=+
ttgatcataatccatattcctttttaccgttttagcctgctcctgcttccaggaaacgatccccgcgatggcgttaaccagtcaacgttaacacaggttacgacttgcacttag

SEQ ID NO: 2761 - DNA, 150 bp, Xenorhabdus bovienii
  Coding DNA location: Contig name=SeqID_16881; Position on contig =58174..58323bp; Strand=-
ttgttaatttgcaaaaatatcatttatgagcaatgtgtaagacagccaccagcgaccggttttttcacaggaaaaacggttgaccacggacaataccgcggagttttatctaatattttctggctaagtgcaagtcgtaacctgtgttaa

SEQ ID NO: 2762 - DNA, 3135 bp, Xenorhabdus bovienii
  Coding DNA location: Contig name=SeqID_16881; Position on contig =58327..61461bp; Strand=+
atggtaactgagatgaataagcgatacagaatattccagcagactccggttgctgggcgtttgccggtcaaaacccagccacgtgtcctttgccgcgccgtggcctgctgtctggctgccgtcagcgccagtgcatttgcggggagttataatgatcctggtcagttaaataatcctgccagctggcgcaccagtgagttccgtgctgactgggggcttggcgcgattcacgctgaggaggcttatgcccgcggctacaccggtaaggggatcaaactaggaatattcgatcagccggtttataccaaacaccctgaatttatgagcccggataaggtgatcacccttgtcacctcggggatccgtgaatataccgatccctatattaaagtgaaaaaaggggataaatttaattacgatggcacaccaaccaaaggttcatccggtaagctgggggcgcacggcactcacgttggcggtaccgcggccggtatccgggatggcgagaagatgcatggtgtggcctataatgcacaaatcatcagtgccgacaatggcgatcctggccctgaagacggtatcgtattaggtaacgatggcggcgtgtatcaggccggctggaacgcgctgatagagagtggcgcccgtattattaacaatagctgggcgattggaattaccaaaaaatttacagtgggagggtataacccagcctatccgcactttactgtagcagacgcccagaagcagtttgatgaaattaaattgattctagggacaaaaccgggtggtgcgtatcagggcgcaattgatgccgcccgtagggggattgtgacgatttttgctgccggtaacgatggtaatctgaataatccggatgccatgtctggtttggcttggtttgtcccggagatcgcgccgaactggctgacggttgctagcttgcagcaggatcttaagagcactaacagcgtgccttattccatcagcgatttttcttctcgatgcggctataccgccagtttatgtgttagcgcgcccggcagtcagatctacagcgcaatcatcagtggaactggcatagataatctgacgacaggctacgctaactacaacgggacttctatggccgctcctcatgctgccggtagtattgccgtgttgatggaacgtttcccgtacatgacgggtgagcagatcgcgtccgtgcttcgcactactgccaccgacatgggtgaaccgggtattgatgcgctttacggctgggggatgattaatctaggcaaagcgatacacggccccggtatgttctataccgaagaagacattccgcaggctttccgtatccctgatcccaacggcgtggcctatggcaacagccagtttattgcggatatttccggtatcggatctgtacttgataagggcaaaccgaccgagcgtatctgcgatagccagctgtgtgcgcaggatacctggagcaatgatatcagcggtcacggtggactcaccaagcaggggagcggagcgcttattcttaccggtcagaatacctattcagggccaacgttggtcagacaggggctattaggtatcagcggtgaactgacttcctcagtctcagtactggagagcggcgttctcggtggtaatggcacccttggcgcactcagtgtgcaacgcggtggtacggttgcaccgggtaactctgtcggcactctcagcgtttcccgcgacgttgcttttgaagcaggttctcattacgccgttgaaatcgctgctgacggacgcagtgatcatattcaggcggctggcagtgcacagcttcgcggcggtgacgtttccgtttccctcgaaaacagcgctaatcttctttcccgcaatgaggtacgcagtttaattggtcaacagtaccgtatcctcagcgcaaaacagggcatcaacggccgttttgatcaggtcgcaccgaactacttcttccttggtaccagcctgtcgtatcaacctgctgaggtcacgctccatgtcgggcgtaataataccgcctttgcggatgtggctaaaacgccaaacgagcgcgctgtggccgcagcagcggatacactcagtgttggtaatccggtttacgagagtatcctgagctttacttctgcggatcaagctcgtcaggcctttagtcggcttgatgggcagatccatgctgatattgcctcctcgctggtcaatgacagccgttatctgcgtgatactctgaatactcgtctaagccaggccgaaggccgtgcttcatcgtccgatatccgcgaagatgataacggcgcatgggcacgtctgctcggtgcatggaatcacgcctcgggtacggataacagtacgggttatcaggcttccacttacggcgtactgctcggatttgatgcgcctacggatgcttacagtcgcctgggtatcgcgaccggctacacccgtacctctctcgatggtggctacgactccaatgctgacagcaataactaccaccttgccctctacggtgaccgtcagttcggtgatctggcattgcgtgccggcggtggatacacttggcatcgcattgacacccatcgttccgttagctacggcagccagttcgatagtcagagtgctaaatacagtggccgcacggcacagttgttcgcagaagctgcgtacaatctgcccgccggatcagtgaactttgaaccattcgtgaatctcgcctatgtcggcttccgtaatgatggcattaacgagaatggtgcggcagcggcgctccacagtgataaacagcacaccgaggccaagctctccacgctggggctgcgtgcgaaccacagttggcaggcaataggaggaacttcggttgctctacagggtgaattaggctggcagcatcagtatggtgatcgtgaacgggctactagcctggcgtttcgcggcagcgacacaagctttgtgacccgcagtgttccggtttctcgcgatggcatggtgctgaaggctaacgcggagatgacagccagtgataacgtgtcattgaccctgggttacagcgggttgctatccagcagccatcaggataacagcgttcacgcaggctttaactggcggttctga

SEQ ID NO: 2763 - DNA, 138 bp, Xenorhabdus bovienii
  Coding DNA location: Contig name=SeqID_16881; Position on contig =61501..61638bp; Strand=+
ttgtggccgcatcgatcgcctgtctgcaactgtccctactgggaatggaacagtcaattaggttcagtaattttatctaaagcgtttcatatgaaacgcttttttatttgttattcccgccgtgcttattgtgagtga

SEQ ID NO: 2764 - DNA, 147 bp, Xenorhabdus bovienii; identical to SEQ ID NO: 349
  Coding DNA location: Contig name=SeqID_16881; Position on contig =61999..62145bp; Strand=+

SEQ ID NO: 2765 - DNA, 168 bp, Xenorhabdus bovienii
  Coding DNA location: Contig name=SeqID_16881; Position on contig =62142..62309bp; Strand=-
atgtacagaccatcgagtaattgttcagggttttcggatgttacctcatgcacacgaaaatgcggttcatcttgcaagtatctaatgtttagaactgtatcgaaacttatattttctgatttgtatagcgaagagactttacctaatgtcagtgtgttacaaacttaa

SEQ ID NO: 2766 - DNA, 252 bp, Xenorhabdus bovienii
  Coding DNA location: Contig name=SeqID_16881; Position on contig =62377..62628bp; Strand=+
atggatgaatatgggctacatcaaattgacaattatcctctaattgtttctaggtttcacaccaatatgttgtctagctcaataattccaagtataaagactgatgcttttttaagctacaaccctgaatattgtaggcgagaactcaaaaaagagcgcagtcttttaaagcccgctaaaagcgaaagtatcaggcaaaagaaaaaaaggacaaataaaattgcgaaggcttctcgcagaaagaacagataa

SEQ ID NO: 2767 - DNA, 111 bp, Xenorhabdus bovienii
  Coding DNA location: Contig name=SeqID_16881; Position on contig =62597..62707bp; Strand=+
ttgcgaaggcttctcgcagaaagaacagataaaaacacttcaatgttagtaatggtttaccaacgctcgctcttcgctcaaatcagacttttggatcttgcgtaccggtag

SEQ ID NO: 2768 - DNA, 114 bp, Xenorhabdus bovienii
  Coding DNA location: Contig name=SeqID_16881; Position on contig =62694..62807bp; Strand=+
ttgcgtaccggtagttttgtgccaagagcaggccttgcaaacgcggttgtgtttcaatcaataggtacaggcagcctcggattacgtactaattataataaattaattcaatga

SEQ ID NO: 2769 - DNA, 165 bp, Xenorhabdus bovienii
  Coding DNA location: Contig name=SeqID_16881; Position on contig =62804..62968bp; Strand=+
atgaattactattgctctattgatattttttacaatagcgctaggttagacaaccgtaagattgtgagtgggctaaggcgtttacttattgacagatcttcgttcagaagatgctttattagtgaaaaattatgccccggtaattttacttacccaatcttataa

SEQ ID NO: 2770 - DNA, 441 bp, Xenorhabdus bovienii
  Coding DNA location: Contig name=SeqID_16881; Position on contig =63005..63445bp; Strand=+
atggaagaatataaaaaatcttgtgaggacgagcttgattgggtaatcgtgaatcaactccatgaagctacactgcaaatgagcaagagctgttttgagttcaaaaaaatatgtataggacttatcggtgcaactttagcaatattagcaaagcttaccgatggtaaacttgatcattcttatttttatataacacttattctatgttctggtttctggatcgcagatttttctgcatattatttccagaggaaaaccaggatggctatgaatagaaaacttgcggcattggccaataggaattccattaaagactatccatctgataatcttgaggtaacttggcttaaagcagcatttaaccattcaatggttctatactatgtttttgctttcattgaagttagtggatggcttgtttatgtaactataggtaagtag

SEQ ID NO: 2771 - DNA, 345 bp, Xenorhabdus bovienii
  Coding DNA location: Contig name=SeqID_16881; Position on contig =63447..63791bp; Strand=+
atgaatatttttgttagctatacgactagagacgataatgttgataaaaccttactagagtccatatctgaaatcgtctcgctttatggtcattgctacatcgacctactacataacaccgaaaaagataaacagcgacatgtcgaatttatgttatcacaagctaatttgttaatcttgattgcatccaattcaatttttacttcaaaatgggtccaatgggaactttctgaagcaaaaagatgctgcattccaattattatcgttgatgctaagtccgatatgagcaatattttgaaaaacttgaagtcaatattgacttccaattcttatttatcatcctaa

SEQ ID NO: 2772 - DNA, 93 bp, Xenorhabdus bovienii
  Coding DNA location: Contig name=SeqID_16881; Position on contig =63917..64009bp; Strand=-
atggcacagggttgttgttgcagccctgacaagctcagacttcaatcgattcagatatttccaatgcatcatcgacttaaatcaattcactaa

SEQ ID NO: 2773 - DNA, 159 bp, Xenorhabdus bovienii
  Coding DNA location: Contig name=SeqID_16881; Position on contig =63981..64139bp; Strand=-
atgttttgtgagggattattagacagcatgatgatttggtatacctatggtgtgagccacgctatattttatatattaaagttgaaaatattaagtacggttaagcagttcaattgttcggacgtaagttatggcacagggttgttgttgcagccctga

SEQ ID NO: 2774 - DNA, 123 bp, Xenorhabdus bovienii
  Coding DNA location: Contig name=SeqID_16881; Position on contig =64139..64261bp; Strand=-
gtgacccgttctggccgcttggtctataactcatttatgccccattgtgtgttgatgccgatgactgaattatatcggcaacctatttttacaatatataaattaatggttagggcgtgttga

SEQ ID NO: 2775 - DNA, 315 bp, Xenorhabdus bovienii
  Coding DNA location: Contig name=SeqID_16881; Position on contig =64233..64547bp; Strand=-
atgagattaagaaaccttcatcgtcatcagactgacggtatctgcttccaaaggtgcgcagatgtaccacacggttgtgtactcccttgcaggctacaggagtgttattgtcgctgcccgaaggtgatcctcacaagcgaccggatcatcgataagtctgactacgctaataaacggaaatcatcaggtcaatgggtaattcatttcccgggacaaaaaataatgtcaggaacacgatggccttttgggttaatcgggagcaggctgtcaatgctcatttcacgcggtgacccgttctggccgcttggtctataa

SEQ ID NO: 2776 - DNA, 132 bp, Xenorhabdus bovienii
  Coding DNA location: Contig name=SeqID_16881; Position on contig =64553..64684bp; Strand=+
atggccaacaggccagtcacccaacggggaacacgtttcccattgggtcaggtgttccccgttgttttatcaggagaataccatgcaacaaaatacaaccccggtcacggtgcacactgtgcccgcgtctga

SEQ ID NO: 2777 - DNA, 435 bp, Xenorhabdus bovienii
  Coding DNA location: Contig name=SeqID_16881; Position on contig =64635..65069bp; Strand=+
atgcaacaaaatacaaccccggtcacggtgcacactgtgcccgcgtctgaattatccccttttgctgaaatttttcctcacaccggttcactggaattaatgctgctggaacacacgttcattaaagctgccgccgtgctttgtgacgatgaccgatgtgatcagtggcagtaccggaaagtgtcagacaacatcgcctatgtcgtgccgacacggtcggattcatctgtagtcaacgtcaataccacggactttaaaggcgaggtctccgccgatgccttcggattgatggtgaccctgagcgtgttgggttatctggcggccctgatgaagctggacgggtacgctgaacggttttgcgacctgtgtgaatatgcgctgcaacatcctcaggcttcgtgtatccgggcggctttgggcttaaagggtgcataa

SEQ ID NO: 2778 - DNA, 462 bp, Xenorhabdus bovienii
  Coding DNA location: Contig name=SeqID_16881; Position on contig =65082..65543bp; Strand=+
atgccaaataatgaactgattatgctggacagtcttgcgctgtcggtcgtgtttcccgacaaaaccccgctggaacggttgtttctggggttcctgctggcgaataccgcatcaacgttatgcggcgattatcagcctgaacagtggacaagccgacaggtgtctgaatcgctgacttatatggtgccgacacgggcggaaacgtattccgtttacctgccggttacgcagctgacggtcacgctttccgccgatgccttcgggctggcggtcacggccatcgtatcagcccgtatcgcggtgctggatacacagaataaggatgcgtaccggttctgcacactgcgggaatatgcgcagcagcacccggaaagcggcctgatagcctcggtcatgacactgaaacccagagagggcgttatcagtccgtcacttatccctaacaaaaataatcattattaa

SEQ ID NO: 2779 - DNA, 126 bp, Xenorhabdus bovienii
  Coding DNA location: Contig name=SeqID_16881; Position on contig =65549..65674bp; Strand=-
atggggttcatggtgttgttccttgattttatgtcaatgaaagaaaacacccgcccgataccgggaaggtgttttggcttccccggtcaggcgcttaagaaaagcgttaacagcctcatgggctga

SEQ ID NO: 2780 - DNA, 558 bp, Xenorhabdus bovienii
  Coding DNA location: Contig name=SeqID_16881; Position on contig =65664..66221bp; Strand=+
atgaaccccatttttttaccggcaccggatgaaaccgataccgcattacgtgaagagctgtttaccgctcaggtcaccggcctgaggcaacacccgaaagcaccacagtcattgcagccggaaaccctgatggtgtgcgaagcctccaccgtcacggaaatggtgctgcggctgaaggtgatccatcttctgggggactggccggtgccggagaggttatctgctcaggttgcgggggctttttttccgctgaccgtcatgatttttgatgcacaggacagaaaagtgctcggtggccggtttgatgaagagattatctgggcgcagccggtcacactgacgtcagaacgcctgtcattggaacagcaacagcagcggttatgtcaggcagcgatgcttgagcagagctggcagaatactccggcggcgtgtgcgttgtggcacaaggtgcatttattgtcactgcatggggtttcctcctgttatcagcagtgccatgaagtgcgggatattctccggtatggcgtctccgtcagtgctttttctgagggggcatga

SEQ ID NO: 2781 - DNA, 258 bp, Xenorhabdus bovienii
  Coding DNA location: Contig name=SeqID_16881; Position on contig =66218..66475bp; Strand=+
atgatggccacattacatttaacggtctggcaggtgattgccgcagccctgttgaaacggcattttggcctgagcctgactgacacggcactgtgtgaaaccgacacggtggcggaattgatagcagggggtgtccggccttctgaagccattaacgaattggtggataaatacgacttaacccggctgaatacgcaggttatcccgcgcagtacgccttatctggatatccacgatgaactgacgggtcatttttga

SEQ ID NO: 2782 - DNA, 93 bp, Xenorhabdus bovienii
  Coding DNA location: Contig name=SeqID_16881; Position on contig =66499..66591bp; Strand=-
atgataaaaataaacaggcggaaccggcccattcggagcacagttcccccgatgggtagattgaaaaaaagtgttacggcctggtttgcctga

SEQ ID NO: 2783 - DNA, 975 bp, Xenorhabdus bovienii
  Coding DNA location: Contig name=SeqID_16881; Position on contig =66560..67534bp; Strand=+
atgggccggttccgcctgtttatttttatcattcaagtgaggaacttaaccatggcagaatggtgcaccaatcaactggaaatcaccggcaaatccgtctgtctcgatgtgatgcaacagtgggtctgcggggaagaagtccctcgttaccgtcaggcggtgttacaaagcctgcggttatttctggcgggttgtgcgggaatactgaaaccgaccaaaccacaaacctacaccccgtacccagcgctggtgcgcggcacggcggtgccaacggcgcagtatctggcctttgagcagtggttgttgttgttacagaataatgtgccgttgaatacggacaatatcaaacgcattgataacctgtatcgtcagtccggtctcagcctgatgtcctgggacaaggtgccggaagcggcgcgtgatattatggcccgtcttctgacccgccagtataccgactggttcggcatggtgggctggtctgacacacccgatatcggggcatgctgggataagctgaatgcgtacccgcaggcggcacagccctgcgatatgctgatgatgatgtcaacgaatctggcgactgaaatcaacggtaacagcaccctgctgaaaggcattgccacgacagcgcagttttacgatgaacaatacgggatggaatggccgtttggtcaccatgtccgctgggaacgccgcaatgtcagcagcttaaccgtgcggtttgattcctcctgggcaccgccttcggcggagctgatgggggagctgtcattgatgtttgactgtgaaatccgccactggtacagcgaagcatcaggccagctcaaaggctacgattgctatgaccaaggcgagcacgtggacagcggtcacgggcagtcaggacgggaaaaccggccggcactctatctggtcaccggtgagcaggcggaaacggcactggctctgccggctatcgcggttgggcaatag

SEQ ID NO: 2784 - DNA, 141 bp, Xenorhabdus bovienii
  Coding DNA location: Contig name=SeqID_16881; Position on contig =67515..67655bp; Strand=-
atgccattgcgtgttttccttgctgaacaaaaagcgaaaaaaggaaaacacgccccgaaaagggaaccggttcccctttcggttgatgtaaaaataaatggatactgcgttaaacgaagggctattgcccaaccgcgatag

SEQ ID NO: 2785 - DNA, 687 bp, Xenorhabdus bovienii
  Coding DNA location: Contig name=SeqID_16881; Position on contig =67649..68335bp; Strand=+
atggcatcccgaaccgatcatcagaaagaattcatttcgctgtttaagcaaacggcccgttatcatacccgttatcaggtcttccgggatttttgcaattgtgctatggcagcgattcacaataaacactgtttcagtgaggagctggagcagtattatctgaaaaccattaacaagtacgaacgggtcgatgttgaccggatcgtacaattgttttcgcatgtggtgctcggactggcgcaggaacccggtgattttctgggtagtgtgtttatgcggctggaactgggtgataaggatcttcagcagttctttaccccctggagtgtggccagaatgatggcacagatgcagttgcaggatgccgccgggctgctgcagacacaaccgtttgtcaccttgtgcgagccgtgctgtggtgcgggctgtataactttggccgccgctgaagtgctgagggagctggggcacgatccgttgtgcagtctgtgggtttatgcgattgatattgacccgctggcggccgtgatggcgtatattcaattatccctgaccggtattccggccgccgtcaccatcggcaatgccctgcatgatggtggtgacaagcgaacccgttatacgcccgcgcattatctgggcaactggtctcagcgtttgcgggaggcggagcttatcgccgcttga

SEQ ID NO: 2786 - DNA, 624 bp, Xenorhabdus bovienii
  Coding DNA location: Contig name=SeqID_16881; Position on contig =68452..69075bp; Strand=+
atgaaccgggtcagattaattttcatttttgtaaaaagagttgttccttgtttccggccgggattcaccgacactgagccaaatctgaaccgaaagaggaaaaccatgtttcagcgttttaaatcccgttttacccgtgacctttccccgtcacaagaagcgcccggactagcgcctgaaagagtacgcggtgccggaggttatttccgtccacagtcagcagaggtgctgctggtaacttcagagcgtggccagtatctccgccaactgtgggaaaacagtgcgctgcccgccgggttgtatcagcaattctatctggatccgctccggcaattatgcgcccgtgtgcagcatgttcccgcgacacaagagggcatctggtcttatcgcggcggatttatcgatctgaccctgcaatttactgcctgtgccgtgcggctggcaaaagggcacatgttgcctccgggggtggcgccggaacccgacaccaccgcgccctccacctctggcagttcaatgccgttagcggtcaggttgtctttgccgataagaattttgaatggatacgggtcagtgactgtgccattaacaggaacgcgacctaataacgcggtcatggcctga

SEQ ID NO: 2787 - DNA, 957 bp, Xenorhabdus bovienii
  Coding DNA location: Contig name=SeqID_16881; Position on contig =68835..69791bp; Strand=-
atggaggttaagtccaatgcattggtgaaaatactggtgccgaccgtgctggttattggtggatttatcggtatcaaaagttgcagctcaactgacaataccgcgtccaatacaacccaaaataatgcactggctaccctgtcaccggaggagttacaggcgttgggtgtcggtggtgatacgccggaagataccctgcgtaccctgataggtaccctcaataaagtgcgggcagagcagaaacgcttaagccagcagaataccgatatcctgaaagaaaatgaccagttaaaaaatcagaatcaggatgttgccggccaaatcgatgcggccgttgcggccatccgccaggaagacgaacagcgccagcgcgtattacaggatgatcaacagggtttgctggcacaaattgatttgctgacggagcggttaaattcaacacctttgtctgtaccggaaagccaaagcgcattgagcagtccgtatgccgtcagcccagtcagtgggcagggtgaatttatttgggtcaatccggctgatgaaaaaccgacagtgttgcaagcgatgggtaatggtcaatctacaccgcaatatcccacttcttttttaagcgaacaatcggccaccgggcaaaaagggcagaacgaacccgcgcggaaggaaaagaacgaaaccccggtctataccctgcctgaaaataccacgctggtaggcagtcaggccatgaccgcgttattaggtcgcgttcctgttaatggcacagtcactgacccgtatccattcaaaattcttatcggcaaagacaacctgaccgctaacggcattgaactgccagaggtggagggcgcggtggtgtcgggttccggcgccacccccggaggcaacatgtgcccttttgccagccgcacggcacaggcagtaaattgcagggtcagatcgataaatccgccgcgataa

SEQ ID NO: 2788 - DNA, 522 bp, Xenorhabdus bovienii
  Coding DNA location: Contig name=SeqID_16881; Position on contig =69781..70302bp; Strand=-
gtgacagccggaaaaaccgatgctaccgagccggtacgcattatttatccgaatgaaaaacaacctgcttcaaccgaaacatcacaacaccagagcaaaccccaattatccgcgcccgtgccggtggccttaacccgctatgccgcgcagcagctgtatgcgccgttacgtaccgtcgagccggtcaccggaattcagccggtgaatctgcatctggcctcatccatcacgacactctatccgtcagagccgatagccatctctccgctggcaggctggagatggaataatcacacagtgatggccctgaaactgcgcaatacggccaaacgcactatcaccctggacccgcgcatcttacaggggcagtttgtggccgccacgttccagcatcgttggttgggtgaaacggggtcaccggaggatacgacggtgttgtacctcgtcacaaaagggctgccggataatacctttatccctgagccgacatcggtgaaaccgggaggccgtcatggaggttaa

SEQ ID NO: 2789 - DNA, 279 bp, Xenorhabdus bovienii
  Coding DNA location: Contig name=SeqID_16881; Position on contig =70336..70614bp; Strand=-
atgagaggatatccatctttcccgcgttgtgtctggctggggctggccagtatcttgctgttcagtacgggcgtcaaagctgatgaactgctgaaatgggaacgtattccgttacccattaccctcaaggtcggacaggagcggattgtttttgcagaccggaatgtgcgtgtcggttttccgccctcactccatgataaattgcgggtacagagtacaggcggggcggtttatctgaaagccagccgtgccttcccgccaacccgcctgcaactgtag

SEQ ID NO: 2790 - DNA, 657 bp, Xenorhabdus bovienii
  Coding DNA location: Contig name=SeqID_16881; Position on contig =70611..71267bp; Strand=-
atgagccggtttcgtcatgcgattaaaagtaaggatcagcatgtcctgaccctgagagtggcatgcggcattctggtgctggtactgctgctgaccctgaccggctggatggcttcaccgcgtaatctcactatccataatccgccggatttacgcagtggcagcactcgcccgtggtgggaagtacctgcgccgagtgtctacagttttgccttttatatttttcagcaactgaacgcctggccgaaaaacggggcacaggactatccagcgaaaatttatgccctgtcgccttatctgacgccggcgtgtcaggattttctgcgcgaagatgccaaaacccgggccgacagtggtgaactgcccggccgggtgcgggtggtgtatgaaattcccggccggggctatgagacgcgcagcgtgacggtgcgtgaccgtgataactgggtggtaaggttggatttggtggccgatgaatattatcacgccgaaccggtcaaacgggcactggtgcgctatcccctgaaagtggtgcgctgggaaggcgatgcagagcgtaatcctttcggtctggcactggattgttacgacggggtaccacagcggctggaagccatgccgccaccattggaagagaaaaagggtgtgtttcaatga

SEQ ID NO: 2791 - DNA, 375 bp, Xenorhabdus bovienii
  Coding DNA location: Contig name=SeqID_16881; Position on contig =71264..71638bp; Strand=-
atgcaaacgatcccttttttacccgatcgcttaaacgccgaacctgtcgtctttcggggattcaccacaccggaaatgggactggcggcaatcgcgggggtagcacttgggctgattgttagccttcctctgatcctgttagtcggttgggtgatgctgccgacagggatgctaatgatgcccttattgctggttagttttggcgggcgctggctcgtccaacttaagaggggtaagccggaaaattatctctggctgaaactggccgagaaaaaacgccggctgtgcatcggtgatccggcgttgattattgccgcgcagggctggtcattacgtcgtagcaggcaagcgcaccgtagcaggagagtgcgatga

SEQ ID NO: 2792 - DNA, 378 bp, Xenorhabdus bovienii
  Coding DNA location: Contig name=SeqID_16881; Position on contig =71649..72026bp; Strand=-
atgaagcaaatttttacagactgccgtcgtatcagtacaaacctgataaccagaataagtgtctttctgttgctgtccggtctttcctgtcagcccgcccgggcggacttgcccgctatcgaaccacccaaaagtggcggcggcgggggattactgggacaggtgaaaggctatgcgcaggatggcattgtgattggcggattgatcctctcggcggtggcgttctttaaagtggcttcggcagcagtggaaactttctccgaagtgcgcgatggcaaagccacgtggacccagtttggctccatcattgttgtcggcattgtgctgttggttgcggtgatctggctgttggcgaaatcagccagcattatcttttaa

SEQ ID NO: 2793 - DNA, 237 bp, Xenorhabdus bovienii
  Coding DNA location: Contig name=SeqID_16881; Position on contig =72062..72298bp; Strand=-
atgaccccggcacaacgtaatgcctttgaagtggcatcagggcattttgatatcacttttttgtatctggtgtgtgtcggcttttttctgtccacgctatttctgtgggccgcctgggcggcggtggatgtctggaacggctgggcgaatgaaaaaatacgcaatcagacgataagtcagtttgccattcgcatggcggtattactggttgtggctgtctggatgtttgccagttaa

SEQ ID NO: 2794 - DNA, 330 bp, Xenorhabdus bovienii
  Coding DNA location: Contig name=SeqID_16881; Position on contig =72295..72624bp; Strand=-
atgcgcgattgcttttctatatctggttctgcctgtctgctggggctgattgtattgtgtatgccactggctcatgcggctgagaaagatgagctggccagtgccaggcgtttaattgatcaggtacagatggcactggaacgcgcaaacatcgccgaaaagcaatctgacacctcaacactgtctcgttatgactttgattactcccgtatcagggctgatctcaacaccatcaaagtgggtatcgatcactacctgatgccttcccgcgatcaaccccgtgatcccgtacccatctccggcgattaccgtcaggagcacccgcaatga

SEQ ID NO: 2795 - DNA, 114 bp, Xenorhabdus bovienii
  Coding DNA location: Contig name=SeqID_16881; Position on contig =72716..72829bp; Strand=-
ttgcctaccttctcatattcatcatcggggacgtgtaaatcaatccgcagcatattgcttgctcccttaattgctaagttttggctgaataaattagtcagactatttagctaa

SEQ ID NO: 2796 - DNA, 693 bp, Xenorhabdus bovienii
  Coding DNA location: Contig name=SeqID_16881; Position on contig =72777..73469bp; Strand=+
atgctgcggattgatttacacgtccccgatgatgaatatgagaaggtaggcaagctgggggcacactgggatgcggccgaccaaacctggtatatcgacagcagttttgacccggagccatttatgcaatggctgccgttctacaatgtgcatgcggaatactggtatctcgcgcaaacccggacaatctgtccgcactgtcatgaacccaccaccgtcaccgcgtttatgcttcctgccggacaccagctactggaagccgatagcgacgatgaaccctgcacggaaatagactataccgagcaggacagccccgcgtttttgttttatatcgccgatattccgacggttgtgcgcagcgtactgcccggttttcatcacacgctgcgcaaagccgtcagccagcggctgcaccgacaacactggataaatcactgcgaacactgtggcgcacagcaggatgataccgaactgtttgcggaaatcggtggtgcgttttttccggcgaccaaagagcaagcggaagctattcagcttcatcgtattgaacagccattcgtggggtattgtgaagatatttcgcaccatcacgaccgttttgatccgaagcaggattaccatctctgtaacgcgtgtgattggtttgcatccatgacactgattatcaacaatcaatcaacatctcgtcattaa

SEQ ID NO: 2797 - DNA, 144 bp, Xenorhabdus bovienii
  Coding DNA location: Contig name=SeqID_16881; Position on contig =73478..73621bp; Strand=+
atgacgagcaagagaatttctgagcacaaggaattttctgaggataaatatgataaaagatacctgttgtcagctaacgagccgctcaggcggcctgtctgcgagcacaggcatcatacttttattgatttctttaatatatga

SEQ ID NO: 2798 - DNA, 612 bp, Xenorhabdus bovienii
  Coding DNA location: Contig name=SeqID_16881; Position on contig =73657..74268bp; Strand=-
ttggtgcacgcacttatcgttatctcacaccctatttctgactctctcagtggtcatgtggctcaatatattgccgatggcatcacgcaatcaaaccccgaaaatagtgtcgaacttgctgatcttgctaaagaaggatttgatccaaggtttactgaatcggatattgcggctttttacaaagaaagtttaccaccggttgatgtgattgctgagcagtcacgaattgccttggctgatgcgcttgtcttggtttatccggtctattggtggacaatgccggccttactcaaaggatggatcgatagggtgttttgtcatggttgggcttataacgagcatcctgatggcagactggaaaaaaaacttcagcaccttccagtacatctggttgctattggtgcggctggcagagaaacttatttaaaacatggtttttgggatgctatgaaaacccagattgaccatggcatttttgattattgtggagcccctgtcatcacttcagaattactgcttcatcctgagttaaaagatacaaatgcctatcaggaggctgcatacgatattggtcgccacattttcagtatggctgaagtttcagaggcatga

SEQ ID NO: 2799 - DNA, 690 bp, Xenorhabdus bovienii
  Coding DNA location: Contig name=SeqID_16881; Position on contig =74286..74975bp; Strand=+
atgataaaagacaagcgtaatctatataccaaaagtaggttaccattggtaagttatctttggtatataaacatgtcaagcaacaaagcccattcaaaactggctaattcacaaacacgtattcgccttacaagagaagaacgctatcagcaactaactgccattgcctggcagatcattcgaaacgagggaacagaggctctgactctgggcagattggctgagaaagccagcgtgacaaaaccggtcgtgtatgaccattttggtacacgttctggtctattggcagcactgtatattgaatttgataaccgccaaacgataatcatggacactgccattcaacaaagtgaacccattttggaaaaaaaagccgctgtaattgcatcctcttacatcaattgcgtgctttttcagggacgtgaaatacccagtattattgccgccttagccggctcacctgaactcgaaaaaatcaaacgcgaatatgccaaaatttttgtagagaaatgcagggtaatactggtgccctacacccaaagcggaaaaatgaccgctgcaagcctttgggcaatgctgggagccgcagaaacgttatcctatgcagcagctaacggcgatatcactgcaactcaggcagaaatcgagctttctgcaatcatcattgcgatggttgaaagaagtctttga

SEQ ID NO: 2800 - DNA, 759 bp, Xenorhabdus bovienii
  Coding DNA location: Contig name=SeqID_16881; Position on contig =75012..75770bp; Strand=-
atggcacagtcagaaaatcaatcccgacaatcttcccaaccccctcgtaagcatggcttgttgtatcgactgttatgggaatggccgtggcaactcattggctttattgtcatgtcatggctattcagtctgttactggaatatgtcgggatgacttttttctggccggaacagggcacctcccacagccaggcaatgatgaaaacggagctgcaatttttatccacggaatttacccagagtctgttgttctccaaaccttcacaaacggtttctgacgggctgggacaggcgtatcaatggttatttgtggacagcggttttatacaccggatacagggacaacagcaatatcagctcaatagccgcaatgattttctgcatgaattcaatgccatattacaggatgtatcgggttatttgcgggaatattgtctggctaccgtgtttatcacgatggtgacgctgattcggctggcgattttgctgttatctgttccgttgtttgtgatggtggttttggtcgcgctggttgatggattagggcggcgggacttacggcgttacggggcgggatatgaatcgagttttgtttatcatcatgccaaacgggggattaaaccggcctgcaccattccttgtgtactgtatttattctggccggatgtggtgtatcccacggtgatattgctaccagcggtactttttctgggtatgacagtggtgataacaacgtcaatgtttaaaaaatatttatag

SEQ ID NO: 2801 - DNA, 1167 bp, Xenorhabdus bovienii
  Coding DNA location: Contig name=SeqID_16881; Position on contig =75780..76946bp; Strand=-
atgagcggccgttatgttgttgaagccctgttacgtcctgccgtcgagctgaatactgcggtggtgtcgtccgttgccgcgtttatctgtatttgcgcaccttgggcgattgcacttactccgtcagtcagttatgtgatggcaggtggttttgctgtgttagcgatgatacgcacatggcagggtattcaggttatccactatcgcagaaacctgcgccgtttgccacgttaccagatgagcacaaaacaaatccctgtcagccatcaacgcttgtttctgggtaagggattccgctggcagcagaagcacacccagcgtttgcaggatacccggcgaccggaagtcgaacgatttgtgcaaccgccccagatatatcagcttgcccgtgctctggagcgccgaaccgaataccgctggccggggttgtcggctctgttacgcaaagattccccgttaaatccggtacgcccgttaccaccggttgggggcaatcccatgatccacggtattgaaccacaggaaaccgaagtatttatggatctgcgggagcgggtcggacataccttagttatgggtacgacccgggtggggaaaacccggctggcgattaacctgcattgtgacgaattcaacgaactgatgggggatgagtttatcccgttgatcaataaaggcggtggcgccggtatgcaggtgacggcctatacccagacctcatcggatattgaagcccgtatcagtagcccggccaaaacggcgcaggtgattggtaactttaatactctgattatgctgcgggtacgggataaccggacagccgagttactcaccagccagttgcccgaagtggaaatttacagcaagacgttggtatcagggcattcggatattgcggatgttgaacaggggcaggatttcacttcgtccacgcaggacagggttggcacggttaaaacgccgttggtgacgcctgctgagatgattaacctgccgaaaggacaggcatttgcactactggaaggtgggcagttgtggaaaattcgcatgcctttgccaaccggcgatgacgatgatgccctgatgccggccaatttgcagaaaatcgccgagcagatgcgacggcactaccgcaccagtgaaaactggtgggaagagaaaggataa

SEQ ID NO: 2802 - DNA, 330 bp, Xenorhabdus bovienii
  Coding DNA location: Contig name=SeqID_16881; Position on contig =76943..77272bp; Strand=-
atgttgccagtcaaaacaccggaactgacaccgggaaaggtcacacgccgatcactgcaactgccgggcatgggtgcgttgtttctgattggtgatgatcctgattcacgccagtggttaagtcagaatgccgagcgactgaaggcccggcacgctgtggggctggttgtcaatgtcagtgaaatgtcgggtttgcagtcactgcgaacattagcgccggatgtgctgctatcaccggcttccggttcggaattggcgcgccgtttgcaactgcaacattatccggtgctaatcaccgaaaccgcactgactcagcaaccatcaccatga

SEQ ID NO: 2803 - DNA, 237 bp, Xenorhabdus bovienii
  Coding DNA location: Contig name=SeqID_16881; Position on contig =77245..77481bp; Strand=-
atggcatatcacgtcattacaatgaaacgtctgagcatcttacccatgctcggcctgttatggatcaatatctgtcaggctgaactgaacgtgattgccgatttaggaggcaaagatgcttcgcccttttatgcgggcattaatgctcaaccaagcgatgaacctccgccatcagtacaacatttctcacccgaggtggcgggtgagaaatgttgccagtcaaaacaccggaactga

SEQ ID NO: 2804 - DNA, 702 bp, Xenorhabdus bovienii
  Coding DNA location: Contig name=SeqID_16881; Position on contig =77457..78158bp; Strand=-
atgaaatcacaccgatccggtctattgatgtggttgctgttgagtaattctgtctgggcagcaacaccgacaccattagcttcgcaacagattcacgcgacagaaagccaacagcaatccctgaaaagtcaggccaaacagtggaagttaagtgccgatgaatatcagcattatcagcatttgatgaaggggccaagaggcattcagtcaacggggcttgatccgctgaccacgttaggcattgaagccgaaagcgatgccgaacgccgtcgttatgccgagcagtgggtcagggcggaatttgcccgtactgaaaaagaactgcgtttccagcgggaagtggatacagcctggcagcggttatttcctgatgtgttgccggtcaatatggagaaatcacgtgagacaaatggtcggctggcactgtttatcaaagccaaagattgtctgccgtgtgaaacccgtttgagcggagtactggcggctaaccagcctgtcgatatttatttggtagacagtcaaagcaatgacgacatattacgtcagtgggctaagacacaccgtattcccgttgaacgggtacgcaaccgacaaatcacactgaatcatgatgcgggttattggctccggtttggcaagggactgatgccggtattattacggcagggagagcagggatggcatatcacgtcattacaatga

SEQ ID NO: 2805 - DNA, 576 bp, Xenorhabdus bovienii
  Coding DNA location: Contig name=SeqID_16881; Position on contig =78158..78733bp; Strand=-
atgttacgactgagcaggaacctatttggcatgaaaataaatgtgttaatcggcttaatcgcggtcatactgacgggatgcacggctcccgtgaaacaaccgctacctcagccttcccaaaatagtttttcttccgtcacgctgacacgaaacatccaatctgtttcagcggatatttattatcaaatacccgaagttgtccgctacgggcgctatttactggtaagtaccgacccgacagcggcccaacgtgatccactttcccagctgatgggtattcatctccccacgtcccagaatcccactgttgccgatgccatgcgttatgcattacgtcagtccggctatgcactctgtgtgcctgacaagaagaatgacattttatatcgccaaccgctgccatcagtgcacgctcagttaggccctgtcaggttacgcactgcgttgcaagtgatggccgatccggcctggcaactggaagtggatgaggtgcagcgtgtggtttgccactatttgcgacagggctatcagctaccggctccggctaaacactctcatcagggaggagggcgttga

SEQ ID NO: 2806 - DNA, 300 bp, Xenorhabdus bovienii
  Coding DNA location: Contig name=SeqID_16881; Position on contig =78879..79178bp; Strand=-
atgattaactctcaccaagactggcacccagccgaaattatttgtgcattacgcaagcgtggtaccacactcgccgctttatcccgtgaatcgggactcagttcttccacactggcaaatactctatcccgcccatggcccaaaggggaatggatcatcgccacccgtttggaaatggaccctgctgaaatctggcccagccgttatttcgatgactacggcaattttattgagcgaaaagtacgccaaccagttgcagactgtcagtcggtcgatgaatatcagccagctgatgaataa

SEQ ID NO: 2807 - DNA, 165 bp, Xenorhabdus bovienii
  Coding DNA location: Contig name=SeqID_16881; Position on contig =79200..79364bp; Strand=-
gtgaggaatctcaggcctcgtaagatcaacccactggtaggatgtttctgccagtgtgtctgttatcgccctttcaatggcggttcaggcaggggaggtttcgacctcgccggattggttgatctccggtacctgagaatccctgttttgaatcgccaccaataa

SEQ ID NO: 2808 - DNA, 111 bp, Xenorhabdus bovienii
  Coding DNA location: Contig name=SeqID_16881; Position on contig =79555..79665bp; Strand=-
ttgtccaaagatgtcgtcatatctcctcctttgaaatgctttatttcagtatcagacaagggggtaactatcaattcaactatgcatcaacacagttgtcttcaatgttaa

SEQ ID NO: 2809 - DNA, 1110 bp, Xenorhabdus bovienii
  Coding DNA location: Contig name=SeqID_16881; Position on contig =79646..80755bp; Strand=+
atgacgacatctttggacaagctcacgattaaaggatttaaatcaatccatgagcttaatgaatttgaacttaaaaacttaaacgtgattgttggcgctaacggcgcaggtaaaagtaatttgatctccttttttaaaatgctgcgtgcattaatagacggcacattaaatcgctatgtacgcgatagtggtggtgcaagcgatttactttttaatggcaataaggtcacgcagaaaatggcgtttgatacacgcttcggggaaagaggatttcgttttaaattagtgcctacaccggcagatagctgtgcgattgaagatgaagctcgctattacataaagggtattggcgacggatggtgggaattaggggatagtgacgatggcagatccagaatggttgctgaagtcgagaacaagtactctgatgcaccgtattcaaggcccatctatgatgccatcgcttcctggcagatttatcattttcacgacaccagtgctacggctggaatgcgaaagtatgaaattattcaagataataaaacattacgcacagatgcctctaacattggtgcattcttattaaaactcaaaaacgatgcgtcaaacgaatataaatcgattgtgaatgcaatcaggttagtcacgcctttctttgataacttcattctagaaccgcgtcagagcggtcagaaagaagaagttaacattagttggacgcagaaaggctcagactaccctatgcaaccttatcatttatcagatggttcaatacgctttatttgtctggcaaccgcattattacaaccaaaccctccatcgaccattattattgatgaaccagaactagggctacaccctgcggccattgtgatccttgcagagttaatccaacaggcggctcagcgtacccaagtcattattgccactcaatctcctattttaatcgatcaattctctgctgaagatattgtcatcgtgaatcgtaaaaagggagcttcaagctttgaacgcttaaatgaggaagatttttctcaatggctcgaaaactattcattgggtgagctatgggctaaaaacgtcattgccggagggccgacttatgagtaa

SEQ ID NO: 2810 - DNA, 765 bp, Xenorhabdus bovienii
  Coding DNA location: Contig name=SeqID_16881; Position on contig =80664..81428bp; Strand=+
atgaggaagatttttctcaatggctcgaaaactattcattgggtgagctatgggctaaaaacgtcattgccggagggccgacttatgagtaattacatcgaagtcatggccatcgttgaaggtaaaacagaacaaatatttattgaaaaaatacttcagccttatctggctgagaaaatgattttcatctctgccactcaagtttctaaacccggacaaaaaggtggagatgtgcgtttttcaagagtcaagaaagacattgagatgcatctgaaacaacgtccagatacctatgtcacaacctttattgattattacggcaccaatgaatggccgggattagaaacgttaaatagacagtgggaaccaaagaaaatcgctgaacatctgcatctgtcaacacagaatgaaattcaccaattcctattcgcacagagagccgatgaacgttttattccctacatcgttatgcatgaatttgaagctttactctttagtgacaaagagatactcgccaatgagttaaatatccatgtacaagaggtagagcaggtacttcgagagtgtggagaaccggagtcgattaacaatagcccacaaacggcaccttcaaagcgattggaaaaatggtcagcaaatggaacatttggcaaaacgacaacagggatagctattgccgagaaaacaggcattcctaagatgagagaaaaatgtccgttattcaatgagtggctatgtaggcttgaaatattaatgaccgtttaa

SEQ ID NO: 2811 - DNA, 519 bp, Xenorhabdus bovienii
  Coding DNA location: Contig name=SeqID_16881; Position on contig =81558..82076bp; Strand=-
atggatatgtcttcgcgcggcatcaacaaagttattttagtgggtcatctggggcaagatccggaaatccgttacctgccaacgggtggaacggtgacaacgttgtcactggcgacttcagacagttggcgggataaacaaaccgacgaaactcgggagaaaaccgaatggcaccgggtagtgatcttcggcaagttagcagaaatcgcggcggagtatctgcaaaaagggactcaggtttacattgaaggccagttacaaacccgcaagtggcaggataatcagggacaggatcgctattcaaccgaagtggtggtgaatatcaatggcacaatgcaggtgttgggcagtcgtggcgatgcaaaacgggttcctgttcaacaggctaaggcagcacaaaaaccacaaccttctcaaccgactaaaaaggagaggaaaccaacacaaatggcacaactttcgtctttaccggaagaggagaaagaagaaccagattggtctgatgagatcccattttga

SEQ ID NO: 2812 - DNA, 306 bp, Xenorhabdus bovienii
  Coding DNA location: Contig name=SeqID_16881; Position on contig =82087..82392bp; Strand=-
atgcagaaaattcattctgatattccttttactccatcgacttgccctgaactttcagggcagtcccgtgattatcaaagacaacaggatacagagatgaatattgccccgattggtgttctggcactgcaatattgccataaacagttaccgttaaccgtgttgcgaagccgtgccggattttatatcggcacacaggatgaaggtgaaccctgctcccgtgagtcagtggaatattttgcctgccatgaacaggcggaatttgccctgaaacaagggcattggacgcagcgtcagtcagtgtaa

SEQ ID NO: 2813 - DNA, 555 bp, Xenorhabdus bovienii
  Coding DNA location: Contig name=SeqID_16881; Position on contig =82373..82927bp; Strand=-
atgcctgacacccggcgggaaaaactattcccgtcagggagtagggttttctcagtcacattgtatttttacctccatggagaacatcgtatgtctgagaacaccacatcgttaaccaaaaacgactatttcaacctgaatattaagggactgggttacctgaataatatccgccacgtcagcactgcgagtggcacgttcctgagctgtgtgatcaatgcattaaatggcccgagtgataatccggtctatgtgcgttttgatattactttagtcggtaaagaagcgaccagtctggtgggtcgttgccagaaagcggtggacgaggataaaaaagtgttgctgggatttaccttaagcaacccgtccaccgatatttttaccctgaaacgcggcgatcatgccggtgaacagcgtgtcagcctgaaagcccgtctgattaaagtggactggatcaaaattggtcaggacaaagtctatcaggccgaacagtctgattcggcacccccccagaacggtgttgcacaggcagaatatgcagaaaattcattctga

SEQ ID NO: 2814 - DNA, 246 bp, Xenorhabdus bovienii
  Coding DNA location: Contig name=SeqID_16881; Position on contig =82869..83114bp; Strand=+
gtgactgagaaaaccctactccctgacgggaatagtttttcccgccgggtgtcaggcatatacgttgctgacgttctgataaagaataatgaaccttcattgccgttagactggcaatatctgcttccaaaggggggcaaatgtaccgccttgaggcactccctttcaggctacgggagttttacagccacccaaaggcgatcgttacaggttcaccgatcatttaagaaacaggttgattcttaa

SEQ ID NO: 2815 - DNA, 2019 bp, Xenorhabdus bovienii
  Coding DNA location: Contig name=SeqID_16881; Position on contig =83151..85169bp; Strand=-
atgtttgcgcgttttaaatcgcattttacccgcccgccagcgccacagaaaaaatcatcagagcaaaaaacaagcgaggttcgtgataacgggggctatttccggccacaatcggctgatgcgttgctggcaacgcccttgcgccgtcagtgcctgcaacaattatggcaaaacagtacattacccgaaggcttgtatcagcgtttttaccttgcaccggtgaagcaattgctgggcagcgttcagcaggtacccgccgccccggagggcgactggtcaggccgtggtgggtttgctgacctgacgatgcaatttaccacctgtgccgtgctgttagcgaaagggcatctgttaccaccgggtgtcgcaccagaaatgcaggcagcacagagtgtcttatggcagacggtcgtgttctgggccgcactgttttatcacctgccgctgttgcggcagcttgaaggggaactggaagacgggcattactggcagccgggtgtttgtatccccgacaaaccgtttcgtttccgctttcgtgcgcccgaaaatgtgctgcctgtaccacaggggctattgctggccgcccgcctgttaccggaagagttcatccggtgggtgatgaccgtgccagaagcatggcgttgtctgatgctgcacatgaatggcaatccctcttctctctcactgattgacgctttgcttcaggaagcggccgaatgggttcactcgcccctagtgaagccggtgatttcaccgcctccggtaacagaaacagatttcgattctgaaattgatgtcgtaccggaaaccacatccattcctcccgcaaatgaaatgaaaagtttatctcaatccgcttcggatgatacccagactttattgtcattatttcaattcaataatgaagctttgccgtcaataggtatgggggcgagtcaggtgctgacgattgcccagtccctgtatgaaacccataaagccacgacctatccacgcacggattgcgggtatctgcccgtctccatgcagacggatattccggtgatgctgacggcgctggtgcgaaccgatccggcgatggccggtattatcagccagctggatgagcaacttgtttcacgggtctggaatgacaaaaaaatcacggcacaccatgccattattcccacacgtcacgcttttgacctcactcggttaacgaccgacgagttacagatttatcaactgatccgtcagcattatctggcgcagtttctgcccatgcaggaaacggatgtgactgaagtgacactggatatcggcgggcaatgcttccgggcgaaagggcgggtcaatgtgaccacgggctggaaagcactgtttactgaaaatcaggaaaagtcagacgttgattccccgctcccgcgctttcaacagggtgactgttgccagattattgaagccagcattcagtcactgcacaccaaaccaccgaccccgtttactgaaggtacgctgattgccgcgatgaaaaatgcggccagtctggtcagtgatccgcaattaaagcaggtcttgcgggagagtgccgggctgggcacggaagcgacccgtgccgggattctggacaccttgtttaaacgccggctgattgagcggaaaaagaaagcgattcagtcaacgccactggcacgggaactggttgccgggttgccggaggtactgaccagtccgggcatgaccgcgttatgggagcagtcgctggatgatattgcgcagggcaaaacgtcgctggctgtttttatgcaaaaacaggtgcaatggcttttgcatttagtggaactaggtaaagcacaaccctttcatctgacgttaccgaaaactccggattgcccgaactgtggcagccggatgcggcagcgacagggaaaaacttcgccgttctggggctgtgtgaactatccgggctgtaaaggggtgctgaatgacaaagcggttacccaatcgcgcaaagctcggcgggcaaatcaacggacatga

SEQ ID NO: 2816 - DNA, 135 bp, Xenorhabdus bovienii
  Coding DNA location: Contig name=SeqID_16881; Position on contig =85146..85280bp; Strand=+
atgcgatttaaaacgcgcaaacatgttgttttcctccttttcaaatttggctcagtgtcggtgaatcccaatctgaaacaaggagaaactctttttgcgaaaatgaaaattaacctgactcgagtcacccattaa

SEQ ID NO: 2817 - DNA, 684 bp, Xenorhabdus bovienii
  Coding DNA location: Contig name=SeqID_16881; Position on contig =85394..86077bp; Strand=-
atggcatctcgccctgaccatcaaaaagaatttatttcgctgtttaaacaaacagcacgttaccacaaccgtcatcaggtctttcgggatttctgtcactgtgcaatggcagccattcacaataaatactgtttcagtgaggagctggagcagtattacctgaaaaccatcaacaagtataaacgggacgatgttgaccggattgtgcagctgttttcgcatgtgacgctgggattagctcaggaaccctgcgattttctgggcagtgtgtttatgcgactggagctggggaataaaggccttcagcaattctttacgccctggggcgtggccagaatgatggcggaaatacagttgcacgacgctgccgggctgttgcagacccaaccgtttgtcacttttttcgagccagcgtgtggtgcgggttgtatgactctggccgccgccgaagtgctgagagagcaggggcatgatccgatgtgcagtctgtgggtttctgcgattgatattgatccgctggcggcggtgatggcgtacatccagctttcactgaccggcattccggccgctgtcaccattggggatgccctgcatgatggcggtaaaaaacggacgcgttacacacccgctcattatctggggaactggtctcaacgtttgcaggaatatgaacaagcagcctga

SEQ ID NO: 2818 - DNA, 96 bp, Xenorhabdus bovienii
  Coding DNA location: Contig name=SeqID_16881; Position on contig =86071..86166bp; Strand=+
atgccattgcgtgttttccttataggacaaaaaaggaaaacacgtcccgaaagggaaccggttcccctttcggttgaagtgaagataaatggatga

SEQ ID NO: 2819 - DNA, 975 bp, Xenorhabdus bovienii
  Coding DNA location: Contig name=SeqID_16881; Position on contig =86183..87157bp; Strand=-
atgggccggttccgcctgtttatttttatcattcaagtgaggaacttaaccatggcagaatggtgcaccaatcaactggaaattaccggaaaatccgtgtgtctggatgtgatgcagcagtggatttgtggtgaggaaacgccccgttaccgtcaggcagtgttacaaagcctgcggctgtttctggcaggctgtgcggggatactgaaaccggccaaaccgcaaacctacaccccgtacccggcgttagtacgcggcacggccgccccgaccgtacagcatctggcgtttgagcagtggctgctgctgttgcagaataatgtgccgttgaataatgacaatgtaaaacgcatcgataacctgtaccgtcagtccggtctcagtctgatgcagtgggacaatgtgccggaagcggcgcgtgacattatcgctcgtcttctgacccgtcagtataccgactggtttgggatggtgggctggtctgacacgccggatatcggggtgtgctgggataaactgaatgcgtatccgcaggcggcgcagccctgcgatatgctgatgattatgtcaacccatctggcgaccgaaatcaacggtaacagcgccctgctgaaaggcattgccacgacagcgcagttttacggtgaacaatatgggattgaatggccgttcggtcaccatgtccgctgggagcgccgcaatgtcagcagtctgaccgtgcggtttgactccccgtgggcaccaccctcggcagaattgatgggcgagctgtcattgatgtttgactgtgaaatccgccactggtacagcgaagcatcaaatcagctcaaaggctacgattgctatgaccagggcgagcatgtggacagcggccacgggcagtcaggacgggagaaccggccggcgctttatctggtcaatggtgagaaagccgaaaccgcgcgggtattgccggcgatcgcggtcgggcaatag

SEQ ID NO: 2820 - DNA, 267 bp, Xenorhabdus bovienii
  Coding DNA location: Contig name=SeqID_16881; Position on contig =87199..87465bp; Strand=-
gtgattgcggctgccttgctgaaacggcattttggcctgagcctggctgacacggcactgtgtgaaaccgacacggtggcggaactgatagcagggggtgtccggccttctgaagccattaacgaattggtggataaatacgacctaacccggctgaatacgcaggttatcccgcgcagtacgccttatctggatatccacgatgagctgacggtcatttttgacagcggtctggctgaaatgctgttcaggcaaaccaggccgtaa

SEQ ID NO: 2821 - DNA, 174 bp, Xenorhabdus bovienii
  Coding DNA location: Contig name=SeqID_16881; Position on contig =87347..87520bp; Strand=+
atggcttcagaaggccggacaccccctgctatcagttccgccaccgtgtcggtttcacacagtgccgtgtcagccaggctcaggccaaaatgccgtttcagcaaggcagccgcaatcacctgccagaccgttaaacgtaacgtggccatcatgccccctcagaaaaagcactga

SEQ ID NO: 2822 - DNA, 558 bp, Xenorhabdus bovienii
  Coding DNA location: Contig name=SeqID_16881; Position on contig =87495..88052bp; Strand=-
atgaaccccatttttttaccggcaccggatgaaaccgataccgcattacgtgaagagctgtttaccgctcaggtcaccggcctgaagcaacacccgaaagcaccacagtcattgcagccggaaatcctgatggtgtgcgaagcctcctccgtcacggaagtggtgcagcggctgaaggtgatccatcttctgggggactggccggtgccggagaggttatctgctcaggttgcgggggctttttttccgctgaccgtcatgatttttgatgcacaggacagaaaagtactcggtggccggtttgataaggagattgtctgggcgcagccggtcatgctgacgtcagaatgcctgtcactggaacagcaacagcagcggttatgtcaggcagcgatgcttgagcagagctggcagaataccccggcggcgcgggcgttgtggcacaaggcgcatttattgtcactgcatggggtttcctcctgttatcagcagtgccatgaagtgcgggatattctccggcacggcatctccgtcagtgctttttctgagggggcatga

SEQ ID NO: 2823 - DNA, 126 bp, Xenorhabdus bovienii; identical to SEQ ID NO: 2779
  Coding DNA location: Contig name=SeqID_16881; Position on contig =88042..88167bp; Strand=+

SEQ ID NO: 2824 - DNA, 462 bp, Xenorhabdus bovienii
  Coding DNA location: Contig name=SeqID_16881; Position on contig =88173..88634bp; Strand=-
atgccaaataatgaactgattatgctggacagtcttgcgctgtcggtcgtgtttcccgacaaaaccccgctggaacggttgtttctgggattcctgctggcgaataccgcatcgacgttatgcggcgattatcagcctgaacagtggacaagccgacaggtgtctgaatcgctgacttatatgatgccgacacgggcggaaacgtattccgtttacctgccggttacgcagctgacggtcactctttccgccgatgccttcgggctggcggtcacggccatcgtatcagcccgtatcacggtgccggatacacagaatgaggaggcgtaccggttctgcgcattgcaggcgtatgcgcagcagcacccggaaagcggcctgataacatcgatcatgacactgaaacccagagaggacgttatcagtccgtcacttatccataacaaaaataatcatcattaa

SEQ ID NO: 2825 - DNA, 432 bp, Xenorhabdus bovienii
  Coding DNA location: Contig name=SeqID_16881; Position on contig =88647..89078bp; Strand=-
atgcaacaaaatacacctccggtcacggacatcgtgcccgcgtctgaacactccccctttgctgaaatttttccgcacaccagttcactggagctgacgctgctggagcacacgttcattaaagccgccgccgtgctgtgtgatgatgaccggtgtgatcagtggcagtaccggaaagtgtcaggaactatcgcctatattgtaccggtacggccggattcctcaggagtcagggttgaaacaaccgactttaaaggtgaggtttctgccgatgctttcggactgatggtaaccctgagcgtattggagtatctggcggccctgatgaagctggacgggtacgctgaacggttttgcgacctgcgtgaatatgcgctgcaacatcctcatgcttcgtgtatccgggctgctttgggcttaaagggtgcataa

SEQ ID NO: 2826 - DNA, 129 bp, Xenorhabdus bovienii
  Coding DNA location: Contig name=SeqID_16881; Position on contig =89032..89160bp; Strand=-
atggccaaccggccagtcacccaacggggaacacgtttcccattgggtcaggtgttccccgttgttttatcaggagaataccatgcaacaaaatacacctccggtcacggacatcgtgcccgcgtctga

SEQ ID NO: 2827 - DNA, 303 bp, Xenorhabdus bovienii
  Coding DNA location: Contig name=SeqID_16881; Position on contig =89166..89468bp; Strand=+
atgagattaagaaaccttcatcgtcatcagactgacgatatctgcttccaaaggtgcgcagatgtaccacacggttgtgtactcccttgcaggctacaggagtgttgctgtcgctgcccgaaggtgatcctcacaagcgaccggatcatcgataagtctgactacgctaataaacggaaatcatcaggtcaatgggtaattcatttcccgggacaaaaaataatgtcaggaacacaacgggattttgggggagtcagggagaggctgtcaatacgaggtgacccgttctggtcttttgtctaa

SEQ ID NO: 2828 - DNA, 138 bp, Xenorhabdus bovienii
  Coding DNA location: Contig name=SeqID_16881; Position on contig =89410..89547bp; Strand=+
ttgggggagtcagggagaggctgtcaatacgaggtgacccgttctggtcttttgtctaaatcatttatgccccattgtgtgttggtgccgatggctgaattacatcggaaacctatttttacaatacataaatcatga

SEQ ID NO: 2829 - DNA, 417 bp, Xenorhabdus bovienii
  Coding DNA location: Contig name=SeqID_16881; Position on contig =89565..89981bp; Strand=-
atgcctcgcctgcacgggtattcaaaaaaagggttacggtgcttcggtacacacgattggcacgcgcaaggtcttgtgaatgtcattggcgcgatcataaaaaatacctttctcaccttaagtttgtttaccggaaacatcaatgccgatgtttttcatgcttgggttacccaagatttattgccaaaactcccgagtggcgccgtgatcgttatgaataatgcgcgttttcataaacgacatgacacgatacaagcgatagccgacagcagatgccaattggaatggctcccgccttatagcccggatctgaaccccatcgaacacaaatgggccggagtaaaagcgataggagaaaaaaggtgttcagttgatgagttatttatggagcatgtagaatgcgtcaagttatattga

SEQ ID NO: 2830 - DNA, 354 bp, Xenorhabdus bovienii
  Coding DNA location: Contig name=SeqID_16881; Position on contig =89903..90256bp; Strand=-
atgagaataactcaaatatcactgacaaatttccgctcctttaaagagacacaaacaatcgatattgcaccggtgacacttttgtttgggccgaatagcgtcggtaagagttccgtattaatggcgctcgcttatgtgcagcagatcttgaaacatggacattgcaacccccaaaagctggattccctaggtaaaaaaacaataggtggtttgatgactatgagcaagtgggcaaacccattgtttatctggatgaaagaggttttgcccagtccatgcctcgcctgcacgggtattcaaaaaaagggttacggtgcttcggtacacacgattggcacgcgcaaggtcttgtga

SEQ ID NO: 2831 - DNA, 210 bp, Xenorhabdus bovienii
  Coding DNA location: Contig name=SeqID_16881; Position on contig =90281..90490bp; Strand=-
atggtgtataaccgggatttcgttgatcgaaaccttaatcaaggcgatcctctacaggatatttttaccttgagtgagaatcaggttgaagccaatgaagcatatcttcgtgtttttcgaagtatcttcggtaaagcgggtcaaatcggacactacaacatgatgacagggactgtcatcgaaactctagtgacgaagagacggctgtag

SEQ ID NO: 2832 - DNA, 264 bp, Xenorhabdus bovienii
  Coding DNA location: Contig name=SeqID_16881; Position on contig =90533..90796bp; Strand=+
atggttatgcgcttgataaatcacacagctgatgatggtcttgcctgtgccgttcgcaccaaaaatataattgatgcggcgaagatcactgagccttgctggactcatataagtcgctatgggcggatttatttggatttcgccgatcataccctcttcttagagttcaccagaaaaggctttttggctaatcgacaagaaattgtttctggtagcttcattgccttcgtattggttttcaatcaactttgctacctttactga

SEQ ID NO: 2833 - DNA, 1167 bp, Xenorhabdus bovienii
  Coding DNA location: Contig name=SeqID_16881; Position on contig =90692..91858bp; Strand=-
gtgaccttcaagcctgatgacctggtagagcctttatcttccaactctactgtggttatgcgtactaaaaatgttcaggttgaaggactcgagcaaagtgatctgattgctattccctcggagctagtaaagagaaaggaacaggctctgtgtgaaggagatattttgatttcatcagctaatagctgggagcttgtgggaaaggccagttacgtaccaaagctgaattatcaggccacagctgggggatttatctctatagtccgtacgaagcagagggttattgatagcagatatctttaccactggattagtagtccgtctacgcagcataaaatcaggcattgtggccgtcaaaccacaaatatttcgaacttggatgtaggtaggttcaaggatctggaaatccctctcccacccctaacagaacaaaaacgtattgccgctattctcgataaagccggtgccatccgccgcaaacgccagcaagccatccagcttgccaatgaattcctccgcgccgtgtttctggatatgtttggtgatcctgaaactaagggatggaaattcacaacagttgaaaatatggctgctaagtgtaagggcagtatgcgaacaggaccttttggtagcgatctaaagcatagtgaatttataaacgagggtatcttggttcttggaattgacaatgcggttagtaacaagtttagacggggaaaagagcgctttatttctcaagagaagtacgaacaactcaagcgttacacggttaatccaggtgatgtattaatcacaatcatggggacgtgtggaagatgtgcagttgtgcctgatgatattcctttagctatcaatactaaacatctctgctgcattactctcgataaaaatcaatgcataccaagttttctccattcatatttcttggttcatccaatagccagacgttatctaggtcagaaagctaaaggtgcaataatggatggattaaacatgggaatgatcaaggagatgccaattcctattgtacctatcaatgagcaaaagaaatacgaatctatttcagtaaaggtagcaaagttgattgaaaaccaatacgaaggcaatgaagctaccagaaacaatttcttgtcgattagccaaaaagccttttctggtgaactctaa

SEQ ID NO: 2834 - DNA, 1605 bp, Xenorhabdus bovienii
  Coding DNA location: Contig name=SeqID_16881; Position on contig =91906..93510bp; Strand=-
atgctaacaggccaaatacgtaacgatatcgacaatctctgggaaaaattctggaccggcggcatcaccaaccccttaactgtaatcgagcaaattagctacctgatgttcgcccgtatgctcgacatgcaggaagacatggccgagcgcaaagcgaaccgtacaggtaaagagtttgatcgcctgtttcccaatacaccggaagggcaattgttgcgctggaaaaactttaaaaacctcagcggcaaagaactgcacaaacaccttaagcaaaatgttttcccttactttgcaaaacttggcaagaagtccgatgaacaagatggtctgggcaacgacggtagtgccatcgaagccttggggcatatcggtgaatacatgcaggatgccgatcttgaaattaaaaatgaatcggtgcttgtcagtgcagtggagatggtggatgaactgcctctaacccaaagcgatgtaaaaggcgatatttacgaatacttgctcagtaaactcaccaccgccggtatcaatggccagttccgcacgccgcgccatattatcgacaccatgatcgaactgattaatcctcagccttttgatactgtctgcgacccggcctgtggtacagccggatttctcgcccgcatcatggaatatctcaaccgcgtgcattccagtgagttcggtattcttgaagatgacgacggtaacaaacactacaccggcgacttgttagagccttaccgtgaccatatcaacaaaaagatgttctggggtttcgatttcgacaccactatgttgcgcgtcagcagcatgaatatggctttgcatggggtgaatggggccaatattctctatcaggacagcctgagtaaatccattaaagaaaacttcccgcagcaggaagaaaacttctttgatgtcatcctcgccaacccgccgtttaaaggcagcctggacgaaacaaacactaaccctgacctgctgggtctagtaaaaactaaaaagaccgagctgctgtttgtggcgcatatcctgcgcgccctcaaactcggtggccgcgcagccgtcatcgtacccgatggcgtactgtttggctcctccaaggcccaccagcaactgcgtcaggagttgatggaaaataaccagctcgaaggtattgtgagtttgcccagtggcgtgtttaagccctatgctggtgtcagcacggccattctgatgtttactaaaggtggtaacactgaacgtgtttggttctatgacctgcaagctgatggctattcattagatgataaaagaacgccgttaaaaggcgaaggcagcaacgacctgcccgaagctattgccaagtggaagcaatatattgccttggttgagaggaacgctttagccaaagatattaacaaagcttttggcgataaaactcaaaaagcattcgtggtggacgccaaagatattgtcgacaacaaattcgacctctccatcaatcgttataaggaagtggtgtatgaggaagaagcttttgaggacccgaagacgattctgaacaaactgaaaacgctggaaagcgagattatggcggatctggatgcactggaggggatgctgtga

SEQ ID NO: 2835 - DNA, 123 bp, Xenorhabdus bovienii
  Coding DNA location: Contig name=SeqID_16881; Position on contig =93510..93632bp; Strand=+
ttgaatagctcgcttaatgattttctgctgtttctgattcgattggcgctgcgcttagcacattgccctgtgccatgttttccaactggcttggctctacctcttaagccaattaatccatag

SEQ ID NO: 2836 - DNA, 1785 bp, Xenorhabdus bovienii
  Coding DNA location: Contig name=SeqID_16881; Position on contig =93667..95451bp; Strand=-
atgcaatcactagaatggacgaccgaactcatgattattgcctctgtggcgggcctggttctcgctgcctttggctatctgctggctatggtcctgctaggacataagaacaccgagctcaacacccaattgcaacaggctgatcaagcccttaagctggccaacactcaaaaccagaaacaccaggatgagctcaagcagctcggtaccactctgcacgagaaagaattgtcggaaagcaagctacagacgcaacagaccaatgcaaaggtcacagaacaacgcctgaatgacgcattagccgagcgtaaaggcgagctggcatccttacagaaaacgctggaagagttacgagggcagcaccatagtacagaaaagcaactagaaaccgctcaatccgataaccgagcgttgaaagaacaagcgcaggatttacgagaccgtctggaaaaatgtgagcagaacgtccagcaagaacgcaccctggtgagccaactcaaagatgagctggcacaagaaggcaaaaaggccaaagagttagaggcatccaataccgaagcgcgcgagcagctgaaagacgtcagacagacccttgtagatcaacaacagcgttatgatcagattcaggagcactatcagtcgctcagtaacgagtatactgagcttaaaaccacgctggagcgcaaagaagaacactttaaagagcaaatgcagcagctcagtgaaaccaagcaatcgctcaccaaagagtttgagagtctggccaataaaattttcgaggaaaaaggcaaaacctttacccataccagtcaggtcagtatcgacactatgctcaagcctttccgcgaacagatcgaaggtttccaaaagcgtataaacgaagtacacgatgtttcgctgcaaggcaataccagcctcaatgccgaaataaaaaaggtactggaaattggcctgcaaatgagcaaagaagccaataacctcacttctgcgctgaaaggggattctcagaagcgcggagcctggggcgaggcacagcttcgtcgcactctggaaatgagtggcttgatggaagaggcgcactatgaagttcaaggctcattcagagacgcagaaggcaagcaaaagcagacagactatctgataaagctgcctgatggtaagcacatcatcatcgacagtaaggtagcactgaacgcatacgaccgggctgtgggtgcagaatcaccggaagaatatcagctggccatgagcgaacatgttaaagcggtacgcaggcacattgatgatctggcatccaaggattacaccaaccttgttggtatgcgtagccccagctttgtgcttatgttcatgcccattgaacccgcctatatcgaggcgctcaaggataacaaaaacctgttcgaatacggctacaaaaaaggtattgtactggtctcccataccacgctcattcccattctgcgcacagtgtccaacctgtggatgattgaacgcagcaatgccgaagcccgcgaaatcagcgaaaaagcaggtgatatatacaactcagtgtgtactgtagccgagcgtttaagtaaattaggtggcaccctgagtaccgtcagcaaccattacaacagcaccgtcaaagcgctggtaggacagcaaggcttgtatggcaaggtggatcggttcagtcaactctctgccaaagtcagtaaaagcctgccccacttggaggctgcacatatagacttcgaaaccgagcgcctgaccttgatcgttgagcctattgatgagtag

SEQ ID NO: 2837 - DNA, 3084 bp, Xenorhabdus bovienii
  Coding DNA location: Contig name=SeqID_16881; Position on contig =95454..98537bp; Strand=-
atggcattgggcacggcgcaccagttggccatgtatatgggtattaagtactacaacaaaaagaaggatcagatcccctcttttgtcgatataaaagaccctacggcaactttgagccaactgcaaaaatccgtttcaagctacgaaaaagaattgcaaaagcagcaggaagagctcgaaagggtgatcgagcagctggaacgtgagcgcacccgaaatatcgacaagcttgagccccccgccaagtctgaccgacaaaaacgccggcagcagagccagttagtggccgacagcctgcaatggaacgaagccaaaacccgtgcactattgatcgacgccatgctgttgcaagctggctgggatatccagaaccccgatcagattagccaggaatttgaagtgatctttcccaataatccctcaggcaagggttatgtggattatgtgctatggggtgataacggtcatccgcttgctgttatcgaagcgaaaaaatccggcaataccaaccttcaagcaggtcgtgagcaggctcgcctctatgccgatgcctttgaacacatgggctaccagcgcccggtgattttctattccaacggttacgaaaccttcatttgggatgatcatcagtacaacacctatcgtccggtgtatggcttttacagtaaggacagcctggattatctgatctaccagcgccattaccgtgccgctgagctggaaaaattcaacccagagctcagcattgctgaccgcccttatcagatcgaagctatcaaaacagtcgcggcacactttcaaagtcagcgtcgtaaggcgctgattattcaggcgaccggtacaggaaaaacccgtgttgccattgcactggctgaattactacttcgcactggctgggccaagcgcgttctgtttttgtgtgatcgcaaagaactgcgggtacaggccgacgatgcttttaagcaaaatctgccctctgagccgcgttgtgtgattggtgaaaccaacaagattgataaaagtgcacgtatctatattgccacttaccccggcatgatgaaccgcttcgctcaattggatgtaggcttcttcgatctgatcattgccgatgaatcccatcgcagtatctacaacaaataccgcgatctgttcgattacttcgatgcccttcaagtgggcttaaccgcgaccccggtgaaatttatcagtcgcaatacgttcgatatgttcgactgcgaatccactgacccaacatttgagttcgggctggatgcagcgattaacaacgagccaccgtatttggtaccgtttcgggttaaagatcttactactgacttcctgcgtgatggtattcactacaataacctcaccgaagagcagaagcgccaactcgaagaagatttgggcgaggaagaggcccgtaataccactattgcaggtaaagacattggccgtaagatcttcagtgaagatactgaccgcattattctggaaaacctgataaacaatggcatcaaagatgaaactggctccctggtcggtaaaactatcatctttgcccaacgccaggatcacgctgagcatctggaagaactgttctgcaagctgtacccgcagtacggtactaaggtatgcaaggtcatccataatgccattccccatgtggaaagcctgatcaaagagttcaaaaaggctgacaacgagtttcgcatcgctatttcggtcgacatgcttgatacaggcatcgacgtgcctgaggtggttaatctcgttttcgccaaacccgtgaaaagttgggtgaaattctggcagatgattggccgaggtacgcgcttacgacacaatcttttcgggcctggcaaacacaaaaccgaattcctgatttttgaccattacgctaacttcgctttctttgaagaggaatatcaggagccagaagacactggcggcaaatctttgctgcaaactaccttcgaatcccggattgagctggctcaggccgccttacagcgaaaccatgcagccgccttcgatgctgccattgagttattgcgtgccgatattaacgacctgccagatactagtattgcagtaaaacgtgaattgcgggtcgtacaccagttacagcaaaccgatctactgaagcgctttgatgcaaaaactcagcatcagttggtcaatcacatcgctccattaatgtcagcccgtgtattgcgcgacaaacatgcgacttatctggataagctcatcgccaccatagaacgctgcctagtagagcaagccagctgttttgatgatggtcgagagctgctgttggcagaacttaataagctggccgttaacattcaggcagtgcgccagaaagatgtggttatagcagaagtgcgcagtgccgagttctggcaaaacccgactatcgataagctggaaaaagctcgcaaagagttgcggggcatcatgaaatatcgccaaaccgttagcggtggattgtacgctataccagaaacaaaaacgggtgacactggtttgcaactaaaagaacgtgaggtaaaaatcgcaggtgccaacgaggccatgatctaccgccgtaggctcaaagatattctggatcagatgatagctgccaaccccacgttgcagaaaatccgcaaaggcgaatctattgccgaaccagaattaaaaaccctcacctcgaccatactcaccagccaccccagtgtgagtttggaggtgctgaatgaattctatggccgcactgccgaccaactacacctgaccgtgcgtgaagttatcgggctggacccgcaagccatcgaagagcacttcaagagcttcttgcatgcccacccaacacttacagcacagcaggtgcgctttatgaacctactgaaaaactacatcgcccagcacggctcgatcaggatcgaaaaactgtacgatgcacctttcacctcagtttcgcatgagggcattgatggcgtatttaccgccgatggcgtgggtgagttaatcaccgtactaaaaccttttatcaaggctgaacccaaattgtcaggctcacagcctgagagcacacaggagtga

SEQ ID NO: 2838 - DNA, 1392 bp, Xenorhabdus bovienii
  Coding DNA location: Contig name=SeqID_16881; Position on contig =98581..99972bp; Strand=-
atgtgcaaggctaagccccgtacactggtcagctggattggggggaacgacctcaaagccaccggcagcaccggagctgatggtcaggcgcttgggccgattgctgcgactcttacagcacaagcgtttgatgccgtagaactgctttacaactacccggaagatcaggtgaggtcctatctggcttggttgcaggagctagttaccacgcctatctgtgctcacgccatttcgctatcttcacctgttaacttcggtgaaatctatgtccaggccaatcagcagctatctaagcttaccgtagagggctgcgagttatccatcttgttaagcccaggaacaccggccatgcaggctgtgtggatcttattaggtaaaacccattatccctgtcagttttatcaatcatcactagagcagggtgtccaacaagtggatatcccctttgaggtttcagcggaatacctgcccgccgctaaaagcattgacagcgcaaagattagccagctggcagaggccagtgcccctatcaatgcagccttcgacaacattgtcacccgtaacccccgcatgcagtctctgaaagcgcaggcgcaaatactggcagaacgtgaagtgccagtgttgatctatggggagagcggtacaggtaaagagctctttgcccgtgctattcataatgccagtcatagagccaacaagccgtttgtgccggttaactgcggtgctattccgaccgagctggtcgattcagtcctctttggtcataagaaaggcgccttcaccggtgctctagccgacaaggcaggtttattcgagcaagctaatggtggaactctatttctggatgaatttggcgaactggaacccagcatacaagtgcgtttattacgcgtattacaggaggggacgttcatccctgtgggcggcaccaaagagcaaaaggtcgatgtccgcttgattacggcgacccaccgcaacctgatagaagcggtttccaatggtagctttagggaggatttgttctatcgggtggctgttggagtactacatctaccgcccctgagggagcgtgatggagatctgtcattactggcagatagcttggtcaaagcgatgagtatccatgactcgatgcttaggcataagaaaatttctcctgatgcaaaaaatcttatccttcaatgcccttggcgaggaaatgtgcgtgaattgcagtccacattgctgcgagcagctctatggtgccaaggtgacgatattaccgccgctgatatccgtcaggcgttgttccatatgccagagccggaaacagggttgatgaatatggatatatctcaaggcattgatataaaatgtataattggcagcgttactgcgtattcaaggtaa

SEQ ID NO: 2839 - DNA, 210 bp, Xenorhabdus bovienii
  Coding DNA location: Contig name=SeqID_16881; Position on contig =99959..100168bp; Strand=-
atgatacgttgccatctcgctcgcctgatgggagagcgaaaaatgaaaatttccgacgtcttgcgtgaaaccggtcttagcaggaatactgtaacgctgatgtacaaagaatctgcacaaaagatctacattgaggctttggataaactttgccgcctatttgaatgtgaggtggctgatatgctggagttcacggatgtgcaaggctaa

SEQ ID NO: 2840 - DNA, 114 bp, Xenorhabdus bovienii
  Coding DNA location: Contig name=SeqID_16881; Position on contig =100333..100446bp; Strand=-
ttgatcactgtagagtgttgttcaacaagtaagctgcatgatatcaatgacagcattcatagcggtctgacatcagcaccagaggcatatctaagatccgcagccatcttatag

SEQ ID NO: 2841 - DNA, 885 bp, Xenorhabdus bovienii
  Coding DNA location: Contig name=SeqID_16881; Position on contig =100554..101438bp; Strand=+
atgtctaatttagaagaactttactgctgcgtcgatgacttttgccaaaaatttatccctctctggcatcaacaactcattgaaaatggattacgtaaacggcaccgtgaggcatccctttctctcagtgaagtcatgatgatcctcattttatttcatatgagtcattatcgtgattttaaaacattttatattgaacatgtaaaacaatatcttacagccgattttcccggattagtcagctatactcgtatcctcaccctgaagaaaagggtgcttattcctttatgcgcttttctttcatcacgtaaggcgcaaactcaagggattgcttttattgattctaccaaaattgctgtttgtcacaatcttcgtattccccgtcatcgcgtatttgaagggatggcacaacgaggtaaaacgagtacaggctggttttatggctttaaacttcatttggttatcaatgattgcggtgaattgttagccgtgaaactcaccgcaggaaaccaggatgatcgtcagccagtcagagcgctgacaaaaggactaacaggatgtttatatggtgataaggggtatttatcccaggctttatgcgatgagttagaagcggaaggcgtcacgttaatcaccaatgtccggagtaacatgaaaaccaaagcattatctctctgggataggttgatgttaagacggagatttttgatagaaacggtcgtcgaccagctcaaaaatatttctcagatagcgcattcaaggcatcgcagtcagctcggttttttgttggaagttgctgccggtcttattgcttatacattccaacctaaaaaaccgagcttgaatctacgggataatgagatcgctatctttaaacgaagctga

SEQ ID NO: 2842 - DNA, 1197 bp, Xenorhabdus bovienii
  Coding DNA location: Contig name=SeqID_16881; Position on contig =101452..102648bp; Strand=-
atgttgaacgtaagaatagctggcaactggctgaatggatgggggaaagtacccccgatgggattcaatatttgctggaacgcgctgattgggatgtcgatatggcccgcgatatcctgcgggattatgtcactgaacatttgggcgatgaacagggtgttctcatcattgataaaaccggttttatcaaaaaagggacacattctgccggggtacagcgtcagtaatagtgggaccgctggacgggtagaaaacagccagataggcgtatttctttgttacgccggcaacggagggcatgcctttgttgaccgggcattatacctgcctcgccagtggacagatgcccgttcccgctgtgaagccgcgggtatccccgccagcgtcacttttgcaacgaaacccccgttagcccggcagatgctggaacgaacatgggatgccggcgttccctgtcgctgggtgaccgcggatgaagtttatggccgtgaccgtcgtctaagagtctggctggagtcccgatacccgccctttgtgttagccattccctgcaatacccccttagggtggcgagggccagagtatatccgtgctgaccggattgccgataccctgaccgccgctgactggaaaacacggtcagcgggaacggggacaaaaggtgagcgtgagtatgactgggctgtcgtgccgttatggcgtttacagctcagtgaagaggatcgacattatggtcattatttgttagttcggcgcagccgggatagcagacaggaacgggcttactatgtggtgtatgccctgagagaacaggtggatcttaatacgctggttcaggttgcgggttgtcgctgggaaatcgaaagtggctttgaggaaaccaaaggggaatgtgggctggatcactacgaagtgcggcgatggcagagctggcaccggcatattaccttgtcgttactggcccatgcagtcctggcggttttgcgggtacaggagaaaaaaacaccggtaggccgggttccgctcagtgtagcggaactccgtaagctgctgtcaaagctgatggaaaaagcgggaaagacaatcgaacagattttacattggtcagactggcgacgacggcatcaataccgggtacaacaatgtcactgtcgccgccggggaaatcatcggcttacagagcaattacggctgtag

SEQ ID NO: 2843 - DNA, 108 bp, Xenorhabdus bovienii
  Coding DNA location: Contig name=SeqID_16881; Position on contig =102730..102837bp; Strand=+
atgcctgtagcgcctgttcccagattttggcaggggatggcatgtgacaccgccttttatttaaggaagaagagccctatcatcgcacatgatggattacggctgtag

SEQ ID NO: 2844 - DNA, 354 bp, Xenorhabdus bovienii; identical to SEQ ID NO: 1741
  Coding DNA location: Contig name=SeqID_16881; Position on contig =102853..103206bp; Strand=-

SEQ ID NO: 2845 - DNA, 492 bp, Xenorhabdus bovienii; identical to SEQ ID NO: 1438
  Coding DNA location: Contig name=SeqID_16881; Position on contig =103143..103634bp; Strand=-

SEQ ID NO: 2846 - DNA, 279 bp, Xenorhabdus bovienii
  Coding DNA location: Contig name=SeqID_16881; Position on contig =103704..103982bp; Strand=+
atgaaaactgaggggatcacactgatcacccatgttcgtcgtaatatgaaagccaaatttttatcactttgggacagagttatgttaagaaagcggtttttgatagagacagtgaatgaccaattgaaaaatatttctcagatagaacattcaagataccggagcgtagtcggctttttactggggattgtatcgggacttattgcttatacattccaacccaaaaagccgagtttaggtttacgtgattctgaaattgggatgcttaaacaaaactga

SEQ ID NO: 2847 - DNA, 171 bp, Xenorhabdus bovienii
  Coding DNA location: Contig name=SeqID_16881; Position on contig =103960..104130bp; Strand=+
ttgggatgcttaaacaaaactgaggtttttcagatagagcattcaaggcatcgcagtcagcttggctttttattggaagttgctgccggccttattgcttatacattccaacctaaaaagccgagcttgaatctacgggataatgaaatcgctatctttaaacgaagctga

SEQ ID NO: 2848 - DNA, 528 bp, Xenorhabdus bovienii
  Coding DNA location: Contig name=SeqID_16881; Position on contig =104138..104665bp; Strand=-
atgtgtgatgaacaaattgtgaataataaacatcaattttttgagcttccattacccgcttcctttttaagaactcggcgggcagtacgagaactgcacattactttagcttattcaccagccgtcagaacgaccaggctggattatgcggctacgcaaatatcctatagactcataaaaggaacatcgttacaggatgtccagcagtattttaatcatgatgtacaggatggcacaaaatccaggaatgatgatgcggcaagtaatcgttctgttactgcacaacaacgtgaccacggtacagtgcaatcatttagttggacctttaagcgtcgctctcctgatgaaaagtggtttgtagttgtaactagaaatgatcgtgagtggggggctccactcaatagtcaacacgaatcatatgctttagttgttactgcaacggatagagaaaacgctgaggccaatctttacgccgaaattgaggcccgaattcgtgaacaggaacgttctagagcacgagtaagctaa

SEQ ID NO: 2849 - DNA, 1851 bp, Xenorhabdus bovienii
  Coding DNA location: Contig name=SeqID_16881; Position on contig =104678..106528bp; Strand=-
atgacggaacaatataaacatcttagtattgcgaaagaatctcttcagaaccctagacgcacacgtcagtttaacattccgagaacaccacgtgccgacttgcgcctgcatggaagcatgttgtctgagcaattacgaggtattacgcaattagctaccccgcaaattccaggaaaagataatgatggccggtacatgcttaaattacaatataccgggatgttagatattgctcatctagacaggcatggtatcgagttcgttatccaagaagacaaaacgatctgtattgcttttgctgatgaacgaggaattgccctctttgaggagcacctgtcacaattgggacatgggcatattacctaccagcagatcctaacagcattggacagtgttgatgtttggtctagtgaggatcgcaaaagctggtcagtcaggcattatggttttcctgaattagaatcattcggtctggatgttgagctttggccgatagaaaccacacgacatccttcacgagagcggatctgcgaagaatttgaaaactggcttcaggaaaatatgattcaccgtttggatcgaattaatcttgatagcttgttgatgtatcgggttcgagtaaattgcgagcaagctgaaaaactactagcccatcgtgatgtccgtatggtagaattgcttccttcaagcgggatttcgtacggaaaattgaacagagatatcaacgttattcctgcacacatcccctccccatctcctgacgctgcgaaagtttgtatccttgatagtggaattaataccgcacatccattattgcgtagtgctatagctgaaagcgccagctttgtggttaatgaagacgaatttgaccattgcgggcatggtacagctgttgcaggtattgcgctatatggtgatgttgaagcctgcgatgccagtaatttctggcaaccatcagtgtggctatataatggaaaactccttaattctcaaggggaatttgatacttctacgatcgaaacaacgttgactgaggctgtagagtatttcgtagatttaggatatcgtatatttaacttatcacttggtaatgcaaatgcaccatatgatggtaagcatatcaggggaattgcttatgttcttgatgtgctggctcgtcgtcacaacattctgttcgttgtttctgcaggtaactttagcggaagtagtgaccctgatgttccacaggaaagttggcgtgctgagtacccaagttacttaatccataacagttccgttattatcgatccagcccctgcactcaatgtcctcacgacaggaagttatgccaggcacaatgcaacatttgatgctcaacgtagggcggatgaaattagtcatttaagccctgcgggggaatttcaaccctcaccattcacacgccacgggccgtcagtgaaaggagcttttaaaccggaaatagtagcccatggtggtaatttcgccgtccccatgcgtaatgacggaggccaatggcgagaacatgccaaaggacttggcgttctaagctgccaccatcaattccaaggaagcacatttttctctgaacaaagtggaactagtttttctgcaccatatataacgcatcttgctggacgtttactaaatgaatatccagatatgtcagccaatatgttgcgagcgatgctggtcaaccatgcagtattgacttctcagatggaaaatacattttctgaagaagttgttgagtgttataaagcagagtcagcaactcgaaaccgcagcattattcgggatgttgttggatatggagtagtcgaggaagatagtttataccgttcatcagaataa

SEQ ID NO: 2850 - DNA, 987 bp, Xenorhabdus bovienii
  Coding DNA location: Contig name=SeqID_16881; Position on contig =106532..107518bp; Strand=-
atggcaaacggtaaggttctcagacagcttataaaagctggggcgacaggtgatgtcgcggccttccgtcgtgtttcggaagtgatcattgagaaagaacgacaaaaacagcatcatcttcttgcgaatgatcttgaacatatcctgtatggagatcacaccgtacagacctcccgtgtgcctgcagctccccagatgcctgttgataaagagagaggcctaccattactggatattaaacagccaagccgttctctgaatgaaatcgtactacccgaatcaagttcagatgcaatcgaagagattcttgaagaaaatcgcagagctgatgtgctacgcagctatggaatgaaagctgttagtaaagtaatcttttttggtcctccgggatgcggtaaaactctggcagcagaagtagttgcttgtgagttggatatgcccttggcaatcgtcaggcttgatactcttgtttcttcttatcttggtgagactgctgctaacctacgccaaatatttgattttatctctcagtatccaatggttgtacttttcgatgagtttgatgctattggtaaagaacgaggggatagtggggatcatggcgaattaagacgggtcgtgaatgcagttctacagatgatggatgcatatcaggggcaaagcttgattcttgcggcaacgaaccatgagcatattctggatagcgctatttggaggcggtttgacgatgcaatcgaattcccactccccgacaaacatcaattattagaattgatgaagctaaaacttcgtggcatacgtcgccagtttgagcttgaagatgatgccgtgctctcactatttattggaaaaagtggtgccgatttagaacggattgtaagacgtgcaatcaaaagaatgattttacgtagccaagagtttttaactctgaaagaccttaagaatgcactcttgcgggaaaatgtaaataaaactcgtcagggataa

SEQ ID NO: 2851 - DNA, 183 bp, Xenorhabdus bovienii
  Coding DNA location: Contig name=SeqID_16881; Position on contig =107701..107883bp; Strand=+
atgtccgcttggcacaatgccgactgttttatatggacgtcccgtaatattcaacttttttcagtgactcagttcgtggctaatttcgcttcacagtcatatatccggcgtctggcgatcattccaatttactgcgccatggtgaagtccgaaccttgcctcctcatcagattaacggattaa

SEQ ID NO: 2852 - DNA, 285 bp, Xenorhabdus bovienii
  Coding DNA location: Contig name=SeqID_16881; Position on contig =107975..108259bp; Strand=-
ttggttccccgacaagcaagtagtggtgggaaaactcaattaggtaaaatcaccaaaaatagtaatcgatacttgcgttgtattttaattcatggcgccagagcagccatgcaacgcagaacgttacggcacgatgcactgggtgactggatgcagtctttggttaaccggcggggatttaataaagcgtgtgtcgcttacgccaataaatgcaaatgcgccagaatatgctggtcaatcaggattaataatgacgtgtttcaggtgagcaaggcctttgcctga

SEQ ID NO: 2853 - DNA, 705 bp, Xenorhabdus bovienii
  Coding DNA location: Contig name=SeqID_16881; Position on contig =108302..109006bp; Strand=-
atgcgtaataaaattcttggtattgatttagcaaaatcgatctttcagctctgtttgctcgatggtaatcacgttgtctttaataaaaaagtgactcgcaatcggctactggatgctgtcagacaaatggaatccgggactttggttgcgatggaggcttgtagcactgcccactattggggacggatggttgggcatcttggctttgaggtttgccttatcccccctcagcacgttaaagccttcgtcaaaaaccataaaaatgatgctaatgacgctctggcaatttgtgaggctgcgaatcggcctgatatgaattttgtgccagtgaaaaacctttctcaacaggatctttgtgctctccatcatgtgcgacagtcattagttcaaaaacgcgttgccacctctaatcaaatcagaggactggcggcagaatatggcatcgtttttccgcaacgctctgctgccctgagacaatcgctgtatgaagcacttgaggatgctagtaatggattaacggtgattgcacgtaggattttgaaacaactttatgaagactggctgatattgctccaacgaacagaggaaatagaagaaaccctcaaattgctatcatcacaaacggcacagtggcaacaattacaatctattcccggcattggtcccctaatcgcctctgcatttatcgcttatgtcggtgattga

SEQ ID NO: 2854 - DNA, 111 bp, Xenorhabdus bovienii
  Coding DNA location: Contig name=SeqID_16881; Position on contig =109031..109141bp; Strand=+
atgctatttcattttggtacaattgacgccatgtgggacgtccatctcatcagattaggttgcgctcagatcatcgatagtgtcatatcgagtcttatttggtacaactaa

SEQ ID NO: 2855 - DNA, 132 bp, Xenorhabdus bovienii
  Coding DNA location: Contig name=SeqID_16881; Position on contig =109189..109320bp; Strand=-
atggcgatgggcgggggcgttatattcggcaggtatattaccagaatattgaggatgaataagctgtattggctcatacacggtctgctgctttggtcattggaatatgagcaaagcaaccttgacacttag

SEQ ID NO: 2856 - DNA, 372 bp, Xenorhabdus bovienii
  Coding DNA location: Contig name=SeqID_16881; Position on contig =109359..109730bp; Strand=-
atgcaactggcgtatgtgctgggactgcgtaccaaagaagcggtggaagcctacaaatcgttagcgacctggaagaaagcactggaaaacgggcatacgtctgtgcgggtggtgttcggtactaaaggtggacggtctcgacagacgaccatattggatcgggcagcgctgcaacatgccattgcctatgcggagcaagagcaggcaggacatagcggcaaactgattgataagccgacgattactcaggccatagaccgttaccgctatattgtcagacgtgcaggactgagcggcaataaagcgccacacagtatgctttattgccgctcagcaatccggagagcattatatagcgcaaggattcagtga

SEQ ID NO: 2857 - DNA, 411 bp, Xenorhabdus bovienii
  Coding DNA location: Contig name=SeqID_16881; Position on contig =109764..110174bp; Strand=-
atggcgcagggatcgacacgttcaaaggttgagcagttcagaaaagcctttatcacgcatgcccgacaggtgggcggaagttttgttacggtggcggatcgtgagcgtatggcccggcagttccttgattatttgaaaaacaatggcatcaaactccggcaaatggatagcctaaaggtgaaatatattgagcgctatatggctgagcgcaaagccaacaatctcagtcaccggacactgcaaaatgaaatgtcggtgctgcgagccattttagcgcaggcgggaaagcataagctggctgatcccgataatgctcgcctgagtaaccgggcattgggtatcgcggataccagccgcaagggaactaaaatggcgctggcaccggctgcgttccgggacatttttcagtag

SEQ ID NO: 2858 - DNA, 177 bp, Xenorhabdus bovienii
  Coding DNA location: Contig name=SeqID_16881; Position on contig =110119..110295bp; Strand=+
gtgataaaggcttttctgaactgctcaacctttgaacgtgtcgatccctgcgccattctcgcctctcttgctactttttcatttttagtcgtttttaaaacaattccctgcgtgtcggttcaggttcaccgttccgtggtgcgtcagataatgtgtagcagggcggaattgtgttga

SEQ ID NO: 2859 - DNA, 207 bp, Xenorhabdus bovienii
  Coding DNA location: Contig name=SeqID_16881; Position on contig =110300..110506bp; Strand=+
ttgcaggagctcgcgacgtgctcagcacggcgatggcatgctccccgttcagtgcctgaccatgttcaggatgaacgcctcattatcttgacgtgtctcatatctccttttttactgcatcagcctgttgtaaggcagcgggttgaaaaccagaccggacgatcgttcgtcaatcaaacagaatgtcagtcaatggcctatttttag

SEQ ID NO: 2860 - DNA, 117 bp, Xenorhabdus bovienii
  Coding DNA location: Contig name=SeqID_16881; Position on contig =110482..110598bp; Strand=+
atgtcagtcaatggcctatttttagaggtttcactgggtaattcgtggatcaaatcggtcgtaaagccagtctggacgtgctctggacgttggccgcccggcggcgtcacttggtaa

SEQ ID NO: 2861 - DNA, 201 bp, Xenorhabdus bovienii
  Coding DNA location: Contig name=SeqID_16881; Position on contig =110644..110844bp; Strand=-
gtggtgccgggtagcgggaaagatcttttgccttcgcatattgtcagacacctaaaccctggtctggcgatgaaagtttcccggttttattgtgataccggcttacccacacaattaggacggaatattctctgtctcacgctgaacgatactgttttaaccggcgcaaagttcaccctcgtttttaattcatcacggtaa

SEQ ID NO: 2862 - DNA, 360 bp, Xenorhabdus bovienii
  Coding DNA location: Contig name=SeqID_16881; Position on contig =110790..111149bp; Strand=-
atgcagcccaccgtcacgggtcaggttgaacaggctgatacggatatcaggagcaggaaagtcaatttgctggtcgtccggcgcgttattccagtaacgaaaactaaaatcatcggggagataaggatggcgttctttcagccattgttcgtcataggtgcctgccagtgtgcggcggggcagccaggcgcgtccgataatacccagtcccgcaggttgacagactttttccgtgatggacggcggcgaattcagccactgcgcaaagtgtgctgccgttatcggggcatccgggtgttcaatgcgtggtgccgggtagcgggaaagatcttttgccttcgcatattgtcagacacctaa

SEQ ID NO: 2863 - DNA, 219 bp, Xenorhabdus bovienii
  Coding DNA location: Contig name=SeqID_16881; Position on contig =111189..111407bp; Strand=+
atgctcagtggtgaaatgctcccggaacggatgtacgccgatacccttattatcgacagcgaagcgctcacgctcgccatgacttaccgttaccacattgaagcaacatcgcccctccgggtgatggaagcccgttttgaaatggacccggctgcaccgctgataagaattgcatcaccggatgacaaagacgagaaggagatacatatttatggctga

SEQ ID NO: 2864 - DNA, 393 bp, Xenorhabdus bovienii
  Coding DNA location: Contig name=SeqID_16881; Position on contig =111370..111762bp; Strand=+
atgacaaagacgagaaggagatacatatttatggctgataattaccttgcccggacaggcacccagtggatggtcatcggcattttaccggatgtctgtaaaaccccgatgggctcttcaactcccccaatcccttaccccgtgatggccaaactggcagacagttcagtgccggtaaaatccgtgcgcgccaatggcaaacccgttgtggtttttgcacagtcgtttgttccccagacgctgggtgatgaacccggtgtggcgaatggcataaaaagcggcacagtggggggaaaatgccatccgaaagagcaggagcatacaaaaagtgtgcgtgtcggcaataaattgctgttacgccacggtgacaaattctggatgaacggagcataa

SEQ ID NO: 2865 - DNA, 1302 bp, Xenorhabdus bovienii
  Coding DNA location: Contig name=SeqID_16881; Position on contig =111767..113068bp; Strand=+
atggcaaaaatcaagaaaatcccgcctaaaccggcgagtgatgaagcattatggaaaaaacgggcacatgacgatgctccgatcggtgagggtaatacgttaggggaaattaccgggcaaccgccgaaatcaacccaggtgcctaaagaagctaatcccgttatcaagccgaatacccagagtgaggaagggttttggggaaaagtcggagatgtgggaaccggtatcctgaaaaatctgggaaatacggccattgatattgctgaagttgtgtataaaggccatcaggctaatgctgcggtggatatgaaactggaagcattagcacataaagcagcgggtaataaagcagaagccaatcggttaacgaataaggctgatgcgctcatggaaaacgcgaatctggatgaatatcgatttaagccagaaggcgcggcagaagaacttggagatacccttgctgacttaaaccccaaaggggtaatcaagaaagcggtgaaaggtatcgctaaaggcgggtcaaaggcaatgtcgatcattactggcaaggaaaaaggcattgcacgaagtaactccagagataaacgacgagaaacccgagctgctgaaaaagataaaacaacaccttccaaagacccagacgaacttaaaaaggaactgaaagaaaaacagccaaataatgggggtaaagtcaaaggagttaagaagactaaggtgccgtgttttgatccttacgacagtaataggtataagtcatttaaaacccctgaagaaagaaaagcatttttggatgagtatgcggatcagttacgcggtcagcaagcagctattaatgatatgtcacctgaagaattccagattgccagacaggcatatgatgcagattctgcaaaagccaaagaaaaaggtgaaaaaggtggggggcgccatgacaaggcagaaggagcacaacgtcgtgcgagaaggaaggctaaaaaacaaataaaacataatatctatcaaaagttacgaaaacaaaatgtgccacattctcaagctaacaaagtagcaacagaaaaagcagataaagccttaaagggattagctgcattacatgaaccagatatggtagctggcggtaaaaataaatatgatcccaaaagatttggagataaggaaattaatagtgccattggaggcagttggaacggtccacgcttagattcgttagataatgcagctaaagatgcaattaaaaatggtctcggtgatgctaaaatgaatgtacaattagaagtatgcagaaaaaagggaaataaatga

SEQ ID NO: 2866 - DNA, 645 bp, Xenorhabdus bovienii
  Coding DNA location: Contig name=SeqID_16881; Position on contig =113068..113712bp; Strand=+
atgcgtgatgaacattttaataactttattgaagaattcggggaagctactcagcatatagcagtaccttctgaatctatagaaaaatggcgaggaaagttacccgaccaactattacattattggagaacagagggttggaacagctatcagaatgggctatttagcactgtaaatcctgacgattatgagggcattgttgacatgtggctggaagatacgccatttgagtcaatggatgcctaccatgtgatcggtaaaagtggtttcggagatctttgcctatgtggtgaaaatactggaactaatttgacaatatcgtgcgcatttaacactatttattacaataaggaaaatttttataaaaaagataaagaagaagcaaatcttgatattgctactttttttgaaagcaaatcattggattatttcgatcttgaagaagatgacgacgatgatgatataggtattttttccaatgcaatagaaaaatatggcccattaaatgaaaaccaaatatttggttttgagccagccctagttttgggaggagacattgctctaaaaaatataagaaaactagatatgtatattcatttagatattctacgtcaattttcttcacctcaaataactgaagtttaa

SEQ ID NO: 2867 - DNA, 2205 bp, Xenorhabdus bovienii
  Coding DNA location: Contig name=SeqID_16881; Position on contig =113800..116004bp; Strand=-
gtgacttttattcccgttatccacgcgaaatatccgctggcacgtttagaactggatacggctgaattacagcaggcaggcggaaaaatactttatcagcaaccagataaagtgacgttgcggttgccgaaaaccacgaaaaaccccgttcggctttcggggatcgccatcgacagccggggtaaccgctccaatcgggcagaaatcatgatagtgagtttactgaccgaaaaacgatggcaggtgttagcgaataaaacgcaggcaaaagccgatggtcatgacagtgtgatctataccgtccttgtcaccgatcaggaaggtgctcctatccctaatcaggctgttatctggtcaaatgataaaggcgaattgtcccaaacccgacagaacacggatgcgcaagggcaggcatcggtcgtgctgcgcagccgtcagcagggactgcatgcggtacgagtttccgtggatggagaggttgctgttgcaccttcagtacagtttgatgcggtgctgatacccgaaattactgttgataaacacagcattaaggcggatggaaaagcaatagcgacgctgaccgttactgtcaaaaacgctggtagtcaacctgtatcaaatcaggccgttggctggcaaaccagccttggccagttctccgcattttcattaatgactgatgcgaaagggcaggccatggcgtatttaaccagcaaagtatcaggcagtgcagacgtgacggtggcggttggcagtgaaacagtgatgtcttctccgattctctttaccgcctcgttaacgcatacgcttcagtcggacaaacaaacggctattgccgatggtcaggacagcatcctttatacggtgaacgtgcgcgatgcagcagatcgccccgttgctaacagcaaagtgcaatggtcaacggataacgggcaactgttggataagcaaagtcagaccaatagccagggagaagcgacagcccggttagtcagtcgcaccgcagggatggcaacggtgaaagcagaggtggcgggaaaaaccctcaatgctccttcgatgacttttaaacgtttgctgaaatcggctatcacggtggataaagtttgggctaaaagtgatggccaggataccgtggtgttgaccgccacggtgaaagactcactgggatcacccgtagcaaatcagccagtgatttggcaaacagatagcggtgtgttgtcttcagaacgaacagaaacggatagccgggggcaaacacaggttaagctgagtagtccattgacaggtgagcatcaggtacaaattcgggttggtgatgaatgggtaacagcgcccatgatcacatttgaggaagttttgttgtcaactgttcgggtggataaaacccgcgcagcagccgatggcaccgagcaggtgacgttcaccgtcacggtgatggacagccgtggttgggggctttcggatcaggccgttgagtggtcgggggacttcaacgagatgatttctgtggaaacccgaacagaccactggggaaatgcaactgcgactgttgtcagccaccgtccgggaaaaggtgtcattattgcgcggatcggtgatcagcaacaagcatcgccggtgatcgaatttgtctcgccgctgagtattgaggataccgttgccgttgaccgtcagggcggcaatgccaaccagaaatcgtttggtctccgggggccttccgtactctggcatggtgcaaaatttcgccttatcacggcaggcaatacaggccgggtaagttggcagagtaactcgccctcggtgacggtatcgggtgatgtggtgacggtacagcaaaatcctgacggagtcagattcacgggtactgatgagaccgggcagcaggtcgaactgactttgacggttcatacctggtttgagcgctctggcctgacgaaagcgttttactcagaagcaaagcaactttgcaaatcactcggcagccggattgcctccaaatatgcgctggaacagctctatgaggaatggggcaatttttatctttatgatggttgggcaagggaattttatgtgacctccacggattacctcaccgccagttcaggtttttcagaagcccaggctaaatgggtattttgggcagaatcggatagctggatgcgcaatgcctggcatcatttggcgtttgcgtgtggtcggtag

SEQ ID NO: 2868 - DNA, 1047 bp, Xenorhabdus bovienii
  Coding DNA location: Contig name=SeqID_16881; Position on contig =116001..117047bp; Strand=-
gtggtgcaaaacgtccaatctcgtcggttcagcaggggaaaatcttcgattgtcggcctgttaagcctgtcactcagttttcccggtcaggccatgtcagaagttcaaaacccggatcaacatgagcacacactggccgaaatcaccgcacaatggggtcaacttactcaatcgcaatcacccggtgaagcggcaaaaacaatggccgctcagcagttatcgtctgcggtgacatcaacattgacaccctggtttaaccaatatggcaatgcccgcctcacactccctttcgacagccatttttcgttaaaagacatttcatttgattggttgttgcctttttatcaaccggtttcgggtactgcattcagtcagctcggggtaaaaacccatcacggtcagacaacaacggcggtcggatttggctatcgctatgtcgccgataattggttatggggtctcaatgccttctgggatacattgtggccggagcagtatcaccgttatagtcttgggttagaagcctggtatgataacgtcaaactctctgccaacctttaccagcgtttatcccattggaagccctcccgccttacggattttgacgcaagacccgccaatggctgggatattcaggccgaagcctggttgcctgcttttcctcactggggcgggcagttgaagtatgagcactattacgggcggcaggtcgcgttattcggtgaatcagaacgccagaaaaatccgtacagcatcaccgccgggttgacttacacgccagtgccgttagtgaccctgggtgccgatcttcggcagggtaaacaaagtgctagtgaaaaccgttttaccctgaatctcaattatcggtttggtgtgccgtttaaccaacagcttgatccgaatgcggttgcgccgctgcgctacctgagttccagtcagtctgattttgtaaaccggcgccgcgatatggtgctggattatcagaagcaaacgctgctgacactggccttgccgacatccgcaatggctatgaaggaaaggaagtga

SEQ ID NO: 2869 - DNA, 105 bp, Xenorhabdus bovienii
  Coding DNA location: Contig name=SeqID_16881; Position on contig =117102..117206bp; Strand=-
atgatgacaacattgccgatatctctgataaataatttagtgaaattattttataacgagcagataattttctcgatcagaaaaagaattaaccacagtatttaa

SEQ ID NO: 2870 - DNA, 366 bp, Xenorhabdus bovienii
  Coding DNA location: Contig name=SeqID_16881; Position on contig =117194..117559bp; Strand=+
atgttgtcatcattcacgaatacgctagatcgtaccttaaacacccccataacttcagacgaagaagcggaacaatatacacctgaacaactcctttcatgggcacaaggctgtatgcttgaaggattacctgatgactttaatgaagcatacgtagaatgcctgcaacaacagcatcttgatgggaaaagggaagtaaaaataacgcatcagtttaaacttaatgccgattccgcctatgaaacctttacacccgcagattatctctaccctacacagtgcatagagagggttctggcaggaaaggactggaagaaagctaagctgacatttaacccaagaaaggcaacatttttctgggaataa

SEQ ID NO: 2871 - DNA, 132 bp, Xenorhabdus bovienii
  Coding DNA location: Contig name=SeqID_16881; Position on contig =117525..117656bp; Strand=-
ttgcgcggggattacgggtttgattgtgtcgttccaaaagtctcggatgaacctgtattgtatttccacaaaatacactacaggctctatgagagacttattcccagaaaaatgttgcctttcttgggttaa

SEQ ID NO: 2872 - DNA, 429 bp, Xenorhabdus bovienii
  Coding DNA location: Contig name=SeqID_16881; Position on contig =117634..118062bp; Strand=-
atgactaaggtcgtgaaaatgtggcgtaaactgggtgcctggctgtggctgtccacgcaaaaccttgccgattatccggataccgctgaaaagatgctgaatatggcggaatggtggctgtgtcttaccatgcccccggatgaggtggaacaaattgcccggttcaaaaaactcaatgaagaacaaaaagcggtattgctctctgccagtaaactcccacgttgttataccgaaggggtggtgctggcgaaaaaaatcgaagcgctgtttcgggttgtgccaccgagcctgtatctggcgctggggatgacggaaaaagaagaaaaggccgagcggcgggcgttaatgcgggaacatcagtgcagtgaattggaagccgcgatgttggtggccagaaaaatggatattgcgcggggattacgggtttga

SEQ ID NO: 2873 - DNA, 2268 bp, Xenorhabdus bovienii
  Coding DNA location: Contig name=SeqID_16881; Position on contig =118110..120377bp; Strand=-
atgaccaatcccaagccactgaaccgccccggcaggctgagtgaatccgaggaagtcgcgatttaccgggcaaatccgtccatcatcgattatctgccctgggtggaatatctggaagacgggcaatgtttattgctggatgatggcgtgtctgtcggtgcggtctaccgtatcgaaccgatcgccaccgaagggcgtcctcttgagcgattaattgaaatccgcgatcaactggaagatgccattcaggacagtctggaagaggatgacatttcgccgtgggtggtgcagtttttttgtcaggatgaagatgatccttccagttatctcactaccttgcgggactatgtgaaaccgtgggcgcagggcacggcatttaccgacgcttttctggcagaatcggaacgtcacctgaaaagcatcgcccagcctgatgggatatttcaggacagcttaattaccggacagccgtggcgggggcagcagcgccagacccgcatggtcgtttatcgttggttgcctgctcataaatcgaaagcttactatcaaactgtatcgtcagtggcagcacttaatcaggtctgcgaacgactgatatcatcactggcatcagcaggtattttggcaacccagcaagatggtgagcagatccacagctggttgctgcgtcattttaatcccgcgccggactggggtatggcaaaagccgatttttaccgcacggtaagttatgaaacacctacaccttccgatctcccggttcacaatgattttgccgaaagcctgtggtttaccccgcaggtgtctgatcccgaaaacgggatctggtggtttgatgggctgccacataaagcggttccggttgagcgcctgcgccgcccatcagagccgggcacgctgacaggggaaatgaaacggggtgacaatatcaatgccctgatggatatgatgccggaaggcaccgtggtcacgctgaccatcgtgacacaggcacaggatacactggaagaaagttttacccgactggcgaaaaatgccgtgggggaaaataccgaatcactacgtgtccggcaggatgtacaggaagtgaaggaattactggggcgacggcataaactgtaccgcagtgcgctgacctttctggtgcgcggcaaggatttgggtaatctgaatcatcgggttcatcagttatcttccacattattgatggcagggttacagcctgtccggccggaattcagtgtttccccgctgaatgtctatttacgggcgttgccgatgtgtttcaatccacagaaagacaaaaaacactggcatagccgcctgacctgggtacagcatctggcgggactattgccggtcaccggacgttcaaccggctccggacatccgggcttcagtttctttaaccgcggtggtgcaccgctgacctttgatccaatgaacaagcaggatcgcacccagaacgcgcatttattgctgtttggcccgaccggcgcaggtaaatctgccaccctgtgttcctccctggtgcaactgatggcgatccaccgacctcgcttgtttattgtcgaagcagggaacagttttgggctgttggcagattactacgccagtctggggctgaccgtcaataaaattggcatcaagccgggttgtggcgtcagtctggccctgtttgccgatgcgcatcaactgctgcaactcagccctaaacaattacggattcatgaagccgatattccggatacggatgaaccgcaggatgacggcgatgaacagcgcgatattctgggcgagatggaaattgccgcccggctgatgatcaccggcggtgagaaaaaagaggaagagcgcctgacccgctcggatcggggattaatccgcgaagccattatgatggcggcacacaccagttatgaggcagggcgtcagatggtggcctcagacttacagaatgcgctctatgccattgcccgcattcaccagcaggataagcatggtcagccattaattacggcacaccgtcgggcacgggcggatgaaatggccggggccatgtcgatgtttacccaaggttttgaaggtgaactattcaaccagcccggcacaccgtggccggaagtggatgtgacgttaattgatttaggcacactggcacgtgaaaactactcggctcagatggcactggcgatggtctcgctgattaacacagtgaataatctggcagacgcgaccagtatcaggacagggaactgcaactggtga

SEQ ID NO: 2874 - DNA, 402 bp, Xenorhabdus bovienii
  Coding DNA location: Contig name=SeqID_16881; Position on contig =120377..120778bp; Strand=-
atgcgaaaaataaaatacgctgtcgtgttatgtctgacagggctgatggcaggctgttcgacctcgaaagatacgttgctcccagccggagaacagaccgtgttggcgatgtggcagggaaacaaggcaggttactccactgtgcaggccagacacactctacgccggacgttaacttctgccgaacggaaccgagcactggaggagcctcaccattacagccgttcggctgcgaatgaaatcagccagcagtttccccgcctccccaatcccgatatggtgatgtatgtctatccgcatctggtcgccggtaagaccccgatactgggttatagcacggtgttcccgttttatcagcaggtgcagtatgccctgccgggtgaacgcacggaggcacggtaa

SEQ ID NO: 2875 - DNA, 117 bp, Xenorhabdus bovienii
  Coding DNA location: Contig name=SeqID_16881; Position on contig =121004..121120bp; Strand=-
atgaaaacgacttcttatcaatggctgtttcgcgccagccagccttattgcctgcaaatcaacatgacgccacctcctgaacccatgccggttcagctttgctggctcgaaccgtaa

SEQ ID NO: 2876 - DNA, 507 bp, Xenorhabdus bovienii
  Coding DNA location: Contig name=SeqID_16881; Position on contig =121120..121626bp; Strand=-
gtgcgtggtcaggtcaattccatcacctttgtttttcaggatggcaccgtgcgcactttgccgggcgcagggcaaaaccagcagggtatcggctggctgtccgatgaaaacggcattccctgtctcagcggtgaacgtaaatccaatgccagcacctatctgccgacactgtttgccctgtcagccatgaattccgctggcgatgctctgaacgtaagccagcacacggcacaaaccaatggcaccggcggcatcacgtcagcgttaaccggtaatgcgggacaagcggcactcggcaaagccctgtcagggggaatgaaagacctgagcgaatggctcaaacaacgttacagccagacattcgatgcggtttacgtcccgcccggtgcccgtgttgtggtgcatatcacccaaccgctggcgattgattacgaaacgacaggacgtaaggtgcgttacggttttagtgagccagaccaacgttatcatcaggaagccttagattaa

SEQ ID NO: 2877 - DNA, 504 bp, Xenorhabdus bovienii
  Coding DNA location: Contig name=SeqID_16881; Position on contig =121437..121940bp; Strand=-
atgaccacatcaggcactgccacgcaccgggcactaaagacaaccaggtcaccgcttcctccggtaacaaacgggcagccagcaacgttttataaaggactggcagctcaggccgcggtgcctgaaaccggaagcggaaacgacgttcaggtatccacaatcccggctgccagtgatgcccgtcttccagttccccttccagttgccgcagcagaggcaggtggtaaaacagcgccgcccagaacaccaccgcctgccacagcagactttgtgcggcctgtgtttccgccagtggtgactggacactttcttgtgtgcgtggtcaggtcaattccatcacctttgtttttcaggatggcaccgtgcgcactttgccgggcgcagggcaaaaccagcagggtatcggctggctgtccgatgaaaacggcattccctgtctcagcggtgaacgtaaatccaatgccagcacctatctgccgacactgtttgccctgtcagccatga

SEQ ID NO: 2878 - DNA, 276 bp, Xenorhabdus bovienii
  Coding DNA location: Contig name=SeqID_16881; Position on contig =121997..122272bp; Strand=+
atggctaaagttgatgtggtttgtcgttattgtcacaaagcagaggaggtcaaagggcatggaaaaggaagcagtgggcacccgcgttatcactgttatgcctgccgtaaaaccttccaactgaattacacctaccaagcctgcaaacccggagtgaaagaacaaatcactgatatggcgataaataacggcgggatcagagacactgcacgtgttttgaacgtcgggatcaataccgtgcttcgcacgttaaaaaacttgaacccagacaagtaa

SEQ ID NO: 2879 - DNA, 252 bp, Xenorhabdus bovienii; identical to SEQ ID NO: 421
  Coding DNA location: Contig name=SeqID_16881; Position on contig =122321..122572bp; Strand=+

SEQ ID NO: 2880 - DNA, 255 bp, Xenorhabdus bovienii; identical to SEQ ID NO: 422
  Coding DNA location: Contig name=SeqID_16881; Position on contig =122449..122703bp; Strand=+

SEQ ID NO: 2881 - DNA, 246 bp, Xenorhabdus bovienii
  Coding DNA location: Contig name=SeqID_16881; Position on contig =122726..122971bp; Strand=+
atgttgcatcttggcggacatccgtcttctgtcccgttgacggactcactgcttcagtctgccgctgagcaggtgcagtcaccgctgctgaatcccgttgaatctgctaaaccggctaccgatactaggttgtcatcatcagaacccgatccggttattccgcctgtcacaccgggaacagtccctgcgcccgacaccaccgaggatacccggagattactgtcattgtttcaggcagaggaatga

SEQ ID NO: 2882 - DNA, 123 bp, Xenorhabdus bovienii
  Coding DNA location: Contig name=SeqID_16881; Position on contig =122948..123070bp; Strand=-
ttgtacattgcagaaacaaggccttccggcgctgatgcggtgcgttcggacaatttcgaatcgttatcgttaccatttgcattctttctcatcaaaatttcattcctctgcctgaaacaatga

SEQ ID NO: 2883 - DNA, 1008 bp, Xenorhabdus bovienii
  Coding DNA location: Contig name=SeqID_16881; Position on contig =123182..124189bp; Strand=+
atgttaaataatgaggaaaaaatgggctgggatgcgttactggatgagtattttttttcgcggatgttacggccggcaaccgaatggagttatcgcaaggtggtgcgggtctttatccggtatatgggggaaacggggttgccggagagcgtgactcaccgggatgtcctgtgctggcggcgtcatctgctgatggaaaaaaatcagtccggctatacgtggaacaataaggtggcgcacctgcgggccatttttaatttcgggatggaaagaaaactgttgtcacaccccaaaaatccgtttaatgacgcggcagtcaaaaaagagaagaaacaaaagaaaaccctgagtaaggcgcagataaccgggatgtacctgcggatgcagcagtatgaagaggaagaacgtttacagaccgccccgcggggcggacgctgtgccttatacccgacggggtactggctgaccgtactggataccttccggctgacgggcatgcgcctgaaccagctgctgcatctgcggttacgggatattaatctggacaacagttacattgagttgcgtgtggaaggcagtaaaaaccacagtgagtggcgggtgccgatgatcccgcagctgaaaccccggctggcgcagttgattgaacaggcaaaagcctgtggcgcgaaagaggatgatccgctgtttgatttaacccgcctgcgtttttgtcatcacggacgccatgttagtcaccagtatcatcatgacagagaaaagcaacatctccgttctttctttaaccgcctgtctaaagaatgtggttttgctgtctccccccaccgcttccgtcatacgctggcgacagagctgatgaaagcccccgaccgcaatttgcagctggtcaggtgtttgctgggacaccgcagtgtggcgaccacgatggagtatattgatatcgatatggaaatcgcgggtaaaactctggcgaatgaactggcgttttatctggatcttgctgtgtaa

SEQ ID NO: 2884 - DNA, 162 bp, Xenorhabdus bovienii
  Coding DNA location: Contig name=SeqID_16881; Position on contig =124259..124420bp; Strand=+
atgggatggtttggaggtggagacacaaaacgaagaaaccgggaagtgtgctcaaagagcaattctgacaatcacctgacttggcatcagaatcaattactgaaatcattactttcaacgcaaaaaggtgagcacaaactgtgttcacctgacttcgtatag

SEQ ID NO: 2885 - DNA, 126 bp, Xenorhabdus bovienii
  Coding DNA location: Contig name=SeqID_16881; Position on contig =124591..124716bp; Strand=-
atgaaaatacagcaaccaaccgtttttcacggtttttttcgcagaaagtcattgacggatttagctgaatgcggtttaatgcgccccgttagcccggatagctcagtcggtagagcaggggattga

SEQ ID NO: 2886 - DNA, 573 bp, Xenorhabdus bovienii
  Coding DNA location: Contig name=SeqID_16881; Position on contig =124756..125328bp; Strand=-
gtgcaacgtgaatatgttcttagtcatgccctaaatttacttgagcagcatggcctgtcagcaacattggagacgcttttaactcccctagaggttgatatcaatcaaataaagcatttctggcctgatcgagaagccttgctgtacgattgcctgcgctatcacagtcagcagattgaaatctggcagcgccagatcctgctagatgaggttttgagccctgagcagaaattactggcacgttacgacaccctcaaggaaaaagtacagaaacagcgttatccgggttgtctattcattgcagcttgcagtgtcttcactgatacagagcatccgatccaccaattggcagagctgcaaaaacaaaattcttttcattataccatagagttattacaacaacttgagatcgaaaacagtgaacgggttgccaaacaaatggaactgatccttgagggatgtctcagcaaactattagtaaaaagagaacttgaagatgtaataacggcaaaattgctggcacaggatattctgaccattgcaaaatgccgaaaaaatggcgcattcagttaa

SEQ ID NO: 2887 - DNA, 1752 bp, Xenorhabdus bovienii
  Coding DNA location: Contig name=SeqID_16881; Position on contig =125347..127098bp; Strand=-
atgatgaaacgtattctcatattgcttctgctgttgagcggcatagctatttctcctatcaaggccaatgcgctgtttgaaccgccgggacaaaatcgctatcttcctgtagctcaagcattcgtgtttgattttcagcagaaagacaatcaactcacactaaactgggatatcaaacccggttattacctctatcgaaaacagttcatcatcaccccgataaaagcaacgttgggtcatttcgatttctccaaatcggtagatcacgaagatgagttttttggcaagactgaggttcattttggttcagcacggattaacatccctatcctttctgcctccaatgactccaatctgcaagtcacgtaccaaggttgtgcggaagcggggttctgctatgctccagagacaataactgtgccattgtcagccgttattgcctcgattccctcagccaatgaagccgcaaaacaacctgacataacgacatctcagaaggcatcattgccgcaggaagaatcccctcccaacgtatctgacgtgccattttcaccattatgggcattgctgattgggattggcattgcctttacaccttgcgttctacccatgtatccgctgatctccggtattattctagggcagcggcgacccgatagcttaaaacgcattttctggttggcaatgagttacgtgcagggaatggcactcacttataccgtgttaggattgatcgttgccgctgccggattgcagtttcaggccgcgttgcagaacccttacattctggtggggctatcaattctgtttattttgctggccttgtccatgtttgggatgtactcattacagctcccctcttctgtccagactcgtttagttgactggagcaaccaacaaaaaagcggctcttacattggcgtattcgtcatgggaatccttgcggggctgatcgcctccccctgtactaccgctcccctcagtgccattttgctttatatcgcccaaagcggtaataccctgcttggcgggctgaccctttacctctatgctcttggcatgggcctgccacttattgccgtcacgctattcggacacaaactcctgccccgcagaggcccgtggatgcagtacgttaaagaagccttcggattcattatcctggcgctccccgtattcctactggagcgtgtacttggtgatacgtggggcataaggctatggagtttgctggcagtcgctttccttggctgggctttcgcattgaccttaaacagcaaaaaaggctggctgcgcaccctgcaactcatcttactggtactgacactcatcacctcacgccccttacaggattgggtgtggggaaatccgactacgacacaacagcaaccatcgctgaagtttcagcaagtcagtgactggcaggaactaagccagattctggccgagaaccgccatcaaccaattatgctggacctttatgcggactggtgtgtcgcgtgtaaggagtttgaaaaatataccttccccgatccacaagtgcaggcgcaattaagccaattcctcgtattacaagcaaatgtcacggagaatggctcaaaacagaaagaattactggataaattgaaggtattggggcttcccactatcttgttttttgatgctcatggaaaagagctacccgattcacgagtcagtggtttcatggatgcagggcgctttagccgccatttacagcatctacaaaaataa

SEQ ID NO: 2888 - DNA, 1302 bp, Xenorhabdus bovienii
  Coding DNA location: Contig name=SeqID_16881; Position on contig =127312..128613bp; Strand=-
atgctagccgtagaattagttatcgttctgctggccatttttttgggagcacgactagggggaatcggaattggatttgcgggaggacttggtgttttaatactggccacaatcggagtcaaaccgggaagcatcccatttgacgttatttcaatcattatgggagtcatcgccgctatttctgtcatgcaaatagctggcgggctagattatctagttcaacaaacagaaaaactactgcgcagaaatccaaaatacatcactatcctcgcacccattgtcacttattgcttgacgctattagccggaacaggaaatatctctctggcaacacaacctgtcattgccgaagtcgcaaaagaacaaggcattaaaccctgccgaccactatcaaccgctgtcgtagccgcacaaattggacttacttcctcgccaatatccgcagccgtagtttatatgtcttctgtcatggaagggcaaggtgtcagctatattcagatgttgatggtcatcattccctcatcgtttgctgcaattattttgatgtcattcatcgtctcatggttttttgactccaaactatctgacgatcctgtctaccaaaaacgccttgcagatggcctcattgaactacgcggcagtcataaagttgatatcaagccaaaagctaaactctctgtactgctgtttctgttaggggtagttgggatcgttatttacgcgattattaacagcccaagccttggtttagttgaaaaaccactgatgaataccaccagcgcgatactgattatcatgttaagcatcgccaccctcacaacggttatctgctctgttaataccgatgctattttaaattcaagcacctttaaagccggtatgagcgcgtgtatctgtattatgggtgtcgcatggttaggagatacatttgttcaagctaacatgggttggattaaagaaactgcgggtagtttgattcatgctcaaccgtggctgctggctgtgatattcttcttctgctctgctctgctctattcgcaagcagcaaccgcgaaggccctgatgcccatggtactggcgctgcatgtcacaccactgacagcactcgcctctttccctgcggtttctggcctatttatcctgccaacttatccgactctggttgcagctgtgcagatggatgataccggcaccactcgtattgggcgttttgtattcaaccacccattcttcattccgggcaccattgctgttgcgttagccgtgacattcggtttcctggttggtggtatgatcctgtaa

SEQ ID NO: 2889 - DNA, 147 bp, Xenorhabdus bovienii
  Coding DNA location: Contig name=SeqID_16881; Position on contig =129167..129313bp; Strand=-
atggctgataatatcgtgtatattgtaattaatcgcaatataccccccttaaatattcgctattttcatcatattaagcactattacttacgttattaccgtgcatatttttataattataattggcaatactttactttaaattaa

SEQ ID NO: 2890 - DNA, 1425 bp, Xenorhabdus bovienii
  Coding DNA location: Contig name=SeqID_16881; Position on contig =129578..131002bp; Strand=-
atgtcaaacaacattcgtatcgaagaagacctgttaggtaaacgagaagtccctgctgaagcctattacggtattcacactctgcgtgcgattgaaaacttttatatcagtgaccgtactatcaatgatgtgcctgaattcatccgtggcatggtgttggtaaaaaaagccgcggcactggcaaacaaagaactccatactatccctggaaaaattgcggacattattgtcaaagcgtgtgatgaagtcctcaacacaggcaaatgcctggatcaattccctgttgatgtatttcagggcggtgcaggcacctcactgaacatgaataccaatgaggtactggcaaatatcggtcttgaattgatggggcacccaaaaggtgaatatgagtacctgaatccgaacgaccacctgaacagaagccagtcaaccaatgacgcttatcctactggtttccgtattgctgtctataattcaatcatgaaattgattacctccatcgagttattgcaagtcggtttcgacaaaaaatccgttgaatttgctgacatcctgaaaatgggccgtacccaattgcaggatgcggttccgatgacactgggccaagagttccgcgccttctccgtgttattgaaagaagaaatcaaaaacatcacccgcacagcagaattactgctggaagtgaacctcggtgctaccgctattggtactggcctgaataccgcgccaggctaccagacgctggtggttgaaaaattggctgaagtcacagggttaccttgcctgccagcagaagatctcatcgaagcaacgtctgactgcggtgcttacgtgatggttcacagcgcattgaaacgtctggcggtcaagatgtccaaaatctgtaacgacctgcgtttgctttcttccggccctcgcactgggctgaatgagatcaacctgccagaattgcaggccggttcttccattatgccagccaaagtcaacccagtggtgccagaagtcgtcaaccaagtctgcttcaaagttatcggtaacgatatctgtgtcaccatggcatcagaagcaggtcaattgcagcttaacgtgatggagccagccattgggcaagcgatgtttgaatccatttccatcctgagcaatgcatgccgtaatctggttgaaaaatgtgttaacggtattactgccaataaagaagtttgcgaaagctttgtatttaactctattggtatcgttacttacctgaacccattcatcggccaccacaatggcgatatcgtaggcaagatctgtgcagagacaggcaaaagtgttcgtgaagtcgtattagagcgcggtttgctgaccgaagcacaattggatgatattttctctgttgagaacctgaaacatccaacttataaagcaaaacgttttgacgactaa

SEQ ID NO: 2891 - DNA, 216 bp, Xenorhabdus bovienii
  Coding DNA location: Contig name=SeqID_16881; Position on contig =130989..131204bp; Strand=+
atgttgtttgacatgagaaccttctttaatttggatacgtttttttactgttctatatacgtttttgttgagaataatgtcgccgtcagcaactgccgtgatattaatcacttatcactggattgctggcgcgatcatatgtggatttaccagaaatgccttgtacctggatcactttatagtgcgaattttattaatgaaataacatatgtgtga

SEQ ID NO: 2892 - DNA, 153 bp, Xenorhabdus bovienii
  Coding DNA location: Contig name=SeqID_16881; Position on contig =131307..131459bp; Strand=+
atgtcaataaacggtgaacatgcaaatttaagggttgtttactggccatgtagctctttgctaacaatattcaaggggaatattttcatcccaatgattttatcactcattaatgaaaggagaaccacgtgcgttggctcccatttgtcctga

SEQ ID NO: 2893 - DNA, 507 bp, Xenorhabdus bovienii
  Coding DNA location: Contig name=SeqID_16881; Position on contig =131435..131941bp; Strand=+
gtgcgttggctcccatttgtcctgatatgtttgctggtttacatcgaatcagtcttgtttgttcgcattgcctctgaagtcggagttttactgactctgctgctagtcatttttacttcttgtgtcggtgtttccctcgtgcgtaatcagggcatcaagaattttatgtcgatgcagcaaaaaattgctgctggcgaaagccctgcgaaagaggctatcaaaagtgtttctctggtgattgcgggagttctgctaatattgcccggattttttactgactttctcggattgctgttgttactgccacccgcgcagaagctgctgaccgcaaaattgctacctcatatcaccttttaccgtccgaataataatgggcgagatggtcagggcggccatcatgggcagacttttgagggggagtatgagcgcaggcaagatgatgcgtcccatacattggatggtcagaaacgtcacgatgaacatggcaacggacaggacaaaaagtaa

SEQ ID NO: 2894 - DNA, 294 bp, Xenorhabdus bovienii
  Coding DNA location: Contig name=SeqID_16881; Position on contig =132120..132413bp; Strand=+
atgaacattcgtccattacatgaccgcgttatcgtcaagcgtaaagaagttgaatcaaaatctgctggcgggatcgttctgactggctctgcggcgggcaaatctacccgtggagaaattttggcagtcggcaatggtcgtatccttgaaaacggggaaatgaaagcgctggatgtaaaagtgggtgatatcgttatttttaacgaaggttacggtgttaaggcagaaaagatcgacaatgaagaagtgttgatcatgtctgaaagcgacattctggcaattgttgaagcgtaa

SEQ ID NO: 2895 - DNA, 1647 bp, Xenorhabdus bovienii
  Coding DNA location: Contig name=SeqID_16881; Position on contig =132469..134115bp; Strand=+
atggcagctaaagacgtaaaatttggtaatgatgctcgcggcaaaatgctgcgcggtgtgaatgtattggctgacgcagttaaagtgactctgggtcctaaaggccgtaacgttgttttagataaatcttttggttcgcctgtaatcactaaagacggcgtatctgtagcgcgtgaaatcgaattagaagataaattcgagaacatgggtgcgcagatggttaaagaagttgcctctaaagccaacgatgcggcaggcgacggtactaccactgcaactgtactggcacagtctatcgtcactgaaggtctgaaagccgttgctgctggcatgaacccgatggatctgaaacgcggtatcgataaagcagttattgcggctgttgaagaactaaaaaaactgtccgtaccttgctctgattccactgccattgcgcaggttggtacaatttctgccaactccgacgaaaccgtaggtaaattgatcgctgaagcgatggataaagtcggtaaagaaggtgtaatcaccgttgaagaaggtactggtctggaagatgaactggatgttgttgaaggtatgcagttcgatcgcggctacctgtctccttatttcatcaataaaccagaagcaggttctatcgagctggaaaacccatacatcctgctggttgacaagaaaatttctaacatccgtgaactgctgccagttctggaaggtgtagccaaggcaagtaagccgctggttatcatcgctgaagacgttgaaggcgaagcgctggcaacgctggttgtcaacaacatgcgtggtatcgtgaaagtggctgcggttaaagcccctggttttggtgatcgccgtaaagcaatgttgcaggatatcgctactctgaccaacggtactgtgatttctgaagagatcggtctggagctggaaaaagcgactctggaagatctgggtcaggcaaaacgcattgttatcaacaaagacaccacaattatcattgatggcgtaggcgaagcagtcgcaattgctgcacgcgttactcaaatccgtcagcaaatcgaagaatcaacttctgactatgaccgtgaaaaactgcaggagcgcgtagcgaaactggcaggcggtgtggcagtgatcaaagtcggtgctgcaactgaagttgaaatgaaagaaaaacgcgctcgcgttgacgatgctctgcatgcgacccgcgcagcagtagaagaaggtgttgttgctggtggtggtgttgcactggttcgcgctgctgctgctatctctgctctgactggtgacaacgaagatcaaaacgtgggtatccgcgttgctctgcgtgcaatggaagcgccaatgcgtcagatcgtagaaaacgcaggtgaagagccatctgtggttgtgaacaacgtgaaagccagccagggtaaccacggttataacgctgcaactgaagagtacggcgatatgatcgagatgggtattctggacccaactaaagtcactcgctctgcactgcaattcgcaggttctatcgctggtctgatgatcacgactgaagcgatgattaccgatctgcctagagacgacaaagctgacttaggtggagctggtggcatgggcggcatgggtggaatgggcggcatgatgtaa

SEQ ID NO: 2896 - DNA, 363 bp, Xenorhabdus bovienii
  Coding DNA location: Contig name=SeqID_16881; Position on contig =134263..134625bp; Strand=+
atggggaaagacatgcgaattaagatcttactcggagcgtcaatcttactgctggctggatgtacaacgaacaatcaattaacggccgcaggttccaatgtacgttttgtggatactcagccgggcagtgaatgccagcgattgggcgaagtgataggtatgcaaagcaattggctcaatggtattggcaatgaaagtagttcaatgcgcaatgcggccaatgacttgcgtaataaagcggcagaattgggtgggaacgtcatttatggcgcaaacagtccacttagccggacagaaaacttgttgggcagttttgtgccactcgatagcaaaatggtaggtcaggtttataagtgtccataa

SEQ ID NO: 2897 - DNA, 144 bp, Xenorhabdus bovienii
  Coding DNA location: Contig name=SeqID_16881; Position on contig =134688..134831bp; Strand=-
atgttggcaagcgtcgtcattagacacgttcaggaacggacaacgccagaaactaaaacgtacacagagctaaccatgctctgtcacgtttttctggctgctgccctaactgactgtttattaaatcaaacaataacactgtaa

SEQ ID NO: 2898 - DNA, 1032 bp, Xenorhabdus bovienii
  Coding DNA location: Contig name=SeqID_16881; Position on contig =134842..135873bp; Strand=-
atggcacacattataacccatattccccctgccagagaagtctggctaaaacaacttgcagatgtcattactgatcctaatgagctactgcaattattatccttaaatacgcacgccatgctgaaagaaggcaatgaagcgaagcgtttgtttcccctgcgtgtgccaagagcgtttgcagcacggatgaaaaaaggcgatcctcatgatccattgttattgcaagtcctgaccgcacgggaagaatttgaaactcaccctggttttttaaccgatccgctagatgaacaacgcagtgcggttcccgggttactgcacaaataccgcaatcgtgccctgctgctggtcaaagggggatgcgcggttaattgccgttactgtttccggcgccatttcccctatgaggataacaaaggcaacaaaaacaactggcaactcgcactggattacatcgaacagcaccctgagcttgatgagatcatcttctccggcggtgatcctctcatggcgaaagatcacgaactggactggctgataactcgccttgaatccatttcacacatcaagcggctacgcattcatacccgtttgcccgtggtgatccctgataggatcacactttcattgtgtaatcgtttcgcacaatcacacttgcaaatagttatggtaactcatattaaccatgcaaatgaaattgataatacgtttcgcgacaaaatgatgtggctaaaacaggctggcgtaacgctactgaaccaaagtgtgatgctgcgtaatgtaaatgacagcgcagatactctggcagatttaagtaatacattatttgatgcaggtatcttgccttactacatccatatattggataaggtgcaaggtgccgcacactttctggtaggcgatgaagaagcaaaagctatcatgcgggaattactgactaaaatatccggttatttagttccgtgcctgacaagagaaattggcggtgagccgagcaaaacccctctggatttgggattgaagcaaaacaattga

SEQ ID NO: 2899 - DNA, 567 bp, Xenorhabdus bovienii
  Coding DNA location: Contig name=SeqID_16881; Position on contig =135914..136480bp; Strand=+
atggctacttatagtaccaacgaattccgttcaggtcttaaaatcatgtttgatggcgagccgtgcgctattctagaaagcgaatttgttaaaccaggtaaagggcaggcatttgcccgtgtgcgtcttcgtaaactgatctccggcaaactgctagagaaaaccttcaaatcaacggattccgttgaaagtgccgatgtcgtggatatgaacctgacctatctatataacgatggtgagttctggcacttcatgaacaacgagacttttgaacagttggctgcggatgaaaaatctgtcggtgacagcactaaatggctgatcgatcaggctgaatgcattctgaccctgtgggatggacgtcctatttctgtgactccaccaaactttgttgaactggaaattactgagacagatccaggtctgaaaggggatactgcaggtactggtggtaaaccagcaaccctgagcactggcgctgtcgtgaaagttcctctgttcgtacaggttggtgaagtgattaaagttgatactcgttccggcgaatacgtttctcgcgtgaagtaa

SEQ ID NO: 2900 - DNA, 315 bp, Xenorhabdus bovienii
  Coding DNA location: Contig name=SeqID_16881; Position on contig =136683..136997bp; Strand=+
atgtcttggttaattcttctggttgcgggtttgcttgaagttgtgtgggcagtcggccttaaatacactcaggggttttcccgtttgatgcccagcctgataaccatcagcgcgatgatggtcagtatagggttattagcctatgcgatgaaaaatttacccgcaggaaccgcttatgccgtgtggacgggaattggcgctgtaggaacggcaattttcggtatcatggtatttggggagtcagccaattttgccagaatactgagccttggtttgattgttgcaggtattattggtttgaaattaacaagttga

SEQ ID NO: 2901 - DNA, 99 bp, Xenorhabdus bovienii
  Coding DNA location: Contig name=SeqID_16881; Position on contig =136998..137096bp; Strand=+
ttgtttgtaaatgaacccagcgtatgctctgagggatccccacaaattagcgctaataaatcaaaaccatgttttggtagattttggcgagatatttga

SEQ ID NO: 2902 - DNA, 453 bp, Xenorhabdus bovienii; identical to SEQ ID NO: 2538
  Coding DNA location: Contig name=SeqID_16881; Position on contig =137050..137502bp; Strand=-

SEQ ID NO: 2903 - DNA, 201 bp, Xenorhabdus bovienii
  Coding DNA location: Contig name=SeqID_16881; Position on contig =137403..137603bp; Strand=-
ttggcacattatcaaaagcagaatatgcacgttgcgatggttatttttatcttcataaaagaccgaataaagggagaaaattcaaaaaatcacgatatcgaatggtacgaaaatctcaggtcaaagatggacgttcggcagcaatggaaccttggcttatttttactagtatggatgattttaaacctcgtcaggttatga

SEQ ID NO: 2904 - DNA, 216 bp, Xenorhabdus bovienii; identical to SEQ ID NO: 2539
  Coding DNA location: Contig name=SeqID_16881; Position on contig =137665..137880bp; Strand=-

SEQ ID NO: 2905 - DNA, 339 bp, Xenorhabdus bovienii; identical to SEQ ID NO: 2540
  Coding DNA location: Contig name=SeqID_16881; Position on contig =137905..138243bp; Strand=-

SEQ ID NO: 2906 - DNA, 144 bp, Xenorhabdus bovienii
  Coding DNA location: Contig name=SeqID_16881; Position on contig =138220..138363bp; Strand=+
atgacatatttcacgtacaggcatagcagtgaccttattgacttggtggaacaatcagtagatcacacaacgctatgcctgtctattttctggggattcctcagagcgtatgctgggtctaatttcaattattttttgacgtag

SEQ ID NO: 2907 - DNA, 900 bp, Xenorhabdus bovienii
  unsure (1)..(900): unsure at all n locations
  Coding DNA location: Contig name=SeqID_16882; Position on contig =37..936bp; Strand=-
atggggagggattttagtgtcaaatcgttgggactaggtattgtagaaaacctcggtttagcggaaaccgtggatcgggcaaaaaacgcagtgccgaaaggcagttttggatttggtggagatggtgggacagttcttagcaaaaatgacaatgattttttagcatgggtacgtagaaataatgctagccctgaatttttcagaaattctactccttcaaaatatacattcacatatggtgtgggtgttctattgaaagctagtgatacttatgcatcgctctctgttgactattctactgctcgcgtaaaagtagtagcaggaaataattcaggtaacgccaactcccctgttagagaactggcatttactgatgaaagctataccaaacctgaatcagacaatcgttttattcgctcaaatgttaatacaaaaacatccggttatatcttatctaagactgcaaattatctggaagacactaattcacgtcatttagggcgttctggttttttacggcctaatgggatggataaccttggagacttagcaattcatgttgctcatccaagtgtagaaggacctcaacatgcaagaggtatttctttttcctatggaagtgattcaaatggattcggcatatctacttatgcatttgataaaaatggtaaatttcaaggaaaaaagagaatattaacggaagatgatattgcagatatgctatatcctgtaggaatagttgtatggtttgctcagaataaaaatccaaatactctttttcctaaaacgcaatggaaatatatcggtgaaaataaaaccattcgtttagctaaccaaaacggttccgatgtgctctctgtcggtggaaatgattcaataacactcannnnnnnnnnnnnn

SEQ ID NO: 2908 - DNA, 816 bp, Xenorhabdus bovienii
  unsure (1)..(816): unsure at all n locations
  Coding DNA location: Contig name=SeqID_16882; Position on contig =1290..2105bp; Strand=+
atggcacaagattatcatcacggcgtccgtgtacaggaaatcaatgaaggtactcgcaccattaccacagttagcacagctatcgtgggtatggtttgtactggtcctgacgcagacgaaaaaacatttccattaaacactccagttttgattactgacgttatgagcgccagtggcaaagcagggaaaaagggaactttgtactcatcactgaaagcgattgctgatcaggctcagcctgtcaccgtcgttgttcgtgtggctgagggcgaatctgaagaagtaaccgtttctaacatcatcggtggtgtcactgatgcaggtaagaaaacgggtatgcaggcactattggcggcgcaaagccagctcggtgttaagcctcgtattctgggtgttccgggtctggattcaaaagcagttgcgattgaactggccagcgttgcccagaaactgaaagcaatggcttatgtcagcgcttatggcagcaaaaatatctctgaagtcatcaaataccgcgacaacttcaatcagcgtgagctgatgctgatttggccggatttcttgagctgggatactgtttccaatagcgagtctatcgcttatgcaaccgctcgtgctctgggcctgcgtgccaaaatcgacgaggaaactggctggcacaaaacactgtccaacgtgggtgttaacggtgtaaccggtctgtctgctgacgtcttctgggatctgcaagataccgcaactgacgctgatctgttgaacaagagtggcatcactacgctgatccgcaaaaacggcttccgtttcnnnnnnnnnnnn

SEQ ID NO: 2909 - DNA, 1614 bp, Xenorhabdus bovienii
  Coding DNA location: Contig name=SeqID_16883; Position on contig =42..1655bp; Strand=-
atgctagatcttaaacagaggataccaaacacagattggattccccaatttgatttggtcactggtaaagaaggtgcgccagcttttcggttggaaactaataagaaggatattacagggaaaatccaatcgcgtttaatgtctttaacgctgacggataaccgcggtttggaatcagaccagctcgatattgagttggatgatgcggatggaaaacttatatttccttcccgaggcgatattctagaattggaattggggtggcatggcgactccttaaccccaaagggaaaatttgtcgttgatgaaattgaacataccggtgcgcctgatcggctgacaattcgtgcccgcagtgctgattttcgaggtgatctgaatgttaaacgcgaagagtcttaccatgaacacactttagagagcattgtgagtacgattgctgcgagaaaccaactgacatttaaaatcagcgaggaattgaagggtatctctatgcacatcgatcagaccaatgaatctgacgtgagctttttgacacgggtggcaaagcaagaaggggcgattgcttcggtcaaaaatggggagttgttgtttatccgccaaggacaaaataagaccgggagtggtgagaatattctgcctgtgctgattactcgtgaatcaggagatagtcatcgattttctctgtctgaccgtgaagcctataccggtgttgttgcccaatggcaggatacacgaacaaccactaagcagacggttaaattgaagcgggtagaatcaaagagcgggaaagttgaaattattattgaatatggaagcagcgagaacaaatcatcgggcaagggaaacgctaaaaaagacaaaaaccctgtccaaaaagatgaaattcctgttcaagaagataaaaatcttatcccaaaagagaaatattctgcccagaaaaaagaatcctcaacctttaaaaaggaaaaagatcgtaaaattgagtctcctcgtgaagtaatctccgctaaacctgctaagactggtgtggtcaatctggagaagaaaaaaggcatcgatttgacgaagaaaagccataaaacaagtcacaaaacaaaagtaaaggataagcccgattacattaaaaagggacaaaaagaaagtaaaagaaaaaacagagataacagaaatatcgatagagaaaagaacatcgatattgggggaagtctatcttctgagaagcagagcaaatcaacgactgagcatcatcaaacaacaaaggtacagaaaaagtccgaaaactatctggtgggagctgaggaaaatgttctgacactctcccgtgtatattctaacaaggaaaatgcggaacgtgctgccaaagctgtttgggaaaagatgcagcggggggctgcggagttttctatcgccttagcaaagggacgcgctgacatttaccctgaaacacccgttcatattgaaggatttaagccggaaattaatgggactagctggacaatcatcaaagtcacccacaatcttaatgacagtggctttacaacatcgttggatctcgaacttaaaattgatgattttgaaatcaaaactgaggatgtcaaaataaaagcttga

SEQ ID NO: 2910 - DNA, 516 bp, Xenorhabdus bovienii
  Coding DNA location: Contig name=SeqID_16883; Position on contig =1642..2157bp; Strand=-
atgatggctgcacttggtttatttgtttttatgttgaaaacaacgccataccaaagtttccaatataaacaaagttggagacatgccttcaatagccgtgtgggagcacggcctgcatggcaatttattggttcagataatgatacgatcacgctatcgggggaactttatcctgaactgacaggcggttctctttcactgtttgcattgaaattgatggcagacagcggtaaggcatggtctttcattgatggaagtggcgcaatttatggaatgttcgttatcgaaagcattgatgagacaaaaacggaatttatgtcgggcggagcggccagaaaaatcagttttacactgaccttacggcgcgttgataacaatttgtttgaaatgttgggtgatttgcaggatcaattatctgatataaaaggcaaaccacctaaatcactggataagccttctggtcttacgagaaaggccataggtgaaattaaggagcatcctaatgctagatcttaa

SEQ ID NO: 2911 - DNA, 3606 bp, Xenorhabdus bovienii
  Coding DNA location: Contig name=SeqID_16883; Position on contig =2154..5759bp; Strand=-
atgagtaatatacagtcacagctaaacaaggtgctgagtaccgttggaaagctgaccggttcctttaaatcttttcaacggcataataaaaagctggaaaattcagtcgataaaattcataaccagttcaaaaaactcaataagaccgttgagagcttaaagcctatcgtgggttatgcgcaggaaactgcgcgtatacgcaccgatcttaaagcctataatcaaacaattaaacaatctttatctgcgcggcaaaattcgacaagaacgatgcaggttagtgctgccagtcaatcagctaatattattcaaactacccagattatcaaacaggaaaattcatccagtaaaaaaagcgaatttaatcttggtgtaacggggaatatgactaacaatttcacattgttagataagttggtcattaatatcaatccaaagataacaattttatttagtattctgaataaaattaatgctgttttgaatgtaactactggtgcagtaaaagtagtatttcaaactttggttggttatatacaactatttggaaatgttggtataaaaacattcgactctttgagagtcagtttgaatatatttacgcagttgggtattcaggcttttgtatctttaaaagttagtctgaatatttttgcgcagttgggaattcaggctctggtgtccttaagagttagtttgaatttctttgcacagttaggaatccaggcgctggataaattaaaatccagtctggatgcatttgcacagttggggcttaaagcttttgaagaattaaaagccagtctgaatttctttgcacaattaggtgttcaggcgctggataaattaaaatccacactggatgcatttgtgcagttgggaactcaggccctgaataaattaaccgctcccctggatgtatttgcgcaactgggaactcaggcgctggataaattaaaatccacactggatgcatttgtgcagttgggaattcaggccctgaataaattaaccgctcccctggatgtatttgcgcagctgggaactcaggcgctggataaattaaaatctacactggattcatttgtgcagtcgggaactcaggctctgaataaattaaccgctcccctggatgtatttgcgcagctgggaactcaggcgctggataaattaaaatccacactggatgcatttgtgcagttgggcgttcaggcactgaataaattaaccgcacccctggatatatttgtgcaactgggaactcaggcgctggataaattaaaatccacactggatgcatttgtgcagttgggcgttcaggcactgaataaattaaccgcacccctggatatatttgtgcaactgggaactcaggcgctggataaattaaaatccacactggattcatttgtgcagttgggcgttcaggctctgaataaattaaccgcacccctggatgtatttgcgcagctgggaactcaggcgctggataaattaaaatccacactggattcatttgtgcagttgggcgttcaggcactggataaattaactgcacccctggatatatttgcgcaactgggaactcaggcgctggataaattaaaatccacactggattcatttgttcagttgggaactcaggctctgaataaattaacagctcccctggatgtatttgcgcagctgggaactcaggcgctggataagttgaaatccacactggattcatttgtgcagttgggtgttcaggcactgaataaattaaccgcacccctggatatatttgcgcaactgggaactcaggcgctggataaattaaaatccacactggatgcatttgtgcagttgggaactcaggctctgaataaattaatagctcccctggatgtatttgcgcagctgggaactcaggcgttggataaattaaaatccacactggattcatttgtgcagttgggtgttcaggcactggataaattaacagctcccctggatgtatttgctaaattgggtatgcaggctttggaagagttaaaagccagcctcaatttttttgctcagctgggcgttcaggcgctggataaattgaaatccagtctggatatatttactcaggttggtgttcaggctctggaagaattaagagccaatctgaataaatttgcgcaggtgggtattcaggctatggagaatttaagagatggcttgaaggtattcgcacaattgggaactgaggctttagaagcgctaagagccgccatggatttttttggtaaaaccggaaacaaagtttttggctcacttaatgatggtgctgatttgctatctaacaaaggaggtcaagatacttttggaaaccaaagaaaaggcctgggaatattagggaatattggtcaaaaagtttttggtgttttgggtaatggtataaatattctggcaaatgttggtgtaaaaggcctgtcttttttaagtagtactttccgtgtattaggaaaatcaataatgttcattggtcgggctatgatggcgaacccgattcttgccattattggtgttatcgcaatggctgctatttatatttggcagaattggggaacgttggggccaaaattcacagccttgtgggaaagcatcaagaatgtctgtagcaatgcatggcagggaattaaagacatagtcagtgccgcatgggaaggtatcaagaactttttcatgaatgggggactgatcggcattatttaccaaaactgggatgccattaaacaaagcgcttcagaagtttgggaagcgattaaagccttattaagtgagaaatgggaatctattaaacaaagcgttcttgccacttgggaaaatatcaaagcccaaatcagtggtgcttgggaatccgtgaaacagaatactttggaaatctgggaaagcatcaaaaaatcaatttcagatagatggaatgaaattgttagtgatgttcaagctattccagagaaattaaagaaagcgggttcggatatgatcgacagcttgttaacgggtattcaagaaaaatgggaagccttgaagggtaaaatttccgctattactgacatattcacatcgtggtggtcaggtgatgataaaaaggaagtagttgtaaaagcatcacaggaaataactaatagcgaaactacgcaacaagcagcacaagttactaaacatgatacaggcggatctatttcagccggaaaattcggcattgtgggggagcgtggccctgaaattattagcggcccagccaatgtaaccagccggaaaaatacggcaaaactcgctgctgtgggatttgccgttagttcaatgtctttgcctattgccgcacaggatgcaccgttgcatgcgcaaagtctgcctgctcacacttatgaggctgttcaggcgaagaaggaacgaagcctgcccccgcagtctagcggggtaccacaatataacatctatgtctatggcgctcagggacagtccgcgcaggatattgcccgtgtggtcaggcaggaattggaacaacgggaacgtatgcagcaagcccgtatgcgtagctcactttctgatagaggagaagatttctcatga

SEQ ID NO: 2912 - DNA, 318 bp, Xenorhabdus bovienii
  Coding DNA location: Contig name=SeqID_16883; Position on contig =5886..6203bp; Strand=-
atgacagaaacactgaacactcaaaatgacgatctgcgcaccatcgaattggaagctccattggcgcgaggtaacggcgaaatcacggaagtgatggtacgcaaacctaccagtggtgcgttgcgcggtgcacgtttacaggcgctgctggaaatggatgtggattctatgctgcttgtcctgccgcgtgttaccactcctgtattgaccaaaaatgacctaatgatgatgtcacctggtgatctgattaatctcagtgtggaggtggtcaattttttgttgccgaagtcggtcaagtccgattcccagaacaattaa

SEQ ID NO: 2913 - DNA, 519 bp, Xenorhabdus bovienii
  Coding DNA location: Contig name=SeqID_16883; Position on contig =6309..6827bp; Strand=-
atggcattacctcgcaaacttaaatacctgaatttgttcaatgatggcaacaactatcaggggatcgtggaagaattgactcttcctaagttaagccgcaagctggaagcttatcgtggtgccggcatgaacggcagcgcaatggtggatctgggtctggatgaaggcgcattggatgcggaattcactctgggcggtattgaatctcaactgtataagcagtggggcattgcgacagcagatggcgttatgttgcgctttgctggctcttttgagcgcgaagataccggtgatgtggttgcggttgaagttgtgatgcgtggtcgcttccaggagtttgatcacggcacttataaacaaggtgataactctcagaccaaaatcaccgcgaaaaacacttatttcaaactgacatgggatggcgaagagctgattgaaatcgacaccatcaacatggttgagaaagtgggcggagaagatcgcctggagcagcatcgccgcaatatcggtcttttttaa

SEQ ID NO: 2914 - DNA, 1173 bp, Xenorhabdus bovienii
  Coding DNA location: Contig name=SeqID_16883; Position on contig =6839..8011bp; Strand=-
atggcacaagattatcatcacggcgtccgtgtacaggaaatcaatgaaggtactcgcaccattaccacagttagcacagctatcgtgggtatggtttgtactggtcctgacgcagacgaaaaaacatttccattaaacactccagttttgattactgacgttatgagcgccagtggcaaagcagggaaaaagggaactttgtactcatcactgaaagcgattgctgatcaggctcagcctgtcaccgtcgttgttcgtgtggctgagggcgaatctgaagaagtaaccgtttctaacatcatcggtggtgtcactgatgcaggtaagaaaacgggtatgcaggcactattggcggcgcaaagccagctcggtgttaagcctcgtattctgggtgttccgggtctggattcaaaagcagttgcgattgaactggccagcgttgcccagaaactgaaagcaatggcttatgtcagcgcttatggcagcaaaaatatctctgaagtcatcaaataccgcgacaacttcaatcagcgtgagctgatgctgatttggccggatttcttgagctgggatactgtttccaatagcgagtctatcgcttatgcaaccgctcgtgctctgggcctgcgtgccaaaatcgacgaggaaactggctggcacaaaacactgtccaacgtgggtgttaacggtgtaaccggtctgtctgctgacgtcttctgggatctgcaagataccgcaactgacgctgatctgttgaacaagagtggcatcactacgctgatccgcaaaaacggcttccgtttctggggctcccgtacttgctctgatgacgcactgttccagttcgaaagctatacccgtaccgctcaagttctggctgacaccatggctgatgcacatatgtgggcaatcgacaaaccactgacaccatcactggtacgcgacattatcgaaggtattaatgccaagtttcgcgaactgaaatctggtggttacatcatcgatggccgttgctggtatgacgaaaaagccaacgataaagacacgctgaaagtaggcaaactgactatcgattacgactatacacctgtaccgccactggaaaacatgatgttacgccagcgcattacagatagttacctgatgaatttcgctaaaagtatcaataaataa

SEQ ID NO: 2915 - DNA, 861 bp, Xenorhabdus bovienii
  Coding DNA location: Contig name=SeqID_16883; Position on contig =8365..9225bp; Strand=+
atggggagggattttagtgtcaaatcgttgggactaggtattgtagaaaacctcggtttggcggaaaccaaaaaccaagcacaaaatgcgttgccacgcagtgggggcgaagtcaccggtgatatcacgatttctactgacagtgagatagcttggcgcaaaaatacagatatggccgcaattggttttaaaaacaccggagatggtgataccgattcttatatgtggtttaaaaccgcagataatggtaacgagtatttcaaatggcagcatagcctctctgggggaggaaccaatgagtggatgagcctgaaatcagataatctccgagtgaaagggcatcaggtttaccatgaaggatataaaccaactgctgcgattgttggcgcttatacaaaatcagaggctgaaagcaaatatcagccgaaaggaaattatgccgttcgtggggaaaattacacgaaacaggagtctgatggcaaatatcaaccccgaggtaactatcaacccattggtaattatatattgaggggagattgttataccaaaggggaatcagacagccgatatttatcatttcaaaatagaagtccccgcacagttttatctggtgttagcctaaatgatggggaaacagccaatttaggtgtagattgccgagggaaagttatgtgggtatggtgtacagaacgtgaatttccagccgcaatgacagtgataccgatagataactatggagtatcaactcactatggatatcaaggctccattgatttaacactcatcaatggcggtagaactattaaagttatttttacgcgaaaagatacacgattatggcgtatagacatttgggattag

SEQ ID NO: 2916 - DNA, 625 bp, Xenorhabdus bovienii
  Coding DNA location: Contig name=SeqID_16884; Position on contig =267..891bp; Strand=+
atgacaattactctgacagatgcccaaaaagaagccctcgaattgatgcacgatacgactcgtgatgggcgtgtacgtgaccgcatcaaggccgtgcttttggcctcagaaggctggactgcccagatgattgcccaggctttgcgtattcatgaaagtacggtgagtcgccatctgaaggattacgtctctgaggaaaaactcgcccctgaaaatggcggctctgaaagccgtttatctgccgaacaaacgacagaattagtggagtatctgacggcaaatttgatgcacactaccgcgcaaattgtggcttgtgtctgggcgcgctggcaggtgactttcactgtggctgggatgacaaaatggctccaccgccaagggttcagctacaagaagccgatgggaacgcctcataaatccgatgcgggtaaacagcaacactttattgagacctacaacgcgttgaaagctgaatgtggccaaaatgcgcctattttgtttattgatgcgatgcatcctacccagtccacaaaattaagttacggctggatgaggcgcggaagagagcatgtcaaagtggtcgaaaccacaggcagccggacccggacctgcaggcatcaagctt

SEQ ID NO: 2917 - DNA, 537 bp, Xenorhabdus bovienii
  Coding DNA location: Contig name=SeqID_16885; Position on contig =466..1002bp; Strand=-
ttgctggataagattaaggccggtgcacgggcaggccgctaccgtctggtctattttgatgaagccggttttgccgcctctccgccggtgcaatatggatggagtccacggggtaaaccccatgaaactgagcctcaacaccatgacagacggtcagttctgggggcgttaaattacacggacaacacgctgttttaccaggcaccgtcaggcagtatcacacgagctgatgtgattgattttttagagcaggtcgccaaacaaggggacaaccgcctgacatttttagtgttggataatgcgcgtatccatcatgggatagagaaaaaaatcagaaatcgctggttacgagaacacaacctgcttttattttatcttcctgcctacagcccagagctgaatctgattgaaatcatctggaaacaagccaaatatcactggcgacgctttatcacttggactcaggataccgtggagtatgagctaaatactctattggaaggttatggtgctaaatttgcaattaattactcttga

SEQ ID NO: 2918 - DNA, 276 bp, Xenorhabdus bovienii
  Coding DNA location: Contig name=SeqID_16887; Position on contig =76..351bp; Strand=-
gtggggaaactgatacaacaaaagagattgaatacactgattgggagcaggtcgatctcttttctgggaagtttctgcaaatatcatgtgaaaaagagtctcaaaaatagcctttttgctggttgttacagcgttttgaggaaaaaaaacacgaacggaaagaaaattcaaaaaaactattgtcaggcggcgaaaagtccctataatgcgccaccactgaccgacgctgagcgaagacacgccgcggcggacagcgagagaacagcccggaaataa

SEQ ID NO: 2919 - DNA, 549 bp, Xenorhabdus bovienii
  Coding DNA location: Contig name=SeqID_16887; Position on contig =242..790bp; Strand=-
atgaattatttactgctttattccacccaggatggacagactaagaaaattattacttgtatcgctgagaatctccgtcgcgcgggtgctgagtgtgacttaagagatctggctacaataaagcacattaatctgaaaccttatcataaagtgatgataggggcgtcgatacgctatggccattttaattccgtattacatcagttcgctattcgacaccaaaaacaattgaaccaaatgccgacggcgttcttcggtgtcaatctaacggcgagaaaaccagaaaagagaacaccagaaaccaatgcttatatacgcaagttcttgatgaaaagcccttggaagccaaatttatgtgatgtctttgctggtgcgttgctttatccccgctatcgttggctggatcgcatcatgattcagtttattatgaggatgacaggtggggaaactgatacaacaaaagagattgaatacactgattgggagcaggtcgatctcttttctgggaagtttctgcaaatatcatgtgaaaaagagtctcaaaaatag

SEQ ID NO: 2920 - DNA, 1452 bp, Xenorhabdus bovienii
  Coding DNA location: Contig name=SeqID_16887; Position on contig =828..2279bp; Strand=-
atgcattttcgcgccataacccgtattgtcgggctacttgtcattcttttctctgtcacaatgattattccgggattggtggcattgatttatcgagatggcgcgggtagagcattcagccagacatttatctttgctctcgtgattggtttaatgttatgggtgcctaatcggaaccaaaaacatgatcttaaaccgaaagagggatttttgatcgttgtcctgttctggacagttctgggaagtgtcggtgcattgcctttcattttctcagagaaacccaacctttcagtgactgatgccttttttgaatcattttcaggcttgacgacaacaggggcaaccacgcttattggtctcgactctctgccgaaagctatcctcttctatcgacaaatgctgcaatggcttgggggaatggggatcatcgtattagctgttgcgattctgcccttgctcggtgtcgggggaatgcagctgtatcgggcagaaatgccggggccgttgaaagacaataaaatgcgcccccgcattgcggagaccgcaaaaacactctggctgatctacgtcttgctgaccattgcctgtgcaatagcgttatgggcggcgggcatgtcgatattcgatgcgatttcccatagtttttctacaatcgcgattggtgggttttcgacacatgatgccagcatcggttttttcaatagcccggctattaataccattattgcgattttcctgctgatctctggctgtaattttggtttgcatttcgccgtactttccggacgaagtttgaaagtttactggcgtgacccggaattccgcatgttcattaccatccaattggcattactggtgatctgtgtgctgatattgtggcaacaatccgtttacgaatcaggattagatgcactgaatcatgctttctttcaagtggtttcgatggcaaccacagcaggatttacaacagtcagttttgccaattggcctctgtttctgccttttcttctcttatgttctgcatttatcggaggatgtgcgggatcgacaggtgggggattgaaagttatccgcatcttgttgttgttcctgcaaggctcccgtgaactaaaacgtctggttcacccgaacgccgtatacaccattaaattgggacaaagagcattgccggagcgaattattgaagcagtatggggtttcttttctgcttatgcgctggtttttcttattagcatgctgttactgattgcaacaggtgttgatgaattttccgctttttctgccatagccgcaacattgaataacttggggcccgggttgggagccgtctctgataactttaccaccatgaatccggcggctaaatggatattggtcgtaaccatgctgtttggacgtttggaagttttcactctattagttctgttcacaccgactttttggcgtgaataa

SEQ ID NO: 2921 - DNA, 612 bp, Xenorhabdus bovienii
  Coding DNA location: Contig name=SeqID_16887; Position on contig =2317..2928bp; Strand=-
atgaagccttatttgatccctgtggcttcagtcaatttcactgaagaaataaagaaaagtcgtttcatcactctgctggaacacaccagcggggtgaatgaggcaaagttatttatccagaacatcaaggagcaatacccggatgcccgacaccattgctgggcttttgtggcaggtgcgccggatgactcccagcaattaggtttttcagatgatggagaaccgacgggaactgccggtaaacccatgatcgcgcaattaataggaagcggagtgggagaaatcactgccgtgtcagttcgctattttggtggcatcaaacttggcacgggaggattggtaaaagcctatggcaatggtgtgcagcaggcactgaaattactggaaacagaatacaaagtaccgcagaaactgtatcaattgcagtgtggatatgcccatatctcgatggtggaacaattgctacaaaaattctcagggcaagtgattgccagtgaatatgctgaaaacgttacattgcaagtttcactgccagctacccttgcgggggagataggtgataaattacgtgacttaagccgtggtgctctgtttttaacaccaaaatcataa

SEQ ID NO: 2922 - DNA, 1341 bp, Xenorhabdus bovienii
  Coding DNA location: Contig name=SeqID_16887; Position on contig =2928..4268bp; Strand=-
atgaagatggaaaagttggcatccctgtaccacgaacatattaaaatattacaaagacgtgcccgcgaaatactgacacgaaatcagcttgacgctctacttattcactctggcgagtcattacgtgtttttctggatgactgcgattatcctttcaaggtaaatgcacacttcaaggcttgggtgcctgtgactaaagtacccaattgctggttatggattgatggtgtgaataaacctaaactctggttttattctcccgtggattattggcatagcgtggaggctttgcccaatagccactggactgaagaagttgagttgatccatctggcaaaagccgatgatatcaaagcagaattgagtggcttatcaaaacagaatacagcttatattggtgagcagactgagcgtgcaaaggatttgggtattctcgaatacaatatcaatcccaaaatggtcttggattatttgagttaccatcgctcatataaaacagattacgagctggtttgtatgcgtgaagcgcagaaaactgccgtgaatggtcatctggccgcatacgacgcgtttacatctggtgtgagcgagttcgaaatcaatatgttctatttgatggcaacagggcaccgcgatacagatgtcccttataataatattattgccctgaatgaaaatgcggcggtcttgcattacaccaaattacaacagactgtaccttctgaaattcgcagtttcttgattgatgctggtgcagaatataatggctacgctgctgatatcaccagaacttatgcagcaaaacataacaacgatttcgcttcactgattaaagatttaaatggggaacaacaagcgattattggctcgatcaaggcgggtattcggtataccgattatcatatcaatatgcatcgtcgcatagccaagttgctaaaaaaacacggaatcattaatggaatcactgaagaaactatggttgagaaagggctgacaacgccatttttcccacatgggctaggccatccactgggtttgcaggtgcatgacgctgccggattcatgcaggatgataccggaacccatctggccgcgccgacattacatccttatctgcgttgtacacgtattttggagccgaggatggttttgaccattgaaccgggtatttatttcattgaaactttattggcaccgtggcgtgaaaatgaatacagcaaacatttcgattggaaaaaaatcgacatgtttaagctttatggtggtattcgtattgaagataacatcgttattcacgatggaaaaattgaaaatatgaccagagatttacagttgtcgtaa

SEQ ID NO: 2923 - DNA, 141 bp, Xenorhabdus bovienii
  Coding DNA location: Contig name=SeqID_16887; Position on contig =4276..4416bp; Strand=+
ttgattatctggcaggagtataaatcttaccacaattcattatttttggtgtcaccatggggaaatctcaccttagcgcagttgactaacaatatttatatttttcataactataataaaaaatattgtcgtccatcataa

SEQ ID NO: 2924 - DNA, 126 bp, Xenorhabdus bovienii
  Coding DNA location: Contig name=SeqID_16887; Position on contig =4401..4526bp; Strand=+
ttgtcgtccatcataaatcttccctgtgatccgctctacaaaaaattcatcattggtttgcattcgattaacacactaatcacaatcaaccgtatctggtcataccagatggtatgcactcattga

SEQ ID NO: 2925 - DNA, 2187 bp, Xenorhabdus bovienii
  Coding DNA location: Contig name=SeqID_16887; Position on contig =4537..6723bp; Strand=+
atgctctacctaagtgacactattcaagtaaactggctgaaagatggcattgcagaactgatcttcaatgcaccagctgcaattaataaattagatacaaaaaccgttgcttcattggataaagcggttgccgtccttgagcaacaaactgaattaaaagggctgttactacgttctgaaaaacaagcctttattgttggtgcagacatcacagaattcttatcattattcgatgcaccaaaagaaaaacttcaggaatggctgaagttcgccaatgatattttcaaccgtattgaagatctccctgttcctactatttctgcgatcaacggctatgcacttggcggtggttgtgaggtagtattgtcaactgactttcgtgttgcatccccagatcttcgcatcggattaccagaaactaaattaggcattatgccgggctttggtggttctgttcgcctgccacgtttaattggcccagataacgccctcgaaattattacagcaggcaaagatattggtgcagaagacgcgctaaaaaatggcctggttgatgccgttgtgccgactgaaaagctggtagatgctgctgcttctattctggaacaagccatcaaaggcgatcttgattggcaagccgtccgccaacctaaactttccccactgaacctcaatgatgttgaacgcaccatgagcttcaccgtggcgaaaggaatggtgatgaaagtcgcaggcccacactatccagcgccaattactgctgtaaaaactattgaaaaagcagcgacattgggtcgtgatgaagccttgaaactagaagtagaaagttttgttccactggctcataccactgttgcccgtgccttggtcggcatcttcctaaatgaccaatatgtcaaaggtctggcgaaaaaacatctgaaagaagtcacagtgccacagcatgcaacggtactgggtgcaggtatcatgggtggtggtatcgcctatcaatctgcacgcaaaggcgttcctgttctgatgaaagacattaatcagaaagcgctggatttaggtgtcaatgaagccgctaagttattgcataagcaatttgagcgtggacgtctggatgctatgaaaatggctaagattctgtcatccattcaaccaacactcagttatgcgggcattgagcaatctcagattgttgtcgaagccgttgttgagaatccgaagattaaagctgcggtcttggcagaaacagaatcacatatcaacgatgattgcattctagcctccaatacctccacaatcccaatcaccgaattagcaaaatcactgaaacggccagaaaatttctgtggtatgcattttttcaacccagttcaccgtatgccgctggttgaaatcatccgtggagaaaaaacctcagacaagaccatttctactgttgtggcttacgccagcaaaataggtaaaacgccgattgttgtcaatgattgcccaggctttttcgtcaaccgcgtattgttcccttatctggcaggcttcggcatgttactgcgcgatggcggtgatttccgtcaaatcgacaagatcatggagaaagagtttggctggccgatgggtcctgcgtatctcatcgacgttgttggcattgataccgcccatcatgctcaggcagtcatggcacaaggttttccagagcgcatgactcgcgattatcacgatgccattgatgtattatttgaaaatcagcgttacggccagaaaaatgacgtgggtttctataaatacactcaagacaaaaaaggcaagccgaaaaaagagcaggatgaaaccgtcgatcaactgctggcaggtatcagtcaaccgaaacaggttttctctggcgaagatatcattgcccgtaccatgatcccgatgattaacgaagtcgttcgctgcttggaagaaggtgtcattgccagtcctgcagaagcagatatggcgctggtttatggtttaggcttcccgccattccacggtggtgttttccgctatctggatacgatgggaaccgcagcttatgtgaaactggctgaacgttatgcccacttaggcgcaatgtatcacgttcccgctggcctgaaagcgaaatccgaaagcaatgaaagttactaccctgtcgcagccaaaattgctgttaatccaggtgaaaaagcgtga

SEQ ID NO: 2926 - DNA, 1164 bp, Xenorhabdus bovienii
  Coding DNA location: Contig name=SeqID_16887; Position on contig =6735..7898bp; Strand=+
atggaaaacgtagtcattattgatggtattcgtaccccaatggggcgctcaaaaggtggtgtattccgtcaggtccgtgccgaagatctctccgcacatctgatgaaatcaatactcaagcgcaacccgtcagtacagcctgagcatatcgacgatatctcttggggatgtgtgcaacaaacactggaacaggggttcaatatcgcccgtaattccgcattgctggcaggcattccccattcggtccctgcggtgaccgttaaccgtctgtgtggttcttcaatgcagtcattgcatgacggtgctcgcatgattatgactggcgatgccagtattgcgatgattggcggtgttgagcatatggggcatattcccatgactcacggtgtcgattttcatccgaaattaagccgcaatgttgctaaagccgcaggtgttatgggcttgaccgcagaaatgctggcaaaaatgcacggtatcagccgcgaaatgcaagatgaattcgccctgcgctctcacctactagccgcacaagcgacagaatcaaaaacgttcgctaacgaaatcgcaccaattcatgggcacgatgctgatggcaacctgaagttcatcgattttgatgaagtgattcgtcccgataccaacctgaaaaatctggctgggctgcggcctgtctttgatcctgtcacaggcagtgtcacggcgggtaactcttcagcactttcagatggcgcatctgcgatgctcatcatgagtgaaagcaaagccaacgagttagggttgaaagcacgtgcccgaattcgttctatggcagttgttggctgtgatccttccatcatgggttatggccctgtacctgcaacgcagatggcattgaaaaaagcaggcttgagccttgctgacatcggtcttattgaattaaacgaagcatttgcagcccaatcactggcctgtatgaaaggactgaatctgctggatagtatggacgataggatcaacctaaacggtggtgcaattgctctcggccatccattaggctgttctggcgcacgcatcacaactaccctgcttaacctgatggaacgcaaagatgtacagttcgggctggcaaccatgtgtattgggttagggcaaggtattgctacaattatcgagagagtttag

SEQ ID NO: 2927 - DNA, 702 bp, Xenorhabdus bovienii
  Coding DNA location: Contig name=SeqID_16887; Position on contig =8050..8751bp; Strand=-
atgacaacactgagctgtaaagtcacatcggttgactccattacagataccgtttatcgggttcatttattacctgattcgcctttttcttttcgtgcggggcaatacctgatggtagttatggatgaaagagataagcgtccgttctccatggcatcgccaccatcagaaaaacagacgattgagttgcatattggggcttctgagttaaacctgtatgcaatggcggtgatggacaggatcctggatcagaaagtgatcgatatcgatattccacatggtcaggcatggtttcgtgaagacagtgaaaacccgatgttattgattgccgggggaactggattctcttatacccgctctattttactgtcagcactggaaaaaaatccgaaccgtgatatctcgatctactggggagggcgtgaattacatcacctctatgatctgggtgaattgcaggggttgagtgagcgttatcccaatctggctgtggttcctgtggttgaacaggttgatgaatactggcagggcagaacgggtacggtcttgagtgcagtcttagaagattttggcagtttggcgaaccatgacatttatattgctgggcgctttgaaatggccaaaattgcccgtgaacgcttttgtagtgaacgtgatgcgtctattgatcgcatgtatggtgatgcgtttgagtttatctga

SEQ ID NO: 2928 - DNA, 1482 bp, Xenorhabdus bovienii
  Coding DNA location: Contig name=SeqID_16887; Position on contig =8762..10243bp; Strand=-
atgaataatatgaaataccgtgatctacgagactttctttccttgttggaacaatcaggtgaattaaaacgaattcgtatggaggttgatccttatctggaaatgacagaaatcgcggatcgtactcttcgtgccggtggtcctgccttattatttgaaaatccaaaagggtattcaatgccagtactgtgcaatctgtttgggacacctaagcgggtcgctatgggaatggggcaggatgatgtcaaggcattgcatgatgtcggcaagttactggctttcctcaaagagccagagccgccaaaaggttttcgtgatctggtcgataagctgcctaagttcaagcaagttctgaatatgccaaccaagcgcctcaattctgcaccttgtcaggagcaagtctggacgggagatgaggttgatctcacccgtattcctgttatgcattgctggccagaagatgctgcgccattgataacatgggggcttactgttaccagagggccaaataaagagcgccagaatttgggtatctaccgtcagcaggttctgggtaaaaacaagcttattatgcgttggttatcacaccgtggtggagcgctcgattttcaggaatggtgccaggctcatccgggagagcgtttccctgtttctgttgcgttgggtgctgatcctgccacgatattgggtgctgtgactccaattcctgatactttatctgagtatgcctttgctgggttgttgcgtgggcataaaacggaagtggttaagtgcctgtccaatgatctggaagttcctgccagtgcggaaattatccttgaagggtatattgaaccggacgaaatggcaccggaagggccatatggcgatcacaccggttattacaatgaagtggatatgttcccagtattcactatcacccatatcactcagcgtcgtgacgctatttatcattctacttacactggccgtccaccggatgagcctgctgtcctgggcgtggcgttgaatgaagttctggtgccaatactgcaaaaacaatttcctgaaattgtcgatttttacctgccaccagaggggtgctcctatcggcttgctgtcgttacgatgaaaaaacaatatgcaggccatgccaagcgggtcatgatgggagtctggtcatatctacggcagtttatgtacacaaaatttattatcgtttgtgatgatgacatcaacgcgcgagattggaatgatgtcatttgggcgataactacgcgaatggacccgcagcgagatactgtcttaatggaaaatacaccgatcgactatctcgattttgcgtcaccggtttctgggttaggctcaaaaatgggattggatgcaaccaataaatggccaggagagacacaaagggaatgggggcgcccgatagtcatgagtgatgaaattcgcgcccgtgtcgatgaaatttgggatcaattagaaattttgaagcgataa

SEQ ID NO: 2929 - DNA, 99 bp, Xenorhabdus bovienii
  Coding DNA location: Contig name=SeqID_16887; Position on contig =10359..10457bp; Strand=-
atgagtgaaggattcaaactttttcagcacggtaaaacattccctgaacaatgtgatacacaggcattagttgattggataccattttgctgcatctga

SEQ ID NO: 2930 - DNA, 96 bp, Xenorhabdus bovienii
  Coding DNA location: Contig name=SeqID_16887; Position on contig =10450..10545bp; Strand=-
gtgtgtttaacgtatatacctaatagattgcaaattgcagcgcagtggcaagtgaatgaacgcagtcaacaaaacagcaatttgaaagatgagtga

SEQ ID NO: 2931 - DNA, 105 bp, Xenorhabdus bovienii
  Coding DNA location: Contig name=SeqID_16887; Position on contig =10553..10657bp; Strand=-
ttgcccgcgtttacagtacagaagataccagtttcccataatattccgactccattacacaatatgtctagcataacaaaaccagggcttcaggatcatcaataa

SEQ ID NO: 2932 - DNA, 489 bp, Xenorhabdus bovienii
  Coding DNA location: Contig name=SeqID_16887; Position on contig =10619..11107bp; Strand=+
atgggaaactggtatcttctgtactgtaaacgcgggcaaatttctcgagcaataggaaatttagagagacaggatgttatttgcctgacacctacagccaaaattgaaaaaatcgttcggggtaaaagaactaccgtcactgaacccctttttcccaattacctttttgtgaattttgatccagagattattcataccacgactatcaattcaacacgaggcgtcaatcattttattcgtttcagcacttaccctgctgttgtcccacaaacgttgattgatgaattgatgtccgcaacggaacaggaatatattgcacctgaaaccccaattactggcgataccgtgctgataactgaaggaattttcgaaggtattcaagcaatttataatgagccggatggagaaacccgctcaattctcctgttgaatattctcaataaagaagtatccaaggtattggataataaacaattcattaaaatttaa

SEQ ID NO: 2933 - DNA, 1071 bp, Xenorhabdus bovienii
  Coding DNA location: Contig name=SeqID_16887; Position on contig =11173..12243bp; Strand=-
atgacaaaattaacccagcgtattgtcgctgggttttacattaggagatcagtaatgagctatgtatttccaggtacgtttcctggtcgtcgtatgcgccgtgtacgtcgtcatgatttttcccgccgtctggtcgctgaaaatcaactcactgtcaatgatctgatttatcccgtttttgttatggaagggagcaatcaacgtcaagaagtgtcttctatgccaggagtgtatcgtctgacaatcgatcttttgttgaaagaagccgaagagattgcccgactgggtattcctgttttgtctctgttcccagtcattgaagcagacaaaaaatcactggatgcgaaggaagcctataaccctgatggtttgattcagcgctctattcgtgcattgaaagatgcggttcctgagctgggattactgacagatgtggcactggacccatttaccacgcatggacaggatggtgtcattgatcaggatgggtatgtcatcaatgatattaccaaagagattctggttaagcaggcgctatcccatgctgaagctggggctgaaatcgttgcaccgagcgatatgatggatggccgtattggtgccattcgtgatcagcttgaggttgatggccatattaacacgcagattatggcttactcagccaaatatgcgtcctgttactatgggccattcagggatgcaattggctctagcggtaatttgaaaggcggcaataagatgacctatcagatggacccagcaaacagcgatgaagcgttgcaggaaattgcacaggatttgcaagaaggggcggatagcgtcatggtcaaacctggtatgccttatctggatgtgatccgtagggtgaaagatacttttggtgtgccaacattcgcttatcaagtttctggcgaatatgcgatgcatatggctgctatccaaaatggctggttgaaagaacagccagccattatggaatcactgctgtgcttcaaacgtgcgggtgctgatggcgtactgacttattttgccaagcgtgtagcacaatggttgcatgagcagaaatactga

SEQ ID NO: 2934 - DNA, 780 bp, Xenorhabdus bovienii
  Coding DNA location: Contig name=SeqID_16887; Position on contig =12308..13087bp; Strand=-
atgtctgtggatgatacccaacctcttatcggtcacttgattgagctgcgtaagcggattttaaatagcttgattaccgtgctggtgatttttctggcactggtttatttttctaatgatatttatcggcttattgctgcaccgttaatggaacaattaccgaagggagcaaatatgattgcgacagatgtcgcatcgcctttcttcacgccaatcaaactgaccattatggtgtctatcgttgtgtcggcaccgatgatcctgtatcaggtatgggcatttattgcgccagcattatataaacacgagcgccgtttgatcatgcccctgctgttttccagcagtgtactgttttatctgggcatggcatttgcttactttgtggtatttcccattgcatttggtttttttgtcaaaaccgtgccagcaggggtggtcatttcgacagatatcagtaattacctgagttttgtcatggccctatttatggcgtttggtgtctcatttgaggtgccggtagccattattctgttgtgttggagtggagttgtaacgcctgaatccctgaaaagaaaacgcccttacattttggttggtgcgtttgtggttggcatgttgctaaccccaccggatgttttctcgcaaactttgctggctatcccgatgtacctgctatttgaagtgggaattctgctttctcagttttatgtgggtggacggaaatcagacagagcagaaaacgaatctgaatatgatgcaggtaacaattcagaaaaataa

SEQ ID NO: 2935 - DNA, 393 bp, Xenorhabdus bovienii
  Coding DNA location: Contig name=SeqID_16887; Position on contig =13091..13483bp; Strand=-
atggtgattggtctggttgttttggggccagaacgcttgcctatagcagtcaaaactgtggctggctggatacgggtattacgctcgctggcggctaatgtccagaatgaacttgctcaggagctaaaagtgcaagagcttcaggacagcttgaaaaaaatggaagaaaaagcagatttgcaatcattgtccccagaattaaaggcatcgatggacgagttaagggaggctgctgaatcgctgaaaaaatcgtatcagctgactcctgaagaggctaaagcgttagaagaggatgaaacacattttcattcttctgtatctcactcagtaccagaaccggcgtcaaaacaaaataaaaatcaatctcctgaaaaagccaatagtgaacactaa

SEQ ID NO: 2936 - DNA, 255 bp, Xenorhabdus bovienii
  Coding DNA location: Contig name=SeqID_16887; Position on contig =13523..13777bp; Strand=-
atgataagcatcccacaattactcattattgctgtcattgtcgtattgctgtttggcaccaataagcttcgctccttgggttcagacttgggagcatcaatcaaaggttttaaaaaagcaataagtgatgatgaaaagccagatcaggttgaaaaaaatagccatgatgctgattttgaaaccaaaagtattgctgaaaaatccactgttgccgagtctgaaaaatcagagagcaaaaataaagagcaggtataa

SEQ ID NO: 2937 - DNA, 1677 bp, Xenorhabdus bovienii
  Coding DNA location: Contig name=SeqID_16887; Position on contig =13889..15565bp; Strand=-
atgatatgtctcatatggaaaaacggctggcggcactggagggaaaatatgactcccagtgaaataaaacgcctttactttattgttcgggtctttctttcctatggcttagatgaactgatccccaatattcgtctgacatggccgttgcgtttcgggcgttattttctgttctggctccccaatcgacacaaggataaaccactcggtgagcggttacgtctggcattgcaagaacttggcccagtgtggatcaagtttggtcaaatgctctctacccgtcgggatctgtttcctccggctatcgccgatcaactctcgatgttgcaggatcgggtcgtttcttttgatggcgcagtggctcgcaaatccattgaaactgctttgggtggaccgctggaaacatggtttgatgattttgattcacagccattggcttcggcttctattgcacaggtgcatactgctcggcttaaggagaatggtaaggaagttgttcttaaggtgatccgtccagatatcctgcctgttattaaagcggatgtccgtttaatgtaccgtatggcgcatctggttcctttactgcccaatggctatcgtcttcgcccgcgtgaagttgtgcgtgagtatgaaaaaacgttgcttgatgaactgaatttattgcgtgaagcggcaaatgcgatccaacttcgccgcaattttgaagatagctcaatgctttacgtgccagaaatttatcctgattattgtcgggagaatgtactggtcatggagcgtatttatggcattcccgtgtcagacattgctacgttggaagcgcggaacacggatatgaaactgcttgctgaacgtggtgttcaggtgttcttcacgcaggtatttcgtgacagttttttccatgcggatatgcatcccggcaatatttttgtcagttatgaacggccggaagatccgacttatatcggcattgattatggtattgttggttcattgaacaaagacgataagcgctatttggcagaaaacttcattgctttcttcaatcgtgattaccgcagagtggctgaacttcatgtggattctggttgggttccagccgatatcaatgtggaagatttcgagtttgctatccgtactgtctgtgaacccatttttgaaaagccgctggctgaaatctcatttggtcatgttctgttgaatctcttcaatacagctcgtcgttttaatatggcggttcaacctcagttggttttgctgcaaaaaacgctgctgtatattgaaggcctggggcgccagctttatcctcagcttgatttatggaaaacggcaaaaccttttctggaagactggttacacgatcaggttggcattccggcgattgtgcgcgcatttaaagaaaaagcgccatattgggctgaaaaattaccggaattccctgagctggtttatggcgctcttcaacagcataaacgtttgcagacgagcattgaccagatatcgcaacaattacagaaacaacaggtcagccagaaaaaatctctctatttactggggatcggtgcgacattgtttatctgtggcagcctatttttcatgactgaccagattcatctatcgtggtggttgatgggggcggcagtcatatcgtggatatttggttggcgcaggcttaagtaa

SEQ ID NO: 2938 - DNA, 654 bp, Xenorhabdus bovienii
  Coding DNA location: Contig name=SeqID_16887; Position on contig =15504..16157bp; Strand=-
atggagacgcccgaattaagtgacaacctgaattctacggtgttgtttccggtgctgactgcgtttctggaaacgactctgaatcatcttctgtaccgtgaaaccgtattgaagtccgctcgcatgaggctggcaggtaaggtactgtccatcgaattgaaagaaattaaaacaccactggtattgatattcagtgaaaaacaggtggatgttttgagccaatggtcagagtctgccgactgttcgatgaaaacgacgttcaccgcgttactcaaattgcgggatcgtcagtgtctttcatctctgattaacagtggtgaaatcgttatcgaaggggatatgcaagttatgcagcaatggtcggctctgctggatatgtctgagtgggatcctgctcattatctttccccttatgttggcgatattgtggcagaaggcctcagtcgggtgatgaaggaaggcgttaaatttgccagcaatgcgattacaaggcagaaaacctatctgacggaatcattgacggaagagtggcgaatggcacccaacccgctggaagtggcttacttcagtgaagaagtcaatgcggttgccaatgatatgtctcatatggaaaaacggctggcggcactggagggaaaatatgactcccagtga

SEQ ID NO: 2939 - DNA, 756 bp, Xenorhabdus bovienii
  Coding DNA location: Contig name=SeqID_16887; Position on contig =16159..16914bp; Strand=-
atggctgatcaatcgaaaaaaactacagattttggtttccgcaccgtagaaaaagatgaaaaacaaattatggtggccgaggtatttcactctgtcgcttcaaaatacgacttgatgaatgatttgatgtcatttggcattcatcgcatctggaaacgtttcactatcgatgcaagtggaattcgccgtggtcataaggtgttggatcttgcgggaggaacgggggatctgacggcgaagttttcccgcatcgtgggtgaaaaaggtgaagttgtattggcagatatcaacgaatcgatgttgaaagtagggcgtgagaaactacgtgatatcggcatcgtgggcaatgttaattatgttcaggccaatgcggaagaattgccttttccagacaattactttgattgtattaccatctcttttggcctgcgcaatgtgacggataaagaaaaagccttgcgctctatgtgccgagtacttaaaccgggcgggcgtcttttagtgctggaattctccaaacccgtactagcacctttgagcaaagtttatgatgcttattcgttccatgtcttacctcgaattgggcagatgattgtcaaggatgcggacagttaccgctacctgacagaatccatccgtatgcaccctgatcaggaaacattaaaagccatgatggaagaagcgggctttgaccaagtttcttacaccaatatgaccggggggatcgttgcactgcataaaggattcaaattctga

SEQ ID NO: 2940 - DNA, 756 bp, Xenorhabdus bovienii
  Coding DNA location: Contig name=SeqID_16887; Position on contig =16990..17745bp; Strand=-
atgcagggcgattggggcgaaatggtgttggctcgcgttttggaatcttctggtttacgtgaagggtatgaatttcatacacaggtcaacattaaaacagaaaacggtgagcgctttcagcctgatgtcatcgtgcatttgccacaggaaaaagatgtcattattgatgccaaaatgtcactgatcgcctatgaacgttactttaacagcgatgatgacacgcagcaggcacaggcgttacaggaacatataaactcaatcaaaggacatattcgggggctaagccggaaagattatcaacaattgcccggtttacggtcgctggattatgttctgatgtttatccccgtagaaccggcttatctggtggcactcaatcaagcacctgaattactggatgaagcattgaagcataatattatgctggttagtccatcaacacttctggttgccgtgcgtacgattaataatctttggcgctatgaatatcagagccagaatgcacgccttattacggacaaagcaaccaaaatgtatgacaagatgcggttgtttgtggatgacatgcaagggttgggacacagcctcaataaagcacaggagagttaccatttggcaatgaaaaaactggctgaagggcggggaaacctgattagccaggctgaaggattccgtgatttaggtgttgatgttaagcgccctattgattcacagcttattgataaatctttccaatcattgcaggttaatgagtga

SEQ ID NO: 2941 - DNA, 147 bp, Xenorhabdus bovienii; identical to SEQ ID NO: 349
  Coding DNA location: Contig name=SeqID_16887; Position on contig =17759..17905bp; Strand=+

SEQ ID NO: 2942 - DNA, 147 bp, Xenorhabdus bovienii
  Coding DNA location: Contig name=SeqID_16887; Position on contig =17902..18048bp; Strand=-
ttgcgcagtcaagtacaggacagtttcggacaggaagctcgcgaacgccatactctgacccatgaaatccgcaatctccagcagcttaatgcacaaatggcaaaagaagcgattaatctgacgaaagccctgaaaggggatacttaa

SEQ ID NO: 2943 - DNA, 210 bp, Xenorhabdus bovienii
  Coding DNA location: Contig name=SeqID_16887; Position on contig =17986..18195bp; Strand=+
atgggtcagagtatggcgttcgcgagcttcctgtccgaaactgtcctgtacttgactgcgcaacccgtcaagctgctcgcgaaaaggcatcaggaggtcattaaggctttggcggctgtattcatcggtacggcgccgattctgctcaaaaatacgattggcgagattttcagattgggtattgaggcgttgttcactattgatcaatag

SEQ ID NO: 2944 - DNA, 138 bp, Xenorhabdus bovienii
  Coding DNA location: Contig name=SeqID_16887; Position on contig =18167..18304bp; Strand=+
ttgaggcgttgttcactattgatcaatagacgttgtttttcttctgcggccagcctgctctcttcaagccgcgtgcttaattcacgtaattcaacttcctgtacgctgttgatttcgcgctgcgccagcagttcttga

SEQ ID NO: 2945 - DNA, 111 bp, Xenorhabdus bovienii
  Coding DNA location: Contig name=SeqID_16887; Position on contig =18355..18465bp; Strand=+
atggctgatagcaagctgactatgcagttcacgcagttccaactctttctgttgaattcgctggtgaacggaaagccagacgaaaatccctccgcccagcaatccacttaa

SEQ ID NO: 2946 - DNA, 531 bp, Xenorhabdus bovienii
  Coding DNA location: Contig name=SeqID_16887; Position on contig =18621..19151bp; Strand=-
ttgagcttgcatgaaattatcgaactggtcacagacttcgtaaaagcccatgaagattgggcaatccccattgttttcctacttgcttttggtgaatctctggcatttatctccctattgttgcctgcgacgatcattttattaggattgggggcgttgattggtgaaagcgggttaaatttttggccaatatggatagcggcggcagcgggagccttttttggcgattgggtttcctatctgtttggtgtccactacaaggacaatgtcggcaagatgtggccactgtcacgtcatccgcaaacgttagttcgcggccatcgattttttgaacgctggggagtttggggcgttttcatcgggcggttttttggcccattgagagctgttataccactggtagcgggtattttcgccatgccgaaacgtcatttccagctcgccaattttgcctctgcgctgatttgggccttcggtattttggctccgggcgcgtttggtttacgctggctggcagaatggatgggctaa

SEQ ID NO: 2947 - DNA, 783 bp, Xenorhabdus bovienii
  Coding DNA location: Contig name=SeqID_16887; Position on contig =19229..20011bp; Strand=-
atgaccacaacattgctatcccatccttcattgctccccttacatggtggcattaacttccgtgatttcggtaataagacgctgcataatggtgcgaaaatcaaatcagggctgttattccgctctggctctctggacatgttgactgaaaacgatcagacttttttgatggaccaaaaccttttccagatcattgattatcgtgatagcagcgaaattgaggataagccagatcgagtgtggcgtggggcgaattatcaccatgctccggccaatccactctctaaggaagttgatgccaatctggaaaaattgggtcaggaacttctggagcagtttgatgcacaagcattcatgctgcgtttatacgaattattgccaatcaacaatcctgcttacaaacagctggctaatctattgatgcaaccagaaaaaggcggaattgtacagcattgcgcagtgggtaaagacagaactggcgttggatctgcgctggtactgtttgctctgggagcagatttggatacggtaatggaagactatttagtcaccaacattacgctggcaccatatcgggaatatctcttgaatgaacatgcaaaagtcatgagtgaccgtgtgattgaaaaatttgcttatgtttattcagtgcgggaagagtttttactgacggccttaaatagtattaaccagcattatggcagtgtggatatctggctggaaaaagatatcgggctggatatgacagcacgtgaaaaattacaaagttattttcttgaataa

SEQ ID NO: 2948 - DNA, 105 bp, Xenorhabdus bovienii
  Coding DNA location: Contig name=SeqID_16887; Position on contig =20060..20164bp; Strand=+
atgacattatcagattttagaacgaaagaaagactagtggcgcatctcgcatttaacagccttattcaaagtacttgcaaaccatccggttatagggttaattag

SEQ ID NO: 2949 - DNA, 219 bp, Xenorhabdus bovienii
  Coding DNA location: Contig name=SeqID_16887; Position on contig =20173..20391bp; Strand=-
atggcattcagcctgcttactgcccaattcgactttctttgctgcccagttattagatacgccggatgcaaagagcaaaatcagctgcgctcgttggcgatgatcacaacgattgatccgagaattgatgatgtgttccagcgcttctttttggtggacactcaggcttactgccgggacttttcacacaaaaaacaggtacatcgaatggtcatttaa

SEQ ID NO: 2950 - DNA, 240 bp, Xenorhabdus bovienii
  Coding DNA location: Contig name=SeqID_16887; Position on contig =20458..20697bp; Strand=-
gtggaagccggtgcgcgctataattggttaagtgcacaggaagagcagcagatacgctatgtcaccccatcacaacgacacagaggagaagataaggccatattaatgaaacgagatacggtttatcgtgcagcccagttatcacatccagaacgagaacgctggtcaggcaagacaaggaactggcaacctgttggcgcggtaaccctgaatccagaacgagaaaaacaggcagcttaa

SEQ ID NO: 2951 - DNA, 219 bp, Xenorhabdus bovienii
  Coding DNA location: Contig name=SeqID_16887; Position on contig =20827..21045bp; Strand=+
ttgtccttgcgggccagttcacgtttcagttgtttattctctttctggctctgtttcagcgtcgctttttcatctctgtcgggcacctgtaaaaaggcgtgtttccattgcttaattgctccgggtaaagtcctttcttacggcaatattcagcgtggcttcggatatgccttcaatttgagctacagccgcaacggtcatgttatcaggtggcagtaa

SEQ ID NO: 2952 - DNA, 153 bp, Xenorhabdus bovienii
  Coding DNA location: Contig name=SeqID_16887; Position on contig =20938..21090bp; Strand=-
atgacacgtatttcaccagaacgtaaatcctccgcgctggctaaattactgccacctgataacatgaccgttgcggctgtagctcaaattgaaggcatatccgaagccacgctgaatattgccgtaagaaaggactttacccggagcaattaa

SEQ ID NO: 2953 - DNA, 210 bp, Xenorhabdus bovienii
  Coding DNA location: Contig name=SeqID_16887; Position on contig =21126..21335bp; Strand=+
atgagggtgacaacaatcctgacagagaaggaccgcttgaaacaaatagtggcgcatgtttttggtgatcgcagccgaaaaacattagacaagctgcttgccctcttatccccctttaatattcggttttactgtacggatgattatgtggtctatgacaagctcccagaagaagaccatcttactgaaaaatgtttacccaacgtataa

SEQ ID NO: 2954 - DNA, 147 bp, Xenorhabdus bovienii
  Coding DNA location: Contig name=SeqID_16887; Position on contig =21317..21463bp; Strand=+
atgtttacccaacgtataaagaggactaatttaacccatcgtagccgaataaaaagactgaatagaaaaaccatcggttactcaaaatctgaagaaatacacgataaggtgataggaactttcattgagcgcgagcactatttttag

SEQ ID NO: 2955 - DNA, 117 bp, Xenorhabdus bovienii
  Coding DNA location: Contig name=SeqID_16887; Position on contig =21441..21557bp; Strand=+
ttgagcgcgagcactatttttagcactcaatctaactatttaatacatgaccgccctacaagctatacagttgcagtaaataactctttaaacatattggtatccttaggttattaa

SEQ ID NO: 2956 - DNA, 99 bp, Xenorhabdus bovienii
  Coding DNA location: Contig name=SeqID_16887; Position on contig =21761..21859bp; Strand=-
atgcagttaaccaataataacaaggctaatagcgccattcacatagggttattatgtctgtttagagattgcaatattattacactaataacctgttaa

SEQ ID NO: 2957 - DNA, 180 bp, Xenorhabdus bovienii
  Coding DNA location: Contig name=SeqID_16887; Position on contig =21958..22137bp; Strand=+
atgctatcaaatattccggctacccctaggtttatccagcaatataaacatgctactagtgaattaaactttctttacaatgtatcaactgagtggcatcaacatccctgtattcaactcagcctatctttacatacacatgaatcgctagatggtgtcgtcataaataaattcatgtaa

SEQ ID NO: 2958 - DNA, 492 bp, Xenorhabdus bovienii; identical to SEQ ID NO: 1438
  Coding DNA location: Contig name=SeqID_16887; Position on contig =22159..22650bp; Strand=+

SEQ ID NO: 2959 - DNA, 354 bp, Xenorhabdus bovienii; identical to SEQ ID NO: 1741
  Coding DNA location: Contig name=SeqID_16887; Position on contig =22587..22940bp; Strand=+

SEQ ID NO: 2960 - DNA, 114 bp, Xenorhabdus bovienii
  Coding DNA location: Contig name=SeqID_16887; Position on contig =22894..23007bp; Strand=-
ttgaacgaatcagaaaaccacgagtggagtgagtctcatcctgtattgataaggctagatagtgtcgtcataagacatttaaccaaagagcaagacagcggatctgaacagtag

SEQ ID NO: 2961 - DNA, 657 bp, Xenorhabdus bovienii
  Coding DNA location: Contig name=SeqID_16887; Position on contig =23013..23669bp; Strand=+
atgcataaggtggattcctccaatacctgtagcattacattgcttattgaacctattgatgaacattaccatttatttagccatctcacagagaatgtggaagtaattttgctagagcatgatgatattgtggcagtaacagattatctggttaagtcgtttctttgtggcgaaaaaccagaaacattcactgtttacttgttacttagcccatacctgtcatgccactgtcaatttgataaacgtattttgaaagctgtttcgtttatcgaatcgctatcagtaaagcgggtttcatcccgtcaagtggctgataaaatttacctttctgaaagccgttttttacatcttttccgtgatcaagtgggaattaactttcgggcttacttactatggttacgcttaagtgatgctattgaggagattcatatgactgattccttaactttgattgctaataactgtggtttttctgactctgctcattttagccggacatgtaaaatggcttatgggatacgcccttccgatcttaagcatataattcagcagaatttacagttcaattgccatacgactcagtgcctctataacatcaataaacagataataaatagtattcatcatgaagaagaagctaatctccaaattacgtag

SEQ ID NO: 2962 - DNA, 1533 bp, Xenorhabdus bovienii
  Coding DNA location: Contig name=SeqID_16887; Position on contig =23662..25194bp; Strand=-
atgaaaattgaggatcacacagctatggaacttttatcagccagccaacgctggtggctaatcctgtctctggcgattatcgcttttctacaaatattggatctgacgattgctaacgtagcattgtcaactattgcaggtgatcttggatcatccgtgtcacaaggaacttgggttatcacgtcatttggtgttgctaatgcaatatctattcctttgactggctggttggcaaaacgggtaggggaagtacggctgtttatcatttcgactctgctttttatcatttcttcctggctatgtggcatatccaatagccttgaaatgctaattatttcaagggttatacaaggtgctgttgcaggccctatcatacctttatcacaaagcttgcttttagcaaattttcctaagaaacaacacagtatggctttagccatctggtctatgaccgtcattattgccccggtttgtggtccaatcctcggtggatggattagcgataactatcattgggggtggattttcttgatcaatgttcccatcggtctagccgctatttttattacttacttgttattgaagaagcgtgaaacaaaaactgaggttatcccagttgataaggtggggttggttctactcattgtcggtgttggttgcctacaactcatgttagacagaggaaaagaactcgactggtttaactccaatgagatcatcttgctggcgattattgcaacggtagggattatcctatttatcatttgggaactgactgatgataacccgattgttgatttatcgttgtttaaatcacgcaattttacggttggtacgatttgtattagtttggcatttctgttgcatattggtgtcctagtcttacaacctcagttgttacagacagtttttggttatacagccacttgggctggactcgcattagctcctctcggcattcttcctatttttctagccctagtcattggccgatttggtgctaaaattgatatgcgctatttggttactcttagctttattgtcttctctttctgctttttttggcgagcatatacttttgagcttggaatggatttttccagtgcagcatggccacagtttgtgcaggggatagcgattgcttgctttatcatgccactcaatgtgattattttatctaatattcctcaggagaaaattgcctcagctggaagtttgtttaacttctttagaacattagccatatcgataggcacatcgttaaccaatacattatgggttcaacgtgaagcggttcatcattctcagctcactgagaacatcacacaaaataacgttcttgtcgatttagcttatcaggatatcaagctcttgggattatctgacttacaagcaaccgtttttctggcgaagaggatcaccaaccagagtttaattctggccgctaacgaaattttctggctcttcggttttatttttctggcactaatcttgattctttggttttccagatcgaatttgtcatctacgtaa

SEQ ID NO: 2963 - DNA, 1188 bp, Xenorhabdus bovienii
  Coding DNA location: Contig name=SeqID_16887; Position on contig =25184..26371bp; Strand=-
atgggaaacaatcaaattgaaaaaatgcctgaacaaccacaagaaaaaaataataagaaaaaacgtaaaataatactttctttttttgtattactttttttgtttgctggtttagcttatctattttactggtatatagtattacgtttctaccaatcaacagataacgcctatgttgtcggtaatcagatccaagtcatgtcccaaacccatagcagtgtgaaaaatatttatgttgataataccgattttgttcagcaaggtgaccttttactaacgttggatagtgctgacgctgagaataccttcgagaaaaataagcatgtattagcccaggcagtgcgtgaaacacgggaaaccatcctcagtaatcccaagctcctggccaatatggaattaaaacagcttactttagacaagttaaaaagtaatctggcacgacgggaaaaattgggtaaggtcaatgtcatcgctgttgaagagctggatcactctcgtaaagctgttgacattgctaaggcagatttaaaagtcgccatgcagcagtataaaatcaatcaggctttgctaatgggtacgccactaaacaaactgccaaatatagaaaaggcagcatccaatttacgtgaagcttggttgtctttgcaacgaaccaaaatctacgctccagtaagtgggtacgtatcacgccgcagtattcaagttggatctcaaatcaatcaatctacaccattgatgattatcgttcctcctgaccagatatgggttgaggcaaattttaaagaagtgcagttcactgatatgcgtctggggcagcccgtcaagttaatcagcgatttttatggcgatagtgttacttatcaggggcgcattacgggtatagatatgggaaccggcagcgctttttctatccttcccgctcagaatgcaacaggtaattggattaaagtggttcagcgcctccctgtacgtattgaattagagccgaaacaagtcgctctcaatccattgcggatcggtttatctatgcatgtaacggttgataccagtgaaacagcaggcacaactctggctgacaaaactccacaacgggttatttatcagactgatgttttttcattcaataataatgagatagatgaaatcattgagcaaatcataaaaagcaacgtaagtgatgaaaattga

SEQ ID NO: 2964 - DNA, 150 bp, Xenorhabdus bovienii
  Coding DNA location: Contig name=SeqID_16887; Position on contig =26524..26673bp; Strand=-
ttgattccgaccacctcagtcagattattcaatccaatcacgttgttaagttataaagttggtatgccgattaccattgatgtgttggcaggtagagttcctaagtatggagttcactctatgaacggtgttttcattttaatcatatga

SEQ ID NO: 2965 - DNA, 117 bp, Xenorhabdus bovienii
  Coding DNA location: Contig name=SeqID_16887; Position on contig =26677..26793bp; Strand=-
gtggtttggtcacaaaaccgacacttcacttcaactaatgccatcacgatccctcacgtatttactctcattatacgtgagaaacaacgggatgaatacgtgaccaatattcattaa

SEQ ID NO: 2966 - DNA, 276 bp, Xenorhabdus bovienii
  Coding DNA location: Contig name=SeqID_16887; Position on contig =26750..27025bp; Strand=+
atggcattagttgaagtgaagtgtcggttttgtgaccaaaccacgcctgttaaaaaacacggcaaaggagaaggtgggcatcaacgatattattgccagtcctgtcgtagaaccttccagctcgaatacacttaccgggcttgccattcgggtatgaaagagcaaatcgtcgagcttgccatgaataatgccggtattcgtgatacggcacgggcacttcatgccagcattaacgctgttgtacgcactttaaaaaactcgcgccgcgatgcgtaa

SEQ ID NO: 2967 - DNA, 366 bp, Xenorhabdus bovienii
  Coding DNA location: Contig name=SeqID_16887; Position on contig =27079..27444bp; Strand=+
atggggtcattcatcagcaacaaaaaacggcaacgttggctgtggtacgcgtgggagcctcgcttgaaacgtattgtcgctcacgcttttggagcccgtagcaaacagacactcatgacgttgctggaaaagttatccgcttttgatgtggcattttggtgcaccgataatttcggggcatatgacatattggctgatgagaaacatatcaccgataaactttatactcaacgtattgaacgagaaaatctgaacctgcgtaacaggctaaagcgactcaatcgcaagacgctgggttattctaagtcagttgaaatgcatgacaagatcattggcacattcatcgagcgtgagttctattattga

SEQ ID NO: 2968 - DNA, 138 bp, Xenorhabdus bovienii
  Coding DNA location: Contig name=SeqID_16887; Position on contig =27505..27642bp; Strand=+
atggaaaatataccaattatttacagaaggataaaattagctagtttattcaagaaaaataaaaatatcattgttatatttgcgttacttattcgaattacttatttgctatattcttctgatataagtacccattaa

SEQ ID NO: 2969 - DNA, 459 bp, Xenorhabdus bovienii
  Coding DNA location: Contig name=SeqID_16887; Position on contig =27740..28198bp; Strand=+
atggcacgctacgacattcctgatgacgcatggatagtgatagaaccttgtttacctccggtccattcagagcgggcaggacgtccacatgttgaacaccgccgagtgatgaatgggatgttctgggtcttgtgctctggggcaccgtggcgtgatttacctgaacgctatggtccttggaaaacggtctataaccgatttaaccgcgggtcaaaatcgggcattatcaacaagatatttaaccggttactgtccattctggatgaaaaaggcttgattgactgggctgaaatttgcctggatggcagcaatattcgcgcgagtaaagatgccgcaggcgcgaaaaaaaacctcccgatatcgctgacgatcatgcgctgggtcgctcacgcggtggttatggcaccaaaatccatctggcaaccgacagacggggttttcccctcaacctgcttttga

SEQ ID NO: 2970 - DNA, 141 bp, Xenorhabdus bovienii
  Coding DNA location: Contig name=SeqID_16887; Position on contig =28137..28277bp; Strand=-
atgaaaccatttttgcgctgtataccaatgccgtcgagcaaagggatggcggatcgactttcgtgggcttgccccgccgtcaaaagcaggttgaggggaaaaccccgtctgtcggttgccagatggattttggtgccataa

SEQ ID NO: 2971 - DNA, 306 bp, Xenorhabdus bovienii; identical to SEQ ID NO: 2153
  Coding DNA location: Contig name=SeqID_16887; Position on contig =28276..28581bp; Strand=+

SEQ ID NO: 2972 - DNA, 222 bp, Xenorhabdus bovienii
  Coding DNA location: Contig name=SeqID_16887; Position on contig =28673..28894bp; Strand=-
atggctattttcagatttaaaagtggatactggaatgacagggatatttaccaagtccgcataacattggatatcattgggttttacacctttcttttcacattgttcacgatagtaaacattattttcaaaatgatatgcaaaggcatctctaataacatgtgttttttagttcttgttgttcttcacttgaaagttgatagagaaaactgctgtttgtaa

SEQ ID NO: 2973 - DNA, 855 bp, Xenorhabdus bovienii
  Coding DNA location: Contig name=SeqID_16887; Position on contig =28934..29788bp; Strand=+
atgcgttcgactggtactagtggtatccctagtgttgctcgtcgatgtaatgaaacaatggactatactactataggtatctataactcatatcgcgatatgcttaagctctccagtggtgcaggactgtgtttatgtccttctacggaggaaattcctgaaatgggaatgataaaagcatttaattggttgactggattgctggataccaatcgctttatggttagagaagaacgttttattccggaagaagcagtcggtcaattaaaagaatggcaaggaaaatttactcgtcatttgataggacctccgtttcttattcatcgttttatcagtttcttgaaagccacgaacactaaattggaactggacagtgggagtatggtcattacgctcggtggctggaagcgtttcactggtgccatgatttcccgtaccgagtttaatcaagagctggaaacttggttaggaatctctgctagccggattcgtgatatgtatggacttgttgaagctaacttcctggctatagaggatgaattcaatcaaaaacatattccaccttatattcacttctctgttcgtgatccggaaaacctatctcgagaagttgctgatggtgagaccgggcaacttgttatattcgatcccatagcacattctacccccggtatgttgctgaccgaagatatgatctacttacgtactgacaatgacctttcaggtcgtaactctcagcgtatgcaatatgttatgcgggcaccttctgcaacagaattcggctgctgcgccgttaatctggaaagtaaaatgtcagctgatgaacaaagggatacatgccctgttactcagtga

SEQ ID NO: 2974 - DNA, 357 bp, Xenorhabdus bovienii
  Coding DNA location: Contig name=SeqID_16887; Position on contig =29798..30154bp; Strand=+
atgtttaatgaaattatcactgataacttttgtcatcccgattgtcagggaagcctggaaaatccagatattcagcttaaattgggtaatcctgtgtgtggagataaagtgaatattgatttgtcactgaatgaagaaaaacgtatcagtgacgctcgatttcaagcttggggatgcacggcttctttagcgatgtctaatcagttttgtcgccagattcaaggaaaaacactaacagaactcgcccaattaaatatacaggagatcgaccagatgctgggtaagctgcaaccgtcacagcagcattgcctagagatgttgcatgctctttttcagcaggtaaggatgcatatatga

SEQ ID NO: 2975 - DNA, 639 bp, Xenorhabdus bovienii
  Coding DNA location: Contig name=SeqID_16887; Position on contig =30151..30789bp; Strand=+
atgactatattgtactttgatttcaatgcgacaacaccaatgagtcataaatcaaagatggcaattcagggcgtgttggatcaatttgctaatccttccagcagatatcgtttgagtaataatttaattacgttaattcatcaggcaaaagagtctgtagctcagttagtgggaggtttgcctgaaaggatcatttttacttccggtggcacagagagtaataatctagctttgcacagtgtatttggccagctcccagctggtcaattatctcgttatcatgccatctgttctgcaattgagcattcttccattctagaacctctgcgttggtatgaaaagcagggcctgaaactgacgatcatcgagccaagtaaaacaggaagaatagatctggacacattgtgtaatgccatcacaccccaaacttgcttcatcgcattgatggcgattaacaatgaaactggtgtcattcaaccttatgatgagcttgcttacaggctgaaaggaaaaggtatccatcttcattgcgatgcaatacaagcggtaggaaaatggcctatccgctgctttgatgatatcccattaactatctctttttcagggcataaattttatggccctaaagggatatcctaa

SEQ ID NO: 2976 - DNA, 1491 bp, Xenorhabdus bovienii
  Coding DNA location: Contig name=SeqID_16887; Position on contig =30789..32279bp; Strand=+
atgtacccacctggtctggagtttattatagggttagttgcttgttttaaggcaggagccattgctgctccatctaatgtggttcgagggagccatcatctgcaaagattaacgcagatcttgaatgactcagaagctaaagtgatacttactactttagagttaagcaaaaccttatcgcatgaatttcctaaccagcatgttatgtattactcggaaaatcagacggtagatgggataacacagcttccttcaatatctccaaaacaattagcttttctacagtatacctctggttccactgatactcctaaaggagtaatggttactcacaataacttaattcatagcttgcgggcgatgaataatacttttggcctgcatgaagggttaatcattggaggctggatacctcagttccatgatatggggttggtaggccatattcttctgaccatggcgctaggtgggcaatataatttcatgccacccctctcatttatccagcatccattacgttggttacagttgatgcatgattatggtgctgaattctgttgtgcccctaattttgcttacgacctctgtgccgaccaagactgtgctgggctcaatctggacctgtctcgctggcgttgggcgggtaatggcgcagaaccagtcaggaatgaaactctgatgcatttttatcaggcagttaaagaatatgggtttgtttatcaaagccaaatcccctgttacggtatggctgaagcaacactggtaatcagttcatccaccagtgaagatcctccatttagtttaacactttgtaacagcagtctagagaaaggaaaacttgtcttacaacctgatggggttgtaatgcaagcctgtggtcaagttgcgccgagtcatcgcgtcgtgattgttaacccggacacaaaggcattgtgtcaacccgatgaaattggtgagatttgggttcaaggtccaagcattgctgtggggtattggaataatcaggaacaaactgagcagaatttcaaggcctatactaccactggcgaagggccttttctccgtactggtgacctcggatgtctgtatgaacatcatttgttgatcacggggcgtttgaaagatctgattattatccgtgggcggaatatttatccacaaaacattgaatacgcagctactatgcagtccaccgtgttccgtttaggcaaagcaattgcttttgaactggaacaacaggtcgttgtcgccatagagctacgaaaaaatgtggggcaggaaaataacttcagagaattgagacgaaatgtaatccaggcactccatgcaacattcgatattaatatcgctgaattagtatttattcaggccaataaattacctacaactagcagtggaaaagtacaacgaagactctgtcgtgcactctatttacaagacaaattacttctggccaatgtactgcctgccaccgaaattcaaggagcataa

SEQ ID NO: 2977 - DNA, 282 bp, Xenorhabdus bovienii
  Coding DNA location: Contig name=SeqID_16887; Position on contig =32245..32526bp; Strand=+
atgtactgcctgccaccgaaattcaaggagcataatatgactgagctggaactaaaaggctggctactcgagtacttgacaccctatttccaacgccatgaaatttctatcagtgaacacgtttccttcgatagtcttggtctggattctgtgagcagggtaaaactgattagtcagttagaaaaagtattacagcaaaaactggaccctattcttggctatgaataccccactatccacgctttgtctgggcatatactgcaattggagcagaggccatga

SEQ ID NO: 2978 - DNA, 594 bp, Xenorhabdus bovienii
  Coding DNA location: Contig name=SeqID_16887; Position on contig =32548..33141bp; Strand=+
gtgctgggcaagagaaggcaagaaaaaagtggtcaattaccgaaaatatccgtggcatttgatcatcgtggaatattccgacttcagtttctaagtgaaaatcttacgaattctcaaaaacggaaccctcgcctaagtcagcttcatacctcaattgtgaatgttttccagtccatagctgaaaaacatcaaattccgctcagtgaaatacgtgttattcatgaagattcagccaggcagcacattgttcacacactctctcttagagaaatacctgaaaccgtcaaacaacggatggtgtctaaaacccttgctgatagtaagccacagacatcagatgctttgtacgaagagcctactcagaaactcacctgtgctgcaattacaaaagagtattttgaaagagctgcagacgattcccaagacacggatactattctagaagtgttctttgaggactgcgaatggtcgagatctcttgcatatgtgcgcggaatccagctcagtcacatgctcggtgtttccacttccattcgcctcaatcttgttaatgaagctggcggggtgagtcagggcgatatagttagcgcatag

SEQ ID NO: 2979 - DNA, 1179 bp, Xenorhabdus bovienii
  Coding DNA location: Contig name=SeqID_16887; Position on contig =33197..34375bp; Strand=+
atgtataacctgtcccggcctatttatctggataacaacgctacaacggcattagaccctgatgttcttcaatctatgatgccttattttataaacgattacggaaatgcttccagctatggacacgcttttgggtggaaagcgatggaagctgttgatgatgcaagaaaagtgatctcaacatcaataaatgcgaaaagtcattccgatattatattcacatctggttcaactgagtcgattaatcttgcaattgctggctttcaacatcggagcaaaaagggtcatatcatcacatcaatgattgaacataaggcggttcttgattgctgcgctaggcttgaggcaatgggaactgaagtaacctatttacccccacaaagcgatggtatcgtatccccaggctcaatatctcttgcattgagagatgatacctatcttgtttcaattatgacggcaaataacgaaattggctcaatacaaaaaattgaggagataggcgcgatctgtaaagagcatgatattccttttcatacagatgctactcaagcgctcggaaaaatagagtttgatgtacagcgtatgaatattagtcttgcctcattttccgcacacaaaatatatggaccaaaggggatcggcgcactttatatcaactcacgtaataagcatgtcgcactctcacctttgatcgttggaggtggacatgagcgaggtttacgttcaggaactcttaatgttccgggaatcgtagggtttgggcatgctgttgaattatctttgaaaaatttgaccactgaatcgacgaggttgcgttatttacggaatttacttcgacaatatattatcgagaacgtgcctgatgttcgaataaatggtcatctcactgaatgtcttcccggcttgttaaatgtatcctttgatgggatagatgcagattcacttttgttggagctttctgaggttgccttgtcctccggatctgcgtgtacatctgccaacagagcaccatcacatgtactgaaagcaataggagtgagtgatgagctgtctcaagcctgcctgcgctttgggttaggtaggtttaataacgaggatgaaatgcggtatgtttgcttccgcttaaaagaagcagtgaataaactgagagcgatggtaccaaggtcatttgctcactga

SEQ ID NO: 2980 - DNA, 702 bp, Xenorhabdus bovienii
  Coding DNA location: Contig name=SeqID_16887; Position on contig =34410..35111bp; Strand=+
atgcgaacaatgccggctttgtttctgttgttcggaaccctgttcactgcgggtggttatggtgctacctttcttatttctgagtattttcggtcacaagggggaagtgatattgatacaggaacgacccttagcgtggcattgatcggtactttgattggtgttcctttggttggatggttttccgggcaattggaagcatcacgccttgcagctttcgcggcgttgtcaatgtcttgtggttattttcttttcggtggctttggtggtgaactgagctacatacaaaatatcgcagcgcttttgattgggctcggttggggaatgttttatataagtggtcccatggccttgtcggaacgggttactgatacagacagggggcaatggtttactcgtttcagtgcatttcaaatggctggaatttgtggcagccccattctcctcactgtagcggttgaacagggaggtttttcaatccagacaacgtttctcctggttggggttgttggtattctcgcttcactgcttctggcaattttcggggtcagggagccgcttgaacaacggaaatcattattgcggccttgggtgaagaaaataacgaagatctctgcagctagtactatccgcccgattgtaatggttgggctggggggctgtgtattctctggaatgatgtcatttcaggggtcactctag

SEQ ID NO: 2981 - DNA, 138 bp, Xenorhabdus bovienii
  Coding DNA location: Contig name=SeqID_16887; Position on contig =35103..35240bp; Strand=-
atgattaagcacgacatcaacgtaatgacgagtgggatacagggtaccgtcgataaatatcgtgccaaaaaaagacgcgatacaactacagtcgctgcatgtacagcgaagaatgtacttgcattcgcactagagtga

SEQ ID NO: 2982 - DNA, 357 bp, Xenorhabdus bovienii
  Coding DNA location: Contig name=SeqID_16887; Position on contig =35224..35580bp; Strand=+
atgtcgtgcttaatcattggccttttgtctttgttaggtataccgattcatcctgtgttccagattgttgcggccatgttaacaggaataggatatggattagtgtatcctgttattcaaacatgggcagtaaatgattctcctcttgaagatcgtcatgcagccctcacctggtttgttgtctcctattttgcgggtatatttggatttccgttgataggtggatggatattagtcgatgcgggaaaaaatctgtttatcctgattctggctgcaattgcttttattgaactggtagtcgcgttgttgggaaaaagtcatctttgttacattaaggggtggcctaagcggggatga

SEQ ID NO: 2983 - DNA, 240 bp, Xenorhabdus bovienii
  Coding DNA location: Contig name=SeqID_16887; Position on contig =35645..35884bp; Strand=-
atgattaatctgctgaaaatcagagatgctgttgccctcaatgggtgtaccgatgcaagatcattgagccatcagttttcagcaccgctgccaatggtagaagctatgctcaagcagcttgtcatgatgggtaaactggaggaagtggacgcttcctcttgcctcagcgggggctgtaaacagtgcccggaaacgcaaaaatatgatactaaggtgtatcaattagcagtgaaaaattaa

SEQ ID NO: 2984 - DNA, 261 bp, Xenorhabdus bovienii
  Coding DNA location: Contig name=SeqID_16887; Position on contig =35925..36185bp; Strand=-
gtgactcaaatattgacagtggcgtgtgaagatccgcaggcgagtggacaccctctgagtcactggacattaccctccaaacatgcctcctggttaaatcaaattgaatgttggttcagtctgatatcccggcatttgctcaggcggcttttcgtcagcagcaaagagatattgcgggcactcattttaaaatatatcgaatattacaatcgggtattagccaaactttttaaatggctttatcgtggaaataaacaataa

SEQ ID NO: 2985 - DNA, 147 bp, Xenorhabdus bovienii
  Coding DNA location: Contig name=SeqID_16887; Position on contig =36123..36269bp; Strand=+
gtgactcagagggtgtccactcgcctgcggatcttcacacgccactgtcaatatttgagtcacttgctcagcgctgaatttctgcttccgctccggtgcaaatcgctgaacagcgcttcaagggcttttatcaggctatttgagtga

SEQ ID NO: 2986 - DNA, 276 bp, Xenorhabdus bovienii
  Coding DNA location: Contig name=SeqID_16887; Position on contig =36288..36563bp; Strand=+
atggcattcagcctgtctcgattatccagccagcgttttctccagtatccggcctacttactgcccaattcgactttttttgctgcccggttattagatacgccgaatgcaaagagcaaaatcagctacgctcgttggcgattatcacaacgactgatccgagaattgacgatgtgttccaccgcttctttctggtggacactcaggtttactgccggggctttctacataaaaaacaggtacatcggatggccacttaaacaaagtgctaattaa

SEQ ID NO: 2987 - DNA, 756 bp, Xenorhabdus bovienii
  Coding DNA location: Contig name=SeqID_16887; Position on contig =36676..37431bp; Strand=-
atgtctgatgtatttcatttaggtatcaccaaaagcgatctgcaaggagcgactttggctattgttccaggcgatcccaaccgtgttgaaaaaattgcaaaattgatggataaccccgttcatctggcctcccatcgtgaatttacgacatggcgcgcagaaattgacggaaagcccgtggttgtctgctctacgggtatcggtggtccttcaacgtcaattgctgtagaagaattggcgcaattgggggtgagtactttcctgcggatcgggacaaccggtgcgatccagccgcacattaatgtgggtgatgtattagtcacgacagcggcagttcgtctggatggagccagcctgcacttcgcgccaatggaattcccggcggtggctgattttgaatgtaccaacgcactgtatgaagcggcaaaagcatcaggatcggccacccacgttggtataacggcttcttccgatactttctaccccggacaggagcgttacgatacttactctggccgtgtcgtccgccgtttccaaggctccatgcaagagtggcagcaaatgggggtgatgaattatgaaatggaatcagccactctgttgacgatgtgtgcaagtcagggactgcgtgccggtatggtggcaggggtgatcgtcaaccgtacgcaacaggaaattccagatgttgaactgttgaaaaaaaccgaaagcaacgctttgggaatcgtggttgatgccgctcgccgtttgctgtaa

SEQ ID NO: 2988 - DNA, 135 bp, Xenorhabdus bovienii
  Coding DNA location: Contig name=SeqID_16887; Position on contig =37480..37614bp; Strand=-
ttgtttgaatcttatactcagtccgttgttttgggttatgaatgtgattattatcacaaaattatgtatgtgtttctttattttttccaattaaagatgatttttatcactaaaaagtgtcagattaggcactaa

SEQ ID NO: 2989 - DNA, 393 bp, Xenorhabdus bovienii
  Coding DNA location: Contig name=SeqID_16887; Position on contig =37863..38255bp; Strand=+
atgggcttttttgatcaaatcaccaatatgctgagtgggggtaaaaaccaacaactccagcatatgatggactgggttgaaggtcagggaggaataagcggattaatagaaaagttttcccagcagggactgggtggcacaatccattcgtggatcggctcaggagaaaattccccgattcacgctgaccaaatctcttctgtttttggctcttccacgatccagcaattggcagagaaaatgggtatcgatcccaatgaagcgtcatcattaatctcacagcatttgcccagtttaatcgataaggtcacgccaaacggtgaagttccagaaaatctggatttaaaatctgcgggtatgaatttattgaaagataaattactggagaaataa

SEQ ID NO: 2990 - DNA, 2295 bp, Xenorhabdus bovienii
  Coding DNA location: Contig name=SeqID_16887; Position on contig =38303..40597bp; Strand=-
atgacagttttgaatcatacattaggttttccacgtatcggcttgaaaagagagctaaaaaaggcgcaagaaaattattgggcaggcaaaatttctcaacaggaattgctggaaacaggtcgtgaattacgtgcacgtcactggcaacagcaaaaagaggcgggagttgatttagttccggtaggtgattttgcttggtatgaccaagtattaacgactaacttgttattgggcaacgtgcctccacgtcatcaaaatgaagatggtagcatcgatctggatacgctgtttcgtattggccgtggtcgagctccaacaggtgcaccagcggccgcttctgaaatgactaaatggttcaatacaaattatcattatatcgtgcctgaatttcagcaggggcaagaatttaaactgggttggactcaattactggatgaagtgggtgaagcactggcattgggacacaaagtcaaacctgttctgctggggcctgtaacttatttatggctcggcaaggtgaaggggaaagcttttgaccgcctctccctattaacggatattctccctgtctatcagcaagtactggcagaattggcaaaacggggcatcgaatgggtgcagattgatgagccagcactggtactggaattgccgaaggaatggctggaagccttctcaacggcttatcaggcgctgcaaggacaggctaaattactgctgacgacttatttcgacagcatcagccataatctggcgacgatcaaatcactgccagtacaagggctgcatgtagacttagttgcagggaaggattcccttgatgaactggatcaatctctgccggaaacgtggttgctttcattgggggtcatcaatgggcgcaacgtctggcgagcagatttgagtgcgaaataccagcttgtggcaccgctggcaggcaagcgtgatatttggatcggcacgtcctgttcattgctgcatagcccgattgacctgaacgatgaaaccgggctggatgaagaagttaagagctggtttgcctttgcattacagaaatgcgcagaactgtctttgctggcgcaggcactgaatgcaccggaaggcagcaaacaggctgaactggatgcttacagtgcgccaatccgtgcacgccgtagttctacaagggtgaacaatccgacggtgactgagcgcatcacggcgatcaaaccacaggatagcgagcgtaatctggtttatccagaacgggccaaactccagcgtgagcgttacaacttaccgttgtggccaaccacaaccatcggatcattcccacaaacaacggaaattcgtagcctgcgtctggacttcaagaaaggtcgtgtggacaacacgcattatcgcaccaatatttctgaacatattaagcaggcgatcaatgaacaggaaaatctgggactggatgtgctggtgcatggtgaagccgaacgtaacgacatggtcgagtatttcggtgaacattttgatggttatgtctttacccaaaatggctgggtacaaagctacggttcccgttgtgttaagccgccagtaatcattggcgatatcagccgcccagaagccattactgtaaattgggcaacatatgcacaatccctgacggataagcctgtcaaaggaatgttaacagggccggtgactatcctctgctggtcattcccaagggaagatattagccgcgaaacgattgccaaacagattgcactggccttgcgtgatgaagttgatgatttacaaaaagcaggtattggcatcattcagattgatgaaccagcactgcgtgaaggtctgccactacgcagggaagaatggcaggcatatctggaatgggctgtggatgctttcaaactgagtgccgcgattgcggaggatgatactcagatccatacccatatgtgctattgcgagtttaatgacatcatgccttccattgcagcactggatgcagatgtgatcaccatagaaacttctcgctcagatatggaattgttggattcatttgaagatttttcatatccgaatgagatcgggcctggtgtgtatgatattcactcacctaacgtgccaagtgtcgaatggattgaagcgttgctgcgtaaagcggctgaccgtatcccagtggaacgtctgtgggttaacccggattgcggcctgaaaacccgtggctggactgaaacccgtcaggcactggcgaacatggtcgaagcggcgaaacgcctgcgtgcttccgtgaacaatacttccgtaaataactaa

SEQ ID NO: 2991 - DNA, 957 bp, Xenorhabdus bovienii
  Coding DNA location: Contig name=SeqID_16887; Position on contig =40705..41661bp; Strand=+
atgatcgaaataaaacatttaaaaacactacaggcattgaaccattgcggttcattggctgcagctgcaaatcatctgcatcagacgcaatctgctctttctcatcagttcagtgaactggagcatcggctggggttcaaactcttcattcgcaaaagccagccattgcgccttacacctcaaggagaagtgctgttaaaactggcggagaaggtactgcctctggtgacggcttccctgcgtgaatgcagtgaaccggaagaaattaacctgcgtattgccattgagtgccatagctgtattcagtggctgacgccagcacttaagcgttttagtgaaagctggccgcaggttagtgtggatttcaaatccggtgtgacgtttgatccgcagcctgcactgcaacagcgggaactggatattgtactgacatcagatattattgcagacagcaagctgaactatacgtcgctgtttgactatgaagtgaaactcgtgcttgccccggatcacccattggcaaataagcgtgatatttatccacaagatctcgctcccgaaacgctgctgatttatcccgtccagcgacaacggtttgatatctggcggcgtttcctccagccagcagctgttaccccaacattgaaaagcgtcgataataccctattactgatccagatggtggcggctcgcttaggcattgccgcattaccccattgggcagtggaaacattcgaaaggcaggggctggttgtgacaaaaacgttgggagaaggattatggagcagattgtatgctgcctgccgagaaggagaacagcaccaacctgccattaatacatttattcgttctgcgcgccagcacgcggtggacaatttgccgcttgtaaagcgggtttcagtatccaacggtgatgcacccaaagagatgcaacaatcaggctgcttcctatggtaa

SEQ ID NO: 2992 - DNA, 900 bp, Xenorhabdus bovienii
  Coding DNA location: Contig name=SeqID_16887; Position on contig =41546..42445bp; Strand=-
atgtggctgttaacgatcacaacttttttgtgggctgcctcattcagcctgattggtgcttttctggccggtcaggttgatagctggttttccgtgctggtcagagtagtgctggccgctttggtgtttctgccgtttttgcgctggcgtgggttatcgctgaaagtgatctcactgtatatggccgtgggagcctgtcagcttggtgtgatgtatttgtttgtatttcatgcctaccactacttgactgtcgctgaatttttgctgtttacggtgatgactccgttatatgtcacactgatatatgatgtgatggggcgtcagcgactgcgttggggctatgcgctgagttctttgctggcggtggctggtgcagcgattattcgctatgaccagttgagcgaatctttttggattggtttgatactggtgcagttggcgaatattttctttgcaataggtcagattggttataagcgcttgatggaagtgcacccgataccgcagcggatcgcgttttcgtggttctatctgggggcttgtgtggtcgcaatcattggctggctgctgtttggtgatccacataaattgccgacaacgcaattacaatggggagtcctgatctggttaggtgcaggcgcttctggcattggttattttatgtggaactatggtgcaacccaagtggataccggaacactggcaattatgaacaatatgttggttccggccgggttgttggtcaattttgtaatttggcagcagcatcctgattggctgggttttaccataggaagcagcctgattgttgcatctctttgggtgcatcaccgttggatactgaaacccgctttacaagcggcaaattgtccaccgcgtgctggcgcgcagaacgaataa

SEQ ID NO: 2993 - DNA, 1650 bp, Xenorhabdus bovienii
  Coding DNA location: Contig name=SeqID_16887; Position on contig =42449..44098bp; Strand=-
atggaaatattttttactatcttgatcttgattttggtggtgtcagtttcaggtgttcttactaaaatgatcccgttccgcattcccttgccgatagtgcaaatagcaatgggagcactgctggcttggcctcattttggtttacacgttactttcgaccctgaattattcctcgttttacttatccctcctttattatttgttgatggctggaaaacaccgaccagagaattttttcaacatgggcgtgaaatagtcattctggttttattcttggtattagtgacggttgtcggtattggctacttgatttactggttgctgccgggtattccacttattgctgcttttgctctggctgcggtgctgtcaccaactgatgcggttgcgttgtcatcaattgttggaaaagggcgcatcccgaaaaacatgatgagtgtgctggaaggtgaagcgttgatgaacgatgcttctggtctggttgcactgaaatttgccgtggcaattgccatgggaacgatggtatttacggtcactggcgcaacgatagagtttttcaaagttgcgattggtggtctgttgtccggtattgccattacatggctgtatagtaaatcattgcgattgatgagccgctggagtggcgatgatcctgcaactcaaatcatgttcatgatgctgctgccattcgcttcctacatgattgctgaacatatcggcgtatcgggtattttagccgcggttgctgcgggtatgactatcagtaagtctggcgtaatccgcaatgcacctttggctatgcgcctgcgtgccgataacgtatggggaatgctggcctttgtctttaacggccttgtatttgtcatgctggggctacaattgccgggtatctgggaaacgtctgtcgagcaggctgaacttgatccgcaagttgaaacgtgggtgctgtttgctgcggttggcatcatttatgtggcgttggtattgctgcggttctgctggttatggttgatgaaaaatgccagcaaggtgttaatgaagaagaaaccgctggagtttgcttcttacactacacgtgaattgtgtctggcgtcgcttgcgggtgttcgtggcgcgattacgttggcgggtgcgttatctgtcccgcttttcctgccggatggcgatccattcccagcgcgttatcagttgattttcatcgcagcgggcgtgatcatgttctccctgtttgtcggtgttgttgtcctgccactgttgctgcgtggcatgaaagtgggagataagcaggcggatatcaatgaaatcagaatggcgaaagcagcaatggctgaagttgcgattgtcagtatgaataaaatggaagagcgcttgtctgccagcaccgaagaaaaactggatgcagaggtagtgagtgaaattgcttcccgagtcacggggtatttgcggcgtcgtactgtaggtaaagatgaaatcgaacataacttgctggttgaggagttggaacggcgtttccgtctgacggcattaagggccgaaaggggagagctgtatcacctacgtgcaacccgtaagattagtaatgaaacactccaaacgctgctgcatgatctggatttgcttgaagcgttacttgtggttaaagatcaataa

SEQ ID NO: 2994 - DNA, 1347 bp, Xenorhabdus bovienii
  Coding DNA location: Contig name=SeqID_16887; Position on contig =44361..45707bp; Strand=-
atgtctggcatgcaggcaccaactcaatgcaaactcgataagtattttaagattactgaacgcggaacgacggtacgtcaggaaattttggctggattgacgacatttctggcgatggtctattccgttatcgttgtgccgggcatgctggggcaagccggatttcctcatacagcggtctttatttctgtatgtttggtaacgggtattggctcactattgatgggattgtgggttaacctgccgatggcgattggctgtgcaatctcgctgaccgcatttacagcgttcagtctggttttaggccagcaggtgagtattcccgtggcgctgggtgccgttttcctgatgggatgcctgtttacggtgatttcagtgacggggattcggtcttggatcttacgcaatatgccaatgggaattgctcatggaaccggtattggtatcgggttgtttctgttgctgattgcggcaaatggtgtggggatggtgattaaaaaccctcatgccggtttaccggttgcttttggctcattgactgcatttcccgtgataatggcactattaggtctggcggcgattattggtctggaaaggaagaaagtacccggtggtattttgttggtgattatcgtcatctcaattattggcctgattttcgatcccgcagtgaaatatcaaggattttttaaactgccaacgctgggagaagatgggctgtctctgatgtttagcatggatattatgggggctttgcagccgatggtgttgccaagtgtcttggcgttggtgatgaccgcgatatttgatgctacagggacaattcgagccgtagcagggcaagctaatctgctggataaaggtggtcagattatcaatggaggcaaagcgctgacggctgattccgtaagcagtatctttgcaggcgcgataggttcttctcccgccgctgtctatattgaatccgctgcggggactgccgccggaggcaagacgggcttaaccgctacggtggttggtattctgttcctgctgattttattcctttctccgttgtcgtacctggttccggcctatgctacggctcccgctttgatgtatgttgggctactgatgttgagcaacgtgcggaagctgaatttcgatgattctgtcgaggctatgtcaggattactgtgtgcggtgtttattgtactgacttgtaatatcgtcaccggcatcatgctagggttcagtgctttggttgtcgggcgagttttctctggtgaatggcgtaagctgaatatcggtacggtgattattgctatcgtgctagtgatattttatgccggaaattgggctatctaa

SEQ ID NO: 2995 - DNA, 120 bp, Xenorhabdus bovienii
  Coding DNA location: Contig name=SeqID_16887; Position on contig =45931..46050bp; Strand=+
ttgttgtgggtaatctccgtatgtacggagaacacaccaatgttggcgtgctgcctccacctccgcccggtttatctccgtatgtacggagaacacactaaaagtatctatttgttttaa

SEQ ID NO: 2996 - DNA, 1695 bp, Xenorhabdus bovienii
  Coding DNA location: Contig name=SeqID_16887; Position on contig =46756..48450bp; Strand=+
atgaataacattcatagattttctaacacagatatcaaggcattattcctatttgtagcattcatgttactttatctattaccgggaatttatagtcatactccttggaaacaggatgaaaattatagttttggtatgatccagacaatgtatgaaacaggtaattggctagtccccatcaatgccggtgaacctttcatggaaaagccaccgctatattattggacagccactacatttactcatttattgtctcaatggctgcctatatatgacgccgcaagaacagccactttatttttctccataattaatttttcattcttcattctgctggctcgccgggcatttgatgtacataatttcaccaatagtcgcatatggatcgcctttgcactgtatgcctgtgcccctgggatcgttcgtcatagccacgatatgttcaccgataccgctttgattacaggcacgacgattgggttatatggtttattggggttgattaaaaacgaaaaaaaacgctattccatattatggctggctattggcacagctatcacaatgttatcaaaaggggtgttcatccctgggttattatggatttgcctgctattaacaccggtttttctaaaaaattgtcgggctaaacaatattggctaaatgtttttttcgcggggataattgctctcattttaattttaccgtggccagttatgttattaattgaacacccagacttatttaaagtttggtttttggataacaatatcggccgcttcttagggttttctgttgaagatttaggtgcaagagctgatccaagccgaattccagaagctgtgttattattctcatttccagcaggcctattagcctttatctttattattaaaaacccgataaaaacccttaccaatcaacgttattttattttttcagcatttatattactcggtatcatcttgttacaaatatcagcctccagccgtgcgttgtacttgttaccctttattgccccgatggctatcttagcaacgggcatttttactcaattacccgagaaaatttacagcgctctgagtctctgtttttcaatgctatggtctattctgattctctttgtatgggcaacttattttctatcactctcttctgattacaaacattggttggcacctttaggaaaatggctgccaatgagttatcagatgcacttttccggttttatattcaccagtgccgttattatcaccattatctggctagctaagagcagaatattgtctaaatctcccgccttacgtaccgcacaaaactggaccttagggattgctgttgtttggggattggtatttaccttgtttatcggctggattgattataccaaaggctataaagaagtatttaccgatcttaaacagcatttagcaggagaatataaagccgatgattgcatgtcatcttattttatcggcgaatcagaagcgccaatgctttattacttcgcccatatccttcatcaaagacagaaagattttgctgctccacaaacatgtcgctggcttatcatgttatccgaagatattgaacccgctccgacaggtatgacgttgttttggtctggacaccgaccgaatgataaaaataaaaatttagtggtgtataaaaaagtgatgcctgaaatggctaaatga

SEQ ID NO: 2997 - DNA, 138 bp, Xenorhabdus bovienii
  Coding DNA location: Contig name=SeqID_16887; Position on contig =48476..48613bp; Strand=+
atgaacgcatcattaagcatgccaaaaaggaaaacgaggagcgtcttctacaggcgcatcccagaacaggtaaactttccattaggaacgccaaagaaaaataaattctgcgcgttagctcaaaaccttttgctgtaa

SEQ ID NO: 2998 - DNA, 1257 bp, Xenorhabdus bovienii
  Coding DNA location: Contig name=SeqID_16887; Position on contig =48700..49956bp; Strand=+
atgaatacttctttcacctctacagtttttcctgatgattaccgacaaaaaattcgccagatgaaacaagccatgcgcgaacagataggcgatgttgaaggcctgttcgctcaggtatgcgacaaaatagaaaaagagatcgccgccgcccgtgtggatgaaaaaaacatcggtagtgcctggccggaaatacactggagtgatgtggcggaacgcaaagtcacagaacaaaccctacagaagattaaacgtcgtggatgtttggtcgtcagacagaactttccacgagataaagcactggcatgggatcagtccatgcttgattacctcgatatcaataacttcgatcgcgtttatcaagggccgggagataacttcttcgatagccttgaagcatctcgcccagagatttaccccatttactggtctcattcgcagatggaagccagacaaagtgaagaaattgcgcgggtacagtcttttctaaaccgtttgtggaaatttgagtcaaacggcgtaagttggtttgatccgaatatcaacatgatttatcccgaccgcattcgccgccggccaccgggtacaacatcaaaaggactaggcgctcatacagactcgggtactttagagcgctggctgcaacccacctaccaaaaagtgttcaataaaattttcaccaaccgattcgaagaatacgatccttgggatgcagcctaccgtccagaagtgaccgagtacgataatacaacaaaatgttcagtttttcggacatttcagggctggacggcgctgtcttatatgaccctcggtcaaggactcctgcatgttgttcctgtgccagaagcgatggcatacattctgttacggccactgctgaatgatgtccccgaagacggactgtgtggtgttgcccccaataaggctcttcctatctccgagaaatggcatcctcatcttgtccaaggattgtgtagtattccatcattgcaggctggtgattctgtatggtggcactgtgatcttatccactccgttgctcctgtggaaaatcagcaaggctggggcaatgtgatgtatatcccggcggtgccgctgtgtgacagaaatctggcttatgctcaccacgttgcagatgctcttgaacatggcacatctccggcctattttcccaaagaacactatgaaaagaactggaaaggtcgttttacggctgctgatttgaacatcatcggcttgcgtggtcttgggttgaattga

SEQ ID NO: 2999 - DNA, 144 bp, Xenorhabdus bovienii
  Coding DNA location: Contig name=SeqID_16887; Position on contig =50010..50153bp; Strand=+
ttgcgaaattttcttaaaacgctaacccgttttccttgcacctgcggggccgttattttggcgctcagaatctggtgtattcagaactcgctttggggccaatattgtaagggatcttctgacgctattccggcaaatagataa

SEQ ID NO: 3000 - DNA, 978 bp, Xenorhabdus bovienii
  Coding DNA location: Contig name=SeqID_16887; Position on contig =50160..51137bp; Strand=-
atgaaaatagcatttgtcttatatgataaagcgttacaaagcgggataacgttagcatcggatatgttaaacagtgccagcagcttgagaagctgggtacagcagagagaagaacccttctatatgtctgttattggtgatgcgaaggaaaataacgaacacatagcgcagattacgctacatacccaccataaattttcggatcctgtcgattttgatttggtttttttacctccgatgtggggaaatccgtcaccttctatggctggcagggaagatattctcgaatggttgcgtcggcaaaaagaaaatcaagctattattgttgcgactggcaccggggtatattggctggcgaaagcgggattgcttgaagaaaaaacagtaacaactcattggtctttctatggcaagtttgaacgtcagtttccgacggttggtctaaatcgtaaggcaagtatcacctattgtgacaacatttattgtgtgagaagcattaactcccaaaccgaactacttgtttacttgatcgcccagtttttcagtgcaccgattgctaagatcattgaaaaacatttcatgcatgaagtatcaaattttcagtcagagccgttttttcaagtgggaggcaacacgcaatttgatgaaatggtgtcgatagcacaaagctatattaagcagcatgtgacttcacaaatcacgatcaaggacattgctactcatgttggtgtgtcggagagcaccctgatacgtaggtttaaggggcaggtaggcatctcaccgcataagtacatgctcgatcagcgtttattaattgccaaacagcttctgcaagataatagcctgactttactgtatatagcgcaattagtgggctttaaggatcctcattactttagtaaagtatttgagcaacactttaaactgactcccgttgcttaccgtaagctggtgaaagccaaagttttccatgcctga

SEQ ID NO: 3001 - DNA, 123 bp, Xenorhabdus bovienii
  Coding DNA location: Contig name=SeqID_16887; Position on contig =51080..51202bp; Strand=+
atgctaacgttatcccgctttgtaacgctttatcatataagacaaatgctattttcattccttttctccagaattgtgcgcacctcttttttatatcaccaccaatatttagcttcgagatag

SEQ ID NO: 3002 - DNA, 354 bp, Xenorhabdus bovienii
  Coding DNA location: Contig name=SeqID_16887; Position on contig =51284..51637bp; Strand=-
atgccggtcagaattattattacaagcggtaccacagcagattgttcacaagctgagaccttaattaaaggactcgatgcagagcatctattggcggacaggggctatgatagcaacgcaatagtagaaaaagcagaacaacaaggcatgcaagtccagatccctagccggaaaaatcggaaggccgccagagaatatgatcgtgagctctatcggcttcgccatttggttgaaaatgctttccttcatcttaagcgctggcgtggtatagccactcgctatgcaaaaaatagcgcgtcttttcttgccgcagtgcaaatccgttgccttgttctttggctgaaagtctcatga

SEQ ID NO: 3003 - DNA, 477 bp, Xenorhabdus bovienii
  Coding DNA location: Contig name=SeqID_16887; Position on contig =51574..52050bp; Strand=-
atgagtacacctgcacaccgccgccacgatatttcagatcgcgtctggagcctgcttgaacctcatttgccaggacgtcaaggcgcttgggggcgtgtagctgaagataatcggcgttttatcaatggggtgttttggattttacggacgggtgcgccttggcgagacctacatactgattatggtgactggaaaaatacccaccgccgtttttgtcgctggagagataaagggatatgggaaaaactgctcgaacaattggttaatgaccccgatttcgagtggttaatgattgatgccagccatattaaggttcatcccgatgcggcaggcgctaaagggggtaatcaggatatggggctcacaaaagggggctcaataccaagatacatttggccgtggatgcgcatggtatgccggtcagaattattattacaagcggtaccacagcagattgttcacaagctgagaccttaa

SEQ ID NO: 3004 - DNA, 114 bp, Xenorhabdus bovienii
  Coding DNA location: Contig name=SeqID_16887; Position on contig =52041..52154bp; Strand=+
gtgtactcatggttaatcaactcttatgatggaatggtggggcattattattgcacgaattttttcatgacgacaccatctagacttcaagaaaaatcttttcggagttcgtaa

SEQ ID NO: 3005 - DNA, 1677 bp, Xenorhabdus bovienii
  Coding DNA location: Contig name=SeqID_16887; Position on contig =52154..53830bp; Strand=+
atgagtaatttacccgtaattgttggtttgggtggtatcaatgcggccggaagaagttctggattccacagctataaacgcatcgtgtcagacagtctcagcgacgagatcatgcaagatacatggctcgatttatgtcatcgaatgggcattgttaaaaatacagcatcggttacaggcgcccatatcgagagtgccaaaaacggcacactgatcagaaaaataacgcacttcgacacgcaaaaagtatcttctgtaaccagtgcgggtcagttgccggaaggatttgaagttggtgatttatataatgcaaaccatcatccgcgcggtttacgtctgacagtctatggagcctcggatttactcagttcaattggcatttcatggccagatatcgccaaattggtggaacccgatcaaatttctgtttatgccagtagcgctctgggtcagatagaccgattttcattggcaggcttaatcggcaacccacagaatggcacacgcattagttccaaaatgctagcgctttcccttgctgacatgccggcaaattttattaatagctacattatcaacagcatcggcaacacatcagctaatctaggtgcctgtgcaagctttctgtataacctcaaacaaggcgtcaatgatatcaaacaaggtaaggcaaaaatcagtttagtcggatgctctgaagcagctatcgtccctgaaattatcgaagggtttcgagttatgggcgctctcgcagaagaccatcaactatgtaaactggatggaaccgatatcgttaacaaccgccgtgctacccgaccattttcaactaatgttggatttaccattgccgaatctgcgcaattcgtattactcatgagtgacgatcttgctttacagtgtggcgccaacatccttggcgctgtgcctgatgttttcgttaatgcggatgccaataaaaaatcaatatcctcacccggaattggtaactacattaccatgatgaaagcagcttccctcgctgaccatctgctggatggtaaattgcagtattcttacgttcaggcgcatggtactggaacaccacagaacagagtcactgaaagtcatatcattaatgaagttgccaaagtttttggactcaattgctgggatgtcaccgccataaaatcgtatgtaggacattccattgccgcctctgcgggcgatcaattagcctgtacattgggggtttggcagtacggatggatccctggtattaaaaccatcgatcacattgccgaggatgtacatgcaacaaatctgaatatcttgatgcagaataagtttgcaggcgagcacggtgaggagatgcgtgccacaatcatcaataccaaaggattcggtggcaataacgccagtgcagttattttatctccacagcaaaccatgcagatgctgaacaaaaaacacggtagctccgcggtctacacatatcatcagcgtaatcaaattgttaaacgtataagtgaagatcaggatcgagcaatttgtcgtggtgaagaatcggttgtttacaatttcggcaacgcagtgatgcaatcatcagatataaaactttcacgtcaggaagtgaaattatcaggatttaaacactctataaagctgccgaatgcagaggaattcagcgcattcttgtga

SEQ ID NO: 3006 - DNA, 96 bp, Xenorhabdus bovienii
  Coding DNA location: Contig name=SeqID_16887; Position on contig =53802..53897bp; Strand=+
atgcagaggaattcagcgcattcttgtgagaaagccatagggaatagccaagtacagtgcagtattcaagcgttattttatggctttactgcctga

SEQ ID NO: 3007 - DNA, 306 bp, Xenorhabdus bovienii
  Coding DNA location: Contig name=SeqID_16887; Position on contig =54003..54308bp; Strand=-
ttgattttcctgacccgagtgagaacacgttttttctcttctggcgagtggggcataaacaagcatctcctagatagtgggggggagtatagttggatgctggggggatgtatatggcttgttgtgatagatggagttagatcgcactattggaattacttccatcataggattggaaattcatttgcattatttataagacaaagtttctgtctcctaataaagcaacttatttgggactttatggataaacatgaaaaatggcatttgatggattatctcatgctaaaacagtggattggttaa

SEQ ID NO: 3008 - DNA, 276 bp, Xenorhabdus bovienii
  Coding DNA location: Contig name=SeqID_16887; Position on contig =54253..54528bp; Strand=+
atgccccactcgccagaagagaaaaaacgtgttctcactcgggtcaggaaaatcaaaggccagattgaagccctagaatccgcccttcaacaacaggctgactgcggccctgtgttacagcaaattgccgctattcgtggtgccgtcaatggactaatggctggtgtccttgaaagccatttacgtgaagagctgacaaataccgagcaaacaccagaagcacagaaagcctcgatcgaagatgccgtttctctgatccgaacttatcttcgctga

SEQ ID NO: 3009 - DNA, 1110 bp, Xenorhabdus bovienii
  Coding DNA location: Contig name=SeqID_16887; Position on contig =54596..55705bp; Strand=+
atgaaatcacgagccgctgttgcattcgggccgggccagccccttgaaattgttgaaattgatgttgcaccgcctcaggccggagaagttctggttaaaatcagccataccggtgtgtgtcatacagatgccttcaccctgtcaggggatgatccggaaggcgtatttcccgccatactcgggcatgaaggcgcaggcgtagtcgttgaggtgggtgaaggcgtcaccagcgtcaaacccggtgatcatgttatccctctttataccgcagaatgcggagaatgcctgttctgcaaatccggaaaaaccaacctgtgtgtcgccgtacgggcaactcaaggaaaaggtgtcatgcccgatggcacaacccgcttttcttacaacgggcagcctatttatcactatatgggatgctcaacattcagcgaatacaccgttgtcgccgaagtatcactggcaaaaatcaatccagaagccaaccatgaagaagtgtgtctgctgggttgcggtgtcactaccggcattggcgctgtgcacaataccgcgaaagtgcaatccggtgattcagttgctgtttttggactcggcggtattggcctcgccgtgatccaaggcgctcgtcaggcaaaagcgggcagaatatttgccatcgataccaattcagcaaaatttgaactggctaaacagttcggtgcaaccgactgcctgaacccgaatgattacgacaagcctattcagcaggtcattatcgagatgacagaatggggagtggatcataccttcgagtgtattggtaacatcaatgtcatgcgtgccgcgctcgaaagtgctcaccggggctgggggcaatcagtgattattggtgtagccggtgccggacaggaaatttccacccgaccattccaactggtcaccggccgttcatggcgcggtacggcctttggcggagtgaaaggccgcagtcagttgcctaaaatggtggaagaggcgatgaaaggtgaaattgagttaaaaccttttgtgacccacaccttgccgctcgaacgcatcaatgaagccttcgatctgatgcatgagggaaaatccatacgcaccgtcattcattactaa

SEQ ID NO: 3010 - DNA, 867 bp, Xenorhabdus bovienii
  Coding DNA location: Contig name=SeqID_16887; Position on contig =55754..56620bp; Strand=+
atgttttacagagaggaaaaaatggagaggattgaacgccgcgcttgttttgggggatggcaggatgtttatcagcacgattcagccgtgcttggctgtaccatgaattttgctgtctatcttcctcctcaagctgaacatcagaaattaccggtgctgtactggctctcaggcctaacatgcaatgaacaaaatttcatcactaaagcgggcgctcaacgctatgctgccgaacagggtattatctttgtcgctccagataccagccctcgtggtgagaacgttgcggataatgatgcttatgatttgggtcagggcgctggtttttacctcaatgcaacacaagagccttgggtgccgcactatcgcatgtacgagtatgtggtatcagagttaccagccttgatcgaaacacattttccagtaacagagaatcgcgctattagcggccactctatggggggtcatggcgcactgacaatcgcgctacgcaatccggatcgttatcacagtgtatcggcattctcgcccattgttgccccctctcaagttccttggggagaaaaagcttttcgtgcttatctgggtgatgatcgtgacacatggaaagcctatgataccatcgagctgattgctaatagcgctaagcccttacatttgttgattgatatcggtattgatgatccgtttcttgcagaacagttacgccctgaattgctgaaagaagtatgcgaaaaggccgggcagccttatacactgaatctgcgcacgggttatgatcatagctactactttgtcgccagttttatcggtgagcatatcgcatatcatgctgaggtattgaagggctgttgtgctgataattga

SEQ ID NO: 3011 - DNA, 981 bp, Xenorhabdus bovienii
  Coding DNA location: Contig name=SeqID_16887; Position on contig =56685..57665bp; Strand=-
atgacaagagtggcgattgcatcgttaggaatttggcatcctccaacttcggttgataataattggtttatagaacactatgccgcccaaggcattgatatgagtggtttgctgaatgcgcttggccataaaaatcgttacctgatccgtgattcatctgatacaacactcacgatgtcagttgcggcatctaatgatgctattcagcggctgggatgtcaggctaaggatttagacttcatcgtgtttgcttcacaaacgccagaatatctcattccttcaacggcgctcaaaatacatcatgctattggaggcggagaaagggctctggcatttgacatgaatgccaattgtgcggggttattagttgcggtagaaatggtttccagggcgatgatggcaaatccgtcatgccagcttgcactggttgtaggcagcgattatcttggggctcacagcagtaatgcacccgtctaccactcatgtttttcagagtctgctgtagcggtaattcttcataaaactgaacagggcaatggttttatagactcagaatttcgtatacaaacctcagtaatcgataattcacttttccctgcatgtggattatcaaatattcaccggcatgatgtttccgcacaagtcaaattcaccccctttgatgatgatatttgtattaccgccgcatccgaatctatccaattgttactttcacgacataatttagttcctgctgatattaagggatttatgttttcacaattttctgtaagtaacattcgacgactctgtgaagaacttggtgtggatcaggataaggcattatttattggtgatgagtatggttacactgcgaccaatagtccatttgttgcactttatgaaacgttggaaagaaaaaaaattgtccgtggtgatttcctgattttctggacgattggtgctggttggcaaagtatcgctgtattaatgcaatattaa

SEQ ID NO: 3012 - DNA, 117 bp, Xenorhabdus bovienii
  Coding DNA location: Contig name=SeqID_16887; Position on contig =57610..57726bp; Strand=-
atgaagctattcagtataaatcaggcatttccaatgactacgattataaataggagcaatgatgacaagagtggcgattgcatcgttaggaatttggcatcctccaacttcggttga

SEQ ID NO: 3013 - DNA, 1032 bp, Xenorhabdus bovienii
  Coding DNA location: Contig name=SeqID_16887; Position on contig =57782..58813bp; Strand=-
atgcgaaataacgtctcaattatttcggcggcaggtatcctgccaccggaaaaaattattattcacccagaggataatatacgtaatgaattcagcgcacccggtgaacagcagttatctcgatcacgtactttatggcgtttagagcataaaaaagatttaattgaattaatgaaagtaagtttgttagcagcagtaaaacaggtacagatggatatttcagatattgattatctgattcttagccaggtatggtctgataacattttgggcgatgaggccggacgactggccagagaactaaagctatcttgcccggtggtgtcaatcaatgtcggaacaagtggtggtgcaactggactggaaatcgccactgctatgtttgctaactctgaatttcataacattgctgttattgctgggtgtaattattcgcattggttctcaatgagcgatcccgcgagaactttgttaagcgatggtgctgcatgcttagtacttagccgaaaacaaggtatgacagtggctggttgccatactttgagtactgcacattacgatgtattgcaatttaatgaagtacctgaacgttatgtctactataaaccgaaggggggtgaatatatatttaataatatgaaggagacgatttaccagtgctgcaataaagtgtgtcaatcaaacggaattagtctaaatgaggtcagcgctttttacgtctatgacccgagcgattgggttgccagtgcagctgcagaagcgttgggcgtagggaaagataaaattatctctatttttcacaaatatggaagcttggggccagcgcagagctttttcggttttatggaaatgcaggataataaaaatttgactgactctgactgggtaattgttatgggaatggggccttcgaccactgcgactgctgttctatttcgatggcagcacatttcttgcaatgtatattgttatgatcataagacacagctaagtaatccaatgttacctagtagtgtaactcaaaatatttaa

SEQ ID NO: 3014 - DNA, 1698 bp, Xenorhabdus bovienii
  Coding DNA location: Contig name=SeqID_16887; Position on contig =58803..60500bp; Strand=-
atgtcagttaatattgcgaaaactttagttaaattgcttgaggattgtgaggttaaagcggcatttggggtttccggggggtttattgcacctatatggcaggcattaacggaatcagaaaaaataaaaatatttcactgtaggcatgagtcgggaggcgctttttctgcatctgaattcagtttgtgtcagcaggttccagccgtagcttttgccacagcggggccgggaataagtaatgcattaactgggttaagagcagcaaagttagatggtgcaaaggtcattttcatctcatcaatcacgtctgttaccccttcagggaagtggaacttgcaggagactacagtacaagatatagatggactgtgtctcccggatggacacggttattttgatgaaatcattatcataaaccaaaaggatgattactttgacgtcgagaaaaaattaaggaaagggttaaataagaaagacggttacgtggttggtatatttttgacagcaaaagtgcagcaagaaatcatcaattatgaaaatgatgaggtgctttccttatctcatgacgatttagacgaaaatgcgaaacgccattcacaggaaatagccgatttgctcgtcaatgaaaatgctgttttttgggcaggatttggtgctcggcatgcttctgcgttgttgacacagattgctgtaaaaacaaattcacgggtcatatctactccgcgggggaaagggatctttaatgaaaaacatagcctttatgccggaaccagcggtttaggatcggatacagaaagtatttataaaacattacattgtccgttattgtcagctgttatcatcatgggaagcagattgggtgagctgagttcatcctatgcccaaaataaccttgagaaggttaaagtttattatataggtctaaatgcacaggaaattaaagggaatctgcccccgcatactgttctcattgacagcgatattgaaacatttctcacttctattgatgcctgcatggctgagaaagtaatacctcccagtcatattaaagccatctcagcgccacatgacagtcataaatgctattcagatgccgcaaaagatgtgatccatccgcttgatgtgatgagtgtggttcaggaaatagctatcgatatgttcgattgttatgttgcttcagaagcgggaaattcctttgtctggactaatcgctacctgaagttttcgaatccattgagatatcgtataagtacagcctatggtgctatggggcactatgcttgcgggttggtagggcttgctgcatcaaaagaacgctgtgcaatcggtatcataggtgacggctcaatcctgatgtcgaatgaagtaagcacggcagtcagattcggattacctgctatctggcttgtgatgaatgatgccggttacaatatgtgtaggcaggggcaggagctattgggttatccgccacttgactgcagtatacctcaagttgacttcgctttatttggacagtctattggagcgacaggttataacgtaaggaataaaaaagaattacgtgaagcccttattcatgcaattgaagaaaagaaacctgccgtaattaatgcatttattgataaatatgagatccctcctctcggtgatagagttgaaactttcaggaaattaaaggaggagttggatgcgaaataa

SEQ ID NO: 3015 - DNA, 162 bp, Xenorhabdus bovienii
  Coding DNA location: Contig name=SeqID_16887; Position on contig =61045..61206bp; Strand=+
atgagcttaatcactgagcgatctatcactcgggttctcaccgaggacaataatttattatgggaagtttcagtcaccatccacatgacaccatctttacgccggagggggtattcagttaagaataaaaaaacccagcatatttgctgggttatgaattaa

SEQ ID NO: 3016 - DNA, 525 bp, Xenorhabdus bovienii
  Coding DNA location: Contig name=SeqID_16887; Position on contig =61257..61781bp; Strand=-
atggccagcagaggcgtaaacaaagttattttagtgggtaatttggggcaggacccggaagttcgctatatgccgaatggcggtgcagtcgccaacattactctagcaacgtctgagagctggcgtgacaagcaaaccggtgagatgagagagaaaaccgagtggcaccgcgtggtgatcttcggcaaactggcagaggtcgctggtgaatatctgcgcaaaggctctcaggtttatatcgaaggctctttgcagactcgcaaatggcaggatcagggcggtcaagaacgttacactactgaagttgtggtaaatattggtggctcaatgcagatgctgggcggtcgcggcggcgcgtcacaagatgctccagcgcaaggcggtaattgggggcagcctcagcagccacaggcttctcagcaattcagtggtggtggtcaaccatctccatctcgtccggcacagtctccagctccacagagcaacgagccgccaatggactttgatgatgatattcctttttga

SEQ ID NO: 3017 - DNA, 2832 bp, Xenorhabdus bovienii
  Coding DNA location: Contig name=SeqID_16887; Position on contig =62032..64863bp; Strand=+
atggataacatcgaagttcggggcgcccgcacccataatctcaagaatatcaatctgataattccccgtgacaaactgatagtcattacagggctatctggctccggtaagtcgtccctggctttcgatacattatatgcagaaggtcaacgtcgttatgtggaatcactctctgcctatgcccgccagtttttgtctctaatggaaaaaccggatgttgatcatatcgaaggcctctctcccgccatttccattgaacagaaatcgacttcccataacccacgttcaactgtcgggacgattaccgaaattcacgattatctccgcctgctgtttgcacgcgtgggtgaaccgcgttgccccgatcatgatattccgctagctgcccaaactatcagccaaatggtagataatgtgctggtattaccagaaggccagcgtctgatgctgctggctcctgtcgtcaaagaacgcaaaggggagcacaccaagctgctggataacctcgccgcacaaggttacatccgcgcccgtattgatggagaagtgtgtgacctgtctgacccaccaaaacttgaattacaaaaaaaacacactattgaagtggtcgtcgatcgcttcaaagtccgtgccgatctggctcaacgactggcggaatcattcgaaaccgcgttagaactttccggcggaacggctgttattgccaatatggatgacgagcaggctgaggagttaatcttctccgctaattttgcctgttccatctgtggttacagtatgagcgaactggagccgcgcctgttttccttcaacaatcccgcgggcgcctgccctacttgtgacggtttgggcgttcagcaatttttcgatcctgagcgagttatccagaatggcgatatttctctcgcgggtggtgcgatccgaggttgggatcgccgtaatttctattacttccagatgcttaagtcattgtcagaccactataaatttgatatcgaagttccattcaatgacttagacccagccatcagaaaaacagttttatacggttcagacaaagaatccatcgagttcaaatacaccaatgatcggggcgataccacggttcgccatcatccgtttgaaggtgtgttgcataatatggagcgccgctataaagagacagaatccaccgcagtgcgggaagaactggcaaaatatatcagtaaccgttcctgcatctcctgtgacggaacccggctgcgcaaagaagcgcgttatgtctttatcgaaagcaccacactgccgcaaatctccgagttcagtatcggtcatgcgatggcgtttttccaaaatatcaaactgagtgggcagcgcgcccaaattgctgaaaaaatcctgaaagagatccgagaccgcctgaaatttctggtgaatgtcggcttgaattatctaaccctttcccggtcagcggaaaccctttccggcggtgaagcacagcgtatccggctggccagccagattggagcgggtctagttggcgtcatgtatgtactggatgagccatctattggcctgcatcaacgtgataatgaacgtttgttagaaaccttgctgcatctgcgcaatttggggaataccgtcatcgtggttgaacatgatgaagatgccattcgtgcggctgatcatgttattgatatcgggccgggagccggtgtgcatggcggcagaattgttgccgaagggactattgaagatatcatgactaacaaggagtctctcactgggaaattcctgagcggtaaatgtaaaattgcgatccctgagcagcgtgttcctgccaatcccgacaaaatactggaattaattggcgccaagggcaataacctgaaaaaagtgacattaaaactgcctgtcggcttgttcacttgtgttacaggtgtttcaggttccggaaaatcgactctgatcaacgatacactattcccaatcgcgcaacgtcagttaaatggagcgaccaatattaatccagcgccttaccttgatgttcaagggctggagcattttgataaggttatcgatatcgaccaaagtccgatcggtagaacgccccgctccaaccctgccacttatactggtgtgtttacgccagtgagggagttattttctggcgtgcctgaatcccgcgcccgtggctatacgccgggacgtttcagtttcaacgtcaagggtgggcgctgtgaagcgtgtcagggtgatggcgtgattaaggttgaaatgcacttcctgcccgatgtttatgtgccttgcgatcactgtaagagtaagcgctataaccgcgaaaccttggaaatcaaatataagggcaaaaatatcaatgaagtgctgaatatgaccattgaagaagcccgtgagttttttgatgcggttcctgctctcgcccgaaaactgcaaaccttgatggatgtcggtctttcctatattcgtctggggcaatcggctaccacgctctcaggtggagaagcccaacgggtcaagctgtcacgcgaattatccaaacgtggtacaggccagacgctgtatattcttgatgaaccaacaactggcctgcatttcgccgatattcagcaattgctgtctgtcctgcatcaattacgggatcagggaaatactatcgtggtgattgagcataatctggatgttatcaaaaccgctgactggattgtcgatcttggccctgaaggtggcaacggtggcggtgaaatattagtgtcaggaacaccagaagaagtggctcaatgtgaagaatcccatacggcacggtttctgaaaccgatacttgagcgtcaataa

SEQ ID NO: 3018 - DNA, 108 bp, Xenorhabdus bovienii
  Coding DNA location: Contig name=SeqID_16887; Position on contig =64870..64977bp; Strand=-
atgattgtaggaaatgccctttattgcatggggaaaaataaaattggtcaacaaatgggcataactccccacagagtggggagaatatttgtttatgtgagatgttaa

SEQ ID NO: 3019 - DNA, 135 bp, Xenorhabdus bovienii
  Coding DNA location: Contig name=SeqID_16887; Position on contig =65093..65227bp; Strand=+
atggagattcaacatgtatatgtttttacctttcttaattgcgttagttatcattgccacggttattatcggcaagaaaaaactgacttacattctttggtttgcattattaatcatcacggtattttggtttaa

SEQ ID NO: 3020 - DNA, 567 bp, Xenorhabdus bovienii
  Coding DNA location: Contig name=SeqID_16887; Position on contig =65277..65843bp; Strand=+
atgaataatacaatgtcagcatcccgcagtcttaatcctgcaatggtcttgaatatcctgggtctattcggcatcagtgtcgttttgataatcgcgttctattatcaattggcacgttttgaacttccctgcccattatgtctgttgcaacgtgcaggtatcatcatgattggcttaggttttctattcaatatttatttcggtattaaaaatgctcactacagtctatctttgcttggctgtctcgtgaccggttttatcgctatgcgtcaagtctctctacatatcctgccgggagatacaggatatggctccaccttcttaggcttacatttttatacttgggccgcagtcttatctattcttaccattattgccatcgctgtcattatgcctctgaaagcaggcaacaccgattcatcaaggtacacaccgcccacattaggcaaaatagccatggggctgtttgcgtttttgatcgcagccaatctggtttctactgtgctggagtgtggtagcgggcagtgtgatgataacccaacattttatcagctactgaaaaagtaa

SEQ ID NO: 3021 - DNA, 1182 bp, Xenorhabdus bovienii
  Coding DNA location: Contig name=SeqID_16887; Position on contig =66061..67242bp; Strand=+
atggaagatttcccaatgatgaaaaaatttgtaatcaatactttggtttttgccacaatcggaacctcttcgttttatgcctcagcacaaaaaacactgacggcgcaacaggtcgcagagattgtcaataatacgcttacaccgctgctcgaaaaacaggatattcccggtatggctgtcgctgtgatttatgacggaaagccgcaattttttaactatggcgtggcggatataaaaactcgacgcccgataacggaaaataccctgtttgaactgggctcggtcagcaagacctttaccgggatcgccgggggatatgccatgcaaaccgataccctaaaccttaatgatccggtgacggcgtacagttctgagctaacgggcagtcagtggcggggggttaaaatgttgcatctggcgacgtacactgcgggggggcttcctcttcagctcccagattcggtcacggaccagaagtcattgtggcagtactaccaacaatggcagccactgtgggcacccgggatgatgcgtaattactccaatgccagcattggcttattcggtgcgctgacggcgaataaaagccagttgacatttgaaacctatatgacgaagtatgttttcctgcctttaaaactgacgcatacttttataaccgtcccggaatcgatgcagtcagattacgcgtggggatataagaatggccagccggtgcgcgtcacaccgggcatgttgagttcagaagcctacggggtaaaatctaccacgcaagatatggtgaaatatatgcaggccaatatggctccggacagcttgcctgccgataacgataaattaaagaaggccatcctcgcggcccagtctcgttattaccgagcgggaaacatgtttcaggggctgggatgggaaatgcataactggcctatcaatccgcagagggtgattgccgacagcggcaatgacatcgccttgcagccgcttaaggttgaggaactgataccgccacgctctgccgtaccggcatcctgggtgcataagaccggcggtaccgacggctttggggcttatattgctttcatcccggaggagaagattggcattgtgatgttggctaacaagaactatccaaatcctgtccgcgtggaagctgcatatcatattcttaaggcattgcgttga

SEQ ID NO: 3022 - DNA, 174 bp, Xenorhabdus bovienii
  Coding DNA location: Contig name=SeqID_16887; Position on contig =67253..67426bp; Strand=+
gtgccggataagtgcggtctggtaacaggctgcgcttatccgactgtagaagaccccctcctgtctccgctaagttgggagcatatcaatttgaccggggtttatgtgtggcgtagtcgtgctaggattagggctggaaaattcaggccactgcgtcaactaaaactggcttag

SEQ ID NO: 3023 - DNA, 117 bp, Xenorhabdus bovienii
  Coding DNA location: Contig name=SeqID_16887; Position on contig =67395..67511bp; Strand=-
gtgcctgaggcacgatcaaagtttttgtcaaagaaaacaaaatcgtggaggccctcaggcaatgattacgtttccctttcattcgctaagccagttttagttgacgcagtggcctga

SEQ ID NO: 3024 - DNA, 1140 bp, Xenorhabdus bovienii
  Coding DNA location: Contig name=SeqID_16887; Position on contig =67526..68665bp; Strand=-
atgagttgggtattcagtaaaaataaatcgtgggataatttatcagcaacatactcttttattgctgatatgcacggagttcagcaagatcccattcatcatgccgaaggggatcttgctattcatactcaaatggttttggcggcattggtgcaattgccggaatatcaaaagttgacgccagaagagcaggaaattctctggacggcggcgctattgcatgatgtggaaaagcgcagcacaacgcgggttgactgggatggtcggattgtttcccctggccatgcccgcaaaggtgaaatgactgccagacagattctgtttcagcaaattcccacaccgtttgaaattcgggaacagatcgcagcccttgtgcgctttcatgggttgccattgtggttgatggaaagacctgatccccaaaaggcgctattggcggcttcattgcgtgtcgacacccacttgctggttttattggcaaaagcggatgttctggggcgaacatgtcatgatgcgcaagagttactagagcgtatcgaactgtttgaactttattgtcgtgagcagaattgctggcgtaatccccggtcatttccttcaggagaagcccgtttccattatttttctacagagagcaaacaaccggattatcaaccttacgatgactatggcagtcaggtgattttgttgtgtggattgccaggtatgggaaaagatcattttatccagcagtattatgcaggtatgcctgtaatcagcttggatgctattcgtcgggagaatcagataagtcctgaagataaagacgctaatggctgggttgtgcagcaggtaaaacagcaggccagagaaaagttacgcagtcagcagagttttatttggaatgccactaaccttacaggacaaatacgtcagcagttgatcaagttgtttatcagctacaacgctagagtccgaattgtttacattgaacaagattataagcgttggcggcaacagaacagcaatcgtcaatatattgtgccagataaagtcatggataggatgctttgtaagctggaagttccaacgcctgaagaggcacatgaagtctgttatttcatcgattctgtcatgctaaataacgtgagctctgcttaa

SEQ ID NO: 3025 - DNA, 711 bp, Xenorhabdus bovienii
  Coding DNA location: Contig name=SeqID_16887; Position on contig =68662..69372bp; Strand=-
atggatatgcaatcaagaaagtatggtagaacgtttcattatccgttctcaccaggcacgaccagtgatgatcgtattaatcatagctggtggcaagatgtacagaaaattaaacatctcattcatacagaaaagttagacggagagaataactgtctaaatcagtatggtgtatttgcacgctctcatgcagctccgacacaatccgcatggacacagcagatccgtcaacgctggcaattaatcaagggtgatttagatgatatagagatttttggcgaaaacctgtatgccattcactctattgaatatcgtcagcttgaagagtatttctttgtatttgcggtgcggattaaagaggtgtggttaggctgggaagaagtcaaattttatgccgcgttattcgattttccgaccgtacctgaaattatcattcctgaaacacggagtgaatctgtatttatgaaaaacattattgaaacagcaaagcagcaaagctgtttttcttcatgggatacaaagaccaaacaatcctgttcaatggagggcgttgtcagccgtgatgcagaggcatattcggtgattgattttccacatcacgtttttaaatacgtgcggaaaaatcatgtcaaaaccgatattcactggaaacgtcactggcaaagagcgcctctctattttgaataccactcaggaggagatacaaaatga

SEQ ID NO: 3026 - DNA, 159 bp, Xenorhabdus bovienii
  Coding DNA location: Contig name=SeqID_16887; Position on contig =69452..69610bp; Strand=+
atgaaagagctcaaaaattggcattacattttctttattcctgattttaatcctttaatatatggaatattaatactgtgtggtaacaaaaatcccctgcctaatactgtaacaagggattatagttatatattcaagggaataaaaattatcaactaa

SEQ ID NO: 3027 - DNA, 1194 bp, Xenorhabdus bovienii
  Coding DNA location: Contig name=SeqID_16887; Position on contig =69603..70796bp; Strand=-
gtgttccagaatattgatgcttacgcaggtgatcctatcctttcgttggtggaagcatttaaaaaagatctccgcgcagaaaaaatcaacctgagcatcggtctgtattacgatgaacagggtataacacctcaattgcaggctgttgcaaccgcagaagaacaaatgagtgctctgccgcagtctgcttctctttatctcccgatggaaggattgcttgcctatcgctcggcaattcaggaattgctgtttggtaaagatcatccattattagggcagaagcgcattgcaacgatccaaaccgttgggggctctggtgcgttaaaggtcggcgctgactttttacaccgttatttccctgactctgaagtgtggtgctgtgatccgacatgggaaaaccatgcatcaatttttgctggagcagggatcaacgtgaattattacccttattttgatgacaaaactaaaggggtaaaatttggtgaaatgttggcaacattcaatcaactgccggcaaaaagtattattttgatgcatccttgctgccataatccaaccggttctgatttaaccagtgaccagtgggatcaagtggttcaggttgcaaaagagcgagaattgattccattccttgatatcgcctatcagggatttgcggatggtgtagaagaagatgcttacgctatccgtgcgatggcgaatgcggaactgccatgtctggtttgtaattcattctcaaaaatcttctccctgtatggcgagcgcgttggtgggttgtcagtcgtctgtaatgatgtagaagcaggtgaatgtgtcttaggacaattgaaagccagtgtgcgccgtatttattccagcccacctaattttggtgcgcaggtcgttgccagggtattgagcgatcctgaattaaaagcactgtggttgaaagaagttgagcagatgcgtttgcgtattaaggaaatgcgaactgttttggttaatgctctgaaaagtgcgctgccagagaaaaattttgatcacttgttgaaacagcgtggcatgttcagttataccggattcagtcaggaacaggttgatcgcttgcgtgaagaatttggcgtctatctggtagtctctggtcgtatttgtatggcgggcgtgaatcaccaaaacgtacagaaaattgctgaggcgtttgcggcggttagttga

SEQ ID NO: 3028 - DNA, 1080 bp, Xenorhabdus bovienii
  Coding DNA location: Contig name=SeqID_16887; Position on contig =70919..71998bp; Strand=-
atgaaagcggcaactgctgttatcgaccgccgcgctctgcgacacaatctgcaacaggtcagagtaaaagctcctgacagcaaactggttgcagtggtgaaagcaaacgcctatggacatggttttttagaagtagcgtacacaatggaagatgctgatagttttggtgtcgctcgcattgcagaagcactggctctgcgtagtggagggatcgtcaagcccatcctattactggaaggtttttttgaagcggcggatttgcccgttctggttgtcaaccatatcgaaaccgtagtccacagcattgaacagctcgaagcactggaacaagcgaacttatcccatcccattaaagtgtggatgaagctggatacgggaatgcaccgtctgggcgttcgtattgatgaagcggaagacttttatcaacgcttgagtcgctgccataacgtcgagcagccggttaatatcgtcagccattttagccgtgcagatgagctgaccgtggatacaaccccccagcaaattgatcgctttatggcatttattgcggataaatcgggtgaaaaatccatcgctgcatcgggtggcattttattgtggccacaggcacatttggattgggttcgtccgggtattatgatgtacggtgcatcgccgatagcagataaaaccgctgctgacttcaacctgatccctgcgatgacattgaaatccagcttaattgccgtgcgtaaacataaggcagacgaatcggttggttacggtggcacttggatcagtgagcgagatacaactcttggtgttgtggccatggggtatggtgatggttatccgcgtagtgcgccatcgggtacgcctgtattgattaatgggcgcgaagttcctttggttgggcgggtctcaatggatatgattaccgtcgatttggggccagaatgtcatgacaaagtcggggatgaagttaccctttgggggagtatcctacctgttgaaaaaattgcggaacacaccggcatcagtgcttatgaactgatcacgaaattgacttcacgtgttgtgatggaatatctagacgaataa

SEQ ID NO: 3029 - DNA, 1410 bp, Xenorhabdus bovienii
  Coding DNA location: Contig name=SeqID_16887; Position on contig =72048..73457bp; Strand=-
atggctggaaaaaaaccaactaacaacagtatggctgaaccaaaagatcgccaagtggaagggctgaagcttccaccacactctttggaagcagagcaatccgtgttgggcggtttgatgctggataatgaacgctgggacaatgtttccgagcgagtctccagcaatgattttttcagccgcccacatcggcgcatttttgctgaaatgcagcgtctgctcgaaaggggtcaacccatcgacctgatcactttatcggaatcccttgagcagaacgggcaacttgatagcgttggcgggttcgcctatttggcggagttatcaaaaaataccccaagtgcagcgaatattaacgcttatgctgatatcgtccgggaacgcgctgttgtccgagatatgattgcggttgcccatgaaattgcggatgcgggttatgatccacaagggcgaaccagtgaagatttattggatctggcggaatcacgggtattccagatcgcagaaaatcgggcgaacaaagatgaaggcccgaaaggcattgaacagatccttgaagaaaccgtcgaacggattgagcagctctatcagcgtccacatgatggggtaacgggggtttccacgggatatcaagatcttgataaaaaaactgccgggttacagaaatctgacctgattattgtcgctgcgcgtccttcaatggggaaaacaactttcgccatgaacttgtgcgaaaacgcggcgatgatgcaggataaaccggtactcattttcagtcttgagatgcccggcaaccagattatgatgcgtatgctggcgtcgctttctcgtgtggatcaaacacgtattcgtacgggtcagcttgacgatgaagattgggcacgtatttccagcactatggggatcttgctggaaaaacgtaatatgtatattgatgactcatcgggtttgacccctaccgaagtacgttctcgtgcccgacgggttttccgcgaacatggcggactcagcttgattatgatcgactacctacaattgatgcgggtaccttccctatctgacaaccgtacactggaaatcgcggaaatatcccgctcactgaaagccttggcaaaagagcttcaagtgccagttgtggcactctctcagcttaaccgcggcttggagcagcgtgctgataaacgtccggttaactcagacctgcgtgaatcaggctctatcgagcaggatgccgacttgatcatgtttatctatcgtgacgaggtttatcacgataacagcgaactgaaaggtgtggcagagatcatccttggtaagcagcgtaacggccctatcggtaggataaggctgacgtttaacggccaatggtcacggttcgataattacgtagggccaagctatagcgacgaataa

SEQ ID NO: 3030 - DNA, 111 bp, Xenorhabdus bovienii
  Coding DNA location: Contig name=SeqID_16887; Position on contig =73476..73586bp; Strand=-
atgaaatcgccgcaaacggcgttgatgtattcgaaatcattacagactatttataattactcaaggctgttttcatggcgtatactgatgcgctatttcgttcttgtttag

SEQ ID NO: 3031 - DNA, 984 bp, Xenorhabdus bovienii
  Coding DNA location: Contig name=SeqID_16887; Position on contig =73640..74623bp; Strand=+
atggcaaaacacatcgagttttccacgtcaggcgaccctgaggtgatccaatattgcgaatttacccctaccgaccctgctcctgatgaggtacaggttcagaataaggctatcgggattaattatattgatacctatatgcgcagtggactatatccaacagcaaatctgcccagtggcctcggaaccgaagccgcaggtattgtgaccaagattggctctagcgtgacatccattaaagtcggtgatcgtgtggcttatgctcaagctacccttggtgcttatagtgaagtacataatgtgcttgaaagcaaattagctgtactaccggacgcaatctcattcgaacaggctgctgcatcacttttaaaaggtttaaccgtttattatctgttctataaaacgtataaaattcaaacgggagaaacttttctgttccatgcggcagcgggcggtgtcggattaattgcctgccagtgggcaaaagcattgggcgcaaaattgattgggactgttggttccgatgaaaaagcagcccttgccaaagcggcgggtgcgtggcaaactatcaattacaaccgtgaaaatattgtcgagagcgtcaccgaaattactggcggagaaaaagttggcgtagtttatgattccgtcggtaaggcgacatggctcaattcgctggattgcctgaaacgacaaggtttgatggtcagttttggcaatgcttctggaccagtgactggggtagatttaggcattctcaatcagaaaggttctctgtttgtcacccgtcctgcaattaatggttatatcactacccgtgaagagttaaatgaagccagcaaggcgctgtttgatttaattgccagtggcaaaatcaatgtcgatgtgacagagaaccagaagtttccattaagtgaagctgcaaaggcgcatcgcacactggaaagccgcgccacccacggctccagccttctgattccttaa

SEQ ID NO: 3032 - DNA, 1038 bp, Xenorhabdus bovienii
  Coding DNA location: Contig name=SeqID_16887; Position on contig =74651..75688bp; Strand=-
atgcagcaaaataaaaaaattgaaaatattgatacaactaaaaatgtgagcaaaaaagaggttgaattccctctcaaccgcttctccgttgcccccatgttagattggactgatcgtcattgccgttacttccatcgtctgttgagtaagaaagcattgctttacaccgaaatggtgacaacgggtgctattattcatggtaaagggaattatctggcttataacgagcaggagcatccgctggcattgcaattgggcggcagtgaaccccaggcgttggcgcagtgtgccaagatcgcggaggagcggggttacgatgaaatcaatttgaacgttggttgtccttctgatcgtgtgcaaaatggccgctttggtgcttgcttgatgggggaagccaagttggtggcagacggcgttaaggctatgcaggatgttgtggatattcctgtcacggttaaaacccgtattggcattgatgaacaggacagttacgaattcttatgtgatttcattgatacggtcgtgaaaaacagtgattgcgataatttcattatccatgcccgcaaggcgtggctatctggtctgagtccaaaggaaaaccgtgaaattccacccttggattatccacgggtctatcaattgaaaaaagatttcccacaattgacgctttccattaacggcggcattaaatcactggaagaagcaaagcagcatttacagtatgtggatggcgtgatgattgggcgggaagcctaccaaaatccatctattctggcgcatgttgatcgtgagttgtttaatgaagcggcatcgatggtgaacaccattgatgcgattaaggcgctttatccttatattgaacgggaattgtcaaaaggcacctatctgggacacatcacccgccatatcttgggcatttttcagggaattcccggtgcgcgtcagtggcgccgccacttgagtgagaatgcccataagaccggcgctgatattatggtggtggaaaaagcactggagatggtgacagagcggatgtga

SEQ ID NO: 3033 - DNA, 159 bp, Xenorhabdus bovienii
  Coding DNA location: Contig name=SeqID_16887; Position on contig =75680..75838bp; Strand=+
ttgctgcatttttgtactttcaaggcgatattttcattctctgaatcccttgtcgttccctcatttataaggaagctgatacagagaatagggggaaatttatggtctactatagcacagagaagctccagagcgcagacaggaatccatacgaactaa

SEQ ID NO: 3034 - DNA, 138 bp, Xenorhabdus bovienii
  Coding DNA location: Contig name=SeqID_16887; Position on contig =75781..75918bp; Strand=+
atggtctactatagcacagagaagctccagagcgcagacaggaatccatacgaactaaaagcaacgattgtcgttcttagtagaagatttgaagaaggtaaaaaagataattatcaattatttgctcactttatttga

SEQ ID NO: 3035 - DNA, 252 bp, Xenorhabdus bovienii
  Coding DNA location: Contig name=SeqID_16887; Position on contig =75921..76172bp; Strand=-
gtgcggctaaatctaataaaatcatacctacgattaattgtcaggattgaaacattattcccttctgaaactatcgcgtctaatgcaatgaacagtgcttcaatcttacgcctttccagtgtatttggcattggtgtggaaaagatagcttgtaatgttctcttatgcctggcgtttaatgtatttattcaaattgatttccattatttgagttttccatcgccaagttacaagagtgatatgatattttga

SEQ ID NO: 3036 - DNA, 105 bp, Xenorhabdus bovienii
  Coding DNA location: Contig name=SeqID_16887; Position on contig =76317..76421bp; Strand=-
atggtaacaaataatcttccctgtgtattaaagatgctaatgttaaagcacaagattaatcaatatcaatactgtttttatgtacagttttttgcgcgtgattaa

SEQ ID NO: 3037 - DNA, 126 bp, Xenorhabdus bovienii
  Coding DNA location: Contig name=SeqID_16887; Position on contig =76543..76668bp; Strand=+
atggacgtatctaaatatcctgaaaaatggcaagagcgctttaagttttttgaacaatatagtagccctgcgtcgaaagaatttaaggtaggtataaaaacataccgcaaaaaaaacgaattctga

SEQ ID NO: 3038 - DNA, 117 bp, Xenorhabdus bovienii
  Coding DNA location: Contig name=SeqID_16887; Position on contig =76679..76795bp; Strand=+
ttggcttgcctttatctttggaattttttatttcttagctataggattatggaaaaaaggtttgagcttattcattttttccattttattagctataggcgttacatcaatatctga

SEQ ID NO: 3039 - DNA, 186 bp, Xenorhabdus bovienii
  Coding DNA location: Contig name=SeqID_16887; Position on contig =76740..76925bp; Strand=+
ttgagcttattcattttttccattttattagctataggcgttacatcaatatctgaaaccctaatatatggaacaatgccgctaacatatattatgtggggttttacagctaactatgcctattatttaaaagaaataaaaggcgatgatggctggaatccctttaaaggcatcttcactaaataa

SEQ ID NO: 3040 - DNA, 741 bp, Xenorhabdus bovienii
  Coding DNA location: Contig name=SeqID_16887; Position on contig =77021..77761bp; Strand=+
ttgttttcagcatattttatcgttcttatctaccaattaatttttatttttatcctgaatagccattcttcagtaaacaaagtattgcgtaacagcagaatagttagtcaccttttcactgacgcgtttaaccatcagcgctgtagccgtctgcctggattccacttccagactgaaaaacatgataatattacaactattggcatcatgctgggtgtgaaaggtgtaatgaaaactatcaatccaaaaaaattactgacacaggctaagacaatctgcctatcacgaggagttcgtttaacacctcaacgccttgaaattctgcgtttaatctcaacgcagccaggcgcaatcagcgcctatgatttattggatctgctacgtgaagtcgaaccgcaggcaaaaccgccaacagtctatcgtgggctagaatttttgcttgaacagggttttgtccacaaaatagaatccacaaatagttatgtgatttgccatcattttgaggaacccagccatacgtcagccatgtttatctgtgagaattgtagttcagtgactgaacgggatgccaaggatattgaatccgctattcagcagttagctcaaggcgtagggtttcatttacgacacagcgtgattgaagtccacggtttgtgttccccttgccatgaaatcgattcctgtacagaacgcgatacatgtcagcataatcacaagactgaagagaataaaaagaaataa

SEQ ID NO: 3041 - DNA, 615 bp, Xenorhabdus bovienii
  Coding DNA location: Contig name=SeqID_16887; Position on contig =77904..78518bp; Strand=-
atgaaagcattaactgccagacagcagcaagtttataacttggtgcgtgaccatatttcgcaaacgggtatgccaccaacacgtgctgaaatcgcagcacgtcttggttttcgttcacctaacgcggcagaagagcatttaaaagcattggcgcgtaaaggggtgatagagattatctctggtgcatccagaggtctccgtttgcttcttgaagaagaaggggcggcgggattaccgctgattggtcgtgttgctgctggcgaaccattgctggctcaggaacatatcgagagtcattacaaagttgatcctgcattattcaaaccaaatgctaatttcctgttgcgcgtcagcgggatgtcgatgaaagacatcggtattatggatggggatttacttgctgtgcataaaacacaggatgttcataacggccaaatcatcgtggcgcgaattgaagatgaagtaacagtaaaacgtttcagacaaataggaaacagaattgaactgattgctgaaaaccctgaattcgagcctatcgttgtggatttaagtgagcagagttttaccattgaaggattggcagttggcattattcgtaacggggattggatctga

SEQ ID NO: 3042 - DNA, 372 bp, Xenorhabdus bovienii
  Coding DNA location: Contig name=SeqID_16887; Position on contig =78637..79008bp; Strand=-
atggcaaatcaatcaacaggtttgattcgtatcattaaagcggcagggtactcggcgaaaggtattagggctgtgtggcaaaatgaagcggcatttcggcaggaagtcattgtagccatattagcgatcatcattgcattttcccttgattttggcatgtccgagaggcttttgctcatcggttcagtcatgctggtggtcattgtggaaattctcaacagcgccattgaggctgtagttgatcgcattggcagtgaataccatgaattatcgggcagggcgaaagacatgggatcagctgcagtatttctgacaatgattctggcgttgtttatctggggaatgatcctttggtcgtattttatgcactga

SEQ ID NO: 3043 - DNA, 2547 bp, Xenorhabdus bovienii
  Coding DNA location: Contig name=SeqID_16887; Position on contig =79069..81615bp; Strand=+
ttgtcttatttccacagatctcaaaatctgtttctggtatgcttgcgacgcgttgctaacaagaggcttaaagttgttatgtcaagttggcgtaaaatatattataagttattgaattttccactaaaattcttagtaaaaagtaaacttatccccacggatcccattgcagaactgagccttgatacgacacggcctattttgtatgtactgccgtatcactcaaaaacagacttattgaccctgcgtcaacaatgcctggcgcaagatctgccggatccgttgaatcctttggaaatgggtgacactctgcttccaagctatgtctttattgatgatggcccacgtgtgttccgttgctatgcacctaaacatgaatccgtgaagatttttcattcttatctggatctgcatcgcaataatcccgatttggatattcagatggtacctgtttctgtgatgttcggccgctcccctggacgcgaagggcaagaaggaaatacagcgccacagttgcgtttactaaacggtgtacaaaagttttttgcaattctgtggcttggacgggatagttttgtgcgtttttccacacccgtttcattactcagcatggccaatgatcatggcacggatgatatcattgccaataaacttgcccgcgttgcacggatacactattcccgtcagcgtttggctgcggtagggccacgtttgcccgccagacaggatctgttcaacaagctgctggcatccaaagccattgagaaagccattgccgatgaggcacgtagcaaaaaaatctcacccgaaaaggcgaagcaaaacgctatcaatatgttggaggagattgcagcagatttctcttctgaaaccgtacgtttgaccgatcgtgtcttgagctggacgtggaaccgtttgtatcagggcattaatgtccataacgccgagcgggttcgccaactggcgcaggatggtcatgaactggtttatgtcccatgccatcgcagccatatggattatctcctgctctcgtatgtgctttatcaccaagggctggttccaccacacattgctgccggcatcaatcttaatttctggccagccggcccgatattccgccgccttggtgcattctttatccgccgtacttttaaagggaacaaactctattcgacgatattccgtgaatatctgggtgagttgttttctcgtggttattctgttgagtactttgtcgaaggcgggcgttcccgcaccggccgtctgctcgatccgaaaaccggcaccctttcgatgacattacaggcaatgctgcggggagattcccgtccaatcaccatcgtgccaatctatgtcggttatgagcatgtaatggaagtcgcaacttatgctaaagagttacgcggtgcaaccaaggaaaaagaaggtttttttcagatgattaatgggctgcgtaagctgcgtaatctgggacaaggctatgtaaactttggcgaacccattcctctgatacaataccttaaccatcatgttcctgactggcgcgattccatcgatccaatagacgcccagcgtccgtcatggctgacacctactgtcagcaaactggctggcaatattatggtcaacatcaataatgccgcagcagcaaatgccatcaatttatgcactacagccttgttgtcatcacgtcagcgagcacttactcgcgagcaactgattgagcaattgaactgctatctgcaattgctgtgtaatgttccttacgctgacgatatcactgtaccgaacaaaacagctgaagcattgctggatcacgccttgctgatgaacaagtttgaggtcgaaaaagacagtcttggagatataattatcctgccccgtgaaagcgcggtattgatgacttattatcgcaacaatatccagcacttgctgatcctgccatctttgattaccagtattgtgatgcatcatcgccgcattagccgcagtgagctactcaggcaggtagagctgatttatccgctgctcaagcaagaacttttcatgcgttacagtaagaaaactctgcctgcagtggtcaacactctgattgatgagttagtgcgtcaatgcctgatctgcaacaaagaacaggatatgctcgttctgaaccctgagcgcattcgcccactgcaattgctggcagcaggtatccgtgaaactctgcaacgctatgccatcacactttctttattgaatgccactcccgaaatcagccgtggtgtgttggaaaaagagagccggatgctggcacagcgtctgtcggtactgcatggaatcaatgccccagagttctttgacaaggcggtgtttgccagctcagtcaatacgctgcgcgaggaaggttatattcatgataatagtgataaaagcacgaccagcgctcaaaaactctatcaggtgttgagtgaattgatgtcccctgagatccgtctgacgattgaaagtgccagtatgccaccagagcagaatgacactgaacagacaaacaaaaatcaacattaa

SEQ ID NO: 3044 - DNA, 147 bp, Xenorhabdus bovienii; identical to SEQ ID NO: 483
  Coding DNA location: Contig name=SeqID_16887; Position on contig =81632..81778bp; Strand=-

SEQ ID NO: 3045 - DNA, 855 bp, Xenorhabdus bovienii
  Coding DNA location: Contig name=SeqID_16887; Position on contig =81822..82676bp; Strand=-
atgacgcagaataaatggctcgcctattgccgtttaatgcgtatcaataaacccattggcgtattattattattatggccgacatattgggcattgtggatcgcagcaaaaggtatgccagatttgtacatcttgttagtttttactattggggtgtataccatgcgtgctgcgggatgttgcattaatgattttgcagatagaaaatttgatgggcatgtagaacgtaccaaatctcgtccacttcccagtggcgatgtcagcgaaaaagaaagcaaaatcttgtttgttacactggggctgatctctttcgcactggttttgatgctgaacaaaatgacgattgccttatctttcattggattggcactggcatgggtttatccttttgtcaaacgagtcagtaacttgccacagattgtactgggagcagcctatggttggtcaattccaatggcttttgctgcagtaagtgagtccttaccattagaatgctggttgttatttttggttaacataatatggtcagtaatttatgacacacagtatgcgatggttgatcgtgatgatgacctgaaagttggtgtaaaatcgacggccgtgctttttgggcgttttgataaactgattctgggtattttgcagtttattatgcttggtattctggtatcggttggttgcatagtgaatttaggtgggatgtactactggacgttattgctggcgggttcgctcttcatttatcagcagaaattgatttctggtcgaaaaaaggctctctgctttcaagcatttatgaacaataactacgtcggttttatcttattcctcggtattcttttcagctatgtttaa

SEQ ID NO: 3046 - DNA, 528 bp, Xenorhabdus bovienii
  Coding DNA location: Contig name=SeqID_16887; Position on contig =82690..83217bp; Strand=-
atggcagatgacacaatattaactcctgcacctatccgctggttttcggcagataattctaatattcctgaagatattttagattggcttatggaagtcggttcaatgacgcgccgttttgaagaacattgtcagcaggtatcagttgtaccttttcgggaatgctttattacagcagcagaattaggagatgaaagtgagcacttacctataagtgaaaggtattggctgcgtgaaattgtcttgtatggagataacattccgtggctgctgggacgtactgtgatccctgaggaaacactgactggcacggataagcggctggtcgatgtaggaacagttccacttggtcgctatctttttagtgataaaaatttgactcgggattatattcaaataggccagcaagggcagcactgggcgcggcgttctttgttgaggttatcaggtaaatccttgttactcacagaggtttttttgccggaatcacctgtatataagatgaacaaaataaaagggggaaaatag

SEQ ID NO: 3047 - DNA, 141 bp, Xenorhabdus bovienii
  Coding DNA location: Contig name=SeqID_16887; Position on contig =83196..83336bp; Strand=-
atgatgatttacataaattgttatcaactttttattttattcacttgcaacgtgatatcctcactccccattcgttgtgctgtcggggaaaatgatgtgccccgcaatgggaaaatgacatggcagatgacacaatattaa

SEQ ID NO: 3048 - DNA, 1647 bp, Xenorhabdus bovienii
  Coding DNA location: Contig name=SeqID_16887; Position on contig =83491..85137bp; Strand=-
atgaaaaacatcaaccctagccagaccgaagcttggaaagcattgcatcagcattttgagcaaatgaaaaacgtccatttgcgggatctgtttaaacaggacaaagcgcggtttacggcattctccgctacgtttgacgagcagattttggtggattattccaaaaaccgcattaccgctgaaacactggagaaattacaggcactggcgaaagaaacggatctgtccggagctatccgcagtatgttctccggtgaaaaaatcaactgtactgaagatcgtgctgtgctgcacattgccctgcgtaaccgcagtaataccccgattgtggtggatgggaaagatgtgatgccgcaagtcaatgcggtgctggcaaaaatgaagtcattcagtgaacgcatcatcagcggagaatggaaagggtataccggtcaagccattactgacgctgtcaatatcggtattggtggttctgatctcggcccttatatggtctctgaagcactgaaagcgtataaaaatcacctcaatatgcactttgtttccaatgtggatggaacccatatcgcagaaacgttaaaaacattgaacccagaaacgacgctgttcctgattgcctccaagaccttcaccacacaggaaactatgaccaatgcgtattctgcccgcaattggttcctgcaaagtgcggagattgaggctcatgttgccaagcattttgcggcactttcgaccaatgagcaggaagtcagtaaatttggtatcgatccacagaatatgtttgaattctgggattgggtcggtggccgttattcactgtggtctgcgattggtttatccattgcactttccattggctatgagaatttcgaacagttgctgagtggcgctcatgctatggataaacactttgagcagacttctcctgagcagaacattccagtcctgctggcgctgatcggcatctggtacaacaatttctttggcgcagaaactgaagcgattctgccttatgatcaatatatgcatcgttttgccgcttacttccaacagggcaacatggaatcgaatggtaaatatattgataggaatggcagtccggtagattaccaaactgggccgattatctggggcgagccgggcactaatggtcagcatgctttctatcagcttatccatcagggaaccaaactgatcccatgtgattttattgcgcccgcaatcagtcataatccgctcagtgatcatcacagcaagctactgtccaacttctttgcgcaaactgaagcactggcttttggtaaaaaccgcgaacaggtggaagcggaatttgtcgcagccggaaaaaatgcacagggcgtggcgaatgtcgtgccattcaaagtttttgaaggcaaccgtccgactaactccattctattacgcgaaattacaccattcagtttgggcgcattgattgccatgtatgaacataaaatctttgcccaaggcgctattctgaatattttctcatttgatcaatggggcgtagaactcggtaaacagttggcgaaccgtatcctgccagaattgcacgatgatgaagcggtaaatagccatgatagttcaaccaatggcctgattaatcgtttcaaaacatggcgctaa

SEQ ID NO: 3049 - DNA, 1374 bp, Xenorhabdus bovienii
  Coding DNA location: Contig name=SeqID_16887; Position on contig =85422..86795bp; Strand=+
atgtatgctgtttcatctccttacccgcagtatgttgtcgcaaaattcggcggtaccagtgtggcagactttgatgccatgaatcactgtgccgatattattttggcaaacgcagatgtccgcgtggtcgttttgtccgcttctgcgggggtgactaatttgctggtcgcattggcgacgggctgtgatagcgataagcgggagaagtgcctgaaacagatccgtgacattcaatatgcgattattgaccggttaaatgacgtggatgtgatatgcgaagaaattgaacgcctgctggaaaatatcgagatgctgtcagaagccgcatcattggcaacatctgaggcgttaactgatgagttggtcagccacggtgaagtgatgtccacattgctattcgtagaattactgcgtcaacgcaatgcaaatgcagagtggtttgatatccgcaggatcatgcgaacgaatgatcacttcgggcaagcagaaccagacacccttcaactccatatctcggcggttgagcaccttcaacctcgtttgaataatacagttgttatcacacaaggttttatcggcagagaagaaaaaggccgcacaacgacgctgggacgtggtggcagtgattataccgccgccttgctcggcgaagcgctgaatttacagcgtgttgatatttggacggatgttcccggcatctttaccactgatccccgtgttgcgccaacagccaaacgcattgataaaattgcatttgatgaagcagcagagatggcgacatttggtgctaagatacttcacccagctacgttgctacctgccgttcgttgcggtattcctgtttttgttggatcaagtaaagatccgcaggccggcggcacactggtttgtgacaaaatcgaaaacccgcctctgtttcgtgcgctggcattacgccgcaaacagacgttattaaccttgcatagcctaaaaatgttacatgcaaggggctttctggcggaagtttttacgctgcttttacgccataacatttcagtagatttgattaccacctcagaagtcagtgtcgccctaacgctggatacgactggctctaccagcaccaatggcagtttgctgactaatgctctgctgaccgaactttctacattatgtcgtgtagaagttgaagaagatctgacgctggtggcaattatcggtaatgagctttcacaggctaaggggctggggaaagaaatttttggcacactggaatcttttaatatccggatgatcagctatggcgcaagcagtcacaatgtatgtttgctcgttccagggaaagatgcggaatcagtcattcagaaacttcatcagaatttgtttaaggtgtga

SEQ ID NO: 3050 - DNA, 159 bp, Xenorhabdus bovienii
  Coding DNA location: Contig name=SeqID_16887; Position on contig =86874..87032bp; Strand=-
atggatgataaagcgggggaaaacacatccgatgagtggagccactctgagatatccaatttatctacatcaggccgaggatggatcatcttaatgacgtcagctcacaccgcgaatatcatagttgcagaggattctttcagcattagcacggtgtga

SEQ ID NO: 3051 - DNA, 180 bp, Xenorhabdus bovienii
  Coding DNA location: Contig name=SeqID_16887; Position on contig =86988..87167bp; Strand=+
gtggctccactcatcggatgtgttttcccccgctttatcatccataataagaaaacgaaaataaattccatttttgctttagcaaaatcagggttgctacacagacactttcagagggcattttatgagtacagccgttgccaacaaacgtaccaaaaaaaccaaaataacggcaaatag

SEQ ID NO: 3052 - DNA, 831 bp, Xenorhabdus bovienii
  Coding DNA location: Contig name=SeqID_16887; Position on contig =87112..87942bp; Strand=+
atgagtacagccgttgccaacaaacgtaccaaaaaaaccaaaataacggcaaatagtgccgctgcaagcggtcaggttcagtccttgagccgagggcttacacttttggaatatatttccgattcacaagtaggtgttgccttgaccgatctggctatacaagctggtttgcctaactccaccacccatcgccttttgactacattacagcagcatggttttgtccgtcaggtaggcgatttgggattatgggttatcgcttcacatgcctttgttgtcggtagcagttttctgcaaagtcgtaatttgatggtgctggttcacccaatattgcgccagttaatggaagattccggcgaaaccgtcaaccttgccatcctgaatcttgatgaatatgaagccgttattgttgatcaggtgcaatgtaatgcgctgatacggatgtctgcccccattggcggcaagctgccgatgcatgcttccggcgcaggcaaagcgttgctttctacactgtctgaacaaaaacgcctccagttactccataaaaaaggtcttcatacctatacccagcatacttacaccaccgcagcagccctgaaagaaaatcttgaacagatccgcaagcaaggcttttcgctcgatgatgaagaacatgcccttgggttacgctgcattgccgcctgtatttacgatgaacatcatgaagcgtttgccgctatttccatctccggctcaatttcacgtatctctgacgatcgagtcactgaattgggcgcactcgtgatgcgggctgcaaaagagatcagccgggaatatggcggtattaagtaa

SEQ ID NO: 3053 - DNA, 93 bp, Xenorhabdus bovienii
  Coding DNA location: Contig name=SeqID_16887; Position on contig =87950..88042bp; Strand=-
atgcaacaggcgccttgttctgcacccgatagcctgatagttgggttcgcagtgaaccaaacagttcaaatagaccttttaagggaaatttag

SEQ ID NO: 3054 - DNA, 123 bp, Xenorhabdus bovienii
  Coding DNA location: Contig name=SeqID_16887; Position on contig =87983..88105bp; Strand=+
ttggttcactgcgaacccaactatcaggctatcgggtgcagaacaaggcgcctgttgcatcacattttaataacagggattttaaatcccttgtatccgaatttggcgagaggaaactgctaa

SEQ ID NO: 3055 - DNA, 642 bp, Xenorhabdus bovienii
  Coding DNA location: Contig name=SeqID_16887; Position on contig =88105..88746bp; Strand=+
atgaataattggaaaataaccgcagaaaatatcctgaccgatggccctgtcgtccctgttattgtgatcagtgagattgaacacgcggttccactggcaaaagcgctgattgccggcgggatacgtgtactggaagtcaccttaagaactgaatgcgcactggaggccatccgtcttatcgccaaagaagtgcctgaagcgattattggcgcaggtacagtcattaatcctgaacaattggccgcagtcaccgaagcaggcgctcagtttgccatcagcccaggattaactgacgcgttattaaaagccgcaactacgggctcaattccattgattccggggatctctacggtttcagaattaatgcttggtatgagttatggggtaaattgcttcaaattttttccagcagaagcgaatggcggcgtgaaagcgctaaaagccattgcaggcccattccctcaagttcgtttctgcccaaccggtggtatttcacccgacaattaccgcgattatctggctctaaatagtgttctgtgtattggtggttcatggctggtgcctggcgatgcgctgaaaaaaggtgattatgcccagattaccgaactggcacatgctgcaattgccggagccaaagcgtaa

SEQ ID NO: 3056 - DNA, 564 bp, Xenorhabdus bovienii
  Coding DNA location: Contig name=SeqID_16887; Position on contig =88929..89492bp; Strand=-
atggctaatgtcattttatacggcgatatccttcacattaaaaacaggcacgaaaatggtagttatcttgatgtttatgggcagtctgcatcgctgggagaaaaatataatgttgtcacttctgtttcatcaaatcgtgatacaggctcgggttcatggcagattttatctgcggaaagtaaaagtttaggaacggaaatttacagtggtgatacggtatttctagtgaatttttatcggaacaatggagggtatttgagagtaagtggctatgcaccctctcctgagctctataatgtttataccgcagatagacccgtgaacgccctcgatacggcaatatggcatatttttacagatacggctaacgaatttgatggcaaaatccgtgagggaaatgccattcgtctgcttaacagttttaataatgtacatggtggttttcttgatacctgttggttggtaaaccaacctggtgctgtatataaggtgtatacttcactgctgtcagatcgggggaatggcacgggtacatggatattatcaaaagcaattaatcaataa

SEQ ID NO: 3057 - DNA, 1725 bp, Xenorhabdus bovienii
  Coding DNA location: Contig name=SeqID_16887; Position on contig =89753..91477bp; Strand=-
atgatggagatagatctcgcgcatttaattgcacaaaccattttgcagggattcgatgcgcaatatggtcgatttctggaagtgacttcaggcgcacagcaacgttttgagcaggcggattggcatgcagtacagcgagccatgaaaaagcgaatcaacctgtatgaccatcatgttggtttagtcgtggaacagctgaaatgcattcacggtacactgcaatatgacgaagattacattgctaaagcaaaagccgtttatacccgtttgctgccggactatccccgttttgagattgcggaaagtttttttaattcagtctattgccgtttgtttcaacaccgtaacttaaagccagaaaatctatttattttttcttcccagcccgcctgccgttttcgccatatttcacgtccattgtcgcgggatttttcctctaacagtaatattgcgtcaatgttgcgaacgatattaaatgatgtgccattgcgccttaaatgggaagatttggatcgagatattgattacatcacgcaatacttacagaaaacattttctgaacacgatttattacaggcgacatttcagattgctaatgaactattttaccgtaataaagcggcgtggctggtgggaaaaattaggctgggcacaacggtttatccatttttattacccatccaccataacgaatctggcggcatctttattgatacctgcctaacgtgccgcgatgatgccagcattgtttttggtttcgcacgttcttactttatggtttacgcctccttgccggcagcattagttgagtggctgcgtgaaattctgccgacaaaatcaacggccgaattatacatggcgattggttgccagaaacatggcaaaacagaatactatcgtgaatatctgatgtttattaacgcatctcaagaacagttttcgattgctccaggcgtgaagggcatggtaatgctggtcttcgcttctccttcatttgatcgtgtatttaaagtcatcaaagataaatttgctccgcagaaagaagtctctcaagaacgtgttcaggagtgctaccgtctggtcaaagaacatgatcgtgtgggaagaatggccgatacgcaggaatttgagaactttgtcattgagaagcgccatatcagccaggaattaatggaagaattgcaaaaagaaatcccggcaaaactcgaggatctgggtgataaagttctgataaaacacctttatatggaacggaaaatgatcccgttgaatatttatatggaacaggtagacaaagtgcagttgaaagatgtgatagaagaatacgggaacgctattaaacaattggccgcggcgaatatatttccgggtgatatgctgtttaaaaactttggggttacgcgtcatgggcgggtgattttctacgactatgatgaaatctgttatatgactgaagtgaattttcggaatatccctccaccacgttatccggaagatgaactggcaagtgaaccttggtacagcgttgctgccaacgatgttttcccagaagaatttcggcattttttatgtggtgacaaccgtgtccggcgttactttgaagaaagccatagtgacctattcaaagcggattactggttggcattacaagagcgcattaaaaatgggcatgtggaggatgtttttgcctatcggcgcaaacagaggttcagtcagcgtaattaa

SEQ ID NO: 3058 - DNA, 1308 bp, Xenorhabdus bovienii
  Coding DNA location: Contig name=SeqID_16887; Position on contig =91554..92861bp; Strand=-
atgaacatttcccgaacacaacagatcgctcagttggaacaagaatggaaacaaccacgttgggaaggcattactcgcccatacagtgctgaggacgtggttaaattgcgtggttccgttaacccagaacacactttagcgcagatgggagcgaaaaagttgtgggaactgttgcatggaaaatcaaaaaaaggctatgtgaacgcacttggtgccctgactggcggtcaggcacttcagcaagccaaggcaggtattgaggcagtttacctttctggttggcaggttgctgcggatgcaaatactgcttccagcatgtaccccgatcaatcactttatccagtggattctgtacctaatgtcattaaacgcatcaataacagtttccgccgtgcagatcagatccaatgggcaaatggtatcggcccggacagtcaggaatacaccgactatttcctgccgattgtcgcggatgctgaagcagggtttggtggtgtgctgaatgcatttgaactgatgaaagcgatgattgaggctggcgcagcggctgttcattttgaagatcaattggcggcggtgaaaaaatgtgggcacatggggggtaaggtactcgtaccgactcaagaagcggttcagaaactggtggctgctcgtctggctgccgatgtatccggagtttcaaccttgttagtcgcacgcactgatgccgacgcagcagatttgctgacttctgattgtgatccttatgacagcgaatttattactggcaagcgaactgctgaaggtttcttctgtacccgagccggtatcgatcaggctatcagccgtgggttggcttatgccccatatgccgacgttgtttggtgcgaaacttctacgccggatcttgaggccgctcgccgttttgcggaagccattcatgcggaatacccaggcaaattgctggcatacaactgctctccatccttcaattggaaaaagaatctggacgacaaaaccattgcgagctttcaagagcaattgtctgccatgggatataaattccaattcattacattggctggtatccacagcatgtggtttaacatgtttgatttggcttatgactatgcccgtggtgaaggtatgaaacattatgtcgaaaaagttcagggacctgaattcgcagctcttgagcgtggttatactttctcttcacatcaacaggaagttgggacagggtattttgataaagtgacaacgattattcagggaggaacgtcttctgttaccgcccttactggctcgacagaagagcagcaattttag

SEQ ID NO: 3059 - DNA, 1599 bp, Xenorhabdus bovienii
  Coding DNA location: Contig name=SeqID_16887; Position on contig =92910..94508bp; Strand=-
atgacacagcaagcattaacaactgatttaacctttacaaagccttttggtgaagctgaaaatcagatattactacctgaatctattggttttatagaagatctagttgttgagttttctgacaggcgtaaaaaattattggaagagcgaattcactggcaggaaaaaatagatgatggagcattacctaattttatttcggaaacaatttccattagagagggtgactggaaagttcagggaattcctgacgatcttaaagatcgccgtgttgaaatcacgggtccagtagaacgtaagatggtgattaacgctttgaattcaaatgttaaagttttcatggcggattttgaagattcactggctccttcatgggataaagtcattagtgggcaaattaatctaagggacgcagttaacggtacgatctcatataccagtgagcaaggtaagcgttatgaattgaaatctgaaccggcagttctggttgcacgggtcagggggctgcatctgtcagaaaaacacgttctttacaagaaggaaccgatctcgggtggtctatttgattttgcactttacttctatctaaatcataaaaatctgctggcaaatggcagcggcccctatttttatttgccgaaaattcagagctaccacgaagctcaatggtggagcgatgttttcagttttgcggaagagcgcttcaatctgccaaaaggcacgatcaaagcgaccgttctgattgaaacactgcctgctgtattccagatggatgaaattctctaccacctgcgtcaccacattgttgggctgaactgtggacgctgggattacattttcagttatatcaagacactgaaaaaccattctgatcgtgttttgcctgatcgccagtcggtcacgatgacacaaccttttctgagtgcctactctcgcttgctgattaaaacctgccataaacgtggtgcatttgcgatggggggaatgtcggcattcataccgagtaaagatattgaacaaaaccagtgggttatggacaaggtcagggctgacaaagaactggaagctaagaacggtcacgatggtacatggatagcgcaccctgggcttgcagatattacgatgacagtcttcaacaccaccttaggagagcggccgaaccaattggcagtttcccgtgaagaagacgaaacgatcacagcggaacaattgcttgaaccttgcttaggagagagaacagaagaaggaatgcgagcgaatattcgtgtcgctgtgcagtatatagaagcatggatttcaggtaatggatgtgtaccgatttatggcctgatggaagatgccgccactgcggaaatatcccgaacatctatttggcaatggatccgccatgaaaaatcactttccaacggtaaaaaagtaacaaaagaactgttcaggcaaatgctgaaagaagaactggacactattaaacaagaagttggagagatgaatttcaaccaagggcgatttatggaggcttctaatctgatggaacggattactacacaggatgagctaatcgatttcctgactttgccgggttatcaattactcgattaa

SEQ ID NO: 3060 - DNA, 930 bp, Xenorhabdus bovienii
  Coding DNA location: Contig name=SeqID_16887; Position on contig =94810..95739bp; Strand=-
atgccaattcgtgtaccggatgaattaccggcggtgaatattcttcgcaatgaaaacatctttgttatgacctcaacacgggcgaatattcaggatatccgccctttgaaagtactgttacttaacctgatgccgaagaagatagaaacagaaaatcactttatcaggttattatctaattcaccgttacaggttgatattcaattgttgcgtattgatagtcgccaatgtaaaaatactccagaggaacatttggataacttttattgtgattttgagtctataaaagatcaaaatttcgatgggttaattgtaacaggggctcctttggggttggttgaatttgaagatgtcacttattgggccgaaattgaaaaaattgttaattgggctaaaaatcacgtcacttcaacgctctttgtttgttgggctgttcaagctgccttaaatgttctttataacctgcctaaatatacgagaacgactaaattatccggtgtttactcccatataaccttagatccttttgcgttattgaccagagggtttgacgagtcctttttggcacctcactcacgttttgcggattttccagaggcagtgatccgtgagcataccgacctagatatcttggctcgttcagaagacgctggcgcttatttgtttgccagtaaagacaaaaggttggtatttgtgacaggtcatcctgaatatggagttgatacattagcggcagagtattggcgtgatctggctgcggggttagagccagcactaccggtcaattatttcctgaataatgatcctgaaaataaaccagttgcatcttggcgtagtcacggtcacttattgtttttaaattggcttaattactatgtctaccaaattacgccatacgatctgacgtatatgaatcctaccttagattga

SEQ ID NO: 3061 - DNA, 132 bp, Xenorhabdus bovienii
  Coding DNA location: Contig name=SeqID_16887; Position on contig =95849..95980bp; Strand=-
atgtatttagtcagagaagccaccccaccgggtggcttttttgcgtttgtatttttctattatttactcaatttctgctttattattttccattttccttattaccctttcttattcgatagaataaaatga

SEQ ID NO: 3062 - DNA, 186 bp, Xenorhabdus bovienii
  Coding DNA location: Contig name=SeqID_16887; Position on contig =95979..96164bp; Strand=+
atgtctggcagtgccctactctcacatggggagaccccacactaccatcggcgctacggcgtttcactgctgagttcggcatgggatcaggtgggaccaccgcgctatggccgccagacaaattctgttttcaatcccgaacaagctgctgtctttcatctgaaactccgtctctctctcaccaaa

SEQ ID NO: 3063 - DNA, 322 bp, Xenorhabdus bovienii
  unsure (1)..(322): unsure at all n locations
  Coding DNA location: Contig name=SeqID_16888; Position on contig =1..322bp; Strand=-
ttggaaaagcagccaccattagttttattagaaaccaatggtgtcggttatgaagttcatatgccaatgacctgtttttatgaactgcctgaaatcggccaacaggctattttattcactcaatttattgtgcgtgaagatgctcagttattatacggctttaatgataagcaagagcgcgcactttttcgtgaactgattaaagttaatggtgtagggccgaagctggcactggcgatcctgtcagggatgtctgctcagcaatttgtgactgctattgaacaggaagccattacctcgttggttaagttgccgggnnnnn

SEQ ID NO: 3064 - DNA, 522 bp, Xenorhabdus bovienii
  Coding DNA location: Contig name=SeqID_16888; Position on contig =431..952bp; Strand=-
atggcgattattcttggtattgaccccggctctagaatcacggggtatggcgtgattcgccagcagggacggcaacttatctatattggtagcggttgtattcgaacaaaagtagatgatttacccaatcgtttgcagaggatctatgccggtgttaccgaaatcattacccaattccgacctgatgtttttgcgatagagcaagttttcatggcgaaaaatgcggattcagccttgaaactggggcaagctcgtggtgtagcgattgtggctgcggtcaatgaatccattcctgtatttgaatatgcagcccgtcaagtcaaacagaccgttgttggtactggggcggcagaaaaaagtcaggttcagcatatggttcgctctatgcttaaattgtctgctgacccgcaggctgatgccgcagatgctctggctattgcgattactcattgccattttaaccaaaacttattgcgtataggtgatgtgcggttaaatttaacgcgagggcgtttgaaataa

SEQ ID NO: 3065 - DNA, 156 bp, Xenorhabdus bovienii
  Coding DNA location: Contig name=SeqID_16888; Position on contig =930..1085bp; Strand=-
atggtgaaatctctgatgaaattgcagcgcagctgtaattaccatcagggttcacagcgtagagaaagtgttccttatctcagggcactttctctaacgtttttatcccatatcacaagtggaataaatcgatatggcgattattcttggtattga

SEQ ID NO: 3066 - DNA, 744 bp, Xenorhabdus bovienii
  Coding DNA location: Contig name=SeqID_16888; Position on contig =1048..1791bp; Strand=-
atggcaggtcatagtaaatgggccaatacgaaacaccgcaaagctgcgcaggattcaaaacgcggtaagatttttactaaaattatccgtgaattagtaacagctgcacgtcttggcggaggcgatccggcttctaacccacgtctgcgtgcagccgtcgataaagcgctgtccaacaacatgactcgtgatacgctgaatcgtgccattgcccgtggtgttggcaatgatgacgcggataacatggaaaccatcatttatgaaggttacggtccgggtggtacagcagttatggttgaatgtttgagcgataatcgcaaccgtactgtttctgatgtacgtcatgctttcaccaaaactggcggtaacttgggtacagatggctctgtttcttacctgtttaccaagaaaggtgtaatttcctatgcaccgagtctggatgaagatgcggtgatggaagcggctttggaagcgggtgcagatgatgtcgaaacctatgatgatggtgcaattgacgtttatactacaccagaatcttttggcgatgttaaagatgcactggatgcggcgggtttcaaggcagaatctgcggaagtttccatgatcccatccaccaaagcggaactggatgcagaaacagcacctaaattactccgtctgattgatatgctcgaagattctgacgacgttcaagaggtttaccacaatggtgaaatctctgatgaaattgcagcgcagctgtaa

SEQ ID NO: 3067 - DNA, 435 bp, Xenorhabdus bovienii
  Coding DNA location: Contig name=SeqID_16888; Position on contig =1822..2256bp; Strand=-
atggattacaagcgccctgagtctgtactggttgtgatttatgcggctaccagcaaaagggtgctgatgttacagcggcgggacgatcctgaattctggcaatccgtaaccggtagccttgaagggaacgaaaaaccgtgggaggcggcgttacgtgaagtacaggaagaaattggcattgatattgttaatgcgggttttgaactgacagattgtcaacgctgtctttattatgagattttttcacatttacgttatcgatatgctccgggtgtaacgcgcaataaagaacattggtttttgctggcgttacctgaggagcgtgagatcctgctgacagaacatttgacttatcaatggctggcggtcgaagaggctgccagattaacgaagtcatggagcaatcggcaggcaattgaagagtttgttatttag

SEQ ID NO: 3068 - DNA, 1770 bp, Xenorhabdus bovienii
  Coding DNA location: Contig name=SeqID_16888; Position on contig =2256..4025bp; Strand=-
atgcgtactaactattgtgggcagttgagcctggcccatgaaggccaaaaagtaactctttgtggttgggtaaaccgtcgtcgtgatttgggcggcctgatctttattgatatgcgtgatcgcgaaggtatcgttcaggtattttttgacccagaccaaaaagaagcatttgctcaggcttctgaactgcgtaatgaattttgtattcaaattacggggatagtgcgcgcccgtcctgacagccagatcaataaagaaatggccactggagaagttgaagttttcgcagatagcctgatggttttcaatcgttcagaggcattgccactggatagcaatcagaacaacagtgaagaacagcgcttgaaataccgctatcttgatttgcgtcgcccagagatgtcactgcgcttgaagacccgcgcaaaagtcaccagttttgttcgtcgttttatggataatgcgggcttccttgatgtggaaacccctatgttgaccaaggccactccagaaggtgcgcgtgactatctggttccaagccgtgtccataaaggcaagttttatgcattgcctcaatcaccacaacttttcaaacaattgctgatgatgtccggttttgaccgttattatcaaattgtgaaatgtttccgtgatgaagacctgcgggcagatcgccagccagaattcactcaaatcgatgttgaaacctcatttatgaccgcggaacaagttcgcgaaatcatggaaaaaatgatccgtgaattgtggcttgacgcacgaggtgtcgatttgggtaacttccccatcatgacatttgcagaagcgatgcgccgctttggttcagataaaccagatctgcgtaacccactggaactggtggatgttgctgatttagtgaaaaacgtggaatttgctgtttttgctgaacctgccaacaatccaaaaggccgtgtagccaccatttgtgtaccgggcggtgctgaactgagccgtaagcaaattgatgaatatggcaaattcgtcggtatttatggcgcgaaagggctggcatggatgaaagttaacaatcgtgctgccggtctggaaggggtgcaaagcccggttgctaaattcctgtcagcagaagtggtggaaggtttgttgtcccgtaccaatgcacaggatggcgatatcctgttcttcggtgctgacaagaaaaatgttgttaccgatgcaatgggagcgctgcgcctgaaactgggacgtgatttgaacatcactgatctggcgagctggaaaccgctttgggtgattgacttcccaatgtttgaagacaatggtgaaggtggcctgcatgcaatgcaccatccatttacttctccatgtgatatgtcggcgacagaattggaacatgacccagaatctgccattgcgaatgcttatgatatggttatcaatggctacgaagtggggggcggttctgttcgtattcatcgcaatgagatgcagcaggtggtattccgcattctgggcatcaatgaggaagaacagcaggaaaaatttggtttcctgctgaatgccctgaaatatggaactcctcctcatgcgggtctggctttcggcctggatcgcctcgtcatgttgctgacggataccgataatatccgcgatgtgattgcattcccgaaaacaacagcggcggcctgtttgatgactgaagcacccagttacgcgaatcctgcatcattggaagaactggcaatctcagtcgttaaaaaaaagagcgaataa

SEQ ID NO: 3069 - DNA, 411 bp, Xenorhabdus bovienii
  Coding DNA location: Contig name=SeqID_16888; Position on contig =4281..4691bp; Strand=+
atggagttaaaaatggttagctcgctttatatcgttttgggcgcactattattgattaagctgtctctggatgtcgtcaaattaagaacacaatatcgagtcgcctatggcgatggcggtttttacgaattgcagacagccattcgcgtgcatggcaatgctgttgaatatattcctatttcaatgctattgctgttgatgatggagatgaatggagccgccgtatggatgctacatatttgtggcctattgttgctttcgggtagaatattgcactactttggcctgcgtcatcgcgaaatccgctggcgccgtatgggcatgggtgcaacgtatatatcaatgataataatgattatcaccaatatctactacttaccttgggaacaaatattttctttctatgcgtga

SEQ ID NO: 3070 - DNA, 93 bp, Xenorhabdus bovienii
  Coding DNA location: Contig name=SeqID_16888; Position on contig =4725..4817bp; Strand=+
atgcaaaccttgatgtacatcatgacacctatgcataagagaagcccatcattaccaagggcggtattcctgccgcctgagggtttctgctga

SEQ ID NO: 3071 - DNA, 759 bp, Xenorhabdus bovienii
  Coding DNA location: Contig name=SeqID_16888; Position on contig =4891..5649bp; Strand=+
atgtcaaatcaagatcctcataatcaacgggacagtctgttctctgccccaatcgccaatttaggcgactggagtttcgacgaacgtgttgccgaagtctttcctgatatggtgaaacgttccatacccggttattctaatatcatctccatgataggtatgctggccagtcgcttcgtgacgccaagtagccaaatttatgatctcggttgctcccttggggcggcaactctgtccatccgccgcagtatcaatgctgataattgccggattatagctatcgataattcaccagccatgatcgaacgctgccgccgccatattgattctttcaaagccagtacacccgttgaggtgatcgaacagaatatccttgataccgacattcaaaatgcctcgatggtagttttgaattttacattacaattcctgcaccctgatgatcgccagaaaatattgaagaaaatttacgcaggattaaaaccgggtggggttctggttctgtctgaaaaattcaattttgaagaccagaaaattggcgagttactattcaatatgcaccatgatttcaagcgagccaatggttatagtgagctggaggtcagccaaaagcgcagtatgctggaaaatgtcatgcggacagattctgttgacacccataagtcacgccttaaagaagccggtttccagcatgtagaagtctggttccagtgtttcaatttcggttcattattggcaataaaaggaactgaacaatga

SEQ ID NO: 3072 - DNA, 972 bp, Xenorhabdus bovienii
  Coding DNA location: Contig name=SeqID_16888; Position on contig =5646..6617bp; Strand=+
atgatcgatttcggtaatttttatcaattgatcgccaagcacccattaagccattggctggatagcctgccagcacaattgagccactggcaaaaaacatcacagcacgctcagttcagctcatgggtaaaaattctggaaaatttgcctgagatcaagccaagccaccttgacctgaaaaatggtgtcattgcgactcatgagccggatctgtcaaaaggtgaaaaagctcgccttcacaatatactgaaaatattgatgccatggcgaaaaggccctttttcattgtatgacgttgaaattgataccgaatggcgctctgactggaaatgggagcgagtgctgccccatatttctcctttagaaggaaaaaccgtacttgatgtcggctgtggcagtggttatcacatgtggcgcatggttggcgaaggcgctcaattggttgtgggtatcgatccaacccaactttttctctgtcaatttgaagcgatcagaaagttactggggaacaatcaacgagcccaccttctgccattgggcatcgaacaattacccgaactacaagcctttgatacggtattttcaatgggagtgctctaccaccgccgctcacctcttgatcatctgtggcaactgaaaaatcaactggtgtctgatggtgagttagtgctggaaagtttagtgattgagggtgatgaaaatcagtgcctcattccgggtgaacgctatgcacaaatgcggaatgtctattttattccctcggccaagatgctgaaagtctggctggaaaaatgtggttttgtcgatgtcagaattgtcgatcatgcggctacaacacctgatgaacagcgccggacagaatggatgaaaaccgaatcactggtagatttccttgacccatcagatcacagtaaaacaattgaaggctaccctgccccattgcgtgctgtcctcattgcccgcaaaccataa

SEQ ID NO: 3073 - DNA, 747 bp, Xenorhabdus bovienii
  Coding DNA location: Contig name=SeqID_16888; Position on contig =6714..7460bp; Strand=-
atgataaggctggaaatttgctgttatagcataagctgtgcgctggttgcacaaaatgcgggcgctgaccgaatcgaattaagcgcaagcccgttggaaggcggattgacacccagttttggggcattacaacagtcgttacagcggttatctattcctgtgcatcccattgtgcggccaagagggggagacttctgttataacaacatggattttgaagccatgaaaaatgacgttgcccgtatccgtgatatggggttccccggcattgtttttggcattttgagcgaaaacggccatattgacagactccgtatgcggcagttgatgtcactgtcgggaaatatggctgttacttttcatcgcgcttttgatatgtgttttaatccgcatgttgcgttggaacaactgacagagcttggagtgcagcgtattttaacatcaggccaacagcagaatgctgaactggggctgacgctgttaaaagagctgatgcaagccagccgtgggccgataattatgcccggcgcgggtgtcagggtgagtaatatcagtaagtttctggaagccggaatgacggaagttcatagctcggcgggtaaaattgtaccttctaccatgaagtaccgaaaggcaggggtggcgatgagttcggacgatcgtgatgtagatgaatattctcactacagtgttgatggtgagttagttgagtcgatgaagggagtgatgagcctgattgagcggtag

SEQ ID NO: 3074 - DNA, 114 bp, Xenorhabdus bovienii
  Coding DNA location: Contig name=SeqID_16888; Position on contig =7559..7672bp; Strand=+
atgacatgttggaaatcacaaggtcagaattttttactggaacagcatgataaaaacgtcatttttgccggctatacctcacttttgacaatttctttgatacaaaaaggatga

SEQ ID NO: 3075 - DNA, 555 bp, Xenorhabdus bovienii
  Coding DNA location: Contig name=SeqID_16888; Position on contig =7630..8184bp; Strand=-
atgtctcatttttcaaaaatttctgagttacaggatttagtggctgatttagccggatttgagcaaaaacttaagcaatttgaagggcatcttggcttacacttcgaacaatattcagcagaccatatttccctgcgttgtaatgaaagtaaaatagccgatcgttggcgtaagggctttctgcaatgtggtcagttaatatctgaaagtatcattaatggccgtccgatctgcttatttgatctgaaccagccaatagtactacttgactggaaaattgattgcgtggaattgccttatcccagccaaaaacactatgtccaccaaggttgggaacatgtcgaactggtgctgcctgtaccaccagagcaacttatttgtgaagctaaaaagttattgcctcaacctttaccagataattttcggatgaaggagagtcatccaaaaggaaaaaatgaacggttgccgaacccgattttggctgtcactgatggtgaaatcacgatcaaatatcatcctttttgtatcaaagaaattgtcaaaagtgaggtatag

SEQ ID NO: 3076 - DNA, 165 bp, Xenorhabdus bovienii
  Coding DNA location: Contig name=SeqID_16888; Position on contig =8245..8409bp; Strand=+
ttgtctatttttgccaaaatatcactcagtaagcgactcattgaagttggcataacgacgaatcacctgaaagacaggctaaaaacaaaaagtaacacaccagaggtggctgatggtagcatgcagaaccccgaatatggtataaaccccgttattttctcataa

SEQ ID NO: 3077 - DNA, 1731 bp, Xenorhabdus bovienii
  Coding DNA location: Contig name=SeqID_16888; Position on contig =8477..10207bp; Strand=+
gtgaatatacaggttattctttcagaaaaaatcagcaatgcgctgattgaagctggcgctccaaccgacagtgaagctcacgtccgtcaatctgcaaaagcacaatttggtgactatcaagcgaatggtgtgatggcagccgctaaaaaggtgggaatgcctcctcgacaattggcagaaaaagtcgtcagccaactggatctgcaaggaattgccagcaaagttgaaattgcaggcccgggttttatcaatatttttcttgataaagcgtgggttgcagcaaatatagaaactaccctgaaagatgaaaagctcggtatcaccccagtcgaaccgcaaaccatcgttatcgattattccgcacccaatgtcgccaagcagatgcatgttggacacctgcgctcaaccatcattggcgatgctgcggcacgtacccttgagtttcttgggcataaagtcattcgggccaatcacgttggtgattggggaacccagttcgggatgctgatcgcctatctggaaaagatccagaacgaaaatgccgatgacatggcattagcggatttagaagctttctatcgcgaagcaaagaaacactacgatgaagatgaagagtttgctattcgcgcgcgtaactacgtcgtcaaactgcaaggcggtgatgaatattgccgtaagatgtggcgtaagctggtagatatcaccatgtcccagaatcaggaaacttataaccgcctgaatgtcacattgacagaaaaagacgttatgggtgaaagcctgtataacgatatgctaccgggtatcgttgcagatttaaaacaacgtggaattgccgttaagagtgatggcgcgacagtggtttaccttgatgaattcaagaataaagaaggcgaacctatgggcgttattatccagaaaaaagatggtggctatctttacaccacgacggatatcgcctgcgccaaataccgtcatgaaaccctaaatgccagccgtgtgctttactacatcgattcacgccagcaccagcacctaatgcaagcttgggcaattgtacggaaaacgggttatattccagaatccatgtcactcgaacaccacatgttcggcatgatgctgggcaaagatggtaaaccattcaaaacccgtgccggcggtacagtaagactgtccgatttgctggatgaagcgattgagcgtgcggataccctcattcgtgagaaaaacccagatatgccagaagacgaactgaaaaaagtcgtggaagcggtagggattggcgcggtgaaatatgcagatctttccaagagccgtactacagactatgttttcgactgggataatatgctggcctttgaaggcaacacagcaccttatatgcaatacgcctacacgcgcgtgtcatccatctttaaacgtgcggatatcgatgaaaacagcctgacactgccggtgatgctgaatgaagaacgcgaacaggcattggcaacccgcctgttgcagtttgaagaaacgatcactacagtcgcccgtgaaggtacgccacatgttatgtgtgcatatctgtacgatctggccggtctgttctctggtttctatgagcactgccctatcctgaatgccgatagcgaagaactgcgccagagccgcctgaagttggctttgctgacagcgaaaactttgaagcaaggtcttgatactctgggtattcagactgtagaacgtatgtaa

SEQ ID NO: 3078 - DNA, 117 bp, Xenorhabdus bovienii
  Coding DNA location: Contig name=SeqID_16888; Position on contig =10373..10489bp; Strand=+
atggaaaaatatctggcgattatattattttttctggttatggttgtattaaatttaaagtcgaatatcatttattttattatcaataatccatttaacggttacaagttattatga

SEQ ID NO: 3079 - DNA, 1539 bp, Xenorhabdus bovienii
  Coding DNA location: Contig name=SeqID_16888; Position on contig =10813..12351bp; Strand=-
atgaacttattgaaatcactggcagcggtcagttcaatgacgatgttttctcgcgtgctgggctttattcgagatgccattattgctcgtatatttggtgcaggaatggcgacggatgccttttttgttgcctttaaattacctaacctgttacgccgtatctttgcagagggcgctttttcgcaagcttttgttcctattcttgccgaatacaaaaatcaacaaggggatgaagcaacacgtacctttattgcgtatatctcaggtatgttgacattgattctggctatcgtctcagtgataggtgtaattgctgcaccttggatcatctatgtgactgcgccgggatttacggatacaccggataagtttgtcttaacccgtgatttacttagaattacgtttccttatatctttttgatttcgctggcttctttggctggcgcaattcttaatacatggaaccgcttttcggtgcctgcttttgctccgacactgctcaatgtcagtatgatcgtttttgcattgtttgtggctccttattgcaatccgccagtgctggcgctgggttgggccgttgttgccggaggggttttgcaattggcctatcagcttcctcatctgaaaaagatcggcatgctggtattgccgcggatttctttccgtgacagtgccgtatggcgggttatccgtcaaatggggcctgcaattctgggtgtatcggtcgggcagatttccttgatcattaatacaatttttgcctcatttctggtttcaggctctgtttcatggatgtattacgctgatcgtttaatggaattgccttctggtgtactgggtgtggcgttagggacgattttgctgccttcactggcgaaaagtttttctagtggtaatcacgaagaatatcgaaaactgatggattgggggctacgtctctgttttttgctggcgttaccctgtgcagttgctctcggtattctcgcggagcctctgacggtatcattatttcaatatggtcacttttctgcttttgatgctgagatgactcagcgggcgttaattgcctactgttttggcttgatggggttgattgtggttaaagttctcgctccgggcttttattcacgccaagatatcaaaacaccagtaaaaattgcgattgcgaccttgattctgactcaattgatgaaccttgctttcgttggcccattgaaacatgcaggtctggcgctttctattggtctggctgcctgcttcaatgccagtatgctttattggcaactgcgtaagcgtgatattttcacgcctttggtgggatgggggatattcctgtttaaattggtggtggcaattgctgtgatggtcggggtgctgttggcagtattgtgggttatgccagcatgggaacagggaaatatggcaatgcgcctactgcgcttaatgggcgtagtgattgcgggagcaggcagttattttgcagttctggccttgatgggatttagactgaaagatttttctcatcggggattgcagtga

SEQ ID NO: 3080 - DNA, 114 bp, Xenorhabdus bovienii
  Coding DNA location: Contig name=SeqID_16888; Position on contig =12426..12539bp; Strand=+
atggcatataaagcaatctggcgggatagcagccgatgtttaaagtctaacagacaaaaaccctgtctacattttctatattacgccccattagccttaccccgagattcataa

SEQ ID NO: 3081 - DNA, 588 bp, Xenorhabdus bovienii
  Coding DNA location: Contig name=SeqID_16888; Position on contig =12534..13121bp; Strand=-
atgtttggttatcgttctgcatcgcccaaaattcgatttattacggataggatggttgttcgtctggtatatgaacgtgatgcttatcgattggctgagtattattcagaaaataaagatttcctgaagccatgggagccaaaaagggatggtagtttttatcaaccctctggatggacaaatcggttgaactatatcactgagttacaacggcagaatgcgacatttaattttgtattattggactctgatgagcgtgaaattatgggtgtggcgaattttactaatgttgtacgcggcgcgttccattcttgttatcttggttattctttagctgagaaattgcaagggcaaggattgatgtatgaagcgctgcaacctgcgatccgctatatgcagcgctatcagagaatgcaccggattatggctaattacatgccacataaccatcgtagtgggaacctgctcaaaaagttgggatttgagcaggaaggttatgccaagaattatttaatgatagatggtgtttggcaagatcatgtgctgacggcattgactgacgatgcatggggcaaagtgggtttatga

SEQ ID NO: 3082 - DNA, 1239 bp, Xenorhabdus bovienii
  Coding DNA location: Contig name=SeqID_16888; Position on contig =13265..14503bp; Strand=+
atgtttaatcctctcatatctcaatggtgcgcaatgtcgttggtttcacaagcacgtagcttgggtaaatacttcctgctatttgataatttattagttgttttaggtttttttgtcgtttttcccctaatttcaattcgtttcgtcgaacaacttggctgggcggcattgattgttggtttcgctctggggcttcgtcagcttgttcagcaaggcttggggatcttcggtggtgccatcgcagaccgatttggtgccaagccgatgattgttactggcatgttattgcgagcactgggttttgctctgatggcaatggcacatgagccatggatattgctgctttcctgcgttctatcaggattgggaggaacattgtttgatccccccagagcggctttggtcattaagttaacccgtccccatgagcgagggcgtttttattcaatcctgatgatgcaggatagtgcaggtgccgtggttggcgcactcatcggaagctggttgctgcaatatgatttcaatatcgtctgctggattggtgcatccatttttgtgctggccgcattatttaacgcctggctactgcctgcataccgtatttcaactatccgtactcctatcaaagaaggcatgatgcgggttattagagatcgtcggttcctttactatgtgctgacattgacgggttattttgtcctgtcagtacaagtgatgctgatgtttccgattattatccatgaaattaccggcactcctactgccgtcaaatggatgtatgccattgaaaccgttatctccctgacattgctctatcccatcgcacgctggagtgaaaaacatttccgactggagcagcgcttgatggcgggcttatttttgatgaccatctgcatgtttccgatcggctgggtcaatcaattacatacactgtttggcctgctttgcctgttttatttaggtttggtaacagccgatcctgctcgtgaaacgctgagtgcttcactgtctgatccacgggcgcgtggcagttatatgggatttagccgtctgggtttagctctgggtggtgcaataggttacaccggtggagggtggctctatgatactggccgtgacttaaatatgccgcaattaccctggattttgctgggattgtctggtttgattaccatttatgctcttcatcgccaattcaatcagaagaaaattgatcctgtgatgcttggtagacattaa

SEQ ID NO: 3083 - DNA, 564 bp, Xenorhabdus bovienii
  Coding DNA location: Contig name=SeqID_16888; Position on contig =14556..15119bp; Strand=+
atgaaaagatttttcttaggggcagcattagtgctggtagggttagtcagcggctgtgatcaatttaaagacttcagcatcaacgaaggtctgatgaatgattatttgctcaaaaaagtgcattatcagaaaaaaatcagcattccaggtattgcgaatgccaatatcacactgggggatttatccagccagataggccgtcaggatcctgaaaaaattgaactatccacgcaagcaaaagttcaacttgcaacactactgggtacgattcaggctgatatgaaactcactatcaaggctaaacccgtatttgatgcagaaaaaggcgctattttcgtgaaagagctggaaatcgtagactaccagacaacaccggaaaaagcagcggctccggttaaggcattgattccttatctgaatacctctttgagtgagtttttcgatactcatccggtttatgttctgaatccagagaaaagcaaggccgaggcagcagcctcacaattcgccaaaaggttggaaattaaacccgggaagttagttattgggttgaccgataaataa

SEQ ID NO: 3084 - DNA, 543 bp, Xenorhabdus bovienii
  Coding DNA location: Contig name=SeqID_16888; Position on contig =15245..15787bp; Strand=-
atgaacgaattttctattgtctgccgcatattgggcacattgtttaaccgcgcaccgcaagatcccgttctgcaacctttaatcaccatgattgctgagggaaaactaaaacaagcatggcctttggaacaggatgaatggctggatcgtttacagcaaaacagtgaattgtcagtgatggcagccgattatcacgctctgtttactggagaatcggcgagtgttgctgtttgtcgatgtgattatacggacggagaagaaagtgaagtacgtcagtttttgacagaacggggaatgccactgtctgatactcctgctgatcaattcggctctctattgctggctgtgtcatggctggaagatcaggcagctgaagatgaaatccaagcacaaattacgttgtttgatgagtatcttttgccttggtgtgggcagttcctcggtaaagttgaagctcatgcaaccagtggtttttatcgaacgctggcgattgtcactcgtgaagcgttgcaggcattgcgttatgaattagaatctgagtga

SEQ ID NO: 3085 - DNA, 942 bp, Xenorhabdus bovienii
  Coding DNA location: Contig name=SeqID_16888; Position on contig =15863..16804bp; Strand=-
atgaacattattttttttcacccttcctttaataccgatgagtggattcaaggaattcaggcacgtctgcctgatgccaaagtgaggcaatgggtcagtggtgatcaagagcccgcagactatgcattagtttggcagccaccttatgaaatgttagccaatcgtcaggggctaaaaggcatattcgcactgggtgccggtgtcgatgcgattttcaaacaagaatcgaaaaatcccggtacgttaccggctgatgttccattgatccgcctcgaagatacaggaatgggaaggcagatgcaggaatatgccattacctcagtgctgcattatttccgccgcatggatgaatataaacgataccaagagcagcgcctttgggcccctatggctccgcataaccggaaagaatttgttatcggggttttaggagccggaatattagggcgaagtgtgattgggaaattaatggaatttgattttaatgtgcgttgttggagcaggacgtcgaaacaactcgatagtgttgaaagtttttacggtaaagagcaattgggtgattttctttctggctgcaaggtgctgattaaccttctccctgatactcctgacactcgtggtatccttaatttgtcattattcagccaactaaaatcgggttcatatgtgattaatctggcgcgaggagcgcagcttgtcgaacaggatctgcttgttgctattgataaaggttatatcgcaggagcaacccttgatgtgtttgccgaagagccattgtcaaatatgcacccattctggactcaccctcgtattaatgtgactccccatattgctgctaacactgttcctgaggctgcgatggatgtcatctgtgaaaatatccggcggatggcacggggtgaaatgccaactggcctcgtcgatagggtacgtggttattaa

SEQ ID NO: 3086 - DNA, 162 bp, Xenorhabdus bovienii
  Coding DNA location: Contig name=SeqID_16888; Position on contig =16854..17015bp; Strand=+
atggttgcaagcctctgctggaaagcgaggaatgaaaatattaataatgttacccagttaacatatttaccactgcatattacaaaaagcgcatctgctttagtaaatgactatcgaacattcaaattgttttttatttgtgtaatcagtcaaaaagcctga

SEQ ID NO: 3087 - DNA, 159 bp, Xenorhabdus bovienii
  Coding DNA location: Contig name=SeqID_16888; Position on contig =17452..17610bp; Strand=-
atggtcatattattcgggtatgtcctttggattagcctagaacaaggtgtaattaagccacaaatctttaagacattcccattagagcaggttgttgaggtgaatccttgcgaggtttttcacctatactttggggagtataaatgcgaaaaagcctga

SEQ ID NO: 3088 - DNA, 792 bp, Xenorhabdus bovienii
  Coding DNA location: Contig name=SeqID_16888; Position on contig =17576..18367bp; Strand=-
atgttaacactcaatttttctacatcggtaaacgctaaaccatcccatatctgggcgcattatgtcgattttgatttgcggaaaaaatgggaagtcgatcttgaatattttcaatttgaaggggaggtcaaaacgggtcaatacggcagaatgatattaagtggaatgccggaaattcgcttttatctttcaaatatcgaagtgaataaagaattcaccgatcaggttaactttccgcaaatgggaatattaacattccgacatcaaattattacagatgaaaacaatatggcgtgtcgtattcaggtgaccgtttcatttgaacctgatgcaaatatttccgctgttcaggccgaaagtttctttaagcaaggtacgcaagatctggttgaaaccgtattaaggctgaaatctgtcgttgagatagtatcccccaaacccaatcttcagcttgtttatgtctctgatatcgagcgttcaagcgctttttataaaacaattttcaatgctgagccgatatttgccagctcccgttatgttgcatttcctgctggtggtgaagtactgtttgctatttggagtggaggagcaaagcctgatcgtgctattccgcgattttctgaaattggtattatgctgccatccggtaaagatgttgatcggtgctttgaagaatggcgaaagaaccctgagatcaaaatagtagaggaaccccataccgaagtttttggccgtactttccttgctgaagatcccgatggtcatattattcgggtatgtcctttggattag

SEQ ID NO: 3089 - DNA, 795 bp, Xenorhabdus bovienii
  Coding DNA location: Contig name=SeqID_16888; Position on contig =18487..19281bp; Strand=-
atgatcttgtacaagggatcaaaaaactatctttttaatcaattaaattatgatagttgcgtattattagaggttgatgagtcggttaacttgaatggatgggacgaattgtctagagcacagcgtttgttatctctcatggaaatattgcgccgttatcactttccggttcagggaaaagtgttggcgcagaaattgaatatcagcttaagaacactgtatcgggatattgcatcgttgcaagctcaaggcgcgattatcgaaggtgagccgggaatagggtacgttttgaggcctgggtttgtgttaccaccgctcatgtttacacaaaatgaaatagaggcgttggcattgggcgcgaattgggtggctaaacgtgcagacccccaactaaaagaatctgcaaataatgcaataagcaaaattgcggctgtgatcccagcagaattgaaacaaatgttggaggcaagctccttactgatcgggcctgctgcgacagctgttcagcctgttgtcgagattcagcagatacgtcaggcgatcaatacccggcataaaatcaccttcgcttatttggatataaaagacatcccatcagaaagaacaatatggccattcgccttaggctattttgaaaatatcagcattgtgattggatggtgtgaattacgcgaggaatttcgtcatttcagatcagatagaatcatgcgtttgaaaattgaaaaacaatgttacccccgttcaaggcaagtattgctcaaagaatggagagcaatggaaaaaatttctcgttag

SEQ ID NO: 3090 - DNA, 624 bp, Xenorhabdus bovienii
  Coding DNA location: Contig name=SeqID_16888; Position on contig =19360..19983bp; Strand=+
atgaccatatacgatttaaaaccccgtttccaaaacttactgcgtcctatcgtaatttatctgtataaacaagggatcaccgcaaaccaggtcactttaaccgcgctattcctgtcaatctttgccggttcactattgagcctatttccctcgccccacctctattggttgctgcctgtttttcttttcattcgcatggctctgaatgctattgatggcatgctggcacgggaacataaccagaagtctcatctgggcgctatttataatgaattgggggatgtcatttctgatgttgccctctatctccccttctgccttttacctggtgtgaacagcctcagcctgttgattattttattcctcactatcttgaccgaattcatcggcgtactggcacaaacgattggtgcatcacggcgctatgacggcccgataggaaaaagtgaccgtgcttttatcttcggagcttatggattgattattgcgattttcccttcgaccttgggctggagtagctctttgtttgctttcatgatcattttactcttggtgacttgctaccagcgcgttgttaaagccttacgtgaaatccggctggctgaacagtcacactccaaatga

SEQ ID NO: 3091 - DNA, 1770 bp, Xenorhabdus bovienii
  Coding DNA location: Contig name=SeqID_16888; Position on contig =19993..21762bp; Strand=+
atgacaccacaactcgatcaacgtattgctgaagaacattatttcaccacatcagataatgcttctctgttttaccgttactggccacagcaacaggccaatccagacagagcgatcattatttttcaccgtggtcatgagcactcaggacgcatccagcatgtcgttgacggactcgatctgcctgatgttcctatgttcgcgtgggatgcccgtggacacggtaagacagaagggccgcgcggttacagcccatctatgggaacgtcgattcgtgatgttgatgaatttgtcagatttattgccattcagtacggcatcgccatgggaaatatcgtggttatcggccagagtgtcggagcggtattagtctctgcttgggtacacgactatgcgccaaaaatccgcgccatgatcctcgcagcacccgcatttgatattaaattgtatatcccttttgccacgcagggactgcaattgatgcaaaaagcacgaggtattttcttcgtgaactcctatgtgaaagccagatatctgactcacgatgaaacccgaattgcctcttataatagcgatccgttgattacccgggaaatcgccgtcaatattctcttggatctttaccaaaccgccgagcgagtagttaaagatgccgccgccattacactacctaccctgttgtttatttcaggcagcgattatgtagtgaacaaaaaaccacagcatcagttttatcagcagctaaatacccctatcaaagaaaaacatgtgatggatggcttctaccacgatacgttgggtgaaaaagatcgccatctggtttttgacaaaatccgggtctttattgagcgcatttttgcacttccgcgttatcagcacgattacagccgagaagatacctggagtcactctgccgatgaatttcgaacattaagcacatcattaccgtgtctgtgtccgaagaaactcagctatcagttgatgcgtaaggtaatgagtactcgctggggcagaacttccgagggtgtttgcatcggtctcaaaacggggtttgattccggctccacattagattatgtctaccgcaaccaaccgcagggtaagggcattttggggcgaatactcgataagcattatttgaacagcattggctggcgcggtatacggcagcgcaagatccatattgaaatgttgatccgccatgctattcgcagtctacgtgaacagaatatgcctgtgcatatggttgatatcgccgccggacacggacgctatattcttgacgcaatcaacgatttcagcaaagtcgattctattttgttaagggactatagcgaaatcaatgttaatcaagggcaggcttatattgaggagcgcgatctgacggacaaaattcgttttattatcggtgatgcctttaatgctgaaagcatcgcatccattacgccagcgccgacactgggtattgtatccggtctctatgaattgttccctgataataatttactcagaaattcgctacgcggctttgctgatgttatgacagaaaatggttatctggtgtacaccggccaaccgtggcatccacaaattgaggtcatcgcccgtgttctttccagccatcgtgacagtcaaccgtggatcatgcggcgccgtactcaaggggaaatggacgcattagtggaagccgccgggtttgaaaaactgtaccaactgacagataactggggcattttcactgtttcgattgccaagcgtgttcatcgctga

SEQ ID NO: 3092 - DNA, 1320 bp, Xenorhabdus bovienii
  Coding DNA location: Contig name=SeqID_16888; Position on contig =21781..23100bp; Strand=+
atggaacaccacatgcactcttctctcgatagtcgtcggcgcctatggctgacaggtgttatctggctattgtttctggctccgtttttctttcttacttatggccaggtcaatcagttcacggcacaaagaggcgatgtcggcactgtgatgttcggttgggaacataacatccctttttggtcatggtcgattatcccttactggagtatcgatctgttctacggaatatcgttatttatctgtacccatcgccgtgaacagtggcttcacggctggcgattaatgaccgcatcactgattgcctgtgttggattcttactgttccccctgaaattttcgttctcccgccccaccacagaaggcctatttggctggttatttaatcaactggagttatttgatctgccctataatcaagccccttccctgcacattattctgctgtggttgctctggctgcgctattcagcctacgtgagtggttactggcgtgggttgctgcacatttggtcagtgctgattgcactctcggttctgacgacttggcagcaccattttatcgatgtactaacgggttttgccgttggtgtcatcctcagttacctactgccggtttcataccgctggcgctggcaacctaatcaagatcgctatgcacggaagttattcggctattatctgacaggcagcgctttgttcgcgcttatagcgagtctgctgggggggagtttctggatactgctgtggcctgctgtatcgttactgatgatcgcactgggttacgcaggattaggcagctccgtgtttcaaaaacagccagatggccggatgtcactgtctgcacgctggctactggcgccataccaactgggagcatggctctcttatctctggttccggcgtaaaagcgcacctttcaaccgtataactgaagggattattctcggcagcctgccttgccagcccgttacggcggtcagtgtccttgatataaccgctgagtggcacaggcgatcggatgcccgctcagtaaactatgtttgccagccgcaaatcgacttactaccgctggcacctgaagctctacaatcggcagtttgtacgctggataaactacgccagcagggagatgttttcgttcattgtacgcttggcctgtcacgcagtgcgatggtggtagcagcatggctgctgaaacagcatcctgaatatgatatcaacactgtcgtagcgatcctgcgtaaagccagaccacatgtcacgttcagacaaacacatctcgatgctctgtctcaatgggcaaaaggctacctataa

SEQ ID NO: 3093 - DNA, 501 bp, Xenorhabdus bovienii
  Coding DNA location: Contig name=SeqID_16888; Position on contig =23039..23539bp; Strand=+
atgtcacgttcagacaaacacatctcgatgctctgtctcaatgggcaaaaggctacctataacggggaacataacatgcagccggaaaatctgatcagcaaagtgattatcgcaacgttaaaaagctggcgctttatctcggcactatctgctttttctatcctgatcgcgacggcaatgctgattgctgtcttcaacactaccgccttaaacaacattgcactctatgccgtactattattcacaacgctgtactgccaatactattgttggcgcatttggcttgactgccactattttcagatcctcaattcatcccctgaaaaaagcgccgagttcgatcaaacgttattgctgatatttaacaagttaccccaatcacggacacagaatgatcgctttaacggagcaattaaactgttaaaaaaggctacgattggtctgatcctgcaatggatactgtttttcctgtttctgcttaccttgaaatattcagcctga

SEQ ID NO: 3094 - DNA, 1737 bp, Xenorhabdus bovienii
  Coding DNA location: Contig name=SeqID_16888; Position on contig =23713..25449bp; Strand=+
atgaatactcgtaaaattaatgggatacgcccatttagtgcgtttattgactcatgtctgaaggaatcttactctttcccccgttttatcagagatatcatcgctgggattaccgtgggtgttatcgctatcccattggcaatggctctggcgataggaagcggagttgcaccacagtatggcctgtatactgccgctatcgccggcattgtcatcgccatgaccggaggctcacgttatagcgtttccggcccaacggcggcttttgtggtgatcctttatcctgtttcacagcagtttggtttgagcggcctgctcattgcgacgctgatgtcaggtgtgattttgattgtgatgggattggcacgttttggccggcttatcgaatatattcctatgtctgttacccttggatttacttccggtattgccatcactatcgccaccatgcaggtgcaaaatttctttggcctgaaactggcacatataccggaaaattatattgataaggtagttgcactttatcaagccctgccttcattacaattgagtgatacgcttatcgggctgactacgcttctggtactgattttctggccgaaactgggagtaaagttaccgggtcacttacccgctttgatcgcgggtacagctgttatgggcacgatgcacctgttaagctatgatgtcgccaccattggttcatcttttagttacacactggcggatggctcgcaaggccaaggtattccccccattcttccccaatttgtcctgccatggaatttacccgatacacattctctcaatattagctggaataccgtatcggcattgctgcccgctgcgttttcgatggccatgctgggtgcgattgaatcgttactgtgtgcagtgattctggatggcatgacagggaaaaagcaccattctaacggtgagctgcttggccaggggttgggcaatattgccgcccctttctttggtggcattaccgccacagcggctatcgcccgttcagccgccaatgtgcgggcaggtgcaacttccccgatagccgctgtggtgcattccctgctggtattattaacattgctggttttggctccgatgctctcttatttaccactggcggcaatgtcagccattctgctgattgtcgcgtggaatatgagcgaggcacataaggtagtggatttaatacgccatgcgcctaaagatgacattattgtcatgcttttgtgtctgtcattgactgtcctattcgatatggtcgtcgcgatcactatcggcattgtactggcatcactcctgtttatgcgcaaaattgccaatatgactcgaatcagcacgtcatctttaacaagcgcggagaaagggttattggtcgtacgaattaacggccctttattcttcgctgccgccgaacgtatttttgccgaactgagagaaaaaagtgttgattatcaaaccatcatcatgcagtgggatgccgtacccgttttggacgctggcggattacacgcttttcagggttttgtgcgcgaacttggcaaagaaaaacatatcgtcgtatgtgatattcccttccagccattaaaaacgctggcaagagccaaagttatgccaattgaaggagagctgagtttttatgctaccttacccaaggcactaaaagagatggcagttgattacacgcctgaggtgtgtgcttcttcagaaaagattcaaggttag

SEQ ID NO: 3095 - DNA, 855 bp, Xenorhabdus bovienii
  Coding DNA location: Contig name=SeqID_16888; Position on contig =25517..26371bp; Strand=-
atgcaacagaaagtggttaatattggtgatatcaaggtcgcaaatgatctgccatttgtattgtttggtggaatgaacgtccttgaatcacgggatttggccatgcggatttgtgagcactatgtcaccgtgacacaaaaactgggcattccttatgtttttaaagcgtcttttgataaggctaaccgttcttctatccgctcttatcgtgggccagggctggaagaggggatgaaaatctttcaggaactaaaacaaaccttcggcgtgaaaattatcactgatgtgcatgagcctgcacaggctcaaccagtcgcggatgtggtggatgtgattcagcttccagccttcctcgcccgccagaccgatctggttgaagcgatggcgaaaaccggtgctgtgattaatgttaaaaaaccacagtttgttagccctgggcaaatgggcaatattgttgaaaaattcaaagaaggcggcaatgaccaggtgatcctgtgtgaccgtggcagcaactttggttatgacaatctggtggttgacatgctgggcttcggtgtcatgcaacaagctacccaaggtgcgccggttattttcgatgtcactcatgcattacagtgccgcgacccattaggtgcagcttccggtggccgtcgcgcgcaggttgctgaactggctcgtgcgggtatggctgtggggatcgcaggtctgttccttgaagcgcacccagatccagaaaatgccaaatgtgatggcccgtctgctttgccattggcaaaactggagtcattcctgatgcaaattaaagcgattgatgatgttgtgaaaagtttcccggaactggataccagcaaataa

SEQ ID NO: 3096 - DNA, 810 bp, Xenorhabdus bovienii
  Coding DNA location: Contig name=SeqID_16888; Position on contig =26431..27240bp; Strand=-
atgaaacccatagttaattatgaattcaataatactcccctgattgacggtattattctggtatcaaaaattatccgccctgattttcctcagactctggtgagtgagcagctaactgcattggttgaagaagcccggcagaggctttcctccattaccgattccaaagtgaaattggattcgctgctgacacttttttatcgggaatggaagtttggtggagctaatggggtgtattgtctgtcagataccctgtggctggatcgcttactccattcacgtcaaggctcacctgtatcattgggtacggtgtttacgcatattgctcaggcgctggggctgtcggtacagcctgtcatatttccaatccaactgatattgcggattgatttgcttgatcagcccacttggttcattaatcccttgaatggggatacgctgaatgaacatacgctggatgtctggttaaaaggtaatattggcccaactgttcgtctgaaaaaacaggatttgcaggaagccgataatgtcagcctcgtgcgcaaaatcactgacaccatcaaagtttctctgatggaagagaaaaagatggaactggcgctgaaggccagcgaagtggtgctgacgtttgatcccgatgacccctatgaaatccgcgatcgggggcttatctatgcccagctcgactgcaatcatattgctgtttcggatttgagttattttgtcgagcattgccctgaggacccaatctcagaaatgataaaaatgcaaattaacaccatagaacagcggttgattgtcctgcattag

SEQ ID NO: 3097 - DNA, 861 bp, Xenorhabdus bovienii
  Coding DNA location: Contig name=SeqID_16888; Position on contig =27224..28084bp; Strand=-
atgaattaccaatgctggctacaacatgcggctacccagttgtctgaaagtgacagccctaagcgtgatgcggaaatcttgttgggatacgtgacagggcgttcccgtacttatctgattgctttcgatgaaacgctaatctcatcggaagaattgcatcagcttgatagcctgctggtgcgccgcattcagggagagccggtagcttatattattggtgaacgggaattctggtcactgccgtttgccgtatcaccagcgacgttgatcccgcgtcctgatactgaatgtctggtggagaaggcattggaattattgcctgattctccagcccggattctggatctggggacggggacgggagcgattgcactggcactggcaagtgagcggaatgattgttatgtgacgggggtcgatatcaactctgatgctgtgatgctggcgcaacataatgctgaaaaaaacgccggaaaactggccattcacaatgtgaattttttgcaaagtgagtggtttgcagcagtgggtaaccaacaatttgatatgattgtcagcaatcctccgtatatagatgagcgtgatcctcatctacaagaaggggatatcaggtttgaaccagccactgcattgatcgctgcacaaaatggcatggcggatttgcaggcaattgtgggacaggcgcgccatttcctgtcaccaaatggatggctattgctggaacatggctggaaacagggaaccgttgtcagaaacctatttttagagaagggttatcaacagatagcgacttttcaggattatggcggtaatgaacgcatcacgataggtcgatggaataaaaatgaaacccatagttaa

SEQ ID NO: 3098 - DNA, 1083 bp, Xenorhabdus bovienii
  Coding DNA location: Contig name=SeqID_16888; Position on contig =28084..29166bp; Strand=-
atgaagccttctattgtcgctaaactggaagcattgcaagaacgccatgaagaagttttggttcacctcggtgatgccagtgttattgctgatcaagatcgtttccgtgcattgtcaaaggaatatgctcaactcaccgatgtgacccattgtttcaaatcctggaaaacggttcaggaggatttacagacagcggagatgatgcttgacgatctcgaaatgcgggaaatggcgcaggaagagctcaaggaggcaaaaattcgtaatgaagagctggaacagcagctacagctactgctgttgccgaaagatccggatgatgagcgcaactgtttccttgaagtccgggcaggaaccggtggcgatgaagccgcgatatttgcgggagacttgttccgcatgtatagccgctatgcggaagcccgccgctggagagtagagattataagcgccaacgaaggcgagcatggtggctacaaagaagtgattgccaaagtttcgggtgatcaggtttatggtcacttgaaatttgaatcaggcggtcatcgtgtccagcgtgtaccggaaacggaatctcaggggcgcattcacacttctgcctgtactgtagctgtcatgccagaaattccagaagctgaattaccggacatcagcccaggtgatttgaaaatagatacgtttcgctcttccggtgcgggtgggcagcacgtcaataccaccgattctgcgattcgaattacccatctcccaacggggatcgtagtggaatgtcaggatgagcgttcccagcacaaaaacaaagcaaaagcgatgtccgtattggcagcgcgtatccgtgctgctgagatgcggaagcgccaagaagtggaagcctctgaacgccgaaatttgttgggttctggtgaccgctcagatcgcaaccgcacctataacttcccacaggggcgtgtgactgatcaccgaatcaatctgacgttataccgccttgatgaagtgatagaaggcaaactggatatgcttattcagccgatcattatcgaatatcaggcagatcaactgtctgcactgtcagagcaggattaa

SEQ ID NO: 3099 - DNA, 1263 bp, Xenorhabdus bovienii
  Coding DNA location: Contig name=SeqID_16888; Position on contig =29197..30459bp; Strand=-
atgactttattagcactcggtatcaatcataaaaccgcgcctgtttccttacgtgagcgggtggcattttctcctgacacaatcgggcttgcgcttgataacttgctccagcagccgctggtgcgaggtggcgttgtactgtcaacctgcaaccgcaccgaactctatctcagcgttgagcagcaggataatttaaaagagcagttaatcagttggttgtgtgagtatcaccagctcaatcctgacgatctgaaagccagcctttattggcatttggataatgacgccgtcagccacttgatgcgagtggcgagtggtctcgattcgctggtacttggggagccacagattctggggcaggtaaagaaagcctttgctgagtcgcaaaattatcaatccctgtcaggggaactggagcgcctgttccagaaatctttttcagttgccaagcgggtcagaacagaaacggaaattggcgcaaatgcggtttctgtggcttttgctgcctgtacgcttgcccgacagattttcgaatctctgtctaaattgaatattctgctggtgggggcaggggaaacgattgaattggttgctcgccatctcaaggaacaccgtgtgcgtcacatgatgattgccaaccgcacgaaagagcgggcgcagacactcgccagtcaagtgaatgcggaggttatttccttgtccgaaattgatacccggctggcagaagccgatattgtgatcagctctaccgccagcccactgccgattatcggtaaaggcatggtcgaacgggcgttgaaagtccgccgcaaccagccgatgttactgattgatatcgctgttcctcgcgatattgaaccggacgttgaaaaattgagcgatgtttatctatacagtgttgacgatttacaggccattattcagcaaaatctggctcaacgtaaggctgccgctgttgtcgcggaaggcattgtgcagcaggaaagccgctatttcatggattggttgcgctctcaaggggcggtcaatacaatccgggaatatcgggaacaggcagaaaaagtcagggccgaaatgacagcaaaagcattgatgtccatcaggcagggtgctgatgctgaacagatcatcaaccagctgactcaccaattgacgaatcgtctgctccatacacccactaaatcacttcaacaggcggccagtgatggcgatttggaacgcctgaatctcttacgggacagccttgggctggatcataactaa

SEQ ID NO: 3100 - DNA, 150 bp, Xenorhabdus bovienii
  Coding DNA location: Contig name=SeqID_16888; Position on contig =30570..30719bp; Strand=+
atgcatcaattcaataaaagtcaatcggacggctatgccgtaatttattcgagaaatgttgacaaaatttcgctaaattatcaccttgattatagacttggatggcgcattagttacccatcagactattttattgctaagggttactga

SEQ ID NO: 3101 - DNA, 618 bp, Xenorhabdus bovienii
  Coding DNA location: Contig name=SeqID_16888; Position on contig =30720..31337bp; Strand=+
atgaaaacatcatcacttttttgcttacttcccctctctgcggttttgctgacagcctgtaccgtcacacagcctcctacaggtacaggttccgccaattctccgcaatggcatacccgtgaacagcaactgcaaaaactgaaaaattaccagacccgaggctcttttgcttatttggcaaatgaaaagaaaatctatgcccgctttttctggcaacagtattcgcctgataactataagctgttgttgcttaatccactaggtacaacagaattggaattattcgtccagccgaatatgattcagcttactgacaataagggtaaaaaatacctcagtgatactcctgaggcattaatttatcagcttaccgatatgaatattcctctgaataatctgaaaaactggattatcggcttacccggcgatgccaaagattttcagttagatgagaattacttgctcaaatcggtgagtagcaagaaaaatggtgagatctggaaaatcaattatcagggttatgatgcttctaccatgccagcgttgcctaatcgattagaactcactcagggcaagaaccgcataaaattgaaaatggataactggacaacccaataa

SEQ ID NO: 3102 - DNA, 894 bp, Xenorhabdus bovienii
  Coding DNA location: Contig name=SeqID_16888; Position on contig =31337..32230bp; Strand=+
atgacgttgacttggccttctccggcaaaattgaatttattcttgtatattactggccaacggcctgatggctaccacgaactgcaaacgctgttccagtttctggactatggcgacgagatcacgattaccccccgtcaggataatcaaatccacctgctgacgcccgttgaaggcgtagcccatgacgataatctgatcgtccgggctgcccgattattgcagaatcatttattacaaaatcagttattgcagaataatagtcagggaaccgaacatctgggcgccgatatccacatcgataaatgcctgccaatggggggaggtctgggtggtggttcttctaatgccgcgaccgtactgattgccttgaattaccactggcaagccaatttgtccgatgatgaactggcacagcttggcatcagccttggcgcggacgttcccgtatttgttaaaggccatgctgcttttgccgaaggcattggggaaaaactccgtccggcatcaccggaagaaaaatggtttctggttgctcatcccggaattgagatttcaactccgacgatcttcacagatcctgaattaaaaagaaattcgccgattcgttctctacccgcattattacaggcaccattcacaaatgattgtgagtcaatcgcaagaaaacgttttcgtgaggttgaacagcttctttcatggctgctagaatacgcaccgtcgcgcctgaccggaaccggtgcgtgtgttttcggcgagttcgaatcagaagcatcggcccgtaaggtgttaaatcaatccccagagtggatgcagggctttgttgcgcatggagtcaacatttcaccattgcatacattccgctctgggatatacatgttattgaaccaatga

SEQ ID NO: 3103 - DNA, 939 bp, Xenorhabdus bovienii
  Coding DNA location: Contig name=SeqID_16888; Position on contig =32298..33236bp; Strand=+
atgaagctttttgctggtaatgccacccctgaactagcacaacgtgttgccaaccgcctgtacactagccttggagacgctgccgtcggtcgttttagcgacggtgaagtcagtgttcaaatcaatgaaaatgtacgcggtggtgatgtattcatcatccagtccacctgtgcaccaaccaatgacaacctgatggaattggtcgttatggtcgatgcgcttcgtcgcgcttctgccggacgtattactgctgttattccttacttcggttatgcccgtcaggatcgccgtgtccgttcagcacgtgtgcctatcactgctaaagtcgttgcggactttttgtccagcgttggggtagaccgcgttcttacggttgacctacacgccgagcagatccaaggtttctttgatgttccggttgataatgtatttggtagcccaatccttctggaagatatgcttcagaaaggcctggaaaacccaattgttgtctctccagacattggtggtgttgttcgcgcccgtgcaatcgccaaactgttgaatgatacggatatggccatcattgataaacgtcgcccacgtgcaaacgtttctcaagtcatgcatatcattggtgacgtcgctggccgtgactgcgttctggttgatgacatgatcgacacaggtggcacactgtgtaaagctgctgaggcattgaaagagcgtggagcgaaacgggtgtttgcttatgcaacccaccctatcttttctggtaatgcagtagaaaacatcaagaactcagtgatagatgaatttatcgtttgtgacaccattcctctgtctgctgagatcaaagcgttgaataaagttcgcactctgacactgtctggcatgcttgctgaagctatccgtcgtatcagcaatgaagagtcaatctctgcgatgtttgagcactaa

SEQ ID NO: 3104 - DNA, 1983 bp, Xenorhabdus bovienii
  Coding DNA location: Contig name=SeqID_16888; Position on contig =33888..35870bp; Strand=+
atgaaaaaagcatttttattcacacctgctctattagcgctttcaatcagtgccatttccaatgcccatgcttataacaacacctatgtctttggcgatagcttgagtgatagcgggaataatgggcgatataccacagatgggaaaaccagtcagctttatggtgagtatgttgctcaacatattactggtagtaaacccaccgcttccaaagatggtggcaccaactacgcccaaggcggtgctactgctattgaatcattaaaccctaaatataataccgccgaacaagtcaaaaactatctggctgcacataataaccgtgcggatgccaatggcgtatatattcactggataggtggtaatgatctcgcagccgctttgatggctggtcaaaagaatccacttgatgcttataatattgtcaacatgagtgcctctgccgccggagaacagattaatcagttggttaacgccggtgctggcttaatcattgctcctactgctcctgatgttggtattacaccaaagctgctggaaacggtgattgaagatggattaaaaaaagtaggcgcttctgattcgatgatcaaacagacattggaaaaaatccatcaggaaattaatgaaaatcctatccccaataacgagatccgtaatctggctatccaacaagttttccacaaattagcgcaaaaagcagcagaattaaaacctggcctaaatgctgacgaagttgaaaaagagcttaacgtgaaatataaagtagccaatgagggtgccacaaaactaaccaatgactacaataatctggtagatgacaaaatcagccagagcaatggcaatattatgcgtgtcgatgccaacggtctgctgaaggaagtgatcgcaaatcctctgatttacggtattgaaaatactctgggctatgcttgcgcacaaggaaaggaagccaaagaatgctctgccacagacccacaaacagacccacaatatgacaagagcaagccgtttttattcactgacaacttccacccaaccccgcttggccatctcatactgggtcaatatattgaatccatctacaatgcgccatcacaggtcatgaccctgaatcaagtcaaccgtatccccgtcaaaggtgttcgcgcttcccttgatggtcacctgcaacaacttcgcaatggtggcaatgctcagggtaaaattggcatctttggcggctacacaggcagccacaacaacaccttcacactgggtggtgattatcagctcactgataacctgctgctgggtgctgtatattctaactataaggatgaacgcacctctgcctccaatttcacgcatgaaggacgtgctcacgtagtgacaacttacgcgttgtggaacttctatgacaaaggttggttaagtggcgatctccattattcaaacaacaaatacgatagtctgacacgtagcattcagttaggtcaggcgacacgccgggaaaccggttctaccaccggtaaacaatggggtggacgcctcacggcaggctgggatatcgctgtcaccaatcaaatcaccaccagcccgattatccagtatgcgtgggataaaggtgatatcaaaggctaccgtgaatccggcgacaacagcacctccatgcattttgctgatcaagactacacttccaaagtcggcacactgggctggcgtgtggatactcagttaggccgcatcaatccttatgcttctgtccagtttaatcacgaattcggtgacacacgctataaactgcgcagcgccatcaattccactgaaacgtcctttgtacgggaaagtggcaaacagaacactgactggcgtcaatatactgtcggtgtgaatgctaacctgttcaataactggcgcggcttcgcttctgtaacccgtaacgagagtaattctcaagagcataactacaatttcagtctgggcatcaacgccagcttctga

SEQ ID NO: 3105 - DNA, 276 bp, Xenorhabdus bovienii
  Coding DNA location: Contig name=SeqID_16888; Position on contig =35938..36213bp; Strand=-
atgaaacgtaaaaatgctttcattctcggtaacatttttatggggttagggatggcggcaatgctgattagcttgtcttatgtattgctcagtcatgtgtttagtttagaccagtctggattggccacaggtatttcattgatgggtttatttgttggtgcattggtttggttggcgggtgccagtatcggtgggcgtgagcaggttactgataagtattggtggttgaagaattatgacgagcgttatcgccgtaaaaaacacagaacctcatga

SEQ ID NO: 3106 - DNA, 234 bp, Xenorhabdus bovienii
  Coding DNA location: Contig name=SeqID_16888; Position on contig =36191..36424bp; Strand=+
atgaaagcatttttacgtttcatcaccaacctccaatacttttctgaactcaatttacaaatgaaacgaactcaaaagcacgaaagtagatacatccttggttatattatagccttattatctaaaaggttattgcggcggcgatcacaagttgtacaaatctcaacgcatttttacacttcaccgaaaggggattcagcaacaataatttgccccccatgtttaacacattga

SEQ ID NO: 3107 - DNA, 762 bp, Xenorhabdus bovienii
  Coding DNA location: Contig name=SeqID_16888; Position on contig =36768..37529bp; Strand=-
atgttggtcaggaattggttgcccagaccttcgccttttgaggcgcctttcaccagacctgcaatatccacgaattccatcgtggttggtagtatgcgctggggtttgacaatttcagccaattggtcaagacgtgagtctggcatcggcacaacaccggtgtttggctcgatagtgcagaaagggaagtttgctgcttcgatacctgctttggtcagcgcattgaataatgtagatttcccaacgttaggcaggccaacgataccgcatttgaatcccatatatttattacctcagatcacttataaaccagcgggcaagatgcctgttggtgagttatacaaaattggcgctattatacacgcaataactagccacgccatgcacagcctgttaagcgctggctttaaaagcatgcagacggttaatggccttgttcatgccatctttcatcagaatgtccgtgcagctcagtgcttcatcaatggcatcatcgatcagcttttgctcactggcaggaggcttgccaagtacaaaacccaccactttatttttgtcacccggatggccgatgccaatgcgcagacggtggaagttagggttattactgaacttgttctgaatgtctttcaaaccgttatggccaccgttactgccccccagtttcatttttgctacgccgggtggcagatcaagttcatcgtgcgcgaccagaatttcatccggctggatgcggtagaatccggcgagggcaaggactga

SEQ ID NO: 3108 - DNA, 1092 bp, Xenorhabdus bovienii
  Coding DNA location: Contig name=SeqID_16888; Position on contig =37249..38340bp; Strand=+
atgggattcaaatgcggtatcgttggcctgcctaacgttgggaaatctacattattcaatgcgctgaccaaagcaggtatcgaagcagcaaacttccctttctgcactatcgagccaaacaccggtgttgtgccgatgccagactcacgtcttgaccaattggctgaaattgtcaaaccccagcgcatactaccaaccacgatggaattcgtggatattgcaggtctggtgaaaggcgcctcaaaaggcgaaggtctgggcaaccaattcctgaccaacattcgtgaaacagaggctatcggtcacgttgtgcgctgcttcgaaaacgacaatatcattcacgtttctggtcaggttgatcctgcctcagatatcgaaattatcaataccgagctggcactggcggatctggatacctgtgagcgtgctatccaccgcgttcagaagaaagccaaaggtggcgataaagatgctaaagcagagctggaagcactggaaaaatgtcttcctcaccttgagcaggccggtatgctgcgtgccttagacctgagtgcggaagaaaaagcggcgattcgctacctcagcttcctgactttgaaaccaaccatgtacattgccaacgtcaatgaagatggttttgagaataacccacatcttgataccgttcgcgccattgcagaagcagaaggctctgtcgtggttccggtttgtgctgctattgaatcagacatcgctgagctggaagatggcgaccgtgaagaattcatggctgaactaggtctggaagaaccgggcctgaaccgtgtcattcgcgctggttatcaattactgaacctgcaaacttacttcaccgctggcgtgaaagaagttcgtgcatggacgatcccggttggtgccacagcgccacaggcagcgggtaaaatccacaccgacttcgaaaaaggatttatccgtgcccagaccatcgcgtttgaagatttcatcaattacaaaggtgaacaaggcgcgaaagaagccggcaaaatgcgtgctgaaggtaaagactacatcgttaaagatggcgatgtgatgaacttcttgttcaacgtctga

SEQ ID NO: 3109 - DNA, 405 bp, Xenorhabdus bovienii
  Coding DNA location: Contig name=SeqID_16888; Position on contig =38439..38843bp; Strand=-
atgctgccagaattctcccgcagggcgagagctgttgaagtgtgggcagcgatttcagaactcggcgtacaagggattcaggtgctgattgaacgctgctgtttgtacgcaaaaatgctggctgaggggctagaattacttggttttaaagttcttaatgaaattgttctcaatcaggtggttgcgtgtttgccagatataatcttgcagcgagctatgctgcaaaaagttcagcagtcaggtgaatgctggtttgggcaaacaatatggcaggggcaagaggccattcgtttgagtgtcagctcttgggctaccaccgaagatgatattcaacgtagcttgaaagcgattgccgatgcgattgatgaggttaaatatgctgatgggatggtaagacaaagttag

SEQ ID NO: 3110 - DNA, 987 bp, Xenorhabdus bovienii
  Coding DNA location: Contig name=SeqID_16888; Position on contig =38853..39839bp; Strand=-
atgaaagatcctattcgtgatgcctcgctgtctgcggttaaggtagcgagtgaaatcgcgtataactacgtcagtaaggtgagaaaccaacgagtatttcccgattctggcgctttatcgggtctacagaatcttgataggccattaccccaacatggaacggattgccaacaagtgcttgcgcagctccataggtacggctcgcccgcgacggtggcgacaacaggaggccgatatttcggtttggttgttggtggttcaacgccggcagctatgggagcaaacatcgtgaccagtgcgtgggatcagatagcgttgatggagtcgtcttcgcctgttgctgatcaattagaaaaaattgccggacgctgggttttggaactgctgaatttaccgccagaggcgtttgtcggttttgtgactggcacaacaatggctcatgtaagtgccttggcagccgcccggcaatatttgtatcagaaaaaagggtatgacttcgcagaacatggtttacaaaatgcacctcaattgaaagtcgtactatctgaagaagttcacatatcagttttaaaggcgctgaggttgctcggttttggtcgttcacagttgaatattgtgccatgcgatagccaaggacgaatcattgagagtgccgtcccagagttttcagataatacgattctggtattgcaggcgggcaatgttaactctggtagctcggataactttcacgcacttattccccgagctaaaaaagcaggcagttgggtacatgtggatggggcatttgggctttgggcgcgagcttcgagtgcgcaatccgcattagtcaagggcgttgaagaagctgactcttgggcggtagatgcacacaagtggctcaatactccatacgattgtggtatgtgtatcgtgcgtcataaacatgcgttgagagaagtgatgacgacttcggcagcgtatgtggagactcaagatatgtggtag

SEQ ID NO: 3111 - DNA, 924 bp, Xenorhabdus bovienii
  Coding DNA location: Contig name=SeqID_16888; Position on contig =40114..41037bp; Strand=+
atgagtgcattacatcaccactccggtgcaacagaaattgaaattcagttacaacaattaatcgggaaagtggccagcttgacgcgacctaatacacatgcagccaaaactgcgatccctgaaatgacattgtgtcatttagaacagccgacggcaccagtaggctggttgtacgaacccagcatcatgatcattgcccaaggaaaaaaacggataactatcggcgggtgctcttattgttgtgatgccagccaatttatggtgacttccaccgatattcccaccattactcaagtttgcaccgcttcgaaagaagaacccttttttgccatgatgttacagtttaatattcaggaagcctcagaattactgatagaaaatcatgttgcgatccggcaggattcgccagaaacatgcgggttagcagttactcccgtaacagcagaactgctggtttgtttcaatcggctactggatttattgaatacaccggaagatatccccgtactttcaccactgattcaaaaagagattgtctatcgtctgttaaaaagtgaattgggtggacgactgcaacaaatggcctcacaggaaagccccagccatcaaatcagcaagaccattaactggctgaaagatcactttgctgaccccatcaaagtcgaacaactcgcacaaatcgcccgaatgagtccttcatcctttcatcaccattttaaggcggtgacttcaatgagcccactccagtatcagaaatggctgcgtttaaatgaagcgagacgaatattattgacgcaacaccataacgtatcagccaccgcatttcaggtgggttatgaaagcccttcccagttcaaccgtgaatacagccgtctatttggtgagccaccctgtcgggatatcaagcggctgcgagtaagatga

SEQ ID NO: 3112 - DNA, 126 bp, Xenorhabdus bovienii
  Coding DNA location: Contig name=SeqID_16888; Position on contig =41034..41159bp; Strand=+
atgatgattaaccaatcgccatcaaatgaccttgataaaacgttaaatgcgaaaacaatatctctttggaggatcaggcaacgattggaaataactgggcacccatccggccaaaattggatctaa

SEQ ID NO: 3113 - DNA, 585 bp, Xenorhabdus bovienii
  Coding DNA location: Contig name=SeqID_16888; Position on contig =41196..41780bp; Strand=+
atgattataacccatattttggttattaactcagcaaaagagtttggtgaatcaaaaggagaactgaataacgcgttaacagagatcatcaaggatcatctgacaggaatggggcacgagatccaaataactcatgttgataagggttatgatattcaggcagaagtcgataaatttatttgggcagacagtgttatttaccagatgccgggctggtggatggaagcaccgtggattttgaaaaagtatgttgatgaagtttttagtgccggtgacggtacgttatttcaagatgatgggagaacgcgcagtgatcttaccaaaaaatatggctcaggcggtttatctcagggtaagacttacatgttttcagtaacttggaatgcaccgctggaatcttttgaagaccccgaacagttctttgaaggaaaaggcatcaacaacgtttattacccttttcataaagcaaatcagtttttaggcatgtcacccttaccgacgtttgcttgctatgacgtggtgaaacagccacagattgcacaggatattaagcggttaaaaatgcacttgtctgatcattattga

SEQ ID NO: 3114 - DNA, 1656 bp, Xenorhabdus bovienii
  Coding DNA location: Contig name=SeqID_16888; Position on contig =41964..43619bp; Strand=+
atgactctaatagcttatctataccgccaatcttggatattactgcttttatcgacaataagcgcattaattagtggatttgccggtgcatctgtagtaagtacaattagcaaaggaattacagaaacaattgagcttaattcctttctctggagcttttttggtatatgtattatttttttcattactaaaacgctatccgaggttatcctctcgcatttaacccaagcgacaatttattcattacgcctcagtctgagtgctaaaatattacgcgcgccttacaaaaaacttaataaactcgggagacacggcctattagctgttttaactaaagatgtcgatgtatttatacaatcttttatgttagccccaactgcttttggaaatatcacccttattttcgcctgttttggttatttagcgtggatttcctggcaactctttgtcattttgatccttttatgtctggtgatgatgtatattttttatcttctggaaaaacggcctatacgtttaatgactgaaatgcgtgatcaggtggacaggctgtatctcaatttccagagcctgatcgatggaagcaaagagctgcaactcaatacgcagaaaggcgatgcttttattgataaagtcatttctcccggtgccagaaaatttaaagagatttgtattaaagcaaccacgggttatgcgtgggtgctgaatgccagctcaatcgctttttatatgattatcggcatcatggtctttgtcgtaccaatctggttgcctcaagacccggccagtctggtgacagtgacattagttgtgctctttctggctggccctatcagtgaagttgtcggtgccattccagaactgagagaagccgaaatctcgctgaataaaatgcgtcaacttgacagtgacttagacgaagggcaggaaaatcaatcagtgcagggtgacacgccaaacccattcttgagtgaaaaacccctagtacttgagttgaaggatatcgtccatcactatacgactgataaagaagaccgtcagtttatgctcggccctttaagcctgaaaatatctcagggcgaaattgtctttattgtcgggggtaatggtagcggtaagaccacgttagccatgatgctggtcggtttattcgaacaggaatccggttctatctggcttaacggtgtcaagatggatgcatctaacaatgtccactatcgccaattcttttccgctgtattttccaactatcatctatttgatcagctcttaaataccggtacagacgtcacagagaaagcgactcattacattcaggcattaaacatgggtcacaaagtgaagattattgatggtaaattctctacgacagagctttcagccggtcaaagaaagcggctggctttggtcgctgcttatttggaagaccgccctctttatctttttgatgagtgggctgctgaccaagatccggtgtttaaacggctgttctatacagagcttctgccagagttaaggtctcgtggaaaaacggttattgtgattagccatgacgatgcttatttcgatattgctgaacgtgttattaaactggaagatggtaatattaaagaaataaataatcatagtcatgaaaccattacggaactaaaataa

SEQ ID NO: 3115 - DNA, 99 bp, Xenorhabdus bovienii
  Coding DNA location: Contig name=SeqID_16888; Position on contig =43701..43799bp; Strand=-
atggttagctgtgttttacttatgtatctaattttattacaggtaatgtgtatcttcgttgttaataatttatattacataataattttaataatgtaa

SEQ ID NO: 3116 - DNA, 141 bp, Xenorhabdus bovienii
  Coding DNA location: Contig name=SeqID_16888; Position on contig =43792..43932bp; Strand=-
atgccatccttagaaaaagaatggcatattttaaaaaaactgataagcaaatttcattttgttcagaaaatatactttgattttttcatgacattcgagaggatgaattatatattaaatcaatgtattttgcatggttag

SEQ ID NO: 3117 - DNA, 3270 bp, Xenorhabdus bovienii
  Coding DNA location: Contig name=SeqID_16888; Position on contig =44106..47375bp; Strand=+
atgaaccaccctgaaaagttgaagccatttgctttatccgaagcacaaagcagccgttggtttcaatatcaaattaacccaagccaacgtgggcgaaataatggtgcgttttgtgccagagttgaggggttaaacgctcaagatttagaagatgcactcaatcacctgatcaagcgccacccgatgctgcgagccagttttgggctatacgatggcgaattgggatatcgcatagcagagaatagcgaaatcaaagttcagacacatgatgcccggcacctcagcgaagacactcttcagcaacttgtatttgacgattgccggcatgttctcgatctggaaaatccgctgcgcttttatgccagttggtatcaatgcaatgcgcaagaaagtgtcatggtattgacgttcgatcacttagttgtcgatggttggtcttactggctgttgctggaagaactcggcatgattctgacctcacaggaattagaaccgatatcagaacacagttatcaagattatgtttcatggcagcagcaatggttaaacagtaaaagtgcaaaaaaacaacaacaattctggtgcgataatctggctggtaatttgagcgcattatcatggccgatgaaaatcggatcaatacagaacggagcagataacaacgccgcccctccagccacggataagatcacggcgttcggtagaatccctgatgatttagcccttaagctgtgtgctatggcatcggaatatggcaacagcctgttcgctatttttctgtctgcctatcaaatcctgcttaatcgctataccgcgcaggacgatatcgttatcggctcaatgatgccgggtcggagtcaagctaaatggggtaagttggtaggggaatttgtcaatccggtcgctttacggggtcaaatcaacggtaatgtcactgtacaggaacatattcttcaaaccgcgaagactatccgtcaggcgattgaaaaccagagataccctttcaccaaggttctggaacaatttaaattacagcgcactgcggatacgcatccgattttccagactctgatgacctttcaaaaacccagatatgtcagtgaactaccaacattatggatggatgacgattccagcacgacagtgcattggggtggcgcggaattaaggcctttcccgcatcctctttatgccgatacccccgtccccctgatggtgaatatgatggaggtcaatcaacagatccgttgtcatttccattacgatccccaagtgttcgatgctgagttaatcaatcaactcataaaaaatctcatcactttgctcacggcaatggcggataaccaacaacagtctatcgacagcttaccgctgatggatgagcaggaactccggcaggttctctatgatttcaacaagacggataagccttttcctcaacacgctctgattcatcaattattcgaacagcaagtcgaacgcacacctgacgccatcgccctgagttgcggtgataaggcgttaagctataccgaacttaaccaacaagccaatcgattggctcatgccttaattaaagctggtattcgtccggataatcgtgtcgctatctgcatggagcgcagtctggagatggtcattggcctgctgggaatattaaaagccggcgctgcttacgttccgctcgaccctgaatatccgacagatcggctcggccatattctgtcagacagtgaccctgcacttctgctgattcatcacggcctgcaagatcatttaccgatgacaactatgcctgtatgggtattggagagtgaagagtatcgaacaaatatcgccagtcagccgacggataacccggttgccaccgatttaggtctgacgtcccgccatttagcctatgtgctttacacctctggctcaacaggcttaccgaaaggggtcatgaatgagcaccgtggagtcgtcaaccgcttgttgtgggcgcaggatgaatatcaattaactcagcatgatcgggtattgcaaaaaacaccgttcagttttgatgtctcagtctgggagtttttcctgcctctgcttgccggcgctcaattagtcatggcgcgtcccggtggtcataaggaagcgctctatctgctggaagaaatcgaagcgcggggcattactacccttcattttgtgccttccatgctgcaaagttttattcatctgacacccgccggccgttgcccttctttgcgtcagattttgtgcagcggagaagccttgtcgtattccttacaacagcagtgtctggctcattttgctcacagcgaacttcacaacctgtatggcccgacggaagccgcaatcgatgtcacctcttggcgatgtgtacccgatcagcatatcggtctggttcccattggtcaccctatcgacaatacccagatctatatccttgataaacatgatcagcctgttcccattggcgtaatcggggaaatttatatcgcgggtgcgggtgttgcccggggttatctgaataaaccggaattgacagcggaacgctttatccgtgatccgttcagtcagcatcctgacatgcggatgtacaaaaccggcgacatcgggcgttggctagccgatggcagcatcgattatctgggacgcaacgactttcaggtcaagatacggggaaatcgcattgaactgggggaaattgaagcgcgcctggctcagtctgacggcgttcagaatgtgattgttatcgcccgtgaatatgatgccggagatacacggctagtcgcttatctcatccccaagcccggcgtcactctgagcattcccgctctacgggaacaagtgggcggcagtctgcctgattacatgatcccgagtgcatttgtgatgctggatgctttcccactcacgctgaatggcaaattggatcgtaaagcactgcctgcccccgatcactcggccgtcctcacacgggaatatgcggctccacaaggtgaaaccgaagaacaactggccgatatctggcaaaggttactgaaaatcgatcgcgtcgggcgtaatgacaattttttcgagctggggggtcattcgctgctgatgctacagctacagtcaagaataagtgaaaactttgatgtcgaactctctattcaacaattgtttgcacaccccactatttgccaacttgaagaacacattattgatgctcagttactgcaatttgacgctgaatccttgcaagatctctacaaaacaatgggttaa

SEQ ID NO: 3118 - DNA, 9951 bp, Xenorhabdus bovienii
  Coding DNA location: Contig name=SeqID_16888; Position on contig =47413..57363bp; Strand=+
atgaatgataatgaattaatatctttaccattagcagaacgtaaaagactacttgagttagctaaagcagcaaagctaactcgtcagcagacacaaaaaacagaaatccatgcacaaccccatgatgggaatgtgccattgtcctgggcgcaacagcgcctctggtttttaacgcaattagatcctgcggcacaaacggcataccacatgtcggcagggctgaacctgcaaggtcacctgaatcagaacgcgcttaaagccgcgctggatcagattgtggcacgtcatgaaattctgcgtaccaccatcgtagacgtcgaaggacagccccaacaaatcattggcagtgctgatagtggttttgcgttatctgtacaagatctcagccagttacccaccacagaacagcaggcggcggtagaagaatgcgcccagcgtgaagccctccttcccttcgattttactcaggggcctttgattagggggcgactgctccgtctggcagaagagagccatgttctgttattaactcagcatcacatcatctccgatggctggtcggtcaatatcttgatgcaggaactttccacactttatcaggccttctgtcaagatcaggccgatccattacccgccttgacactccagtatgctgactatgcgctctggcagcggcaatggttacagggtgacgtgctggaaaaacagttagactactggcgcagtgaattgcagggcgcaccggtgattttagagttacccaccgacaaaccgcgtccaacccaacagagttatgccggaagccgagtcgatataacactgccgcctgcattgagtaccgagttaaaggcattcagtcagcgtcacggcattaccttatttatgaccttattggccggatgggcggtattactttcccgtatcagcggacaacacgatctggtgataggctctcccgtcgcgaatcgccaacggcatgagctggagccgctaataggcttttttgtcaatacgttagcgttacggatccaactgggtgacaaccccagcgtcagcgagctgttggcacgggtgaaaaatcatgctctgggggcttatgcacatcaggatctgccattcgagcaattagttgaggcgttaaaaccgccgcgtagcttgggccatagtcctatttttcaagtgatgctggctctggataatacgccgggacagcaatatttcgagctggatgggctgcatctgcatgaactgccacgaacccgagacagtgcctattttgacctgaccttaacactgaatgatactgagcaaggtttagtcggtgatctggaatatgccagtgatctttttgaacatgccagcattgagcggatggtcggttacctgcaaaccaccctgtcagctatggtggccgatgacagcctgcgggtagacgatcttcccctgctgacctcttcacaacgcactcagttattggcgaactttaacgataccgccattccatatccaaaaaatgctctgatccatcagttgttcgaacaacaggtggagcgcactcctgataaaattgccctggtctggggagaaactcaactgagttactccgagctgaatcagcgagccaatcaactggcacacagcataatggcatcgggagtccatccggatgatcgcgtcgcaatttgtgccgagcgcagtctggatatggtcatcggcctcgtagggattttgaaggcgggcgccagttacattccgctggaccccaatcacccgactgaacggctggcttatatgctgtctgacagtcagccagtattaatgctcactcagcagcacctgaaagcccgcctgcctgtcacaaacataccggtatgggcactggatagtgaagaacatcaaacctgtatcgccagtcagccaaaagacaatatcgacgcgtctcagctagggctgacctcacagaatctggcttatgtgttatacacctccggttcgactggcctgcctaaaggcgtcatgatcgaacaccagaatgtggtgcacttaatccattctcagttccagatgtcaaaattgacaccgcatgattgcgtactgcaatttgcctctttcggatttgataactctgttgctgaaattttcccgacatttgctataggggcaacggtcgttttgcggccagaccatatcaaggtgccggatacggaatttattacctttctgcaaaatcagggcatcacagttgtcgatttgcccaccgctttctggcacctgtgggcacaagaaatcagcgccggttatagctggcctcctgagcaattacgttccgtcgcggccggaggagaaaaagccgagcaccgccatctggtcacgtggctatccagtcctggcacacaaaaatgccgctggctcaatacctatggcccgacagaaaccaccgtcaatgcaacctcgatcgttatcgataaagaaaatctctgcacctatgaagatatcccgataggccggcctatcgccaatacccggatctatattctggatcaacgcggtcaacccgtcccgattggcgtaaatggcgaaattcatatcagtggcagcggggttgcgcgcgggtatctgaaccggtctgagctgacagcagaacgttttattcaagatcccttcagtgacatccccggcgctcgcatgtacaaaaccggcgatttaggtcgctggctaccggatggcaccatcagctattcaggccgcaatgactttcaggtcaaaattcgcggcttccgcattgagttgggtgagatagaagctcaactggcaacctgcgcgggcgtcaaagatgccgttgtcatcgtcagagaagataacagcggcgataaacgtctggtggcttacttaatcccacagtctggtgcaaccctgaacgtggctagcctgcgtgaacaactcagtgtcaatctggcagattacatgctgccaagtgcctttgtcacactggaagccttcccgttaaatcagaacggtaagatagaccgctcggccctgcccgcaccggatcgttcggccagcgtcagtcgcgaatatgctgaacctcagggtgagatcgagcaacaactggccgctatctggcaaaatttattgggattggagcgggtcggccgctatgacagtttctttgaactgggtggacattctttattaaccgtccaagtcgcatctcgtttgcgccagtcgctgaatattgaaataacgttgcaggatctgtttactcaaccggtattagcggatttagcccagtcattggtgacagcaacccagtcaacacagccgatgatcctgcccgccaaccgtgaacaaacattacccctatcctggacacagcaacgtctctggtttttggctcagttagatcccgccgcccagacggcatacaacatgtcgggcgggctgcacctgcaaggccacctgaaccagaacgcgcttaaagccgcgttggatcgcatcgttgcccgtcatgaaattctacgcaccaccatcgtgcaggccgaagggaaagcccggcaagtcattggtgatgcagatggcggtttttctttaaccgtccgggatcttagtcagttatcttcatcagcgcagcaggcaaccattgaggaatgcgcccaatttgaagccagccatcctttcgattttgcgcaagagccgttaatccgcgctcaactgcttaaactcggcgagcagcaacatgttctgctattgacccaacatcacattatttccgatggctggtcgcttaatgtattgatgaacgaactttctgcgctgtaccaagccttcggtcaggggcaagctgatccattgcctgcattagccattcaatatgccgactatgcggtttggcaacggcaatggctgcaaggcgaaaggctggaaaaacagttgagttactggcgcaatgagttacaagatgcccccaccttattagaactgcctactgataaagtccgcccgtcagtacagagttatcatggtgatcaggtcacgttcactttatcgccggaattaaattcagggttaagggcattgagccagcgccacggtgcgacgttgttcatgacattactggccggctggggaattttgctgtcacggttaagtggtcagcccgatttagtgattggtactcccgtcgccaaccgccagtacagcgagttggagcctttaatcggcttcttcgccaatacactggtcctgagaatcaagttagaagataacccgaccgtcagcgcattattggcaagagtgaaggctcatgcgctggaagcctacgcccatcaggatctgccatttgaacaattagtcgaagtgctacaaccgccacgcagtttaagtcacagtccgattttccaagtcatgttggctttagataatacatccagtaaacaaagtttcgaattggcggaattgagcctcaatccgctggcgctgaccagaaatagtgcccattttgatctcactctggcactgagtgacaccgaaaatagtctgacatgtgagttggaatatgccagcgatctttttgaacgttccagtatcgagcgcatggcgggttatctgcaaaacctgctggcggcgatggtcgctgatgacaacctgcgagtcgcagatctgccactattaatgccacatgaacgcactcaattactgaccgactttaacgataccgccgtcacctatccgcaggacaaactgctgtcgcagttatttgaacaacaggtagagcacacacctgatgccattgccctaatctgggaagacgctcaactcagttatgccgaactgaaccagcgcgccaaccaactggctcacgccctgattgcctttggcgttcagcccgatgaccgcgtggcgatttgtatcgagcgtaatctcaacatggtgattgggatgctgggcatactcaaagccggtgccggttatgttccgctcgacccggaataccctgccgagcggctggcctatatcctgtcagacagtgcgccaaaattactgctcacccaacagcatttgcaggcacaattgccggtagagaaactcccggtctggcaactggacgatactggccatttaaatagcgtggcacagcaaccgaccgataaccctgatccacgccagttggggctctttccgcatcatctggcctatatcatctatacctccggctctacgggtctgcccaaaggggtgatgattgaacatcacaacgtcgtgaatttcacctactcccaatgccagaccagtgaactcaaacccactgaccgcgtcctgcaatttgcctcggtttcatttgataccgccgtgtctgaaattttcccgacgttgtcagtcggcgcgaccttgatcctgcgtccggcgcatattcgcatcccggatgccaccttcagtcatttcttgcaggagcaggcgatcagcgtcatcgatctgcccaccgccttctggcaccagtgggtacaggagatgaaagccggccgcagtggtttcagctcccatgtacgttcggtcacggtcggcggtgagaaagccgaacaccgtcatttcgtcacttggcaatcaatgccggaaacccggcactgccgctggatcgatacttacgggccaacggaaacgacggtcagtgccactgcgctgacactggatggccctgcttcctatgtaacagaatccttgtcgattggccgtcccctgatcaatacccacgtttatattcttgatacacaggggcagcccgtccccatcggtgtcaccggagaaatctacattggtggcgcaggcgttgcccggggttatctgaaccgccctgaactcaccgccgagcgttttgtgtccgacccattccgtgaacaaccccatgcacggatgtaccggacgggcgatctgggctgctggcgaccggatggcacaattgtctacctcggccgcaatgattttcaggtcaagatccgcggctttcgcattgaactgggcgaaattgagtctcagttggccgcctgtacaggggtcagtgatgccgtggtggtggcacgtgaagagggcagcggcgataaacgtctggtggcgtacctcgtaccgaagtccgatgtcacactggatgccgccagcctgcgcgaacaactgagcacccacttggctgaatatatgttgccgagtgcattcgtgatactggatgccttcccgctgaacccgaacggcaaactggatcgcaaggcgctgcccgcacccgaccacgccgccaccgtcagccgtgaatatcaagctcctcagggagagatggagcagcaactggccgttatctggcaaaccttgctggggctggaacaggtcgggcgtcaggacaatttctttgaattgggtgggcattccctgctggtggtcagcctgattgaacaactgcgccaaagcagtctgaatctggatgtcagcgccgtcttttcttcgccaacactggcggcgatggcggcgcgtctgatagtgaaaacgtctgatggtgctactggcactagcgtacaaaacgtgccgccgaatctcatcaccgacggttgtcagtccattacaccggagatgctgccactggtggcactgacacaggataacattgaccagatcgtcgcccaaattcccggaggtgtctccaatattcaggatatctatccgttggggccattgcaggaaggcattctgttccaccatttactggaaacaaccggtgacacctatctcgacaaccagctgatgacctttgacagccgcccgcgtctggacacgtttttgctggcactacaacaggttatcaaccgtcacgatatcctgcgcagtgcggttcactggaacggcctgccggagccggtacacgtggttcatcgtcaagcccctcttcccattgccgagctgacgctgtcgccggaacacgatgccgaacagcagttgcgcgatgctaccgattctcgctcggtacggatggatctgactcaagccccgttattgtctatcaagcttgccaaagatccgcatagtgaaacctggtttctggctttactgcaccaccatctggtgtgtgatcacctgtcgctggagatgatatttaacgaagtgcaggcaatgctactgggacaggatgactcgttggcaccatcgttgccttaccgcaactttatcgcccagacccgcaccgtgccgcttgaaaaacatcaggactacttccaccagctcttgggtgatatcgatgaacctaccctgccctttggtttactcgatatacaaggcaactctgatgaacagagtgaaatagcagaagccaacttcactttagataacgaactggcccgaaaaatacgtgactgcgcccgtcagcagggcgtcagtgcggcggtattgttccacgtcgcttgggcgcaggtagtggcgcaatgcagcggacgggatgatgtcgttttcggtacggtattactgggaagattacagggaggctcaggtgccgatcaagtcctcggtatgtttatcaataccttgcctgtgcgcgttttattgcaggaacgcacggtgcgacaaaccgttcaggaaacttaccagcagttaagtttattgctggaacacgaacagaccccgctggccatcgcccagcgttgcagccgtgtgcaggcgcctcaacctctctttaacagcctgcttaatttccgccatagccagcgtgacgataaacagtctgcatcaccggcttgggaaggtattcagatcctcagcggtgaagaacgcagtaattatcctctgtcgctggatgtggatgacttcgatgatggctttgccctgaccgcccagtgtaaccgacaggttgatccggcacgcattaacacttttatggataccgtgctgagagagctggtggccgcactgcaaaacgtctctgaacagagtattcaatctctcgccgtcctgccgccagatgaacgcactcggttactggtggactttaacaatacggcggcttcctatccgcaaaatgtcctgctccaccagccattcgaacagcaagtggaacgcacaccggaggccattgccttaatctgggaaggcactcagctcagctacaccgaactgaaccagcgcgctaaccaactggcacatcacctgatttcgtccggcgttcagcccgatgatcgggtggcgatctgtatcgaacgcaatcttgacatggtgattagtatgctgggcatattaaaagccggtgcaggttacgttccgctcgatccggcctaccctgccgaacgtctggcctatatcctgtcagacagtgcgccgaaattactgctcactcagcagcatttgcaggggcgattagccgtagaggatctccccgtctggcgactggacgatgccgaccatttaagtaccgtggcacagcaaccgaccgataaccctgactcacgccgactggagctacagccgcatcatctggcctatatcatctatacctccggctccaccggactgcctaaaggcgtgatgattgagcaccgcaacgtggtgaatttcacctatgcccagtgtcaggtcagtgaactcaaatccactgaccgcgtcctgcaatttgcctcggtttcgtttgatactgccgtgtctgagattttccccacattggccgtcggcgcgaccttaatcctgcgaccggcgcatattcaagtaccggataccacctttagtgatttcctgcgggagcaggcgatcagtatcgtggatctgcccaccgccttctggcaccagtgggtacaggagatgaaagccggccgcagtggtttcagttccctgctgcgttcggtcacggtcggcggtgaaaaagccgaactgcgtcattacctcacttggcaatcgatgccggaaacccggaattgccgctggatcgactcctacgggccaaccgaaacgaccgttatcaccacggcgctggcactggacaacccgaccgccgatgcttcccgtgcgatggaaacgttgtcgattggccgcccgattgctaatacccggatctatattctcgacacgcgggggcagcctgtacccaccggcgtcaccggagaaatctacattggcggcgcgggggttgcccgaggttacctgaaccggcctgaactcaccaccgaacgttttgtatccgatccctacagtgagcaacccaatgcgcggatgtaccggacaggcgatctgggctgctggcaaccggatggcacgatagtctatctcggccgcaatgactttcaggtcaagctccgtggcttccgcattgaactgggtgaaatcgaaacccaactggccgcctgcctgggtgtcaaggatgccgtggtggtggcgcgtgaagaggatgccggtgataagcgtctggtggcttatgtgatcccgcaacccgatgcgtctttggacgcagccagcctgcgtgaacaactgagcacgcacctgacggaatatatgctgccgagtgcgttcgtgatactggatgccttcccgctgacgccgagtggaaaactggatcgcaaagccctgccggcacccggtcgttccgccagcaccagccatgaatatgaagcccctcaaggtgaaattgaaccgcaactggccgctatctggcagaccctgctgggactggagcaggttgggcgccatgataacttctttgagttaggcgggaattcattatccatcatgcggttatccactcacctgcgtgaagaattccaccttgaaattcctattgcagacatttttcatcactcaacactgtataaacttgctgaacttattctatcaagacaaattgaaacctttttagcccaagatatagagtcggtacaaaaagagttggagaacctgtctgaagaagagttgcttgccatgttaaatggagatcaacaatga

SEQ ID NO: 3119 - DNA, 10737 bp, Xenorhabdus bovienii
  Coding DNA location: Contig name=SeqID_16888; Position on contig =57360..68096bp; Strand=+
atgaacatcaatgaacaaactctggataaattacggcaggcagtgctccagaaaaaaattaaagaacgcatccaaaatagcctgagtactgaaaaatatcagatccagcccagaactgacccacaacaggcgttaccgctatcctgggcgcagcagcgcctatggttccttgctcaattggatcccgccgcacagacggcgtatcacataccggctggccttcatctgcaaggccagctgaaccaaagcgcattacaggccacgctgggtagcctggtggcacgccatgaaattttgcgaaccaccattgcgctggtcgaggggaaagcacagcaaatcattggcgatgcagactgcggctttgctttaaccattcaggatctcagtcagttgcctgaagcagaacaacaaaccactgtcgaagaatatacgcagtctgaagcgagccatccctttgattttgaacatggcccgttgatacggggacgattactcaagctctcgcaggatagccatatcctgctgttaactcagcatcacattatctccgatggctggtcaatcaatgtgttgatgcaggaactctcgacgctttaccacactttcgatcagggtctggcaaacccattaccgccattgacgctccagtatgccgactatgcgctctggcaacggcaatggctgcaaggcgaagtgctggaaaaacaattggattactggtgcaatgcactacaggatgcccctgcgctcttaacactccccacagacagaccccggccgccacagcagagttatgctggtggaagcgttgagatcacgttccctgcgacgctgaatgcacaattaaaaacactcggccaacgtcatgggacaaccttatttatgaccctgttggcgggctgggcagtgttactctcccgcatcagtggacagaaggatctggtaataggcacgcccgtcgcaaatcgccagcatcgtgaactggagcctttgctcggtttctttgtcaatacgttagcgctgcgggtacagttgcatgacaacccaaccgtcagtgagctattggcacaggtgaaagcccataccctgaatgcttacgtgcatcaggatctgccattcgaacagttagttgaagcgttaaaacccccgcgcagcctgagccatagcccgatctttcaggtcatgctgtctcaggaaaatacgccggggcaacaaaacgttgaactaccggggctgacgatcagtgagctggatctacctgaaaacagctcacacttcgacctgtcgttatccctgaatgatagcgaaaacggattggtgggcgcactggaatacgcccgcgatctttttgactcttccagcattgagcgcatggttggttacctgaccaccctgctcaccgccatgacagcggatgacacgctgcgggtggaagcgctgccactcttgatgtcacaagagcgtacccggctattggtggattttaacgaaactaccgtggcctatccgaaagatattctgctccatcagatggttgagcaacaggtcgagcgtacaccgtatgctattgccttaatctgggaagacactcaactcagctacgccgaactgaaccagcgcgccaaccaactggctcacgccctgattgactttggcgttcagcccaatgaccgcgtggcgatttgtgccgagcgtagccccgacatgatcattgggatgctgggcatattaaaagccggggcgggttatattccgctggataccgaataccctgccgagcggctggcctatatcctatcagacagtgcaccaaaattactgcttactcaacagcatttgcaggcacgattagcggtagacggcctgcccgtctggcgactggacgatatcagccatttaaatgcggtggcacagcaatcgacacacaaccctgaactgtgccaagcagggttactgccacatcatctggcctatatcatctatacctctggctccacggggcagcccaaaggcgtgatgattgagcaccgcaacgtggtgaattttgtccactcccaatgccagatcaatgaactcaaatccacggatcgcgttctgcaattttcctcggtctcctttgatacggccgtctctgaagtgttcccgacgttgtcagtcggcgcgaccttgatcctgcgtccggcgcatattcgtataccagatgccgcctttggtcatttcttgcaggaacaacggatcagcatcgcagaactacccaccgccttctggcaccaatgggtacaggagatgaaagccggccgcagtggtttcagttcccacctgcgttcagtcacggtcggcggtgaaaaagccgagcaccggcatttcgtcacctggcagtcgatgccggaaacccagaattgccgctggctcgacacttacgggccaacggaaaccaccgtcattgccactgcgctgacactgaacagccatgccgcccgttctttctgtgcggcggaaaccttgtcgattggccgcccgattgccaatacccagatctatattctcgatacacagggacaacccgtaccgattggtgtcgccggagaaatctatattggcggcgcaggcgttgcccggggttatctgaaccagcctgaactcaccgccgaacgttttgtgtccgacccattcagtgaacagccccatgcgcgtatgtacaggacgggcgatctgggctgctggcgaccggatggcacaattgtctatctcggccgcaatgactttcaggtcaagatccgcggattccgtattgaactgggggaaatcgaagcgcaattggccgactgttccggtgtcagtgatgccgtggtggtagcgcgtgaagaaggtgcaggcgataaacgtctggtggcgtacatcgtgccgaagtctgatgtcacattggatgccgccagcctgcgcgaacaactgagcacccacttggctgaatatatgctgccgagtgcattcgtgatattagatgccttcccactgaacccgaacggaaaactggatcgtaaagcgctgccggtgccagatcgtaccgccataatcagccgtgaatatcaggcacctcaaggggaaaccgagcagcaactggccgcggtttggcaaaatctgttggggttagagcagattggacgtcaagacaacttctttgaactaggcgggcattcactgctggtcgtcagcctgatcgaacaactgcgccaacgcggtctcgccgtgggtgtcagtgcggttttctcagccccgacgctagccgctatggccgcacatttaaccgatgatgccgcatctgatacccgtacgcaggccgttcccccgaacctgatcccggacgattgccaagccatcacgccggagatgttgccactggtcacactgacacaggacaatattgaccagcttgttacccgagtcagcggcggggcggccaacattcaggatatttacccgctggggccattgcaggaaggcattctgttccaccatatgctggaaacaacgggagacacctatctcgacagccagcttatgacctttgacagccgccaacggctggatgcgtttctgctggcgctgcaacaggtgatcgatcgtcatgatatcctgcgtagcgccgtccactggcatgggcagccggagccggtacaggtagtttaccatcaggctcctcttcctgtgatagtgttagccctgtcaccagaggaagacgctgaacagcaattacgccgccatactgattcccgctccatacggatggatatcacccaagcgccgttaatgtcagccaatattgccaaagatccgcatagcgaaacctggctgctgtccctgctgcaccatcatctggtgtgtgatcacctgtcgctggaactgatatttaatgaagtccagacattgctgctgagacaaggtgaacatctacagccagcgttgccctaccgcaatttcatcgctcagacccgaagcgtgccggttgaaaaacatcaggcttattttcaacagttgctaggtgatgttgatgaacccactctgccctttggtttactggatgttcaggcaagtaataatgagatcgcagaagccgttttaacactggatgacgaactggcgcagaggatacgagactgcgcccgtcagcagggagtcagcgccgccgtcctgttccatgtcgcttgggcacaagtgctggcgcaatgcagtaatcgggaagatgtggtcttcggtacggtgttattgggacggttacagggcggtgaggatacgacccgaatactgggtatgtttatcaataccctgcccgttcgtgtcatcttgcaggatcgcagtgttcaacaaacggtacaggaaacttatcagcaactcagtcagttactggcacatgagcaggcgccactggcggttgcccagcgttgcagtgggattcctgtttccctgcccctgtttaacagcctgctcaatttccgtcacagctcagatgatgacgagcaggatctgtcactcgcctgggaaggtatccagaccctcagtggtgaagagcgtagtaattatcctctgtcgctggatgtggacgccttcgatgacggttttgcgctgaccgcgcaatgcagccagcaaattgatcctgcccgcattaacgcttatatggatattgccctgaaagggctggtggcggcgctgcaaaatcagcctgaacaaagtatccagtccgtgactatcttgccaccagcagaacgttctcagttgctggtggactttaacaataccaccgtggcttattcacaggacaagctgctgccgcagttattcgagcaacaggtagagcacacaccggattcaatagccctaatctgggaagatcactctctcagttacaccgaactgaaccagcgtgccaatcaactggctcacgccctgattgcttttggtgttcagcccgatgaccgcgtggcgatttgtattgagcgtaacctcgatatggtgattggtatgctgggcatactcaaagccggcgccggttatgttccgcttgaccctgaataccctgccgaacgtctggcctatatcctgtcagacagtgcgcccaaattactgctcacccagcagcatttgcaggcacgattgccgatagaagatctgaccgtctggcaactggacgaagccagccatttaaatagcgtggcaccgcaaccgaccgataaccctgatccacgccagttggggctgcatccccatcatctggcctatatcatctatacctccggctccaccggtctgcccaaaggggtgatgattgaacaccataacgtggtgaatttcacctatgcccaatgccagaacagtgagctcaaatccactgaccgcgtcctgcaatttgcctcagtttcctttgatacggccgtgtctgaaattttcccgacgctggccgttggcgcaaccctgatcctgcgtccggcgcatattcgcatcccggatgccacctttagtcagttcttgcaggagcaggcgatcagcgtcgccgatctgcccaccgccttctggcaccagtgggtacaggagatgaaagccggccgcagtggtttcagttcccacctgcgttcggtcacggtcggcggtgaaaaagccgaacaccgccatttcatcacttggcaatcgatgccggaaacccggcactgccgctggatcgacacttacgggccaacggaaacgacggtcagtgccactgcgctggcactggatgatccggcttcctatggcatggaaaccctgtcgattggccatcctcttatcaatacctacatttatattcttgatacgcgggggcaacccgtccccatcggtgtcaccggagaaatctatattggtggcgcaggggttgcccggggctatctgaaccggcctgaactcaccgcagaacgttttgtgtccgacccattcagtgaacaacctcatgcgcggatgtaccggacgggcgatctgggctgctggcgaccggatggcaccattgtctacctcggccgcaatgattttcaggtcaaaatccgtggcttccgcattgaactgggtgaaatcgaaaaccagttagccgcctgtgcgggtgtcagtgatgccgtggtggtggcgcgtgaagaaggagcaggcgataaacgtctggtggcttacctcgtgccacagtccgatgtcacgttggatgccgccgatttgcgcgaacaattgagtattcacctggcagaatatatgctgccgagcgcattcgtgatactggatacgttcccgctgaacccgaacggcaaactggatcgcaaggccttgccggctcccgatcacgccgcctccgtcagtcgtgaatttcaggctcctcagggtgaaaccgaacaacaactcgcctctgtctggcagaccctgctgggactggaacaagtcgggcgtcatgacaacttctttgaattgggcggacattcgctgctggtcgtcagcctgattgaacaactgcgccaacgcaatctgactctggatgtcagcagcgtcttctcttcgccgacattggcggcgatggcggttcgtctggccgcgtcagattctgatggttctgccggcataagcgtaccgccgaatctcatcaccgacgattgccaggttattacaccggagatgctgccgctggtggcactgacgcagaccaacattgaccaaatcgttacccaagtctccggcgggatcagtaacattcaggatatctatccgttggggccattgcaggaaggcattctgttccaccatttactggaaacggaaggcgatacttatctggacaacctgttgatgacctttgacagccgccagcgtctggatgcgtttttactcgcgctgcaacaggtattccaccgccacgatattctgcgcagtgcgatcctctgggatgacctgccgcagccggtgcaggtggtttatcgacaggcaccgatccccgtgacagagttaaccctgtcaccggaggaagaagccgaacagcaactgcgtcgccatattgatccgcgctcggtacggatggatatcacccaagcgccgttaatgtccgccagccttgccaaagatccgcagagtgaaacctggtttctggctttactgcaccaccatctggtgtgtgatcaccagtcgctggagatgatatttaacgaagtgcaggcaatcatggtaggccagagcgacaatctgccaccgtcactgccctaccgtaactttatcgcccagacccgcgccgtaccgtttgaaaaacatcaggactatttccgccagcttttgggcgatgtggatgaacccaccctgccctttggcttacaggaagtctatggcgaagatagcaacatcatagaagcggaattcgatctggatgcttcatttgcgcagacactacgggaatgcgcccgtcagcagggagtcagtgccgcagtactgttccacgtcgcctgggcgcaggtactggcgcaatgcagcggacgggatgatgtcgtcttcggtacggtgttattgggacggttacagggtgttgccggtgccgatcagacactggggatgtttatgaatacattacccatacggatcaagctgagtaccttcaatgtacagcaggtcgtccggcagacttatcgtttattgagtgaattactggagcatgagcaggcaccgctggcgatggctcaaaattgcagtggagttaccccgcctctgccattattcagtagcctgttgaattatcgtcacaaccaggacgatacccagcagacaaccctcacggcttgggaaggcatcggactgttaaatgtcgatgagcgcaccaactatcccctgagtttatctgtcgatgacaccgcgcaaggctttacactggtcgcacagtgtgttccggaacttgatcccatgcggattaatcatttcatgaacacggtgttacagggtttagttgaaagcctgaaaaattcgccggaacaaacctgcctgcaactcaacatactgccgcaggaagaacgtacacagcttctgcgaacattcaacaacacccgtgaggcttacccgcaggatcaactgatccaccagctcattgaacaacaagtcgagcgctccccgaccgcaaccgcgctgatttatgatgacaatcaattgagttacgacgaactgaaccgtcgggccaaccaactggcacactatctgattgcgtttggggtacgtccggatgatcgggtcgccatttgtgtagaacgtggtctggagatggtcatcggcttattagcaatcatgaaagccggggcgggttatattcctctcgatccggaatatcccggtgaacgcctgtcttatatgctatcagatagccagcccaccgtattattgactcagcatagccagcaaacccgtttgtctgagactgatacgccaatattgatactggatagtgatgaatatcaggcaaatatcattcatcaacctgagtgcaacctgccagccgccgatttaggtattacatcacgcaatctggcctatgtgctgtatacctccggttcgacgggacgccccaaaggggtcatggttgagcatattggggtagtaaacctgctgctatcaatgaaagaccggctgaaaatctctgtcaatgataccctgctcaccgcaaccacaattggctttgacgttgccgcacttgagctgtatttgcccttatgcaacggcagtacctgcgtcatagcgccatcattgaccgccagagatccagatcaattagcggaattgatcaccgcacgcaacatcaaagtcatgcaggcgactcctacaacttggcgcatgctacttgattccggctggacaggtgccgcgatcaaagccacaagcggaggagaagcattacctcacgaactggcacagcgtttaaaagaaaaagtcagtggattgtggaacctatatgggccgacagaaaccactatctgctcaacggcttccggtaatcttcagacagagccagagagccgctataccacgctccagataacgattggccgcccgattgccaatactcagatctacattcttgataaaaacggccatcccgttccaatgggtgtggccggtgaaattcatatcggcggtattggcgtcacacgtggctattttaaccgtccggatctcacggcagagcgttttgtccctgacccattcagtgacgaagcgggtgcaccggctgatagacgcatgtataaaacgggagacttgggacggtggcttcctgatggcaacattgactatctcggccgtaatgattttcaggtcaaaatccgcggattccgtattgaattaggggagattgaagccagattactcgcctgtgccgatatcaaagaagccgttgtcatggttcgtgaagataccgccaatgataagcgtctggtcgcctatctggtactacagccggaggcatccctgaacccggagaaactccgtgaaacgttacaggccagtttagccagctatatggttcccaatgcctttgtagcgctggattcattcccgcagacaccaaacggtaaattggatcgtcaagcattaccattaccggatgactcagcggtcattgctcaagtcggttatgaagcacctgtcggagggacagaaaatatcattgctgacgtctggcaagaaagcctcggccttgaacgtgtcggcaggcatgatcacttcttcgaattgggtggtcactccttattgacactgcaagttgtcgtgcgcttacgtcaggcgctcggcatggatatcgccatacgcgacctgcttattcatccgacaatcaatgaacttgccgcttatcttcaagcgaaaaatccattgagtccccctctggctcaacagcaaaatatcgtcacaatccgtaaaggaaacggaaaatcatcattgttcttcattcatccggcgggaggtgacgttcagtatgcttacgatcttaccgcttatattgatgataaagaccggtcaatttatgggatcatcgccagtgataccttcggggaggaaaatgcccggttaaccatcagcgaaatcgctaaagaatacgttgcctgtctccgtcagacgcagatacagggaccttatgatctggccggatggtcagttggcggaaccattgcgtatgaaatggcatgccaactgatggctgagggagaagccgtcaattttgtcgggttgtttgattcaggtgccagctatcaggacgcattttctctggaagaaaaacaggcaggtctgccatttaatgaaacagccacattgcttgaagtactgccagaaaatatgccgacctctctgcatgatgagatccagagattagcggaaaaccatgactgcgaggcgatattgatgcttgctcaacagaacgatttattccctgcttctgagaatatcaggcatcaactacacctttatcacaacatttctgtcgctgcttatcactatattccatcgacagccacggttgacgtcaccctgttcagggcaacggaagacaatgatcagagtagtcacgcccttggctgggaagccgttataccgaaggaacggctaactgtcgttccgatcaacggttctcatgaatccatcatggagccaccccgcatccaagatgtcggaaaggcattactttcagccatgacgaccccaagaggacattaa

SEQ ID NO: 3120 - DNA, 1617 bp, Xenorhabdus bovienii
  Coding DNA location: Contig name=SeqID_16888; Position on contig =68374..69990bp; Strand=-
atgtctctctctgaacctgccatcaaacgtctcgatcacctcggccttgtcgccgctttttgccatgagatcggtttaccccgcatgattgatgctattttgcctaaatatgcagagcatacggtttctcatggcgaggctcttttagcgatgatcctcaatgggttgggtttccacagtcgaacgctccatatgtgccctgatttttttaagcacaaacccgttgaacgcctgattggggtgggaattatggctgaacacctcaatgatgatgtgctcggccgcacgctggacgccttgtttgactgcggtgtctctgaaatttatcaggttatcgctgagcgggttattgataaattggcattaaaatccgattccgttcaccttgatatcacgagttttcacgtggatggtgagtacaaactccccgatgatgacgagacaaaacgcctcgttttggtgcgtggttacagtcgtgatcaccgtcctgacctgaatcaggttgtgctgcaacttatctgtgaaaatcaggcggggatccccgtatacatgcaggcgatgagcggaaacaccaacgacaccaaagcgtttgcagagacgacgaaacatcacattggctgcctgaaagcggcccaaaacagccgttatctgattgccgatgccgcgctttatacccaagagacactggcctcacttcatcaacaaaatcaaaaatttattacccgggttccgttaaccattaaagaggcgaaacagcacctgctgacggttaataccgaccagttacaaccggttacagaaggttatgccggtcattggattgaatcttgctacgggggcgttccacagcgctggttactggtcaacagtgaagcggcgatgcagtgtgaacatcagactttcaggaaaaatacgcggatttcgacggaaaaagaactgaaacagttcgagaaactcagcaaaaagtcgtttccctgtggtgaagatgctttgcaggcattgtgtgacttcgaagcagaatgccagtttatcggcattgaggcccccaaagttcaaaaaatcgaggtgcataaggggcgaggccgcccggctaaaggtcaacatcccgatagtgttcattatcagctttctgcctcggtctacagccaactggggaaagtggcttatgcccgcctcaaagtcggcatgttcattctggcgacgaatgaaatggacgataaggcgctgaatatggaaactctgctggctaattacaaagcgcaacaaaaagtcgagcggggtttccgtttcctgaaaagtccggagtttctgacttcagcgatttatttgaaaaagccagaacgcatcgaagcgttattaatgataatgacatgcagtttaatggtttatgctgcactggagcataaaatccgcaccggactgaagcaaaatgccccgttctatcccgatatgaaaggtaaacccacccaatctcccacggcgcgttgggtgtttttgaccttcgaagggattagtactttcgagtttcaggaacaccgtatggtgacgggaatacaggtgtatcaaaatgaactgctgaaaatattggggcaaccctatgaatcattttattcctga

SEQ ID NO: 3121 - DNA, 255 bp, Xenorhabdus bovienii; identical to SEQ ID NO: 422
  Coding DNA location: Contig name=SeqID_16888; Position on contig =70124..70378bp; Strand=-

SEQ ID NO: 3122 - DNA, 252 bp, Xenorhabdus bovienii; identical to SEQ ID NO: 421
  Coding DNA location: Contig name=SeqID_16888; Position on contig =70255..70506bp; Strand=-

SEQ ID NO: 3123 - DNA, 276 bp, Xenorhabdus bovienii; identical to SEQ ID NO: 420
  Coding DNA location: Contig name=SeqID_16888; Position on contig =70555..70830bp; Strand=-

SEQ ID NO: 3124 - DNA, 231 bp, Xenorhabdus bovienii
  Coding DNA location: Contig name=SeqID_16888; Position on contig =70931..71161bp; Strand=+
atggaagattcgcgagtcatggctagtgaaattttacgctctttcgaaatccatgtcttttccaaaattggtaaattaccccatgatgaagtgatacttcacgtttggcttgctttaatcgaagatgttgctaaacggactccatcaataggagcgcgtatattgacatattctaagagggcacataaatgggctgttcggcgggggatacagtgggcaggttgtgaataa

SEQ ID NO: 3125 - DNA, 249 bp, Xenorhabdus bovienii
  Coding DNA location: Contig name=SeqID_16888; Position on contig =71075..71323bp; Strand=-
atgcactacgatatcaaccttgatggtcgtttgattacccgtgccgcctgtgctgcacgaacaccgagagcaccatcaggccctcgttttaatggcagaatagcctctggctccgcctcccccatcaaccccgctccatgcgcaaatttaaataaggtgggattattcacaacctgcccactgtatcccccgccgaacagcccatttatgtgccctcttagaatatgtcaatatacgcgctcctattga

SEQ ID NO: 3126 - DNA, 333 bp, Xenorhabdus bovienii
  Coding DNA location: Contig name=SeqID_16888; Position on contig =71476..71808bp; Strand=+
atgataaaaacattcgattttcccgcacgagtgggtgccgctggcgagtttgaacccgtggtacgttccgttcagttcggtgatgggtataagcaaacatcaggcgatgggatcaactcacagcgggaaagctggctcctgtcatttgtgggtgtcctgccagaaatagagcccatcatggcttttctgcgtgagcatcagggctggcgttcgtttaaatggcgcaatccgttatctgagctgggactgtatcaggccggaaaattcaatatacaggccaacggggcttatttcactttatccgtcacgttcacccgcgtttatcatccgtag

SEQ ID NO: 3127 - DNA, 738 bp, Xenorhabdus bovienii
  Coding DNA location: Contig name=SeqID_16888; Position on contig =71820..72557bp; Strand=+
atgacaatcaatgccactctccagcgtcttgagccggggagcaagattctattgttttcggtcgatggctcggcctttggtgggccagagctgtattttcataatcaccctatcccctacacagaagatgaactggaaaactctgatcagttaccgatgaaatctatctggtggcaaggtcaggagtataaaccgtggcctgtcaaaattgaaggactgggggtcagcagtgatggcagtgcagcctcaccgacactcagtgtggccaatattgacggcactatcagcgccatgtgtctggcatatcagaatatggcgcaggctcgtgtgactgtccatatgacctttgcgcattatctggatgcccgtaattttcccgaaggcaaccccgaagccgatcccacgcaagagaaaatagacgtctactatattgatagtaagacacatgaagacaatacagagattcattttgccttgtcttctccggctgacctgcaagggatacgaattccgacccgtcagattcatagtctgtgtacgtggtgtatgcgtggcttatatcgaaaatccccatgcaactacatgggtgatcgttattttgacgaagacggaaatccgacccatgacccatcacgagattcttgcggtggactgatgagtgattgtaaagcccgacatggtgaggcggcgcaattgccgttcggcggtttccccggttctgcgttactgagaaagtga

SEQ ID NO: 3128 - DNA, 543 bp, Xenorhabdus bovienii
  Coding DNA location: Contig name=SeqID_16888; Position on contig =72703..73245bp; Strand=+
atgaaaaaattagttttggcatcattagttgctgcaggaatgtctattgtgtcaatgggagcttgtgcggctggtgaaagcactatttcggcaggatatgcgcagagccatgttaagtctgggggtgataaattaaaagaaaacccaaaaggttttaatatcaaatatcgctatgaatttgataataattggagtgtgattggttcgttagcatatactcatcaagggtatgaatattattacggtggacacaaaacgggtactgttgatttagattattactcattgacagcgggccctgcgtatcgcatcaatgaatatgtgagtgcttacggcttagttggctcgggtcatggtaaagtggaagccaaaaacaagataaatggatcttcacacagcgaaaataaaactgaactcgcctatgctgctggcttacagattaacccgatccctaatatagcgattgacgcatcatatgaatattcaaaacttggtgaagtcaaagtgggcacatggatgattggtgttggttaccgattctaa

SEQ ID NO: 3129 - DNA, 453 bp, Xenorhabdus bovienii
  Coding DNA location: Contig name=SeqID_16888; Position on contig =73306..73758bp; Strand=-
atggtacgaaaatctcaggtcaaagatggacgttcggcagcaatggaaccttggcttatttttactagtatggatgattttaaacctcgtcaggttatgaaaatttacagccgaagaatgcaaatagagcaaaattttagggatgaaaagagtgaacgttttggatttggtcttagagcaagttatagccacggtgctggtcgtttatcagtattgagtctacttgctacactgagttcagttgtactttggctgattggtttttatgccgaaaataaaggaatacatcttaattatcaggcaaatagtattaaatcaaggcgagttatctctcatcttacattagcggagaatgtattacggcattccccgctaatattatttgaaatcgttcttaataacacactcaaatatctcgccaaaatctaccaaaacatggttttgatttattag

SEQ ID NO: 3130 - DNA, 492 bp, Xenorhabdus bovienii; identical to SEQ ID NO: 1438
  Coding DNA location: Contig name=SeqID_16888; Position on contig =73917..74408bp; Strand=+

SEQ ID NO: 3131 - DNA, 354 bp, Xenorhabdus bovienii; identical to SEQ ID NO: 1741
  Coding DNA location: Contig name=SeqID_16888; Position on contig =74345..74698bp; Strand=+

SEQ ID NO: 3132 - DNA, 216 bp, Xenorhabdus bovienii; identical to SEQ ID NO: 2539
  Coding DNA location: Contig name=SeqID_16888; Position on contig =74766..74981bp; Strand=-

SEQ ID NO: 3133 - DNA, 339 bp, Xenorhabdus bovienii; identical to SEQ ID NO: 2540
  Coding DNA location: Contig name=SeqID_16888; Position on contig =75006..75344bp; Strand=-

SEQ ID NO: 3134 - DNA, 150 bp, Xenorhabdus bovienii
  Coding DNA location: Contig name=SeqID_16888; Position on contig =75321..75470bp; Strand=+
atgacatatttcacgtacaggcatagcagtgaccttattgacttggtggaacaatcagtagatcacacaacgctatgcctgtctattttctggggattcctcagagcttatagctggcttattgtctatattcgaaatattcacaaataa

SEQ ID NO: 3135 - DNA, 1260 bp, Xenorhabdus bovienii
  Coding DNA location: Contig name=SeqID_16888; Position on contig =75486..76745bp; Strand=+
atgacaattaattttcacaaagaaatttgggaaggatttgatgaaaaaacaaatcatggaaagactccttttcttttcgaatcaattcttcctttaaatgagggtttttctaatcatgaaactgttaaaaatgcattttataatttatgcaataaatctaatttactaaaaactgattgccgcttgcgtatctatgatggtgaaaaacgtcgtgatgatcttgttgaaaaattatcctctgaaaccatattatcggatgaaacgttgatacatttcatgcaacgattaagtggaaaagagcgtttcagtttagtgattaataaccttgagcaatcttgtccaaagctagcagctgatttcggtttatttgcgcaatctttctttgcttataaaggtattcctattggtggaatagaacaagcaactttttgtggcaattattctggtaccgcttttggtatacacgaaggttttgaacatgcatttttgtgtcatttaggaccgggtattaagtatttttattgttggtcaagagaactttatttggaaataactggctcacgcgaacccacgttctcagattcagaattgtatgacaaattaatagaaaaaggaacgctttatatacttaagccgggtgatgccttgtatttaccagcatcagtttatcatgtcggtcgtcaagaagaattttcagtatcaattgcgctgccattttatacttatccattgtcgcgttttatggcattaaaaatacttcctgctctcagtaaaaaatcacttccctttgatcaagaaggtatgtcagaattaattaactttgataataatcaatttgatacagaaccactctcaactcttttaacagaaacaataaataaatggctacaacaggatctacctaaatatttacattattactggcatcgacttcgtagtaacggaggatgggaactgcctacggctataaacgcagatccattaaaggaacccgaacatcaaaatgatttaatcattaatcctgattctcaagtatcattacaggctccatttattgtgagttatgagcatgggttagattgttcttctgatgaaattcgcgtatttattgcaacaaaaagtgtaatattacctgccagttctgagactttaaaacttttggatacacttaatactcgacaacccattacaataaattccgaggaaatttacacctcactaaaaacattaatagtcacgggcggtttactttctcattaa

SEQ ID NO: 3136 - DNA, 852 bp, Xenorhabdus bovienii
  Coding DNA location: Contig name=SeqID_16888; Position on contig =76763..77614bp; Strand=+
atgtatagaaatttcccagcattagtggatgattatctgaataaaaatattcccactagaaatttaattaatagtattattagtgaaggaaaagcaaaggttgatggaaatgagctgattgataaacatttcgatcctatgattgcaattatttataatcaaattaaagatctcatcaatccatcaaatctcagtaaggaagaagcaaaattatatattggtgagctgtctgtcttcgctcgttacaattccaccatgttattaagagcagccgataatattcgtggtttttgtcctgaatttgctcaagaattaacacggaactttttggaagaaggtggagaacgaggaaaattacctgcccactatgttgtttttagcggagcactcattgcggacttagattttcgagtgaatggctggatgccacgtacttcttcaacacgtgctcttatttccctaatcgacatacttacgtggtctcattgcccttcaacggtactgggcatgtactatgcaaccgaagctattgctatcgcggaaacgctacttttacaagacattaccaatcgtctgggacaaattactggtcaaggaacaggaaattcattaaaaaaacttgatttttattatcgaatgcacttggatgaaactcatagcgctgcaactgataatgtcgcagttgaacgcgggcatcaagaaggtattgctagattcatcagggatgcagatctattccactttcagcaacctcagattgtggatggcttccttcaaatgcttactccttttgttgatcagtgggttgagattcatcatttaacccgaacagatcactgttacagtcattaa

SEQ ID NO: 3137 - DNA, 387 bp, Xenorhabdus bovienii
  Coding DNA location: Contig name=SeqID_16888; Position on contig =77632..78018bp; Strand=+
atgaaaaaagttgaatattccggtgggtgtctttgtggtcatatcagatttatagcgacaggtgaggctggtaatcctcatacatgttcttgctccatgtgccaacaacattctgggggattgactctatgttggattgaatttccgaaagccgcagtccactggaatgggccgggtggcgttccctctgtatttcgttcttccgactattctagtcgtgccttttgctcacaatgtggaagctctctaggagcaatagacgatggcccaacagtcggactgctattaggtaattttgatagtaaaaacaaaaaaaaccttcgcccagtttcacattcatttatatcgtcacgcccccgttggtggaaaatcgatactcaatcctaa

SEQ ID NO: 3138 - DNA, 888 bp, Xenorhabdus bovienii
  Coding DNA location: Contig name=SeqID_16888; Position on contig =78034..78921bp; Strand=+
atgttgaattctccaatattatataaagcggcgatgattcgccgcatacgcacttttcttgattctcaggaatttattgaaattatgactcccgttatgcgccgttattctggtgatgactctcgtccacggctctccctacataatggaggttggctaagagaatcttcagcttttgccttgcgctacaatcttcaatactatgatcgtatctatgaaataggccctagtttccggcctgatgcagtggatgatacccacctaccagcatttacaatgcttgatttatataaaaaagattctacccttgatgaaatgcttcaacttgcacaatcaatcatagaaatattttatcaagggaaaataagtgtattgtcgtttgctgatcatcttaaacaacggttttcagttgatttttttgaagatttttccgcttccgaaatatttattgattgtttacgggaaatgtattgtgacaaaacaactcccccgctgaatctaattgatcgctatattattgagaatattgaacctctatcacaacaatgctgtattatcgtaacggattttcctttgctcaccgagatacgagcaaagaaaagaacaggaacaaaaggaatcgtcgagcgtttcgaaattttgattaatgggatcgaaattgttcatggttatactgacgaagatgatgtagagcgttttgaaactcaggctcggaaacgtaacatgtttgggtctgaagatgaggtgatgtgtaccatgatgagaaataaattggtatcgccttccagcgctggatttgctattggtatagaaagattatgtcaagttgcattaggagaaaaacaaatttctgcatttgcaacttcgcgcccgttttctcctttttaa

SEQ ID NO: 3139 - DNA, 1611 bp, Xenorhabdus bovienii
  Coding DNA location: Contig name=SeqID_16888; Position on contig =78958..80568bp; Strand=+
atggtgacattcaatgaatggtttattatggccttttctatcgcattagttttaatcgttcctgggccaacaaatactttacttttatcagctgggttacaacaagggttaagtaaatctcttattctcgttattgccgaagctataggatatacagtggctattgcaatttggggattttttttgctatctctgacacagacgttgccttggatgtaccagcttgtgaagctattgtctgcgacttatgtgctgtggctagcttttaaattatggatgtatagcttaaaaatggattattttacagataatgaggtgaatttaataaatattttcgcccataaaggtacaaatttcgttgatgttatggtagccacatttttgaatccaaaagccttattattcgtaagtacttttattccaataagcgcttttaagtctgtgaatactttttttcctatgcttggtgtttttttgataatcttagtgccaataggtacattatggatatcttttggaagcttaattcattcctataaatacttacgtagatttactgccatttttctgcggatatcatccgtgattctgatactattttcattctcgttaacttattcaggaatagcaaaggctgaaagttcactggttttgtacaattggcaaagttatacaagtccagagatgctccaaaaattcaaaaaagagcataatatcagcattactctattagaatacaaatcaaatgaagaagcattagaaagcattcagcttggaaaaattgatgctgaccttgctgttgtagcggataattttttgcttcactggataaacgccggacttctgcaacctattgatgctcagtcaatgacaaatttcaagaatattaccccccgctggcgcacatctcctgccgatccgcaacgaacttatggtattccttggtcttggggcattgttggcactgtcgtccatacagatgtttacgatggcgatattaatacatggaaggttgttttagaaccgccaacatcattatttggtactattaatgtgggttcagacatgaatgatcttatttatgcggccattcgctatcatggtggtaaaatatgtgactcaaatcctaaattacttgaaaaagttaagaaaaccttacttgaagcaaaaaaacattgggccgcaatggagtatggtagtgtcaatatgatggcttcgggaaaatttaaagcaggtattgactggaatggtgcagcgttgcgtcaacgtagaattaattctcatattcagtttggcttgccacgtgaaggggtattaatattcagtgataatcttgtcattctcaaaaaatcgaaaaattatgaaaatgccagattatttcttaattttattatgcaacctgagaatgccgcattgaattctgcatttcatggctatgacagtaccatagaaggggctgataaatatttacccttatggatgaaaaatgcgcctgaacttaaaattcctgaacatgtattaaaaaattcagatcattcggtcatgtgctcaccttttgttcaaaaagagtatcttaatatctggcaacagcttttaaaaataagttattag

SEQ ID NO: 3140 - DNA, 1044 bp, Xenorhabdus bovienii
  Coding DNA location: Contig name=SeqID_16888; Position on contig =80803..81846bp; Strand=+
atgactgtcaaaaaagtgacaaaaacaaaactcttactggcaaccctcgctgcaatggctgtcatcatcatagctgttgcaggcaagctggaaaatgccaataaacgtttcctctcagtcgccaccgcttccacgggaggcacttattatccgatgggggtgggtctggctaatatctggagcaaccatctgaaaaatgagcatattcaggtcacggggcagtcttcagccggatcaattgaaaatattgatctgctacagaaagatgaggcgcaactcgccattttgcagagcctgatcgcctttgaagcctatcagggcgtgcgtcatttcgaaaaccgaccgtaccacgatttacgttccatctcggtactttggccgaatgtcgaacatttcgccctgctggaagacaaaatcaaagagggtacgctcaatgatattgccggaacccatttttctgtcgggccacaggccagtggcacagaacaatcaaccctgattattctgcaaggtgtcaatctcagtaagaaagacatccgcccagaatatcttggctatggcgataccgtttccgccatgcgggatggccgtcttgagggtggcgccctgcctgctggtgtacccgcatcggcagttactgatatgtacgccagcggcgtgccttcccgtatcctcaatgttaccgatgaccaactggcaaaaatcaatactatcgccgattcttggtttcgttttgttatcaagccggaaacttacccacgtcaaatccagccggttcataccattgctcaacccaatattctgatgacgacccgtaagattgatgaaaaaaccatttatgaactgacaaaagtgttgttcgaaaatttgaaaaaagttcagcaaatccatagcgcggcaaagtacattacgtcagaaaatgcgctcaaaggtgtctctgtacccttgcatatcggtgcgtatagattttatcgcgagaggggtctggatatccccgacaatcttgtacccccggaagcaaaactcactgcaactcagccataa

SEQ ID NO: 3141 - DNA, 1977 bp, Xenorhabdus bovienii
  Coding DNA location: Contig name=SeqID_16888; Position on contig =81871..83847bp; Strand=+
atgagcactgacactttaacgtcatcttccccccacgaactggataaagaagccggttcgggcagccgtcatctgagcggcatttatctgaaactgacagcaatactggctatcgtgatttccctttatgccatttattctaatgcgttatccaatacgcaggagttttaccgcaatgcgacctttcttgggggaattctgatcttgggttttattctgtttcccctttccaaacgttatgccaccccaaaattcaatcgttgggattatctttttatcctgctgacattgctcagttatggctatttttatttcacttacgttgacttacatgtggttcgcaacagtattcccgacacgctggattatgtgatggcggtgatcggaattggcgtcttatttgaagcagccagacgcacaaccggctatttcataccgggactgtctctcttcgctatcatttatgccctgttcggccagtatttcatcgggatctttggccatgccggattttcccttgagcgcctgctattccgcctgtttatgaccagtgaaggcattttcggcatcaccctgtcaaccgcatcaaccgccatcatcgtcttcattttgtttggtgcatttttgagtgtcagcggcgcgacggcgttgttcaacgatttggcattggcaatagctggccgtcgccgtggagggccagcgcaagtcgccgtcatttcttccgctttgacgggatcattaagcggcagtgccgtcgccaatgtcgcgactactggcacttttaccattcccttaatgaaaagtatcggtctgtcaccgcgctttgccggtgctgttgaagcggccgcttcgacgggaggaatgatcatgccgccgattatgggggcggcggcgtttatcatggcgggttttcttggtatctcctacaccacgattgtcatggcggccattattcctgctttgctctattatgccgccctgatcattgccatcgatttagaagcaaaaaaacagggactgcaaggcatcagcaaagagaatattcctcaagtcaaaaccgtactgaaagcccgtggcctgctgttattaccgctatttatcgtaatcggcattctgctgatgggaaaaaccccgatttacgccggttttcttggcattattacgattatcatcgcaagctggatcacaccagatacctcggctcgcatgacaccaaagaaaattgccaaagccttgagtgaagctgcccggggctccattcaagttacgattgcctgtgctgccattggggtcatcatttgtgtcgttacgatgactggcatcggttcgaccctcgctttcaatatcgtttcgctgactgacaatacgctgtggatgatcctgctggtggtgatggtagtttgtatcgtcctcagtatggggctgccttccaccgccttatatattgttgtttccgtgacagtgtcacccatattaattaaagcgggcgtcttgccattagcggcacattttttcgttttctggttcggtgtgctttccaatattacccctcctgtggcgctggccagttacaccgccgccagcattgcccgctccgacccaatacaaacctcatggagtgccgtgcggctggctcttccgggcttcatcattccttttattctggtctataaccccgctttattgatgcaaggcaatgacttaaatgtgctttccattatttatatgatcatgaccgccctgattggcatttattcactctccgtcgctactgctaatttctggatgatcaagactcactggctggaaagaatattcttcgctatcgcggccattctgcttatcaaacccgggatgctgacagatttggccggtgtgatattcatcgctacagcgggcgttgttcatcggttacgttacaaccggcaacgtgctttccctctggagttaataaggaaaaacaataaaaatgtatga

SEQ ID NO: 3142 - DNA, 1191 bp, Xenorhabdus bovienii
  Coding DNA location: Contig name=SeqID_16888; Position on contig =83840..85030bp; Strand=+
atgtatgacgttattatcattggtgcggggttggtcggccttggtacggctaatgccctgcaagaacatcacccatcattgcgcctgctggtactggataaagaaaatggggcagccgcccaccaaagcgggcataacagcaatgttgttcactccggcatttactaccctcccggcagtttaaaagcccgtctggcaaaacagggaaaccgctcgatatatacgttttgtcagcaacatggcctgtatcatgaccgctgcggtaaaatgattgtggcgacccaaccgaaggaactgcccttattggaaaatctctaccagcgggggttgcagaacggccttgacgtcagccgcctgtcacaagctgaattgaaagagcgcgaaccttatgtcaatggtattgaagcgattttagtgccggatgcggggatcgtaaattatccggaaattgctgcgaaactggccgagatcattcaagccagagggggtgatattcattaccagcaacaagtgcagaatatccgtgaacacaatggctatgttgaagtgcaaacccaacaaacccactatcaggcaaaatggctggtgaattgtgcgggcttgcatagcgatagaattgcgcaactggccggttatgatacgggcatgaaaattgtgccgttccgtggcgaatactatgtgctgaacagcagtaaaaattatctggtcaatcacctgatttatcctgtacctaaccctgattttcctttccttggtgtccattttacgcggatgtacaacggcaagcgggatgttggccccaatgcagtattggcatttaagcgcgaaggatatcgtaaaaccgatttcagcccacgagatttggcagaagtgctcacttacaaagggttttggaagatcgcctcacgctattttggcgaaggagtggccgaaatgcgccgttcattctcgcgccagctttttaccgagaatgcccgccagctcattcctgacctgcaacccgaagatgtcacaccggggccagccggcgtccgcgctcaggcactgacagccgatggcaagctagtggatgattttcactttgtggttggtcgcagatcactgcatgtatgtaatgcaccttcgccggcagcgacagcttcgatggagattggaagggagattgtgaggcggtattttgcggagctttga

SEQ ID NO: 3143 - DNA, 174 bp, Xenorhabdus bovienii
  Coding DNA location: Contig name=SeqID_16888; Position on contig =85120..85293bp; Strand=-
atgctggttagtattttttatgcgggaaaacaatataaatatagagctgtagattcacacaaatatgagggtgatggaataggtatgacaacattagttccatctaattcgagctatgagatgaagagtaacgattatactctacatacagacgtaatggttcgggataactag

SEQ ID NO: 3144 - DNA, 357 bp, Xenorhabdus bovienii
  Coding DNA location: Contig name=SeqID_16888; Position on contig =85339..85695bp; Strand=-
gtgagttatgttggcggcaacaataaagactcatcattatttatcaaactattagcgcatctgaaagccgcctatcgccgggcgaaaagtattaccttgatagtcgataactacattattcacaaaagccagaaaacacaagagtggctcgcccaaaatccgaaattcaaattgatttatcaaccgatttattccccatggataaatcatattgaaaaattagggttagcactccatgaaacgattacacgtaatcattgttgctgttatatgtggcagttattgagaaaagtgcgtggctttatgaacacggttagcccattcccaggaaataaacatggcacagcaaaagtgtag

SEQ ID NO: 3145 - DNA, 810 bp, Xenorhabdus bovienii
  Coding DNA location: Contig name=SeqID_16888; Position on contig =85921..86730bp; Strand=+
atgaaagaattagtggatgtcttttctgattttccagacccacgttgtcagggaaaggtcaaacaccgtgttattgatatcttagtgatcgcggtatgcgctgtcattgctggggctaacgcctggactgatattgaacagtacggtcaactcaaaaaggattggctgagttcatttcttccgctcaaagggggtattccgtcacatgatactttccggcgctgtttcagtttattaaacccgagcctctttgaacatcatttttatcaatgggtttctcgtgacctctcttcagaaaaacgggctatcattgcgattgatggtaaaagtttacgtcattcgtttgataagaaaattgaccaaagcgcattacatatggtgagtgcattcacggttgagaaagggcttagcttatgtcaatgtgccgtagacggaaaatcaaacgaaattaaggccattccggcattattatcgatgctttcattgaaaggccatctcgtgacgatggatgcgatgggttgccaacgcacgattgctcagcaactacgcgagagtgaagccgattatattttgtcgcttaaaggcaatcaggggaaaaccttttcggaagcggttaactattttcaacaacaacagataacccaaaaaccttaccttaaacctgaccatgatgaattcgatgatagccacggacgtaccgtcagacggcgcggatgggttctgccactgacatcagaaacaaatgagtatggagataagtcttcgggcatgatttttatcgcgggttttctggatagttttttgcattaa

SEQ ID NO: 3146 - DNA, 117 bp, Xenorhabdus bovienii
  Coding DNA location: Contig name=SeqID_16888; Position on contig =86781..86897bp; Strand=+
atggatgatttttttggtttggcgattaatcagatcgtccaattcggattgagttccctgcaagtgatctatccgtcattccgcacctcattcctgggtcatgctcccaatagttag

SEQ ID NO: 3147 - DNA, 276 bp, Xenorhabdus bovienii; identical to SEQ ID NO: 420
  Coding DNA location: Contig name=SeqID_16888; Position on contig =86939..87214bp; Strand=+

SEQ ID NO: 3148 - DNA, 252 bp, Xenorhabdus bovienii; identical to SEQ ID NO: 421
  Coding DNA location: Contig name=SeqID_16888; Position on contig =87263..87514bp; Strand=+

SEQ ID NO: 3149 - DNA, 135 bp, Xenorhabdus bovienii
  Coding DNA location: Contig name=SeqID_16888; Position on contig =87511..87645bp; Strand=+
atgaatctgaccctgcgtactcgaataaaaaggctgaatcggaaaacgatctgctactctaaatcagaaatcctgcatgacaaaatcatcggaacgttcattgagcgtgaatactatcttgcaaggataatctaa

SEQ ID NO: 3150 - DNA, 324 bp, Xenorhabdus bovienii
  Coding DNA location: Contig name=SeqID_16888; Position on contig =87642..87965bp; Strand=-
atggcaattactgattcatggctacgttctatcaatggtaagccccaagaaataatgattaccaaatccgatagggatggtttatctgttcgtgttaccccaaaaggaaaagtgatttttcagttccggtatcgttgggatggaaaaggggatcgaattgacattggcacatatccagcaaccagcttaaaggatgctcgtgattcagtgacttcttatcgcggggaattggaacagcaccgtaatcctaaaatagtcaaacgtgttcgtaaagagtctgcgttaaatgcgatgacagtagagggtcatgctcccaatagttag

SEQ ID NO: 3151 - DNA, 645 bp, Xenorhabdus bovienii
  Coding DNA location: Contig name=SeqID_16888; Position on contig =88155..88799bp; Strand=+
atggcagccatttttgatatggatggtctgcttattgattcagagccttactggaagcaaggagaagaaactgtatttggtgaattgggactggacttatctttggcgaataaattgcctgatacactgggattacgcatcgataaggtggttgaactatggtatcaggtatcaccttggcaaggcacctcaaaaaaggaagttgaacagcgcatcatcaaccatgtcatccggttagtcaaagaaaaccgtcccctgcttcccggcggcgaatacgctttaaacctctgccataaacatggccttaaagtcggtctggcttctgcgtccccccataatatgctcgagcaagtacttgaattgtttaacttgagacattacttcaatgttgtagtttctgctgcaaacttaccatacagtaaaccacatcctgaagtgtatttgcagacagctagccaacttgaggttaaccctattaattgccttacactggaagattccttcaacggtatggtagaaaccaaagcagccagaatgcgctctattgtgattcctgccttccaccattttgatgacccccgatggtcattggctgatattaagttaaattcactggaagagttaaccataaaaaacattacttga

SEQ ID NO: 3152 - DNA, 582 bp, Xenorhabdus bovienii
  Coding DNA location: Contig name=SeqID_16888; Position on contig =89038..89619bp; Strand=+
atgacagcagaagggcatctccttttttcagttgccagcctcgtattggctcaccagctagaaattacaccagaaatagcacagggagattggcttcatatgcttcctggcgtacttctggcctcattgttacctgatattgatcatcccagttcaacgttaggtagattattccgttttatatcaattcctattgcacgactatgcgggcatcgtggatttactcacagcttactagctctgatggtaggaattattctcttccaggctgaaataccgtctggttggcccatcccaactgacttttttcatgcaatgattgtgggttatatcagccatctgattgctgatatgcttacacccgcaggcattccactcttatggccactgagaatacgtttctgtatccctattcttagaggaaaggaacgcaaaaaagcggagcgatttattgctgtgctggtggtcgtcattgccattctccttccacatcacattgatttttcgtttatccaccactattttgataaattacaaatcgataagttgcaaattgacaagttacagaacctatataagtag

SEQ ID NO: 3153 - DNA, 1392 bp, Xenorhabdus bovienii
  Coding DNA location: Contig name=SeqID_16888; Position on contig =89973..91364bp; Strand=+
atgaatttaccactcgtcattaatgtgctggtttttgtagcactacttataatattagcaaaagcgagctcaaataaatggagcctatccaaaaaagttgttgttgccctagtcgtgggtgttgtttttgggctggcattgaacatcatttatggtgcacacaatgtcatcgtgaaagaatcaattaaatggttcaatatcgtcggcaatggctacgtgcagttactgcaaatggtcattatgccattagtcttcgcttctattctgagtgcagtcgcacgtttacataaagcgtctgctttagggaaaatcagtttcctgacaattggaaccttgttgttcaccgctgcaatttcggctttaatcggcatcattatcgccaatgtgtttggtctgactgctgcaggattaattcaaggcacacaagaaacggcgcgcctgtctgctattgaaacaaattatatcggcaaagtttcagatctgggtgtgccacagcttatcctctcttttattcctaaaaatccatttgctgacctcactggagcaagccctacctcaattatcggtgttgtgatttttgccgcgtttctgggtatcgctgcattacaaatgcttaaagatgaccatgaacgtggtgagcgagctcttattgccattgataccctgcaagcatgggcaatgaaactcgtcaggctggttatgcgcctaacaccatacggcgttatggctctgatgactaaagtcgttgccagctccaacattcacgatatcgcacaattgggcaattttgtcgttgcttcctatattgcccttggtttgatgtttgtcgtacatggagggcttttggcacttactggcatcaacccgatcaaattcttcaaaaaagccggcccggctctgacgtttgcatttaccagccgttcaagtgctgccagtattccgttgaatgttgaaacacaaacccgccgccttggtgtaccagaatccattgccagtttttctgcctcttttggtgcgactatcggtcaaaatggctgtgccggtatttatccagctatgttagcggtaatggttgccccaaccgtcggtattgaccctttcgatcccctgtggattgcgactctcgtcggtattgtgacaatcagctctgcaggtgtcgctggtgttggtggtggtgcaacattcgcagcactgattgttttacctgctatggggctacccgtgactttagtcgcactgctgatttctattgaacctattatcgatatgggccgcacggcattaaacgtcaatggtgcaatgacagctggcacaatcactagtcaattgatgggtaaaactaacaaggaaatattagagcaagatgaagaggtaggattaagtcagtcctaa

SEQ ID NO: 3154 - DNA, 114 bp, Xenorhabdus bovienii
  Coding DNA location: Contig name=SeqID_16888; Position on contig =91451..91564bp; Strand=+
atgaatcccggctttatgtttactgaatatttacttcaggccataacagagcaaatcactatggcattactttatatattcaccactgcgaagggcttcaatacgcttatctaa

SEQ ID NO: 3155 - DNA, 885 bp, Xenorhabdus bovienii
  Coding DNA location: Contig name=SeqID_16888; Position on contig =91517..92401bp; Strand=-
atgatgcgaatagccttgttccttctcactaacctcgcggtcatggtggtatttgggataatactttcacttacaggagttcagcgaagtagtgtagctggcctcatgattatggctggtttgtttggttttggtggtgcgttcatttctctgttaatgtcgaaatggatggcattgcgttctgttggtggtcaggtcattgaaaaaccttccaatgaaatggaattgtggctgatggaaactgttcgccgtcagtcagatcaggttggtattaccatgccacaggttgctatttacgatgctcctgatattaatgcatttgcgacaggtgcacgtcgtaacgcttcgttagttgctgtcagtactgggttgctgaacaatatgagtcgtgacgaagcggaagctgttattgctcatgagatcagccatatcgctaatggtgacatggtaacgatgacgttgttgcaaggaattgtgaacacattcgttatttttatctcgcgtatcatcgcacaggcggcatcaagttttctgtccagtaatgataatgagaatgaaggtagcagcaacggtaatccaattgtttatatggtgctttcaatggtgctggagattgtatttggtattctggcaagcattattaccatgcggttctcccgttaccgtgaatttcacgcagatgcaggatcagcgaaactggttgggcgtgaaaaaatgattgctgcgttgcaacgtcttaaaaccagctatgagcctcaagaagaggatcgtatgatggcattctgtattaatggtaagtctaagagcttcagtgaattgttcttatctcatcccccattagataagcgtattgaagcccttcgcagtggtgaatatataaagtaa

SEQ ID NO: 3156 - DNA, 123 bp, Xenorhabdus bovienii
  Coding DNA location: Contig name=SeqID_16888; Position on contig =92457..92579bp; Strand=+
atggggattccgcccatattattcaatttttttaagatgttaagcgatagaatcaacataactttacagtgttacaaaaaaggccgactaccaagtcggccttttatctgtaacgaactttaa

SEQ ID NO: 3157 - DNA, 2073 bp, Xenorhabdus bovienii
  Coding DNA location: Contig name=SeqID_16888; Position on contig =92582..94654bp; Strand=-
atgaacaaactcattaatttggctttcgttttaggtctatcattttctggtatagggtatgcaaatactgctaatgtcatcggtagcagtaccattaatgggaacaatgcacctgttattaccctcagtcaattgccagatttaaaaccggaacaacaacattcaaccgtgagtaagcggattgtttctcgctttttgcgttctcactaccgccatttttatctggatgttgctttttcagggaaagtctttgatcgctacctgaacgcattagattatggccataatgtttttcttgcatcagatattgcacagtttgctgaacagagagggcttttaggtaaagcgcttgaaaatggtgatttaaggctgccttatgctctgtttaacttgatgcagaagcgccgtttcgaacgctatcaatatgttctttctcgcttggaacagcctgttaatttagatggcaatgatacgtttgaaaccgaacgtactaaggctccgtggtcgaccagcgttgaggaattaaataaactctgggatgccaagattaaatctgattggataaatctcaaactgtctggtaaagatgataaagaaatcaaggaaatacttaccaaacgttatcgaactcatctaaaacgtcttaatcaaagtaagagtgaggacgtttttcaaattatcatgatggcttttgcgcgtgaaatagaccctcatactagctatctttcacctagcaatacagagcaattcaattcagaaatgagcctttctcttgaaggaattggcgctgtcttacaatatgatgatgaatatatcgctattcgttcactggttgggggaggccccgcagcgaagagcaatttactgaaagatggggacaaaattattggggtcgggcaagccgggaagccaatcgtagatgttgtcggatggcgtctggaagatgttgtgactctgataaaagggccgaaaggaagtaaagttcgccttgaaatcatacccagcacgaaaggggctaaaaatcatatcgtcacgttaactcgtgagaatattcgccttgaagataatgcagttaagatgtcagtgaaaacggtaggaaaagaaaaaattggcgtccttgatataccgagtttctatgttggcctgactaacgacgtgaaaatacagctgcaaaaattgaccaaacagggcgtttcctcaattgtcattgatttacgatccaatggtggtggagcgttaactgaagctgtatcgctgtctggtttgtttatttctactggtccgattgttcaaatccgggataataccggtagaataaaacaagactcggatactgatgaagcaatatattataaaggtcctctagtcgttttagttgatggcaggagtgcttcagcatctgaaatttttgctgctgttatgcaagattacggccgaggcttaattgttggcgatcctacttttggtaaaggcaccgttcagaatcaccgttctctaaatcgtatttatgatcagatgttaaaacctgactggccagagattggttcagtgcaatatactgttcagaaattttatcgggtgaatggtggcagtactcagcttaaaggtgtaactcctgatatccttatgccaacagcggaagagcctgctgatataggcgaaagccaagaggacaatgcgttaccgtgggatagtattcagccagcatcttatcccttctcaaaggttatttcagcgtcggtgccgttactgactcaattgcataaccagcgtattgccaatgctcctgagtttaaatatatcaagcaagatattgcttattacaaattaataaaagctcgtaatggcgtttactctctgaattatgcgcagagagagaaagagaataaggaatatgaatcaatcaagttgaatcgtattaatgagcgctttaaacgagagggtaaaaagccgctcaagtcacttgatgatttaccgaaagattacaaagggccagatccctacttagatgaatcggtacaaattgctctagatttggcacatcaaccagccgaaataactctgacgaagtga

SEQ ID NO: 3158 - DNA, 723 bp, Xenorhabdus bovienii
  Coding DNA location: Contig name=SeqID_16888; Position on contig =94674..95396bp; Strand=-
atggaaactgaacctaagttgaatagtagtaaagaagtcattgctttcttggcggagcgctttccgctctgtttcgcagcagaaggtgaagcacgtcctttaaagatcgggatctttcaggatatcgttgaacgtattcagggtgaagaatgtttaagtaaaacacagcttcgttctgctttgcgcttgtatacatccagttggcgctacctttatggtgttaaagaaggtgcccagcgtgttgaccttgatggtaatgcgtgtggtgagctggaagtggagcacattgaacatgcgcgtcagcaactggcagaagcgaaagcgcgagtacaggctcaacgggctgaacaacgtgccaagaaacgtgaaaccgaaaacgcatctgacaaaaaaagcgaacatcctgtgaataaaaagatggcacctcgtcgtcaagcatcaggtgatggtgaaaaacgttcacctcgttcgcaaaatcgtctgcaacagtcacgtaaaccagcagataacgttacaagaaaaattgcacaaccaagaatttcacaacctgagttaacctcagtcacagacgtatcctctttgaaagtcgggcagacaatcaaagtaaatgtaggtaaaagtttaatggatgcttctgtgctcgaaattgcaaaagatggtgtaagagtgcaattacctactggtctggcaatgattgtacgcgcagaacacttaaagttctga

SEQ ID NO: 3159 - DNA, 102 bp, Xenorhabdus bovienii
  Coding DNA location: Contig name=SeqID_16888; Position on contig =95356..95457bp; Strand=+
atgacttctttactactattcaacttaggttcagtttccatgaaatttcctgattacaacggttttgccaaccagcgcaggcatgaacaggcgacattataa

SEQ ID NO: 3160 - DNA, 498 bp, Xenorhabdus bovienii
  Coding DNA location: Contig name=SeqID_16888; Position on contig =95492..95989bp; Strand=-
atggataagcataaattttatcaggagctatcagatagcttgatggctctattgtcaggtgaatatgatttaatcgcttctcttgccaatacaagtgcattgttaagtgatcgtttggatgatgttaattggatcggcttttatttggtggatggtaatactctagttttagggccatttcaaggtaagatcgcttgtgttcgtattcctataggaaaaggggtatgtggaactgctgtggcaaaaaatagcattcagcgtatttctgatgtacatgcttttcccggtcatatagcttgtgatgccgccagtaacgctgaaattgtccttcctttggaaattaatgggcaaattattggcgtattggatatcgacagcactgtttttgaacggtttgatgaaaatgatgaacatggcttgaaagcgcttgttatcaggctttgtaagcatttggggcaatgcgtcgtgccaaaatatctacaacagaacgtaacttaa

SEQ ID NO: 3161 - DNA, 375 bp, Xenorhabdus bovienii
  Coding DNA location: Contig name=SeqID_16888; Position on contig =96573..96947bp; Strand=-
atgtctatcagaggaatgataatgaaacgagtatattgggttttagcttttttgtttttctcttttcagagcattgccgcaccaatacaaactgtcagcaaattgcagtttgggaaacaatgggcctttacccgtgaagaagttatgcttgattgccgctcggatggggcgctatttgtgattaaccccagtacattaatgcagtacccgttgaatgatcgtgcaacacagcttatggaatccaataaaatcattgctacatcgttaaataagatccttttagatgatcctgagcattccaatcaaaaaatgagtattgaaccattccaaaaagcggcattagctttatgtgacaatacacgcgacaaaaaataa

SEQ ID NO: 3162 - DNA, 945 bp, Xenorhabdus bovienii
  Coding DNA location: Contig name=SeqID_16888; Position on contig =97013..97957bp; Strand=-
atgatttcgcttgaggcgttatacgtactctgccgtttctttcattttgtggtagtcatgctgatgtttggccttagcttgtttactgccatgcttgcttcaggccgcttttcggtactgatgagagaacggttaagagtcggagtttcaatcagcactgtgctggccttaataacctcaatagtctggtttatcatacaggcaggattaatgggggatggttggcatgatgtttatcagttcgatatttggctggccgtgctgggaacgacctttggtcaagtgtggaaatggcagctgttggttgcagcacttgctgttgcgtgtttgttcttttttcatactaaaactagaaatttcttattgttgggctgctctgttattttgctgtcaagtcatgctttcattggtcatgctgcaatgcatgaggggaatatcgggttgttacttcaggctaaccagattgttcatttactgagtgctggttattggtttggtggtttgtggccttttttgctgtgtttgcaattcttaaggctgaagaatacattgaattctaacttatatcgtgatggtacatatagcagttatatagtagacaagctatctggtgaaagcgtagctgcaatgcggaaattttcgaattacgggcattttgccgtttttatggtgatcatcacgggtattgtgagcagcatcattttaatcccagactggccagttttcagtaccaccatttctgagtatcaatcaatgctgtggttgaaaattgccttggttgctggcatggtgcttctggcgctgatcaatcgttatattctggtacccaggttaaatcagaaagggagctatgaatggttgatcatgaatagctggttggagattattctggcaacatccgtactgttatgtatagccatctttgcaacggaatcccccgtatga

SEQ ID NO: 3163 - DNA, 423 bp, Xenorhabdus bovienii
  Coding DNA location: Contig name=SeqID_16888; Position on contig =97957..98379bp; Strand=-
atgaaaattcacctgtatattaaagggttatctattatgtccattcttagtatccgttcattctgggctaaattatctgctctggtggttctatttgtcggaatgtcttgccaacaggctttggctcatgcgcatttgaaagaccagacgccagcagaaaacacaacagttgaagccgctccacaagctataactttgagcttttcagagcgtattgagcttgggttcagtaaagtaaaactgattggcccagaaaagaaaaccgtcaaaacgggtaagctagaacttgattctgacactaagaccaaattaattctgccagttgaagataaacttgcagcaggagaatatagcgtcgactggagcgtgctctctgtcgatggccataaaacaaaaggcgcttataactttaccgtaaaataa

SEQ ID NO: 3164 - DNA, 504 bp, Xenorhabdus bovienii
  Coding DNA location: Contig name=SeqID_16888; Position on contig =98568..99071bp; Strand=-
atgttaaaacaagaaatggtcaagaaattaaatgagcaattaaatctggagttttattctgccaacctatatttgcaaatgagtgcatggtgcagtgacaaaggatatgaaggcgcggcggcatttctgagagctcattcacaggaagaaatgcagcacatgcagcgcctgtttgattatttaggtgacacgggagcaatgcctgttctcggtgctgttcaggctcctccagttgaatttaactccatctctgatgtattcaatcagacctatgagcatgaaaaactgatcacagaagagatcaacaagctggctcatgtagcgatgatgacacaggattactctacttttaacttcctacagtggtatgttgctgaacaacatgaagaagaaaaactgttcaaatccattctggataaattaggtatggtaggtgaaagtggcaaatcactgttcttgctggataaagatctgaaagggttgtctgtaccagcacatgcctaa

SEQ ID NO: 3165 - DNA, 231 bp, Xenorhabdus bovienii
  Coding DNA location: Contig name=SeqID_16888; Position on contig =99404..99634bp; Strand=+
atggttcataacttagccaagttatctaaagatgaaatggataaggtcaatgttgatttagcggcatcaggagttgcatttaaagaacgctataacatgcctgtcattcctgacacggttgaacaatctcaaccacagcacctgcgagaatatttccagcagagattaaatcattaccgccagcaatcaaggtatttttcacgcttaccttatgaacccagaagccgttag

SEQ ID NO: 3166 - DNA, 954 bp, Xenorhabdus bovienii
  Coding DNA location: Contig name=SeqID_16888; Position on contig =99684..100637bp; Strand=-
atggtggaactacgaaaactctatccggcttatgacgcgtaccaaacgggatatctggataccggagatggacatcaggtttactgggaactgtgcggcaatccaaaaggtaaacctgcggtattcattcatggaggccctggtggagggatcgcaaattatcatcgacagttatttgaccctgagtgctatcatgtcatgttgtttgatcaacgtggttgtgggcgctccaaaccccatgccagtcttgaaaataataccacatggcacttgattgatgatattgagcgtctgcgtaatttgatgggggttgatagctggctggtttttggcggttcatgggggacaactttgtctctggcttatgctcagaaacatccgagccgtgtatcagagctggtgttaaggggtatttttttacttcgtacccaagaattgcattggtattatcaggacggtgcttcccggtttttcccagataaatgggaacgcatgatatctatcctttctgaggaagaacgcgaagatgtaatggatgcttaccgtaagcgcttgacgagtgatgatccagaagtacagttggaagctgcccgtttatggagcctttgggaaggtgaaactgtaacattattgccttctgaaaatgcaaattcattctcagaagataaatttgccctggcacttgctcgtattgaaaatcactacttcgtcaataacggttttatggataatacacagcagttattggaccatattgatcttatcaggcatgttcctgcggcgattattcatggacgttatgatatggtgtgccagttacagaacgcatgggatctggcaaaagcatggccggaagcggagttgcatattgtagaaggtgctggtcattcctttgacgaagcaggcattttacaccagttgatcaaggcgactgataagtttgctggaaaatag

SEQ ID NO: 3167 - DNA, 375 bp, Xenorhabdus bovienii
  Coding DNA location: Contig name=SeqID_16888; Position on contig =100717..101091bp; Strand=-
atgaaggcaaaccaatttattcatcgtattgggttattgggaacaggcattctgctttccgtttcattgactactgcgtcagccgctgaaaatgatcacgtggcgaagtttgtttcttgcaaaaacttaaccaaagaccaaatagcagcacaggtcaagcaagatttcttacaaaatcgtattcatcactgggataaagacaggaaacaattaggaacttcaaaacccattgcatgggtaaatgtcaatgatatgactggcgatagaaatgcgttacaggttccgcttattgttcgtggctcccaaagagacaaaagttacaatgtcacaattgattgtcaaaaagatacaatcaattatagtgaggtaaagtaa

SEQ ID NO: 3168 - DNA, 183 bp, Xenorhabdus bovienii
  Coding DNA location: Contig name=SeqID_16888; Position on contig =101193..101375bp; Strand=-
atgttttcaggtatgccggcattatcccatgaagaacagcaagttgcagtagaaaggatccatcagttcatttcagaaggtatgagcagtggggaagctattgctattgttgctcaagagttgagggagaaacatcagggcaaggagcagatccatgttttatttgaggatgacgaaaaataa

SEQ ID NO: 3169 - DNA, 1371 bp, Xenorhabdus bovienii
  Coding DNA location: Contig name=SeqID_16888; Position on contig =101542..102912bp; Strand=+
atgaagattgcattacaaaaacgactgttaccttattctcctgatcttgccacccgatattttgcccctctctcagtatcaccttgggcaatgttgttacattctggaacggctgaacacccccataaccgatttgatattttagttgccgaaccagtaacaacgcttatcacacggggagaatcaacagaaataaactgtaatggtgaagtttctctctctcaggaagatccattcttgttgttgaagaagcatctgcatattcgcaatattgctctgcaattcgatcctgattatccttttcaggggggtgcattaggtttatggggatacgatcttggccgcaagattgaaaaattaccctctattgctgccaatgaactggattttccggatatggccgttgggatttacgactgggctctgatcatcgatcatcaccgacagaaagcaacattactgggttatcacaatctcgataatcgtctggcatggctagaatcgcagcaaaaaaaccgggaaacaaatttctccctgagcagtcaatggcaatccaatatgactgcgcagcaatatcacgaaaaaattgcccagattcatcgctatctgcgtgatggagactgctatcaagtcaatctgtcgcagcgctttcatgccagctatcaaggtgatgagtggcaggccttcacccaactcaatgatagtaatcgcgctcccttttctgcttttatccgtttgcctgaaaactgcattatcagcgtttcgcctgaacgttttttattactggaagataagcaaatccaaacgcgcccaattaagggaacattgccacgattgcaagatccggaagaagattatttacaagccaaaaaattggccaactcccgcaaagatcgcgctgaaaatctgatgattgttgacttattgagaaatgacatcggacgggtagcaacaccaggctctgtcaaggttcctgaattgtttgtcgttgagccctttcccgctgtataccatctggttagtaccattacagcaacattacctgatgaatatcaggccaccgatttactccgagcttgttttccaggtggttcaatcactggcgcacccaaaattcgtgctatggaaatcattgaagagttggaacctcatcgtcggcatggatattgcggtgctattggctatattagtttctgcggtacaatggacagcaatatcaccatacgtaccttactgacagaaaagggaaaaatttactgttgggcaggtggtggtatcgtcgcagatagcattgctgaaaaagagtatcaggaaacatttgataaactggggcgcatcttacctcaattaggggaactccatataccatga

SEQ ID NO: 3170 - DNA, 570 bp, Xenorhabdus bovienii
  Coding DNA location: Contig name=SeqID_16888; Position on contig =102909..103478bp; Strand=+
atgacatcgctttctgacttcattcatcggtttcaattgcaacttcctgcgcagccagcagatttggcgaacaaccagcgaaatgctgctgtattgctgccgattatctgtaagccagagccaacacttttattgacccagcgcgctaaaaacctgcgttcacatgccggccagatcgcttttcctggtggagccgccgatcccgaagatcattctctgattgccaccgctttgcgtgaagcagaagaagaagtcagcattccacatcacaaagtacaagtattggggcagctagcccccttagacagcagtgggggctatcgtgttactcccgttgtcgggttagtctctccctctctttcttttcggacaaatccaacagaagtggcaagaatttttgaaattccactttttgatgctctctctcttccccactaccaacatttagatataaaaagccgcaagcgacagcaccgagtctatttttattggtatcgtgaacaaatgatttggggattaactgcggctattatttatcggctggcacaacaagttcaaagatcggtctaa

SEQ ID NO: 3171 - DNA, 1347 bp, Xenorhabdus bovienii
  Coding DNA location: Contig name=SeqID_16888; Position on contig =103667..105013bp; Strand=+
atgtttaaggtgggtattggcccatccagctctcatactgttggtcctatgaaagcaggaaaacaatttgtcgatgatcttgtaaaccaaggagtaatgtcctctatcacgcgtgtagctgttgatgtttacggctcactttcattaactgggaaaggtcaccatacggatatcgccatcatcatggggctggcaggtaacatgcccgcgactgttgatattgattcaattcctggttttattcgtgatgttgagcaaactcaacgtttgccgctggcaaatggtttacatgaagtcgattttcctcgtgacggaggtatgaacttccgcaacgataatctgtcactacatgaaaacggtatgcaggttcatgcattcgcaggtgacgaaaaaatttacagcaaaacttactactccatcggtggtgggtttattgttgatgaagaacatttcggcaaaccctctcaagataccaaaccggtttcttatccattcagctctgctgctgacctgctgatgaactgcagcaaaacaggtctgtctgtttctggcttgatgatgaaaaacgagctggatttgcatagtagagaagaaattggcgaatactttgccgatgtatggaataccatgcaagcctgtattgaccgtggtctgaacacggaaggcctattgccaggcccactgcgagtgcctcgccgtgccgcagctctgcaccgtatgctgacatcatcaaataatttctccaatgacccaatgaacgtggttgatttgatcaatatgtttgcattggcggtcaatgaagaaaacgcggcaggtggccgagttgtcacagcgccaaccaatggtgcatgtgggatcgtgccagcggtactggcttattacaaccactgcatcgagccagttacgccaaatctttatatccgctatttccttgcctctggtgcaatcggcatcctgtataagatgaacgcgtctatttctggtgcagaagtaggctgtcagggcgaagttggggttgcctgttcaatggcagcggcaggtcttgctgaattattgggtgcgagccctgagcaagtttgcattgcggcagaaattggcatggagcataacctcggtctgacttgtgacccggttgctgggcaggtgcaggttccatgtatcgaacgtaatgcgattgcttcagtcaaagccatcaatgcatctcgcatggcacttcgccgtaccagcgaaccccgtgtttcgctagataaagtcattgaaactatgtacgaaacaggtaaagacatgaacgcgaaataccgtgaaacatcacgcggtggtttggcgattaaagttcagtgtgactaa

SEQ ID NO: 3172 - DNA, 99 bp, Xenorhabdus bovienii
  Coding DNA location: Contig name=SeqID_16888; Position on contig =105236..105334bp; Strand=+
atgagaaaacaaagaataaaaaatcacaataaaattaaaaccaaagcgaaaatcttgttttcgtctctcaaaacagtccatcttaatttttctgactga

SEQ ID NO: 3173 - DNA, 957 bp, Xenorhabdus bovienii
  Coding DNA location: Contig name=SeqID_16888; Position on contig =105570..106526bp; Strand=+
atgattggcacacatggggctgcggcagagcaactgcttcataccgcagagatgttgattggagaacaggaaaacgtttcttatattgacttcgtacccggtgaaaatgccgatacattgttcgacaaatacaaccagaaactggaatcacttaatacagagcaaggtgtcttatttttcgtggatacctggggtggtagcccattcaatgcagccaaccgtatcgtggttgacaaaagcaactacgaaattatcactggcgtaaacgtccccatgctggttgaagccttcatgtgccgtgacgatgatccatcaatggaagagctggtttctgtggcactggaaacaggaagagaaggtatccgcgcccttaaaacagaacaagctgaagaaacccaaaaacctgaaccagtcaaacccacagcaccaaccattgctcccgcttcatcacctaccgtttctggtggcgggcacatgaaaattgcccttgcgcgcatcgatgaccgccttattcatggtcaagttgcaactcgctggacaaaagaaaccaatgttaaacgcatcattgtggtcagcgatgatgtggcacaagataccatccgctccactttgttgaagcaagtcgcgcctcctggcgtcagcgctcatgtgatagacgttgctaaatgcgttcgtgtttacaacaaccctaaatatgcgggtgagcgtgtcatgctgctattcacaaaccctacagatgtactgcgtattgtcgaaggcggtgtttcacttgaatctatcaatatcggtggcatggctttccgtcagggcaagactcagatcaataacgccatttcggttgatagcgctgacattgaagctttcgagaaattaaattcccgcggtatagaacttgaagctcgtaaagtttccagtgatacccgcttgaatatgattgatctacttaaaaaagcttaa

SEQ ID NO: 3174 - DNA, 801 bp, Xenorhabdus bovienii
  Coding DNA location: Contig name=SeqID_16888; Position on contig =106612..107412bp; Strand=+
atggaaattaccgttgttcaacttttgttgatattcatcgttgcctgtattgcaggcatggattctattcttgatgaatttcaattccaccgtccgctggttgcctgtacattagtcggcttagtactgggtgatatgaaaaccggcatcatcatcggcggtacactcgagatgattgctcttggctggatgaatatcggtgcggcagtcgcccccgatgcagcattagcctccattatttcaaccattctggttatcgctggcggacaagacgttggtgcaggtatcgcactggctattcctctggctgcgacaggacaagtattgaccattatcgtccgtactctgaccgttggcttccagcacgcggcggacaaagccgcagaaaacggtaatctccgtgcaatcagcgcccttcacatttctgcgttaatgcttcaggcaatgcgtatcgccctgcctgcactggtcgtggcattgtcagtcggtacgtctgaagttcagagcatgctgaacgcgattccacaagttgtgaccagcggcctgaatatcgcagggggcatgatcgtcgttgtcggttacgcaatggtgatcaatatgatgcgcgctggctacttgatgcccttcttctacctcggtttcgtcacagcggcctttactgatttcaaccttgttgcattgggtgtgattggcgttgttatggctatcctgtatatccaacttagccctaaatataaccaatcacagacagccgcttctgcaggcaatacttcaaatgaccttgataacgaattagattaa

SEQ ID NO: 3175 - DNA, 858 bp, Xenorhabdus bovienii
  Coding DNA location: Contig name=SeqID_16888; Position on contig =107417..108274bp; Strand=+
atgaacaacatgtcagatacaacaaacataggtcagaaaaaactgacacaaagtgatatccgtggtgtttttctccgctctaatctatgtcagggttcatggaactttgaacgtatgcaggcattgggtttttgcttctcaatggtgccagtcattcgtcgcctctatcctgaaaatactgaggaacgaaaacaagccataaaacgccatctggaattcttcaacacccatccttatgtggcagcacctatccttggcgtcaccatggcgatggaagaacagcgcgccaatggtgccgatattgataacggtgccatcaacgggatcaaagtcggcttaatggggccactggctggcgtgggcgatccgattttctggggaaccgtgcgtccagtcttcgccgcccttggtgccggaattgctatgagcggtagcatgatggggccaattctatttttcttcctatttaacttagtacgattgctcacccgttaccttggcgtggcttatggctataaaaaaggcttagatatcgttaaagatatgggcggcggcttcttacaaaaaatgacggagggggcatcaattcttggcctgtttgtcatgggcgcgctagtcaataaatggactaaagtgaatattccgctggtagtttctgaagtacctgatcctaccaccggcgtaataaaagtcactaccgttcaaactatccttgaccaattaatgcctggtttgatgccgctattgctgactttcggctgcatgtggctgctgcggaaaaaagtaaacccactgtggatcatcatgggctttttcgttctagggatcgtaggcttccgttttggtttcctcggttaa

SEQ ID NO: 3176 - DNA, 459 bp, Xenorhabdus bovienii
  Coding DNA location: Contig name=SeqID_16888; Position on contig =108393..108851bp; Strand=+
atgagcttgaatgatatcatattaatgattttagttttattaatgctcgcttttgcgatttatgatgaatttattattaatcagttcaaaggtaaaacgctattaaatataaaactaaaaagaaaacatcggatcgatgccttaatatttatcgttctgatttctatcgtcatttataataatgttatcgtacagggcaatcagttaactacccacttactgttatttatcattttggttacaatatatttaggttatattcgttcgcctaaacttattttcaaaaaacaaggattttattacgccaaccgtttttttcaatataaaaagataaacacaatgaatctatctgaagacggtattttaatgataagttttgaaaaaaataatatatatatcgctgtaaacaaactggatgatttagagaaaatctatcaattccttgtcaacaacagataa

SEQ ID NO: 3177 - DNA, 189 bp, Xenorhabdus bovienii
  Coding DNA location: Contig name=SeqID_16888; Position on contig =108956..109144bp; Strand=-
atggtcttgccaaccgatttagagcttatttttattaggctcttcaggcattcgtaccacgttttgttgcaaacgagtatgttgatacgaattttccaaaaatgttttggaacaggctactccccaatgactggaaaggacaataccagatttaaaataaaaggcaaaaaatatttagttatatattaa

SEQ ID NO: 3178 - DNA, 621 bp, Xenorhabdus bovienii
  Coding DNA location: Contig name=SeqID_16888; Position on contig =109180..109800bp; Strand=+
atgtgtatatggaatcacccagccgaggctatgttgatgaatctctacgcaacactcattctcgcattcgcgctatccatggatgctttcgctgccgcagtaggaaaaggtgccgttcttcaccgcccacgtttccgtgaggcgatccgcacaggtattatctttggtttggttgaagcctgcacgcctttaatcggttggtttttgggattttatgccagccaatatattatggaatgggatcactggattgcattttcactgctgttcatgcttggctgtcggatggttattgaaagtttgaaaaataatgttcaaactaccgttgaatctactcctcgccgtcatagttcaacgacattagttatcactgcaattgcaactagtctcgatgctatggtgattggtgtcggtctcgctttcttacaggtcgatattttgcataccgccatgacaattggaataataaccatgattatggctacattaggaatgttaatcggacgttatattggaccgttattaggtaaacgagcagaactgattggcggcctgatattaatcatcatcgggttcaatatattattcgagcatcttaaattatttatgtatgcagcatag

SEQ ID NO: 3179 - DNA, 816 bp, Xenorhabdus bovienii
  Coding DNA location: Contig name=SeqID_16888; Position on contig =109856..110671bp; Strand=-
atgtcttatcaatgccctctatgtcattcaccattattgttcactcatcatcaatggcgctgtgaaaacaatcatcagtttgattgtgcgaaagaagactatgttaatttgctgccagttcaacataaacgctcaaaagaaccgggtgacagtgttgaaatgatgcaggcgagaagggcgtttttacattctggctactatcaggaattacaacagaaaacgattcagttgcttgacaagtatttgccagaaggcgccggaacgttattggatattggttgtggtgaaggctattatacggctgcggtacaggcacagttgaatctccatcgggatatgacggtatatggtctggatgtagcgaaaatagcggttcgttatggggctaaacgctatccaaaagtcaatttctgcgtagcatccagccaccgcctgccatttgctgacagttcgcttgacggaattctgcggatttatgctccttgcaaagcgactgaattagctcgtgttgtaaaaccgcatggcattgttttgacggttacacctggcccacgtcatttgtatcagctgaaggaattgatttatcaggaagtgaatttacatcctgaaaacaaggaacagtgggagggatttgaattaatttcgacagaaatgctggcctatgcaatgccattggatggagagcaagctcataatttattgcagatgaccccttttgcctggcgggcatcagaacaggttaaaactaatttgatgactgaaaaactgtttaattgtgaagctgattttatgctaaaagtttatcggcgtatttga

SEQ ID NO: 3180 - DNA, 561 bp, Xenorhabdus bovienii
  Coding DNA location: Contig name=SeqID_16888; Position on contig =110812..111372bp; Strand=+
atgattatgccatttgacaacttggaaaccgaacgactgctattaagaaaattagcttatgatgacgcccctcaaattcagcaaaaattcccttattgggaggtcgtgaagtatttagacagcaatgcagttccttggccgtatccggataacggtgcagaatactttgtcaatcacattgctatgcctgaaatacaaactggaaaagtatggatatggtcaatcaggatgaaaaataaccctgataaactaattggtgtgattgggttatatgataaaccggataacaaccgaggtttctggctttctccagaatatcatggccgaggattgatgcgggaagccagcgaaagagtcactgattactggtttaatgagttggatcgaaccgtactcagaacactgaaagcctgtattaatgaaaattcgagaaaaatttcattaatacagggaatgcgtttgatcagcaccaataaaaaacaatatgtgtcaggtagatatgattctgaaatgtgggaaataaccaaagatgagtggcttaataaatattctcttccttga

SEQ ID NO: 3181 - DNA, 384 bp, Xenorhabdus bovienii
  Coding DNA location: Contig name=SeqID_16888; Position on contig =111540..111923bp; Strand=-
atgttgaatacctttacaaatcgaggaaatatgcgatttttggcaaatttcatttcaccattagatgctcgtattgtattaggcaggatgctgtcagaagggatcaatgctgaattgattgatgaaaacgtagtatggaacaactatatgtattcacaggcgttaggtggcgttaaattactggttcataattcagatattgaacaggcaaaaaacgttattactcaaattgatcggggctgttaccaattggatgattctagtgaaaactcaccagtgtcaaaaaacaacgtaactgacaatacattaaatacttttttatccatcgcattatttttgattacgggcattgcgataccgtttaagtcatcatattttcgttaa

SEQ ID NO: 3182 - DNA, 96 bp, Xenorhabdus bovienii
  Coding DNA location: Contig name=SeqID_16888; Position on contig =112268..112363bp; Strand=-
atgctggtgtttttagttgtcattttcaaattgcttgagatctattttttaatattaatctcgtcacctaagcggattaaaaaaataaatgcgtaa

SEQ ID NO: 3183 - DNA, 204 bp, Xenorhabdus bovienii
  Coding DNA location: Contig name=SeqID_16888; Position on contig =112326..112529bp; Strand=-
atgatatcagcggtaagccaccagcgacgatcgagtgggaatgatccaaagcttttccatatatcgcccttttatgatgatttaataaataagaccctgatttcagggtctttttattttaatggtttttgttgttattatgcgaaaccacgagttaggttttataatgctggtgtttttagttgtcattttcaaattgcttga

SEQ ID NO: 3184 - DNA, 1578 bp, Xenorhabdus bovienii
  Coding DNA location: Contig name=SeqID_16888; Position on contig =112486..114063bp; Strand=-
atgacaactaatatccaccagcatcgcattctgatccttgattttggttcgcaatatacccagctaattgcccgccgtattcgtgaaattggtgtttattgtgaactttggacatggaatgtcacggaagagcaaatccgtgaatttaacccgagtggtatcatcctttcgggtggaccggaaagtacaacagagaataatagcccgagtgcgccggaatatgtctttgatgcaggcgtgccggtactgggaatttgctatggtatgcaaaccatgtccacgcaactgggcggcaaggtgggtaattccactgagcgcgaatttggttatgctcaagttgaaatcaaaagtgactgtgaattattccgtggtattcaggatgccctgagtgaatccggtaagcctttgctggatgtatggatgagtcatggtgataaagtcactgttgttccagaaggtttcatcaccgttgccagcacggatacctgcccgtttgccattatggtcaatgatgaaaaacgtttttatggcgtgcaattccacccagaggttactcatactcatcagggtttgaatattttgcaacgttttgtactggatatttgtcaatgtgaagcattatggacatctgcttccatcatcgacgatattgtagaacgcctacgtacgcagattggtgatgatcacgttattctggcactgtctggtggcgtggattcttccgtaaccgcattgctgctgaaccgcgccattggcaaacgcctgacctgtgttttcgtagacaacggcctgttgcgtctgaatgaagccgatcaggttatggcgatgtttgagggtaaattcgacctgaacctcgttcatgttaaggcagaagagcgcttcttgtctgcattgacgggcattgatgagccagaagccaagcgtaaaaccatcggtcatgtctttattgatgtatttgatgaagaagcatcaaaacaaactcaggttaaatggctggcacaaggcacgatttatccagatgttattgaatccgctgcttctgcgacaggcaatgctcacgttataaaatctcaccacaatgtgggtggtctgccggacgatatgaaactgggtctggttgaaccgctgaaagagctgtttaaagatgaagttcgccgtattggtctggaactgggtctgccatatgacatgctgtaccgccatccattcccaggcccaggtcttggtgtgcgtgtattaggtgaagtgaagaaagagtattgtgacctgctgcgccgtgcagatgctatttttattgaagaactgcataaagcggatctgtacaataaagtcagtcaggcattcaccgtattcctgccagtacgctctgtcggcgtaatgggtgatggccgtaaatacgactgggtcgtttccctgcgtgcggttgaaaccatcgattttatgaccgctcattgggcacacctgccatatgatttcttaggtcgtgtgtcgaacaggatcattaatgaggtcagtggcatatcgagggtagtttatgatatcagcggtaagccaccagcgacgatcgagtgggaatga

SEQ ID NO: 3185 - DNA, 1467 bp, Xenorhabdus bovienii
  Coding DNA location: Contig name=SeqID_16888; Position on contig =114140..115606bp; Strand=-
atgttgcgaattaaaaaagaagcattaacttttgatgacgttttgttggttcctgcccattctacagtcctgcctaatacggcagatctgtccactcaattaacttccactattcgtctgaacgttcctatgctctcagcggccatggatactgtgacggaatctgctctggcaattgcactggcccaggaagggggcatcggcttcattcacaagaatatgcccattgagcgtcaggcagaagaagtcagtcgcgtgaaaaagcacgaaagtggtgtcgtgactaatcctgttactgtaacgccacaaactacattgcgcgaagtacacgaactgactaaacgtaatggtttcgcgggttatcctgtcgtgacagaagagaacgaactggtaggtatcattactggccgtgatgtacgtttcgttactgatctggatcagccagtgactgcggtaatgacgccgaaagagcgtctagtcatcgtaaaagaaggtgaagcgcgcgaagttgtgttgcagaaaatgcacgaaaagcgtgttgagaaagcactggtcgttgatgatagcttccacttgcttggcatgatcactgtgaaagatttccagaaagcagaacgtaagccaaacgcctgtaaagatgaagaaggtcgtctgcgggttggtgctgcggtcggtgcgggcgctggcaatgaagaacgtgttgatgcgctggtggctgcgggagtggatatcctgcttattgactcatcccacggccattctgaaggtgttttgcagcgtattcgtgaaactcgtgctaaatatcctgatttgcaaatcattggtggtaacgtagcgactggcgaaggtgctaaggcactgtttgaagctggcgttaacgcagtgaaagttggtattggccctggttctatctgtactacccgtatcgttactggtgttggtgtccctcaaatcacggcgattgctgatgctgtggatgcactggaaggtactggcattcctgtgattgctgacggtggaatccgcttctctggtgacatcgctaaagcgattgcagcgggcgcatcatgcgtcatggtgggttcaatgctggctggtacagacgaatccccaggggaaattgaactctatcagggacgttctttcaaatcctaccgtggtatgggatcactgggcgcgatgtccaaaggctcttctgaccgttatttccagaccgataacgcggctgacaaactggtgccagaaggcatcgaaggccgtgtggcttacaaaggcctgttgaaaagcatcgttcaccagcaaatgggtggcttgcgttcctgcatggggttaacaggttgtgccactattgacgaactgagaactaaagcagaattcgttcgtatcagtggtgcgggcattcaggaaagtcacgtacatgacgtgaccatcaccaaagaatcaccaaactatcgtttaggtttgtaa

SEQ ID NO: 3186 - DNA, 1368 bp, Xenorhabdus bovienii
  Coding DNA location: Contig name=SeqID_16888; Position on contig =115777..117144bp; Strand=+
atgtcactaccaaccaacaccggaattttttctgttagtcgtctgaatcagactgtccgtcagctattagagctggaaatgggtagaatttggctaagtgctgaaatttctaacttttcccagccttcatcagggcattggtacttcactttaaaagatgagcgggcgcaaattcgtgctgctatgtttcgcagcagtaatctgcgggcaacatttcgtccacaaaatggtcagcaggtgttggtgcgtgcacagattacgctatatgaaccacggggtgactatcaactgattgtggaaagtatccaagctgctggagatggactgctacagcaacaatttgaggtgctgaaacagaaacttacctcagaagggttatttgattcgatccataaaaaaccactgccctcaccagcaaaacgcctcggtgtcattacctccgccagtggcgctgcgctgcatgatattctcaatatcctgaaacgccgcgatccatcactgccaattatcatttatcccactgcggttcagggagctgaagcgccgttacaaattattcgggcgattgagctggcaaatgatcggcaggagtgtgatgttttaattgtcggccgtggcggtggatcactggaagatttgtggtgtttcaatgatgagcaggtagcacgggcgatcttccagagccgtattcctatcgttagcgcagttgggcatgaaaccgatgtcacaattgcagattttatagccgatctgcgcgcacctacgccttctgcggccgctgaactagtcagtcgcaatcaaattgagttgttgaggcaagttcaatctctgcaacaacgactcgaaatggcgatggattacttttttgcccaaaaactgcgtatttttaatacgttgcagcatcagctccagcaacagcgccccgatttacgtctggctcgtcaacagaacaaattagtggaattacgtcaaaagttggtcgatagcttcttgcgttgtttgaagcaacattccctttcacatgagaagctaaatctgcgactcttacaaactaatcctgatcagcaaattcggcatgatagccaacagatccaacaatatgattttcggttgaaacaagcgattgaacgtcaattaggacattatcgggagaaatttgcggtttcctgctcgcagctcaatgccgtcagcccgctggcaacgctgcaacgcggttacagtatcagtgaaacatccgatggcacgttactgaaggaaactaagcaagtgaaagttggggataccctaaacacccgattacaggatggctgggttaaaagtcaggtgattcaagtaaaaagacagaccaagagagaaaaatcacaatag

SEQ ID NO: 3187 - DNA, 2259 bp, Xenorhabdus bovienii
  Coding DNA location: Contig name=SeqID_16888; Position on contig =117194..119452bp; Strand=-
atgaagattgtggcaaaaatagcgggagccagtgtaatacttattgggcttcaggggatagcttatgctgaaaatgcgagtgacaataaaaaagaaaaagttatgcgctttagtagcctgaaagtttcaggtgctcaagataataattccccacagactcaggcaatggaaaaacccggcgcttatagttctgtcggtgaagataataaactggaatctatggacagcgtattgcgtagcttgccggggacttatactcagatggatgtgagccaaagtgcggtcagcgtcaatatccgtggcttaagtggttttggccgcgtcaatatgatggtggatggtgtcagccagagtttttatggtactgctccgagtgaattctcacatgggcagcagccttataaccagactggtgcattaattgatcctaattttattgttcgtgttgatgttgctcgtgggcaatctgacgattctgcttctgtcaatgctctggtaggaagtgctaattttcgtactcttggtgttggtgatgtaatatttgatggcaacaatctaggtgtgcgtactaaatggacgtatggaaataatggcatcggcaaaagtggcatgatggcttttgcgggaaaaacgcaggcatttagtcctgatggttctattggcgctatgcttgcggttagtggacacagcattgatgcccattataaaaacgcgatgggagtcagcagcgatgaatttggtacacgtgatacatttaaacaaaaaccaaattctcaattgatgaaattaaatattaaacccaatgaatttcatgatttggaattaagtgggcgtttttatcataataaatttaatcaacgtcatatcgacagttcagattattatctgaaatatcattacacaccatttagtgaattggttgataccaaattgctgcttagctcaagcaaaagccagcaggactttgaaaacaggtcgatgggcgtattgggtgaaggtgaatctaaaaaccaatccaatgctattgatattagtaataccagccgtttcaattatgctgatactgactttgcatttacactgggtagtaaatggatgaatactggatatcgtaaaaaaatcagtactgaaatagaagataaaaaagtggctggggaagcaatagaaaataatgggtttgcgccaagtggaaaacaagatattgccagcatctacagtcgccttaaaatcgaacacggtatttatacggcagatttggcactgaattatatggattacagtgttaaagggataaaaccagcctgtgaagaacgagtaaattgttttcctcaaggggaaacacaattaaatctaaaagagcgagggtttaatcctggtattttgttatcggcagaaattattcctgaatttcagccatttgtcagttatacgcactcaatgcgagcaccgaatgctcaagaaatttttcattctaatgacggtggcaattctatgaaccctttcttgaaaggagaaaaagcggatacctatcaaattggtttcaatagttatcgcccaaatttaattgtcgatggagatacatttcgcctgaaagcgacactgttccaaactaaaattaaaaattacatcaccagtgatcagtatgtgctttgtattgaaaagaggatgtgtaaaatggatgggacactgacaggtgaagagtttgctgctattaacaccaatgtgacagcagttatttatagtaatagcctaacgcgggtaaatatgcgcggttatgagattgaggctcattatgatgcaggtatattctatagctcactggcatatagtcagcaaaaaacacagcaaccaacttcaatgggggcaacttattttggggatagcccggcttctcaattgccagaacgttatattacgctggatacgggagttagattattagatgaaaaactcagtattggggctattgtgaaatatactggagaatcgtatcgtcaacatcctgatgctacactggatgatgatggtactatcttaatgaaaaaagatgataaaattccaactatcattgatttgtatagtgattatcaggttaataaaaatctatttattaagttttccatacaaaatttaatgaataagaattactctgatgcattaaatcgcatgaattcttcaccgatgatggatgaacagaatgccagaacccaaaccgcccgtggcagaacctacataatgggtgcagaagttcgcttctaa

SEQ ID NO: 3188 - DNA, 2172 bp, Xenorhabdus bovienii
  Coding DNA location: Contig name=SeqID_16888; Position on contig =119577..121748bp; Strand=-
atgttacagcataaaacggtattttcacctcaaacaacaagggtagtacgcagctttctactgggtggtagtttgctgtgtaacagttttgccactattgcaatggagaaaaatatggtgccacctatggctacaaaacagccacataagatgacgtttcacgatgatacccgtgttgacaattattactggctgcgcgatgacactcgtcaggataaagacgttattgattacttgacggctgagaataagtataccgagcagatgctgaaatcaggccaggaattacgggaaacactgtataacgaaatggctggcagaatgagtaaagaagaccagtcagctccttatacctataatgggtatgtttatcgtactgtttatgaggcagggaaagatttcccgatctatcagcgtaaacctgtcgataattcaaccgactggcaggtgatggttgatggtaatgaacgggcaaaaggccataagttctatcgagtcagtgggtttgcggttacgcgggacaacaagcgtatagctgtggcagaagatactcaaggtcgccgcaattatcaggtttcatttaaaaatttaggtgatggtgaatggcagaacagtgtcattgaaaacacatctggcaatattgtgtgggcaaatgatggtaatacgctgttttatgtgcgtagagatccacagactctgttgccttatcaattattccgtcatcaatatggcactgatatccaacaggataaaaaaatctatcaggaagatgatgaccgtttttatctgggaatatcagaaagtacctcgcttgactatattttgatctctattgccagcagtacgacctcggaatatcggctgattgatgccaataatcctcaatcagaaactcagattttctctgctcgtcaggctgggcgtgaatatgatctcgatcatttccgtggacaattctatatccgttccaaccatgaacatccattgtttggcttataccaagcaggcgctattaataaactgtgggagacggtaattgcgccccaggaagagactgatctggaaaattttgcgctgttcaacaactggttggtagtgcaagagcgtaccaaaggattgtcaacaattcgtcagattgattggaaaacccagcaggaaaaacgcgttaagtttgatgaacctgcatatatggtatcgttagactataacccggaacccgatactgatttactgcactatagttattcgtccatgactacaccgagttcggtattccagtggaatatgcaaacgggtgaacgtgaattgctgaaacagcaggaagtcaaagggttcgacaaagagaactatgaaagccagcgtatttgggtaaaagcccgggatggcgtagaagtgccggtttctctggtataccgtaagtcattatttaagaaaggagaaaatccaatcttgatttacggttatggttcttatggtatcagtatggacccttatttcagctctccgctgctgagtttgctggatcgcggctttgtgtatgccttggtgcatgtgcgtggtggtggtgaattgggtaagaactggtatctgcaaggtaaagtcgaaaacaaaatgaacagttttcatgattttattgatgcaaccaaaacattgcttgctgatgggtatggtgacagccagcgcgtatatgccgaaggtggcagcgcaggcggtttattgatgggaacggtgatcaatcaggctccggagctatatcgtggtgtgattgcaaaagtcccttttgtggatgctgtgactacaatgcttgatccatccattccattgacgaccggcgaatatgaagagtggggcaatccaaataacaaagaggattacttccgcattaagtcttatagcccttatgataatgtcaaacatcagcgttatcctcatttattggttacgacgggtttgcatgattctcaagtgcaatattgggaacctgcaaaatggatggccaaattaagggaaataaagcaaggggatagtctcttattactggaaacgaatatggatactgggcatggtggaaaaccagggcgttttaatcgcttgaatgatattgcctttgattatagtttccttttaatgttggatgatgccaaagtttattttccacaactaaaagactaa

SEQ ID NO: 3189 - DNA, 804 bp, Xenorhabdus bovienii
  Coding DNA location: Contig name=SeqID_16888; Position on contig =121767..122570bp; Strand=-
atgttgacgtataccacgtatcaaaccactcacgttggtcacgtgacaaaatcctttctcgctgcgatcactctccatgctttgctggtgggctggtttatttatacacccaaggatattgatattgaggagttcctgcctccgcctgcggttatggtggaattgtcattgcagacagaagcgatacacaagatacagaatcaacctattggaattgaacagcaattgtctgttgccagccagcaacaggaaagtaaggttgatgaaatcaacatgccaaaattggatgtgaatgaaaatgccaatattttggtgcataagccgaagaaaaaacagaaagaacaggatgcacctaaaaaaacacagcctgttaagcgtgtgaaggcagaaaaacaggaaagtgaaaagtctcgcagtagcgctgcaccgacaaccagtaatgcaacggcagataatataacctctcgtacagccgcatcttatgaaagtaattccgatgccattgctgatgccagagcggtctggcaggctgaggtcagcgggcatttaaatcgctataagaaatatccgccggatgcccagagaagaaaccgaacagggcgaccgatggtaaaattcacggttaatcagtttggtactgtgattgatagtgaattaataaaacgttcggggacgaactcactcgacagggaagcaaggctcgtgttggaaagatcgcaacccttacctttaccccctgatgttattttaatcaatggcagggtgacagttgaactgccgattgatttttatttatctcagtaa

SEQ ID NO: 3190 - DNA, 903 bp, Xenorhabdus bovienii
  Coding DNA location: Contig name=SeqID_16888; Position on contig =122683..123585bp; Strand=-
atgaaagcatctacctgtataaaatcgacttttttagcgtgtgccttcctgtttggcggctgtgtaacaccacagcacgatcctcaaaatggatctcaaagagcgcttcaaaccctttccagtgaattagtgcaatccggcatgttgcttgatatgaaaacgggcaaagcgatcacctccgctgaactgcttgagcaactggctgcttaccctagagtcattgtgggtgaaaagcatgataatccctaccaccatcagatcgagttatggctggttcagcagcttgggcagaaacgcccccacggttccgtattgctggaaatgattaacccaaaccagcaggaaaaagtgaataaagtcaaaagctggttgcagagcaatccgattgtcagagaggaaagaattaagcaattattggcgtggcaacaaggctggccgtgggaattgtatggggagctggttacggagctggtgaaagcaccttatccgttgctggcggcgaatttggatcgctcggagatcgatcaggcatataaaaatcattcccctacggataaaacggcatgggtttctgatgacgttaaaaaattaatcgaagaaacgattaaaaattctcacggtgcggacatagaggcaaaacacctttctgccatgacgatgattcaacaaatgcgtgatcggcggatggctgagcagttggttaacgcgccatcacctgctttgctatttgcgggcggataccacgcggtaaaagcgatgggagtccctcagcatgtgaaaaaaatagcgccaaatgagcaggttgctgtattcgttatcgcagaacaaggggtttctctgaacagagaatatgctgattttgtctggtttacccccaaagtaactaaagctataacccaatag

SEQ ID NO: 3191 - DNA, 2280 bp, Xenorhabdus bovienii
  Coding DNA location: Contig name=SeqID_16888; Position on contig =123740..126019bp; Strand=-
atggacgagaaattaaaacaaagtgctcttgattttcatgaatttccgcaaccagggaaaatcaccgttaccccgaccaagccattaacaacacagcgtgatttggcattggcatattcgccaggcgttgctgcgccttgccttgagatagcaaaagatccactggcggcttataaatatactgcacgcggcaatcttgtcgcggttatctccaacggtactgctgttttgggcttggggaatatcggtgcattagccggcaaacccgttatggaaggtaaaggcgttctatttaagaaattctctggcattgatgtttttgatcttgaagttgatgagtccaatcctgataaattgattgatatcattgctgcattggagccgacttttggtggcattaaccttgaagatatcaaagcaccggaatgtttctatattgagcagaaactccgtgagcggatgaaaattcctgtattccatgatgatcagcacggcacggcgattatctgtacggctgcggtattaaatggattgcgcattgtcaataaagatatcggcaaagtacgcttggtggtatctggtgcgggtgcagcatctattgcctgtatgaacttgctggtggctctgggtctgaagcgtgaaaatattaccgtctgtgactcgaagggtgttatctatcgtggtcgcgaagagaatatggaaaagaccaaagccgattatgctatcgaagataatgggtgtcgtacgttgatggatgtgatccctgatgccgatatttttcttggctgttctgggccgggtgtcctgacaccagagatggtgaagacgatggcgaaagatccgctcatcatggcgttagcgaatccagaaccggaaatcctgccaccactggcaaaagcggtgcgccctgatgccattatctgtacaggccgttctgattttcctaaccaagttaacaacgtgctctgcttcccattcatcttccgtggcgcacttgatgtcggggcgacaacgattaatgaagagatgaaactcgcctgtgttcacgcaattgcggatctggcactggccgaacaaagccaagaagtggcttcagcctatggcgaccaagatttgttctttggctctgaatacattattccgaagccatttgatccacgcctgattgtcaaaatcgcgcctgccgtggcgaaagctgcgatggattccggtgtcgcaacgcggcctatcgctgatttcggggcttatattgagaaactcaacgagtttgtctataaaaccaacctgtttatgaagccgattttctctcaggcgaaaaaagagaaaaagcgtattgtattggcagaaggggaagatattcgtgtactgcatgccacgcaggaattggtttcccttggattggcattcccagtattgattggtcgcccaagcgtcattgaaatgcgtattaagaagcaaggtctgcacattgaagtcggtaaagattttgaagtcgtgaataacgaaaatgatccacgttttaaagagtattggcaggaatattaccaactgatgaaacgccgtggtatttctcaggagcaggcccgccgtacggttattggtaatccgacactgatcggtgcaatcatggtacatcgtggtgaagcagacggcttgatttgtggcactgtcggcagctacagcgaacattatcaagtagtgaaagatttctttggcttccgtcagggggtacataccgcaggtgcgatgaatgccttaatgttgccgatggggaatacttttattgcagatacttatgtcaatgaagatcctactccagaggaactggctgaaattacattgatggctgccgaaactgtgcgccgttttggtattgaacctaaagttgctttgttatcacgttcgagttttggttcttctgattgtgtttccgcacaaaaaatgcgtaaggtgctagaactggtgcagaaagcggctccgtcacttgaaatcgacggcgaaatgcacggagatgcggcactggtggaaaacattcgtcgtgacattatgccggacagcccactgaaaggtgcagctaatttgttgattatgccaaatatggaagctgcgcgtatcagctataacctgctgcgtgtcaccagctccgatggtgtaacagttggcccagtattgatgggcgtgtcgaagccagtgcatatcttgacgccgattgcttctgtccgtcgtatcgtgaacatggttgcgttggctgccgttgaagcacagaccaatccactgtaa

SEQ ID NO: 3192 - DNA, 636 bp, Xenorhabdus bovienii
  Coding DNA location: Contig name=SeqID_16888; Position on contig =126570..127205bp; Strand=+
atgcataatcattcagtcatgatagtcgatgatcatcctatcattcgtcacggtttaaaaaggttgattgaattggaacgtgaactcattgtgactgctgaaacagacaatggtgaagatgctattaatatagcctgccagataaaacctgacattattctgatggatttaaaaatccatggcctttccggaattgatacgattaaatctctccgccgaaaagggcttgattcctatgttttggtactctcagattcagataatcgcggtgatatttatgatgcaattgatgccggtgcaaatggttatttattaaaagatattgaactggctcctctgatgagtaacataaaaaaagccgcaaatggcgatgcagtatacagtgaaaaagtctatcaatatttatccacccgtcatcttcatattgatcctttatcaaaattaaccaaacgtgaattggatgtcctaaaagaaatctcagaaggaatgacaaataaagaaatcgctgactttctttttatttcagaagaaactgtgaaagttcatacccgtaacttattgaaaaaacttaaatcccgctcccgtctagaagccaccatcatctatctaaggcatagaaaaccagagttaatctga

SEQ ID NO: 3193 - DNA, 381 bp, Xenorhabdus bovienii
  Coding DNA location: Contig name=SeqID_16888; Position on contig =127552..127932bp; Strand=+
atgtcagataccacttctcacaaagcattcactctctacggtatcaaaaactgcgataccatgaaaaaagcgcgtcgctggctagaagaccaagagatcccctatcagtttcatgactatcgcgttgatggtctatcctctgagttgctacagttatttattgaacaagcgggctgggaacccctgttgaatactcgcggtacaacttggcgcaaattgtctgatgatcaaaagtcagctattaataatacagaagctgccaaaaaattgatgctggaacaaccttcaatcataaaacgcccgctattggtgtcagaaacagggaattatttactcggctttaacgccgaacaatatcaacagtttttctttcatgactag

SEQ ID NO: 3194 - DNA, 1128 bp, Xenorhabdus bovienii
  Coding DNA location: Contig name=SeqID_16888; Position on contig =127947..129074bp; Strand=+
atgacttgtccagtaattgaacttacccagcagctaatcaaacatccttctgtcagccctgatgaccaaggatgtcaggatatactcattcaacgtctgcaaaatactggctttacaatagaacgaatgcctttcggggatactctgaatttctgggcttaccacggaacaggcacaacgtttgccctcgcaggacacactgacgtggttcctgccggtgatacttcaaaatggcaaacccctcctttcgatcccgttattcgtgatggcatgctgtatggccgtggtgcagcggatatgaaaggttctctggcggccatggttgttgctgctgaacgttttgttaaagctaatcctgaccatccaggccgcctcgctttcctgattacttcagatgaagaagccagcgcgacaaatggcacagtcaaggtggtcgaaactttaatatcacgccatgaacgcctggattactgtctggtaggagaaccttccagccagcaacgtctgggtgacataattaaaaatgggcgtcggggttccctgacagccagtttgactatccacggtattcaaggacatgttgcctatccacagctggcagataaccctattcaccgttcactgccttttctacaagaactgatcaatagccaatgggacaatggcaatgaatttttccccgcaaccagtatgcagatcgccaatattcaagcgggaactggcagcaataacgtcataccgggtaaattgtgggttcaatttaatttccgtttcagtactgagttgacagataccgagatccgccagcgggttgaagagatgctgaaaaaacataatctgaaatatgacattgactggtggctatccggccagcctttcttgacctgcaaaggtgaacttgtcgatgccgtggttgaatccattgaacagtgttgcggatataagccagagatatcaacgagtggcggcacatcggatgggcgttttattgccaaaatgggagcgcaggttgtggaattagggcctatcaacgccactatccataaagttaatgaaggtatcagcgtgtcagatttacagaaattgagcctgatttaccaacgtatcatggagcaattaatcaaatga

SEQ ID NO: 3195 - DNA, 675 bp, Xenorhabdus bovienii
  Coding DNA location: Contig name=SeqID_16888; Position on contig =129071..129745bp; Strand=+
atgatgacgcctgaaatgttgacaggtctgtcaacagatcacttggtgacattagcgggtaatcaccgtttacagttcaatgccactaaagcgtttcttgctatgcaaagagatgcagccaaggcaggttttaaattacagcccgccagttcatttcgtgatttcgcgcgccagcaaactatctggaatgaaaaatttcggggacaacgtccggtattggatgacaatagccagcccctcgatattacaaaaatgaccgaaggagagatttgtgaagctatcctccgctggtctgctctgcccggcgccagccgtcatcactggggtactgaactggatatttatgacccattccttctgccacaaggtaagaaattgttactggaaccatgggaatatgaaaacggcggctattttgaaccactatcagactggctgactgaaaatatgtctgtttacgatttttatcgcccattcaaccgacataacagtggtgtagcatatgaaccgtggcatatcagtttttggccgctgtctcatgaagcagaaaatttgttcaatgagcaagtgctgctaaatgtctggcaggatcacaatattgctggtattgattggttatcagccaacctctcctctctttttgaaaagtatgtcaagatagctgagccggattaa

SEQ ID NO: 3196 - DNA, 195 bp, Xenorhabdus bovienii
  Coding DNA location: Contig name=SeqID_16888; Position on contig =129794..129988bp; Strand=+
atgcactggttgatggattattggtgggttattctgctactactcgtcggtattattgttaatgcaataaaagagttgagccgcgtcgatacgaagcgctttttagataacaaaccagaattaccccctcaccgagattttaatgataaatgggatgatgaggacgattgttcccagaaacaccgcaagaaatag

SEQ ID NO: 3197 - DNA, 2160 bp, Xenorhabdus bovienii
  Coding DNA location: Contig name=SeqID_16888; Position on contig =129933..132092bp; Strand=-
atgaccgtgttagattcgatctggaaaaagttgcaggaacaaatgcagcagcaagggcagcgccgcttggtggttttaagtggtgatgtccagtggagcgagcagattgttattcatctgaaaaaacagtttcagggggattgggtaaccgtcgcatctggagacgaggatgcgattgagccagcaaaagcgtttagtttgcttgggcgcgaatttatgcatggggtttttgatgtaacccgtggttttaatgccgaagcgctggcgattctggctggtacgctaaaagccggaagctggctggtgatgcgtgtaccaacttggtcacaatggccagcacagccagatgaagacagttcgcgttggaacgagtcggctggcgtgatctctacgcctcattttatccaacatattcaacagcaaatccttgagcttcccaatatcctgttatggcaacagggaaaaccctttcagccagtgcaattatcacaaaccgtaccgtggcagatgcctgatggtaatcctactgccagccagcaggctattcttgaacaattactacgggcttcacagggggtttgggtggtcactgcgccccgaggacgcggaaaatctgccctggccggaatgctcatacagcaatggcaggggaagtgttggctctgtgcacctgcaaaaatcacgacagaagttattcgacattattccgggacttccgatcctgagcaggattctcctgttgataaaaccccattctgggcagtagacaatttattgaaatattgtcgattgaaaaacaatcgagaaggtcacgatattgatgctgattggcttctgattgacgaagctgcggcgatcccaaccccgcaattagccgaattaatccgatattttccacgagtgttattaacgacaacggtgcagggctatgaaggaaccggacgtggatttttgctgaagttgtgtgccacattgcctgattgccatgttagagaattggaaacaccgatgcgttgggctgaaaatgatccactggaaacatggttagatagctcactgttattcgacgacaaacggttatttaacgaaaaatcgttgccggatgagccattggtttattccgagcctgagaaaaatttgcacttttatcccatcactcaggcaatgtggttgcgacaacctgaattactgcgtcagttttatggattgttgaccagtgctcattaccgcacatcccctcttgatttgcgccgtttgctggatggtaacggaatgacttttctggccgctatatctcgttccgctgtgaataatcaacaattgatcggtgcgttatggatggtaagtgaaggcgagttgccacagacattggcgcatgaagtgtgggcagggcgtcgccgtccaagggggaatctggtggctcagtctttggcagcacatggtggctttccacaggctgcgacgatgcgttcacagcgtgtcagtcgtattgctgtgcaggcacaatatcgccgccgtggcattgcacagcgcttagttactcaacagtgtcaagaagcccgtgcacaaaagcaggattttctttctgtcagttttggttataccgctgaactttggtcactctggcaaacatgtggctttcgattggtgcggatggggacccatcttgaagcgagcagtggttgctataccgcgatggctattttgccactgagtgagaagggcaaatggctggctgagtccgcgcaacagcaattatgtcgtgatgcatactggctggaattactgatcggtttttccttacctatttatcatcatggtgataaccagctcagtgatagcgactggcaggaactggcgggttttgcattcgctcatcgtcccctgtctgcgtcttattttgcgttacagcggttattattggcacatgatctggctttgccagcattgagaaaatatcttcaacaacagatagatattgaacagtgcgcacgcgatttatccctgagcggacgtaaggcgttgttgaaacgttgtcgggaagaaactgcaggagcattggcaagcattgatgagatacttgccaatcagtggaaaaattggactatttcttgcggtgtttctgggaacaatcgtcctcatcatcccatttatcattaa

SEQ ID NO: 3198 - DNA, 453 bp, Xenorhabdus bovienii
  Coding DNA location: Contig name=SeqID_16888; Position on contig =132089..132541bp; Strand=-
atgaactatattgaccctactttacttattttgttagtgctggcaggccttggcattatcagccataacatgacagtaacgcttgctatgttgtttttgctgatagtccgcattacaccactgaatcaatttttcccttgggtggaaaaatatggtttgacgataggtatcctgattctcaccatcggagttatggcacctatagcaagtggaaaaatttctgcgcaggacatattcagttcatttttgaactggaaatcactgctcgctatcgctgtcggtattatcgtatcgtggctgggaagccgaggtgttgccttgatgtcgagtcagccttctacagtggcggggttattggtcggtactgtattgggtgtagcgttgttcaagggcgttcccgtcggcccgctgattgcagcgggtattttatctatcatgattggtaaaccatga

SEQ ID NO: 3199 - DNA, 156 bp, Xenorhabdus bovienii
  Coding DNA location: Contig name=SeqID_16888; Position on contig =132679..132834bp; Strand=+
atggccacattagtagaaaaaacagtctgtaagaaaaaatacataagattcccccttccctattatttaacaataactttaatttatagttacatttatttatttgattatgaaaaaattaatattctcaatcatattcaatatgttattaactga

SEQ ID NO: 3200 - DNA, 117 bp, Xenorhabdus bovienii
  Coding DNA location: Contig name=SeqID_16888; Position on contig =133236..133352bp; Strand=-
atgggaaagggttatcttaaagcactttctgaaactattggatattcaggagagggatcctattaccgttacaaaatggtgatttggattaatgtattaaatgattatttaaactaa

SEQ ID NO: 3201 - DNA, 231 bp, Xenorhabdus bovienii
  Coding DNA location: Contig name=SeqID_16888; Position on contig =133490..133720bp; Strand=+
gtgacgatttatttgttggttcagcatcaagctacattaaccatacgacacaaacatacattaagacttttaacagggaaaatgcagaaaggttgtaaggaaagccttacaaacgggatgcattcgtatgaaagatatgaaaaaaacactcttctcaatcatgttcagtgtggcattaactggttgcaccactcaatgggtgccggtaggaagtcactataccccttttaa

SEQ ID NO: 3202 - DNA, 381 bp, Xenorhabdus bovienii
  Coding DNA location: Contig name=SeqID_16888; Position on contig =133617..133997bp; Strand=+
atgaaagatatgaaaaaaacactcttctcaatcatgttcagtgtggcattaactggttgcaccactcaatgggtgccggtaggaagtcactataccccttttaatgaagcgaacgcagagtgcaatatagaagcactccagcagttccctgtgagaaacgaagttgcccaacggtcttcaatcaaaaccgtaaaacattactgtcctgcctgttgtaaatctgacaaagctgataaatctgacaaagactgttatttcgatcagagtgtccctacgaccgaaagttatgttatggatgttaacgaacgctccagacatcaattatatagcagctgtatggaacgaaatggttgggaagaacagacaaaatatctgttttaa

SEQ ID NO: 3203 - DNA, 114 bp, Xenorhabdus bovienii
  Coding DNA location: Contig name=SeqID_16888; Position on contig =134045..134158bp; Strand=+
ttggctatcctgaatattccctattaccacacctctttttcacatttatcaaataaatatccccgtcatcacgatcaaagatacccccactattttagtgtaggatatctctga

SEQ ID NO: 3204 - DNA, 714 bp, Xenorhabdus bovienii
  Coding DNA location: Contig name=SeqID_16888; Position on contig =134187..134900bp; Strand=-
atgcagaaaaaagctgagttgtatcgtggaaaggcaaaaacagtgtattccactgacaaccctgacctgcttgtgctggaattccgtaatgatacatcagccttggatggtgaacgcatcgaacagtttgatcgcaagggtatggtgaataataaattcaaccatttcattatgaacaaactggaagaggcgggtattccgacgcaaatggaacggctgctgtcagataacgaatgcctggtgaaaaaactggatatggtgccggttgagtgtgttatccgcaaccgtgctgcgggttctcttgtgaagcgccttggtgtggaagaaggaatggtattgaatccccccctgtttgatctgtttttgaaaaatgatgccaagcatgatccgatggtcaatgagtcttactgtgaaacattcggctgggttagcaaggtgcatctggccgagatgaaacgactgagttacaaagccaacgaagtattgagtaaactgttcaatgatgctggtttgattctggtggatttcaaattagagtttggtttgttcaacggcaacgtcgtattgggggatgagttttctccggacggtagtcgcctgtgggatcagcagactttggataaaatggataaagaccgttttcgccagagtcttggtggcttgattgaagcgtatgaagaagtagcacgccgaatcggggttattttggactaa

SEQ ID NO: 3205 - DNA, 1047 bp, Xenorhabdus bovienii
  Coding DNA location: Contig name=SeqID_16888; Position on contig =134992..136038bp; Strand=-
atggcaacattattgcaaaaatcgaaggtcatgaaggttgctggcctgtcattagtcgttttgctggcagcctgttccaaagatcagcactataaacgtcaggtgagtggggatgagtcctatcttgagacgccaccgctgaaagcattgaacgttccagcaggaatgatattgccgccgcaaaatagtgaatatactatttcatcagcgaccgaaaaaggggcggtgggtaaatcccttgatattcgtccgccagtacaggcgatgcagttattggcgggttcccacatgggaaataatgtgcgaaccggtaagttgttgattgaaaatacgccagaacacagcaatctgtggtcacaagtggttagtctattggcgaagaagaattaccagattagcgaaaaagatgataccaagcaaactctggtcactgattggatctcatggtcgcgggcagatgaaaatattccttatcgtggacgctaccgtattgaagtgtctccgcagggttctcaaattgctctgtctgttacaaatgaaagtttggaacatgatgggaaagtcgtctctgatccggcaataatccaagattatgatttaatcatgcttaacgagctgtctgatggtttaaatcagcagcaggagttagcaagtttgaacagcacgaagaatacaggggcgttagtagtaaacagtggcagcgataatacagctttgccacaaatcattgtccgtgcgccatacactgtggtctggaaccgattaccgcatacgttggaaagtataggcatgcgtgtcactgatcgtacgcgtgcgacgggaatgatagaggtgacttataaagagctgagttcttcaggctggaaagaactgggcgtcgaggctccttccatcagcgaaggaaattacaagttacaggtgggcgacttggataaccgaagcagcctgcaatttatcaaagagaaaggccagccgctgactcaggctgaaaatgatcaaatgatggctgtatttaaggcagcattcagcagaactacagacaagtaa

SEQ ID NO: 3206 - DNA, 900 bp, Xenorhabdus bovienii
  Coding DNA location: Contig name=SeqID_16888; Position on contig =136055..136954bp; Strand=-
atggtgagtggtaactctggttttacgggcagtatggttgcaatggtaacgccaatgaattcagacggtcagattgataaaaccagtttgaaaaaattaattgattatcatatcgccagtggtacatcttcaattgtttctgttgggacaacgggtgaatgtgcaacactcagccaagatgaacatgtggatgtcgtactgacaacactggaattggctgatggccgcattccggtgattgccggaacaggggcaaatgcgacggcagaagccatttcgctgactcgtcgttttgaaaatacgggtattgctggttgcctgtctgtgacaccttattataatagaccatcacaggaaggtttatatcagcattataaagcgatagctgacaatactgacttaccacaaattctgtataatgtaccctctcggaccgcatgtgatttactgccatcgactgttgcccgtctggcaaaactggaaaatattgttgcgattaaggaagcgactgggaacttaagtcgtgtcagtcagatccaagaattggttaatgatgaaaatttcattttgctgagtggtgatgatgcaagttttcttgattttgtgcagcttggtggaaaaggggttatttctgtgacggcgaatgtagcggctgcggagatggcacaaatatacgaactggctcagaagggtgaatttgtgaaggcgcgtagcctgaacaaccgactgatggaattgcatcatcaattatttgttgaacctagcccgacgccagccaagtgggcctgtcgtaaactgggattgattgccgatgacacgctgcgcctgccaatgattccgttgacgcaggcaggacaagtttcggttaataatgccttgaaattggctggattactgtaa

SEQ ID NO: 3207 - DNA, 558 bp, Xenorhabdus bovienii
  Coding DNA location: Contig name=SeqID_16888; Position on contig =137197..137754bp; Strand=+
ttgcccaaatcagaacagtattttttagtgatcaccgcccttggtgcagatcgccccggcatcgtcaataccattacccgccttgccagtgtatgcggctgtaatattgaagacagccgtctggcaatgtttggcgaagagtttacctttatcatgctgctatccggtagctggaacgccattaccctgatcgaatccactctgccacagaaaggggcagaactcgaattgcttattgtgatgaaacggactcggtgcggtgtccagacaaaatttccttcgacaatttccgtcagagtggatgtggatgattcaccgggtattgttgaacgttttaccaatctgttcacgacccagaatttcaatattgctgaactggcatcaaaaacccatcccgctgaggaaaatatgcccgcccgtctgcaaatctacattacaggccataacccactggatgataatggcctcatattcaaagaatccttttatcgcctatgtacagaattaaatgcacaaggcagtattagcgtactggatcatttaaataaaaacgattaa

SEQ ID NO: 3208 - DNA, 474 bp, Xenorhabdus bovienii
  Coding DNA location: Contig name=SeqID_16888; Position on contig =137769..138242bp; Strand=+
atgagccgattgaaagccggtgataaagccccaaaattcagtcttcctgaccaagatggcgaaaccgttagcgtatctgacttcaaaggtcagcgtgttttagtttatttttatcccaaagcgatgacgccaggctgcactgttcaggcttgtggcttgcgtgacaagatgaatgaactgaaagaaattggtgttgaagtgttgggtatcagtacagatacacctgaaaggttatctcgttttgcagaaaaagagaggctgaatttcacacttctttctgacgttgaccatcaagttgccgagcaatttggtgtttggggagaaaaacagtttatgggaaaaacctatgatggccttcaccgcatcagtttcttagttgacccaaaaggtgatattgaacacgtttttgataaattcaaaaccagtaaccatcaccaaatcgtactggactacctgaaacaacattcatcataa

SEQ ID NO: 3209 - DNA, 1065 bp, Xenorhabdus bovienii
  Coding DNA location: Contig name=SeqID_16888; Position on contig =138326..139390bp; Strand=-
atgctggatatgatcatgcgatggtatcatcgccgtttcgcagatccgcaggttgctgcactatcggtaattttgttggttgggtttggcgtcatttattttttcaatggcatcctggctcctgttcttgccgcaattgtgctggcttatctactggaatggcctacagtaaaactggaaaaactgggttgtagccgaactctttcagtgaccattgtattgacaatttttatggggataagtgcgctggttatcctgatcgttgctcccactgtctggcaacagggattaaatctgttttctgacttacccaatatgttcaatcgctttaatgaatatgcacacactttaacctcccgttatcctgctttggtcgatgccggtatcattgaaatgattgccgataatctgcgtactaagcttcctctggccggtgagtcttttttaaagatttcagtggcgtccgtgattggtttactgacgctcgcgatttatctgatcctagttcctttgatggtgtttttcctgctgaaagataaaagccagatggttgcagcattacagagtgtgttgccacgtaatcacggtttagcgggtaaactatggcatgaaatgaatcaacagatcgtcaactatattcgtggaaaagtcacggagatggttattctgactatttgtacttatgcggtgtttgctttctttggattacgttattctctgctgcttgcggtatttgttggtttgtctgtactcatcccttatatcggcacggtgattgtcacaattcctgtcattattgtggcactgtttcaatgggggcttggtactgatttctggacactgtttattgcctatctggttgtgcaggggctggatggtaatctccttgtacctatcttgttctcagaggcggtgaacttacacccactcgtgatcattctttctgtcattatttttggcggattctgggggttatggggcgtctttttcgccattccactggcaactttgatcaaggctattattcgtgtttggtctgaagaaaaaatcgtaggatcagaataa

SEQ ID NO: 3210 - DNA, 117 bp, Xenorhabdus bovienii
  Coding DNA location: Contig name=SeqID_16888; Position on contig =139465..139581bp; Strand=+
atgatttgctatcatacacacattcataatttaataactaactgggacacattgtttttacgagaatcattttatgataaaaacacccaagaaatccctgatagtgacattgattag

SEQ ID NO: 3211 - DNA, 1470 bp, Xenorhabdus bovienii
  Coding DNA location: Contig name=SeqID_16888; Position on contig =139538..141007bp; Strand=+
atgataaaaacacccaagaaatccctgatagtgacattgattagcctattactatttggaaattcacccgctttatctgtaagttccgaaaattcactacccgatatcggaacaagtgcgggggcgactctcagtatcaaccaagaaatagaaatgggggatttttttatacgtcagatacgtgctggagcgccgctaattgatgaccccctgcttaatcaatacattaataaattaggccataaattagttaatcatgccgattcagtaaaaacgccttttcaattttatctgatcaataaccccgctattaacgcgtacgctgttttcggtggtaacgtagtgctacattccggtttattccgctatagccgcaatgagagtgagttggcttctgtcatggctcatgaaatctcccatgtaacacaacgccacttggctcgttttatggaagatacgcagcgcaaagcgccattcgcatgggcaggaatattaggatccatactgttgatgatggccaatccacaagcaggaatggcgacactcagcggcacactgggtggttttcagcaaggtattatcagctttacccagtcaaatgaacaggaagctgatcgcattggtatgcagattctcaacaactcaggttttaaccctcatggtatgcctgatttcatgcagattctggttgatcagacgcgatatagctctaaaccgccagaaatgttattaacccatccactacccgatagccgtttatccgatgctcgtaacagggcaaatcagtatccgaaaaaaaccattccagaatcagaatctcaagattttctgtttgcccgtgttcgcatcctgacaatcagcgctacagatcagctcaattacattgaacaaattctgaataattacagtcagggaaccgctaaagaacagctcgccgcttcttatggacgggttctccttctgtctcaggctcaaaagtatgctgaagccaaaacagtattgtctccattactggataagcagcctgataacatctggtttatcgatgctatgacggatatcgatattgagcaaaaacagtatgagcaagcgattacccgtttacagtatgctctccagaaacatcaaaataacccggtactacaaatcaatcttgccaatgcctatattcaagccaaacactatccgcaagcatcacaactgctatttcgctataccttcaacaatcctaatgatcccactggctggtcactaatgacagaattagccaaaaaacagggaaaacgtgataaagagctggtttcctacgctgagactatggcattgcaaggcaaatttgacatggctataaactatctcagccaagccagttctttggtaacattaaatagtgatgatcaggctcgttatgatgcccgtattgatcaattgcgccaattgcaacaacgttatagccaatatgacaaatga

SEQ ID NO: 3212 - DNA, 372 bp, Xenorhabdus bovienii
  Coding DNA location: Contig name=SeqID_16888; Position on contig =141004..141375bp; Strand=+
atgaggactttttacatgccacaggttattttttatcataaccctcgctgctcaaagagccgtgaaacactcaagctggttgaagatctcggtattgcaccagaaatcattcactatctcgacaccccaccaacggtagagcagcttaccgttttactgaagcaactgggttttaaagatgcccgtcagttaatgcgaaccaaagaagaactttataaggatctcaatcttggtgatgacacattatcccaagcggcattactccaagcaatggcaaaacaccctatattgatagagcgtccgattgttgttgtcggtgataaagctcgtctaggtcgcccaccagaacaagttaaggagattcttggctaa

SEQ ID NO: 3213 - DNA, 708 bp, Xenorhabdus bovienii
  Coding DNA location: Contig name=SeqID_16888; Position on contig =141468..142175bp; Strand=-
gtgcttctgaatacaccgtcgcagctttccttgcccctatatttgcccgatgatgaaatatttgccagtttctttgcaggtgagaatacttccttattagctgcaataaaactggccattagtcagtcacacggcagttatatctatttttggtcccgcgatggcgggggcaagagccatttgcttcatgcatcttgtgccgaattatcccaacagggagaggcggtgggatatgtaccactggataaacgtgcctattttgttcctgaagtccttgatggaatggaacatttatcattagtgtgcattgataatattgaatgtattgcaggcgatcaagaatgggaaatggctatcttcaatctttataaccggattgtagagattggccgcacctgcttattgatcaccggggatcgtcctccacggcaaattaatctgacattgccggatctggcttctcgtctggattgggggcagatttacaaattgcagccactgtctgatgatgaaaagattcaggcattgcaattgcgggcgaaattacggggatttgaattacccgaagatgtagggcgttttgtgttgaaacgactcgatagggaaatgcaaacactgtttagaacgttagatgagcttgaccgtgcttctattgtggcgcagcgcaagctgacaataccatttgtgaaagatattcttgatctctga

SEQ ID NO: 3214 - DNA, 96 bp, Xenorhabdus bovienii
  Coding DNA location: Contig name=SeqID_16888; Position on contig =142166..142261bp; Strand=-
atgcctgttttgaacagcgcatttatttcatttatagtcactttctgtggtagacttagcgctgttcgttatccattctgtttgaggtgcttctga

SEQ ID NO: 3215 - DNA, 1311 bp, Xenorhabdus bovienii
  Coding DNA location: Contig name=SeqID_16888; Position on contig =142866..144176bp; Strand=-
atgacccgccgtactattggggtagatgaaaggccatcactgatacagaccattcccttgagtttacagcacttatttgccatgtttggcgcaactgttttggttcccgtcttatttaaagtgaatcctgccacaattctgctgttcaatggtattggaacattgctgtatctatttatctgtaaagggaaaattccggcttatttaggctccagttttgcatttatttcgccggtacttttgttgttgcctctgggatatgaactggctctgggtgggtttattgtttgtggactgttgttttgtttggtttcgttgattgtcaaaatagcaggacggggttggatcaatgtgatatttccgccagcggcaatgggggcaattgttgctgtcattggtctggaattggcaggggttgcagcagatatggcgggtttgcgcccagccattggagctgaagtcaatacggctaacctgaccatatcgatggtgacgttagccgtgacaattttgggttcggtgatgttccgtggctttatggcgattattccaatcctgattggtgttttagcaggctatgcgctggcgttttttatgggagtagtggattttacacctgtacttgaggcaccgtggtttgcattacctacgttctatacaccgcgttttgaatggtttgccattatgactattttgcccgcggcgctggtcgtgattgcggaacatgttggtcatctggtcgtcacggctaatattgtgcagaaggatttattgaaagatcccggtctgcaccgttcgatgtttgcgaatggtttttcaaccatgatttcgggtttttttggttcgactcccaatacaacttacggtgaaaacattggtgttatggcgattacccgagtgtacagttcgtgggtgattggtggagcagcgatactggccattctgctttcttgtgttggcaaactggctgcggcaattcaggtcattcctgtcccggttatgggcggtgtttccttgttgctgtatggtgtcattggcgcatcaggtattcgggtattgattgattctaaagtcgattatagcaaggcacagaacctgatcctgacctccattattttgattattggtgtcagtggggcgaagatccagattggtacagcagaattgaaaggtatggcactggcaactgtagtaggtattggtttgagcctgattttcaaattgatcagtgttatccgcccagaggagccttatattacttcttctgtggaatcgattgacaatgataaaaaacgtgaagctgtagaataa

SEQ ID NO: 3216 - DNA, 126 bp, Xenorhabdus bovienii
  Coding DNA location: Contig name=SeqID_16888; Position on contig =144124..144249bp; Strand=+
atggtctgtatcagtgatggcctttcatctaccccaatagtacggcgggtcattatttatatcctctatgttaccttgctggaagccaaaaaaaaccgacttttcagtcggctaaatgttatttag

SEQ ID NO: 3217 - DNA, 627 bp, Xenorhabdus bovienii
  Coding DNA location: Contig name=SeqID_16888; Position on contig =144242..144868bp; Strand=-
atgaagatcgttgaagttcaacacccattagttaaacataaactcggcctgatgcgagatcatgatataagcactaagcgttttcgtgaactggcctcagaagtgggtagtcttctgacatatgaagcaactgctgatttagaagtagaaaaagtgaccattgaaggatggtgtggtccggtagagatagaccagattaaagggaagaaaattaccgtggttcctatcctgcgtgccggtttgggcatgatggatggcgtattggaaaatattccaagtgcgcggatcagtgttgtcggggtttatcgtgatgaaaaaactttcgaacctgtgccttattttcagaaactggtttctgatattagtgagcgcatggctttggttgttgatccgatgttggcgaccggcggttctatgattgctacgattgatctgctgaaaaaggcaggatgccctgtgattaaggtattggttttggttgccgcaccagaaggggttgccgcactggagaaggcccacccggatgtcgagctatatactgcctcaattgacgaatgtctgaatgagcatggatatattgttcctggcctgggggatgcgggcgataagatattcggtactaaataa

SEQ ID NO: 3218 - DNA, 135 bp, Xenorhabdus bovienii
  Coding DNA location: Contig name=SeqID_16888; Position on contig =144878..145012bp; Strand=-
atgcaggtttcctgccagacaaaaataaaaggaaaaatgcttatgcttgataaaaatcaatggattgatagtggctcggtgtcgaaaaggaggtataatcccgcgatttttttatctgccggctatatacagtag

SEQ ID NO: 3219 - DNA, 1086 bp, Xenorhabdus bovienii
  Coding DNA location: Contig name=SeqID_16888; Position on contig =145076..146161bp; Strand=+
atgcaaccgcctgggggctacgcagtgaccaacaaaacctctcttagctataaagatgctggtgtcgatattgatgctggcaataccttagtcaatcgtatcaaaggtgtcgtgaaacagacccgtcgccctgaagtgatggggggattaggcggtttcggggcgctatgtgcgctgccacagaaatatcgtgaacctatcttagtttcaggtacagatggcgttggcaccaagctgcgtttggctatggatctgaaacgccacgataccatcggagttgatttggtcgccatgtgtgtcaatgatctggttgttcagggagccgaaccacttttcttccttgattactatgcaacaggcaaactggatgttgataccgcagccagtgtcattactggtattgccgaaggttgcaaacagtctggctgtgccctggtcggtggtgaaaccgccgagatgccgggtatgtatcatggcgaagattacgatgtggcggggttttgtgtcggcgtggtcgaaaaatcagagatcattgatggcagccaagttcaagtgggtgatgcgctaattgcactggcatccagtgggccacattccaatggttattcattgatccgtaaaatccttgacgtcagccagaccaatccggaaacaacagagcttgaaggcaaatcgctggcagatcatttgctcgtcccaacccgaatttatgtcaagcctgttcttgaactgattgaacagttcgagatccacgccattgcccatctgactggtggcggcttctgggaaaatatcccccgcgttctaccggaaaatatgcaggccaaaatcaatgcctccagttggcaatggccagctatctttacgtggttgcagcaggcaggcaatgtcagcaatcacgagatgtatcgcacatttaactgtggagtaggcatgatcatcgctctgccacaatctcagacaaaacaagcggttgagtggctgaacgcgacaggtgaaaacgcttggcagattggtactattaccgaatttgacaccaatactgaactgaacaccaacgagcaacaagttatcatcagcgaatga

SEQ ID NO: 3220 - DNA, 639 bp, Xenorhabdus bovienii
  Coding DNA location: Contig name=SeqID_16888; Position on contig =146167..146805bp; Strand=+
atgaaaaaaattgtcgttttggtttccggcaatggcagcaatcttcaatccattatagacgccagccagcaaaaccggattaatgggcatatctgtgcggtattcagtaataacgccaatgcctatggcctgcaacgtgcagaacaagcgggtatccccgcccattttctcaatccacaagcgttcccggatcgcactgcttatgattgcgccctgctcacagccattgatcaatatcagccagatttagtagttttagcgggctacatgagaatactatcgcctgattttgtgcagcactactgtggacgtatgctcaatatacatccttctctgctgcccaaataccccggtctgcatactcaccgcaaagccattgaaaatggcgatcaagaacatggcacttccgtccattttgttaccgaagagcttgatggcggccccgttattttacaggccaaagtaccgatttttgaggaagatcaggaagaggatgttatcaggagagttcaggctcaagagcatgatatctatccgctggtgattggctggttcttagatgggcgcctgagcatgagcgataatatagcaatactggatggcaaaacactgccacagcagggttacgcctcagaataa

SEQ ID NO: 3221 - DNA, 108 bp, Xenorhabdus bovienii
  Coding DNA location: Contig name=SeqID_16888; Position on contig =146790..146897bp; Strand=-
atgctcactcaccccggtcacatagttagctatgctcctggggattcgttcccttgccgccgcactgcaactcgaaatccattcggtatagattattctgaggcgtaa

SEQ ID NO: 3222 - DNA, 564 bp, Xenorhabdus bovienii
  Coding DNA location: Contig name=SeqID_16888; Position on contig =147208..147771bp; Strand=+
atgtccagtggttctgaaaatccacctgtaaatttacgtcctcttgagcgggaagatctccctttcgctcaccaaatcgataacaacgccagtgtcatgcgttattggtttgaagaaccctatgaagcttttgtcgagctatgtgatctctatgacaaacatatccatgaccaaagcgaacgccgttttatcattgagagcatgaacgccaaagtcggattagtggaattggtcgaaattgattatattcaccgacgcgcagaattccagattattattacaccagcctatcaggggcaaggctatgcaaccaaagcggctaaacttgcgatggaatacgcattttgtgtattaaatctctataaactttatttaattgttgataaagagaatgaaaaagcgattcatatatacaacaaattagggttccataccgaaggcgaattaatcgatgaattttttgtaaacggctcttatcatactgccattcggatgtgtactttccagcaccactattttgccaataaagcccgtgaatcccagaccagctcgctggcccattaa

SEQ ID NO: 3223 - DNA, 2070 bp, Xenorhabdus bovienii
  Coding DNA location: Contig name=SeqID_16888; Position on contig =147788..149857bp; Strand=+
atgtcccacgaccgcctctataacgaaaaagaactcagttggctctctttcaatgaacgtgtacttcaggaagcggctgacaaaagcaatccacttattgaaagaatgaggtttttagggatctactccaataatctggatgagttttataaagttcgctttgccgatgtaaaacggcgcattcttatcagtgaagagcgagggtctgccaccagcggccgccaattattgaaaaaaattcaggccaaagtcgtaaaaatcgatcaagagttcgatgaactctataacgatttactgctggaaatggcccgtaatcagattttcctgattaatgagcgacaaatatcccccaatcagcaaatttggttgcggcaatatttccgccagcatttacgcccacacattacacctatcgtcatcaatccagaaaccaatctggttgagtttttgaaagatgattacacctatttggccgttgaaattattcgtgggcaagagacgaaatatgccttgctggaaattccctcagacaaagtaccccgtttcgtcaatttgcctccagaaatgccacgcagacgcaaatcgatgatcttgcttgataatattctgcgctatacgttggacgaaattttcaaaggttttttcgattacgatacgctgaatgtttattcgatgaaaatgacccgtgattccgaatatgatctggcaacagagatggaatccagtctgttggaactgatgtcttcaaccctgaaacagcggttgaccgccgaacctgtccggtttgtttatcagcgtgatatgcctgatgaaatggtagatctactgcgcagtaaactggggctatccaatgatgactctgtgattgccggtggccgctatcacaatttcaaagacttcatcaaatttcccaatgaagggaaccgaaatctgctgaacaaaacgatgccacggctacgccatacttggtttgagcattttcgtaacggttttgatgccatccgtgagcaggatgttctgctctattatccttatcacaccttcgagcatgtgctggaattgctgcgtcaggcatcgttcgaccccagcgtgttgtctatcaagatcaatatttatcgcgtggcaaaagattcacgcattattgattcagtgatccatgccgcccacaacggcaaaaaagtgactgtggtggttgaattacaagcccgttttgatgaagaagccaatatccactgggcgaagcgactgactgaggcgggtgtacacgttattttctccgcaccaggcctgaaaattcacgccaagttatttgttatctcacgtcttgaaggggatgaaattgtccgttatgcccatattggaaccggaaatttcaatgaaaaaacggctcgttcatacactgattattccttgctgactgccaagccggaagtcaccaacgaagttcgccgtgtatttaactttattgaaaatccttatcgcccagtcacatttgagaatctgatggtatcaccgcaaaattcgcgcgctatgctcaatcaactgattactcaggaaattgaaaatgccaaagcaggggaagcggcgggcatcactctgaaaatcaacaatcttgtggacaaggaattggtggatcgcttgtatgatgcctcagaagcgggagtcaaagtgcgtcttctgatacggggaatgtgctctctagtgccaaatcaagcgggcttcagtgaaaatatacaagtcaccagcattgtggatcgctttcttgaacacgatcgagtttatgttttcactaacaaaggggatgagaaggttttcctttcttcggctgactggatgacccgcaatatcgattatcgtattgaggtcgcagtttgtctgctcgatcctcaattaaaacagcgggttttggatattctggaattacagttcagtgatacagttaaagctcgctatatcgataaagagttaagcaatcgctatgttccacgcggaaataagcgtaaaattcgcgcacaaattgccgtctatgattacttgaagacattggaacaaccggagccaagagcctga

SEQ ID NO: 3224 - DNA, 1497 bp, Xenorhabdus bovienii
  Coding DNA location: Contig name=SeqID_16888; Position on contig =149897..151393bp; Strand=+
atggaaattgccaccattgatctgggctctaatagctttcacatggtgatcgcccgtattgtgaatggcgcactacaggtgatcgggcgtttaaagaaacgggttcacctcgctgatggcctcaacaataaaaatgaattaagtgaagaagctatcaatcggggccttgcctgcctttctctgtttgcagaacggttgcagggtttttccgcgaataatgtctgtctcgtaggtactcacagcctgcgtgaagccaccaacacacaagagtttctaaaacgggcgaaagaagtcatcccctatcccattgaaatcatttccggtcatgaagaagcccgcctgatcttcatgggggttgagcatactcagccggaaaaaggccgcaagctggtgatcgatatcggtggtggttctacagaactggtgattggtgaaaatttcgaaccgctgttaattgaaagccgtcgcatgggctgtgttagtttttctcgtcaattctttcctgacaacataataaacgaacaaaatttccgtagggcacggcttcaggctgcacaaaagttagaaaacctcgtttggcaattccgggtgaaaggctgggattttgccttgggagcatcaggaaccatcaaagcagtacatgaattactcgtcggactaggtgaaaaagatggtctgattacacctgagcgtctcaatatgctggtaaagcgggttctgaaatacaagaatttcaaatcactggatctgcctggtttatccgaagatcgtaaacaaacttttgtttccggcctggctatcctgtgtggtgtgttcgatgtcctgcatattcaagaactgcgcttatctgacggggcactgcgtgaaggcgtactttacgagatggaagatcgtttccgtcatcaggatattcgccaaagaaccgccaaaagccttgctgaccattataatattgatagagaacaagccgatcgcgtctggagtactgccaagacactttacggacaatgggcgacgcagaatccgaaacggctccagccacaactggaatcaattctgctttgggcggcaatgctgcatgaagtcggtttaagtatcaacctgaatgggctacaacggcattccgcctacatcctgcaacacaccgatctgccgggctttaaccaagaacagcaatcattgctggcaacattggtacgctatcatcgcaaggccattaaagtacatgagcatccccgcttttacctgttcaagaaaaaacaatatcttccgatgctccagatattacggctggcaacactgctcaacaaccagcgccaatccaccacaacacccgaatcgcttaggctggacacctctcatggtcactggacgctctacctgccacaaaactatttaacccaaaatgccctgatgcagcttgatttggaaaaagagcaggcttactggagtgatgtgattggctggtacttgcatatcaaagaggaatcgacgtaa

SEQ ID NO: 3225 - DNA, 165 bp, Xenorhabdus bovienii
  Coding DNA location: Contig name=SeqID_16888; Position on contig =151406..151570bp; Strand=+
atgaagaagaaaaagaataccgttcagattacaacattaattctgctgatcagttttctgattttatttgggcgctttatctattcatccatcgcagcattggaacatcaccggcaaaagcaacaacattcgatggagcatattaggaatactaaaacaaaatag

SEQ ID NO: 3226 - DNA, 1464 bp, Xenorhabdus bovienii
  Coding DNA location: Contig name=SeqID_16888; Position on contig =151670..153133bp; Strand=+
atgttacaatcggcctttaaatctggtaattcaactgttgccagtcaacattcccaaaagctggcagttgttcgccaacgtctgctgtctctttttattaacgataaattattcgttgatacgttattgggtcaggctgatgaacattcaacaatcagcgacgagcagttgctggagaaaattgaggaagtcagtgcgcagctgaccgatctgcacgctgccgacattgcagatattctggaggccctgccctacgatgaacgtcttgctttatggcgactcatcgataataaccagcgcggtgaggttttagtggaagcctccattccggtctgggacaatttgatcaaggatatgtctgaccttgaactattgaaagccatcggcacgctgcatgtggatgagcaggcttatattgcggaatatctaccccgtgatactacacgccgtttactgacttatctggaaccgagtcaacgcaaccgtattcgcgaagtattgcagtaccacaaagacagcatcggccagatgatggattttgaatttgtgacagtgcgaggcaacatcacactcagtacagtacaacgtttcctgcgttccagaggctccattcccgacgcaacggataaaatttttgttattgaccgcaaaaaccgccttcagggggaactcccactcacaactttgctaatcaatgccccggacaagttggttgcagaagtgatgaatacagatactgtcaccttcttaccagagcaaaagggcgaagatgccgccagtgcgttcgaacgttacgatttaatctctgctgcagtggtagataataacgggcgcctgatggggcgtctgaccgttgaggatatcattgataccttaagtgaagaaacagacaccaatatccgacgcatggggggattaagccgtgaagaagatgtgttcgcccctgttgggcagacagtaaaaacccgctgggcatggctcgccattaacttgtgcaccgcttttgttgcttcgcgggtgattggcttgtttgaacataccatttcccaactggttgcccttgcgacattaatgcccattgtcgcgggtatcggaggcaacacaggcaaccagaccattaccatgatcgtccgggcgttggcactccaccaaatccaatccggcagtttttcttatctgttattgagggagttcggtgttgctctgattaacggcgttatctggggtggaatcatgggcgttgtcacctatctactctatggcgatcttgcgatgggcggcgtgatgacaatggcaatgatattaaatctgctgatggcagctctaatgggcgtattgattccatttattatgatgaaactggggcgagatccggccattggttccagtgtgatgatcacggcaatgaccgatactggcggattctttatctttttgggattggcaacgctgtttttggtttga

SEQ ID NO: 3227 - DNA, 234 bp, Xenorhabdus bovienii
  Coding DNA location: Contig name=SeqID_16888; Position on contig =153137..153370bp; Strand=-
atggtggagaaaatatggaagttatggcaattattgaattatcgccaaactatccgcacagtattacccatgcggaagtgcagccagaagaaattgtttctattaaatataaagacattatttgtcgtcaccatatggcagggacatctggatatagtgtttgggacgaaagggtttattaatagtttgagaaaaaacgccgatatcatttataaatcggcgtttctcccataa

SEQ ID NO: 3228 - DNA, 1242 bp, Xenorhabdus bovienii
  Coding DNA location: Contig name=SeqID_16888; Position on contig =153478..154719bp; Strand=+
atgaagaataaacgtcgtacttattttttccgatttgcggtactagccgttgtcatcgcagccgcttatttcgcgtggaactatttcaaaacgcccacaatatcagaagaaaaatcggctcaggcatcaaaatctccgcgaaatttaagacattcgccacaaccgcctgtgcaagtagcaacagccaaaatacaaactgtaccccattatttaggaggactaggtactgttcaggcggccaataccgtgactgtcaccagccttgttgctggccaattaaccgccttgcattttgatgagggtcagttcgtcaagcaaggcgatttattagcagaactcgatccccgttcctttcaaattcaactggcaaagacacaaggccaatatgccagagatcaggcaacactggccaatgcccgacaggatttagcccgctatcagcaattagcaaaaaacaactcaatctcccaacaggatctagataagcaaatatctgctgtgcgccagtatgaagctctcctgaaagctgatcagtcaggtattgatgacgcgaaactgcaattgacttacagccggattacagcccctatttccggccgtgttggtctgaaaaagattgatgttggcaattacatatctgccggtggaggaactccactcgtgatcatcacacaggtcgatccgattgatgtgttgtttgccctgccggaaaacgatattagcacggtattgaaagcacaggaaaacaataaggatgttgtcgttaccgcttgggatcgcaataaccagcagcaattggcacaaggtaaattactcagtatcgataacctgattgatgtgactactggcacgattaagataaaggcgcgattcgataaccaaaacaacgtgctgtttcccaatcaatttgtcaatattcagattaaggttaatacactggaaaatgccatcgttatcccgaatgccgcactacagatgagtaatgaggggcattatgtctggaaggtggataaagaaaacaaagtcaacaagcataaagtcacaatcgggttacaaaatgctcagttggtagtcatcagcaaaggtctggcaacaggtgatcgagtcgttacggatggtactgaccaattaaccgaaggtactggcatcaatattgtcaaaccactgaaatcagaatccgccaatactcacgatcatacgggtaaatcaaagccatcaaacagtaaggtggagaatacttaa

SEQ ID NO: 3229 - DNA, 3171 bp, Xenorhabdus bovienii
  Coding DNA location: Contig name=SeqID_16888; Position on contig =154719..157889bp; Strand=+
atgcattctgattctccaatgactggcggtggtccatctcgcctgtttattctacgccctgttgctaccacgctgtttatgatggcaatactactggcagggatcatcggctaccggatgctgccagtttccgctttacctcaagtggattaccctactattcaggtggtgactctctaccccggagcgagtcccgatatcatgacgtctgtcgtcaccgccccgctagaacgccaattcgggaagatgtccggcctgaaacagatgacgtcacaaagttctgggggcgcctccattataacactggtgttccagctctcgttgccattagatgtcgctgagcaggatgtacaggcagcgattaatgcagcgacgaatctattaccccatgacctaccttatccgccaatttatagcaaggtcaatccggctgatcctcctatcttgacgttggccgttacttctgatgccctgccgatgactcaggtacaggatatggtggagacccgtattgcccagcgtatttctcaagtcggaggcgttggcttggtgacactggctggtgggcagcgtccggctgtgcgcgtgaagtttaatgcacaggccatcgccgcacagggattaaacagcgaagccattcgtaccacaataatgaatgcgaatgtgagttcagcgaaaggcagttttgatggcccgactcgctcagtgacgttaaccaccaacgatcaaatgaaatccatcgacgaataccgcaatttgatcgtggcctataaaaatggtgctcctattcgtctacgtgatgtcgcgactattgaacgaggagcggaaaataccaaattaggcgcttgggcaaatgagaaacccgccattgttatcaacgttcaacgtcagcctggtgccaatgtcatcgataccacggacaatatccgtgccatgctgccggagctgatcaacagcttgcccaaatcggttaacgtggatattttgacagatcggactgtcactattcgtgcgtcggttcaagatgttcagtttgagttgttactggctatcgcgctagtcgtgatggtgatttatctgtttttacgtaatgcaacagcgaccttgattccaagcattgcggtgccactttctctggttggtacatttgccgtcatgtatttctgtggtttctctgtcaataacctcacgttgatggcattaaccatcgcagcaggtttcgttgtagatgatgcaattgttgtgatcgaaaatatctcccgctatatcgaacgaggagaaaaaccgatggctgctgccctgaaaggagcaggagaaatcggttttaccatcatctctttaacgttttcattaattgccgttctgatcccacttttgttcatgggagatattgtcggccggctgttccgagaattcgccattacacttgctgttgccattttaatttctgccgtggtatcactcacattaacgccaatgatgtgcgcacggatgctaaaagcagaagctgaaattaaacataaccgctttgaacaggccagtgaacacttctttgagcgaataattgcaatatatggcgaatggctgaaacgggttttaaatcatccctggataactctcggcgttgcattcagcacattggcattcaccgtcctgctctatttaacgatcccaaaaggatttttcccattacaggataacggcttgattcagggtacactggaagcgccgcaatctatttcattcaatgccatgtcagataaacagcggcaggtaacggctctgctactgcaagatcctgatgtagagaatgtgacaacgttcattggtgttgatggcagcaactcaacgctgaatagtgggcgtctgcaaatcaccttaaaatctctcaatcagcgtaatatccgagttgatgagatcatcccgcgcctacaggctcgcgtcgctaacgtacctgacgccaaactgtatctacaaccgacacaggatttgacaattgatacccaagttgcccgcacgcaatatcaatttacattgcaggcgactgtctctagtgaccttaacatttgggttcccaaactacaggaagcactgaaacagcgccctgaattggtggatgttggtactgactggcagaatcgggggttagtggcttatatcaatgtcaatcgcgatatggccagtcgattaggtatttccatgactgccatagataatgcactgtacaacgcttttggccaacgcttgatttcaacgatttatacccaagctaaccaatatcgggtgatccttgagcaggatacacaaaatgaagcgggtataaatgcactcaataatgttcacctgatcggaaccgataacaaggtagtgccactcagtacaattgccactgttgagcaaaaattggggtacttatccatcaatcatctgcaacaatttcctgctgtcactttttcgttcaatgtcgcacaagaggcttctcttgaagccgcggttaatgcagtcaaagaaacagagcagtcgattgggatgccaaaaaacatcaatacgcaatttcaaggagcaacactggcgttccagaatgcgctcggcaataccctatggctgattttggctgccgttatctccatgtatatcgtgctgggtattctgtacgaaagttttattcaccctgttacgatcctgtcaactttgcccactgctggcgtaggggcattgttagccctgatgatgggtggctatgagttggatattattgccattatcgggatcattttgctgatcggtattgtgaagaaaaacgccatcatgatgatcgattttgccctagcggcagaacgtgaaaaaggcatgtcgccttatgacgcgatttttcaggcttgccttctgcgtttcagacccattctgatgacaacgatggcggcgctgctgggagcattaccgttaatgctcagtacgggaatcggggctgagttacgccgtccattaggtatctgtatggtgggcggattgatcatgagccagatcctgacgctctttacaacgcctgttatttatctgttatttgaccgattagctaactattttaaaaacaagcgccaaaacagactccagagccagaatcaaggggaattagatcattcatcggttaatcatcaggagccgctgtga

SEQ ID NO: 3230 - DNA, 3084 bp, Xenorhabdus bovienii
  Coding DNA location: Contig name=SeqID_16888; Position on contig =157886..160969bp; Strand=+
gtgaagtttttcgccctatttatccagcggcctgttgccacgacgctactgagtttagccatcactttatgtggcgcactcagttttgttctgctgcctgtatcgccgctaccgaagttggacttccccttcatttcagttagtgcttacatgccaggcgcatcacctgaaaccatggcatcttccgtcgctacaccactggaacgttcactcggtaagattgctggcgtgaaggagatgacctccgacagttcgctaggcaataccaacattacgttggaattcgaacttagccgggatatcaatggcgccgcacgggatgtccaagcggcgatcaatgcagcagaaagcctgctgccttccggtatgccaagccggccaaggtactataaggcgaatctctctgatgctccgatcatggttttgactttaacgtcaactaattatagtgaagggcaactgtatgatattgcctcaacataccttgcccaaaagctttctcaagtagaaggcgtcagtaatgtgtctgtcggaggcagttccctgcctgcggtaaggattgaactgaatcccaatgccttgttcaatcagggcgtttcactcaatgatgtcagccaagccatcaacagtgccaatgcccaacgtccaacaggacatgtggattcagcgcaacagaactggcaaatacatactaatgacgaactgaagagcgcagacagttatcgctccattattgtgcattatcgtaatggttctcctgtgcgtttgcaggacgttgctaatctcaaggattccgtcgaagatattcgagcagcaggaatgtccggaggtaaccccgccatcgtactgatgattcgtcgtgaatcgggagccaatatcattgcaaccatagaccgaattcgtgctgaactgcctgctctgcgtgaatctattcctgccaatattcagcttaacgtcgcacaggatcgctcaccgcccattcgtgcctccctgcaagaagtgaaacagtcactcgccattgctgtcgctttagtgattctggtggtttttctgtttttgcgttcaggccgcgccaccctgattcccgcaattgcagtgcctgtatcactcattggtacattcaccgccatgtatttgtgtggtttcagcctgaataacctctctctgatggcattgaccattgcgacaggatttgttgtcgatgatgccattgtggtactggaaaatatttcccgccatctggaagctggattgaagcctgcccaagccgcactaaagggtgtcagagaggttggattcacggttcttgccatgagtgtttcactcgttgcagtttttattccgcttgtattgattgatgaattactcggcaggctgttccgcgactttgccgtgacactcgcgacagctatcggaatttcactactgatttctcttaccttaaccccgatgatgtgcgcgcgtctgctcaaatcatcaccgaaaaaatcgcaaaaacgtattagaggttttagcaaggtactgttgaaaattcagcagggctatgggcgttctctgaaatgggtactcaatcatacccgttgggtactgctaacattagttggtatcgttgtgctgaatgtttggctctatatcaacatcccgaaaaccttttttcctcagcaagataccggacgactcttgggattcgtcgttgccgatgaaaacagttcattccaggccatgcgcgacaagatgaaacattttatgcaggtcattgatgccgatccaacggtcgaaaatgtatcaggatttactgagagccgctcaggagttatgttgatagcactaaagccactgagagagcgtactgaaagtattgaacaagtgataacccgtttaaaagggaaactctcgaatgaagcgggtgcccaactgtatttgatccccattcaggatctcagatcgggtggacgcggcggtgctaaatcaatttatcagtttacgttgctgtccgatgatcttggtgaactgcgcaaatgggaacctgttattcgcaaagcattggcgaaattgcctcaattgactgatgttaattcagattatgaaggtaaaggctcagaaatagccattatctatgatcgtgatctgatggctcgtttgggcattagtgtcaatgaagccaatgctttgcttagcaatgctttcgggcagcagtctatttccacaatttatctgccccggaatcaatacaaagtggtcatggaagtcgcacctgaatatacacaagatgccagctcattagaaaaaatgtttgtgatcaatgccaaaggtgaacgtattccactttcctattttgcccgctggcaacctgcgaatgcaccattgggtgtttatcatcaggggctgtcagcctcctcgactatcgctttcaatgtcgcgaaagactatacactgtcggatgcgatcagtgcgatagaacgaacaatgacagagttgagtgtcccttccgcagtacgcagctctttcgcaggcacagcccaggattttcagaaaactcagagctcacaattgtgggtgatcctggcggctattgtgaccgtttatctggttttaggggtgctctatgagagttatatccatcctctgacaatcctttccactctgccttctgcgggagttggcgctttacttgcactagagctgttcaacacaccatttagtctgatcgccatgattgggatcatgctgctaattggcattgtgaagaaaaatgccatcattatggtggattttgcccttgaagcgcagaaaagtggaaaattgagtgcacaagaagcgatacttcaggccagtttattgcgcttcaggccaattatgatgactactctttcagcattattcggcgccttacctttggttctgaatagcggtgatggggctgaactgcgtcagcctctgggcattaccattgtcggaggtctagtgatgagccagcttctcacattatataccacgcctgttgtatatctgttctttgaccgactgcgtgaaaaatggcaccaccgccgtacgataaaatctcaggcgatgaaaccatcatga

SEQ ID NO: 3231 - DNA, 1446 bp, Xenorhabdus bovienii
  Coding DNA location: Contig name=SeqID_16888; Position on contig =160921..162366bp; Strand=+
atggcaccaccgccgtacgataaaatctcaggcgatgaaaccatcatgagacacataatgagagcaggtattagtggtaagctatttttggctattttcgcgacctgtatgctggtgctggtgacaatgcactgggggattcgcctcagcttccagcatagtttcattggttatattaagcaaaatagccaaatgcgagccaataagatggcagaagcattgacggaacaataccagaaatatggtaactgggatttcctgcttcaaaacgatcggatgatctttcaaatcatgcgaactattgaacaaaacagcgatagccgccaaagcccgtcatcccgtggctggcgcagtcaattctgggtagttgacaatcaaatgcatcgtctggtcggtcatgggagtcagatccctacagacacctatcgaaaatcagtaatttatcaagataatatcgtcggttgggtcatcgtccgtacatcagataaaatcactcgtcaagcggatatccgttttgaccgccagcaacaattaaccagttggattattgctggtttttcaaccttactggctctgattgccacttttcttctgtcccgtggttttctaaaacccgttaaacggttggtggagggaacacataaacttgccgcgggtgatttcagtgttcgtgtgaagccatccagtacagatgaaattggtcaattagcatcggactttaatcggcttgccagtacactggaaaaaaatgaacaaatgcgccgtgattatatggtggatatttctcatgaactgcgtactccactttctgtgctgcgcggtgaactggaagctttgcaggatggcgttcgccaatcaacgccagagacaatccactcactactgacggaaatcaccacactgacaaagctggtggatgatttgcatttattatccctttctgatcgtggttcgttagcctaccgacaggaactgaccaatgccagcgatctgctgcaagtcaccctagccgcttatcgtggacgttttgctgacaagcagatcacactggaactgaacttgacggaaaacgcaattctgttcgcagacccaggccggctaacacagttattccaaaacttgctggaaaatagcctgcgctataccgctgctcccggaaaaatcatcattcgggcacatctcactccccaaaagtggatcttggattggcaggatagcgcacccggactgactgtcgagcaatgccaacagatttttgaacgtttttaccgctgcgagtcttcccgtaatcgcgccagtggtggttcaggtttggggctggcgatctgttacaatatcgtcgaagcacacgatggcgttatttatgcagaaagatcatctttaggtggtcttaaaattcacgtagaattaccgctggttgaactgcctgaatataaagcacaatga

SEQ ID NO: 3232 - DNA, 708 bp, Xenorhabdus bovienii
  Coding DNA location: Contig name=SeqID_16888; Position on contig =162363..163070bp; Strand=+
atgagtacgcattctacacaatataccgttttaatcgttgaagatgagccaaaattagggcaactgctcattgattatctgcaagctgcagattatcagacacaatggctgacacgtggtgatgaagttattgcccatgttcagaagcaccagcctgatattatcctgcttgatatcatgctacccggccttgatgggatatcgatttgtcgagaaattcgccggttttctgatattcccattgtgatgatgaccgccagaacagaagaaattgaccggctactggggttggaaatcggtgccgacgattatatctgcaagccttatagcccaagggaaatggttgccagagtgaagaccattttgcgccgttgctatcgtccacaagatatcatcagcgaacatggctccctgacaattgatgaaaatcattttcaagcacgttatcttgatcgcgtccttgagctgacgcctgttgagtttcgcttactgaagatcatgtccagccaacccggacgagtattctcccgcgatcaactgttaaataacctctatgatgatcaccgtattgttaatgaccgtactatcgacagccatatcaagaatttgcgcagaaaactggaacaattagatgatgataaatccttcatccgctccatttatgggttgggctatcgttgggaagcggagatatgccgtttaatgtga

SEQ ID NO: 3233 - DNA, 132 bp, Xenorhabdus bovienii
  Coding DNA location: Contig name=SeqID_16888; Position on contig =163055..163186bp; Strand=+
atgccgtttaatgtgaaacttcatccaactggaaccgtgataatcaatcccatctgtcggatttctgaagaagcccaaaatatcaccgttaatcatttcaaagtcataagatttttttgccccgagacttaa

SEQ ID NO: 3234 - DNA, 123 bp, Xenorhabdus bovienii
  Coding DNA location: Contig name=SeqID_16888; Position on contig =163351..163473bp; Strand=-
atgtttttcaaggagccggcaggagatagtaattctggagtaaacataattaataacgttctcgatctgagttcaagtcaggccttgtcattaaaagcaaggctaaggaaacaagaattttaa

SEQ ID NO: 3235 - DNA, 1377 bp, Xenorhabdus bovienii
  Coding DNA location: Contig name=SeqID_16888; Position on contig =163427..164803bp; Strand=+
atgtttactccagaattactatctcctgccggctccttgaaaaacatgcgctacgcgtttgcttatggtgcagacgccatctatgccgggcagccccgttatagtctgcgtgtccgcaataacgaatttaatcatgaaactctggctcaggggattaaggaaacgcacgagttaggcaaacgtttttatgttgtcgtcaatattgctccccacaatgcaaagctgaaaacgttcatccgcgacttgaaacccgtcgttgaaatgggacctgatgcgttgattatgtccgatcctggcttaattatgatggtacgtgaagcatttcctgagatagatatccacctttcagttcaggccaatgccgttaactgggccacggttaagttctggaaacagatgggactgacacgcgttattctctcccgtgagctttcgctggaagaaattgctgaaattcgtcagcaagttcctgatatggagcttgaagtttttgttcatggcgcactttgtatggcttattctggtcgctgtctgttatcaggctatatcaacaaacgcgatccaaatcagggaacatgcactaatgcctgccgctgggaatacaatgtgcaggaaggcaaggaagataatgtcggtaatatcgttcatatgcatgatcctattctggtcaaaaatattgaaccgacacttggacagggggcaccgacagacaagatattcatgattgaagaagccaaacgtccaggggaatatatgagtgcttttgaagatgagcatggcacttatatcatgaattcgaaagatcttcgtgcgattgagcatgtcgaaaggttggccaatataggggttcattcactgaaaatcgaaggacgcactaaatccttctattattgtgcccgtactgcacaagtgtatcgccgtgctattgatgatgcagcggctggcaagccttttgactccactctgatgaccacactggaaggtctggcacaccgtggttacacagaagggttcctgcggcgccatacccatgacgcgtaccagacttatgaatacggctattcaatgtcagatacccagcaatttgtcggcgagttcactggcaatcgcgtaaatggtctagctgaagttaccgtaaaaaataaatttctggtcggagatcaactggaactgatgacaccatcaggtaatatcaactttacgctggaatctatggcaaataaaaaaggccagacaatcgaagtagcacccggagatggtcatatcgtctatctgcccattcctgaagaaattattttgaattatgcgctgcttatccgaaatttaaagggaactaataccagaacaccacatacaaaagaaatacaagaaaaataa

SEQ ID NO: 3236 - DNA, 171 bp, Xenorhabdus bovienii
  Coding DNA location: Contig name=SeqID_16888; Position on contig =164903..165073bp; Strand=-
atgaagaaacagaaagtattaattaaaacaatatttttttattgtggttttatttttaaccatttgaatttattatattttatttattttgggataaaagaaaaggccagctcaagggagattgagctagccaaggaggtggttcctagtcttacagtaaaacttttttag

SEQ ID NO: 3237 - DNA, 1050 bp, Xenorhabdus bovienii
  Coding DNA location: Contig name=SeqID_16888; Position on contig =165402..166451bp; Strand=+
atgactgatatcgctaagttgttaggaaaagacgcagaaagtttattgcagcatcaatgtactactatccaaagtgaacatctttaccttccaggcgcagatttcgtcgatcgagtcatgatcgaaaacaatcgaccaaataccgtcctgcgttcaatgcagactttattgaatcatggacgtctggcagggactggctacctttcgattttgccagtagaccaaggcgttgaacattcagccagtgcctcttttgcagccaaccctctctattttgatcccaaaaatctcgttgaattagcgatcgaagcgggttgtaactgtgttgcttcaacttatggtgttctagcatctgtctctcgccgttatgcccataaaattccgtttctggtgaaacttaatcacaatgaagcattaacctatccagcccaatatgaccaaaccctgtataccagtgtcgaacaagcatttgatatgggagcggttgcggttggtgcaacgatctattatggctctaccgaatcacgccgtcagataggagaaatttccgccgccttcgaacgtgctcacgaattaggcatggtgaccgtgttatgggcctatctgcgcaattcagctttcaagaaagatggcgttgattaccatacaagcgccgatttaaccggccaggctaaccatctggcagcaactatcggtgcagatatcgttaaacaaaaaatggctgaaaccaatggcggatatactgcaattggctttggtcacacggacaagcgtgtttatacccatttaacaaccgagcatcctatcgatctggtccgttatcagcttgctaactgttatatgggacgtgcgggattgatcaactctggcggcgcatccggagccaatgacctgagcgactccgttcgcactgccgtcatcaacaaacgagcaggtggtatggggctgattcttggccgtaaagcgttcaaaaaatcaatgaaagaaggggtagagttaatccattcggttcaagatgtttacctcgataagaaagtaaccattgcctga

SEQ ID NO: 3238 - DNA, 855 bp, Xenorhabdus bovienii
  Coding DNA location: Contig name=SeqID_16888; Position on contig =166536..167390bp; Strand=-
atggtatctcctattcggatactggcttttctttggctggtgctaggagtcaccatcatgagaattaattcattgaccatcgcaggaaccgatcctagcggtggtgccggcattcaggctgatttaaaaactttctccgcacttggggcctatggcacaacagtaataaccgctttggttgcccaaaatacgatgggagtccaatcagtttatgacattgatccccgctttgtcgctgcgcagcttgaatcggtgctttctgatgtcagaatggatagcatcaagataggtatgttatccaatgttgccaatgtcaatgtagttgcagaagctctgaatcgttaccctgttccccatatcgtgttggatacggttatggtggctaagagtggtgatcccttattatcctcagaagcaataactacgatggtagagcaactcttgccaaacgtctccctgattacgccaaatttgccagaagcggcggccatactgaaatgtaacattgccggaacggaaggtgaaatgttgcatcaggggcgtgaattgctttcaatgggatgtcaggcggttttactgaagggaggacatctggttaatgaagaaagtccagattggctgtttactgctgaaggagagtggcgttttactgctcccagaatcaatacgcgacacactcatggcacaggttgtacgctctctgcggcgcttgccgcattacgtccccgttatcctgattggaaaaacacactgccagcggcgaaaacttatttgcagaatgcactggcgcaggcggatacactggatgttggaaagggaatagggccagtgcaccattttcatcaatggtggtag

SEQ ID NO: 3239 - DNA, 366 bp, Xenorhabdus bovienii
  Coding DNA location: Contig name=SeqID_16888; Position on contig =167572..167937bp; Strand=+
atgctcaaaactaaaactgacatccagcgtttcaccatccccgatggtaagacaatgaagaaagaaatcgtcttcaacaacggattaacaggattgtactttgctgcccgaagaaatccatcaggcgtgataacaaaaagctggcgttatattgtgggtagcaatgatattactttaggcacctaccctgcttacagtttggaagagaccagaaaatggcatttgcaacaggtacaaaagaccagacaagggtttgcacccagtaaaacactcataggaaaacccaccactatggatggtctggttcaggagtggctggaagtaaagtgcgctaaaccgtcaaaaccgggaagacaggcgatctga

SEQ ID NO: 3240 - DNA, 738 bp, Xenorhabdus bovienii
  Coding DNA location: Contig name=SeqID_16888; Position on contig =168067..168804bp; Strand=+
atgttatatgcctttcaggtgcatggcatacaagggcaacaaccgggacaaccagtctacgttcctcaaaaattgtcggagatccatgacagaaaaaaagttgctgctttggtaggtaaaatacgtgataaccatcttcaggcagagcaataccgcatcttatggcattttctgggcaacactccttcacatgcagcgatgcgctttattatggtttttggtactcgcaaatcagaatcagcaaagctggtatggcctgaaatagatttaaaagctaaaacatggaccttacctgctgaacgaaccaaaacaaaacaggagcgcgtctaccctctccctgactacctgatcagtctgttagaagagtggtcttggacacagcataaccttggcaaacagatatggacacatatcggacataccacgatgtctcattccgctgtcaggttacgggaaaccgtaggaaatgattttacgactcacgacctgagacgtagcacggcatcaatgatgagcaacgaggcgggaattgatcccattatcgtagacctgatgttaggtcatagcctcagtatggtaatttcaaagattctggcaacttaccagccaaaagcgtttcagaaaaaggtcgataaagcttggcctgtttggtttcagtggtttgagaaaaatatcatcaacaagaagccaaaggaatggcaagaggaacagcctaaacttgcggatgcaagtaaatga

SEQ ID NO: 3241 - DNA, 297 bp, Xenorhabdus bovienii
  Coding DNA location: Contig name=SeqID_16888; Position on contig =168801..169097bp; Strand=+
atgagtgaaaacaccatcaataaggctcttcgcaagatgggctacgatacccagcaggacatctgtggtcatggcttccgcactctggcctgtagtgctttaattgaatccggtttgtggtcagaagacgctgtagagcttcagatgagtctcaaggaaagcaacagtgtccgtggtgcctatacccacaaagccaagcatcttgaccaacgccgcctgatgcttcaatggtgggctgactatcttgatgccaatcgcaaaggcatggtaaggccatttgagtttactaacaggtaa

SEQ ID NO: 3242 - DNA, 285 bp, Xenorhabdus bovienii
  Coding DNA location: Contig name=SeqID_16888; Position on contig =169276..169560bp; Strand=+
atgatatcaggtcttgatggtggaaatttcatccttagcttgatggcaaaggaaagggtgaaatcaggcatactcaatagagccacgatagaaggcttcaagggtgagtataccgtgatttttgatggctcggagttgaagggcaagccactagtcttgtgtagttccagacaaccttatgaagcacgaatcttcaaaagtatcgatggcgcggtagccgaactactgcgtataggtttaagcgaagcttcagtcaaaaacaccagtaaaccgaactctaaataa

SEQ ID NO: 3243 - DNA, 462 bp, Xenorhabdus bovienii
  Coding DNA location: Contig name=SeqID_16888; Position on contig =169572..170033bp; Strand=+
atggatatccaaaaagagacacttttttcagaaattgaaaccgcaaacagcaaacaactggctgttttaaaagctaactttcctcaatgttttgataaaaaaggggctttcattcaagaaaaacttcttgagatagtaaaatccgcggacattgaactgtcaaaagagtcatatagtttaaactggcttggcaagtcctatgcccgcctgttggctaacctgccgccaaaaacattactcaccgaagataaagaacataaccatattgagcaaaataaaaacagtcagaacctgttaattaaaggggataacctcgaagtattgaagcatatggttaatgcttactctgaaaaggtgaaaatgatttatatcgacccccatataacacaggttcggatggattcgtatataatgatgatcgtaacttcactcgagaacaactcagtgaacttgctggtatag

SEQ ID NO: 3244 - DNA, 1278 bp, Xenorhabdus bovienii
  Coding DNA location: Contig name=SeqID_16888; Position on contig =170204..171481bp; Strand=+
atgtgtgacgaaattttcagcgaacaaaatttcatcggaaatatagttagggcaaccggacaaactacaggccaagacagtggtggattaggagcttcattcgactacattttagtttatacaaagtcaaataatatcgatttaagtggattaccgttaactgaccatgacctcaaacgtttccagaataaagatgatgtaggctactatgcttatgatcaaatgagaaaaacagggagtaatgataaaagagaagagcgccctaacatgttctacgctgttctagacccagatgggaatgaagttttcccaatagcctccgctgggtatgagggacgttggagatttagtaaagaaacctacttaaaacaagtagaagataatatggttttatggaaaaaaacaaaccgtaatggagaagaagtttggtggccttatgtcaaatattatgttgaaggaagaaccaaacgcccgtctcctctttggactgaatttgagggtaataagaaagcagctcgtgatcttcgctcactatttgatgggaagaaaatctttgattttccaaaaccaattcaggtaatacagagcctaatatatattgtccctaacgcatcaaaagatgacttgatattagatttttttgcagggtcaggttcaacttctcatgcagtgatggctatcaacgctaacgatctcggaaatcgcaaatttgtttcaatacaaattccagagaatacacctgaaacatctgaggcatataattcaggttataaaaatatttttgaaataacaaaagaacgacttgtcagagcatcaaataaaattaaaaaagaacatccagattttaatggtgatctaggattcaagatatttgagacagttgatgattttcgagtaaaagatgaaagcgaactaacactttctaaccacaccttctttgatgatgctgttctaacccaaaagcaatatgacacattattaactacgtggtgtttatacgatggtagcctactcacaacaccgattgaagacgttgatcttcagggctataaagcacacttatgcgatggtcgcctgtatctgatagcacctaacttcagcagtgaatcattgaaggctttacttcaaaagctggattcagacaaagattttgctccgaacaaagtagtattttttggaggcaactttgaaagcgcaaaacagatggagctaaacgaagcacttaaaagttatgctaataaaaaatcgattgagttagatttggtggtgaggaactaa

SEQ ID NO: 3245 - DNA, 2910 bp, Xenorhabdus bovienii
  Coding DNA location: Contig name=SeqID_16888; Position on contig =171484..174393bp; Strand=+
atgtctaaagggttcacattcgagaaaaacttaccacaccaaaaagccggtgttgatgcggtgatgaatgtttttgtgtccgctattctacataagacggataatgttgctatccgtttgttggctaaccctgagttaaacctgactgaacagcaatactacaacaatctgaaagcagttcagcaatttaatggcattgaacatacaaaacagcattatgatgccaaaagcaatatcattgatatttctatggagactgggacaggtaaaacatatacatatacaaaaacaatatttgacctgaacaaagcatttggtattaataaatttattattatcgttcctactctttcaattaaggcaggaacagtaaactttttaaaaagtgaggctttaaaagaacactttcgagatgattacgaacgtgaactaaaggcttatgttgttgaaagccagaaaaactctggtaaaaacacaaagtcatatatgccacaagctattcatgattttgttgaagcaagtaatttcaataagaaatatatacatgttctcgtaatcaactcaggaatgattaactcaaagtctttaacagacacgtatgatgttggtttactagataatcagtttgatacaccattctctgcaattagtgctgttaaaccatttgtgatcattgatgaaccccataaattccctacagctaaaaagacatgggagaacattgagaaatttaatgctcaatatatcatccgttatggtgcgacattcagtgatggttatgaaaatttagtttatcgcttaacagccgttgatgcttttaatcaggatttggttaagggaatcgatgcatatgttgaagatattgttggtgatagctcagcaagcctgaaatttgttaaatcagatggtaaagaagccagatttgatctctctgagaatgaaaaaaagtcgagttatcatttgacaaaaggtgagtcattatcaattactcacagttctatacatgatctttacattgattcattaaataaaagcactgttgtgctgagcaatggtatcgagttaaaaacaggtgagtcaataaatccgtattcctatgatcaaacgcttgaagacaacatgatgcgtaaagctgtcaaagagcacttcaagttagagaaagactatctgactcaaagaccacgcataaagccacttacactattctttattgatgatattgaaggatatcgtgatggtaatgagattgccggaagcctgaagactaagtttgaagagatagtattggctgaagcaaatgaactattaaaaagcgagaaagataatttttatagaaaatatcttgagaagaccgttcaagatatttctttggttcatggcggatatttttcaaaggacaacagtgacagagatgagaaaattgagcaagaaataaacgaaatccttcatgacaaagagcttttgttatctttagaaaatccacgtcgtttcgttttctcaaaatggacgttgcgtgaaggttgggataaccctaacgtttttcagatctgtaaacttcgttcaagcggtagcactacatccaaacttcaagaggtaggacgtggtttacgccttccagtgaatgaatacatgtgtcgtgtaaaagaccgtaatttcacacttaactattatgttgattttactgaaaaagatttcgtagattctcttgtcaaagaggtcaacgatagttctttcaaagaaaccgtaccaagtaagttaacccaagagcttaaggacaagattctttctcaatatccagctctttcatcaatgaaactcatgatcgaactcgttaacaatgaaatcattgatgagaatgaaaacttcaaagattctgatgcatatgcacgcttgaaagttaagtatccagctgcattccctatcggagtaaaaccgaacaaaatcaaaaaagcttccgatggaaaaagacgcactaaaatgcgtgctggtaaatttaatgagctaagagaactatgggaactaataaatcagaaagcagtaattgagtataaaataaacagcgaaaatgagtttttgtccattttcaggtcatttatgctcgaagaagcagaaagatttacaaaatcgggcctgcatacccgtatagatagaatctacattcataatgatacagccatgtccaaaagtatcgttagtgatgatgataactttgctaaacttaatacaatggcttatcaagagtttcttgataacttatcgcaaactgtttttgtaaaacgtgataccttacataaggtattttgcgaaataaaagatactatcaatatcactgactacctgaacattcaaacaatcaggaagattaaatctggctttagcaagtatttgttgaacaattctttcaacaagttcagtctgggctacaatgtgatttcaggctctattcatcctacaaagttcacgaacgcagacggcgaacctctgaatgagatattatcaagtgatcttggtatattgaatgacagcataaaaccaccgctggattcgtatctgttcgaagaggttttttatgattcagaactggaaaagctgaatataactgatggagagattacatctgtagctgtttttacaaagataccgaagaattccattaagatcccggttgcgggtggctatacgtattctcctgactttgcttatgttgttaaaacaacaaaaggtgattatttaaactttatcattgaaacaaaaaatgtagatggaaaggatagcttacgacttgaagaagatcgcaagataaaacatgctcaagcacttttcaatcaaataagtaaatctgtcaaagtcgaatttaaaacacagttttctgcagacacaataggtgaactgattaaacaagttcgatga

SEQ ID NO: 3246 - DNA, 285 bp, Xenorhabdus bovienii
  Coding DNA location: Contig name=SeqID_16888; Position on contig =174812..175096bp; Strand=-
atgaccagaaaagatatcaaacaacaaattgcttcagcgcaggaacgattatatttcttggaagctaaaaagaaacagcaaacgaaaaaagagaacacccgccagaaaattattttcggtgcagaggttgccaaagtcttaggatgtgatattggttatgtagataaagaattagtctttgggattctgcttaacatatctaatctacctgagcgtgatattcaggtttatagagcacaaggccaagtctatatcgaaaatgccataaataaatccaagtattaa

SEQ ID NO: 3247 - DNA, 243 bp, Xenorhabdus bovienii
  Coding DNA location: Contig name=SeqID_16888; Position on contig =175108..175350bp; Strand=-
atgtataaaaataatgatgaggccattgattgggaaaccaaaatgcttcttgatgatgggatatataccgatacggaacaagcctatttagaagcagagaaaatagtaaaccagataagggaacaagcaaagcagcaccagataaaacaacaatttaaattgaaagttaaatcaatcaaaagacaaatcagtaatggttatgactatgtgaatgtcccttatgccaacaagaaaaaacattag

SEQ ID NO: 3248 - DNA, 162 bp, Xenorhabdus bovienii
  Coding DNA location: Contig name=SeqID_16888; Position on contig =175495..175656bp; Strand=-
atgtatcctatcagttatttaatcattagtataattaaattaaaatctctaattcatttcacacattggcgctttacttttccttgtgcaagactggccctaacgctgttctcacccttctgtaagtggaactatatcatagcaaggctatttatcggataa

SEQ ID NO: 3249 - DNA, 264 bp, Xenorhabdus bovienii
  Coding DNA location: Contig name=SeqID_16888; Position on contig =175672..175935bp; Strand=+
atggttcacgagatgcttcttaaactattaccccaaaattggcgttatctgctttcatcatacttattgattattcttgtagttatacttttaaaagtagttttctttgttatgattcataaagatctcaccgaacaacgagctgagagatttaaaaacgctccagttagtcatgctcaatatgatccttcgaaattaacacatcgcatggtaaaatttgatgagagcaatggaattatttccgacaaagaagcatataaataa

SEQ ID NO: 3250 - DNA, 957 bp, Xenorhabdus bovienii
  Coding DNA location: Contig name=SeqID_16888; Position on contig =176027..176983bp; Strand=-
atgcctatcatagcacccatacctcgaaatgaacgacagaaaatgaaaaagcttatccagaaaacccaaaataaggattatgctcgccggatgatggccttattgatgttacacaagggggatacggtttctcacgttgccaaaaccctttgtgcctcacgttcttcggtcaatcgctgggtaaattggtttacattatatggactggacggattaaaaagcttaccgccgggcaggccagccatctggaatttagagccacttctcgctgtggtttctttcttattaaaacactccccacaacatttcggttatctccgctcacgctggagtcttgagcttatcacacataaaatcaatgtattactggatatatcactctctcaaagtacactttatcgctacttttatcgggcggggatcgtctggcgaagagccgcacccacgttaagattgtctgatcctgaacatgatgaaaaaagggcaaaaatcaccggggccttatccaatgcctcagagcaacatcctgttttttatgaggatgaggtggatattgaccttaacccaaaaatcggggcagattggtgtttcaagggacaacaaaagcgtgttgtgacccccggaaagaaccagaaacactatcttgcgggttgcctcaacgcgaaaacgaaagaaataacttatgtcgggggcttaagaaagaactcggatttatttattaagttgttagatgtacttaataatcaatatgttaatgcaaagacgatcaccttgattttagataactatggcattcataaaagtcagaaagtcatcgcgtggctggcaaaaaatcctaaatttaatctcttgtttttaccggtctattccccttggttgaataaaattgaacgcctgtggcaatccctgcatgaaaccgtgacacgaaaccattgctgccaatttatgtggcagtga

SEQ ID NO: 3251 - DNA, 150 bp, Xenorhabdus bovienii
  Coding DNA location: Contig name=SeqID_16888; Position on contig =177064..177213bp; Strand=-
atgatatccgggctttctaaaatattatccacccctaccgatgagttaacacatttgcttttcagaccaacagttattaatggaggtggactaaatataggcagttcaaataataaatcttctcttaagctaaataagaattcaaaatag

SEQ ID NO: 3252 - DNA, 147 bp, Xenorhabdus bovienii
  Coding DNA location: Contig name=SeqID_16888; Position on contig =177194..177340bp; Strand=-
atgaaaaatgatatatcaataatcgtaaatatgttatgtgagaaaacacctaaagtgatgaatcttatccaagagagttttgatatatttatcgcattaagagtatactctgtcgaagaggtcatgaatgatatccgggctttctaa

SEQ ID NO: 3253 - DNA, 294 bp, Xenorhabdus bovienii
  Coding DNA location: Contig name=SeqID_16888; Position on contig =177394..177687bp; Strand=-
atgactaaagaaaatattattgagaatgaatcaactggactgttcttggatttggcttgtagatcgtttgaagcaagttggaaagtttttctggaaataaatggtgagggtggttcagatgaacttcttgatgatcccgattttatgagtccatttattatcaatatcattgatcacataacgaagagctatgagaagttcactgctcaagaagggaatatgggtgatattaatgagattaacattgaaaaagtagctgccttgttagtttcgtatacaaagagttttaaataa

SEQ ID NO: 3254 - DNA, 315 bp, Xenorhabdus bovienii
  Coding DNA location: Contig name=SeqID_16888; Position on contig =177767..178081bp; Strand=-
atgaataatcaagaaataaaaaacatcaaagaatcatctacaaaatcttttgctgcgatggctaaaaatctttatatatttggtctgaatatatacaaggagcaagaggaatatgatttcttggcatctattatgttggataagaatagaacggagtcctatatcttacatgtcaaagattatctggcaaagcgctttgatgaacatatggaagagtcaagtaagaatgaaagactgatgtatgtcgatatggataaggtcatattcgaaatgagatgtattcatatcaaagcattaatttttagcctgacttaa

SEQ ID NO: 3255 - DNA, 267 bp, Xenorhabdus bovienii
  Coding DNA location: Contig name=SeqID_16888; Position on contig =178113..178379bp; Strand=-
atgagaaacaacaacacaaaccaacagcgaacagagttctatgagcaaagctttgtgaaaaatgaagcagcatcaagacggtttatccgcctcccagaagtgttgaagagggtagggcttagccgggcaagaatgtatgggctaatcaatgcaggtcgctttcctaaacaggtaaggattgggctaagatcgattgcctttatcgaaagtgagatagaagcgtggatggatagagttattgctgattcccgcaatgaatctcactaa

SEQ ID NO: 3256 - DNA, 96 bp, Xenorhabdus bovienii
  Coding DNA location: Contig name=SeqID_16888; Position on contig =178510..178605bp; Strand=+
atgtcgctggttttgcataagggaacctgtcttggtggcaggctcccggagataatggaaagggcaggggttacgcatgaaattttggtcggctaa

SEQ ID NO: 3257 - DNA, 1110 bp, Xenorhabdus bovienii
  Coding DNA location: Contig name=SeqID_16888; Position on contig =178602..179711bp; Strand=-
gtggatgtcttttctgattttccagacccacgttgtcagggaaaggtcaaacaccgttttattgatatcttagtgatcgcggtatgcgctgtcattgctggggctaacgcctggactgatattgaacagtacggtcaactcaaaaaggattggctgagttcatttcttccgctcaaagggggtattccgtcacatgatactttccggcgctgtttcagtttattaaacccgagcctctttgaacatcatttttatcaatgggtttctcgtgacctctcttcagaaaaacgggctatcattgcgattgatggtaaaagtttacgtcattcgtttgataagaaaattgaccaaagcgcattacatatggtgagtgcattcacggttgagaaagggcttagcttatgtcaatgtgccgtagacggaaaatcaaacgaaattaaggccattccggcattattatcgatgctttcattgaaaggccatctcgtgacgatggatgcgatgggttgccaacgcacgattgctcagcaactacgcgagagtgaagccgattatattttgtcgcttaaaggcaatcaggggaaaaccttttcggaagcggttaactattttcaacaacaacagataacccaaaaaccttaccttaaacctgaccatgatgaattcgatgatagccacggacgtaccgtcagacggcgcggatgggttctgccactgacatcagaaacaaaacacttaaggtcttggccagatattcaagctcttctggtaacagaaacgatacgacaagaacactattctgacacggtgacttctgactttcgttattatttaagcagttgtcatgattctcccgcctttcagttaggtgcaatacgaaaacattgggctatcgaaaatagtttacactgggtactggatgtcactttccgagaagatgattcacggatgagagagcgggtcgccacaagaatatttgcccaattacgtaaaatggcactcaatattgttaaacgagatatcaatagtaaattgagtttgagtgcgcgaagaaaatcagcgggatgggataacggttatatggaagcactgttatttaatcaattttag

SEQ ID NO: 3258 - DNA, 879 bp, Xenorhabdus bovienii
  Coding DNA location: Contig name=SeqID_16888; Position on contig =179747..180625bp; Strand=-
atgaagtcaggtgaggttatcaaagccgcaaagcaatggttcagaatgagtaactatgatgttttacaggacatcacgctaaacgacgtcaacgatgaactaagtcgccgtgcagtcctgttccgctatgattccatgaatgaacagagtccacgctatcaacgctatctggaagaagaagccaagatactggctggcactccgttgttagtgagttcaatcgaagccattcccccaacatcaaaaaagaaaaatcctctggtcgatgccacatttcatgtgcagcatatgaccatcaatgatattagccgttatgaggctgagttacggaaactcaatttgcttcaacgtagcgatgtttcgcctgatgcaccatcaacgcccgtatcaagagaacagggtaaacagcgattaaccgatattgaactgctgaatgatgatcattcgctatatctgtggctaaacattaaacggctgaccgatgatgaagtcatcgagcacatcaaaatcatgctcccacagtggcgtaaggagtatggcatcacggaaccagagatcggcctatttcgtttcggtctgagcacgattaagaaggtgatctccttgagaatcattcctatgctggatctgatgctgtgggccaatcatcgtggcgtaaaaatttctaatgagcaaatgtcacgtttgctctatccgaatgattcagaggtcattagaggaggcgcacaaattaaggataccgataaaccttttgcggaaaaagcactgacccgcgagtttgcgcggctttttaacctctatctgagtaaagacagctacatgatggatgtcagagttgctgacgccatgaaaatgaacgaaaaagaagaagaaaactaa

SEQ ID NO: 3259 - DNA, 210 bp, Xenorhabdus bovienii
  Coding DNA location: Contig name=SeqID_16888; Position on contig =181064..181273bp; Strand=-
atggcaaaaatcactggtactgtgaagtggttcaacgagtctaaaggttttggttttattactccagctgatggtagcaaagatgtatttgtacatttttctgcaattatgaaagatgggtttaaaacattgtctgaaggccaacaagttgagtttgaaattcagaatggtcctaaaggtcctgcggctgcaaacgtcacagctttatag

SEQ ID NO: 3260 - DNA, 105 bp, Xenorhabdus bovienii
  Coding DNA location: Contig name=SeqID_16888; Position on contig =181345..181449bp; Strand=-
atgtgtgcgttgggttcagcacctgaaaaaaatggcttgcgattatataaagagtatgtgataaaacacatgggtaaacgaagtattggttctgttaatgaataa

SEQ ID NO: 3261 - DNA, 117 bp, Xenorhabdus bovienii
  Coding DNA location: Contig name=SeqID_16888; Position on contig =181874..181990bp; Strand=+
atgtcacagcaagtaataataattattatgcccctttgctattatcggttttttctatcaaatataattgactgtcatttcagtcaacttatattcccgggacatacaatagtatga

SEQ ID NO: 3262 - DNA, 171 bp, Xenorhabdus bovienii
  Coding DNA location: Contig name=SeqID_16888; Position on contig =182036..182206bp; Strand=+
ttgaacgaggaagttagactgagtggcacacattatgttgcgcagactctatttcctgcatcattttccctgttgagtatgatgctggctgtaggaagtttaatgaatctaatcataagaccagccggaaatagatccggccggaagaatactgaaaaaatttaccgttag

SEQ ID NO: 3263 - DNA, 1371 bp, Xenorhabdus bovienii
  Coding DNA location: Contig name=SeqID_16888; Position on contig =182203..183573bp; Strand=-
atggcagaacaagcagaacaatctacgcttaagcgtggtttaaagaacaggcatattcagcttattgccctcggtggtgcagtaggaacgggattgtttttggggattgctcaaaccataaaaatggctgggccttcggtacttctcggatatgccattggtgggtttattgcatttctaattatgcgtcaactgggcgaaatggttgtcgaagagcctgttgctggctcgtttagccattttgcttataaatactggggtgattttgccggttttttgtctggctggaattactgggcaatgttcattcttgtcggaatggcagaattgacggcagtcggcatgtatattcattattggtggccggaaatcccaacatggatttctgctgcaatattctttgtgctgatcaacgccattaacctgattaatgtccggttatatggtgaaaccgaattctggttttccatcatcaaagttactgccattattggcatgattatctttggagcttatttgctcatcagcggcactggcgggccacaggctagcgtagccaatttatggcagtatggcgggtttatgccaaacgggatttccggtctgattatggcgatggccgtgatcatgttttcatttggtggactggaaatggtcgggattactgcggcagaagctgaagatcctgaaaaaaatattccaaaggcaactaatcaggtcgtttatcgaatcctactgttttatattggttcgttgtctattctgctttcgctttacccatggatgaatgtggtagaaggcggcagcccatttgttttgattttcgatcacttggataacttttgggtgtctaatatcctgaatgtggttgtattaacggcggcattatctgtttataacagtggcgtatactgtaacagccggatgctgtatggtttggcaaaacagggtaatgcccctcgcatcctgacaaaagttaatcatcgcagtgtacctgttttatcaataggattgtcggcattggcaacatctataggggtgctggttaactatattatgcccggaaaagcatttgaattgttgatggcgctggtagtaacaacgttggtcattaactggattatgatctgtctggcacatctgaaattccgagctgcaaaaaatgcagaaggaattaagacgaagtttcaggcattttggtatccattcggcaactatttgtgcttaatattccttgcattcattctcgtcgttattctgatgacaccggaaatacgtatctcagttatcctgatgccgttctggattggcatgttatggggaggctacttgttttccaaggctaaaagggcaaaagcgcgagttatctaa

SEQ ID NO: 3264 - DNA, 195 bp, Xenorhabdus bovienii
  Coding DNA location: Contig name=SeqID_16888; Position on contig =183633..183827bp; Strand=+
ttgaacctgaacagggcgagaaattttctcatttcccctaatttctacgcgatttgtcgtgctcaaactaccttaacaattgtagctattggattaagctctgattttagcgcgacatttaaaccaaccccattaagctatcttatttatcactttgaacctagactgtgttcatacgaaagcaatagtttttaa

SEQ ID NO: 3265 - DNA, 144 bp, Xenorhabdus bovienii
  Coding DNA location: Contig name=SeqID_16888; Position on contig =183989..184132bp; Strand=-
atgaagggtttgaattggggatctgttcaattacccgatacctgcctttttgatattcacctcaatcattctcttgcaactatctgtgctaacatacattcgcagtattcattcttgggaaaggatgttttaatattcacctga

SEQ ID NO: 3266 - DNA, 387 bp, Xenorhabdus bovienii
  Coding DNA location: Contig name=SeqID_16888; Position on contig =184409..184795bp; Strand=+
atgccacaagataaccacttagcacttgtatgcgcactgagtaaatggatcgaaaaccaccttggccgagttatccatcttgaagagcttgctgcttattctggctattcgctttggcacatgcagaaaatattcaaggaagtcacggaaatctcgcttggaaagtacatacgccaacggcggttggccggcgctgttcacctgctgagaaacagttccttgtctatttttgatattgccttagatttcggctttggctcccaatctcattttacctatatgttccgtaaagaatatggcattacaccttacgattttcgtcaaagtacagatatagaacttgaggttaagcttccattgcatttgacttataactgccagttatga

SEQ ID NO: 3267 - DNA, 834 bp, Xenorhabdus bovienii
  Coding DNA location: Contig name=SeqID_16888; Position on contig =184906..185739bp; Strand=-
atgataagaaaattaatattaggcgtatgtattacgttgttgattggttgtagtcatcagcctcaacgggaagtcagaaacgattatatcgttgatcactcgcattcttattcgactaagcaaggcatcgattcagcccgatttcttgttttgcattatacggcattgaatgatcaaaattctttacgggtattaaccggaggtaatgtcggtgtccattatctcatcccatctcggccaaaatatgagaataaagaacccgttatttttcagttggcttctgaaaatgaaaaggcctggcatgcagggaggagtgactggagggggtataagaatttaaatagcaattctattgggattgaaatcgttaattgtggttttaagcaacactttatcaaaaaagaatggtgtttataccacccgtcacaaattgatgcattaatccgactggcaaaagatattattcagagatatcaaattgaggctgtgaatgttgttggccatagtgatatcgccccgctcaggaaaaaagaccctggtcctgtttttccgtggcaagcactttatcaacaaggtattggtgcttggccggatctcataacggttaataaatatctggccaacagggtgccgagtatgcctgtgccagtcattggtatacagaaagcgttggttctctatggctattccatgcctcagacaggtcatttggatgaagatacccataaaatcattcaggcgtttcagatgcatttccgcccatcagatattagtggtgttcctgatgcggaaacggaagcgattgctttggcattagtcgaaaaatacaaatga

SEQ ID NO: 3268 - DNA, 117 bp, Xenorhabdus bovienii
  Coding DNA location: Contig name=SeqID_16888; Position on contig =185746..185862bp; Strand=-
atgcccggtttttattggattttaataagcacctctgccagtaaaaaacatcacatctattgtagtcttatctactatatagtcatgatgattctatttttcctccataatcactga

SEQ ID NO: 3269 - DNA, 120 bp, Xenorhabdus bovienii
  Coding DNA location: Contig name=SeqID_16888; Position on contig =185933..186052bp; Strand=+
atgtatatcctttaccttttaaattgctgctttattggtggctttcactcaccccaatcatatagaaagctatattcttggggattcgcttcgctcatttactaccgcgctgcaacttga

SEQ ID NO: 3270 - DNA, 1425 bp, Xenorhabdus bovienii
  Coding DNA location: Contig name=SeqID_16888; Position on contig =186077..187501bp; Strand=-
atgctttgggactacgtattaatatatttactccttggagttggcctttacttcacactgcgcactggtcttatacagcttcgtcattttggacacatgttttcagtcttgaaaaatagtaataagtcagatgattctggcatttcatcttttcaggctttatgtactagccttgcagcacgtgttggaacgggtaacctggcgggagttgcaattgcgattacagctggtgggcctggcgctattttttggatgtgggtagtcgcatttattggtatggcaacttcttttgtggaaagcacgcttgcccagttgtacaagacgaaagacgatcaaggaaattatcgtggcggccctgcctactatatggagaaagggttgaagaagcgatggatgggggtattgttttcagtcttccttattatcgcgtttggtcttgtatttaatgctgttcaggcaaactcaattgcggaagcggctgcttttgcctttcatgtcaaacctatttatgtcggtattgtattagtcattatcagtggcgcgattattttcggcggattgcgttcgattgcgcgggttgcggaattagtcgtaccacttatggctggtgcttatttgttactggcgttttgggttattggtcacaatattgagcgtattccagaagtatttgcattaattatcaaaagtgcctttggccttcaggaagcgatcgcgggaacattaggttatggcatttctcaggcgatgattcagggtgttcaaagagggctgttctcgaatgaagcggggatgggttctgcaccaaacgcagcggcttccgcatcgccatatccgccgcatccggcctctcagggctatgtgcagatgctgggggtatttatggatacgattgttatctgtagtgcaaccgctgtcattatcctgtcttctggtattctcaatgaaaatgtgactgctatcagtggaattgaattgactcagcgggcattatcatcggctgttgggcattggggaacgacattcattgctattgcaatcttcttctttgcttttacatcgattattgccaattatgcttatgctgaaagtaacatgatattcctggagcgtaatcacaccgcaggtttgtttatcctgcgcttggctgcgttaagcatggtgatgtttggttcgttggcagaagtgccattagtctggagtatggcgaacttatcgatggcatgtatggcgattgttaacttgattgctattcttctgctatcaggtattgcgataaagctggctaaggactacaaccaacaaagaaaagcagggcagttgccgacattcgatatcaatatgtatccagagcttcaaaaggaagttgaagaaggcatctgggataataagtcctctcaggacagccagaagtgcagtcattga

SEQ ID NO: 3271 - DNA, 132 bp, Xenorhabdus bovienii
  Coding DNA location: Contig name=SeqID_16888; Position on contig =188003..188134bp; Strand=+
atgtactactcacttttcctccctcccatatactgtcatgttccttatgtagtaataactctatttattaaaaatactaaaataattacaaaatttaatattgaaatttctaagatttacgaaaacatatag

SEQ ID NO: 3272 - DNA, 192 bp, Xenorhabdus bovienii
  Coding DNA location: Contig name=SeqID_16888; Position on contig =188315..188506bp; Strand=+
atgttagagcgaaaaagaaaaaaccccgcagacaacattctgcctaaacgggtttatagaggaaaatcaaaatacgagtatcacccagcaacaggcggttcgatctctatctgttgtttaagttcaccagtatccgttgtttggaaagaatacaacaaggttgtagaaaaaattgaaaaaaacagcacgtag

SEQ ID NO: 3273 - DNA, 519 bp, Xenorhabdus bovienii
  Coding DNA location: Contig name=SeqID_16888; Position on contig =188898..189416bp; Strand=+
atgttgaaacgaacaatagccaatggagtattgcttatgtatttgtgtaagatactaaaaattgctgttatccctgctctaatcgttctatcactatcaaccccagccctcgcaaaagacggagcattgattagtttacctgataagagatttgccgtcatatcagttagcgatctggaaagtgaatcaattggcagctattctatcgctgttttcaaggatcgggatctgacggaattcgaaaccggagctgttttttcccgtgatggtttggtgttcgaagataacaataagccaagagtgacatttgcagatattaacggtgatggtgccaaggagttgattgtgtacaaacttacggcaggctctgggaattatcttgaagttgatgcactcaagataacagataaaaatgtcaaattcctcgcccgaatcaatacagatagtaaacatgacccaattcagttactccgcaccctgtgtaaaaaaggccagtgcacaggtcagctgcaccattaa

SEQ ID NO: 3274 - DNA, 372 bp, Xenorhabdus bovienii
  Coding DNA location: Contig name=SeqID_16888; Position on contig =189528..189899bp; Strand=+
atgaaacgtcttttactaccccttttccttgtcccattcttctcttatgccgcacatatgaatgcagataaaacagcggaaacctattgtgatttatttggaaaagcctctgtagaagcattcaagaccaatgcctcaccagatgccatagctcaaaaaacctttaatgagttgaacaagaagggattcgatcttaaggaaatccatagcaacaaggatgaattaatttcctctatcaaacaaacagtcatagaagtcagaaagaataaacaggtatttccaagccataaacattttgatgaatcattagataaatccgtcaaaacctgcaagactcaaataaaaaataccttatctcaaggtactcaataa

SEQ ID NO: 3275 - DNA, 618 bp, Xenorhabdus bovienii
  Coding DNA location: Contig name=SeqID_16888; Position on contig =189943..190560bp; Strand=-
atgatattgttgcagatttccgctgctcaggggccagatgaatgtgcgctggccgtcagaaaggctttggaacagttgatccatgaagccgacgaattaggtgttatggctgatatattggaggaggaggcagggcggcgttctcatacattacgctctgtgatggttgctattcagggcgaaaatgaacagcagctttttgagcgctggaacggtactatcaaatggatttgtgcaagtccgtggcgaaaaggagacggccgcaaaaactggtttatcggtgtggcgcagtttaaacctttacagcaaatgatggaaagtgaaatccgttttgaaacgctaagagcctcaggtcctggtgggctgcatgtcaacaaaacagaatcagcgattcgggcagtgcatattgctagtggaatcagtgtcaagatacagtcggagcgaagtcagcatgctaatcggcggcttgcttgcttgttgttggagcatcggctacagcaacagcaagatatgcatcaggctcaacttaaggctgaacgacgtttatttcacaaccaaatagaaaggggtaatcctgtacgtacctttgcaggtatgcagtttaatccgcaaatttga

SEQ ID NO: 3276 - DNA, 1122 bp, Xenorhabdus bovienii
  Coding DNA location: Contig name=SeqID_16888; Position on contig =190557..191678bp; Strand=-
atgggcaatactttgcatttagctgcgtctcgcgttcagattatcgcagcagaaaatacttggctggaaggtaaagctatccagcaacttgaaacaacagcacaactccctgatatggtaagcgtcgttggtctgcctgatctccatccgggcagaggatatcccgttggcgctgcatttttttcacattcacgtttttatccagcccttattggcaatgacattggctgcggtatggcgttgtggcgaacagatttgacactgaataaatggtcgctggacaagctggaaaaacggcctggttctattgataatcctctgcaagcagcagagttgcctgatgatatacctgagcatttttgttattcaccgggaacgattggtggtggcaatcattttgctgaattgcagcaactggatgaaatttatcagccggaaatgctcgaaacatggcaattgaataagcaacagctcttattattggtacatagtggttcgcgcgggttgggacaagttattcttgaacagcatgttcgcgaacatgggcataatgggctgatagcctccagcccggaagcacagagttatcttcaactgcatcagcaagctctggactatgcttgttttaaccgccagttaattgcagagcggatgttaaaacgctggcgaactcatggaagttgtttatttgatgtttcacataatatgcttatgccatacacaattggcggtgttgatggctggctgcatcgtaagggagcaacaccttctgatcaaggagccgtaattattccgggatctcgaggggattacagctacttggttcagccactgaccagtgatcgcagtctcttttctcttgcacatggtgcggggaggaaatggatgcgtggtgagtgtaaagcacgtttaactgggcgttataacgcagaacaactctctcgtaccgcatttggcagtcgtgtgatttgtctggataagcaactgatttttcaggaagccccagaagcttataaacctataggcggcgtgatggatgctatgctgcaagcgggtttggtgaaattgatagcgcggcttaagcccgttctgacatataaaacgcggggtaacaaggaatga

SEQ ID NO: 3277 - DNA, 192 bp, Xenorhabdus bovienii
  Coding DNA location: Contig name=SeqID_16888; Position on contig =191820..192011bp; Strand=-
gtgatcactatagatatagtcatttatgaaaatagatggctatatctttttgtaataatagaatatgccctatcagcaactattacttgcgggcagatgagattaaataaaacaccggtaatggctataagacttagagtaagatgcagcgtctgtaagtacagatataagctaaaccccattaataactga

SEQ ID NO: 3278 - DNA, 738 bp, Xenorhabdus bovienii
  Coding DNA location: Contig name=SeqID_16888; Position on contig =192056..192793bp; Strand=-
atgagaaagataataatgctttttacgttactatttacatcggttaatgttaatgctcaagtattaaatgagaataatccggacaagtacaagaaattcaggctggattatgtggagatggtcgatctggctaacccacaaaggctatcgtatagagttttttatgaagagccttctaccggagaaaacagcaagtggtttgatgctattaagcaaggtgattttgaaaccgtcaaaaaaatggttgagagtggtcaggatattgaagccaaagacaccggtagcttaaatcaaactgcactgggttgggctacctttattggttatgaagatatagtggattatttaatatcaaagaaagctaatttgtgggcgacagacacaagggatgttcatcataccttaaaatcggcagttttaggtaaaaataccaacatagtgaagaaaatacataatttaatgaagcatgaacttgatttaaatgatcaaactattgaagatgacggcgaaacaccggtaatgatcgcagcaagcaataatagaattgagatagtaaaatatctgattgagcagggtgcgaatctgaatttatttacgataacggatgataaaagtatgtattcttatgatcaaagcgcattaacctatgcctgtgagcgtaatttagaagaaatgcaaaaattactcattaagcacggggcgttaaatcacaaaacacataagccatcatgtaattaa

SEQ ID NO: 3279 - DNA, 1050 bp, Xenorhabdus bovienii; identical to SEQ ID NO: 2546
  Coding DNA location: Contig name=SeqID_16888; Position on contig =193030..194079bp; Strand=-

SEQ ID NO: 3280 - DNA, 267 bp, Xenorhabdus bovienii
  Coding DNA location: Contig name=SeqID_16888; Position on contig =194017..194283bp; Strand=+
atgcatcaattcgagggcttctttttgggcatctgtcagattaattttcatgagcgcgatcatgatctgatacaaatgaaaaatcaagcatcttcaatgacgacggatatatatcataatttaaccggagataaatctgttttaaggaaaagtttgagtggaattttggtaaacgaatctcttatctcaataaatcaacggaagctatcaggcgttcaaaatcgtaagtcacaatcttggcagcaatcgccctttccgttcccttaa

SEQ ID NO: 3281 - DNA, 120 bp, Xenorhabdus bovienii
  Coding DNA location: Contig name=SeqID_16888; Position on contig =194292..194411bp; Strand=-
atgaaatcccattataaatgtcatgaatatatcagagtcactcaccacagcccattattgattattgaacctgttccgtttgccattgctcctgaaaacttcaccgtgttcaccaattga

SEQ ID NO: 3282 - DNA, 255 bp, Xenorhabdus bovienii
  Coding DNA location: Contig name=SeqID_16888; Position on contig =194388..194642bp; Strand=+
atgacatttataatgggatttcatgaaggattatatatggcggaagtagtaaaattcataaattcgcttttttgtgattatgtttttctatttggttttttttggtgcatttctgttcctatagggctgatttttacagctatggcatgtgtattcaaaaaagcaacctacagaattttatgttcaatattggctatattctttttatttccaccaatattcgcgtttattatttcctgtaaacatgaaaaatag

SEQ ID NO: 3283 - DNA, 93 bp, Xenorhabdus bovienii
  Coding DNA location: Contig name=SeqID_16888; Position on contig =194632..194724bp; Strand=+
atgaaaaatagagatggaattaccgaatgtcagttcccaggtgtggtcataatgaaagcatggggattcgattattttcagaaaccccattga

SEQ ID NO: 3284 - DNA, 1248 bp, Xenorhabdus bovienii
  Coding DNA location: Contig name=SeqID_16888; Position on contig =194734..195981bp; Strand=-
ttgaagacggaacaaaagtggattcatgaatacaatatttggttttatgcactattcggaacggcagtaggtgcaggaaccctgtttctccctatacaattaggactatccggaccacttgctatgttggttatgctattgatagcattcccatttacctattaccctcacctaggtcttgcacgttatatcattaccagcaattccccttctcccacattactcagtgcaaccaaacaatattatgggatcaggatagctcgtatcatcaactttttttatgcactaactttcctgcttattatttttgtttatgcaatatctattaccaattccgttaatattttgttgcagcaattttggcagattcagtttccacgaacactaacagcgtttatggtagttttagggttacacctaattttcttattgggtaaaaaaatcacactgaaattcatgggcgtgttagttcttccactcattctttacctgctgacattatctgtgacgcttatatttcaatgggatagtgcaaacattaaacatctcatcagcaatattcatattgatctggattcagtgagagcactttggttactaatgccagttatggtattctctttcagccacaccccaattatgtctactttttctaaccactgtaaacgagcctataaaacagatgcggaataccacattaaacagattgtgaaacccacttatgcgctaatctgcatagtcattctgttttttgtatttagttgtgttttaacgttatcacctcaggaaatacaggcaactaaagacaacaatattaccattctcagcgcgatcgcgcagaaagagggcttgtactggatagcaataacggcaacccctgttgctatcattgctatgacaaaatcattcttaggaacttattttggagcattggagggagtcagaggattagtcggagcattggagagtaaaattctccatcataaagaaaataaagtgcgtgataagttgatcggcatggctattgtttttgtccttactttaatgattactatctggaatccgaatactctgaaagttatcgcaggcatcactggacctatgattgcgcttattttgtttgttttaccgtctctatcaacgtacttggttgaaccactacgcccctatcgttctttttctaatttgatggttctattagtcggtcttggtagttttggtattgctgtttttagcctttttagctga

SEQ ID NO: 3285 - DNA, 264 bp, Xenorhabdus bovienii
  Coding DNA location: Contig name=SeqID_16888; Position on contig =196020..196283bp; Strand=-
atgggcgcgcgggatgaaattaccaaaggtatgcagagcagctttgataagctcaatgaaacgtttggtaaaaaactaccgcaacggctggagataacagaagcatcttttgatgcactggataaaaggctcaaggcagcttgtgacagactggaaaacgttaacagccgactgcaatatcggtttattgcatggcttgcagtgagtgtggcggtggttggcacactgtttttcctgaaaagatttatctttatcctggtttag

SEQ ID NO: 3286 - DNA, 147 bp, Xenorhabdus bovienii
  Coding DNA location: Contig name=SeqID_16888; Position on contig =196452..196598bp; Strand=-
atgcagcttcgtgagaactggcagaatacctgcaaccagcattttgaacgtgcacagcgcccggaacgcatcgcggaagaaatccagaaagcgacaaaggcactgatcgtcgccggcagtcagactcgcgatgaaaagctacggtaa

SEQ ID NO: 3287 - DNA, 102 bp, Xenorhabdus bovienii
  Coding DNA location: Contig name=SeqID_16888; Position on contig =196618..196719bp; Strand=-
atgatgctattcgcagtgactctgaatagtatttccgacgttataaccccaaaaatcctgaatacgaggctgtcagaaagcctattccgggctgaccattga

SEQ ID NO: 3288 - DNA, 114 bp, Xenorhabdus bovienii
  Coding DNA location: Contig name=SeqID_16888; Position on contig =196716..196829bp; Strand=-
atgcagaaggcgcgcttaatggggtttgaagcgttaatctattcacgtttccacctccgtagacggaggggagcagctacactgtcaccagatgttttctgtccgcatcaatga

SEQ ID NO: 3289 - DNA, 150 bp, Xenorhabdus bovienii
  Coding DNA location: Contig name=SeqID_16888; Position on contig =197049..197198bp; Strand=-
gtgagtaataatagaaactattggggaacatcttttgcctgcgccgctttcgcatactccataattaaatttgcgtgtttgtgtggtttagatcttaaccttggtgataattatgacgtatattatgaaaataacttaaactcgttgtaa

SEQ ID NO: 3290 - DNA, 162 bp, Xenorhabdus bovienii
  Coding DNA location: Contig name=SeqID_16888; Position on contig =197263..197424bp; Strand=-
ttgtacaccgaaattcccctgcaaaacggattaaaatttgaacgctatttctcggctaaaataatccagtctttgcctcggtcatcgtggtatttatccgggttctgttgcattaaggtgaagtcaggtaatattctgtcttttacgcttgctgtgagctga

SEQ ID NO: 3291 - DNA, 1254 bp, Xenorhabdus bovienii
  Coding DNA location: Contig name=SeqID_16888; Position on contig =197477..198730bp; Strand=-
atggaaagcaaagtagttgttccggcggaaggtaaaaaaattactattgatgccaaaggtaaattaaatgttccgaataacccggtaatcccttatatcgaaggggatggcattggtattgatgtaacgccggtcatgctgaaagttgttgatgctgcggttcagaaagcttacggcggtgagcgcaaaatttcttggatggaaatctacaccggagagaaatctacccaggtttatggcaaagatgtctggttgccagaggaaactctggatctgatccgtgactaccgtattgctatcaaaggccctctgacaacacctgttggtggtggtattcgttctctgaacgtggccctgcgccagcaattagatctatacatctgtttgcgccctgttcgttactatcaaggtactccaagcccggttaaacaacctgaattaaccgatatggtcatcttccgggaaaatgctgaagacatttatgctggtattgaatggaaagcaggctcagcagaagcggataaagtgatcaaattcctgcaggatgaaatgggtgtcactaagatccgttttcctcagcaatgtggtatcggtgtgaaaccatgttcagaagaagggactcagcgtctggtacgtgctgcgattgaatatgccatcgataacgatcgtgaatcagtgactttggttcacaaaggcaacatcatgaaattcactgaaggcgctttcaaagactggggttatgaactggctctcaccgaattcggcggtgaactgctggatggtggtccatgggtgaagatcaagaatcctaagagtggcaaagacatcatcattaaagatgtgattgcggatgctttcctgcaacaaatcctgctgcgtccggctgagtacgatgttatcgcttgtatgaacttgaacggtgactacatttctgatgcattggcggcacaggtaggcggtattggtattgcaccaggggcaaatatcggtgatgaatgcgcattgtttgaagcgacacacggtactgcacctaaatatgctggtcaggacaaagtgaacccaggctctgtgattctctctgctgagatgatgttgcgccacatgggatggtttgaagctgctgaccttattattaagggaacggaaggggcgattgctgccaaaaccgtaacttacgacttcgaacgcctgatggaaggcgctaagctgctgaaatgtagtgagttcggtgatgcacttatctctcatatgtga

SEQ ID NO: 3292 - DNA, 684 bp, Xenorhabdus bovienii
  Coding DNA location: Contig name=SeqID_16888; Position on contig =198818..199501bp; Strand=+
atggtcacagatttaaggtacaatacgcaccctcattttgcgcgatggcttatcatgacaaatatctcttttaaaaaacgtaaacttaaccgattcagccaaagaaaaaataaagatactataaaaaaattaacaggccctcgcagggtactgatctttaacaaaccttatgatgtgctcccacaattcaccgatgaaatggggcggacaacgttaaaggattttatcccatttcttgatgtttatgccgcaggtcgtctggatcgcgatagcgaagggttgctgattttaaccaacgatggaaaattgcaggccaagttgacgcagcctcataaaaaaacagctaaggtttattatgttcaggttgaaggaattcctgatgagagcgctctgaacaagctacgcaacggcgtcacattgaaagatggcccaacactttccgctggggccgagttggtagaagaaccagaatggctctgggaaaggattcctcctattcgggaacggaaaagtattccagtaagctggcttaaaattaccctttttgaaggccgcaaccgtcaggtacgcagaatgaccgctcatgtcggttttccaacattgcgcttaattcgtttcagtatgggttcgttacaattggggcagctatccccaggagaatggagagaaattgattttgtttaa

SEQ ID NO: 3293 - DNA, 453 bp, Xenorhabdus bovienii
  Coding DNA location: Contig name=SeqID_16888; Position on contig =199494..199946bp; Strand=+
ttgtttaatccacacgtcacagttgcctgcattgtgcatgcaaaaagcaaatttttgatcgtcgaagaattcattaatgagattcccctctggaaccagcctgcgggtcatcttgaagcgggcgaaacgttgctggaagccgctgaacgcgaattatgggaagaaaccggcattcgtgccaagccacaggcattattgaaattacatcagtggaacgcccctgatggtacgccttttatccgttttctgttcctgattgaaatggaacaaatcgtagataccgatccacaagataaagatattcactgctgccactggctaaatgcagaagagatcctcagcagcccacagctacgatcaccgctcgttgctgaaagtatccgctgttatctggaaaatcaggcttacccgttatcaatattggatagctatgggtcacctttcaccaaatga

SEQ ID NO: 3294 - DNA, 231 bp, Xenorhabdus bovienii
  Coding DNA location: Contig name=SeqID_16888; Position on contig =199816..200046bp; Strand=+
atgcagaagagatcctcagcagcccacagctacgatcaccgctcgttgctgaaagtatccgctgttatctggaaaatcaggcttacccgttatcaatattggatagctatgggtcacctttcaccaaatgaacttttaaataagaagccgaataagaaagcgcgcgaagacgtttggtgcaccttatctaccgacgtgttaaagtattgcgcttgtttttttccgcagtga

SEQ ID NO: 3295 - DNA, 1104 bp, Xenorhabdus bovienii
  Coding DNA location: Contig name=SeqID_16888; Position on contig =200056..201159bp; Strand=+
atgttagataacagccagaaaaaagtcattgtcgggatatccggcggtgtagattcatccgtttccgcctaccttctgcaacagcagggttatcaggtagctggtctgttcatgaaaaattgggaagaagacgacggtgaagaatattgctcggctgccgctgatcttgcggatgcccaggcagtttgtgacaaactgggcattgagctgcataccattaattttgcagccgagtattgggataatgtgtttgaacatttccttgctgaatataaagcgggcagaactccaaatcccgatatcctctgtaacaaagagattaaattcaaagcatttctggaatttgctgctgaggatttaggggctgattacatcgcaacaggccattatgtccgccgtcgggatgtggatggtatcagccaattgctccgtggactggatgacaataaagatcaaagctactttttgtataccttgagccaccaacaaattgctaaaagcctgtttcccgttggggagctggaaaaacccgaagttcgccgcattgctgaagaaatcgggctggtaaccgccaagaaaaaagactctacaggcatttgctttattggtgagcgtaaattccgcgattttctggggcgctacctgcctgcccagccgggttctatcattacagttgatggacagaccatcggtcagcatactggtctgatgtaccacacactcggccaacgcaaaggattggggatcggtggaaccaaagatggcagcgaagaggcatggtatgttgtcgataaagatgtcgaaaacaatacgctgattgttgctcagggtcatgatcatcctcgtctgatgtctgtcggtttgattgcacaacagcttgattgggttgatcgtcagacattaaaaacagaaattcgctgcgtagtaaaaacgcgctatcgtcagcatgacattccctgcactgtcatccccttgagtgaagacaaaattgaagttcgttttgatagccccgttgccgctgtcaccccaggtcagtcggccgtattttatcagggggaaatctgtctaggcggtggcgtgatcgaacaacgtatacaggagtag

SEQ ID NO: 3296 - DNA, 627 bp, Xenorhabdus bovienii
  Coding DNA location: Contig name=SeqID_16888; Position on contig =201162..201788bp; Strand=+
gtggctaaaaattattatgacattacactggcactggcaggtatctgccagtcaggccatctggttcagcagcttgcccatgaaggccagtgtgatgccgatacttttgaagtgatgatcaacagtatcttgaacatgaatccggcatccacacaggatgtctttggcaacgatgcctgcaacctgcgcatcggccttgatgctatgttgagcatgttcaacaacactcgcagtggagtctctgccggccttacccgctatatgttgagcctaatagtattagaacgccgacttagcaaaaatcaggcggcagctaatgaactggctaatcgcattaaccagctagagcgtcaacaaacctactttgaacctatgtcagagggtatcctcaacgcccttgcgggtatctatgtcgatgttatcagcccattagggcctcgcattcaagtcacgggttcacctgatgtattacgcaatacgctggtacaggcgaaagtccgagcagcattactggcaggtatccgcagcgccgtattatggcagcaagttggcggcagtcgcctgcaaatcatgttttctcgtcagcgcctaatccgacaggcaaaagacattcttgatcattgttaa

SEQ ID NO: 3297 - DNA, 1371 bp, Xenorhabdus bovienii
  Coding DNA location: Contig name=SeqID_16888; Position on contig =201812..203182bp; Strand=+
atggaattatcctcactgaccgctgtttctccaattgatggtcgttacggcgacaaagttagcgcactgcgcgctatttttagtgagttcggcttactgaaattccgcgtgcaggttgaagtacgttggctgcaaaaactggccgccacaacagaaattaaagaagttcctgcgtttgatgcaagcgcaaacgcttacctgaatgaaattgtcgcaaatttcaatgaacaggacgcactgcgcatcaaagaaattgaacgcacaaccaaccatgacgttaaggccgttgagtattttctgaaagaaaaagtggcgcatattcctgctcttcatcaagtctctgaatttattcattttgcctgcacatcagaagacatcaataatttgtcgcatgcattgatgctcaaaaccgcccgtgaagagattatactgcctcaatggcgtcagttgatcgacactatcaagcgtatggcccacgactaccgtgacttacctttgttgtcacgtacacacggacaacccgccaccccttctactgttggtaaagaattggctaacgtagcttatcgtatggagcgccaatttcgccagtttgggcaggttgagatcctaggtaaaatcaacggtgctgtcggcaactacaatgctcacctgtctgcctatccgcaggtggattggcaccagttcagcgaatcattcgtcacatctctggggattcagtggaatccatataccactcaaatcgagccacatgattacattgcggaactgtttgattgtgtagcacgttttaacactatcctactggattttgatcgtgatacctggggttacattgccctgaatcatttcaaacagaaaacagttgctggtgaaatcggctcttctaccatgccacataaagtcaatccaattgattttgaaaattctgaaggaaatctgggattggcaaatgctgttctggggcatcttgccagcaaactacccgtttcccgctggcagcgtgatctgacggattcaactgtattgcgcaatctgggtgtgggtttggggtacgcgctaattgcttatcaagccaccatgaaaggtctgaataaattggaaatcaacgaacagcacctgttagatgagctggatcagaactgggaagtgctggctgaacctatccaaaccgtcatgcgccgttacagtattgaaaaaccctatgaaaaattgaaaaaactaacacgcggtaaacgcgttgatgccgaaggtatgaaaaccttcattgatggccttgagcttcccgaagaggaaaaatctcgtctcaaatccatgacaccagcaaactacattggctatgccacttcactagtcgatgaattaaaataa

SEQ ID NO: 3298 - DNA, 156 bp, Xenorhabdus bovienii
  Coding DNA location: Contig name=SeqID_16888; Position on contig =203174..203329bp; Strand=-
atgaaagtgacttttaaaaacaagggattagaattggtgggagtagataactttgcttttatttatgttttatgtaatttttcgcatgctttttttcccctatggacaggaaaatttcctgtccatagggggatatatgaaaaaattttattttaa

SEQ ID NO: 3299 - DNA, 684 bp, Xenorhabdus bovienii
  Coding DNA location: Contig name=SeqID_16888; Position on contig =203481..204164bp; Strand=+
atgcgtatactcattattgaagatgaggcgatacttcgccatcatttgacagtacagctccaagaactcggtcatcaggttgatgcggctgaaaataccaaagaagctgattattatctgaaagaaaatcatcctgatattgctatcgtcgatctggggttacccggagaagatggcctcagcatgatacggcgttggcgcagcgatcaggttaatttaccgatcctaatcctcacagttcatgacagctggcaagaaaaggtcacagtactgaatgctggagcagatgattatgttaccaagccttttcgtctggaagagattaacgcgcgcatacaggcattaatgcgacgtcatagtgggctagcatctcaactcgttgaattatcgccattcttaattgatctctctcgcaaagagttttcagttaataaaaacagtatcaaattgactgcattcgaatatacgattatcgaaactctgatgcgtaataatggcaaagttgtcagtaaagaatcactgatgcgccagttataccctgatgctgaattacgtgaaagtcatacaattgatgtattaatgggacgcttaagaaaaaaaatatcgaatgagtggtcagacgaagtcattgttacagtccgaggccaagggtatcgtttcgatgtaaaacaacatgatatttaa

SEQ ID NO: 3300 - DNA, 1461 bp, Xenorhabdus bovienii
  Coding DNA location: Contig name=SeqID_16888; Position on contig =204154..205614bp; Strand=+
atgatatttaaattttcgaaaaagcatatttcactgagaactcgatttctcatggcgacgtcggccattatccttgcgctgacgctgtcatatggccttgtcgccattatcgggtatttagtgagttttgataaaacaatttactccatactccgtagccaaagtaatttatttagtaccttggctaaatgggatggtagcaagctggttattaaaattccctcaaatttatccatgactaatcgctccctggccctgatttatgacaatcaaggtcgtattctctggcgccaaaatcatacgccagaattggaaaaaaaaattcctgaggaatggctgaaaaaagatggtttgcatgatttatctatctcttttaaagaaaaggaaggttttctctaccctaaaacatcgactcagtcagacaattcaaccaaaaccgacgggatcgataatgatgagtcattaacttattctgtagcagtcaactcttatgctaagaccgataaactgcctgcgatgacaattgttattattgatactatcccacaagatatgcagagttcagtgaaagtctgggcatggtttggatatgtattgcttgccaacctgattttaatcatcccattaatctggcttgctgccgattggagtctgcgtccaattaaatcggtaattacccaaataagctctctggaaagaggtgaacgtgaaaaattggatgaagagccccccaacgaattaaaaggtctggtcagaaacctgaatgcattattaagcaatgaacgtcgacgttatactagatatcgcacgacactttctgacttatcacatggcctaaaaaccccattagccgtgttgcaatctaccctactttcactgcgctcaggtaaacagatgtccattacacaggctgaaccaatcatgcttgagcaaatcaaccggatgtcccaactagttgactactacctacgtcgtgccaatatgcacagcgatcataacctacttttgagacagacttcttccgtctcaattttgctggatagactgatcatcgcactgacaaaagtttatcagtacaaaggggtcgatattacactggatgtttcttccgaaatcacttggttaggcgaaaagaatgacttcttggaagtgatgggaaatgttctggaaaatgcctgtaaatattgtctggagttcgtcgaaatcaccgccttaatgggcgataattctgtcactatcattgtcgatgatgatggcccaggtgtaccgccagaaaaacgcgacatgattttcgagcgtggtctacgtgcagatacattacgttctggtcaagggttagggctgtcaattgctgctgaaattgtcgtgcaatatgacggaagcatcagcgttgaagatagcccacttggggggactagggtaaatgtagtattccgctcacagcaaagctgtgaatactga

SEQ ID NO: 3301 - DNA, 1158 bp, Xenorhabdus bovienii
  Coding DNA location: Contig name=SeqID_16888; Position on contig =205675..206832bp; Strand=+
atggccggaaattcacttgtcactcaggatgtcaccatggattatcagctaaatctggactggcaatcgtttttgcagaatcattggcaaaaacggccactgctgattaagcagggtttccagcaatttatcgatcccctttctcccgacgaactggcgggactggcgatggaaaatgaaatcgatagccgtttggtcagtcagaaaaacggtcgttgggaagtttcacatggaccatttgaaatttatgaccatttaggcgaaaaagactggtcattacttgtacaagccgttaatcactggcatcttccttcttctgccctgatgaaaccatttcgcatgctgtctgactggcgaatggatgatctgatggtctctttctctgttccagacggtggtgtcggccctcaccttgaccaatatgatgtgtttatcattcaggggcagggacgccgtcgctggcgtgtcggcgaaaaaataccaatgaaacagcattgccctcaccctgatttattacaggttgatccttttgaggcaatcattgatgaagaaatgttgccaggggatattctttatattccccctggattcccgcacgaaggctacgctatcgaggattcactaaattattccataggcttccgcgcacccaatgcccgtgaactcttcagtggttttgctgattatattctggcaaatgaattgggaagccatcgttatagcgatccagagctggcattgcgtgataatccagcgctaattcagtcaaatgaactggacactctgcgaataatgatgcgtgatctgctggaacaaccagcaactttccaaaattggtttggcgaatttatctcccaatcacgccatgagttggacattgccccaccagaacccccttatgaaagcgatgaaatttatgaactgctgaagcaaggtgaaagtttgaatcgcttaagtgggttacgcgtcctgcgagttggtgatcaatgttttgtcaatggcgaattaatagatactcctcatatccatgccgctgatgcgctttgtcagcatgatcgagtggatgcgggtattctgggtgatgccattgatgatgttcgttttatcagcctactagcggcattggtcaatagcggttactggtattttaatgattaa

SEQ ID NO: 3302 - DNA, 1074 bp, Xenorhabdus bovienii
  Coding DNA location: Contig name=SeqID_16888; Position on contig =206873..207946bp; Strand=-
atggcaacgttgccatccaatgttgcctggtctgtacctgtcatcggttttatttcacatctcgatacttcgccggatttctctggtaagcatgttaatccgcaaatcttggaaaactatcgagggggggatattgccttggggataggaaatgaagtgctgtcgccagtcatgtttccggtattgcataatttattgggaaaaacattgattatggcggatggaaaaactttattgggagcggatgataaggcgggcattgctgaaattatcacagcgatggtgcgcttgaagcagcaaaacattccacatggcgatattagggttgcattcacgcccgatgaagagattggcaaaggagggcactcttttgatgtagaagcttttggtgctgaatgggcctataccgtggatgggggtggtgtgggtgagttggagtttgaaaacttcaatgcagcgactgtgactatcaagattgtcggtaatgtggtccatcctggcagcgccaaaggggtgatggtcaatgcatcttctctggcaatgcgcatccatcatgcactgccagtggacgaaacacctgaacatacggaaggatatgcaggtttttatcacttgcagagtgtaaaaggtacggtggaacgtgctgagatgtattaccttgtccgtgattttgaccgtgataattttgaaaaacgtaaaaacacgctatgcgctattgcggaaaaggcgggaaaaggactgcacccagattgctacattgaactgacgattgatgaccgttattacaatatgtacagtgaaatgatgaaacaccctcatgttattgccattgctaaacaagctatgctggattgcgatattgaaccgataattcagcctattcgtggtggtactgacggagcacaactgtcttatcgtggtttgccttgcccgaatatttttacgggtgggtataattaccatagtcggtatgaatttatttcactggaaggaatggagcaggcggtaagtgtcatcatgaggattgctgaactgacagctatccgtgaaaacaattcattatttgacatatag

SEQ ID NO: 3303 - DNA, 159 bp, Xenorhabdus bovienii
  Coding DNA location: Contig name=SeqID_16888; Position on contig =207960..208118bp; Strand=-
atggacagattattagagcgtttttttgaatatattgcgtttgatactcaatcaaaaccatcagctaaagccgttcccagcagtaatggtcaactgaaactcgccaaagcactgcatgatgagttgactcagcttggtttttctaattacactgaatga

SEQ ID NO: 3304 - DNA, 831 bp, Xenorhabdus bovienii
  Coding DNA location: Contig name=SeqID_16888; Position on contig =208186..209016bp; Strand=-
atgcgtgttcgtcatcggtttggtaagttttgcaagattaaacgattgcggtgtcagcgattaaatagaaaaaatttttacagggatattcgattggcaaataaaataaaaaggcctcatgtggtcgtactgacgggggcgggtatctccgctgagtcaggcattcgaacatttcgctcttctgatggcctgtgggaagaacatcgtgttgaagatgttgctacgccagaaggtttccaacgtgatgctgaattagttcaggcattttacaatgcgcgtcgaaaacagctccagcagccggaaatccagcctaatgccgcgcattatgccttggtagagctagaacagcaactgggggataattttctgctcgtgacacagaatatcgataacttgcatgaacgagcaggaagtcgtcgtgttttgcatatgcacggtgaattgttgaaagcgcgctgttgccagtctggtcaggtgattgaatggaagaccgaattgacaacggaagaccgctgccattgttgccagtttccttctccactgcgtccccatgtcgtatggtttggtgaaatgccattgggtatggagcagatttattctgctttagcggatgctgatctttttattgccatagggacgtctggtcacgtttatcccgccgcaggttttgtgcatgaagctaagttatctggcacacttactattgagttgaatctggaacccagtcaggtcgaaagcctatttgatgaaaaacactatggtcatgccagtaaaattgtcacgcaatatgttcagtcattacttcagcagatgaaggcggataaaagctga

SEQ ID NO: 3305 - DNA, 1248 bp, Xenorhabdus bovienii
  Coding DNA location: Contig name=SeqID_16888; Position on contig =209183..210430bp; Strand=-
atggcgaatttgcctcttgcattatttaccgcattacggtttagccgaggtcgtcgtcgtgcaggaatggtttctttgatttctgtcatttcgacattgggtatcatgcttggtgttgcagtgctgattatcggcttgagtgctatgaacggttttgaacgagaactgaaaaaccgggtgctttctgttgtaccacatgggcaggtctacgcggtagaacagccttttcagcattgggaacaggcacttgagcgcgtaaaacagacagcgggtattgttggtgtttccccttatattgaatttaccggattgatggagaaaggtgaaaaactccacgctgtacagatacgaggtgttgagccgaccaccgaagctgatgtcagtgctttgcctcaatttgtcggtgatgatgcatggaaagtgtttcatgctggcaaacatcaggtgattttagggcagggtgtggcgaattcgctgcatgtgaaacaaggtgactggctgacggtcatgatccccaatagtgatccgagtttgaaacttttgcagccgaaacgcattcgcctacaggttactgggattttccagttaagtggcatgctggatcatcgtctggctttggttcctttatccgatgcgcagcaatatctggattatggtcatgctattacggggattgccatcaaagctgataatgtttttgccgcagaacagcgggttttggatgcgggtaaggcgacagaaaaatatgtctatatcagtacatggataaaggactacggatatatgtacaacgatatccagatggtacgcggcatcatgtacctagcgatggttctggttatcggtgtggcttgctttaatattgtttcaacgctgattatggctgtgaaagacaaaagcagtgatattgctattttgcgtacactgggagctaaagatggtcatatcagagcgatttttttatggtatggattactgactggcatggtcggcagcgttattggcacgatggctggcatcctcacatcgctgaatctgacgactattattaaagggctggaaaaactgctcggtcatcaattcctttctggtgatatctattttattgattttctgccatcagaattacatgctatggatattttctatgtcctgttaacggcattgatattgagtctgttggccagttggtatccggctcgtcgggccagtaaacttgatccagcacggattttgagcggtcaataa

SEQ ID NO: 3306 - DNA, 702 bp, Xenorhabdus bovienii
  Coding DNA location: Contig name=SeqID_16888; Position on contig =210430..211131bp; Strand=-
atgagtaatcaacccttattgctgtgtcatcatctgtgcaaaaaatatcaggaagggcaggtttccacagaagtgttaaagaatgtcactttttccatacggcagagagaaatgatggcgattgtcggcagttcgggatcgggtaaaagtacacttctgcatttgcttggcggactggattcgcctacgtccggagaagttctttttaaagggcgatcattgaatgaaatgtctgcctctgtacgagccgagttacgcaacagtgaaatcggttttatttaccagttccatcatctattgcctgatttcagtgcgttggaaaatgttgctatgccgttattgattggcggtaaaaagcgccaggcttcacaaaaagcgctggagatgctggcggcggttgggttggaaaagcgggcacaccatcggcctgctgaactgtccggcggtgagcgccagcgtgtcgctattgcccgtgcattggtgaatgaaccatcactggtgctggcggatgaaccaacaggcaaccttgaccagcgtaatgctgacagcatctttgaaattttgcaggaattgaatcaacgtcaagggacggcgtttctggtggtgactcatgatctgaaacttgctggccgattggctcgtcaggtcgaaatgcgcgatgggtttttacaggatgaactcgttctggtgggagagaggtaa

SEQ ID NO: 3307 - DNA, 1164 bp, Xenorhabdus bovienii
  Coding DNA location: Contig name=SeqID_16888; Position on contig =211124..212287bp; Strand=-
atgcgcggacgagcggtcgataaattcggccgttttgtctcttggttatcggccattggtattacgctgggtgtggctgcactgattactgtgctgtcagtcatgaatggttttgaacgttcattggaaagcagtattttgggttttatgccgcaggcaatcatcacatcagaaaaaggctctatcaaccctgatgagcacccgatgaatcagctttcgggtctaaaaggagttaaccgtattactccgattgtacaaggcgatgtggtgctacaaagtgcccgtaatgttggtgtgggaatcatgttgggtatcactcctaatgaatatacgccactggcggcgcatattgctgatattgatcgtactcagttacaacccggacgttatttcgtcatcttgggggagaagttggctataaagctgggtgttaaacgaggtgatcagatccgcgttatcgtaccaagtgccagccagcttacgccgatgggtagaattcccagccagcggttattcacggtgattggaacattttttgccaatagtgaagtcgatgacacggaaatgctggtcaatcaacaagatgcggtgcgcttattccgttatcccatggataatatcactggctggcgtctgtatctcaatcaaccgctgacggtggatgtattaagccagcaaactttaccggaaggattagtatggaaagattggcgtgaacgcaagggcgaattttttcaggctgttcggatggaaaaaaatatgatggggttactgttgagcctgatcatcgcagtcgctgcttttaacatcatcacttccctctctttattggtgatggaaaaacagggtgaaattgccatcttgcagacgcagggactaacccgccgtcaggtaatggcgatcttcatgatccaaggggggagtgctggcatcattggtgctttgttgggaacggggctgggtgttctgctttccagtcagttaaacagtttaatgcctcttgttggcctgttgactgaaggtatccaattacctgttgcgattgatattacccaagtggtgcttattgccaccagtgccatgttgatctccctattatcgactctatatccttcctggcgcgcggctgccattcaacctgctgaggctttacgttatgagtaa

SEQ ID NO: 3308 - DNA, 174 bp, Xenorhabdus bovienii
  Coding DNA location: Contig name=SeqID_16888; Position on contig =212378..212551bp; Strand=+
atgtcatattttatctctagttatgtatgccaatatgtacaaaaccaatatctatcccgtcagctttacttatcacatagtatcaccgtttcgctcagatttgattatcgtcaatttcaagtgaaaaataaaaaaaccagccattatactcaaccctcgaaaattttggcctga

SEQ ID NO: 3309 - DNA, 228 bp, Xenorhabdus bovienii
  Coding DNA location: Contig name=SeqID_16888; Position on contig =212472..212699bp; Strand=-
atgtttattgattttggcaaaagtatctgggtagtacttccagaggagcgcaagtcagattggatgacatcagaagctcttgttaatagtatctttatattagattatggcgttttcaaggctacgcatcggcgtagccttttctgtatcaggccaaaattttcgagggttgagtataatggctggtttttttatttttcacttgaaattgacgataatcaaatctga

SEQ ID NO: 3310 - DNA, 105 bp, Xenorhabdus bovienii
  Coding DNA location: Contig name=SeqID_16888; Position on contig =212765..212869bp; Strand=+
atggaaccactcgtaccccggttctgtgtttttttactttctctcaacctgccagcgtatttgttgcaaggctacttggtcaaaaatgtgttgggaatggactaa

SEQ ID NO: 3311 - DNA, 3441 bp, Xenorhabdus bovienii
  Coding DNA location: Contig name=SeqID_16888; Position on contig =212895..216335bp; Strand=+
atgtccgcaaaataccgttatcaacttcctgaacgtcgcggtgatatccgccagttgggtcatttgactggtgccgcctgtgcagtcgaatgtgccgaaatcattgaacgtcactcaggtccagtgctactggtgacacaagatatgcaaaatgctttgcgattgcgtgatgaaattctgcaattcacccacgcaccaataaatatgctgtcagattgggaaacattaccttacgatagtttttcaccccaccaagaaatcatctcaaatcgcttatccacgctttatcacttaccgttcatgacgaaaggtgcactaatcctgcccgtcaatacgttgatgcagcgtgtttgtccacatgaatatctcaagggacatgccttggttatgttcaaaggtcagcacctttcacgggataaactgcggacagaactggaacagtccggttatcgtagtgttgagcaagtacttgaacatggtgaatttgctacacgcggcgccttgtttgatatgttcccgatggggagtgaacatccttaccgcattgattttttcgatgatgaaatcgatagcctgcgtactttcgatgtagatagccagcgaacactggctgaagtggaaacaatcaatttattgccagcccatgaattcccgactgatcaagaggcgattgaattattccgcagtcaatggcgcgaacagtttgaagttcgccgcgatgctgagcatatttaccagcaggtcagcaagaaaatgctgccggctggcattgagtactggcaacccctgttctttgaacagcccctgcctgcgatttttgattatctacccgaaaataccttgctcattacacaggatttagtcagcgcagcagagcgtttttggcaggatacagcacaacgctttgaaagccgaaaaattgatccaatgcggccattactatctcctgagcggatttggctacctgtcgataaattattcgctgaattaaaaaactggccccgcattcaggttaaaaatgacgcactccctcaaaaagcaggaagcaccaaccttgcttatcaggctctccctgatttatcggttgccacacagcacaaaacacctttggataaggtgcgccgtttcatcgaacagttcaacggcaggatcgttttctcggtagaaagtgagggacgtcgggaaaccgtacaagagctgttgtcacgtatcaaaattagcccgataaaaataaaacagctgatagatgccaatgagtctggctgtttcttgatgataggggcggcggagcatggtttcattgatgaagaaaataaactcgcacttatctgcgaaagcgacatgctcggtgagcgtgtaagtcggcgccggcaagatagccgacgcaccatcaatactgatactttgatccgcaacctcgctgaactgcgtcgtggccagcctgttgttcaccttgaacatggtgttggtcgttatcagggactgattacgctggaaacagggggcatcaaggcggagtatctgatcctgacctatgccggagaagacaaactgtatgtgccagtctcctccctgcatctcatcagccgttatgctggcggtgcagaggatagcgccccactacacaaattaggtggagaagcgtggaataaagcacgtcaaaaagcggccgaaaaagtacgtgatgtcgccgctgagttactggatgtgtatgcgcagcgtgccattaaaccgggctttgccttcaagcaggatcccgagcaataccaactgttttgccaaagttttccgtttgatacgacacctgatcaagaacaaacgatcaatgcggtactggatgatatgtgccaacccattgccatggatcggttagtgtgtggtgatgttggctttgggaaaaccgaagtcgcgatgcgcgccgcttttatggccatcactaataacaaacaggtagccgttctcgtgccgacaaccctgttggcacagcagcattatgataatttccgagatcgctttgcaaactggcctgtgcatcttgaagtactgtcacgctttcgcagtgcaaaagaacaacagcaggttattgatatggctgctgaaggcaaagtcgatatcatcatcggtacccataaacttctacaaaatgatctgtgctggaaagatattggtttattgattgtcgatgaagaacaccgttttggagttcgccacaaagaacgtatcaaagccattcgtgctgatgtcgacgtcctgactctgaccgcgactcccattcctcgcacgcttaatatggcaatgagtggtatgcgtgatctatcgattatcgccacgccgcctgcccggcgtttagcggtcaaaacctttgtacgtgaatatgacagtttagtcgtccgtgaatccatcctgcgggagatcttgcgtggtggccaggtttattacctctataatgatgtcgaaaatattgagaaggctaaaaatcggctggaagaattagttcctgaagccagaatcgtcgtcggccatgggcagatgcgtgaacgtgatctggaacgggtcatggcagatttccatcaccaacgttttaatgtgctggtatgtaccaccattattgaaaccggaattgatatccccagtgccaatacgattatcattgaacgcgctgatcactttggattggcccagttgcaccagttacgcggacgtgtcgggcgctcccatcatcaggcatatgcttatctgctgactccaaacccaaaagccatgactaccgacgcccaaaagcgcctggaggccatcgcatccctcgaggacttaggtgcagggtttgcactcgccactcatgatctggaaatcaggggagctggtgaattgttaggtgaagaccaaagcggccagatggccagcgtcggttttacactctacatggaactgttggaaagtgccgttgatgcgctcaaaaacggacgtgagccatcacttgaagatttaaccagcagccagaccgagattgaactacgtatgccggtacttttgcctggtgattatatccctgacgtgaatatgcgcctgtctttctataagcgcattgccagcgcccacaatgacgctgaactggctgaactgaaggttgaattgattgaccgatttggtttactgcctgatccgagtcgccagttattgcaatctgcctcaattcgtctgaccgcacagaatttgggtatcaaacgcatcgaagcgcatgagaaaggtggctttatcgagttcagtgataacaataaagtcgacccaaattatctgatcggtttattgcagacacagcctaacatttatcggctggatggtccctctaaactgaaatttattactgaattaacagagagacctgcacgtttgtctttcatccagcaattattggaagccttcattcagcatcagatataa

SEQ ID NO: 3312 - DNA, 555 bp, Xenorhabdus bovienii
  Coding DNA location: Contig name=SeqID_16888; Position on contig =216408..216962bp; Strand=-
ttgaacgcatttttagttctcttaaatattcagggagcatgcttcaataaaaatgtgtataaaattattaatatatcaaggtgctatgtgggtaaattaaagataagacagtatggaataggctctctaattgctattgctgccattggcactgccgcaacactttattttgaatccccacaacccaaagttgcgcaagtattatcttcagagcctatccgaataacggttcttactcctcatcactattgccatgagacagtattcgccattcctattagatcagaagatatgaaagggggtctctttacgggatatgaataccgtatattgactcttcttgacaatataaaagcaagcagggaatatcttgcattaaaccattcagcattaaaaaattgcctgatggtttatgtgaaggagcaacgcaccgttgggtatgatgttaattatactattggggataatcctggaaaagtgcgagtgacgtacaaaccggagcaaaccattccgttaaatgaaaaagggcaattaattctccagccatatttgtag

SEQ ID NO: 3313 - DNA, 1305 bp, Xenorhabdus bovienii
  Coding DNA location: Contig name=SeqID_16888; Position on contig =217442..218746bp; Strand=-
atgacaacgccaaagacaagaattgtcattattggtgggggcgctggtggtttagagctggcaacgcgtttggggcgcaaattggggcgtaagcaaaaagccgaaattactttggtggatcgcaacaacagccatttatggaaaccattattacatgaagtagcaacgggttctcttgatgatggtgttgatgcattgagttatttagctcatgccagtaaccatcattttaacttccagttaggcacgcttacgaatatcgatcgtgatggaaagaaaatcactctggcggaaatccgtgatgaaagcaatgatctgctggtagcagagcgagagctggcttacgacattcttgttatggcattgggtagccagtcgaatgatttcggcacggcaggtgtaaaggaaaactgcattttcctcgataatccacaacaggcgcatcgttttcataatgaaatgctgaacttgttcctgaaatattctgccaaccagtgtgcgggagaaaaagtcaacatcgcgattgttggcggtggcgcaactggcgtagaactttcagctgaactgtacaatgctgttaagcagtttaatagctacggttttgagagtttgaattcagacgcgctgaatgtcactctggttgaagcgggtgagcgtattcttccggcattgcctccacggatttccagtgcggcacatcaggaattgaccaaacttggcgtcaaggtgttgaccaagactatggtgaccagcgcagataagcatggcctgaataccaaagatggagagttgatcaaggcttccctgatggtttgggcagcgggaattaaagcgcctgattttatgaaagacattggtgggttggaaacaaaccgcattagtcagttggttgtgaagccgactttgcagacgacgttggatgctgatgtcttcgccattggtgattgtgcatcatgcccgaaaaaagagggtgggtttgttcctcctcgtgcccagtctgctcaccaaatggcgagtcgttgctatgataatattctggctttattgaatgaaaagccattaaaagaatatgtttataaagatcatggttcattggtttcattatctaagttcagtacagttggtagcctgatgggtaacttgatgcgcgggtcaatgatggtagaaggccgtattgcacgtgtggtttatatctcattgtatcgtatgcatcaggtagcactgcatggatatataaaaacaggtttgatgatgctggttggtggcatcaatcgtgtcattcgtccgcggttgaaattgcactaa

SEQ ID NO: 3314 - DNA, 180 bp, Xenorhabdus bovienii
  Coding DNA location: Contig name=SeqID_16888; Position on contig =218718..218897bp; Strand=+
atgacaattcttgtctttggcgttgtcatgactaccccactgaaaatacaactaatgttatgtaaggcgctaaagccgtttcttttaataacgttcttaaataacatcagatttgacaagtttcatactgcaaatatctccagagtatcatggctggttagttggtcataccaaaaatag

SEQ ID NO: 3315 - DNA, 96 bp, Xenorhabdus bovienii
  Coding DNA location: Contig name=SeqID_16888; Position on contig =219022..219117bp; Strand=+
atgaagtttgatttgatagaaacggggtctcatcgggaaataataaagaggaaaaatcgagaagaaaaacaaaaaagggacagaattgccaactag

SEQ ID NO: 3316 - DNA, 1020 bp, Xenorhabdus bovienii
  Coding DNA location: Contig name=SeqID_16888; Position on contig =219162..220181bp; Strand=-
atggggccagtaatgttagatgttgttggttatgagttggataatgaagaacgcgaaattttgcaacatccattagtgggcggtttaatcctgtttacccgcaacttccaggatacgcaacaattgcgtgaattaattcgccaaatccgtgaagcgtcgcattaccgtttggtgattgcggtcgatcaggaagggggacgtgttcagcgttttcatgaaggctttactcgtttacctgccgcacagtcttttgcctgcttgaatgacttgcttatgggagcgcatttggcgcaagaatcgggttggttaatggcatcagaaatgattgcaatggacattgatatcagttttgctcctgtactggatctaggacaccagtgcactgcgattggtgagcgctcattccacggagagcttgaactcgcggtgatgatggcagaaaaatttatcaagggcatgcattccgcagggatgaaatcgacaggtaagcattttccggggcatggagcagttgtagcagactctcacaaagaaacgccaagggacaatcgctcgatggatgccattagctgccatgatatgcagatttttcgcgatcttatccaacgtaacctgcttgatgcaattatgcctgctcatgtggtttattctcaagtagatgatcttccagccagtggttcaccttattggctgaaatctattttgcgtcagcaactggaatttgaaggtgttattttttccgatgatttgtcgatggaaggtgcggctatcatgggcggctatgccgagcgaggaaaagcctcattggaagcgggttgtgacatgattctggtgtgcaacaatcggcagggggcaatcagcgtgctggataatttgccgatggtcaaatctgatagggtagcacggttatatcatcagggtagtcaatacagtctggaagagttgaagaaatcacaacgctggcaacaggcaaataaagaattgaatggcttgtgtgagcagtggttaagttatatttaa

SEQ ID NO: 3317 - DNA, 861 bp, Xenorhabdus bovienii
  Coding DNA location: Contig name=SeqID_16888; Position on contig =220272..221132bp; Strand=-
atgttaactagcgataacaccttgctgagaatgttatgtcagcaatggcctgacattccagtaaaaaattgggaaatcaggcgattaaatggactgacacagggaagtttctctattacagatggtgtgcgccagatggttgggcgcacacaaacacagaatagtgaaacactgggtgtggatcgtcagcgggaaaatcaggttttacgcaggttatcttccactggcatctctcctaaagtaatagccatgaacggtgattggctattgctggaatggttttcgggaacaaagataactcatgaaacgttgaacttaccattattgcagcagttactggcacagatacttgccactcttcataaccatcaccgattgggttatcccctccaattcaaaaagcaaatcgcatctcagtggcagcagattgaccagagccgcttatctcctcgctggctgcgtttgcagaaattttttatggcagccagaacgccaacaaccctgaaaatagcacctgctcacatggatattcaccccgataatctacttatgactgtagaagggttaaaattgattgattgggaatatgccgctgatgtcgatattggtttttcattggctgtgttgtttaaaggcaatcagtggaatgagatgcagcaacagatttttttagattattattgtagttacgcatcagggtacgcggatatcacattattgcagcagagaattaaacggtgggaaccgtgggtcagatatatgatgctgatgtggtatgaagtacgttggcagcagacgaaagatccacaatttttagtattggcgcaccctctgcgccagggatttaaattggcgcattaa

SEQ ID NO: 3318 - DNA, 567 bp, Xenorhabdus bovienii
  Coding DNA location: Contig name=SeqID_16888; Position on contig =221122..221688bp; Strand=-
atgaaaagaattctctttgttatattatcagcgatgtttctggcgagttgtaacttaccaatacagtcgcctgctcctgttacacctgtgaagccagagaaaaaaacggaaccacaagtacagccatcggataaagttcctcagccacctaagattcagtcgactaattggaatggcattgttcaaccgttggttgcgcagatggttaaggccaatggtgtggaaacgggaaaagtattacttgtcgatactgttaaaaacaacactaatggttcgctgagagccctgcaagtgactgatatcattactgatgccgtgagccgtaaacagctttttcagattgtaccgaaaaaacaagtgcatagagctcaacaggcattgggattgtcatcggaagatagcttgggattgcgcagtaaatctattggcttggcacgttatttgagtgctgattatgtgctctactccgtggtttctggtagtaacgatcaacgtaacatagaaatacagcttatgctggttaaaacgggtgaaatactttggtcaggtagcggtgatgttaactag

SEQ ID NO: 3319 - DNA, 351 bp, Xenorhabdus bovienii
  Coding DNA location: Contig name=SeqID_16888; Position on contig =221781..222131bp; Strand=+
atgcatatggatatggaaaacttcctgcccggaatggcgattacagttcatgatgaggcgataaccatcttctgcgatgccttcttgttgtgcgattttcgctgcaaccgtgaacaggcgtcccaatgcaagctcatgctctggagtaacatcgttaaccgttgggatcaatacgtttggcacgatcagaatatgggtgggcgcttgaggggtaatgtcacggaatgctgttaccagatcatcctgataaacaatatcagaaggaatttcacgacgaatgattttgctaaaaatagtttcttctgccatctcacttctccttttttgtcattaaagatgactcatgattaa

SEQ ID NO: 3320 - DNA, 786 bp, Xenorhabdus bovienii
  Coding DNA location: Contig name=SeqID_16888; Position on contig =222187..222972bp; Strand=-
atgtttttagttgattcacactgtcatctcgattgccttgattatgaaactctacacaagagtatggatgatgttgtggctaaggcagcagaacgggatgtgaagtatatgttggcagtggcgactacgctgccgggattccagcaaatgaagaatttgattggtaaacgtgaaaatatcgcgtattcctgcggtattcatccattgaatctggatgaaggctacgattttgatgaacttgcccggcttgcagcggacgatgatgtcgtcgcaatgggagaaaccggtctggattattattatcaaaaagaaaatgcagagttacagcgaacttcctttcgtgaacatatccgcataggacgtaaattaaacaaacctgtcattgttcatacccgcgatgcaaaggatgatactcttttggtcttgcgagaagaaaaagtacaggaatgtggcggtgtgctgcactgttttacggaagataaagatacggcgagagctttgctggatctgggtttttatatttctttctctggtatcgtgacatttcgcaatgcagaacagatccgtgaagcggcaaggtttgtcccactcgatcggattttggtagaaactgactcaccttatctggcacctataccgcatcgaggcaagcagaatcagcctgcctatgtacgtgatgtcgctgaatatatggcggtattgaaaggggtgagtcttgatgaattggccgcggtgacaaccagaaatttttgtgacctgtttcatatcaacatcccagaaaattaa

SEQ ID NO: 3321 - DNA, 999 bp, Xenorhabdus bovienii
  Coding DNA location: Contig name=SeqID_16888; Position on contig =222986..223984bp; Strand=-
atgaactggtatccgtggcttaaccatgcatatcgcctgttgattgaatcccatcagcaggagcgtgggcaccatgcccttttgcttcatgctcatgatggaacgggggccgatgcgttattgtatggattgagccgctggttgatgtgtcaggacaaacaaggaatgaaaagttgtggcaagtgtcacggctgtcatctgatgttggcagaaacgcattctgactggcatgttcttgcccctgaaaagggaaaaagtactattggagttgatgctgtacgtcagctcaacgaaagactttacgaatattctcaacaaggtggcgctaaaattatctggctaccctctgcggagtctctgaccgatgctgcttccaacgccttgctaaaaacattggaagaaccccctcaaaatacctattttttgttgcagtgccagcgtccagcgcgtttgctggcaacgctgcgcagtcgctgcttttactattttctgcctgtgcctgaacagcatgtagggctttattggctgcaacatcaactccctgcaatatcatcgctggatgcgcagacggcgttaaaactttcacagggtgcgcctcttgctgctgaacagttgcttcagactgaaaaatggcagcagagaaatgtgttttgtcaggcaattgaacaggcattgtataactgtgataccctgtcacttttaccattattgaatcgtgatgatgcacagcaatctttgtattggctggttagcttgttatccgatgctgtgaaatggcagcagcaggcgcaggattactgcgtcaaccaagatcagcaggctttgatccatcatctggcttccactcaaagtgtggaaaaattattaagtacagttgatgattgggtacattgtcgtcatcaattactatctgtggtgggcatcaatcgggaattattgttgacaggacaattactcaattgggaaaagcagctttgccccacacggcaactcatttag

SEQ ID NO: 3322 - DNA, 642 bp, Xenorhabdus bovienii
  Coding DNA location: Contig name=SeqID_16888; Position on contig =223981..224622bp; Strand=-
atgaacagcaaatttattgttattgaagggcttgagggcgcagggaaaaccactgcaatccgaacagtggttgaaacattgaaacagtatggcatttctgatctgatttttactcgtgaaccgggtggaactccgttggcagaaaaattacgtcaactcatcaaacagggcgttgaaggtgaatcactgacgaataaggcagaagtattgatgctatatgcagccagagtccaattggtagaaaatgttatcaagccggcactggaaaaaggaacttgggtggttggagatcgtcatgatctttcctctcaggcatatcagggcggtggtcgtggcattgatcagaaactgatgacatcattacgcgaatcggcactcggtgatttttacccggatttgactatttatctcgatttgccaccagaggttggtttacagcgtgctcgtgagcggggtgaattggatcgcattgaaaaagaatccttggattttttccaccgtactcgtgaaagatatctcgagcttgtggcacaagatgacaccatcaaaaaagtagatgcgacacaaccgctggaaaaagtgcaggatgctattcgtcagaccttattacagtggttgaaacaacaggacatgcaggcatga

SEQ ID NO: 3323 - DNA, 1026 bp, Xenorhabdus bovienii
  Coding DNA location: Contig name=SeqID_16888; Position on contig =224619..225644bp; Strand=-
atgaaacttaaaaagcgtattttcattttacccagcttgattattatgattgtagcaatcatgtttttttcttttgtgaaaaaaatagaaaattttgctaatcagaaaattaatcttaatcaagaaatgatatttactgtgccagcaggaacagggcgtgctgggctaggaatattgttggttcagcataacttaatcaaagatcaccaattgttgtcgtggttattccgattaaaaccagaattggcgaaatttaaggctggtacttatcgtttgcaacaaggcatgtcattgcgagcaatcttgcaactattttccagcggtaaagaagtgcaattttctatccgtttcgttgaaggaagtcgattgtctgactgggagaaaatattacagaatgcgccatacttaaaacatgaagcagagggcaaatcaccaaaggaattgactgacgctttagacatgaaagcggaagaaccattggaaggttggctctatcccgatacttacctgtacaccgcaggaaccagtgatgttgaattgctaaaacgtgctcatcaaaaaatgaacatggcactagagcaagagtggaaaaatcgcgaaaaaaatctgccatataagagtgtttatgagatgttgatcatggcatccataatcgaaaaagagacagcaatagattctgagcgtacaaaagttgcttcggtatttattaatcggctgcggttaaagatgagattacaaactgatccgacagtaatatatgggttgggggataagtatacgggttctattttccgtagtaacctgactgcttttacgccatataatacttatatgattgaaggattaccgccaacgcctatcgccatgccaagcctagcttcgattaaagctgcggcacaccctgctgtgacagggtacttatactttgttgcaaatggtaatggcggtcatacattcactgcgaatctggcagaacataatagggcggtaaatctttatcgtcagagattaaagcaggataaatga

SEQ ID NO: 3324 - DNA, 825 bp, Xenorhabdus bovienii
  Coding DNA location: Contig name=SeqID_16888; Position on contig =225689..226513bp; Strand=-
atgtatttgattaatggcaaaccgtgtaatcaattacctgttaatgatcgtgcggtacaatttggtgatggctgttttacaacaataaaagttgagcaagggcaggcagctttgctacctttgcacataaaacggttacaaaaaggcgttgaaaaactgtttatgccagcactggattggctgcaacttgaggatcatattaagcaggtggttaccggctgtgaatccggtattctgaaagttattctctccagaggagttggtggtcgtggttatggtattagtgatgctatcgagccaaatcaggttctctcgttgagttcatatccagaacagtatgttatccagcgtaaaaatggtatttcactcgttcttagcccaattgttatgggtatcaatccccatttggcgggtattaaacacttgaaccgcttggaacaggttctgataaaaagattcattgagcagtcaaaggctgatgaagcactggttcttgatagtgatggcttactggttgagtgttgtactgctaatattttctggcgaaaaggtaaaaacgtttatacgcctgatttgaatcaatgtggtgtagaaggggtgatgcggcagaagattatgcaattattggcagaaagtgattataacctgtcatgtgtcatgcgttatcctgaggtattagctcatgctgatgaggtgattatctgcaattccttgatgcctgttatcgcagtaaaccaaattcaggcgcataaaaatcagcctgcatggaaatatcaatcaagagaattgcatgagtatttattgcctgcatgtttaaggctgtag

SEQ ID NO: 3325 - DNA, 1284 bp, Xenorhabdus bovienii
  Coding DNA location: Contig name=SeqID_16888; Position on contig =226687..227970bp; Strand=-
atgttcttcgtcctaaattttttccctccctggaggataaccgtgtctaagcgtcgagtagtcgtgaccggactaggcatgttatctcctgtcggcaatacagtagagtcttcttggaacgctgtttgtgccggacagagtggtatcggccttatcgaacattttgacaccgctaaccatgcaactaagtttgctggtgtggtgaaaaattttaatcatgaagatttcaatatttcgcgcaaagatgctcgaaaaatggatctgtttattcagtatggaattgctgctggtatacaagctattgaagatgcaggaatcgaagtaacagaagccaatgctagccgctttggtgctgctattggttctggtattggtggtttgggtcttattgaagaaaaccacagtacattgctctcggcgggacctcgcaaggtcagcccattctttgtaccttcgaccatcatcaatatggttgcaggccatctgagcatcctttatggtcttcgtggtcctagcatctccattgcaactgcctgtacctctggcgtgcacaatatcggtcatgcagctcgtattattgcgtacaatgatgctgatattatgctggcaggtggtactgagaaagccagtactacatttggcgttgcagggtttggtgctgctcgtgcattatcgacccgtaatgatgatcctcaaggtgcaagccgtccttgggataaagatcgagacgggtttgtgctgggtgatggcgccggtgttctggttcttgaagaatacgaacatgccaaaaaacgtggtgcaaaaatttacgctgaaatcgttggctttggtatgagcagtgatgcttatcatatgacatcaccgcctgaagatggagcgggtgctgcgcttgcaatggaaaatgccctgaaagatgcggatatttccccagaccaagtgggctacattaatgctcatggtacttcaacgcaagttggtgatcttgcggaagctcgtgcggtagaatctgtttttggtgaaggcactaaagtattggtgagttcaaccaaatcaatgacaggtcacttgctgggtgctgcgggagcgattgaatcgattttcactattcttgctttacgtgagcagattgttcctccaaccattaatttggaaaatcaggatgaaaactgccgtttggatcttgttccaggcgaagcacgtaaagttgaagggatggaatacgcactgtgtaattctttcggtttcggtggtactaatgggtcactgattttccgtaagatataa

SEQ ID NO: 3326 - DNA, 105 bp, Xenorhabdus bovienii
  Coding DNA location: Contig name=SeqID_16888; Position on contig =228003..228107bp; Strand=-
atggctctggaagaagagttcgatatcgagatcccagacgaagaagctgaaaaaatcactacagttcaggctgctattgactacgttgaaaacgcaggtaaataa

SEQ ID NO: 3327 - DNA, 750 bp, Xenorhabdus bovienii
  Coding DNA location: Contig name=SeqID_16889; Position on contig =5..754bp; Strand=-
atgactgaggaaaacatgagctttgatggaaaaattgcactggtcactggcgctagccgtggcataggtcgctcgattgcagaattattggttgaacgtggtgctcgtgttatcggcacagcaaccagcgagaatggagccgaagcaatcagtgcctaccttggtgataaaggcaaaggttttgtattgaatgtcacagattcagaatccgtagaaaaagcactctcgaatattcgtgctgaatttggtgaaatagacattctggtaaataatgcaggcatcactcgtgataacttgttgatgcgtatgaaagatggagagtggcaagatattattgacactaatctttcttcgatttttcgtctgtcaaaagcagtaatgcgttctatgatgaaaaaacgttatggacgtattatttccattggatctgttgtcggaacaatgggaaatgcagggcaggcgaattacgcggcagcgaaagcaggagtcattggtttcagtaaatcactggctcgtgaagtcgcttctcgtggcatcaccgtcaacgttgttgcacctggttttatcgaaacggatatgactagagcgttgacagacgatcaacgagcaggcattttatctgaaattcctgccagtcgtctcggtgatgcaaaggaaattgccagtgctgtagcgtttcttgcttctgacgaggccgcttacattacgggtgaaacattacatgtcaatggtggcatgtacatgatctaa

SEQ ID NO: 3328 - DNA, 735 bp, Xenorhabdus bovienii
  Coding DNA location: Contig name=SeqID_16889; Position on contig =751..1485bp; Strand=-
atgctcgcagcttcagttgctatctggcgtatatggcagcaaaagggaggcaagcagccttccatgatggctggccatagccttggcgagtactcggcgctggtttgtgctggtgtgattgaattccagcaggcgatcaggctcgtcgaattacgcgggaaattgatgcaggaagctgtatcagaagggcaaggggcgatgtacgccattatcggattggataatgaatccattgcaaaggcatgtgaagagtccgcacagggtcaggttgtttcacctgtgaattttaattcgcctggacaagtcgttattgcgggtgaaaaagaggctgtagagcgtgcaggtgctgcttgtaaagcggctggcgcaaaacgtgctctgcctttggctgtcagcgttccgtcacattgtgcactcatgaagtcggcagccgatcagttagctgctgcattgcaatcaattgtgtttaatcagccacagttccctgttgtcaataatgtagatgtcaaagtagaagaatctgctgatgcgattcgcgacgcactggttcgtcagttgtataatcctgtacgctggacagaatccgttgaatatatagcggcacaaggtactgaacaactgttggaaatggggccaggtaaggtattaactggtttaacgaaacggattgttgatactttaaatgctgtagcagtaaatgatgtatcatcactcacagttgctctgaataaatga

SEQ ID NO: 3329 - DNA, 159 bp, Xenorhabdus bovienii
  Coding DNA location: Contig name=SeqID_16889; Position on contig =1508..1666bp; Strand=-
atgggtgttccccgtccaggttctcagtcacctggtatgttggctgatttagccccagaatttccgttggtggaccagattttgccagaggcttctgcggtcttgggatacgatttatgggcattagttcagcaggggccagcagaaagagctgaataa

SEQ ID NO: 3330 - DNA, 171 bp, Xenorhabdus bovienii
  unsure (1)..(171): unsure at all n locations
  Coding DNA location: Contig name=SeqID_16889; Position on contig =1615..1785bp; Strand=-
atgggaagaattcaacgcggccagcttgtcttaattgaagcattggncgntggctttacctggggctcagcgctaggacgttntttaattaacaggaaaataaacatgtctgattcgcaatgggtgttccccgtccaggttctcagtcacctggtatgttggctgatttag

SEQ ID NO: 3331 - DNA, 804 bp, Xenorhabdus bovienii
  unsure (1)..(804): unsure at all n locations
  Coding DNA location: Contig name=SeqID_16889; Position on contig =1854..2657bp; Strand=-
atgtatacaaaaatcttaggtacaggcagttatttgcctccgcaggtgcgtactaacgcagatttagaaaaaatggtggatacgactgacgagtggattgttactcgtacaggcattcgtgagcgtcgtattgcggctgagggtgaaaccgttgccactatgggattcaaagcagccgaaaaagctattgaaatggctggcatcgataaaacacaaatcgatttgattgttgtagcaacaacaacttcatcccatgcgtttccgagtacggcctgccagattcagaattcattaggcattcgaggtatcgccgcctttgatgttgcggccgcttgtgctggatttacttatgcgttaagcattgtcgataaatttatcaaggctggcgaggttaaacatgccctggttatcggggcagatattatctcaagagttgtcgaccctaaagatcgcagtacagttgtcctttttggtgatgcagcaggcgcaatggtagtaggggcttcagaagagccgggtatactgtcaacccacctgcatgctgatggtcgctatggcgatttactgtcattacctaatcaggatcgattgaaatggggttcacctgaatacgttacaatggctggcaatgaagtatttaaagttgctgtccgtgagttgaccagtattgttgatgaaacactggaagcaaacaatctggatcattctcagcttgactggctagtgccacatcaagcgaatttacgtatcatttcggcggctgccaagaaattggacatgacgatggataaaggngggttgtaa

SEQ ID NO: 3332 - DNA, 1008 bp, Xenorhabdus bovienii
  Coding DNA location: Contig name=SeqID_16889; Position on contig =2664..3671bp; Strand=-
atgggcggggattttggtcctcgcgttacggtgcctgctgcattgcaggcactggcatctaatccgcaattaaaattattgttggtcggagatcccgaaaccatctcccctttgcttgcaaataaaaatgctgagcagcttagtcgtttgcaaattattcctgcggaacacgttgtttccaacgatgcaaaaccttctcaggcgatccgttccagtcatggtacttcgatgcgtattgcactaaatttagttaaaactggtgaagcgcaggcatgtgtcagtgcaggaaatacaggcgtattgatggggctggccaaattgatgctgaaatccatcgagggtattgaacggcctgcattgatgacgatgatccctaatttaaaacagcagaaaactgttatattagatttgggagctaatataaattgtaatagtcgtatgttagtccagtttgccattatgggagcagtaatggcagaggatgttgcaggtgtgaaaaatccgcgtgtggcattactcaatatcggagaggaagaatccaaagggctggataatatccgcgaagctgctatgaccttacagaatacctcagcaatcaattatataggttatgtagaagggaatgagttactgacgggaaaaaccgatgtactcgtgtgtgatggcttcgcaggtaatgttacgctgaagacgatggaaggtgcgatcagggtgattttatctttggtaaaatcaccggatggtcagaagaaaaaatcatcgtggttgaggaaagtattcaagaagtggttgttaaaacagatagtaaaacgcttcggccacctaaaccctgaccagtataacggcgcaacactattaggattgcgtggtatcgtcataaaaagtcatggtgccgcgaatgaacgtgcgttcaaggctgctatagatcaagcagttcagaccgtacagaatcaggttcctgatagaatcgctgtccggctggatgcagtattacccaagagtgaataa

SEQ ID NO: 3333 - DNA, 171 bp, Xenorhabdus bovienii
  Coding DNA location: Contig name=SeqID_16889; Position on contig =3730..3900bp; Strand=-
atggccgtacaacagaataaaccaactcgttctaaacgtggtatgcgtcgttctcatgacgcactgactgcaacacatgtctctgtagacaagacttctggtgaaactcacctgcgtcaccacgtgactgctgacggttactaccgtggccgcaaggtaatcaacaagtaa

SEQ ID NO: 3334 - DNA, 525 bp, Xenorhabdus bovienii
  Coding DNA location: Contig name=SeqID_16889; Position on contig =3913..4437bp; Strand=-
atgcagaaggtaaaattacccctgaccattgatgcgcttcgtgcagctcagaaaagcttagactacgaaggtagttattctgctgaacaagcttctcgtctcgccgagtctgtggtcagtgtggatggtgatataaatagctcattatcatttcaaattgataatctgcgtctggcagttgtaaaagggcattccgatgtggatgttacacttgcctgtcagcgttgtggcagtaatttcagtcatcatgttcacacaacgtattgttttagtccggtcatcaatgatgaacgggccgaggcattaccggaagagtatgagccaatcaacattaatgaatttggcgaaatagatttgctggcaatgattgaagatgaaataattctttctctgccggtagtcccggtgcatgattctgaacactgtgaagtgtccgacgcggaaatggtatttggtgtactgcctcctgaagcagaaaaaccaaacccatttgccgcattagccagtttaaagaaaagtacttaa

SEQ ID NO: 3335 - DNA, 606 bp, Xenorhabdus bovienii
  Coding DNA location: Contig name=SeqID_16889; Position on contig =4571..5176bp; Strand=+
atggaaaaaatgatgcttccgattgttttatcatcaacatcgatatatcgccacctattgttggaaaaaatggggttaccttttgtctgtgccgctcccaatattgatgaaagcccacaagagaatgaaagccccacacaactggtgatgcgcctgtcacaggcaaaagctaccgcattacaaccgagttattccagccatctgattataggttcagatcaggtttgcgttttaaatggaaaaattacaggtaaaccacacaattttgagaacgctttcgcacaactcaaaaaagccagtggacagtgtgtcactttttatactggaattacgctatttaacagcaaaacaggaaacactgatacccgctgtgaattatttcatgtccatttcagagatctgacagaacccgaaattatcagctacctaaacaaagaacagccttttaattgtgctggtagctttaaaagtgaaggtttgggaattacgttatttaaaaagctcgatggcagagatcctaacaccctaatcggtctgccattgatcactctaacagaaatgctcatccgccaggggataaacccactgacggtgcgttatcaataa

SEQ ID NO: 3336 - DNA, 957 bp, Xenorhabdus bovienii
  Coding DNA location: Contig name=SeqID_16889; Position on contig =5170..6126bp; Strand=-
atgaaaacaaataatccaattgtacagtttgtcactattgatgacgatgaagccggtcagcgaattgacaactttttgctggcgcgcttaaaaggtgtgcctaagagtatgatctatcggatcttgcgcaaaggtgaagttcgagttaacaaaggaagaatcaagcctgagtataaattagcagcggctgatgttgtccgtatcccaccagtcagggtagcggaaaaacagcagccacctgtatctgccaagctgggcaaagtagcagttctggcagaatgcatcctttatgaagatgactacatactagtcattaataaaccatcaggtaccgcggtgcatggtggaagcggattgagcttcggtgtaatcgaagggcttcgtgcattacgtcctgaagcgcgttttctcgaactggtgcatcgtctcgaccgtgatacatcgggtgttctgctgattgcgaagaagcgttctgcattgcgtgcactgcatgaacaattgcggttgaaacagatgcagaaagattattttgctctggtacgagggcagtggcagtcacattgcaaagtggtacaggcacctttattgaaaaatatcctgcaaagtggtgagcgggtagtgaaagtcagcggcgatggtaaaccatcggaaacacgttttaaagttgaagaacggtatgagtttgcgaccttggtgctcgcaagcccagtaacgggacgtacgcaccagatccgtgtgcataccttacatgctggtcatcctattgcatttgatgaccgctatggtgatagggcgtttgatgcacaactgacagaaacagggcttaaccgattgtttctgcatgccagttcattaaagtttactcatccatccacgggagaaactctgcgtttcgaagctcaaatggatgatgagctacggcaatgtttaacaacattacgacaaaataattattga

SEQ ID NO: 3337 - DNA, 129 bp, Xenorhabdus bovienii
  Coding DNA location: Contig name=SeqID_16889; Position on contig =6378..6506bp; Strand=-
ttgggatactgtaataaactggtacagatttcacccaatccagtaagctgcaactcgcagcccataaattgtttgattaaacattacgtcttacgccattgctgcgtttttgttcgatcagacagataa

SEQ ID NO: 3338 - DNA, 138 bp, Xenorhabdus bovienii
  Coding DNA location: Contig name=SeqID_16889; Position on contig =6526..6663bp; Strand=+
atgaaattcagactcgccgacaaatataggcgcctctatacaaacgatagccgtgaggctggcggctttgtaaaagacacgaggccatcggttaccagtagtgcatctctttttgctcgcagctctataccaatgtaa

SEQ ID NO: 3339 - DNA, 3177 bp, Xenorhabdus bovienii
  Coding DNA location: Contig name=SeqID_16889; Position on contig =6684..9860bp; Strand=+
atgaaaagaatgctaatcaacgcaactcaacaggaagagttgcgtgtcgcccttgttgatgggcaacgtctttatgatttggatattgaaagtcctggacacgagcagaaaaaagcaaatatctataaaggtaaaattacacggattgaacctagtctggaagctgcttttgtcgattatggtgcggaacgtcatggtttcctgcccattaaagaaattgctcgcgagtatttccccagtaattatcatgctcatggccgacctaacattaaggatatccttaaagaaggtcaggaagtcatcgtccaggttgataaagaagaacgaggcaataaaggtgcagccttaacaacctttattagtctggctggtagctatttagttctgatgccaaataaccctagagcaggtggtatttctcgccgtatcgaaggtgatgaccgtatcgaattaaaagaagcgctctcctctcttgaattacccgaaggtatggggcttattgttcgtactgccggagtaggcaaatccgccgaagctttgcagggagacctgaatttccgcctgaaacactgggaagctatcaagaaagccgcagataatcacccagctccgttcctgatccatcaggaaagtaatgttatcgtacgcgccttccgtgattacctacgcccggatatcggggaaattctgatcgacaatcctaaaattctcgatttggcacgccagcatatcactgcgcttggacgtcctgatttcgccagcaaaatcaaactgtacagtggtgaagttcccctgttcagtcattatcagatagaatcacagattgaatcagctttccagcgtgaagttcggctgccttctggtggttcagtagtcatcgatacaactgaagctctgactgcaatcgatatcaactcatcccgggcaacccgtgggggagatattgaggaaacggcctttaacaccaatctggaagctgcggatgaaattgcacgtcaattacgcctgcgtgacctcggtggtcttatcgttatcgatttcattgatatgacacctgtacgccaccagcgtgaggttgaaaaccgtttacgtgatgcagtacgtcaagaccgtgcccgtattcagattggccgcatttcccgctttggcctgctggaaatgtcacgccagcgtttaagcccatctctgggtgaatccagtcaccacgtctgccctcgctgtagcggtacaggaaccattcgtgacaacgaatcactttctctgtcaattcttcgcctgatcgaagaagaagcactgaaagagaatacacatcaggttcatgcgattgttcccgttcagattgcgtcctacctgctgaatgaaaaacgtaaggcggtcagcgccattgaacatcgccaaggtgatgtaggtgttgttatcgtaccaaacgatcagatgcaaactccgcatttctctgttttacgggttcgtaaaggtgaagaaatttctaccctgagttatctgcttccacaaatacatgaagcagaaatgacgaatgctcaggatgatggacaacatgaacgcaagcgtcctgagcaacctgctatttcaacttttgatctgcctgcagaaactaccacccctgtggcagcaaaaacaaaagagaaaaaggtagcggtgagcaataatcagcaaacagaacaaccaggtctgttcagtcgcttcctctgcgccctgaaaaaaatgttcagtggtgaaagtggtgaagaagaaaaacaggcgcaggaaaagagcaataaatcttctagtaacgataaccgacgttccccagaacgccgcaattcacgtcgccagaatcaaagacgtgagcgtaacgagaatgacactcgcaataaccgtgagcgcggcgatgaacagcgtaaaggtcgcaatgttcagcagaaaaacaacgcgccggataatattgcggtaaatgtagatatagataatgaagctcgtgaagcacagcagcaacagcgccgtgaacaacgggcggaacgccagcgccaccgtcaagaagaaaaacgtcagcagcaactggaaaccaaggctcaacagacgagtagacctgaaattacagaagaggaagtcgaagagcatcaacctgtaatgcctcgtcgtcagcgtcgtcagcttgaacagaaaattcgtatcacagataacgtgaaagaagaagctgttgttgtctctttaccgattgtaacaaaggtggtcattccggcgattacagaagaagagaaaaaagtttctgtaccagccattatcgatacgaatgtagaagcggctaatcagccttcaataccacaaggctcaatcacgcaaaataatgagcagcaagacaacatcatgcctcgccgctctcgccgttcaccacgccatttacgtgtcagcggtcagcgtcgtcgtcgttatcgtgatgagcgtaacctgactcaatcacctgtaccactggcaatggcagttgcgtctccagagttggcatcaggtaaagtttgggtgcgttaccctgttacacctgtgacaaagcctgctgaaccagaagtatctgctgtggaagaaacagcgtcagagcagcaagagagtgtcatgccgatacctgctgttgctggttcagtgtcagtttcaactgttgctgatactcaggttaccgagcaaattgcagccactcatgacgatgttaagcttgcgaccaatggttatccgctcgtggcatccgtagaacctgtgcttgaaaaacctgaagtatcggcaccggaaaacctggaacccgtcgtcaaccatgaaactaaacatcagcctgaagccttaaatgacacggaagaaacacgccacatagcagaaccaatcattgtgacgtctatcgttgaacaggaacagcatgaagaacagccaactgtcgcaacggaaatatgctctaaggcagaggaagttaaagcggaagagacaaaaattgctgagtctccgattatcgtggaaaaaaatcatcacgcttcttccccaatgacaaaggcaccagcaccagacttagtagtacagactgtcattgtcagcgaatggcaacgccctgcttatccattcagaggaaaaggcggcgcgggtgggcattctgcaacaaatgtcgcaatatctgcaatgtcaaaaccgcaatcatttgaataa

SEQ ID NO: 3340 - DNA, 510 bp, Xenorhabdus bovienii
  Coding DNA location: Contig name=SeqID_16889; Position on contig =9969..10478bp; Strand=-
atgggctctgccaataaggctactcatgggaaaatccgaactgttatccccataacagagaaggatttaaccatgagtagattcaagaaagcatcgcatgtactttggtgttgtcaatatcatatcgtctggacgcccaaataccgatttagaatactgaaaaataatgtaggaagggaggtctataagcagatacggatttcatgtgaacaactcgagatagaaattgtagaattgaatgttcaactcgatcatgttcatcttttggtaaaaatacccccgaaattatctgtatctcaggtgcttgggcatttaaaaggacgaacagccattcgattatttaataaatttccctatttaagaaagaaaaagttatggggaaatcacttttggtcgagagggtactgtgtagataccgtaggtgtaaatgaagaaatgataaggaagtatgtgaagtatcaggaaaaacatgaacatgaagacaatcaattatcgttaaaagggatgtga

SEQ ID NO: 3341 - DNA, 645 bp, Xenorhabdus bovienii
  Coding DNA location: Contig name=SeqID_16889; Position on contig =10662..11306bp; Strand=+
atggagaacattccgactatgaaatcttggctaatttttggtgctggcagaggcgttggacgccatttagccactatggcactgcaacaaaaccaccccgttacggcattagttcgtaacgtacagcaagccgtggaactgagtacaatgggcgctaatgtgatacatggcgatgcctgtgacaaaaagagtatcgaaaaagccattgctcaggccggagaaaaccctattgttttctcaaccattggcggcggaaacgctgatcaccatggtaatatggccatcatagatacattggaacaagctgaagtttcacgcatgctactggttacatccatcggatgtggagacagttggaaaacgttgtcaccacgtgccaaatcattatttgggcaatcagtcagacataaatcgctggcagaaagttacctgcaaaccagcaaattggattttacgatcattcgtcccggaggactcactgataaatcaggtactggacattgccaacgctatcaaggtgaagttcacggtatggtgagccgagaagatgtagcacaacaattggcactgatggctgaagatgaggaaacttattaccagatttacgctttagtcgatccagagttaaaacctcactggggctga

SEQ ID NO: 3342 - DNA, 321 bp, Xenorhabdus bovienii
  Coding DNA location: Contig name=SeqID_16889; Position on contig =11347..11667bp; Strand=-
atggacaacgcaaataaaccaacattccataatgtactggaatttgtgcgtatatttcgccgcaagaataaattacagcgcgaaatagtagacaacgagaagaaagttcgagataaccaaaagcgtgtattattgctggataacctgagcgattacattaaaccgggaatgtcagttgaagatattcaaggaattatcgctcatatgcgcagtgattatgaagaacgtgttgatgaatatatcatcaaaaatgcggaattgtctaaagagcgtcgtgagctgtccaaaaaacttaaggcaatggatggcggagtaaaataa

SEQ ID NO: 3343 - DNA, 108 bp, Xenorhabdus bovienii
  Coding DNA location: Contig name=SeqID_16889; Position on contig =11790..11897bp; Strand=-
atgtttctaatgcggagaaaagtctcttttcggataggtactgaaacctctcatggcagcggaaactcttggtcatcagatgctaggacgatgaaaatgattgattaa

SEQ ID NO: 3344 - DNA, 165 bp, Xenorhabdus bovienii
  Coding DNA location: Contig name=SeqID_16889; Position on contig =11822..11986bp; Strand=+
atgaccaagagtttccgctgccatgagaggtttcagtacctatccgaaaagagacttttctccgcattagaaacatgtgaaatgataatcaacgattttcaccctatatcattagagagttcagattgtccaaaatatggtttaccatatctttttgcatcgtag

SEQ ID NO: 3345 - DNA, 156 bp, Xenorhabdus bovienii
  Coding DNA location: Contig name=SeqID_16889; Position on contig =11925..12080bp; Strand=-
atgtgttatcttattttttgtgtattgatcatgttgataaaagttttattgcacggtttagtttatgacaagttgtgtactaaatctttggtttctacgatgcaaaaagatatggtaaaccatattttggacaatctgaactctctaatgatatag

SEQ ID NO: 3346 - DNA, 1428 bp, Xenorhabdus bovienii
  Coding DNA location: Contig name=SeqID_16889; Position on contig =12127..13554bp; Strand=+
ttgagtaacgataaaaaccccactttctattttcatgattatgaaaccttcggcaagcaccctgccttagatcgcccagcccagtttgcgggaattcgcaccgacagtgattttaatatcatcgaagagcctttggtggtgtactgttcgcctactgacgattatctgcccgatcctgaagctgtgatgatcacggggattacaccacagttagcattaaaaaaaggggtcaatgaggccgaatttacccgccagatccatgaagcgttcagcaagcccaatacctgtattatcgggtataacaatattcgttttgatgacgaagtcagccgaaatatcttttatcgcaatttttacgatccttatgcttatagctggcaaaaaggcaactcccgctgggatctgcttgatgtattacgtgcctgctatgccctgcgcccagaaggcattatctggccagaaaatgaggatggtctgcccagttttaagctagaaaacctgacgaaagccaacggagtggaacatactcaggctcatgatgccatgtccgatgtttatgccactattgcgatggcaaaacgggtaaaaaaagcccaacctcgcttgtttgattattttttccaattaagaaacaaacagaaggtcagtaaccagattgatattccgcaaatgaagccactggttcatgtatcaggaatgttcggaactctgcgcagcaatatcagccttatagcacctttggcatggcacccgacaaaccgcaatgcggtcatcatgtgtgatttggctggtgatatttccccgttactagaactcagcgcagacgaattgcgcgagcgcttgtatacccggcgtaatgaactacagccgggccaagctccagtacccattaaattgatgcatatcaataaatgtccgattattgctcctgaaaatacgctacggacagaagatgcggaacgagtgggattgaatcgcgatcaatgtgcaaaaaatctggttatattgcgcagtaatccgcaaatcagggaaaaagtggttgagctattttctcaaccagaggaattccctgagtccgataatgtcgatgccaagctgtatagcggttttttcagtgatgccgataaaaccgcgatggaaattatccgtgaaaccgcacccaaaaacttacctgcactggatttaacatttcaggatccacgtattaaaacactcctgttccgttaccgcgccagaaactatccggcaacgctggattatgatgaacaacagcgctggctatattatcgccgggagatattgacacaggaaagtatcagccaatatcttgcgaccattgaacagctctttgttgaatatcaatctgatgaagaaaagtgccgccagttaaaagcgctggttgattatgcagttcagctggctggctaa

SEQ ID NO: 3347 - DNA, 120 bp, Xenorhabdus bovienii
  Coding DNA location: Contig name=SeqID_16889; Position on contig =13532..13651bp; Strand=+
atgcagttcagctggctggctaacggccccgcatcatactggcttattttggaaaaagaaaaagacaagatgctctattttgtctttttttctcatcactccagcatcattatagtttaa

SEQ ID NO: 3348 - DNA, 1731 bp, Xenorhabdus bovienii
  Coding DNA location: Contig name=SeqID_16889; Position on contig =13672..15402bp; Strand=-
atgaatgatgctaaaagtcctcaaaaccagcaactcattacaattctcactaatattgttggatcttctcatattctcactgaacctcgaaaaacagaacgttatcgcaaaggttttcgctctggacagggaaatgcccttgctgttgtatttccggcttcattattagagcaatggaaagtgttcaaagcctgtattttagctgacaaaattattttaatgcaggcagctaataccggattgacggaaggttccacacctaacggtgatgattatgaccgcgatattgttattatcagtacactgcggatggataaaatacaggttcttaaatcagtcaatcaggtcattgcatttcctggaagtacattgtggcacctggaaaaggtcttgaaaccgttaggtcgtgagcctcattctgttattggctcttcctgcattggtgcgtcagttgttggggggatctgcaataactctggcggctctttggtccagcgtggcccagcttatacagaaatggcactgtatggccgtgtgaatgagaaggggcaagctgaactgattaatcatttgggtatatcgttagggaatacgccagaagatattctgacttgcttggaagaacagcgttaccgagctgaggatattcagttggatgaccgagttgcttctgatcatgagtatgagcagcgtgttcgagatatcaatgcagataccccatcacgttttaatgccgatgagcgtcggttgtttgaagcctctggttgtgcaggtaaattagttatttttgctgtccgtttggatacttttcctgcacagtcttcttctcaagttttctatatcggtaccaaccaacctgaagtattgacagaattacgccgacatatattagctaatttccagcatttaccgattgctggcgaatatatgcatcgggatatttttgatatcgctgaagggtatggtaaagacacttttatcatgattgataaactgggtacggataaaatgccaatgtttttcagcctgaaagggcgtatagatgccatgtttagcaaaattccttttttgccatcacacctgacagatcgcgtaatacagggcttgagccatttattaccttcacatttgcccgcacgtttgaaagagtaccgaaatcgcttcgaacatcacttgatgttaaaaatgtctggtgaaggcataaaagaagctagtgagtggctggaaagctactttaaacaagccgagggagaatttttcgcctgtacgccagaagagggcgcaaaggcatttttacaccgttttgcggcggcgggagcggctattcggtatcaagctgttcatagcaatgaagttgaggatattttggcattggatattgccctgcgccgcaatgaccacgaatggtttgagcatctaccgccagaaattgatgaagcattggtacatcgtttgtattacggccactttatgtgctacgtattccatcaggattacattgttaaaaaaggcacagatgttcatacactgaaagtaaaaatgctggagatcctgaaccagcgaggagcagaatatcctgctgaacataacgttggccatttatatcaagctaaacagcagcttaaacagttttatcagatgactgatcccactaatactttgaatccgggtattggcaaaacctccaagctgaaaaattggggaagagaggacggaaagtgtgattgttag

SEQ ID NO: 3349 - DNA, 1383 bp, Xenorhabdus bovienii
  Coding DNA location: Contig name=SeqID_16889; Position on contig =15586..16968bp; Strand=-
atgtcgcataatactactctcacacttgacactaaccaaaccagtgctagcaatcgtgttcaactaagaagaacactgaccctgtttcaggtggtcatgatggggcttgcttacatgcagccaatgactatctttgacactttcggcattgtttccggattgaccagcggacacgttgcgacatcttatgctctcgcgctgatcgccattttatttacagcattgagttacgggaaactggtaaaacgcttcccatcagcaggatctgcctatacttacgtacaaaaatcaataaatccccatcttgggtttatggtaggttggtcatcattgctggattatctgcttatgccgatgatcaatattctactggcgaaaatttatcttcaggctcttttcccaggcattgacccatggattttcgtggtcacgttgacaatactgatgacgattttcaacctgagcggcattaatgtagtcgcgaatctcaatggtgttattgtgattgttcaggttgtcgttatgttggtactcgtcggttttttggttcatggtgtctacaatggagaaggagttggaacattattgagtattcaaccgttcacgtcagatgaagcgaagttgattccaatgatcactggcgcgacgatactctgcttctcattcctcgggtttgacggtatcagttctctgtcagaagaaacacctaatgctggaaaggtgatccctaaggcgatcttcatgactgcattaatcggtggggctatctttattacagtatcttatttcttacagctttatttccctgatatttctcggtttaaagacccagatgcctctcagccagaaattatgctgtatgttgctggcgctctgttccagtacattattcttatgttctcctgtgttacggtagtggcttcaggaatggcagcacatgcaggtgtatcccgtctgctctatgtgatggggcgtgatggtgtactgcctgaaaaagtatttgcttatattcacccaaaatggcgtaccccatcaattaatgtcatattggttgggattgttgctctgtcagcgggttggctggatttggtaacagcaaccgcattgatcaacttcggggcgttagtcgcatttacttttgttaatctgtcagtgatttcgcagttctacattcgtgaaaagcgtaacagcacactgaaagatacgattcactttttgctcctgccagttcttggggctgcgacagtgggggtattatggatgaatctggagtcaagttcgatgaagttaggtctaatttggggaggaatcggtattatttatatgttcttcctgacccgcagtttccgtcagccaatgccacagttcactgaatcagtgtaa

SEQ ID NO: 3350 - DNA, 216 bp, Xenorhabdus bovienii
  Coding DNA location: Contig name=SeqID_16889; Position on contig =16958..17173bp; Strand=-
atggagcaattattcacttttgcactcgtgccaattggcgcttgctgctgcaacgatgattatggggcatggtcctccgtcagttcactgtcttctaataactcttctttcttttctgtctatagacagatgcgaagtctacccactaactatcgattaagtagttgtattagtacccagatcgaagttatgggaggtttcgctcatgtcgcataa

SEQ ID NO: 3351 - DNA, 246 bp, Xenorhabdus bovienii
  Coding DNA location: Contig name=SeqID_16889; Position on contig =17172..17417bp; Strand=+
atgtttgcgttcctcagtacagcagcccgttcttataatggccgcttatggtcagtatcgatccggaacaaaatccggcctcttggtgttgtaaaaaataactcaaagcaaaaaaataactggtgtatatttacacaccagctattttttagtgcacgcattttgcatttcacacttagaaatagcaagagctatcacactaaaaattcattattttttacaataccggagagcctgatggaatag

SEQ ID NO: 3352 - DNA, 1974 bp, Xenorhabdus bovienii
  Coding DNA location: Contig name=SeqID_16889; Position on contig =17627..19600bp; Strand=-
atggctgtttttgtaaaaagaaaaatcgtattgggaattattgccgctatttcatccggcacagtcttggctgccaataatggtgaagacaaaattgttgtaactacagcagcaggtttccagcaaaagattgaagatgcacccgcttctatttcggtagttagccgtgaacagttagaaacgaaatcttatcgtgatgtcacggatgcactgaaagatgtaccaggggtagttgtgactggtggtggcagtagtagtgatatcagtattcgtggtatggcttcaaaatatactatgattctgattgatggtaaacgtgttgatactcgcagcacccgcccaaatagtgatggttctggtatcgaacagggatggttgccaccattagcatcaattgaacgtatcgaagtcgtgcgtgggtcgatgtcctctctttatggttctgatgctatgggcggcgtaatcaatattattacccgtaaggtacagaaagagtggcataccagcctgcgtgcagatactactctgaccgaacgtaaaaattcaggtaatagctaccaaaccagcgcttatgctgcggggccattaattgatggtttgttaggattgaaagtcaatggcctgttttctcatcgtaatgaagataagtttattggtggctttagagagcaggaaatgcgtaatggtgcagcaacgttctctttgacacctgatgaacagaatactttcgaatttgaggctgggcgttatgagcaggatcgagactcaaccattggtaaaactcgtgattgccagccaaaatcttgtaaagatgacataagtcgctataaacgtaataactattcgatttcccataatggcgtttatgacttcggtacaatgacttcttatgttcagagggatgaatcgcataaccctgagcgtgaaatgaaatataacgatacgttatttaataaccaaactacgtttatattagatgatcatacgttaagtgtaggaggacagtatcgctatgaagatttacgagatactggtaataaattaaattcagcaaaagatgttaataaattaacacgttggagttgggcattatttgcggaagatgaatggcaaatgaccaatgattttgctctgacgggtggtgctcgtttaaataaagacgaaaactttggagcacattggacgcctcgtttgtatggtgtatggcacgcagatgaacagtggacgatcaaaggtggtgtttctactggttaccgttcacctgaattgcgacaggttgcccctaattggggacagacaacgggtggtagcaatcttaagggaatgattatagggaattcggatattaaaccagagaaaagtgttagtgaagagattagtgttatttggaataatcaagataactttaacgttggtgtaactgtctttaatacagactttaaagacaagatcactgaggttggagagtgtgataaagatactgaaaatccatgtaaaccaacaggtgatattacttatgattttatcaacaagcgtacaaacttggataaagcgaacatccgtggaatagaagccaccctgaattgggatatcgtagaaaacttgtccttagccgcaagttatacttataccgagtcggagcagaaaagcggtaagtataaaggtcaggcattgaataaaatgccaaaacatatggccaacgctaccttgaactggcaggcactaccagaaatggatacgtggactcgcattaatttcagaagtaaatcaacaaattatgtatatcgctctggcgtgaagaatggtacaccatcttacactttcgttgatttgggaatgacctataacttgacgaagaacttgcgtgtattaggtggtatctacaacgtctttgacaagcgcgttactgagaaaacccatgatgcggtactagatggccgtcgttataacatcggcattaattatgatttttaa

SEQ ID NO: 3353 - DNA, 789 bp, Xenorhabdus bovienii
  Coding DNA location: Contig name=SeqID_16889; Position on contig =19753..20541bp; Strand=-
atgaatcagggactgaaaatcaaccgacttacggccgggtatcctaagcatccggtgattgaaaatctgaatgtcaagtcattgcctagtggtcaaatcacggtattgctggggcctaatggcagtggaaagtccacacttcttcgttcattggcggggcttaataaagctagaggtgaactgttgctcaatgggcaggatttgatgcagatgaatttcgctcaacgcgctcagggtgtagtttacctgcctcagtcgttgccggagggggttcatctccatgtactggaatccgtgattgttgcccagcgagcatcaggtggtgtaagcagcaaacaatgtgagaatgaagtcatggaactgttacgtcagcttggcattgaacatttggcgctcagctatctggatcaattatcaggcggacagaaacagttagtgggattggctcaatcattaatcaggcagccgacactgttattattggatgagccattaagtgcactggatttaaattaccaataccatgtcatggatttagtggcacgtgaaactcgtcgtcgtaatattattacggttgttgttgttcacgatattaatattgcattgcgtcatggtgaccatgtattaatgctgaaaaaaggcgagttaattgccgaaggtacacctgaacaggtgattacaccagatagtctggcgcaggtttatggtgttaaaggccgcattgagcgttgctctcagggagtgcctcaggtattaattgatggtttagtgacggaattggctaattag

SEQ ID NO: 3354 - DNA, 1086 bp, Xenorhabdus bovienii
  Coding DNA location: Contig name=SeqID_16889; Position on contig =20538..21623bp; Strand=-
atgagtatcactaccgaacctatgccaatggtgaaacaacaattgagtgagtgcgatgtaaaagcacgctatcgccatattttgcatcgacgtactgcattgatattatttattatttttgtgattgcagcttctttggtactggattttacaatggggccatcagggttatcactgcaagctctctggcagacactggtttcgccggaaagtgttgatgcaggaacgcgggtgattgtttgggacattcgattaccctatgccttgatggcggtagtcatcggcctgtcgcttggattggcaggtgctgaaatgcagaccatcctgaataacccactggccagtccatttaccctgggtgtttccaatgctgcctcatttggtgcggcattggccatcgtgcttggcattggcattccgggaataccggatcaatggctcatctctgccaacgcctttatcttcgctttactggctgccttgatgcttgatggcattacacgctggacaagagtggcaacgtctggcgttgtattgtttggcattgcgatggtgtttaccttcgaagcgctggtttctatgatgcagtttatcgctacagaagacactttacaggggctggttttttggacgatgggtagccttgcaagggctacatgggaaaagctcggcattatgctgctggtatttctcatgattatgcctatctcaatgatgaactcttggaagctgacagcattgcgtttaggtgaagatcgtgcagccagttttggtattaacatcagccgtcttcgtctgggaacattgctgcgcatcagtatcctaaccgcactggcggtagcgtttgtcggtccgattgcgtttatcgggctgatcgcccctcatattgccagaatgatgtttggtgaagatcaccgtttctacttacctgcgagcgcattgattggtgcattagtgttgtcgatggcgtctattgcatccaaaaacctgatccccggaattatcataccggtaggtatcgtcacatcgctgattggtgttccgttcttcctgagcattattttacggcataagggaagtatatga

SEQ ID NO: 3355 - DNA, 1152 bp, Xenorhabdus bovienii
  Coding DNA location: Contig name=SeqID_16889; Position on contig =21644..22795bp; Strand=-
atgaagaggctaactaaagtgaagtttgtatttcgagcagtagtgaagggtatgaatatcagtctactggcaagctccgctatgatggcgagttttgcatcttgggctgaaacagtcacggatgttgctgggcgtactgttgaggtgcctgaaaaagtcaatcgtattttgttgggagaagggcgtctattccattcccttgcactattggaaggagacaagcctttagcgcgtatcgttggctggcaaggtgatttccgtaaactggacccacaaacttactctatttataaagctaaattccctgaaattgataatattcctctgataggtaacaccagcgctgacagtgtcagctctgaaaaagttctgacgcttaatcctgatgtggctattttcggcttatctgggcatgggccaggaaaaaacagtgagctggttaagcagttggaaaaagcaggtattcctgttgtttttgtcgatttccgcaacgaccctttgaaaaacacattaccgagcattcgcatgctgggtaaaatgctgcatcgtgaagagcaagctaacgcttacgctgatttttatgaaaaaaatcaaaaattagtcaccgatatcactgaccgcatagcggaagctcagaaaccttcagtctttattgagttaagagcaggttctagtgaagattgctgtggtacggcaggtaatggcaacatggggaatttcattgacttggctggaggcaaaaacatcgccaaagatgtattgccgtcaccgttggggatgatgaatctggaaaaagtgattgtcgcagatccttatatttatattgcgagtggtgctcaggatccgggtgataaagatgggggtgttcaaatgggtgcccaaacttctgcggatattgcctgcgctggactgaaaactgtcactgcacgtcaaggcatcaataccttgaccgcagtgaaagaagggcgtagttacggtatctggcatcattactacaattcaccttataacgttgtggtgactcaggtttttgccaaatggttctaccctgaaaaatttgctgatctagatccacagcaaacattgaaagaacttcacaataaattcttggctgttgaaccagcaggcacgtattgggtcagtgagaagtaa

SEQ ID NO: 3356 - DNA, 1488 bp, Xenorhabdus bovienii
  Coding DNA location: Contig name=SeqID_16889; Position on contig =23006..24493bp; Strand=-
atgtctcaagaacaaagcacaccaagggatcagcctccaagaaccttgcgccgtgaattaaaagcacgacatatggcgatgattgccattggagggtcaattggcacagggttgtttgttgcttccggcgcaacaatttcacgggctggtcctggtggaaccttactttcctatgcattaattggcctgatggtttatttcctgatgaccagcttgggcgaattggcagcttacatgccagtttcgggttcattttcaacctatggctccaaatatgttgatgaaggttttggcttcgcattgggatggaactactggtataactgggccgttacgatagctgttgaccttgtggcagcacagttggtcatggggtactggttcaatgatgtgccaggttgggtatggagtgcgttgttccttggcataatttttctgctgaacttcatttctgttaaaggttttggtgaagctgaatactggttttccctgatcaaagtctctacgattattgtcttcattattgttggcatcttgatgatcatcggtatcatgaaaggtgctgaaagtgcaggctggcagaattggcaagtggctgatgcgccatttgccggtgggtttgctgccatgattggggtggcaatgattgtcggtttctcatttcaggggaccgaactgattggcattacagcaggggaatcaaaagatccggcgaaaaacattccacgagctgtacgcaaagtattctggcggatcctgttattctatgtttttgccattttgattatcagcttgatcattccttatactgaccccaacttattgcgtaatggtgtgaaagatattagtgtcagcccgttcacgctggtatttgaaaatgcggggttgttgtctgcggctgcgatgatgaacgcagtaatattgacggctgtgctttcagcgggaaattcggggatgtatgcttctacccgcatgttgttcacgttggcgagggaaggtaaggcccccaaaatttttggtcatttgtcaaaaggaggcgttccacgtaacgcactttacgcgactaccgtggttgcagggttgtgtttcttcagctcaatgttcggcaaccagacggtatatctgtggctattgaatacctcaggtatgacagggtttattgcgtggcttgggattgcaatcagccactaccgtttccgtaaaggctatatagcacaagggcgggacttgaatgagctaccctatcgctcaggttttttccctgtcgggccgatttttgcgtttgtgttgtgtttgatgatcacattagggcagaactatcaggcgtttttgcaagataatatcgattggtacggtgtcactgcgacttacatcggtattccgttattcctgattatctggttcagctacaaactgaaaaagaaaactcggtttgttaaatgtagtgagatggaatttccatcgttaaaacttacaggtaatgaataa

SEQ ID NO: 3357 - DNA, 864 bp, Xenorhabdus bovienii
  Coding DNA location: Contig name=SeqID_16889; Position on contig =24662..25525bp; Strand=-
atgcgtatcactctgagacaactggagatttttgcagaagttctgaaaagtggttcaacgacacaggcttctcagcatttagcgttatcacaatctgcggtgagcgcttcactgacggatctcgaagggcaattgggtgtgaagctttttgatagagtgggaaagcggttagtgaccaatgaacatggccgtttgctgtatcccaaagcattagcattacttgaacaggctggtgaagtagaacagctttttaaactggaattgggagcgctgcggttagcggccagtagcaccattggcaattacatgttacctgaaatgctgtcgaaatatcgtcaggactatcctgatacaccattggaattgaatatcagtaataccgaagatgtcataaaggcggttgtcgaatttcgcgtcgatttaggattgattgaaggcttatgtcacaatcctgaattgattacccaaccgtggatggaagatgaattgatgatcttctgctcaccgaaaaattcactttcacagcgtgactttactgtggaagatttgattaaagagccttggatattgagagagaaaggttcaggtacaagggaagtgctggatcaccttttgttctcgcaaatgcctcgattcaatattgcgatggaattgggaaattcggaagcgattaaacatgcagttcaatatggtatgggtatcagttgcctttcgcggcgggtcgtccaagagcaattgaaaaatggcacattagttgagttggtgatccctgaactgaatctttaccgcacactttatctgatttatcaccgtcaaaaacatatgtccaatgcactacaaaaattgttgagctattgtaaataa

SEQ ID NO: 3358 - DNA, 1083 bp, Xenorhabdus bovienii
  Coding DNA location: Contig name=SeqID_16889; Position on contig =25716..26798bp; Strand=+
atgtctgaaagtcaatttggcaaaatcgacaggccccagcacaatccgatactgatattaattcccggattcacactaattgcagttctgactgcaatcgctatccatgtaggcggcatgccgtggtttatcaatatgggattaggtgccctgacacttgccattcttttggggattattgtcggaaatacgctttatcctctcttgaagcccacttgtgataaaggggttcatttcgctaaacactacctgctacgcgctggtatcatcctgtacggctttcgtctaacgttccaacaaatcacagatattggtgcaacagggttactgattgatgccattatgctttcttccacctttttcattgccttatggcttggacgtacctttttgggattggatagtcaaaccgcagtattgattggtgcagggagcagtatttgtggagcagcagccatcatggcaaccgagccagtggtcaaggcatctgccagtaaagtagccgttgcagtttctaccgtggtaattttcgggacgctcgcaatatttatctatccatggttttaccagctcaatgcccattaccaatggcttcctttctctcaagaaacattcggcatcttctctggttcaacgattcacgaagtcgctcaagtcgttgctgttgggcatacattaggcaacaatgccgagaatgcagccgttatcagcaaaatgatccgtgtcatgatgctggccccctttctgttactgctctctggttttattagtcggatagaggctaaaaactttggcaatgatcaaaaaaaatccccaatcagcattccgtggtttgctatatttttcattgctacggcaggcctaaactcttttcatttattacctggctcccttatcaaacatatcattaccgccgataccatcatgctagcaatggcaatggttgcattaggtttaacgactcatgtcagcgccattcgtcaggctggaattaagccgattctgctggcattcttcctgtttatctggctgatggctggaggattaatagtcaatcaaggaatccaacgtttattgggttaa

SEQ ID NO: 3359 - DNA, 843 bp, Xenorhabdus bovienii
  Coding DNA location: Contig name=SeqID_16889; Position on contig =26901..27743bp; Strand=+
atgaaatttgttggagcccatgtgagcgctgctggtggtgttgatcaggcggtgatccgagcgcatgagttacaggcaaccgccttcgccttgttcacgaaaaatcagcgccaatggcatgccccaccgttatcggcagatgttattgataagttcagagccaattgtgaacgttatggctatggcagccaacaaattcttccccacgacagttacctgatcaacctgggtcatcccgaagcggaagcgctggaaaaatcccgcgccgcctttcttgatgaaatgcagcgttgtgaacaactaggcattgatttacttaacttccatccaggaagtcatctcaaaaaaatcgatattgataaatgcctcgcccgaattgccgagtctatcaatatcgtgctggacaaaacacagggtgtaaccgctgtcattgaaaatactgccggtcaaggaaccaatctcggcttcaaatttgaacaactctcagccattattgaaggtgttgaagataaaaaccgtgttggtgtctgtattgatacctgccatgcttttgcggcaggttatgacttacgcacggaaaaagactgcgaagcaactttcgaagcattcgataaaattgttgggttcaagtacctgcgagctatgcatctcaacgacgccaagagcgaattttccagtcgtgttgatcgccatcatagccttggagaaggcaatattggcaatacgccgttcagctacattatgaaagatgatcgtttcaatggcattccattggttcttgaaacgatcaatccaggcatctgggatcaggaaattgcttggctgaaatcccaacagaattga

SEQ ID NO: 3360 - DNA, 939 bp, Xenorhabdus bovienii
  Coding DNA location: Contig name=SeqID_16889; Position on contig =27744..28682bp; Strand=-
atgagtcgtcgagttgccacaattaccttaaatccagcttatgatttagttggtttatgcccagatattaccaagggaacggttaatcgcgtacagaccgcagggttgcatgctgctggtaaagggaacaatgttgcgaaggtgctgcgtgacttgggcattgatgtcacggtcagcggttttctgggacgagaaaatcaggaaggatttcagcagttctttagtgaaaacaatatggtaaaccgctttcatttggtctcaggccgaactcgtatcaatgtgaaattgacagaaaaatacggtgaagtgacggatttcaatttttcaggtttccatgtgacagcagaagaatggaactattttgtcagtgattctctcgactggctggggcagtgcgatatggtggtggtcagtggtagtttgccagagggcattttaccggaatcatttgcggattggatgctgcaattgaaacagcgttgcccctgtataatttttgacagcagccgggaagcttttgttgctggtctggaggcgtcaccgtggctggtaaaacctaatcgtgatgagttggaaatttgggctggtaaaccattacctgacttggatagcgtgattaatgccgcccatgaattgcgtaatagagggattgcccatgtcgtcatttcattgggagagcaaggggcgttatgggtcaatgcttcaggcgcatggctggcaaaaccaccacattgtgaaatagtcagtactgttggggctggggactcgatggtgggaggattagtttacggcttattaatgcgtgaaaccagtgaacatactttgcgtctggcaaccgcagtttctgcacttacggtcagccagccgaatgtagggatcaggagccgcactgaacttgcatcaatgatgtcaaagatcgagctgacttcttttaggtaa

SEQ ID NO: 3361 - DNA, 144 bp, Xenorhabdus bovienii
  Coding DNA location: Contig name=SeqID_16889; Position on contig =28748..28891bp; Strand=-
atgaagatagattttaaattatctgtagtggttttattttcgtcatctgacaagaaatcttctctcggcatatttttacttttagatcgagataacacaacgatcaatcaagtggtaattttaactgaaacgattcaattttga

SEQ ID NO: 3362 - DNA, 525 bp, Xenorhabdus bovienii
  Coding DNA location: Contig name=SeqID_16889; Position on contig =28821..29345bp; Strand=+
atgccgagagaagatttcttgtcagatgacgaaaataaaaccactacagataatttaaaatctatcttcatcatcatggataaattccagccggaggaatatacagtgtcagttgttgtcggagttggtgtcatcattattaatgataaaggtgaagtcctgctgggaaaacgcaccagcaagcacgcaccctattggtcaatctttggtgggcacgtcgatccaggtgaaacttttgaagaatgcgccatccgggaaattcaggaagaaactggattaacgattcaagatcctaaagtctatggtgtctgcaataacctagaaacctaccatgaagaaggaaaacatacagtttctgtctgtttattggcacatcaccctggaggtgagccacaactaatggaacctgaaaaatgtgagcagttaatctggtgtgatcctaatcagctaccagaaccccactttgaagccagccgcaatgccatcaagctatggcaaatggaaaaattctatcttatcgcttaa

SEQ ID NO: 3363 - DNA, 240 bp, Xenorhabdus bovienii
  Coding DNA location: Contig name=SeqID_16889; Position on contig =29254..29493bp; Strand=+
gtgatcctaatcagctaccagaaccccactttgaagccagccgcaatgccatcaagctatggcaaatggaaaaattctatcttatcgcttaaaacaacccatcttctcaaatgcttttcaggcgggttatttcatataacctgctcccacatttgtatgaaaaatacaacaaaaggaatttacttatcatccataaatatttgtttacacatatcattcattaacgtatcgtcaagctag

SEQ ID NO: 3364 - DNA, 1245 bp, Xenorhabdus bovienii
  Coding DNA location: Contig name=SeqID_16889; Position on contig =29525..30769bp; Strand=+
atgaccattgaggtaacgcaaaatttaaaacgtccctccatacttggaggcgcaatgatcattgccggtactgccgtcggtgcaggtatgttttccattcctattgctacttcaggcgtatggtttacaggatcaataattttgctggtatatacttgggcatgtatgtacttctctggcttaatgattttggaagctaatcttaattatccgtctggctctagtttccatactgttactaaagatttactgggtaaaggttggagtaccctcaatggcttatctatcgccttcgttttgtatatcctgacctatgcttatgtttcagccggcagctcgattttatttcataatattacgcatctccttcccctgcctcaatcgggaactgggttgctgttcgcactgatcgttgcctttattgtctggatgtccaccaaagcagttgatcgcttaagtaccattttgataggcggcatggtaataacatttattatgtcagttggaagcatgtttaccgaagtcaaatcaactgtcttatttgatcaagccaatactgaaaccagctatttaccatatactttcatggcgctaccttatctgctggcctcatttggctatcacggtaatatcccaggtctggtgaaatattaccataaggacagtagagccgttgcacacagcctgttctatggcacattaatcgcattggtcatctacattttgtggcagtatgtgattcagggaaatattccccgtgaagccttcaagcagatcatcgccgatgggggtaatatcgcgaatttactgcaacagatggataatacgtccaacaatactaccgtagcccaactcttaaatgctttctcatatatggcattggcgagttcattcttgggtgtatctctgggtctgtttgactatctggctgattttttcggattcgatgacagtggagaaggtcgttttaaaaccgcactggtgacattcattccgccaacggtactggcgttaatctttccaaacggtttcctatatgcgatcggctttgcaggactggcggcaacgatttgggcggttatcgttccagccctgatggctcatgctagccgtgtgcgctatccaaacgccagctatcaggctcccggcggtaattttctgattgcttttatcattctgttcggactgataaatgctacagctcatattctctccttatttgatgtgttacctacttatcattga

SEQ ID NO: 3365 - DNA, 147 bp, Xenorhabdus bovienii
  Coding DNA location: Contig name=SeqID_16889; Position on contig =30818..30964bp; Strand=+
ttgcctaatgtgctgactgcgagtaattttgtcgtcacttcaatattcattccattatttccttgtttttacggaaggtatctatggctaaagccaatgaaattaagcgcggaactgcaatcagttacaatggaaaattattattag

SEQ ID NO: 3366 - DNA, 573 bp, Xenorhabdus bovienii
  Coding DNA location: Contig name=SeqID_16889; Position on contig =30901..31473bp; Strand=+
atggctaaagccaatgaaattaagcgcggaactgcaatcagttacaatggaaaattattattagttaaagacatcgatattcagacacccagcgcgcgtggtgccagcactctgtataagatgcgctttactgatgttagaacgggtcagaaagtggaagagcgtttcaaaggtgatgatattctcgaaaccatcacattgacccgccgcagcgtcagtttttcctatattgatggtgatgaatatatcttcatggatgatgaagatttcaccccttatcactttaaaaaaaatcaaatcgaagaagaattactgtttattcctgaagaaggtttgccgggagtgcaagttttaacaatggatgggcaattgctggctctcgaattaccacaaactgttgatatgatcattgaagaaaccacgccgagtattaaaggagcatcagcaagtgctcgtacaaaacccgctaaaatgagtacaggactcactattcaggtgcctgaatatctgagttcaggcgaaaaaatccgcattcatattgcagaacgtcgttatatgggacgttgtgattag

SEQ ID NO: 3367 - DNA, 312 bp, Xenorhabdus bovienii
  Coding DNA location: Contig name=SeqID_16889; Position on contig =31543..31854bp; Strand=-
atgcaaaattatcttaaattgttaattagctgtttgttggtttcatggatgtcttatggatatgcgcaatctacaggagggcaaattcagttttcaggttctattgttgacccaggatgtcaagtcgtcgtatcgaatactcaggctaatatctcttgctatcggttggggaaaagccttactgtaaagcaaattatttcaactcagaaaacaatcggcgaggtcatgcttcctggtaatataggtgtttccagtgtgaagtggactgatagccaaaaacgtgtggcgatcattaatgtggattacttctga

SEQ ID NO: 3368 - DNA, 132 bp, Xenorhabdus bovienii
  Coding DNA location: Contig name=SeqID_16889; Position on contig =31849..31980bp; Strand=+
ttgcatggtcacctcactttcgtttttccattaactaaaactcagttacctttattccttcatctccatcataattatttcacaggaaaaaatacaacattgacacattttattgattcatatcaaaaatga

SEQ ID NO: 3369 - DNA, 312 bp, Xenorhabdus bovienii
  Coding DNA location: Contig name=SeqID_16889; Position on contig =32136..32447bp; Strand=-
atgttacgaaaaatgacgacttttttgtttatacctttgctttatcctgtaatggcacatgatccgctatcctcaagttttgggtctcttcaatttcatggcgctattgttgagcctccatgtcagtttaattggggtgaagaacgtactgaagtagcctgttggcacaatggcgaacagattaatcaagataaaaacttagaatatcaaaaagatagtgattacccattatcaaagcatattggaatagaagaaataaggtggatggaagaaaacaagaagtcaggaattgttactatcacttatcactaa

SEQ ID NO: 3370 - DNA, 168 bp, Xenorhabdus bovienii
  Coding DNA location: Contig name=SeqID_16889; Position on contig =32758..32925bp; Strand=-
atgagatacctatttaaaacgaaagtaaattttggtggtagtcaaattaactgggggagcactatagcaaaatttatggcaaagagtaatcgctctggcatgttgttgctaagacatggagatatcagcatatttataccatttatggactggcgtaactatcattaa

SEQ ID NO: 3371 - DNA, 705 bp, Xenorhabdus bovienii
  Coding DNA location: Contig name=SeqID_16889; Position on contig =32924..33628bp; Strand=+
atgacccgcagtaacccattatctatatttatacttaatatgctcggtattgccctgtttttctcatggtatttgcctgagaatcacggtttttggtttaacattgatgcagccatttttcatttctttaatgaaaaactgcttccaaattccagatttgcactgtttgtcgccatcgtgaatatcagggcatttgatgttatatcgcttctgtgtatgggcttgctctattacagcgcatttcgcaaacaggactatgcgggtaaacgccgtcttttcatgatagggctggtaatgttagtcactgctgtcattattaaccaaataggccacaaaattcccgtcagccgcccaagcccaacattaacattcgaaaatattaatcgcgtggacgacatgatcagttggcatacaaaagatgcttccaaagacagtttccctggtgatcatggattaatgctattgatttttagttgttttattcttcgctatgtctctcacggcgcatttttcattgccctgctgattatgatcacctttaccctcccgcgcattatggcaggtgctcattggtttacagatattgctatcggttcattatccctgacattaattggaatgagctgggtattactgacacccttaagtgatattatggcaacatggctggataaaaaactgccgtatattaggcgtactaattaa

SEQ ID NO: 3372 - DNA, 585 bp, Xenorhabdus bovienii
  Coding DNA location: Contig name=SeqID_16889; Position on contig =33972..34556bp; Strand=+
atggtcaagtctcaaccaatactgagatacatattgcggttgatacccgcaattctcgcggcagtggtactaaccgcatgtagttcgccagactcccaaatgcgtagcaaaaaaactgatactcatgcagtaaacagccaaaagcacttcttactgcaagcgtctcaggatgagtttgaaactctagttaaaaatttggatactaaatccaaaatccttaaccaatatgcagactggaaaggtgttgcctatcggcttggtgggaatacaaagcgcggcattgattgctctgcttttgtccaacgtaccttccatgatcagttcgatatagatttaccgcgttctacatcagagcagcaaaaaattggccaaaccgtcagccgttctaaattacgggcaggtgatttagtgctgttcaaaacaggcatttatatgcgccatgtcggtatttacatcggcaataaccaatttgtacatgcttcgaccagtaatggagtgatcgtttccaaattgaccgatacctactggactaaacggtactacggcgcaagacgagttctgcgagacgtgaacaaagtctcctga

SEQ ID NO: 3373 - DNA, 345 bp, Xenorhabdus bovienii
  Coding DNA location: Contig name=SeqID_16889; Position on contig =34631..34975bp; Strand=-
gtggataatatccaactttcggtagtacatagactgccgcaaagttatcggtggtcatctggcttcgttggtacgaaagttgaaattttaccaacagaagaaacagatataggaaatagcctgatggggctgaaattgttaagccatgaaggtgaaaatgctcgggttattttgcatagtttgaatcaatctattgctgatatgcaaatattgagcgcagtaattgagtgggaaggtgagccatgtttgttttttgctaaagaggatgagagtgcagtgatatgtcgacttaagacattaggtgctgcgattgcagaaaacataacggcgttgtacccactttag

SEQ ID NO: 3374 - DNA, 153 bp, Xenorhabdus bovienii
  Coding DNA location: Contig name=SeqID_16889; Position on contig =34946..35098bp; Strand=+
atgtactaccgaaagttggatattatccacgtattattcctatcagaaacaacattaatacatctaaccaccagctgtaggctatcagtgcgtcaaaaccgaataaccccccaacaaaaagcaaacaaaaaagtaaataaaaagttaaaataa

SEQ ID NO: 3375 - DNA, 93 bp, Xenorhabdus bovienii
  Coding DNA location: Contig name=SeqID_16889; Position on contig =35462..35554bp; Strand=+
atggcttcttttgctatttcaagatttttggggattatctctaaatgcagccactatcaggacagaataaaaaatattgggaaaactctatga

SEQ ID NO: 3376 - DNA, 1131 bp, Xenorhabdus bovienii
  Coding DNA location: Contig name=SeqID_16889; Position on contig =35659..36789bp; Strand=-
atgttgatgccattggcaattgatatgtatttgccgagtatgccaacgattgccaccaattttggcgtcgatgccggtcgagtacaaatgacgctgagtagttacattttgggttttgccattgggcagatggtctatgggccaatgtcagatagtctgggacgtaagccagtcattgtaggtggtgtgattgtttttgccattgcttctgctgcgtgtgctttgtcacaaaatattgatacctttatttccatgcgctttctgcacgggttttctgctgcagcagcaagtgttgtgatcaacgctttgatgcgagatatgttcacgaaagatgaattttcccgcagtatgtcttttgtgacattggtgatgatcattgcgccgttgttggctcccatgttaggtgggttgatgatggtatggttcaattggcatgctattttctggtcaatctcgattgctggagtgataaccgcgtttcttgttgctttctttatccgggaaacattaccgaaagagagaaggcagcgattcaatttaaaaactatttttaaccagtttgctatgttatttcggcagcgtcaggtgctgttttacatcttggcaagtggattttcttttgcaggcatgttttcttttcttagtgccggtgcatttgtttacattgacttgaacggggtttctgcacaacattttggttactattttgggttgaacattatttttctgttcattatgaccatgattaatagtcaatgtgtccgcaaatatggcgcatcgaaaatgctgcatttcggcgtgtttgtgcaatttgtcatgggtttatggttattatttagcactgtacttgatttagggtttatttctcttgtacttggtgttgcaatttatatcagtggtatttccatgatcacttctaatgctatggctgttgttctggacgattatcctcatatggctggaacggttgcgtcactggctggaactattcgtttcagtattgctgcgctggtgggcacaattttatcttcagtatctgcaaaaagcgcatggccgatggtgggctcaatggcattatgcgtaatattggcaatgttacttattatttatgcgaataaggccaaaaaataa

SEQ ID NO: 3377 - DNA, 708 bp, Xenorhabdus bovienii
  Coding DNA location: Contig name=SeqID_16889; Position on contig =36893..37600bp; Strand=-
atgcgattggataaatttttatcacagcagttaggtataagtcgtaacgatataggtcgtgaactacggactagtcgggttactgtcgatggcgaggtcattaagagcggtgcgtataaattgaagcccgatcagcaggtagcctatgaaggttcagtattggaacagttagatggttcccgctattttatgctgaataaaccacagggatatgtgtgttcgacggatgatccaacaaatccgacaattttgtattttatcgatgaacctgttgcccataaattacactcagcaggccgtttggatattgataccacaggcttggttttgctgacagatgatgggcaatggtcacatcgtattacgtcacccaaacatcattgtgaaaaaacctatcttgttacattggaatatccaatatcagacgatattgagatgaaatttcttgcaggtgtgcagttgaatggcgaaaaaacactgacaaaaccagcgaaactagaaattatcgagcctcaccgtgtacgtttgagtatcagtgaaggacgataccatcaagtaaaacggatgttcgccgcagtgggcaatcatgttgttgagcttcatcgtgaacgaattggtcaaatttgtttggactctgcattggagccaggagaatatcgagcattgaccaaaaacgaaattaacagcatacaggtgccaacaccttaa

SEQ ID NO: 3378 - DNA, 123 bp, Xenorhabdus bovienii
  Coding DNA location: Contig name=SeqID_16889; Position on contig =37633..37755bp; Strand=+
atgaacacacccttgatattgcaagcacttcaagggtcactattggagtacaagattaaacagataatattcagagtcatcgtaacatcaataattataacaataataaactacatgttatag

SEQ ID NO: 3379 - DNA, 1758 bp, Xenorhabdus bovienii
  Coding DNA location: Contig name=SeqID_16889; Position on contig =37871..39628bp; Strand=+
atggcttttactttacgcccttaccaacaagaagcggtagatgctaccatccaccattttcgtcagcacaaagatcctgcggtcattgttttgccaacaggggcgggtaaaagcctcatcatcgcagaattagcaaaactggctcacggccgagttttgatactggcacacgtcaaagaacttgttgcacaaaaccatagcaagtattgtgcctatgacctgcaagcggatattttttctgcgggattgcatcaaaagcagagtgaaagaaaagttgtctttggtagcattcaatccgttgctcgcaatctggattgttttgatcatcatttctcactgttaattattgatgaatgccaccgtatcagtgatgatgaaaacagtcagtatcagcaaattatccagcaactcaagaaaaacaatccccagatacgtatcttgggcttaaccgccacgccctaccgtttaggctctggctggatataccaatatcactatcatggcatgatacgtggagatgaacactgtttttttcgtgattgtatttatgaacttccgttacgttatatgattaaacatcactttctggtgcccccagaaagattggatatgcccgtaatgcaatatgatttcagtcaggttcgtaccagccagcagggaattttcaatgaagctgacctgaatcgggagataaaacgacaaaagcgcattactcctcatatcattaagcaaatcatcgaatatgcccaagaccgcaaaggagtcatgattttcgctgccacagtggaacatgctaaagagattttccaattgctatctgctgaacaggccgcattagtcagcgcaaataccccagcaactgaacgggatttattgatcactgctttcaaggcgcaacaactccaatatatggtcaacgtcgccgtgctgacaacagggtttgatgcgcctcatgtcgatttaatcgctatattacgtccaacagagtccgtcagtctctaccaacaaatcatcgggcggggattacgcttatcccctgacaaaaaagagtgcttaattctggattacgccggaaatccccatgatatttattcccccgaagtcggtagtagcaagcccaattctcaaaaccagcctatacaggtattttgccctatctgccaatttgccaataccttctgggggaaatgtacagcggaaggtgaaatcattgagcattttggccgtcgttgccaaggatgggaagaagatgaaagcggcaaacgacatcaatgtgatttccgatttcgtttcaaatcctgcccacattgcggtgcagaaaatgatatcgctgcacgacgctgtcaccgctgccaggaagtcctggtcgatcctgatgatatgctgaaagccgcccttaagctcaagaatgcactggtactacgttgtggcggtatgcaattaacgtcgggtcatgatagtaaaggggaatggctgcaaatcacttattacgatgaagatggtgcggacgtatcagaacggttccgtttagcaacacctgctcagagaaaagtgtttgagcttcacttcctacgccagcaccagcgtgcgccgggtatccctctgcaatggaaaacagctgaggacattgcacaacagcttcctctattacgacatcccgactttgttgtcgcacgaaaaaaaggtcagttctggcaaattcgggaaaaggtttttgactatcaaggacggtttcgccgagcagatgatctgtactga

SEQ ID NO: 3380 - DNA, 282 bp, Xenorhabdus bovienii
  Coding DNA location: Contig name=SeqID_16889; Position on contig =39791..40072bp; Strand=+
atgttaactattaatgcagaagtacgtaaagagcagggcaagggtgcgagccgccgcctgcgtagagctaacaagtttccagctatcatctatggtggtaaccaagaaccagtttctatcgaactggatcacgatgcagttatcaaccacgaaagtaaaccagaattctatgaagtcctgaatctggttgttgatggtaaagaaactacagttaaagtgcaggcagtacagcgtcatccgtttaaacctaagctgacgcacatcgatttcctgcgtgcttaa

SEQ ID NO: 3381 - DNA, 207 bp, Xenorhabdus bovienii
  Coding DNA location: Contig name=SeqID_16889; Position on contig =40170..40376bp; Strand=-
ttggaagagagtttcccagcagatcgcggtacattacgtcaattaacaaaatttgctggcagtggtggcggattgaccatcaactttgatgcaatgttgttgggagagcgaattttttgggacccagtgacggatactctgacgattaaaggcacgccaccaaacttgcgtgaccaactgcaacgtcgtggcagtggtaatcattaa

SEQ ID NO: 3382 - DNA, 846 bp, Xenorhabdus bovienii
  Coding DNA location: Contig name=SeqID_16889; Position on contig =40331..41176bp; Strand=-
atgagtctggaaattacccagatcgcgttacaccggttgattaaacgtgatgaacaaacacttgaagtcattctgcgtgattctttgctgaccaccaatcaggtcgtagaagatatgatggctgaattacatcgtgtgtatagcgcaaaaagcaaagcctatggtttattcaatgatgaaagtgaactggcggaatcgctccgtcatcaacgtaagggagatgaagactttctcggttttagccgtgctgcaaccgttcgcttgaaagatgaattgacaaaatatccgtttgcggaaggtggtacggtgttgttttgccagtatcggtatctggccgtagagtatttacttatttcggttctcaatagttgcaacagcatgtctgtcaatgacgagctggatgtgaacactacgcagtatcttgatattcctcatgctgatatcgttgcgagaattgacttgactgagtgggaaactaatcccgaatccagtcgttatctgacttttttgaaagggcgggtagggcgtaaggtttctgacttttttatggattttctgtctgccagtgaaggcatgaatgccaaagtgcagaataaggggttgttgcaggcggtggacgattattgcgaatcagcccagattgataaaaatgaacgtcaggcttatcgccagcaggtttacagctattgtaatgagcagttacaggcaggtgaggagattaaactacaagagttgtctcaagaattgccaccattgggcgagcagaattccagcaattttcgcaggaacagggatacgaattggaagagagtttcccagcagatcgcggtacattacgtcaattaa

SEQ ID NO: 3383 - DNA, 114 bp, Xenorhabdus bovienii
  Coding DNA location: Contig name=SeqID_16889; Position on contig =41311..41424bp; Strand=-
atgttcaactttttcatcgctgtagcgagacgactgtggcataaatcaaagatcctggatatacaaagccctatatactaccgtatagaagggcaattttctgcttttttatga

SEQ ID NO: 3384 - DNA, 228 bp, Xenorhabdus bovienii
  Coding DNA location: Contig name=SeqID_16889; Position on contig =41383..41610bp; Strand=+
atgccacagtcgtctcgctacagcgatgaaaaagttgaacatttattagctgaattggtaaatgttttcgagaaaaaccatacacctactgatttgtccctgatgatcttgggcaatatggtaacgaatttaatcaatacgagtattgcccctgcgcagcgtaggcacatcgcagactcgtttgcacgcgcgttacagtcctcgattaatgaagacaaagcgcattaa

SEQ ID NO: 3385 - DNA, 732 bp, Xenorhabdus bovienii
  Coding DNA location: Contig name=SeqID_16889; Position on contig =41640..42371bp; Strand=+
atggtgactagccgtcagcattaccgcgaaaaagtctctcagatgatcagctggggacactggtttgcactgttcaatattgtgttcagtcttgtgctgggcagtcgctatttatttgcgtctgactggccgggttcactgtttggtcgcatctatgcgctactcagttggctcggtcattttagtttcattgtctttgccatttacttacttattttatttccgctgacgtttgttgtgatgtcacagcggttattgaggtttctttccgctgcactggccacagcagggctaaccctgctcatactagattcctctatctatattcgctttcacctgcacctgacaccgttggtttgggacttagtcaccaacccagaacagggcgaactgacaagggaatggcaactgatgttcatctgcataccggctatttttctagtgcagatgctatttggcacatggagctggcaaaaattacgtagcctgaatcgccaacggtcggtaagccattggcggcggtattcattaccggcttttatcgcttcccatctgatgtatatctgggcagatgctaacttctaccgcctcatttacatgcagcgttcaaatttaccactggttttattcaatgaccggacgcaaattccctggaaaacaccgaattactggatcaacaggaatccagcgccgtatgaaccaacaaggaaacccggctgccctaaccgttga

SEQ ID NO: 3386 - DNA, 1170 bp, Xenorhabdus bovienii
  Coding DNA location: Contig name=SeqID_16889; Position on contig =42211..43380bp; Strand=+
atgctaacttctaccgcctcatttacatgcagcgttcaaatttaccactggttttattcaatgaccggacgcaaattccctggaaaacaccgaattactggatcaacaggaatccagcgccgtatgaaccaacaaggaaacccggctgccctaaccgttgaatatccactgaatggcttatcctaccaagataacaggcaaggttataatttactgttgctagttgtagatgatctggataacaaagacattaccaacgccatgccgtcccttgagcgctttactcagaacaatatccaatttacacagcacttcagtactggcattcaaaacgatactgcattgtttggattattctatggcatatcatcaggctatctagatggcattcttaatagtagaaaatcctcagcgcttcttgatgcactgactcaccagaggtatcaatttggtctgttctcttcggatgggttccaaacacctctttaccgccaggctcttttgaccgattactcattccctaccccaaccaagaaagatgatagcctaaccgtgacaaaatggcgtcagtggctggatctcaatcatggcactaccccgtggttctcatttttgggcattaatggttttacacactcaacgggccaatttgacaaaaaagcacttgataccgaaatcaataatgttttagagacactaaccaataaaggcatgctggataaaaccatcgtggttattacagccaaacacagtgaattatccacgggacactcaccaaaatggcttactggcgacaaattcaatcgtgaacagatacatgtcccgctcatcattcactggccgggtacacctgcacaggtcatcaacaaattaaccagtcatcaggatgtcatgactaccctgatgcaacgtttattacatgtcagtaattctccaggtgattattctcaaggtgaagatctctttaccgttcggagagataacccatggttaatcacgggtgatgacggctcattaattgtcacaacggctacaaataccatctatctttccaagaacggagaatattatctgtatgatttggatggtaatgaaattcaaggagccaagcctaacctcgcccagttattacaaatactaaccgaggttaaacgatttttagcaaactaa

SEQ ID NO: 3387 - DNA, 102 bp, Xenorhabdus bovienii
  Coding DNA location: Contig name=SeqID_16889; Position on contig =43529..43630bp; Strand=-
atggagatattagggcgggattttacacccattttacaccaagcaaatttgaggcataaaaaaaccaaccataataggttggttttcttagggaaatttggt

SEQ ID NO: 3388 - DNA, 102 bp, Xenorhabdus bovienii
  Coding DNA location: Contig name=SeqID_16889; Position on contig =43599..43700bp; Strand=+
atgggtgtaaaatcccgccctaatatctccattcttaccttaccttaccttatcttcacttgtactttctttgttaatgcgacagaacccttttgcgcatag

SEQ ID NO: 3389 - DNA, 648 bp, Xenorhabdus bovienii
  Coding DNA location: Contig name=SeqID_16889; Position on contig =43789..44436bp; Strand=-
atggatcgcgttatctatagcgcaaaattcggtgataagacggtcaggtttgttgtgattaaaatggaactttatgtgtcacgtactgatattgtcgaaagctttcgtgagtgcgccactgattatgtaaagctcgaagttaatggtttagtggacgattggttaaaagggatgggggatgttcaagatagaaaatcagccatgttgggtgaaagtagtatcgggccagttgtacatttttatactattagccatctacttcatattatgtctgatttcaatgagtctagaaatgatgaattgatagcgctaggacgcagggttaatgctctttttagatggttttctgatgcttcttaccaggctcatgagcatttcggtataacgatctttgagatgcttaattcagttagtaaaagattagaccggcttaatgatttttttgttgtgaatgttatccatgatggtgatgtgtgggtttctgagtgcgatgaacttgggctggttacagaagctaagacttatgatgagttaacagaacaagtttgggaaatagcgtctgaattgtatgagctagtcggcgattctgagtacattcgtatcaagtttgttcaggaacaatcatctgattcaaggatagccctctga

SEQ ID NO: 3390 - DNA, 171 bp, Xenorhabdus bovienii
  Coding DNA location: Contig name=SeqID_16889; Position on contig =44706..44876bp; Strand=+
gtgcctgttccaagatcagaattttcgaccagaaaacgatctcacaaggaacagtcatggataaatgaattgaacttttctgcgatgtcgacgattcttgccgtgttttcattccaccaggggaacaacagtgtatcgcgaagtggcaacgccgacgttatggtcacatga

SEQ ID NO: 3391 - DNA, 189 bp, Xenorhabdus bovienii
  Coding DNA location: Contig name=SeqID_16889; Position on contig =44873..45061bp; Strand=+
atgagtatcagtgaaatcatgaccatcttgatcttttttcctatgtcaaatcaccgtaatttcaaaatattttatttgggactcacttggcaatatcattacaacgattttccggccttgctcagttacacctgttttatcggagttgtttcctctgtattacccttgctacttgcagtacggctttaa

SEQ ID NO: 3392 - DNA, 111 bp, Xenorhabdus bovienii
  Coding DNA location: Contig name=SeqID_16889; Position on contig =45065..45175bp; Strand=-
atgcttaatacgccactgaacgttaaaagaaaattgtctgatggttgccatctgttggtaggtcaactggcagaaactcaacaaccaccgactttagttggtggttgttga

SEQ ID NO: 3393 - DNA, 276 bp, Xenorhabdus bovienii
  Coding DNA location: Contig name=SeqID_16889; Position on contig =45168..45443bp; Strand=-
atgctttcactctacacagcctatgatgtacagcatgaattaagagattttatcaagcgacaacgtaagcaacaaaaaatcaccgttgaagtgctgtccaagcgttccggtgtgccatatagcaccatcaggaaatttgagcgtacaggcaatatctctttgcggcagtttttaatgctattagaagctattggtgaactgaacccactgcatcaattaaccaaagagcgcaagcaggagccaatcacgattgcagaggtactcaagaatgcttaa

SEQ ID NO: 3394 - DNA, 165 bp, Xenorhabdus bovienii
  Coding DNA location: Contig name=SeqID_16889; Position on contig =45461..45625bp; Strand=-
atggtaaatagctcaaatgtatcctctcaatgcgcccaccattatataagtaaaaaaagctccaacgactacggaatgctcaccaagaaacaactcacacattccacaataattctactattgtggaatttaatcataattttcactatgttattgttactctag

SEQ ID NO: 3395 - DNA, 165 bp, Xenorhabdus bovienii
  Coding DNA location: Contig name=SeqID_16889; Position on contig =45619..45783bp; Strand=-
atgtcatgtcagcaggtgtataaaatcatccgtgaggctcgtttaaaggccaatttagcgatttgcgtgaatccgcacatattatggcatgcctgtgattatacaaaacaacaaggccacctgctcaagcggatggcctgggtgaatatctttgtccaatggtaa

SEQ ID NO: 3396 - DNA, 156 bp, Xenorhabdus bovienii
  Coding DNA location: Contig name=SeqID_16889; Position on contig =45738..45893bp; Strand=-
ttgatattgcagtctaaaaataatcaacaaaactcatataaattacttatttttatttttcttaatcatctgaacctgttgttggttgaactggaaagacacgtacacgcatgtcatgtcagcaggtgtataaaatcatccgtgaggctcgtttaa

SEQ ID NO: 3397 - DNA, 1116 bp, Xenorhabdus bovienii
  Coding DNA location: Contig name=SeqID_16889; Position on contig =45961..47076bp; Strand=-
atgaaagaattagtggatgtcttttctgattttccagacccacgttgtcagggaaaggtcaaacaccgtgttattgatatcttagtgatcgcggtatgcgctgtcattgctggggctaacgcctggactgatattgaacagtacggtcaactcaaaaaggattggctgagttcatttcttccgctcaaagggggtattccgtcacatgatactttccggcgctgtttcagtttattaaacccgagcctctttgaacatcatttttatcaatgggtttctcgtgacctctcttcagaaaaacgggctatcattgcgattgatggtaaaagtttacgtcattcgtttgataagaaaattgaccaaagcgcattacatatggtgagtgcattcacggttgagaaagggcttagcttatgtcaatgtgccgtagacggaaaatcaaacgaaattaaggccattccggcattattatcgatgctttcattgaaaggccatctcgtgacgatggatgcgatgggttgccaacgcacgattgctcagcaactacgcgagagtgaagccgattatattttgtcgcttaaaggcaatcaggggaaaaccttttcggaagcggttaactattttcaacaacaacagataacccaaaaaccttaccttaaacctgaccatgatgaattcgatgatagccacggacgtaccgtcagacggcgcggatgggttctgccactgacatcagaaacaaaacacttaaggtcttggccagatattcaagctcttctggtaacagaaacgatacgacaagaacactattctgacacggtgacttctgactttcgttattatttaagcagttgtcatgattctcccgcctttcagttaggtgcaatacgaaaacattgggctatcgaaaatagtttacactgggtactggatgtcactttccgagaagatgattcacggatgagagagcgggtcgccacaagaatatttgcccaattacgtaaaatggcactcaatattgttaaacgagatatcaatagtaaattgagtttgagtgcgcgaagaaaatcagcgggatgggataacggttatatggaagcactatttcatgcgtaa

SEQ ID NO: 3398 - DNA, 159 bp, Xenorhabdus bovienii
  Coding DNA location: Contig name=SeqID_16889; Position on contig =47109..47267bp; Strand=-
atgtttgtcggagaaactatcactttagttcctatttttattaaggtgttttttctttatataaacttaacaaaatggtacagcctaaaatcaagtcaattacccccattttattacaggattgttaagttcccaggggttacgcatgaaaatatttag

SEQ ID NO: 3399 - DNA, 114 bp, Xenorhabdus bovienii
  Coding DNA location: Contig name=SeqID_16889; Position on contig =47306..47419bp; Strand=-
atggatctttttctagtaaacttcgctgatatggcagccaaggggttgagtgagaacaaaaccattggcctcgatcggctggataagctcctgttacacggatattctcattga

SEQ ID NO: 3400 - DNA, 324 bp, Xenorhabdus bovienii
  Coding DNA location: Contig name=SeqID_16889; Position on contig =47525..47848bp; Strand=-
gtgaatttttcagaaaaacctgtgaaagttactcgttggacggctataaatctagctgcaagagattttcgttacgtatgtggtatcagatatacttcttcatcactcgaaattagcacaggggaaagcgttaagatcccattgagttataaagcgcccggttgggaagctacttatatagaagcaacctttcatgatggatatgtggcaacaacgcaggtttatatcactccagatgataaatacccagtagtggctcctccttcgaatggtatagcatgccaaactctgcccggccgtgggttaggggaaaataaaccgtga

SEQ ID NO: 3401 - DNA, 147 bp, Xenorhabdus bovienii; identical to SEQ ID NO: 349
  Coding DNA location: Contig name=SeqID_16889; Position on contig =47880..48026bp; Strand=+

SEQ ID NO: 3402 - DNA, 336 bp, Xenorhabdus bovienii
  Coding DNA location: Contig name=SeqID_16889; Position on contig =48004..48339bp; Strand=-
atggatgggccggaacagagaaaattaattccgttacatattcctatggctgttactgtatctcaggctatgagggtggcaaaacaggaactgaaagaatggaatattaataaatttatcgtcactggagcatcaaagcgcggatggacagcttggttatcttctatttcagatcctgacgttgatgctattgtgccctttgttatggacttacttagtaccgacttggctcttgagaatatgtatcgtacttacggtggaaactggccgattaccttttccccctattatcaacaaggtatcgacaagttacttaactaccacctactgaagtag

SEQ ID NO: 3403 - DNA, 318 bp, Xenorhabdus bovienii
  Coding DNA location: Contig name=SeqID_16889; Position on contig =48454..48771bp; Strand=-
atggttgatttttctcatgttattccgtgttaccgggcgaaactggctgcgctcccggttaaatattcgctccaaggcaaaaaatcactacctagtattgaattgctaaaatatgaaatgacatcacaacgatggtcgccgggaaatttggtatcccctgatagctggcaacatgacgttgacatgtatatcccggataaccctaaatcgcaacatgcgctcgtcgtggtaaataatggaacaaattatgatgatgacatcaaaaaaacaagccagccaacaaatttcagcgagaaatcactggcagagattgcatga

SEQ ID NO: 3404 - DNA, 99 bp, Xenorhabdus bovienii
  Coding DNA location: Contig name=SeqID_16889; Position on contig =48754..48852bp; Strand=+
atgagaaaaatcaaccatatcctcttactggcatatggcattttccgtatttatcagagcggaaccttcagcagaaaagaaaaaaagagtgataaatag

SEQ ID NO: 3405 - DNA, 1458 bp, Xenorhabdus bovienii
  Coding DNA location: Contig name=SeqID_16889; Position on contig =49050..50507bp; Strand=-
atgacaataacttctgaacaattgatcgcactgttgccgctattgatcgtcggattgacggtggtggttgtgatgctgtccattgcgtggcgacgcgatcatttgatcaatttcaccttaacggtaattggtctgaatctagccctgctttctctctattttgttggacagcaggagccgatggatgtcacgccactgattcatgtggatagatttgcaatgttttataccggccttgtgctgattgcgagccttgcaacgaccacatttgcttactcatggctggagaattatcccgataacaaagaagaattttacctgctggtgttgattgcggctgtcggaggaattctgctttcttctgctaaccatatggcatcactgtttatcggtattgaactgattactctgccattatttggcttgattggttatgcgtaccgccagaaacgttcactggaagcgagtattaaatatatgctgctgtccgcagcggcatcttcgttcctgctattcggtattgcactgttgtacgcagaatcaggtgacttgtcctttgcgtcactgggtagaagcctgagtgacagtcaactgcatgagccgctgatcttggcagggctgggaatgatgcttgtggggctgggtttcaaactttccctcgtacctttccaactttggacaccagacgtttatcaaggcgccccggcacctgtatcgacttttctggcgacggccagcaaagtcgctatctttgcggtgataatgcgtttattcctcgaagcacctgtggctgaaagtgaaacgctgcgcattgtgctgaccgtgatggcaattgcttccatcctgtttggtaatttgctggcactgacacaaagtaatatcaagcgcctgctcggttactcatcgattgcgcacttgggttacttgctggtggtcttggttgccattcgaagtcacacattggcagaagaaacggcgggtatttatctggcgggttacctgtttgccagcatcggtgcatttggggtagtcagtctgatgtccagtccataccaaggtccagatgctgactcactgtactcataccgtggcctgttctggcataaaccgattctgtcagcagtcatgactatcataatgctgtccctggcagggataccgttaacattcgggtttatcggtaaattctatgttatcgctacggcggtagaagcagaattgtggtggctgacgggggctgtcgtgctgggcagtgccattggcctctactactacctgcgagtaatggttagtctgtatctgcctgcaccgaagacactgaatcgcgatacgccaagcaactgggcgttgacttcaggtgggatcgttgtgttgatctctgggttgctggtgttgatcctcggtatttggccacaaccagtgattgatatcgttcagcaggcgaaaagcgccatgtag

SEQ ID NO: 3406 - DNA, 1521 bp, Xenorhabdus bovienii
  Coding DNA location: Contig name=SeqID_16889; Position on contig =50514..52034bp; Strand=-
atgctactaccttggctaattcttctacccttcatcggtggcttgctgtgctggcagacggagcgcttcggcacccgtatgccgcgttggatagcgcttctggcgatggggctgactctgctgctttccctgcaactttggttacagggcggttatacgctgaccaacccacagggcattccacagtggcaatcagaattcctgatcccgtggatacctcgctttggcatctccattcatctggctttggatggtttatcactgctgatggtggtcttgacagcactgctgggcttgatggcaattctctgttcgtggaatgaaaaccagccatatcagggattcttccatctgaacctgctgtggatacttggcggtgtgatgggtgtcttccttgccatcgacctgttcctgttctttttcttctgggaaatgatgctggtgccgatgtatttcctgatcgctctgtggggacacagaggttcaggcggtaaaacccgtattacggcagcgacgaaattcttcatttatacccaagccagtggtctggtaatgctgatttcgattctggcattagctttcgtctattacgatgcaacgggagaatggtcattcagctatgaaaaactgctgaatacaccgatgtcagataccgttcaatacttactgatgctgggtttcttcatcgcatttgccgtaaaaatgcccgttgtgcctctgcatggctggttgccggatgcgcatagccaggcaccgactgcaggttcagttgaccttgcggggatcttgttgaaaacagcggcgtatggtctgttgcgttttagcttgcctctgtttccacaagcctctgcggaatttgcgccgattgcgatgtggctgggtgtcattggtatcttctacggtgcgtggatggccttcagccagactgacatcaaacgcctgattgcctataccagtgtttctcacatgggtttcgtactgattgccatctacaccggcagccaactggcttatcagggggcggtcatccagatgattgcacatggtttgtcagccgctggcctgtttatcgtgtgtgggcaattatatgaacgtctgcatacccgcgatatgcgtaatatgggcggtttgtggggaagaattcaactgttgcctgcgatatcgctgtttttcgctgtggcgacactgggtatgccgggaaccggtaactttgttggtgaattcatgatcctgttcggcagtttcagcaaattcacccttattactaccgtatccgtgtttggtttagtttttgcatccgtttacgcactgtatttaatgcagaaagcgtattacggcacgccaacaactgataagccactacaacggatggatgtgcgtgaaatctccattttgctactgttggtcgtcttgctggtgattgtgggtgtttatccgcaaccggtccttgatacctcagcggcggcgatgagtaacatccaaaattggtattcagcttcacttttaactacaaggccgtaa

SEQ ID NO: 3407 - DNA, 1851 bp, Xenorhabdus bovienii
  Coding DNA location: Contig name=SeqID_16889; Position on contig =52054..53904bp; Strand=-
atgaacctactctatttaacaattctactgccactgctgggttttttactattggcattctctcgtggccgctggtctgaaaatctgtcagctaccattgggagtgcttctgttgggctggcagcattagccacactctgggccggggtggatttccacgcccagaatggggcagaggggctggtttacagccagacattgtggaactggatggaggcagataacttcagtattccggttaatctggtactggatgggctatctctgaccatgctgagtgttgtgacgggcgttggtttcctgatccacatttatgcttcatggtacatgcgcggtgaagagggttactcccgtttcttcgcttataccaatttgtttatcgccagtatggtggttttggtactggcggataacatgctgctgatgtacctcggttgggaaggcgttgggctgtgtagttatctgctgatcggtttctactataaaacgcctgccaatggcgcagcggcaatgaaagccttcatcgtaacccgcgtaggtgacgtgttccttgccattgggatgtttatcctttatgaccagtttggcacattgagtttccgcgaattggcggtattggcaccgcagcatatcgaagcaggctctacggcgattacttgggcaaccttgatgattctgggtggtgccgtgggtaaatcggctcagttgccactgcaaacgtggctggcagatgcgatggcaggtccgacaccggtttctgctttgatccacgcggccactatggttactgccggggtttacctgattgcacgcagccatgcgttgttcctgatggcgccggatattcttcatctggttggtactattggggctattaccttgctgctggcaggcttcgcagcgctggtgcagaccgatatcaaacgcgtgctggcctattccaccatgagtcagattggttatatgtttctggctctgggcgttcaggcgtgggatgccgccatcttccacctgatgactcatgcattcttcaaagcactgttattccttgcttctggctccgtgattctggcttgtcaccacgaacagaatatcttcaaaatgggtggcttgagtaagcgcattccgtttgtttatctctgcttcatcgtgggtggttcggcactgtcagcgctgccacttctgactgctggcttctacagtaaagatgaaattctgtggggcgcactggcgaatggtcatatgaacctgatgctggcggggcttgtcggtgctttgatgacatcactgtataccttccgaatgatctttatcgtgtttcacggtgaagaaaataccaaggctcatccagtcaaagggattacccataccttacctctatcggtattgctggtgctctctacttttgtaggagcgctgattgtgccaccgttggcgggagttctgccggaaagtagtacaacagcagggcatgacgacaaactgacattagagattgtttctggtgtggttgctgttctcggtatcttgctggcagcagcgttgtacttgggcaaacgtgctgtggttaaggccactgcaaacagtgtgccggggcgtttcttctccacatggtggttccatgcatggggatttgatgcactgtatgactgggtattcgtgaaaccattcaaaggcattactcaactattacagaatgatcctttgaactcactgatgaatattcctgccatattgtcacgttggggtaataaggggcttggcttaagtgagaacggacaagtccgttggtacgctacctctttggggttgggggcagtgctggttttggctctgctgcttttgatttaa

SEQ ID NO: 3408 - DNA, 303 bp, Xenorhabdus bovienii
  Coding DNA location: Contig name=SeqID_16889; Position on contig =53901..54203bp; Strand=-
atgatacctttagaacatggtctgattctggcggctattttgtttgtattgggctttgtttgcctgattgtccgccgcaatctgttatttatgctgatcgggctggaaatcatgatcaatgcttcggcactggcgtttgttgttgccggcagctattggctccagcctgatggtcaggtgatgtacattctggccattactctggcagccgccgaggcgagtataggtctggcactgttactacagttgtaccgtcgtcgccagagtctgaatattgatatagtcagtgagatgcgcggatga

SEQ ID NO: 3409 - DNA, 528 bp, Xenorhabdus bovienii
  Coding DNA location: Contig name=SeqID_16889; Position on contig =54203..54730bp; Strand=-
atggaatttacattttatgtcgcagggctggttgccatcctcgctacactcagggtgataacgcacactaacccagtacatgcgttgctgtacctgattacttctctgttggcactgtcggtcgtgttcttttcactgggcgcatattttgccggtgcactggaaattatcgtttacgcgggtgcgatcatggtgttgtttgtcttcgtcgtgatgatgctcaacctcggtaaatctgttgtcgagcaagagcgggcatggttgcagctccgcgtttggatcggcccggctattctggctactgtgctgctgattgtgttgatctttgctatcagcagcctgccaacggctgagatcagcggtgaagtggtcagtgccaaagaagtgggcattagcctgttcgggccttatgtcctggcagtagaactggcatcactgttactgctggcagggctggtagtggcttatcacattggccgtgaaaatcgtcagggtgaagtgatcagtaatcgtacggaggatcaataa

SEQ ID NO: 3410 - DNA, 543 bp, Xenorhabdus bovienii
  Coding DNA location: Contig name=SeqID_16889; Position on contig =54743..55285bp; Strand=-
atgacattgaaagagttagtggttggtttcgccacccaggtacgcagtatttggatgatagggcttcatgccttccataaacgcgaaacaaaaatgtatccggaagagccggtttatttgccaccccgttaccgtgggcgcatcgttctgacgcgtgatcctgacggtgaagagcgttgtgtcgcctgtaacttgtgtgcggcggtgtgtccagtaggatgtatctcactgcaaaaagccgaacataaagatggccgatggtatcctgaatttttccgtatcaacttttcgcgctgcattttctgcggactgtgtgaagaggcttgcccaacgaccgctatccagttgacaccggatttcgaactgggcgaattcaagcgtcaagatctcgtatatgaaaaagaagatctgctgatttcaggaccgggtaaatatcctgattataacttttaccataagacaggcatggcgattgatggcaaagataaaggggaagccgacaatgaagctaaacctatcgatgttaaaagcctgttgccgtaa

SEQ ID NO: 3411 - DNA, 978 bp, Xenorhabdus bovienii
  Coding DNA location: Contig name=SeqID_16889; Position on contig =55301..56278bp; Strand=-
atgagttggtttactcccgatgtgattgaagtcttgattactattctgaaagcggttgtcattctgctggttgttgttgtttgcggggcgttcatgagtttcggcgaacgccgcctgcttgggctgttccagaaccgctacgggccaaaccgtgtgggttggggcggttcattgcagctcgtcgctgacatgctcaaaatgttttttaaagaggactgggtaccgcgtttctccgatcgggctattttcactctggctccaatcattgctttctgctcgttactgctggcgtttgctatcgtgccagtcagccccacgtggatggtggcggatctgaacatcggcattctgttctttatgatgatggcaggtttgtcggtttacgctgtgctgtttgccggttggtcgagcaacaataaatattccctgttgggggcaatgcgtgcatcggcacagacactgagctatgaagttttccttggtcttgctctgatgggcgtcgtagcacaggctggctccttcaacatggtggatatcgtcaattcacaacaacatatgtggaatgtcattccccagttctttggtttcctgacctttgctattgctggtgtggcggtgtgtcaccgtcacccttttgaccagccggaagcagagcaggaattggcggatggttatcacgtcgaatattccggcatgaaattcggtttgttctttgtcggggaatatatcggtatcgtgacggtatctgctttaatcgtcacattgttctttggtggctggcatgggcctttattgccttctttcatctggtttgcgttaaaaacggcatttttcatggtgatgttcattctgatccgtgccgcattgccgcgtccgcgttatgaccaagtgatgtcatttggctggaaagtctgcctaccgttaactttactcaacttgctggcgactgccgcagtaattttatacaacgctcaataa

SEQ ID NO: 3412 - DNA, 2736 bp, Xenorhabdus bovienii
  Coding DNA location: Contig name=SeqID_16889; Position on contig =56275..59010bp; Strand=-
atgctgactatggctacgatacatgtagacggcaaagaatatgatgtaaacggggctgataacctgttacaagcctgcctctcattggggctggatataccttatttttgctggcatccagcgctgggaagcgttggcgcttgccgccagtgtgcggtgaagcaatatcagaacgcagaagatacgcgtggtcgtctggtgatgtcttgtatgacaccagcgacagaaggcacgtttatctctattgatgatgaagaagcgaagcaatttcgcgcaagtgtcgtggaatggttgatgaccaaccatccccatgactgccctgtctgtgaggaagggggtaactgtcacttgcaggatatgacggtgatgacggggcattcattccgtaaataccgttttaccaaacgtactcaccaaaatcaggaactggggccatttgttgcccatgaaatgaaccgctgcatcgcctgttaccgttgcgttcgctactacaaagattatgcggacggaacggactttggcgtttatggtgctcatgacaacgtttattttggtcgcactgaaagtggtacgctggaaagtgaattttccggcaaccttgttgaaatctgcccgacaggggtatttaccgacaagacccactcagagcgttacaaccgtaaatgggatatgcagtttgcaccaagcatctgccaacagtgtagtattggctgtaacaccagtcccggtgaacgtcatggtgaagttcgccggattgagaaccgttacaacggcactgttaaccactactttatgtgtgaccgtggtcgttttggctacggttatgttaaccgtgacgatcgtcctcgtcagccacagcaattgcgtggtgatcagtggatttcactgaatgccgagcaggttatgcagggtggggcggatattttgcgtcaggccaaaaatgctattggtatcggttcgccacgcgccagcattgaaagcaactttgctctgcgtgagctggttggcgcagaaaacttctatagcggcatatcagtggaagaacagaaccgactcgatatgatgctggagattcttcagcaaggcggcgtctatactccatccctgcgtgagatcgaaggttacgatgcagtgctgattttgggtgaagatctgacccaaacgggggctcgcatggcactgtctgtacgccaggcggtcaagggcaaggcgcgtgaaatggctgcggctcagaaagtggctgattggcagattgccgcagtgatgaatatcggtcagcacaccaaatatcctttgtttttaaccagcgttgatgatacccgactggatgatattgcagcatggaattaccgtgcaccaactgatgatcaagcccgatttggttttgctgtggcgcatgccctgaacagcatcgcacccgccgtcaatgatctgccggatgagctgaaaacgaaggtagaaattgttgcacaggcactgcgtgatgcgaaaaaaccattgattatcagtggcagcaatgctggtagtgatgcattgattcaggcggcggccaatatcgcatgggcactgaaagacaaaggcgcaaatgttgggctttcctttgttgcggcttatgctaatagcctcggtctggcgatgatggaagcacagccgttggatgtcgctttgcagcgtattgccaaaggcgattctgataccgcgattgtggtggaaaacgatctctatcgtcatgcggcagccgataagattgacagtgcattaggcagcctgaaaaatctgatcgtcgttgatcatcaacgtactgctatcatggataaggctcacttgattctgtcagctgccagctttgccgaaagtgacggtacgctggtgaatcaggaaggccgtgcccagcgctattttcaggtttatgaaccgtcattctatgacaaatctatcgttatgctggaaagctggcgctggatgcattccctgtataccacttacgcacaatgccagactgactgggcgcaacttgaccatgtgattgaagcttgtgtcaaagctatgcctcaattcaaaggtatcgtcaatgccgctccggattccacattccgtatccgtggtcagaaattggctcgttcacctcatcgttacagtggccgtacggcaatgctggccaatgtcagtgtccatgagcagcgccaaccgcaggatatcgacacggcatttgctttctcaatggaagggaacaacagtccgtttgccgaacgtcagcaaatcccatttgcatgggcgcccggctggaactccccgcaggcatggaacaaattccaggcggaagtcggtggcaaactgcgtttcggtgatcctggtatgcgtttgattgaaacgaccgatggggggttgaactactttgacagcattccggctgcatttgctgcacagaaaaaccaatggtatgtcgcgccttatttccacctgttcggcagtgaagaattgtcacagcgtgcagaagtaatacaggaacgtatgcctgagccgtatgtgatgatgaatcatcaggatgctgaacatctgaatgtgaaagaaggttccatgatggaatttgactgtgcgggtcaacaattgcggctggctgtgcgcttaagcggcaatctggtgcagggtcagattggcctgccgctgggaatgccgggtattccacctgttctggcgggtaaatcagccaataacttacgggggattgcacaatga

SEQ ID NO: 3413 - DNA, 1365 bp, Xenorhabdus bovienii
  Coding DNA location: Contig name=SeqID_16889; Position on contig =59084..60448bp; Strand=-
atgacaacgcactcaggagtgaaagaaattatccgcgtagcggaaactcatcccctgacatggcggttgcgtgatgaccaacaacctgtctggctggatgaataccgtagcaagagtggttacaaaggagctgaaaaagcactgaagggcatggttcctgatgaaattaccacgttggtgaaagatgctggtttgaaagggcgtggaggtgcaggcttctccacgggcttgaagtggagcctgatgccaaaagatgaaagcatgaatattcgttatctgctgtgtaacgcggatgaaatggagccgggaacctacaaagaccgcctgctgatggagcagctgcctcatctgctggtggaagggatgctgatcagcgcatttgcgttgaaagcctaccgcggctacatcttcctgcgtggcgaatatgtcgaggcggcggtacatctgcgcagagcaattgaagaagctaaagcggccggtttgctcggtaaaaatattcttggtagtggttttgattttgaactgtttgttcataccggcgcagggcgttatatctgtggtgaagaaaccgcgttgattaactcccttgaaggacgtcgggcgaatccccgttcaaaaccgccatttccggctacgtccggcgtatggggtaaaccaacttgtgtaaacaatgttgaaaccttgtgtaacgtccctgcgatccttgaacatggtaaagagtggtacatcggtctgagcgaaggcaaaagtaaagatgccggcaccaaactgatgggcttttccggtcgggtcaaaaatccgggcgtttgggaactgccttttggcaccactgcccgtgaaattctcgaagattatgcgggtggtatgcgtgacggtctgaaattcaaggcttggcagcccggcggagcgggaaccgatttcctgactgtggatcaccttgatctgccgatggattttgaaaatatcgctaaagcaggcagccgcttgggaactgcactcgcaatggccgttgatcatgagatcaacatcgtttccctgacccgtaaccttgaagagtttttcgcccgtgaatcctgtggctggtgtacgccatgccgtgatggtttgccgtggagcgtcaaaatcctccgcgccattgaggatgggaaaggtcagcctggtgatatcgaaactttggaacaactctgccgtttcctcggccccggcaaaactttctgtgcccatgcgcctggcgctatggagcctttgcagagtgctattaaatatttccgtgatgaatttgaagcgggaattgtcaccaaagactacggcaacaccaatctgattgcgggcattcagccaaacctgctcaagcagcgctggtaa

SEQ ID NO: 3414 - DNA, 546 bp, Xenorhabdus bovienii
  Coding DNA location: Contig name=SeqID_16889; Position on contig =60445..60990bp; Strand=-
atgcaaagtgaatttaacgcaaacaagcaagtacgtcttgatgtgattaacgtaacggacgctcagacacagggtgcgtttgtactgagtaccgcagaacgtgatgccatcgagcaggaaaaacaccattacgaagatccgcgtgccgcgtcaattgaggcactgaaaattgtacagaaacagcgtggttgggtgccggacggtgccatctatgccgttgctgaagttttgggtattcccgccagtgatgtggaaggggtggcgacgttttacagccagatttaccgccagccagtagggcgccacattattcgctattgcgatagcgttgtgtgtcacatcacaggttatcagggtgttcaggcagcgatagaaacgcacttgaacattcgtccggggcaaactacggcagatgggcgtttcacactgttgccaacctgctgtctggggaactgtgacaaggggcctaccatgatgattgatgaggacactcacagttacgtgaaaccagaagaaattgaaaaactactggagcagtatccatga

SEQ ID NO: 3415 - DNA, 1800 bp, Xenorhabdus bovienii
  Coding DNA location: Contig name=SeqID_16889; Position on contig =60993..62792bp; Strand=-
atgatgacagatcagatcgcgcaagaaagcgcacggcctgcttgggaaacacgggatcaccttgatgatccggttgtaagcgagcttaatcgtcaatttggcccagatgccttttccgtccagcctacccgtaccggtatgccggttgtctgggttaggcgagaacaattactggcagtaataacgtttctgaaaaaattgcccaaaccttatgtcatgctgtttgacctgcatggtgtcgatgagcgtcagcgctctcaccgacaggggcttcctgcggcagacttttcggtgttttatcacttgatttccattgagcgtaatcgtgacatcatgctgaaagtcgcactcaatgaaaaagacttgaatgtcccaaccgtcacgtcaatttactctaatgctaattggtatgagcgtgaaacgtgggagatgttcgggattacattcaatggtcatccgaatttgcgtcgcatcctgatgccggatacatgggaaggacatccgctgcgcaaggaatatcccgcacgcgctacggaatttgaccctttcatgttgaccaagcagaaagaagatctggaaatggaagcactgactttcaaaccagaagagtggggtatgaaacgcggtaccgaaaatgaggatttcatgttcctcaacctcggccccaaccatccttcagctcacggcgcattccgcattgttcttcagcttgatggcgaagaaatcattgattgtgttcccgatattggctaccaccaccgtggtgcggaaaaaatgggtgaacgtcagtcatggcacagttatatcccttacactgatcgtgtcgagtatttgggaggatgtgtcaacgaaatgccgtacgtgctggccgttgagaagctggctggaattgatgtgcctgatcgcgtgaaaaccatccgcgtcatgctgtctgagctattccgcattaacagtcacctgctctatatcagtacattcattcaagacgttggtgcaatgtctccagtgttctttgcctttacagaccgtcagaaagtttacgatgtcgtcgaggcgattaccggattccgtatgcatccagcatggttccgtattggtggtgttgcccatgacttgccccgcggctgggataaactgctgcgagacctgcttgactggttgccaaaacgtttgaactcctatgttaaagcggcactgaaaaacagtgttctgaaagggcgctctgtgggcgtagcttcttataactccaagcaggcattggactggggcgtgacaggtgcaggtctgcgtgcaaccggaatcggctttgacgtgcgtaaatggcgtccttattccggctatgaaaacttcgattttgaagtgccaacaggttacaacggcgactgttacgaccgtgttatgctgaaagtggaagagatccgccagagcatgcgcatccttgagcagtgtctcaagaatatgccagaaggcccgttcaaggctgatcaccctctgaccacgccaccccccagagagcgtaccctgcaacacatcgaaaccatgatcaaccacttcctgcaagtgtcatggggtccggttatgcctgccaatgaatcattccagatgattgaagcaaccaagggtatcaacagttattacctgaccagtgatggtaacaccatgagttaccgtacccgcatccgtacaccgagttttgctcacttgcagcagatcccatcggtgatccgcggcagtctggtttctgacctgatcgtttatctgggcagtatcgattttgttatgtctgatgtggatcgctaa

SEQ ID NO: 3416 - DNA, 675 bp, Xenorhabdus bovienii
  Coding DNA location: Contig name=SeqID_16889; Position on contig =62873..63547bp; Strand=-
atggattatacgctcacccgcatagatccgaacggtgagaatgaccgttatcccctgcaaaaacaggaacttgtcaatgatcccctggagcagcacgttcaccgcagtgtctatatgggcaaactggaacatgctttgcatgacatggtgaactggggaagaaagaattccctgtggccttataacttcggactttcctgttgttatgtagaaatggtgacgtcatttaccgccgttcacgatgttgcgcgtttcggcgcagaagtattgcgggcatctccacgtcaggccgacttcatggtgatttcaggaacctgcttcgtcaaaatggctcctgttattcaacgtctgtatgaccagctgcttgagccaaaatgggtcatttccatgggtgcctgtgcaaactccggcggtatgtacgatatttattctgtagttcaaggggtcgataaatttatccctgttgatgtttatatcccgggctgtcctccccgccccgaagcctatatgcaggcactgctgctgttgcaggagtccataggcaaagagcgccgccctctatcatgggttgtcggcgatcagggggtttaccgcgccaatatgcaatcagaaagagaacggaagcgcggtgaacgtattgcagtgaaaaacctgcgtaccccagacgaaatttaa

SEQ ID NO: 3417 - DNA, 444 bp, Xenorhabdus bovienii
  Coding DNA location: Contig name=SeqID_16889; Position on contig =63563..64006bp; Strand=-
atgtctacatccactggagtttttgcccatcactgggcgtttgcagttttcctgctaggtgcttttggtctgtgtgcgcttatgttattgggtgcgtacttcctggggggcaggtcgaaaggcagagcgaaacacataccttatgaatcgggtatcgattctgtcggcagcgcccgtctccgcctgtcagcgaagttttatctggtcgccatgttctttgtcatcttcgacgttgaagccctttacttatacgcatggtcagtttctatcaaagaaagtggctggctgggttttgccgaagcaagtattttcattttggtgttattggcaggcttggtttatctggctcgcattggagcactgaactggactcctgcgcgctcacaacgtcaagtcagtaaacccagtgctgacattcataccaacaacagtcatatgcagtaa

SEQ ID NO: 3418 - DNA, 306 bp, Xenorhabdus bovienii
  Coding DNA location: Contig name=SeqID_16889; Position on contig =63993..64298bp; Strand=+
gtggatgtagacatactcgttgcttactcatcaaaagtggtgtcaagatgtctgctctttttgccggcagtgttgcaccacatcgattcatgggaagggataacaaccaaatatgaaacagtgctaatcaatatcattaatagcttgaatcgtcttggtttttattcctctaaacaatattttgcctgcatggcaaaagcgactacctatttatttacaaacaaaaaaccattaattaacagattgtgcttatatatcgctaaaacgtgtcagtcgagtaaaaagccaccaacgcgccataactag

SEQ ID NO: 3419 - DNA, 957 bp, Xenorhabdus bovienii
  Coding DNA location: Contig name=SeqID_16889; Position on contig =64717..65673bp; Strand=-
atgataaatgcaaatcgtcagataataaacctcgatctcgatctgctaagaacttttgttgccgttgctgacttaaatacttttgcagccgccgcagcagcagtttgtagaacgcaatcggctgtgagtcagcaaatgcaacgtctggagcatcttgtggggagagaattgtttgctcgccacggacgtaacaagctcctgactgaacatgggcttcaacttcttggttatgcacgtcagattttacgtgccaatgacgatgctactgcatcattgacgtacaatgatgctgacggtgaattaagaataggggcatctgatgatactgttgatacccttcttcctttcctgttaaatcgcattgcttctgtctatccacgcatggctgttgatgtgcgaatcaaacgcactcagtttattgaaagcatgctggataaccatgaaattgatttggcattgaccacagcaaaaattaatcaccatccaaaaacggttctgcgctcctcgcctgtgttatggcactgtgcgcctgattttcagttgcagacgaacgaagctataccgttggttgtaatggatgaaaccaacccattccgtcagatcgcgctggatacgctggatacggccggtatttcatggcgtattgcttatgaagcggcttccctatcagctgttcgtgcagctgtgaatgctgaagttggcattactgcccgccctctggaaatgcagaatgcagatctaagaattttgggggaaagtgaagggctgccacgcctgccagaaatacaattcttcttgtatcgaaacagtaacgaacagaatgaatctgtcctgactgtttttgatgcgatagaaaataagaaaacaccttataccgtaactactgtcgaatctggtgaaaccgacgagattgatgaatcagttgaaatatccactgttgaaaatatagacgagtaa

SEQ ID NO: 3420 - DNA, 1215 bp, Xenorhabdus bovienii
  Coding DNA location: Contig name=SeqID_16889; Position on contig =66487..67701bp; Strand=+
atgttttccattaataaatccagcaaattagataatgtctgctacgacatccggggtaataccctcaaagaagccaagcgacttgaagaagaaggcaataagatactgaaattaaatattggtaatccggcgccatttggcttcgaagcacccgatgaaattttggtcgatgttattcgcaatctttcaaccgctcagggctactctgattcgaaagggctgtactccgcgcgcaaagcgatcatgcagcattatcaagccagaaatatgctggatattaccgttgaagatatctttattggtaacggtgtttctgagcttatcgttcaatccatgcaagctctgctcaatactggggatgaaatgctggtgcctgcgccggattatcctctctggacagcagcggtatcactttccagcggcaaggctgttcattacctatgtgatgaacaacaaggctggttccctgatttagatgacattcgcagtaaaatcaccccacgcacccgggggattgtcattattaacccgaacaacccaacgggagcggtatatagcaaagagttgctactggaaatcgtggaaattgcccgtcagcataatttgactattttcgccgatgagatttacgacaaaattctgtacgatgatgcccagcaccattccatcgcggcactggcccccgatctctttaccgttacctttaatggcttgtcaaaaacctatcgcgttgcgggtttccgtcaaggctggatggtactgaatggcccgaaaaaacaggcaaaaggctatattgaagggctggaaatgctggcatccatgcgtctttgcgccaacgtcccaatgcagcacgccattcaaacagctttggggggctatcagagcatcagcgaatttatttttccgggcggtcgcctctatgaacaacgtaatcacgcatgggaattgattaatcagatccccggtgtttcctgcgtgaaacccatgggcgccctgtatatgttcccgaaaatagacaccaaacgtttcaacatccatgacgatcagaaaatggtgctggatctgttattacaggaaaaagtgctattggttcaaggtacggcgttcaattggccagaacctgaccatttccgtattgtcacactgccacatactactgatttgcaaatagcgattgagaaacttgcccgctttatcggcaattatcggcaataa

SEQ ID NO: 3421 - DNA, 720 bp, Xenorhabdus bovienii
  Coding DNA location: Contig name=SeqID_16889; Position on contig =67752..68471bp; Strand=+
atgccacacatatcccccacattctcattcagtacagattccaattgcctttcacaacttattttggctcctaatgggtttacttccaccctggctccgtccacaattaatcacattgtcccgcagcaagagaaaattatgagtcattttttcgcccagttatctcgcctgaagttgatcaatcgctggcctctcatgcgaaatgtgcgtacagaaaatgtttcagagcacagtttgcaagtcgcttttgtcgcccacgcactggcggtgatcaaaaaccgtaaattcaacggcagtatcaatgccgaacggatcgccctgctggccatgtaccatgatgccagcgaagtcatcaccggagatctgcctactccaattaaatattacaatccccaaattgcccacgaatacaaaaaaatagaaaaaatcgcccaacataaattattggctatgctgccttctgaattacaggatgattttcgctctattttggatgataagcttcacactgatgaagaaactgccattgtcaaacaggccgatgcgttatgtgcttatttgaaatgtctggaggagctatcggctggcaacgctgaattcaatcaggccaaatcacgattggaaaaaacattggccgaacgccacagtgaagagatggattattttctgacagtgtttgtgccaagtttcagtctttcccttgatgaaatcagcctgtaa

SEQ ID NO: 3422 - DNA, 1830 bp, Xenorhabdus bovienii
  Coding DNA location: Contig name=SeqID_16889; Position on contig =68557..70386bp; Strand=-
ttgaatagcgaactgttgtgggtattgaccctgctattagtagccattgttcttttcaccaccaataaagtcagaatggatgttgtggcgttattggtgatcatcgcatttgtcctgagtggcacgctctccctgaatgaagctaccatcggtttcagtgatccgaatgtcttgttgattgctgctctgtttgtcattggcgaagggctggtgaggacaggcgttgcctaccagatgggggattggctggttcgtgttgccggtagaagtgaaaccaaaatgctggctctgctgatgctgtcagttgccgggctgggggctttcatgagctccacgggggttgtggctatctttattcctgttgtcctgagtgtcgccgctagaatgaaaacctctccaggccggctgatgatgccgttgggttttgctggcttgatcagtggcatgatgacgctggtcgcaacaccacctaatatggtggtcaatagtgaattggtgcgtgaaggtctgcggggttttgattttttttccattacaccgataggtattttagtgttgctggcggggattgtttacatgcttgttacccgtcgctggctaggcgggaaaacacctcagaaactggacgaacgttaccatcgtacgttccgtgacttgatccgtgactataaattagctggccgtgcccgccgtcttgctgtccgcgaagattccccattgattggccgtgcgctggatgaattgaatctgcgcgcccactatggtgccaatgtgattggtattgaacgctggaggaagtttcgtcgggtgatggtagcggccaccggcgaaactgagttacaccagcaggatgtgctgctggtggatatgtccgatagcgatgtggatctgcgagaattttgcagcgagcaacggttagagccgatgatattgcgcggggaatatttttcggaacagtcccgtgatgtgggaatggccgaagtttctgtgatccctgaatcagaactattggggaaatcgttgcgtgatatgaaatttcgcacacgttatggtctcaacgtggtggggattcgtcgtagcggtaaagccattgttgacaaattagtcgatgaacctgtacaccttggtgacaccttactggtgattggcgactggaaactgattcgtgcattgaaaaccaaaacacctgatttcattgtgctgaacctgcccgttgaagtggaaagtgccgctcccgcagcatcacaggcacctcatgctctgttttgccttgccctgatggtggcgatgatgctgaccaatgaaattcccaattttgttgctgccttgattgcctgcctgctgatgggaaaatttcgctgtatcgatatggaaagcgcctatcgtgccattcactggccgagcatcattttgattgtcgggatgatgccttttgctctggcactacagaaaacgggcggtattgatttaattgtcaaaggtttgatggatattgccggcaacatggggccacgggtgatgctgttgtgcctgtttgtactctgtgcgctgatcgggttgtttatctccaatacagcaactgccgtattgatggcgccgattgctattgctgcggcgaaacagatgtctgtttcatccttgccctttgcgatgattattggtgttgcggcttcggctgcgtttatgacacctgtttcatctcccgttaatacgctgatactggggcctggtggatatcgatttgctgatttcctgaaacttggcgtaccttttacactgatcgtcatggggatcagtgtggcgatgatcccgatactttttccattctga

SEQ ID NO: 3423 - DNA, 675 bp, Xenorhabdus bovienii
  Coding DNA location: Contig name=SeqID_16889; Position on contig =70549..71223bp; Strand=-
gtggtactgaaatgcagaggtttcttatttgatctggatggtacgttgattgattcattaccagtagttgagcgtgcatggtgccagtttgcagataaaatgagcatcgatagagatgaagtgttgagttttgttcatggtactccggccatgatatcactacgtcattttatgcctgatgcaagtgaagaggaaatcaatcgcacttttaagtggattgaaaaaatcgaatcagaagatacagaaggagttactgccttacccggtgcggttgcgctgattgataaactcaatgcgctggacattccgtgggcgatagtgacttcgtgtacggttccccttgcttctgtccgccataaagtggcggagttgcctgaacccgctcattgggttactgctgagagtgtcaaaaatgggaaaccgaaccctgagccttatctgctgggagccagtatgctggggctgccgccagaggagtgtgtggtttttgaagatgctgctgctggtattcatgcgggtttggatgccggctgtcaggtggtggttgtccataattcgccgggtattccacgtcgtgatgaacttcatcttgtgctcaataatctggaagacattgaaattagcaaatctggcggttatgtaacaatttatgcctcaaatgaggaaaattgttga

SEQ ID NO: 3424 - DNA, 495 bp, Xenorhabdus bovienii
  Coding DNA location: Contig name=SeqID_16889; Position on contig =71245..71739bp; Strand=-
atggaaatgacccatacacaacgcctaattctctctaatcaatacaaaatcatgtccatgctggagcctgaacatacggaacgctatcgtcgttaccagaccgtcatcgaacggggctttgggttacaattgcgtgaattagatcgtgattttggtgaattatctgaagagacttgtcgccttattgtcaatatcatggaaatgtatcatgcgctgcacgtttcatggagcaacctgaaagacaagcaggagctggatgaacgtcgcatggtattcttgggctttgatgcagccactgagccgcactatcttgcctatgttcgtttcatggtgaatacagaagggcgctatactcattttgattctggcagtcatgggtttaactcgcagacgccgatgtgggataagtatcagcgcatgttggcgttatggctgtcttgtcctcgccaatatcacctgagcaccgttgagatatgtcagattattaacgcatga

SEQ ID NO: 3425 - DNA, 459 bp, Xenorhabdus bovienii
  Coding DNA location: Contig name=SeqID_16889; Position on contig =71889..72347bp; Strand=-
atgatgaatacgacgccacctgtcaaccaaggttggtttaagagagtacaattagggcagcaatatttgaaaacgtggccgctggaaaaacagctcgcgccggttttccctgaaaatcgcattatcagagcgacccgttttggcattcgttttatgccgccgctggcaatctttatcttgacgtggcaaattgcactgggtgggcaattggagccatctgtcgcaaccgcgctgtttgcctgtagtttgccgttgcagggattatggtggttgggaaaacgtgcagcaacgcctttaccagaagggctgctgaaatggttttatgaaattcgtgagaaatttgccgaagcggggattgccatgatgcctgtggaaagcacaccaacctacttctcgctggctgaactgcttaaacgggcattcaagcaattagataacgctttccttgatgatatttga

SEQ ID NO: 3426 - DNA, 1203 bp, Xenorhabdus bovienii
  Coding DNA location: Contig name=SeqID_16889; Position on contig =72609..73811bp; Strand=+
atgtcaagtaagctggtactggttcttaactgcggtagctcctccctgaaattcgctatcatcaatcctgccaatggtgaagaatatctttctggtttagcagagtgctttaccctgcctgaagcccgtattaaatggaaaatggatggcgcgaaaaacgaagctgctttaggtgccggcgcagcacacagtgaagcactgaacttcattgttaatactattttgtctgaaaagccagaactttctgcgcaaatttcagccatcggccatcgtatcgttcacggcggtgaaaagttcacttcttccgttgttatcactgatgaagtgatccaaggtattgaagctgctatcccattcgcaccactgcacaatcctgctcacctgattggtatcgcagaagcgaaaaaaggattccctcatctggttgagaaaaacattgcagtatttgacactgcattccaccagactatgcctgaagaagcgtacctgtacgctctgccatacaacttgtacaaagagcatggcatccgtcgttatggcgcacatggcaccagccacttctatgttactcgtgaagctgccaaaatgctgaacaagccagtggaagagctgaacgtcatcacctgccatctgggcaatggtggttctgtttctgctattgttaacggtcagtgtgttgacacttccatgggtctgactccactggaaggtctggtgatgggtactcgcagtggtgacatcgatcctgctatcgtattccacctgcacgatgcaatgggcatgagcgttgatcagatcaatactctgctgactaaagaatctggcttcctgggtctgactgaagtcaccagcgactgccgttatgtagaagataactacgaaaccaaaactgatgctaaacgtgcaatggacgtttactgccaccgtctggcgaaatacatcggcgcatacagcgcactgatggaaggccgtctggatgcgattatcttcactggcggcattggtgaaaactcctcactcgttcgtgaactggcagtgaaaaaagttgctctgctgggcttcgagtatgatcacgagcgtaatattgcagctcgcttcggcaaatccggcgttatcaccactgataacagccgccctgctctggtgatcccaaccaatgaagaattggtgatcgctcaggatgcagcgcgcctgaccgcataa

SEQ ID NO: 3427 - DNA, 129 bp, Xenorhabdus bovienii
  Coding DNA location: Contig name=SeqID_16889; Position on contig =73817..73945bp; Strand=+
atgatttccagaaccgccagcaatgctggcggttctctattcatgaatgcattgattaatatttcattgatatctattgcgttgactcatttttcgtctattcatatagcattgagtcacgttgattga

SEQ ID NO: 3428 - DNA, 2130 bp, Xenorhabdus bovienii
  Coding DNA location: Contig name=SeqID_16889; Position on contig =73989..76118bp; Strand=+
atgttgatccctactggcaccagcgttggtttaaccagtgtcagcctgggtgtcattcgctccatggagcgaaaaggcgttcgcctgagtgttttcaaacctatcgcacagccacgtcatagtggttctcaggatcaaaccacatccatcatccgttctcactccagcatgcacgctgctgaaccactggatatggcacatgtggaatccctgctgaccactaatcagaaagatgtgttgatggaagaaatcgtggctcgttaccacgcaaacaccaaagatgcagaagtggttctgatcgaaggcttggtgccaactcgtaaacatccatttgcgcagtcactgaactatgaaattgccaaaacactgaatgcagaaatcgtgtttgtcacggcactgggcactcattctccagaacagttgaaagaacaaattgaactgagccgcgcagaatacggtggtatcaaaaaccagaacatcattggtgtgattgttaacaagctgaatgcgcctgttgatgatcaaggccgcactcgcccagatttgtcagaaatcttcgacgaagcctccaaagcaaccgttgcctacatcgatccaaaaaccgtattcaaaaacagcccactccctattctcggttgcattccgtggagtttcgacctgatcgcaacccgcgcaatcgacatggcgaaacacctgaaagcagacattatcaacgaaggtgccattcagagccgtcgtattaaatcggtgactttctgtgctcgcagcattcctaacatgctggaatacttccgtccaggttccctgctggtcacttctgctgaccgtcctgacgtgctgatcacggcatgtctggccgcaatgaatggtgttgacgtaggtgcagttctgctgaccggcggctacgctattgatgattctatccgtgaactgtgcgaacgcgcattcagcactggcctgccggttttcacagtgaaaacaaacacttggcagacctccctgaacctgcaaagcttcagcctggaagttcctgcggatgatcacgagcgtatcgaaaaactgcaagactacgttgcacaacacatcagcagcgagtggatcgattctctggcagcaacttctgagcgtccaaaccgtctgtctccacctgcattccgttatcaactgactgagttagcacgtcaggctggcaaacgtatcgttctgccagaaggtgacgagccacgtacggtcaaagcagcggctatctgtgctgaacgtggcattgcggaatgtatcctgctgggtgatccggaagaaatccgccgtgtagctgcggctcaaggtgttgaactcggtgcgggcgttgaacttgttaacccagccgccgtgcgcgagcgttacgttccgcgtctggttgaactgcgtaaaagcaaaggcatgaccgaagttgtggctcgtgaacaactggaagacaacgttgttctgggtacgctgatgctagaacaaggcgaagttgacggtctggtttccggtgcagttcacaccacggcgaacaccattcgtccaccgttgcagttaattaaaacagcaccaaacagctcgctggtttcttctgtcttcttcatgttactgccagaacaagtactggtttacggcgactgtgcgatcaacccagatccaaccgcagagcaactgtctgaaatcgccatccaatctgcggattcagccaaagcattcggcatcgatcctcgcgttgcgatgatttcctactccacgggtaactctggtgcgggcagcgatgtagagaaagttcgcgaagcgacgcgtctggcacaggaaaaacgtccggacctgatcattgatggtccattgcagtacgacgccgctatcatggcagacgtagcaaaatccaaagcgccaaactcacccgttgctggtcaagctaccgtgttcatcttcccagacctgaacaccggtaacaccacttataaagcggtgcagcgttctgcggatctggtttccatcgggccaatgctgcaagggatgcgcaagccagttaacgacctgtcccgtggcgcattggttgatgacatcgtttacaccgttgcactgactgcgattcaggcggctcaacaagaaaacgcgtaa

SEQ ID NO: 3429 - DNA, 168 bp, Xenorhabdus bovienii
  Coding DNA location: Contig name=SeqID_16889; Position on contig =76100..76267bp; Strand=-
atggtttttataaaaaggcttatcgaatatttaattgattattactataaaaaaataaccccagccaaaaagaatggggttattttacctgtctcagttatctcatcatgtttctcacaaccagataaaacgactcaagaaatagaaaattacgcgttttcttgttga

SEQ ID NO: 3430 - DNA, 1425 bp, Xenorhabdus bovienii
  Coding DNA location: Contig name=SeqID_16889; Position on contig =76318..77742bp; Strand=-
atgacgaggacggcaaaaacacctgtggagcaatccgcaggtgcgcagaaacttcaccgcggattaggcaaacgtcatgttcaattaattgccattggaggagccattggtacagggttgtttatgggaacgggaaaaaccattgctgtatcaggcacttcaataatcctgacttacctgatgatcggtttttttgctttcatggtcatgcgggcaatgggagaactgttgctcacaaaattggattaccgaacctttgctgattttgtagcggattatctcggcgagaaagccagttattttcttggctggacatactggatgagctgggtcgtcagctgtattgcggatgttgtagtgtgtggtggctatatccaatattggtttcctgatgtctcactctggttcacggctctgtcacttttggggctgatatgtttgtgtaatttctgttcggtacggttattcggtgaaactgaattctggttcgccatgatcaaagtcgtggcaatcgtagcactgattatcgtcggtgtcggcatggtgtttgtcggatggacatcgcctaatggcgtgacagcgtctgttcgtcatttgactgatcctgaagtgttcttgccgaacgggatgtttgggtttctggcaggctttcagattgccattttctcttttactggcattgagctggttggcacagtgactgcggaaactaaagaaccagaaaaagtcttaccgaaagccatcaacactattcccatcaggatcatcattttctatgtgctttccattatgtgcattatcgccgtaacttcgtggcagaatatttcccctgaagtcagcccgtttgtgacgctgtttgcgttggctgggttgcctgcggcggcggcggtgattaattttgtcgctctgacttcggcgatgtcctcggctaacagtggcttatacgcgtgtactcggatgctgtatggcttgtccacagaaaagctggcgcatggtaaattcgcccaactctcagtgagcagtgcagttcccatcttcagtttgatattttctgttatctgcatggcaagcggagtattcctgctgttcattgtccccaacgtgatgaaattatttaccattgtctcaacggtggcggctatcatggtcatttatagctgggcaatgatattgattgcttatctggcttaccgtaaaaaacgccctgatctgcataaaatttccatctataaaatgcccatgggcataccaatgacatggtgtaccttgatattttttgccttcacggtagtgattatggtgtttgactacgatactcgcgttgcattatatggcacacccatttggtttgtgatattggaagttttgtggcgcatgcggaaaagtcgtaagcaacatgcaacagaagaaagagtggtaaattaa

SEQ ID NO: 3431 - DNA, 975 bp, Xenorhabdus bovienii
  Coding DNA location: Contig name=SeqID_16889; Position on contig =77764..78738bp; Strand=-
atggatttattgaacttattgtttgaaaagaaacttgaggatgctctgcatttccctcccactttaaaagcctcatggctggcggagggagtattgcagttgctgccacaggagagcaaagcggatacgttgattctctccgtcggtatccacgggaatgaaaccgcgcccgtggagatcctgattcagctggtgtcgcaactcgctcagggaaatctaccgttgcagcacaaccttctgctgattttcggtaatgtcccagccatgcgtgaaaataagcgttatatcgataatgatctcaatcgcatgtttggtggccgtcaccagaattttcctttagggaatgaatcgaaacgagcgatggagttggaagcggttgttcaccagttctttcgtgagccagcggttagggcatcaacacggcgctggcaccttgatctgcatacggcaattcggggttcctgccatgaacagtttgccttgctgccgtttcaggctcgtgaatatgcatctgatttcctacagtggctggaggggagcgatattgatgctctggtcttccataacgcagcaggcgggacgttcagtcactttaccagtgaacatttcaacgtagagagttgcacgatggaagtgggtaaagcgcgtccttttgggcagaacgacctgagcagattcaacaatattacgcttgcattacgcgatgtcgtggcgggttcgtttttgattaaacgggaaaaaccgacaatgaagcgttaccgtgtaatcgacgcgattatcaaacaagaggacagttttcggctccatattcctgaggatacgaaaaacttcactgcgctgccggacgggttcgaaattgccagccagccgaatcaattctggaaaattgcttctcctgcaaactttattctatttcccaacgctcatgttgccattggtcagcgtgcgggtctattgctggtgcaattaacgtaa

SEQ ID NO: 3432 - DNA, 1344 bp, Xenorhabdus bovienii
  Coding DNA location: Contig name=SeqID_16889; Position on contig =78751..80094bp; Strand=-
atgtcgggaattgaagcaaattttgatggcctggtgggtatgactcatcattacgccgggctgtcaatgggtaatgaagcctcgatgactcatcgggggcaacagtccaatccccgcaaagctgcgcttcagggattgatgaaaatgaagtcgctgtctgatatggggctggttcagggggttctgcccccgcagcagcgccctaaccttcccgcactgcggcagttgggttttactggcagtgatgagcaggtattaagcaaagttgcacgatattcacccttgttgctgtctaatctcagttccgcttcttccatgtggacagcaaatgcggcaacggtttcaccttctgctgacagtgctgatcaacgagtccattttacggtggcgaacctgaataacaaactgcatcgttcattggaaagtacagtcaccgcgcgagtgctggaagccgtctttcctgatcaggcttgttttgtccatcatgatcctttacctcaacatggtgattggggagatgaaggtgcggcaaaccataatcgtttctgcggcgaatatggtgaagcgggtgtgcagctatttgtgtatggccgcagtgttttacaggaaggcgcggcacctaaacgctatccggtaaggcagacattggaagccagccaggcggtcgctcgtctgcaccaacttgaggccgctcaaacggtatttgcccagcagaaccctgtcgccattgataggggggtgtttcataacgacgtgatcgccgtcagtaaccgcaatgtttttttccatcatcagcaggcgcttgtgaatcagcagtccgtattagctgaacttgaggaaaaaatggcgcggcttgggcaaaaattgattgcggttgaagtcccttcatcacaagtgacgcttcaggatgcggttgaatcctatctttttaacagtcagttattgagccaacctaatggcgatatgatgctgattttgccagaagaatgtcgccagaatgctaatgtctgggcatatttgcaggctttggttgcgggtgctgattcccctattaagaaactccacttttttgatttacgggaaagtatgcgtaatggcggaggccctgcctgcctgcggttgcgcgtcgtcttgaaagaacaggaattagcggcggtgaatcaggctgttttgatgacgccagaactgtatcaacgcctgacttcttgggttgaacggtattatcgtgattccctgtataccgcagatttggttgatccccaattgctgaatgaagtctattttgcccttgatgaactgactcagatcctcaagctcggttcgatctatgagtttcagcgttaa

SEQ ID NO: 3433 - DNA, 1479 bp, Xenorhabdus bovienii
  Coding DNA location: Contig name=SeqID_16889; Position on contig =80131..81609bp; Strand=-
atgaatcatcaagcaaattatatcggtagcgggtgggtagcagggcaaggcgaacccgtcatcaaatattctcctcttgatcagcggattttatggcaggcaaacagtgcttctgccagtcaagtaaatgacgcttgtcaatctgcccgcagggcgttcccggaatgggcgaaactgacggctgaaaaacgcatagccattattcaggcgtttgctgatctactcacacaggaaaaagaagccattgcccgtgtgatcagcgaagaaaccagtaagcctttgtgggaaacaaggacagaagttcagtctatgatcggtaaagttgctatttccattgaagcatggcaacagcggactggctattcagaaacgcctatgccagatggcaaggcgatattgcagcaccgtccccacggtgtgatggcagttttcggcccttataatttccccggccatttacctaacggccatattgttccggcgttgattgccggtaatacactggtgtttaagccaagtgaattgacgcccatgacggcggaaaaaaccgtgcaattatggatcaaggcggggttgcctgcgggtgtgttgaatctggttcaagggggaagggaaacaggcggtgcattgctggatagccgtgaaattgatggtgtgttgtttaccggcagtgcagtgacaggttttcatttccaccgtgtgcttgcgggtcagcctgaaaaaatgctggcgctggaaatgggcggcaacaatgccctgattgtggatgattatgacgatcttgaggccgcagtttacaccatcatccaatctgcgtttatttccgctgggcagcgctgtacctgcgcccgcaggctgctggtgaaacgtggagagaaggggaatgctctgattcaacggctacttgataccgcaggtcagattattccatctcgctgggatgccgatccccaaccgtttataggcggggtgatctcgttgcccgcagtagaaaatctgctggatgctcagtcacgattgcaggcattgggcggggtttcgctgttgactatgactcaacctgatcctgactcaacgtttatgacacccggcattatcgatctgaccgatgccaaagaggttcctgacgaagaatatttcgggcctctattaaccttgaagcgttatgacacttttgaggaagcaatctccatcacaaatgatacgcgctttggtcttgcaacggggttgatttcgccggatgccgctctattcgagcatctgttgcaggaagcaagagcagggattgtgaattggaacaagccgttgactggcgcatccagtgctgccccgttcggtggcattggtgcatcgggcaatcatcgtcccagtgcgtactatgccgcagattattgtgcctggccaatggcatctctgacggcagacaagctggttttacctgatgcacctgcgccgggtctggattttttccgttcttga

SEQ ID NO: 3434 - DNA, 1047 bp, Xenorhabdus bovienii
  Coding DNA location: Contig name=SeqID_16889; Position on contig =81606..82652bp; Strand=-
atgatgctatttagatccgttcaacatcaagatttaggggatattctcgatctttcgtcccgtgctggcgttggtctgacatcgctgccacacaatcaggaatacctgacggcacggatttcacgcagcattgattcatttaacgatgtaaatggacgagcacagcagggattcctatttactctggaagatacggagaagcatcgtgttgttggtgttagtgcactggaagttgcggtagggctggaagaagcattctataatttccgtttacagcggtcggtgcgtgcatcccgtgaactgggcgtttacaacacatttgaaacgcttatggtggggcaggattatacggggtgcagtgagttatgtacgttgttcctcgatcctgattatcaggggggaggtaatggtgttttcctttccagaagccgcttcctgtttatttcggcattcaggcatctctttccaaaatctatttttgcggaaatgcgtggggtggtggatctacagggagaatccccgttttggaatgcccttgggcaacactttttcaatatccctttcgctcaggccgattacttgaccggcattggtataagaacgtttattgcggaattgatgccattccatcccatttatgtaccactactgccggaagatgcgcagaaagccatcggtcaggtgcatgagaataccgtacccgctcgcgccatcttagaaaaagaaggtttcttctataacgatggggtcgatatttttgatgcaggcgccatcttgcaagcagaaattgataatgtgcgttcgatcaaggcaagtcggcttgcctatgtcaaaaaaagcgaaaaggtctcccgacagagtgatggggtgccgtgtattgtttccaatgtgcattttcaggactttaaggcactgctcctgaatatccctgatccgtttagtcatgatgaactgcaactgactcctgcggagatggaagtgctccatgtggatgagggggatgctgtgcgctttatttctcttttttctgagggatcttcacaatga

SEQ ID NO: 3435 - DNA, 1212 bp, Xenorhabdus bovienii
  Coding DNA location: Contig name=SeqID_16889; Position on contig =82673..83884bp; Strand=-
atgtcaaacacgatccagagaagctggtttgatcagtatatggtcccttgtttttcaccggctcaatttattcctgtccgagctaaaggctctcgtgtatgggatcaggaagggaaagagtacgttgattttgccggtggtatcgcggtgaattcattgggacatgccaatgatgagttaaagaaagtattaacttctcaaatagaaagtatgtggcacgttggtaatggttatacgaatgagcccgttttgaaactggcaaaaatacttgtcgaaaatacctttgctgataaggtttttttctgtaattcgggtgctgaagcgaatgaagccgcactaaagattgcgagaaaatatgctttagataaatatggcagccataaaaacgaaatcatttcattcgaaaattccttccacggtagaacattatttaccgtgactgtgggcggccaacccaaatattcacaagatttcgctccattgccgcaacaaattagccatcttccctataacgatattgacgctatcaaagcccatatttcggaaaatacttgtgctgtgattgtggaacccatcattggtgaaggcggtgtcattcctgctgatcctgccttcctgaaagccttgcgggaactgtgtgaccaacatcaggcattgttgatttttgatgaaatccaaacaggagtcggtcggacagggtatttttatgcttacgaagaaacaggtgttgagccagatatcctgactagcgccaaaggtcttggtggaggttttcctatcggagccatgctggttaaacagcctatagcagaagttttccagccgggttcacacggtacaacattcggcggtaatccgctggcggcggcggttgccaatcaggtagttgctttagtcaaccaaccggaatttctggcgggagtacaagagcgtcatcatgaattcatcaagcgtatgtcagatttgaaccaacgttatcacgtgttcagtgaattacgtggaaaaggcttgctgctgggagccgaactggagaaaaaatatcagggtaaggctaaaaccctgagcaatatcgctgcggaagaagggttgattgccttgattgccggtccaaatgtgttgcgttttgcccctgcgttaaatatcgaagagcaggacatcaatgacggtttcgcccgtcttgaaaacgccctcaagcgatttgttcaggaataa

SEQ ID NO: 3436 - DNA, 162 bp, Xenorhabdus bovienii
  Coding DNA location: Contig name=SeqID_16889; Position on contig =84014..84175bp; Strand=+
atgaatatctttttccatcctttaagattgcaagctggatgcatcatctctttgaggtttaacaaagtcaatacaatgagattacaaataatttactttatgatgtttttcacaatttataaaagcggttttatttacaatttatgcatagtttatgcataa

SEQ ID NO: 3437 - DNA, 273 bp, Xenorhabdus bovienii
  Coding DNA location: Contig name=SeqID_16889; Position on contig =84439..84711bp; Strand=-
atggaagacagaatttataatctgttagaaataactttaatcttgaagtctattaggtataaatcccatcctattagggctattttattaggtattttgaattttggctgtgttcagattaaagcgatagcttttgaacgtacttcaatgcggttcgaaaggaggtacgcagcgaaccctactcacgtactaattcttgattacctacgtgtacgctccgatttctgcggacagtctgtgtacaacattacgtttactgggatagattcttag

SEQ ID NO: 3438 - DNA, 111 bp, Xenorhabdus bovienii
  Coding DNA location: Contig name=SeqID_16889; Position on contig =84848..84958bp; Strand=-
atgttttcgctggttgacattctaacatcaaaagatatacattctctctttgaaattttcatagtatttatcttcagtaaaatatattttaccttgttgtatttattttaa

SEQ ID NO: 3439 - DNA, 147 bp, Xenorhabdus bovienii
  Coding DNA location: Contig name=SeqID_16889; Position on contig =85378..85524bp; Strand=+
gtgatcgttcctataaggcaatgcccatcacgcctgaacaaattgaaatatgtgaacttggctcagtaccgggatgtccggtgcaagaagacgtcgaaaacactctgccgggcgctaacgggaaactggcagcctgaacattgttag

SEQ ID NO: 3440 - DNA, 192 bp, Xenorhabdus bovienii
  Coding DNA location: Contig name=SeqID_16889; Position on contig =85553..85744bp; Strand=+
ttgccctttctcttaagccaacttagacaggttctcgttgtctactttaattacagatgctataacctacccatccatttacccacagagaagaaaaggaggttaattatgatgttaagtgatgtgattgaatattcacatttctttggtaatcgtcagcactcaggcttatctactaacgcattgcgttaa

SEQ ID NO: 3441 - DNA, 1752 bp, Xenorhabdus bovienii
  Coding DNA location: Contig name=SeqID_16889; Position on contig =85851..87602bp; Strand=+
atgagtacattattatcaacccaaaatctgtcattccatcacggtcacactccactgttagccgatatttctatcgccattaataaaggcgagaaaatcggtctgatcgggtataacggttgtggaaaaagtacgctactgaaattactttctgcccaattatcaccgaatgagggaaccgtaacactggcaaatcactgcattctggcctacatcgaacagcatttaccggctacattgcacagtatgacgctgattgaggctgtgttggataaactgcccgcagaacaacgaattgaggacaattggcgggcggaaattttgttgagtgaaatggggtttcagccggagcagcacaatctggcgatctcagcacttagtggcggtcagcatacgcgcttattactggcacgggcgcttatcattaatccagatttattattgctggatgaaccaagtaaccatctcgatttgccgacaattctctggctggagcaatttctaacacagtggtgcggcagttttattctagtttctcatgacaatacgctgttggatcacttaacgaattgcacctggatattacgcgacggtaatgtgtctctctatcgtcttccgtgctcacaagcccgtgaagcgcagacagcacaagatctcagtgatgaacaccgtcataacgcgcagcaaaaagagattgatcgcatcgcgcacagtgccaaacgtctggctatctggggcaaagtgtacgataacgaagcgctttcccgtaaagccaaacaaatggagaagcacgtcgatcgcttgcagggctgtcaggttgaactggccgttagcagccaatggcggttgaaactgaccggtgatgctttacgtgcagatcgcctctgtgcgttcaatcaactgacagtgagccctgcaccgtcctgcccaccgctatatgtgacagataatttgtccgtgaaaagcggtgatcgcattgcgattatgggtgcgaacggaaccggaaaatcatctctgttaagaatgattttggcacaatcgcaatctcaggctctgacgctgccggatagtcctcttgtactgcatccgcgtgtcaatcttgggtattacgaccagaaactggcacagttgtccgatagtgatacactgtctgatgccttaaaaccgtttgccgcgctgatagacaaacagcggaaaatggcgttgatcagcgcggggtttccgtatttgcgccatcaacaaactgttgcatcactgagcggtggtgaacgcgccagactgttattcatcggcctgagtttggcgaaatattcattattgatgctggatgaaccgaccaaccatttggatatggacggtaaaaatacgcttcgcgatgaaatccggctgttcgctggtggattattgctggtcagccatgatcgtgaattgattgagcaaagctgtaaccgttattggtatattgatggccagcgtttaacggaataccacgatttggatgcggtatatcagaaaatccgtcacgccaatagcaatacacaaacggacagtgcatccgtatctacgttttctctcgtaccatcatcggaaatgttctctgatgatgacgaaatgaaactggcagagctaatttcactagaggaaaaactggcgacggatttgcaacgcaaggccgcacaccagaaaccgatattgcaacagcaatggcgtgagaaaatagcccagttgcgtcaacaattgtcgttggattga

SEQ ID NO: 3442 - DNA, 1098 bp, Xenorhabdus bovienii
  Coding DNA location: Contig name=SeqID_16889; Position on contig =87667..88764bp; Strand=-
atgaatagcgcactgatcaacttgatgaatacgcaattccggcaatatatccgtgagccggaaatcctgttctggtcgttcggtttccctctgttactggtctggctactgggggtttcgttctcctctcaggatattcccgaaagaaaaatcggtatcgtgctgcctgtggaagccgtacaacagcagcaaatgaaacagtggggagagcagctgactgcgcaggagcacatgatctcagggattattaataaagaagagatcaagcgtgaaaggttggttaaagttcggtacaacatcacctattatcccgatcatgaggccgtcgtgcgtgggctgaaacgaggggatatccagatgttcattgaacaggataaagagaaaaaacgcgtccattaccttgatccacagagtagtgacgccttattgacctattacctgctcaaccagcaggaaggaatagagtctgaaaaaaacctgtttatactggaaacaccgggactgcgctatgtggatttcttggtaccgggcttactggcaatggcgattatggagacttgcctgattgcggttggctgggcactggcggaaaaacgtatcacacgggtcactcgtcagatgtgcattactccgatgcgcaaatccacattcctgctggcgcatatcctctcctgcctgttgatcagcattaccgagatattaatcatctacctgtttgcagacctctattttgatgtagaaatacaaggctcgttttacgccttcctgctcttgatgctcacggggaatatttgcttttccggtgtggcagtgctggtggcatcccgcgcccgcaaagcccaaaccgcgaatggattgttggaagtctccattttgattcagattttgttgtcagggatctttttcagttacaaaaacttcccgcagtggatggcgaatattattgaatacctgccattaaccattttggccgacaatatgcgcaaagtatttattgaaggcggtgatctattgcaggtcgtacctgcagcgattatcttgagtttgattgggattgtgacatttgtgttgggtatgaagatatttcgctggtattga

SEQ ID NO: 3443 - DNA, 945 bp, Xenorhabdus bovienii
  Coding DNA location: Contig name=SeqID_16889; Position on contig =88757..89701bp; Strand=-
atgggtattcaacacaacgagaaagtgattgagtttgaacaggtcaagaagcactacaaggactatcaagcgctaaaaggaatttctctggatgtctatcgtggagaattccttggtctgcttggcccgaatggagcgggtaaaacgacactggtcgaaatactggaagggctgaaaacgccggattcaggctcggttcgggtattaggcaaaacctggcagcaggatgcaccttacctgcgtcagcacctcagcggcgtcttacagcagaccctgtttatcgataagctcagtgtagaagaaacgcttaacctgtttggcagcttttatggttgttcacgcaaacgagcgcaggaggttatggaactggtcgagctggaagaaaaacgcaaaacctatgtggaggggttatccggtggtcagcgtcagcgtctcgcattgggtgtggccatcatcaatgagccggaaatcctgatcctggacgaacccactaccgggcttgacccgcgcattcgtcatgatacttgggatatcctgcgtaaactcaaccgtgaaaagcactcaactatgatcttaactacccattatatggaggaagctgaatatctctgtgatcgcatttgtatcatgaataagggagaaattatcacacagggcagtatagatgagttgttgaaaaaacactgcgatggcgatctcattgaattccgtacccattttcctgaccgcctgcaggcactgagtcaacatgctcaagtcttaaattatgagtacgatgaaaggaaagataagatctgtatgctgattgaagattccactagttttgttgctcatctttttgagtttgccaaacaagtcgaggctgacatcattgaactgatggtcaggaagaaaacgctggatgacctgttcatgactttggccgggagaaggttacatgaatag

SEQ ID NO: 3444 - DNA, 750 bp, Xenorhabdus bovienii
  Coding DNA location: Contig name=SeqID_16889; Position on contig =89773..90522bp; Strand=-
atgaaatttgccggaggtcgtatgcatatgcaaaaacatacatttcaacccaaagcccccctggagcaaaaacagttgagattgactcagacactgcatcaggcgtttgagcagaaggtacagcgctatccacaggctattgtgctgaatactgagaacgggctggggctgacttatgagcagcttaatcagagagccaatcaactggcgcattatatcctgcaaatcaagcagcagatgggggaaacggacgccttttcacccgttatcggcatctgtctggaacatgatgaagagatgctggtatccattttggcaatcctgaaagcgggactggcttacctgcccattaacagcacccatggagcggagcgaatcggtttttacattgaagatgcgggtatcgagcttgtcattggcgtcttgcagtatcaatcactgtttgatgaaagtaaggtagattacctctgcattgacagcgaaaaagcctttattcagaccatgccattacataacccggatgtgagtattcattctgacccattggcttgtatcgtctacatatctaagactgccggtgtctcgaaaggcgttgaaatatcccataccagcgcgatgagactgagtgccatgagattgcttcgtgctgagaaatatcatcttgatttgacaaaaaataactcgacagaaaatgacatttggacactgcttgacgccagtacttttgaagttcacacgatgggaaaatga

SEQ ID NO: 3445 - DNA, 222 bp, Xenorhabdus bovienii
  Coding DNA location: Contig name=SeqID_16889; Position on contig =90424..90645bp; Strand=+
atgcagtgtctgagtcaatctcaactgtttttgctccaggggggctttgggttgaaatgtatgtttttgcatatgcatacgacctccggcaaatttcattgttatacctttcatctttcaagttgcggctttgttggctgcaacttgaaatctattaggtatggagtgagtttgattcagcatcaggacgacgttcccaaacaatacgatcatgatggctaa

SEQ ID NO: 3446 - DNA, 924 bp, Xenorhabdus bovienii
  Coding DNA location: Contig name=SeqID_16889; Position on contig =90719..91642bp; Strand=-
atgaggatatacgatgcggtatggctgcatctggatcctgatctttttcaagggttgtttataaaacaatcgaataacagacaagtaatgacagaaatatgggttaaatcggagctttcaatgattgaacaaaatcttaaggtgacgttggttcaaaccgatttggtttgggaaaatgcggaacaaaaccgtgaacatatcgaacggcacattgctcagatcacgggtagtgatctgattatcttaccggagatgtttaccacgggtttcagcatgaagccacaggccattgctgagacaatgacagggccaagtattcagtggatgaaagcgatggctgccaagaaagattgtgccattgtcggcagcatgattatcacggaaaaccagcgcttttataaccgtctgctgtgggttaatcccgatggctctgtcgctcattatgacaaaaagcatctctttactttcgcccaagaagatcacgaatacaccgcaggcaatgccccgctggtggtgaatttcaagggttggaaaatcgctgcctttatctgttatgacctacgtttccccgtctggtcgcgtaacgtcaatggtcattatgatgcggcgatctacatcgccagctggccagcaagacgttcggctcactggtgctcgctccttcaggcgcgcgccattgaaaaccagagctacgttatcggggttaaccgtgttgggcaggatggcaaccaactagactatgacggtcacactatgttgatcgatccactgggtgaagtactgctgcacgaaatgaatcacgaagtggtgaaaaccgtgcagctgtcactctcccatgtgcagggtgtcagggaacgtttcccatttctgaaagatgctgatccctttgttttgaacaacgatgtgttaggaagtgatgcataa

SEQ ID NO: 3447 - DNA, 1233 bp, Xenorhabdus bovienii
  Coding DNA location: Contig name=SeqID_16889; Position on contig =91642..92874bp; Strand=-
atgttcgaccataataaaaaggacgtcagtagtatcttgcttaccggtgcaactggcgtgatggggggaaggatccttctggaaattctgacgacgacggatattgaggtttactgtctgatacgggcagaaaacaaccagcaggcaatagaacgtctgaaaggtatcttgtttgcttacgatcaggaaaaacaaagtgagaacactcatcatcggattattccggtactgggggatgtctctaaaaaaagattggggctgacacaagagctttattgcgaactggctgacaaagttgaccgggtcattcattgcgctgctaacgttagccttgtggcgtcttataaaaagattgcgcctgttaacgtgcagggtacacagcatgtgattgatttctgcctccagggtaatgtagcgatgttgtatgcttccagcttcagcatggcgggggattgcctgtataaggacggttttgtcctgcatgaaacggatctggacgtggggcaacgatttgatgacatggattacgaacgctccaaatttgagtccgaaaaaattattcacagtgccggaaaaaaaggactgaagtgggtgattgtgcgcccgggcaacatttggggagaaagtacgaatgggcgttacccattagcgcataccaaggtcaagggcatctattacgaaatggttaaagcattggtggaaactgggctgacgttcaatgcacaggacgattttgatatcacccctgtggattacgtggcggaagcctcgctgtatgccattttcaatatcgagaaatttaatgggaagacgcttaatctgactaaccctaacccgattacgttcaatgacatcgtctctttcctgcgcgattttggttatcgtattgataccattaacatgaatgattacatggaagcgctggcacaaaaccgcctgtaccgttatggccagccttatcgctcggtctttaccgatctgctggggctattttactccggcatggaactgaccgaaaaagccaaatatgccacacaactgacaactgaattactcagtggcagtggaattcagtgccccctgtcggatagaacgctacttttccattacttcaattacctgatcgaatgtgagtttattgcgccgccacaacagcagggagaaagggctgaaatacgggaagcatctgtacgggggagctatctggaacaactgtttgatgctgatttgtaa

SEQ ID NO: 3448 - DNA, 768 bp, Xenorhabdus bovienii
  Coding DNA location: Contig name=SeqID_16889; Position on contig =92967..93734bp; Strand=-
atgagccgacaaattgctgtcgtcactggggcagcggggggattcggcacagcgattagcaaggtgttgctggatattggttatctggtggcggcaacggatgtcagtagccaaaaactggcgctcctgaaggagcgtctcggacaccctgaatcccttgcaacctttgaaatggatgtaactgacttagcctcggtagaacgggcggcgcaacagattgttgaaacattcggtgacaccattacagtgctggtgaacaacgccggcattattaatcgagcattctgtctttctggccaagggtttagtgagacaaccaaggttataaacgtcaatttgataggtgccttcaacagcacatcaatttttgttcgctacatggcgcgcctgaaatatgggcgcatcatcaacattgcctcggttgccggcatttggggagcggcaggcagttccgcttatggcgcttcaaaagcgggtctgatctctgcgacagaatcctgggggcgtgaattgggtccactgaatatcagtgtgacagccgttgctccaggggtctgtaaaaccgacatgttggagcagtttgtggaatcaggcccgatggagtcggcgggagaggataaggttgtacgttccattgttccggtcgggcgttggggaacgccagatgacgtggctgaagttgtgggatttttggcgagttgcaaaactaactacctcaattccgcagtgatcccattggatggcggaatgcgtgtcggaacgttatag

SEQ ID NO: 3449 - DNA, 3081 bp, Xenorhabdus bovienii
  Coding DNA location: Contig name=SeqID_16889; Position on contig =93731..96811bp; Strand=-
atgagtcagcgcttatctgtgaataaatcgagccatcaactgacagcgttaccgctaacgatagggatctcccacttgcaggcgctggcgactgaactgcgtgttgtgaaggtgggtgaatcaatatcactgttattgccagatgacacaatagcagaacagacgactctgcttggtcgcctgccagcagtgacggcaggcagtttgggagatgcgggtttcatggcggattatggcgtgaattatgcctattacgcgggtgcgatggcaaatggcatccactctgaagaaatggttattgcgctgggaaaacagcgcattcttggaatttttggttcaggtggcctgcgtattccacggattgctgaggcgatttcccgtatccggcagacattgcccgaaggtccattcggcgtcaacctgctgcataaccccggtaatcctgaatgggaaatggcctgtgtacgcctgtgtatggaaaatcaggtgcgggtgattgaagcttcggcctacatcaaccttagctcggcgctggtctattaccgcgttagtggtctggtacaacaacctgatggcactatcttgcgtcatcatcgcctgattgccaaagtttcccgtcgcgaagttgctcagaacttcctgcggccagcgccggaaaagattttgcaaaaattactggtagaggagcttatcacacctgagcaggcagaactggctcgccaaataccgatggcagatgatatcacggtagaaggggattcagggggtcatactgatcagggcgtgctcgcctgcattttccgctcagtcgtccagctacgggatgaaatcgcagacgaaactcaacatgactatcaggtgcggatcggcgcggcgggcggtctgggaacacctcatgccattctgtccgcttttgctctgggcgcggcttatgttgtcactggctcgatcaatcaggcttgtgtggaagccggcacatcccgcgcggtgaaaaaaatgctagggcaggctcaaattaatgatgttgccactgcaccctcagcggacatgtttgaactgggggcaaaagtacaggtactgaaacagggcagtatgtatgctgtgagagcacaaaaattgtacaatctgtataagcagcacgacagtctggacaccctgcctgtacaggaaatcgctctgctggagaaacagatattccacaaaccactgacagaaatctggcaggaaactattgcctatttccagagtattaaccaactggacatcattactaaagcggaaaaacagccgaagacaaagatggcgttggtgttccaatggtatctcggccaatcatcccgctgggcgatcacaggtgatccagtacgcaatctagattaccagatctggtgtggtgcggcgatgggtgccatgaacgaatggctgcaaggaacgccttttgaagcagtggaaaacaggcatgtcagcgaaattgcccaattgctgatgaagggagcggcctatctcactcgcattaccctacttgaattattcaatattgctgtgcctgagcagattaaacggcatctaccgttgcatttctacacgggcggggaaaattccccgccaaatgaatttagtcatgaacaatctaacgacgatcttgctgaccacagtcaggttgatgatcgtcatcttaacttaatgtcaattcaaaaatcacaggtgaggagtaaagaacctatggacgcttcaacaaaactcgtattggataattcaaaggacttttacaaaaaatgttgggagctgatgcctggtggtacgcattacaactttggtgatcctgagcgcccgctggtgatccctttcaaccgtgggcgcaattcccgtgtgtgggatttggatggtaatgaacatctcgatctgttctgtaaatttggggcattgctggttggacaccacaatgaggcttataaccaatccctgatcgaatacatgggtaaagtgacttcggttgatacctgcgatctggaagtgggtgtttgcgaaacgttggttaaacatattccctgtgcagaaatggtgcgtttctgcctgagcgggacagaagcggtacagaatgcgctgcgtcttgcccgtgcctttacgggcaaaaatcgcttcatccgcttccatggccattaccacggtaatgccgacaatatcatgggctggcgtaaaaagcaggatctcacttaccccgtgccagagcagttcaatggggacctgctggatacactgggacgtgaccccaaaatcatggtagaccaaacgttcatgttgccctggaatgacattgatgttctgacggcgactattgaacgttatcacaatgaaatcggcgctgttctgatggaacctctctgcatcaatggtggcgggatcttcccagaagaaggctatctggaaaaaaccaaagcattgtgtgaaaaacacaacattgtgctgattttcgatgaaatcattacgggtgttcgtttgggactggggggagcacaaaaactactgggtgtgacgccacatctggcgacctttgggaaagcccttggcggcggctctatgccaatctctgccattgtcggtcgtagtgacatcatgaacctgtacacccgcgggaaagtgatccatgcaggcaccttcaacggttacccactgggtctggcggcaattcagacgacctttgatttgattgaacgagatcccggctgctatgaccgtatggggaatatcatgcgtcagatctccgacgtgttcgtgaaagcggccaaagcggttgacctgccactggtcgtacaaggaatgccaaccgcgctggtttatcactcccagagcacacctgttagttctacggaaggctacagcgataaagtcaaattctgcgacatcatcattcgtgaaatttccaaacgctatggcattcagttctcaccattgtctcgcatgtactctaacctgttgatgtcacaggatgacgtgcgtttctttgaagagaggatctttgatgcgatggtaaatgctcgcaaagtcattgatatcgcattcaaagaaggaattgatgcatga

SEQ ID NO: 3450 - DNA, 4365 bp, Xenorhabdus bovienii
  Coding DNA location: Contig name=SeqID_16889; Position on contig =96808..101172bp; Strand=-
atggaaaatattgcgattattgggatggggtgcttatttcccggtgcagatacccttgagaaatattgggataacttgctgcgggaaaaggattgcaccacacccttatctgctctggaactgggcgttgatctggactgttattattctccggttgcaggtaaaccggatacaattaattatgttaagaatggacatgtccgggattttcattttgacggcaaaggatatcacttgccggaagaagaattaaattcgctggataatttatttaaatggactatttattctgcggagcaggcattgaatgacagtggctatcgtcagaataaaaaagtattagaaaaaaccggattaattctcggtaatattggtatgccgactcattcaaccaaacgattaatgagtcctttttatcaaaaaatattacagccttatattcaaaaattaattgggcgccctgattttcattttgattcggtttggccacccgcaaattattctggccagaatttaattacgggtgggcataatgctacgattgcagcgttggctctgggattatcgggtcctcgctattgtcttgacgctgcctgtgcatcagcactgtatgccatcaaactgggaatagattatctcttcagtcacaaggttgacatgatgctggtcggggcgatttgtcatacagaccatatctatatcgatcatggtttcaatatgttgcaggtattccctgcaaaaggggaatccattccttttgacagatcatccaaaggggtgaaagcgggtgagggaagcggcattgttgccataaaacgctactctgatgcgatacgtgataatgacaagatttatggtgtcattgaatcgatcgggttgtccaacgatgcgggtgccaaacacttattggtaccagatatacaggggcagcgcatcgctctggagcgcgcctatcgggataatccgcagcatgttgattatgttgaatgtcatgcgaccggtacgaccattggtgatcaggtcgaactctcgacaattgaatccttctttggtgaacgtggaacaataccattgattggtgccaacaaagcgatcaatggccatatgctcaccgcgtcaggtatgggggggttactgaaagtgctgttggccatgcagcataatatgatccctgctaccccgcgtgtcgaacaattggttttgacacaaaaagggctgctgaacattgatcacgtcgtgcgggaagccaagccctggcctgtcagcaatagacctaagcgtgccggcattaacgcctttggttttggtggggtcaatgcgcacatggtcattggtgaagatacacctgaacggcgggcggcatgcacacaggtgaagttggagaaccgtcagaaaattgagcgtctgtctatcgtcggtattggtgtgcatatggcgaaaaccgaagatggtaaaacgctggatcagacattgcagcaagggatacagcatttttacccactgccgaaaacccgctggattggcatggaaaagcgtcacgatgtcttggcaatgcaggggataagccagccgcctttaggctcttatattgaaacgtttgaatttgactgcaagcacttcaaattgccgcccaatgtggtaggtgcgcatttaagctgccatatgttcttgttgcccatcgcggaacgtgcctttattgatgcgggttatacgctggatggcagtaagcgcaatatcgccgtcattgtagcaggaggcgtggactatagctctttgcgctatcaggcacgtaatgaaattagttggcaacttagccagagtttggccagcagaggtattcatctgtcagaagaagataccgtagccttgcaggaaatcgtcaaagatggtctgtttcctaaaccttatcctgaaggtattactggcggtataggtaatattgtagcaagccgtctggcggctcatttgaagttgaatggcccggcgtttacgctctatggagaagaaaattccccgttcaaggcactggaactggctcagttcatgttgagcagacagcatgttgatgccgtcatgattgccagcagcagttttggcggcagtctggaaaatgtgctgtgggatcatcaatctaatcacggtaaccaaatcgttggcgatgcgggtggtgtgattatccttaagcgcgaacaggatgctattcgtgataatacacctgcttatgctgtactggatgggctcagcatcacctatatgcctgatcactctattgatttcagaggaaacgaagacgcgattctggcggcggctagatccggattagaagcggcaggttgtacagccgatcagattgattacattgaactgtatgcgggtgggaaaccaggcgagatcgccgctgaaatgtctgcattaggtcgggtttatgcttcacaaaacagacaactgaccgccaccatcggcaccgttaaggccaactacggacatctgtttatgaccacgggcctgcttggaatcatcaaatccgcgttacagcttacacagcgatacttaccggcactgccagattatccgcagcatcaggaattggcgcattatgcagaagggaaattccaactgccggctcatacccaatcctggcctgcaccggcaaaaggtccccgtcgtgcagcaatcagtcacttgggtattgaccgggcttacagtcatgtgatcttaagtgaaccacagagcggaaagcgcgctcgcccaacgagtcgtccagagtcaaatcaggcaggcttaaaagttctatcgtataccgcaagagaaaaaaccgttgaagagttaatcctcaatgaacagacattggctcgttttgcgtcactggctgcggctgcgcatgtcaatatggcggtgacaccggcagatgccgaaacaaaagtggtatctcccgaagtatcaaccctgaatatgtcattgccgatggaacttaatcacttcatacgcaatgcccatactcaactgcattacctgcaattggagcagacgtattatcagttgcttaaacagcatctggcagagctgcccttaattcagtctaaaaccacagaatccgcattggttgcaccgacgaaaaagagagtgacaacctcacccgccgttttcgacgagcagcaagttctggaattgacagacggcagtgtagaaaaagttttgggtgctgattatgcagaagtcgatagctaccagatacgtacgcgtatgccatcaccccctttcatgtttgtttcgcgcattacggcactttctgccgtcaaaggcaagttagaaccctgctatatcgaatgggagtacgacgtgcctgaagatgcgtggtatgccgtgaatggccgtgtaccatcgttcgtcgcgctggaatcgtcccatgcgatgatcgtggcgtttacggtgattggctgtgacctgatgttcaaaggacagcgctgttaccgtgcggtggactgcaataccacgatttacagcgagatgccgaaaacgggagatgtgttgcgtggacgcgtcaatatcacctctgttgtgcgggtcggcggcttgactttagtcgcttatgaatatctttgctatgtggaggaacgtctggtgttccggctggtggccaactccggtttctttggccgcaaagaaattgagaacgcaggtaactttgataccagcgcttattttgccaaaggcaaaaatagcattccagcaaaaccctttacaccgttgctgcactgtgatcggacaacattcaatgagcgggacatcactaacgtcatgaatggtgatctcgctgcctgcttcgggtcgcagtatcaatataaccgggaaggcaagttatgcgtcccggatacccgcatgttaagccggatcttgagtgtcgatacggtgggtggcgcattcggtttggggcagattgtggcggaattagatatcgatcccgcacattgggcattcaaagctcacttcaagaacgatccggttatgccggggactttactggtagaaggctctgaacaattgatgaagttctatctgttctatcttggattgaattcacagcctgatctggaagcgcatacgctgactgaacatacatccggtgctaaattccgtggtgaagtgaaatgcgaacgggatgtggtgcagttccggctgacctgtaaatccgttgatgctatctattctgatgacaagctggagtctattactttgttttttattgcggagacgctctatcgcggcaatgtggttggcgtgagtgacaacatgggcgtgagatacgtgcgacgcaagccacaccagatcattgcggcagaactgaaacaggaagctttaaaatga

SEQ ID NO: 3451 - DNA, 126 bp, Xenorhabdus bovienii
  Coding DNA location: Contig name=SeqID_16889; Position on contig =101114..101239bp; Strand=-
ttgataatatacctgagcgaatactttcgctcaggggaactctgtcatattcaggagtctctccttgatggaaaatattgcgattattgggatggggtgcttatttcccggtgcagatacccttga

SEQ ID NO: 3452 - DNA, 6876 bp, Xenorhabdus bovienii
  Coding DNA location: Contig name=SeqID_16889; Position on contig =101318..108193bp; Strand=-
atgctgattacgggcgtgttttattcaatacacgaggaatgtatgtctgagacatattttttgcatgataggaaagttcgtggggatatagcgatcgttggtatggccagtcattttcctgatgctccaaatttgtataaattctgggaaaatatcattggcaaaaaggactcgctgactgatatctctaccatgttaggagacgaatattggcaaaaagaggatttttacgatcccaacccggcagtggcagataaaacttatggccatagtgctggctttgtgcctccgattgacttcgatccggtggagttcaaaattccacccgcgattattgactcaattagtacggcgcagttatttgcactctatgttgctaaacaggccatgctggatgcgggcttggttggacaggaaaatagcagggtagaccgtgatcgtatcggtgtgattttaggtggggcaggaaatggcaacacgtcattttcactggcttcacgccagcagtcaccttatttgcgtaaaattatggtcaaatccggcctgtcagaaaaagtggcaaatgacatcatcgaacggatgcatggcatgtaccttgaatggactgaagacagtttcccaggttttttgggtaacgtcgcctgtggccggattgccagttattttgatctcggtggcacgtcttatatggtagatgctgcctgtgccagcagccttgcggcaatcaaggccgctatcggtgaactgcattctggtagttgtgatgccgtgttgacggggggtgtcaatttggagaactccattttttcattcctgtgcttcagtaaaacgccggcattgtcaaaaagtaatttatcccgtcctttcgatcagagtgctgatggcatgatgcttggtgatggcgtgggaatgttggtactgaaacgtctcgaagatgcagaactggatggtgacagaatttatgctgtcatcaagtccattgaagcttccagtgacggcagagccaagagtatttttgcccctcgtctggaaggacaggccaaagcgttgaggcgggcttatgccagcgcagggctctcacccaatgatattcaattggttgaggcgcacggcacgggtacggcatcaggcgatgataccgaactaaaaagcttacacactgtgtttggtgaataccaggtgcctgcaaaatcggtggcaattggcagcatcaagtcccagatcggccatactcgttgtgccgcaggcgctgcgtctatgatgaaggtcgcgttggcactgcatcataaagtcctgcctcccactatcaatgtgggtaagccgacaaacttgctgaaagcagaaaacagcccgttttatgtcaacagcgaagccaggccgtggttgcgttcattcagcagtgcaccgcgtcgtgcggcattgagtgcctttggtttcggtggcaccaatttccatgtcattctcgaagagtatgaaaaacatacgcatggacgttatcggctgaatgagtcaccttggatcatgttgtttaaaggtcataatccggcggaattgcttgcgcagtgtgaagaaactctgatccatttcagtggtaacttgcctgatatcgccatccgccagcatcttgagcagcaggacattgacagcttacagccgcaacaggccagagtgctgtttgtctctcaatccgcagaacagacagttgccttgttgtcgattgccatcaaacagttgcagcagaatagcgctcatggttgggaacatccgcgcgggatctattaccagccccaaggaaaaatgctggatggcaaaattgtcgctctgttccccggtcaggggtcgcagtatgtcaacatggcgcgcgacgttgccaacgattaccccgaaatgcggcaatcgctggaaacactggatgatgtgtccatcaatgaattagggcatgaactatcgccggtgatttatcccgtaccgacattttcagatgacgagcgtcaggtacagcaacaacggctgatggacacggctaatgcccagccagcattgggcgctatcagtgcaggttatttcaacattttgaaagggatgggattcgcccctgattttgttgccggacacagttatggtgaagtcacggcactctgggcggcaggggtgctttccgataaggatttccaccgcgtttctcttgccaggggctgggctgcggcatctgccagcgatcaccgtggggcagatactgatgctggcgtaatgctggccgcgtcgctcaaccctgcacaacgcgcacagattctggaacgctataccggcattatcattgccaatgacaactctcagcagcaggtggtattcggcggtgcgacttccctgattcaccagctccatgatgagttgaaaaaacgtgatgtgcattgccgtattctgccggtttcagccgctttccataccgcatttatccagccggcttatcagccttatcgtgaacgtctggcgggtatcaatttccagtcaccgcaatgcagactgttctccagtgcaacagcggaaccgtatggaaattctccgcaggcgattcgggaattgttagcggaacaattgattaagccagtgcaattccgccaaaccattgaagccatttaccagcagggtggtcggttgtttgtcgaagtagggcctaaaggggtcttgggcaaattggtagccgatatcctgaaagacaaagaacacgaggttatttccgttaatcccaatgacaaaggggaagatcggttacagtttgcccgtgctcaagccaaattgctggcggaaggtgtcaaactcagagaaataaatcagcacatacgcccccaaccgatagcggaagacaaaagcaaacgtctgacgttcagaatgagcgggggtttctacctgtcccagaaaaataaggcacgacgccaacgtgcgctacgtgatggcgacagcgcgattgtcgagcaatttatcgctgaatctgcacctgtaccgatggctccggttatgcctttgcattcccaaaaagaagtcaacatcaaagaagagcattcaggcaaagaagtcaaaccaacacaagaagtacatccaacaaaagaagttgtggtagaaaaagttgaaaataaagtcgaaaaaatcgccgaaaacaaaacaatttctgcccaatttattcaacaaaatatgctgacaatcattcaaagacgagagagcacgatggaacagaacaaccagttgagtgaaaacgtagatgtaaacatgttaaatggactgttgcaggctcaacaggtcatgagccagcttcaccaacaatttcaagctaaccagaaagactatattcaactgctggggatgttgttggataaacaatataccctgctggaaacctgtaaggatcatcagaacctgccgagcatgttatccagtctgagtcagagtgttcaattactggacaagaaccttgaactatatcattccaaccatgaacactatttcatggctcagcagagcttgttccagtccgggcaagtggcaccgatgatagcacctactcaccgtacgtcatcgcctgtggtggattattccgctctggccaaagtgaccgcttcggcgacaatagaacctgctccagtatcaacgccagcgccaattccaactccgattccgacaactgccccagcggtgaaggttgacacggctcctgtaaagggatccaagcctgtggacacgataaaggaaattgagccagtgcgttcaatggtgccagaaatgcctgtcatgccatcagtggtagaggaacctgttaagccaatagtgaatgaaacacctgtcagtcagcctacacctgtagtgattgagacaaaggcgaaaatccttgatcccgaagtagaaaaacagttccagctcttgtcacaaatcactgaagagaagattgtcaaccaattgatctccatcgtcagtgacagaacaggttatccgcaggatatgatcacgccagaaatggatctggaagctgatttgggcattgactccattaagcggctggaaatctttggtgcgatgtttgacgcgttctctgcgaacgtgggtctttacaatgaagcttcaagaaataaagatctggaaaacttcgaagtcgattccttgagtaatatcagcaagatgggcgtgttctttaagcaaatgcttgacgacgtcatgaatggcttgctcggcaacgggggtgatgaagtcgtggcagagcaatcactgccatcagtcgaaacccgtgaacacgcaaacaccaaaagcaacgttgtccctgatagcgggggagcaacaggcaaattacagtctctcggatttttcacatcaacagtaacttcacctgaggttgacagcgtaaaaaagccattagctgaaccgcaactgattgtaccttctgtggttcagcctgcactaaagaatgaaattgtcttaaatgaagaagagtcttttgccggctcacccgtttcgcgttttgccgtggtgaaacaacccctgcctatgccagatcgtctacagggggtgttttcatcccctaaacgctggctggtcgttgatgaggggacaaccaccgtggatgacgtagtgaacgcactcaggcaacagggacagcaggttgctgttctgatgctggagaaaaaccaagctgtaatgagggacgaagcagcgctggacatggctttggcagacattgagcagcaacatggcacgattgagggcgttatttacttgcagacacctaagcagagcgttaaggcgttagctgatgtgtttaatgaacaggattaccgctcagttgaaaccacgttcctgctggcaaaacgtctgcaaggaagccttaaccatgatgaacagaagaccggttatttcatggttatcatgcgcggtgatggtgagttactcacctctggacgggaacacctgtctatcgtttcggctgggctcacagggctgactaagtctctgaatattgaatggaaaaatgtcttctgccgaacagtcgatattgatgccagagtcaaagacagcgatgcggcgaagatggtggtagaagagctccaagatagccggactgatatgggggaagtgggacgcggcgtgaatggcgagcgtatgacattggcactgacagaagaaaatgtattgtcagcgacatctgtcaatcaggtcaacgcgagtgatgtgctggttgtaacgggaggtgctcgcggcattactgcacaatgcgttattgaattggcgaaacagagtcaggccactttcattctgcttgggcgtacggatatgaccgagccattgcctaaatgggcagaaggcaaaattacgcaggatgagcgcaaaactgcggccatggcttacctgaaagcgcagggcgttcagcttacacccgttaagattaatgggatgttgagccgcttgacgcatattgatgaaatcaatggcacattgcaggcaatcagacaggctgggggacgggtcatgtacctgcactgcgatatcactgatccaaaacaggtgaaaatcgtactgaccaaagcacagcagcaacttgggcagataacgggtctgattcatggtgccggcaatctggcggataagcgaattgaaaagaaaacactggcagatttacattcggtctttaatgccaaggtcaaagggctggaaaatctgtgccgcgaattagactttacatccctgcaccatattatgttgttctcatcggtttccggtttctttggcaatgccgggcaggccgactactcgttggcgaacgaaacactgaataaatttatctacctgcctttcaaaggtaaaaacagtcagataatccgttcagtgaactggggaccgtgggatggcggtatggtcagtgatgttctcaaacgggcatatgacgcacagaacatggcgattattccgctcgaagaaggcactcaacgttttgtgcgtgagttccgggatcccggttcactccagatcacgattggcggggcaaactacaaggctgagaagacagttaaggtgttgggtatcggagagcaggttgaccgtcaattgagtctcgataagaacccgttcttgtatcaccatgttatcgagggtaaatccgtattgcccatgacggcggcgattgcctggatggcgcggatctgtgaagatcgtttccccggttatcaactggaaaccatcactcatttcaaagttctgaaaggtattgtctttgataacgcgctggctgaatcttactgtgtggcatgggttccgagtacatttgatgaatcgggtgatgggcggttggcactgaatgttgtcattaccagtaaacgaatgaaacattatcaggcgaccttgatcctgagcctgcaaagccgtgaagcgaagcatgaagcagtcggtatcgatctgaacgctgaggttccgcagacgttgccattctatggcggtgtcgggggagagggcatgctgttccatggggaatcattccatggtgtccagaaagtcgtccatgttgatgatgatcatattacattgaagtgctgtgttatgccggtacagcttgaaatgcaggggcagttctcgacccgtttatttaatttgttcattaacgatattgcttttcaattgcctgcaatgtggttgctgcaacgaaatgaaatgtgtttacccaatgcaattgaaaaaatagaacaatatgctgagttgaaatttggtcaagaattctacgcgtcaattgaaatcaagaaccaaatatcaacggaaataataacagatattattttttatgatgaacaaggctatatttatagtcggtttcataatgcaaaatttaccgtgtttgttgaatag

SEQ ID NO: 3453 - DNA, 123 bp, Xenorhabdus bovienii
  Coding DNA location: Contig name=SeqID_16889; Position on contig =108278..108400bp; Strand=+
atgatcgagccatatattagccaaagtagattaccgaaatattcttgtaagaatattacatatatttttctgggatatttttttattctttttttccttagcacagtgtttgaactgttatag

SEQ ID NO: 3454 - DNA, 525 bp, Xenorhabdus bovienii
  Coding DNA location: Contig name=SeqID_16889; Position on contig =108556..109080bp; Strand=-
atgattgtatttaacctcaaaagaggtctaaccatgataaattatgctaatactatttggcatattattattaatactgctattgttggtggaatttattttttcctgataaatatatggcgagtcactccatctattggtgattatttgatcttgtttttatttgttttttgcattagagtttttgttgaaataatttatgataacatcaaggccttttcttcgaaacaccttaatcagaccctgttaaataatgttatagcattaattgaatttaagggaagttatcgaggtttttatcaggtatggggactgattaccctctgtgtgctggcgtttcatattttattaatcctacctttttactccttattatcaaaaataagatttttgtcatggtttgttagtggttttttattttgtttattgtcacataacttttttatattagttttaaattattatcttgttgatttttgttataatttattttcgaacgttattatttcactaatcgtattttaa

SEQ ID NO: 3455 - DNA, 213 bp, Xenorhabdus bovienii
  Coding DNA location: Contig name=SeqID_16889; Position on contig =109046..109258bp; Strand=+
atggttagacctcttttgaggttaaatacaatcataaagctttttccttgttacaatcttaacaacggtgatcatcttatatgtgtcatttaccatgttacaaaattgattatgaatatcatttggaacataaaattctggcgtttttccttaacgctatattggtatacctttaatttatttttctttcaattctttaaaaaaaccacctga

SEQ ID NO: 3456 - DNA, 531 bp, Xenorhabdus bovienii
  Coding DNA location: Contig name=SeqID_16889; Position on contig =109919..110449bp; Strand=-
atggtgcaagagaaatcagtaggtattgagtggattgatatcgtcaatgaaggcaatgaagtaatcgcgcaggcgactcgccagcagatgcgtagccaaaacttgaggcatcgtgcgacttacattgttgtgcatgatggtatgggcaaaattctggttcaacatcgtacagaaacgaaagatttttaccctggaagattggatgcaacggccggtggcgtggtcatggtgggagaaaacatgcttgattctgcccgccgggaagcggaagaggagctggggatcgcgggtgtgccttttgctgaacatgggatcttctactatgaagaaaaatcctgccggacatggggagggttattcagttgtgtcagccatgggccgtttgcattacaggaagaagaagtttcggctgtttactggttgtcgccagaagaaattactgcccgttgtgatgaatttacgccggattctctgaaagccctttctttgtggctagcgcgtaacagacagacggaactgcctgaaaattga

SEQ ID NO: 3457 - DNA, 702 bp, Xenorhabdus bovienii
  Coding DNA location: Contig name=SeqID_16889; Position on contig =110577..111278bp; Strand=+
atggcattttacaggcaactcaaaccagtggtaatgtactggaactatatttatccatccgttattattactagaggttatatgatagacctgtattatgccccaacgccaaacggctataaaatatcattgtttctcgaagaagtcggcctgccttacactgtccattcaatcaatataagcaccggcgaacaattcaaacccgaatttctggccatttcgcctaataataaaattccggcaattgttgatcaccaacccgctgatggaggagaacccatctccatctttgagtcaggcgctattttgctctatctggcgaataaaaccggtcaactgttgagcaaggatgtgcgtgaacgcaatcagcaattgcaatggctattctggcaggttgccggctttggccctatgctcggccaaaatcaccatttcaatcattacgcttctgaagtcgtaccttatgccattaatcgctatatggaagaatcacggcgtttagtcaatgttctgaatacccaactggaaaaaacgccgtatcttggtggaaatgagtacaacatcgccgatatcgctacctatccgtgggctagatgtcatgaacatcaaaaaattaatctgaatgattaccctgcggttgaaaaatggcttgagaaaattgaacaacgccctgcaacacaagccgcatacaacaatggctaa

SEQ ID NO: 3458 - DNA, 915 bp, Xenorhabdus bovienii
  Coding DNA location: Contig name=SeqID_16889; Position on contig =111419..112333bp; Strand=+
atgcgtatcttaattactgggggtacggggctgattggttatcgattgacttgccaattactttcgctttcccattccatcaccattttgagtcgttctccacaaaaggtatattctctgttctccgaacaagttgaatgttgggccacactgaaaaataaaaataacctgaatgattttgatgcagtcatcaatcttgcgggtgaacccattgcagataagcgctggacatcagcacaaaaaacaaaactctgccaaagccgctggcaactcactgagaaattaagtcatttgattaatgccagtgaatttccgccttctgtatttatttccggttcctctgttggctattacggcaatcaggggcaagcggtagtctctgaaaatgatcttcctcatgacgaattcgcccatcagctctgtaagcagtgggaaacactggcattacaggcggaaagtgaaaaaacccgagtgtgcctgctgcggacaggcattgtgctggcaaataaaggcggagcgctgaaaaaaatgctgccactgtttcgattgggtttaggcggtaaaatgggtgatgggaagcaatatatgccttggatccacattgatgatatggtcaatggtatctattacctgctggtatcgcctgaactgagcggcccgttcaacatgacagccccttatcctgttcataatgacctgtttagtgcagcactggcgaacgtgctacatcgccccgctttcattcgcatgcctgcctttgtattaaaaataatcatgggagaggctgctatgctggttttaggtggtcagcaggctattcccaaacggttggaagaagggggattcggcttccgctattttgaattagaggaagccttcaaagatttattaaaagcggaagctaattcaccttaa

SEQ ID NO: 3459 - DNA, 585 bp, Xenorhabdus bovienii
  Coding DNA location: Contig name=SeqID_16889; Position on contig =112330..112914bp; Strand=-
atgaaaagattgattgtcgggctgacgggagcaagtggcgcgatttatggcgtcagattattgcaggtcttgcagtcggttgagggcattgaaacgcatctggtcatcagccaatccgcccggcagacattggcactggagacagattatacgctgcgggatgtgcaggcactggctgatgtggtgcatgacaaccgcgatatcgctgcttctatctcttcagggtcatttaaaaccttagggatggttatcttgccctgctcgataaaaaccctgtcgggtatcgtgcatagttacactgatggcttgatcacccgtgctgctgatgttgttttgaaggaagggcgcaagctggtattgagtgtcagggaaacgcctttgcatttagggcatttgagattaatgactcaggcggctgaaatcggggcggtgattatgccgcctgtgccggcattttatcaccgtcccgatcacattcaggacattattgaccagacggtcaaccgagtactcgatcagtttgatatcgaactgccacaagatttattcaaccgttggcagggagcgaaacaaattgaagtttaa

SEQ ID NO: 3460 - DNA, 1533 bp, Xenorhabdus bovienii
  Coding DNA location: Contig name=SeqID_16889; Position on contig =112963..114495bp; Strand=-
atgaggaaaaactacatgtgcggtattgtcggtatcgtcggttttacaccggttaaccagtcgatttatgatgcattaacggtgcttcagcaccgtgggcaagatgcagcaggcattgcaactattgatggtaacaatgagttccgtttacgcaaggccaatggtttggtcaaggacgtgtttgagacacggcacatgctgcgtttacagggaacgaccggaatcggacacgtccgttacccaacagcgggtagttccagcgcctctgaagcgcagcctttttacgtgaattctccctttggtattacactagcgcataacggcaatctgacaaacgcacataagttgaaaaaaatgctgtttgaacatgcacgccgccatgttaataccacatcagattctgaaatcctgctcaatatttttgccgatgaacttacccaattcccggattttccactggagccggatgatatctttgcggcggttgcagcgatgcacaagaaaatccgtggtgcttatgcctgtgttgccctgattattggacatggcttggtggctttccgtgatccgaacggtatccggccactggttctggggaaacgcacgctggaagatgggcgcaatgaatatatggtcgcatcggaaagcgtggcactggatacattgggttttgaattcctgcgtgatgtggcttctggcgaagcgatctacatcactgaaaaagggcagttatttacccgccagtgtgcagaaaatcctgcattaacgccctgcttatttgaatttgtctattttgcccgtcctgactcctttattgacaaaatatcggtatataacgcgcggttacgaatgggcaggaaactgggcgaaaaaattgcccgcgaatgggaagatctgcatattgatgttgtgatccctgttcctgaaacgtcttgtgataccgcactggaaatagcccatattctggataaaccctaccgtcaggggtttgtcaaaaaccgttatgtgggacgcacctttatcatgcccggccagcaggaacgccgtaaatcggttcgtcgtaaactgaatgccaatcgtgctgaattccgtggtaaaaatgtcttgttggtagatgattccatcgtacgtggtacgacatcagaacaaattgtggaattagctcgcgaagctggcgctaagaaggtctattttgcttcggcagcaccggaagttcgcttcccgaatgtctatggcatagatatgtctaatgctaatgaactgattgcccacggtcgagaagttgatgaaattcgccagctcatcggtgctgatgcgctgatatatcaggatctcagcgatcttattaatgcggtgcgtgaagaaaaccctgatattgaaaaattcgaatgttctgtatttgatggcatctatgttacgaaagatatcgaccagatttacctcgattatctggagaaccttcgtaaagatgacgccatgaaattgcgtgggcagagcgaaattgaggatctggaaatatataatgaggggtaa

SEQ ID NO: 3461 - DNA, 507 bp, Xenorhabdus bovienii
  Coding DNA location: Contig name=SeqID_16889; Position on contig =114495..115001bp; Strand=-
atggtctggattgattatacaattattgccatcattggtttctcggcactggttagcctgatacgtggttttgttcgcgaagcgctctcactggtcacttggggatgtgctttctttgttgcaagtcacttctatacttatctagcggtttatttcacccgcttggaagatgaactggtgcgtaatggggtagcgattgctatcttattcattgcaacactgattgttggcgcggtcgtaaactatgtgattggttcacttgttcagcgaacaggcctgtcaggtactgatcgggtgctggggatctgttttggggcactgcgtggagtattgattgtttctgccattctatttattgcagattctttcacaccgctccctaaaagtgaggactggcaacagtcacaactcatcccacagttcagtcaaattatcaggtggttttttgactacctgcaaaattcgtctagtttcctgccggagaaattaccctctccgcttggctga

SEQ ID NO: 3462 - DNA, 213 bp, Xenorhabdus bovienii
  Coding DNA location: Contig name=SeqID_16889; Position on contig =115066..115278bp; Strand=+
ttgcgtagcagatttctcactctactgaaaataattcgcagcaggttcaaaaacgacaatcgccgcaagggcctaacctgtaactatcacgacgggaagcagaacacttcccgtaagacaccaataaggtcagggactgtagtttttgatttgcccttgcaaacccgtcaattctttcaattcaggcaaattggattcaagggcttgccttga

SEQ ID NO: 3463 - DNA, 702 bp, Xenorhabdus bovienii
  Coding DNA location: Contig name=SeqID_16889; Position on contig =115195..115896bp; Strand=-
gtggcaagtaaatttcaaaatcgtttagttggaaccatcgttcttgtggcactgggtataattgtgttaccggtgctatttgacggcgataagaaacataatgaaagccagtttgcttccattccgctggcactaaagcctggtgatgaagaagatatcgatttgatcgcacccctgacgcaggatatgccatcgacaccaccggaaggggcggcggaagcgatggcaaagcaagcacaagagctacagccagatatgctgtccagttcgttattgtcagagcctgcgccaatggcaccgccgcctgtggagatcacacaagcgcccaaagcgacggttaaatctgaacccaatcctcagccaaaggtggaagttaagcgggaaacgagggctgaaaccaaacctgaaactaatcctgaagctaagtctgaaagcaaatccacgccagtgaaggcgccgcagggagtggcatatgttgttcagcttggtgcattgaagaatgcgggtaaagtggatgagattgtggcgaagctgcgtctttcgggtcatcaggtctatatcattccttcttctccagtacagggagcattgacgcggatttatgtcgggccgaatgcatcaaggcaagcccttgaatccaatttgcctgaattgaaagaattgacgggtttgcaagggcaaatcaaaaactacagtccctga

SEQ ID NO: 3464 - DNA, 1299 bp, Xenorhabdus bovienii
  Coding DNA location: Contig name=SeqID_16889; Position on contig =115886..117184bp; Strand=-
atgtctgatatattgcaaattcctcaagccacgtcgtcactgatgacgtggctttcctatctcggaaacctgcacgcaaaagccattgatatggggcttgaacgtgtgggagcactcgccgatcagttagatttgctgcatccggcgccgaaagtcatcaccgtgtccggcacgaatggtaaggggacgacttgtcatacccttgaatccattctactggccgcaggcctgaaggtcggagtgtatagctccccgcatctggtgcgttataccgaacgggtacgtatacagggtaaagagccgacggaacaggatttctgccgtgtatttgcggacattgaagcccaacgtggtgatatcacattaacctattttgaatacggcactttggctgcgttacagctttttaaagaagctgatctggatgtcgtgattctcgaagtggggctgggcgggcgtctggatgcgaccaatattgtggattcagatgttgcggcaatcaccagcattgcactcgatcatatcgattggctgggtgcggatcgcgaacatattggccgtgaaaaagcaggtattttccgtcaggggcgttttgccgtggtgggggagccggatatgccacataccatcgctgaagtggctgatgagctggggtcgaaattatttcgtcgcggtgttgactgggatttctcacaggatgcggacagttggtactggcgcacaggagatcaacagttcagtgaattacccgtccccaatctgcctctggcgaacgctgcaacagcgatgggagtgatttactgtctgttgcagcaggatgataacgtcagtcaggccattaatgaacgagcgatccgtgaagggttaagcaaggcccagttaccggggcgtttccaaatcgtcagggaaaacccgcgggtgattttggatgtggcgcataatccccacgcagccggttatctcgtagagaagctggcagaattgccccgcgcaccagacagtaagatccgcggtgtcgttggtatgctggaagacaaggatatagtgggtacgcttgcttgtcttgcccagcagattgatgaatggtactgcgcatcattgcatgaaccccgtggagccgaagcaaccatgctggccgagtaccttggcgatgcccgaacatttgtggacgttgagcaggcatggcatcaggccatggcagaagcctcagcgcaggatatcatcgtggtctgcggttctttccatactgttgctcatgttatggaggcactggcggaggtgaaggaaggtggcaagtaa

SEQ ID NO: 3465 - DNA, 948 bp, Xenorhabdus bovienii
  Coding DNA location: Contig name=SeqID_16889; Position on contig =117177..118124bp; Strand=-
atgagctggattgaaaagattctaaataaaagcaaaataatgcaaactcgtaaggcaagtatacctgagggagtttggacaaaatgtgatagttgtggtcaggtactttatcgtgctgaattagagcgtaaccttgaagtgtgcccgaagtgtgatcaccacatgcgaatttcagcccgtgagcgattgcacacatttctggatgaaggaaccggtatcgaattaggcagtgaactggaacctaaagatctgctgaaattccgcgacactaaaaaatacaaagatcgtttggtagcagctcagaagcagacgcaggaaaaagatgcgctgatcgtgatgaaaggctcattgtacaaaatgccaattgtggcaggagcatttgaatttacctttatgggtggctccatgggctctgtagtcggtgcgcgctttgtccgcgctgtcgaacagtcactggaagacaactgcccattcgtctgttttacttccagtggtggcgcacggatgcaggaagcgctgatgtctttgatgcagatggcaaaaaccagtgccgcgctggcgaaaatgcaagatcgtggcctaccttatatctgtgttctgaccaacccgaccatgggcggagtgacagcaagtctgggaatgctgggtgatatcaacattgctgagcctaaggcattgattgggtttgctggccctcgtgtcattgaacagaccgtgcgtgaaaaattgccggcaggcttccaacgcagtgagttcctgctggaaaaaggcgcaattgacatgattgtacgccgtccagaaatgcgtgagaaaatagccaatttgctttcgatgttgactcgtcagcctcatcccgctgcaaaagtagaaacggtagcggagatggttgctgaacccgctgatgttgaaactgacataaacatcaatactaataaagaagatgtctga

SEQ ID NO: 3466 - DNA, 690 bp, Xenorhabdus bovienii
  Coding DNA location: Contig name=SeqID_16889; Position on contig =118238..118927bp; Strand=-
atggagtttttaactcattttgttgattttactaagttcattgtcgattttattttacacattgatgcacatttgaaggaattggtcagtgattatggcaattgggtatatggcatcttattcctgatcatattttgtgaaacgggtttggtggtcacgccatttttgccgggagattcgctgctgtttgtggcaggcgcgttgtctgcattaggctccaatgatctgaatgtacatattatggtggcgttgatgattacagcggcgattattggtgacgctgtaaactatacaattggtcgtatttttggtgaaaaattatttaccaacccgaattcaaagattttccgccgcagttatttggataaaacccatgagttttatgaaaaacacggtggaaaagcgatcattctggcacgatttgtgccaattgttagaacatttgcaccgttcgttgcgggaatggggaaaatgtcttaccgccattttgctgcttataatgtaatcggtgcatttatatgggtgctattattcacttatgccggttatttattcggtgatatgccaatcatacagcagaacctgaaattattgattgttgtaattatctttatttctatcctgcctggcatcattgaaatttggcgccatcgacgagctgcatccaaaaaagcagtagatggcaagtag

SEQ ID NO: 3467 - DNA, 840 bp, Xenorhabdus bovienii
  Coding DNA location: Contig name=SeqID_16889; Position on contig =118974..119813bp; Strand=-
atgtctgatgcagagctgagtcagtctgtaccagaggcaaaaaaagtgaaaattgcactggggattgaatatgatggcagccgctattatggttggcagcgccagcaagaagtaaaaagtgtacaggaatgtctggaaaaagccctgtcaaaagtggcagatgaaccgatttcggttttctgtgcaggcagaacagatgcgggggtacatgctactgggcaggtagtgcattttaaaacctcggcacaacgtaaagatgctgcctggacaatgggcgttagtagccatttgccacccgatatcgcagtgcgctgggtaaaaacggtggatgatgaatttcatgcccgtttcagcgcaacggcacgccgctatcgatatataatctttaatcatcgctatcgccctgcggtgttagcacagggcgtcacgcattttcactatccattggatgagagaaaaatgcatgaagcggcacagagtttactgggagagaatgattttacttctttcagggcagtacagtgccaatctaattcaccgtggcgcaatatgatgcacattaatgtcagccggcatgggcattatgtggtggtggacattaaagcgaatgcatttgttcatcacatggtgcgtaatattgttggcagtttgctggaaattggttgtagtaatcaggatatcggctggatggctgaactattggcactgaaaaacagaacaaaagcggcggcaacagctaaagctgagggattatatttagttgcggtggattatcctgagcactttggtttacctgaacccattatggggccgttgtttctagctaatgatttaatctga

SEQ ID NO: 3468 - DNA, 1011 bp, Xenorhabdus bovienii
  Coding DNA location: Contig name=SeqID_16889; Position on contig =119813..120823bp; Strand=-
atgtcagaaggctggaatattgcgctcttgggtgcaacaggcgcagtaggtgaagcgatattggcgttattacaggagcgcgagtttccggttggtgaactgcatcttcttgccagtgagcaaaatgctgggaaaattcagcgttttagcggtaaaagcatcaccgtttatgatgccgcagaatttgattggtcacaggtacagcttgcgttttttgccgcgacgatggaagcaacggcacaatatgttgaaaaggcaacggaagcgggctgtctggtaattgacagcagcggattgtttgccgcagagcccgatgtaccgctggtcgtaccgggagttaacccatacgctttggctgaatatcgcaaccgcaacatcattgctgtggcggacagctcaacaagccaggttttgacggccattaagccattgatcgatgttgcaggtgttgcacgtataaatctgaccaatatattgccggtttccgtacatggtaaagccgccattaatgaattggcagggcaaagtgcccgtttattgagcggcattccgccggatgaaagtctttttaacaaacaattggctttcaacttgctgcctttattgcctgatgccgaaggctcagtacgcgaagagcgtcgcattgtcgatcaaattcgcagaatattacaggacgaagggctgcccatttcagtcagttgtgttcaatcttcggttttctacggaattgcccagatggtgagtgtggaaacgctgcgtccagtcggtgtaggagaagctcgtggagaacttgaacgttttgcggaaattcaggtctcagaagagggggattaccccactcaggtcacggatgcatccggcaatgacaggttgagtattggctgtctgcgtaatgattacggtatgccggagatgctacaattctggtctgttgccgacaatatccgttttggcggtgcgctgatggcggttgaaatcgcagaaaaactgatgcaggagcaattctactga

SEQ ID NO: 3469 - DNA, 1137 bp, Xenorhabdus bovienii
  Coding DNA location: Contig name=SeqID_16889; Position on contig =120878..122014bp; Strand=-
atgagaaaagtgaaaattctggttgatgaaaatatgccttacgctgaacaactttttcagcaattgggcgaagtacaggcaattccggggcgcccagtccctgcgggtgttctggaacaggctgatgcctttatggtgcgttctgtcactaaagtgaatgaatccttgttgaaaggcagttctgttaaatttgtgggtactgctactgcgggaatggatcatgttgatcagcaatggttgtcgcaggcaggaattggcttctcagccgcgccaggatgcaatgcgattgccgttgttgagtatgtgttttctgcactgatgttattggcggaacgggatcaatttcaactcaaagataaaactgtcggcattgtcggtgtgggtaatgtcggggggcgtctggctgaccggctggctgctttgggcgtgaaaaccttactgtgcgatcctcctcgtgccgatcgtggggatgagggtgaattctggccgttggaaaaattagtacaggaagcggatattctgactttccatactccgcttaatagatctggccgttatcagacttatcatctggccgatgcagaattactttctgcattaccggacaaccgaattttgattaatgccagccgtggtgaagtggttgataatcaagcactactttcagtattacaaagtgggaaaaaattacgtgttgtgcttgatgtctgggaaccagagcctaacctttcattacccttgctggctttggttgatatcggtacaccccatattgccgggtacactctggaaggcaaagcacgtggtacgactcaggtctttgaggcttactgcgaatttctggggcagccgcgcagggcggaattgtccgaccttttgcctgaacctgatttcagccatatcaccgtacatggtgaagtgacacaaagcatcctgaagcgcttgatacatttagtgtatgatgtgcgccgtgatgatgcaccactacgtcaggtcgctgaacaggatggcgcttttgaccgattgcgtaaaaactatccagagcgccgggaatggtcttccctgacggtgcattgtgactcagaaaaaagcgcccaattactgtctgaaattgggtttaacgctaaagtgatttaa

SEQ ID NO: 3470 - DNA, 186 bp, Xenorhabdus bovienii
  Coding DNA location: Contig name=SeqID_16889; Position on contig =121933..122118bp; Strand=+
ttgcctgtacttcgcccaattgctgaaaaagttgttcagcgtaaggcatattttcatcaaccagaattttcacttttctcatccaacgacttaaatgggcgtgatccactattctgccacttaatcgacataaaacctattatcagaaatgggagaattatctggattgctacatctgttgtctga

SEQ ID NO: 3471 - DNA, 888 bp, Xenorhabdus bovienii
  Coding DNA location: Contig name=SeqID_16889; Position on contig =122192..123079bp; Strand=+
atgataaatttcttgtttccctttattgccgttctgatttggtcaattaatgccgttgtcagtaaagtagcagccacgtcaattgagcctgctgccattgctttttatcgttggttcattgcgtttctggctttaacccctttcattttatggccggtcctgaaacagcggaaaatggttatccagtattggtggaaattattgattctgggtactctgggcatggtacttaaccaaagtatggcctattacgctgcccatacggtgagtgcaacattgatagggatctttacttcactgattccgttgttgacggttatcatcagtatctttgccttacgggttgcccccacggtaggtatcaccctgggtaccgtgttttcgttgttcggcttggtatggctggtgagcaaaggagagcctgcttccttattagagcacggtctggggatcggtgaagtgatgttatttattgcgtccgcttcctacgccttatatggcgtattaacaaaacgttgggcgatcccattacccaattggcaatcactctatatacaaatcgggtttagccttttgctgcttttgcctaatttcatgatgaccgaagatgtccggttaaccagcgataacatttccctcgtcctgttcgcgggcattcccgcctcaattcttgcgccctatctgtggatacagggcgtgactcgcctgggcgcgaatatgacttctatatttatgaatctggctcctgtatttaccgccattatcgccatagtgtttctgcatgagaaaatgcaaagctatcatctgatcggcggcggcattgttctggcaggggttatactcgcccagcgcctacgtacccctctcactcgccggaagtctgaataa

SEQ ID NO: 3472 - DNA, 1479 bp, Xenorhabdus bovienii
  Coding DNA location: Contig name=SeqID_16889; Position on contig =123044..124522bp; Strand=-
atgtacattgcgtggattgggatatcgattggagttgcagaaataatgaaactgttcaaagtaccacgctcgttgtttcatcagttactcctgttctttggtgcgccactgttgttattgggcggggcttctgtgtatacccattatttcagtgcggaaaatgcggcaacacttgcctatgaccggacgttacttgcatcggcaagaacagttgcggaacgtctgacagtaaagaataaacagttaaacgttgatgtgccttatatcgttttggacagttttgaacgtaataccaatgatcgtctctactatcaagtgatatcaccggaagggaaaaccatttccggttacgataatttaccccccattcctcaatatacccagcgttcacaactgtatacggccttggtatatttttataacgcggaatatcagggataccccatccgtgttgcggccttgtatcagccgatcaacgaaggggggttaatgggcatggcattgatactggtggctgaaaccgtgggttcccgccaatatttagcgcggcaattactgatttcttccctgataagccagggaaccgtagtggtattgacactgattcttgcttatttcctgttaaagcagcttcttaaaccactgcgcaggttatcaggcatgatggtgctccgttcagccaatgacttaaccccattgccggatattttgccgtggtcagagctttcaccattgcttcgggcatttaatcgctacatagaacggttgaaactgatggttgggcgtcaagcgcggttcagtgccgatgcttctcatcaactcaggacacctttgagtgtattaaaaacgcagatagccgtggcactcaatgacaaagatccccatccgagtggaaaaatcatcaaggctatcaacaagaccgtagataacatgatctcactgaccgatcgtttgttatatctttcacagttgaaagtgcatgagaaagaagccatccagaattatcagcccgtcaatattgtggaattattacagcaagcctgtttttctcgtttgcaacaggcggaaagcaaaaatgttgatttgggttatgaaggggaaaatgccttttggatcaaaggggaaccagtattgttgacagaaatgtgcgctaatttgttagataatgccattaaatatacgcctgctgcgggaatggtgacggcaagagtgagcatgacagcggacaaaaaatactgttgcctcgaagttgatgattcagggccgggcatcgcgcaagaaaatattactcaatcgctgatggcgtttaaccgtctggacaatgcagcggggctggaaggcgctggattgggtctgactattgtcaaagatatcagcttgtaccacggtgcgactctccagcttttgcccagtgcaacactgggcggtttgctggtgagaattttattcagacttccggcgagtgagaggggtacgtag

SEQ ID NO: 3473 - DNA, 666 bp, Xenorhabdus bovienii
  Coding DNA location: Contig name=SeqID_16889; Position on contig =124477..125142bp; Strand=-
atgcgtcttttattagttgaggatcaccctgatttatcacattggttgcagaaagcattaagaagttctggttttacggttgatattgccgaagatggaattgcggcagatcagcttttgctgacggaaaattataccttgctgattctggatgtcgctttacccagactggatgggatttccctgttatcacggctgcgtaagcgcgggcaaaatttgccagttttgttattgactgccaaagcggatgttgcagaccgagtgaaagggttaaattcgggcgctgatgactacttaactaaaccttttgattttgaagaattagaagcccgtattcgagcactgttacgccgtggtgttggctcgccgctagggatgcagcaattcggctcattggcttacgaagacgcaggttatttcttattggataatcaaccgctggcgttgactcccagagaattctcagttttaacaaccctttttcaccgtcgtgggcgcccggtttcgaaacaacaactgtttgagcaggtattttctttatccgatgaagcaaatccccaaagcatcgaactgtatgtgcatcggttacggaaaaagctcctcaacagtgatataggaatatgtacattgcgtggattgggatatcgattggagttgcagaaataa

SEQ ID NO: 3474 - DNA, 108 bp, Xenorhabdus bovienii
  Coding DNA location: Contig name=SeqID_16889; Position on contig =125364..125471bp; Strand=-
atgcaatttatcaaattagaagccgctctgcttaaagattcgaggtgtattccattatttaatcagacgaccttagcatttcagatgaatcgtaaactgtccgactaa

SEQ ID NO: 3475 - DNA, 144 bp, Xenorhabdus bovienii
  Coding DNA location: Contig name=SeqID_16889; Position on contig =125730..125873bp; Strand=+
atggctaataatcctgattttattttttataatcaggattatttaagccaaatattttttaatatacttgtaactataataaaatccatcacaataatgagagaacttccccctccgtgtaatgtgaaacactacgaaaattaa

SEQ ID NO: 3476 - DNA, 960 bp, Xenorhabdus bovienii
  Coding DNA location: Contig name=SeqID_16889; Position on contig =126019..126978bp; Strand=+
atgttattagcaactacctgcttacttttctgtgccaataccttagcaaccaatgcccctaatagaaccgaatgcattgcaccagccaaacccggtggtggctttgatttaacctgtaagttagttcaggtttcattattggatagcaaagccatcaatacgcctatgcgggtgactttcatgcccggtggtgtcggtgctgttgcctataacgccatcgttgctcaacgttctgctgagcccggaactatcgtagctttttctggcggttctctgctgaatctttcccaagggaaatttggccgttacaacgtgaatgatgtgcgctggctggcaagcgtcggtactgactacggtatgatcgccgttcgtagtgattcgccttacaagaacttgcaagacctcatggaggcattcaaaaaaaatcctaccagcattgtattcggtgcaggtgcatccatcggcagccaggattggatgaaaacagcattactggcgaaagaggttgggattgatccacgcaaaatgcgctatgtcgcgtttgaagggggtggcgaacccatcactgccctacttggtaatcatattcaggtcgtttccggcgatctgagtgaaactctgccttatctcagtggtgataaaattcgtgttcttgcggtctatgctgataaacgcctgagtggtaatttagcacgtattccaacagccaaagagcagggttataacctcgtctggccaattattcgcggtttttacatagggcctaaagtcactgatgaacactaccaatggtgggtagagacatttaacaaactacaacaaacaaaagagttcaaaaagcaacgcgagctacgtgggctctttgaattcaacatgactggcaaggaattgaacgactatgtgaaaaaacaagttgcccaataccatgagctggccaaatcctttggtttagcaaaataa

SEQ ID NO: 3477 - DNA, 432 bp, Xenorhabdus bovienii
  Coding DNA location: Contig name=SeqID_16889; Position on contig =126992..127423bp; Strand=+
atgagcgatcgtatatttgccactgtatggttggtactgtgtgggatcgggctaaccattggctggggcattcacagtgaatacagctatgaacccttaggaccccgaccatttccaatcgccattatttcgttaatggcactctgttctttgttactgctattcaaaaaacctgagcccacccagtggcctacagcacaagtattacgccgcttactgttgttgattacctcactagtcgtttatgcatggacatttgagtggctgggctttcctctggcaacgacgttactaaccatcagtgtggcgttactgtttaacgctaaacttcctgcggcgatcatttccggcgtgtttcttggtgtctcgctcttttttgcatttgatcgcctgttagatgtcactttgccactcggcaattggctaaaataa

SEQ ID NO: 3478 - DNA, 1512 bp, Xenorhabdus bovienii
  Coding DNA location: Contig name=SeqID_16889; Position on contig =127435..128946bp; Strand=+
atgatggatacttggatatatctgagtcagggttttgaagtcgcattaatgcccaaaaacttagtcattgcgttaatcggctgttttattggtactgttgtcggcatgctccccggccttggcccaatcaatggtgtggctatcttgctaccattggcttttgcattgaaattacctgcggaatccgccttaattttattggcaacggtctatattggctgtgaatatgggggccgaatttcttcaattctgctgaatctgccaggagatgccgctgcgattatgacagcgcttgatggtcatccgatggcaaaacaaggaaaagccggtgttgctctctctatttctgcggtcagttcgttttgtggctcacttttagccattattggaattatcctgttcgcgcctattctggcaaagtggtctttggcatttgggccagccgaatattttgccctgatggtttttgctatcgcctgtctcggcagcatgatgagccagaatcctatcaagtctttactcgccgccttaatcggtttgagcttggctacagtcggagtcgatgccaataccggggtttatcgtttcacctttgatagcgtccatctctctgatggcattcaatttattgtcgtcgttattggcctgttttcagtcagtgaaattctgttgatgctggagagcacctctgcgggacaaaaagtgataagtaaaaccggacgcctgcttttcaataaaaaagaagccgcagtttgtacagggccaatactacgctcctcagtgattgggttcttcgtgggtatcctgcccggtgctggggcaacgattgccagcgcaatcacctatatgacggaaaaacggatcagcgggaatagcgactcctttggcaaaggtgatattcgtggtgtggcggccccagaagctgctaataatgcttcagcatgtggttcattcattcccatgctcaccctcggtgtacccggttcagggacaacggccgtcatgataggtgctctgaccctctataacatcacccccggccccgccatgttcacagagcaaccggatatcgtctggggactcattgccgccttactgatcgccaacgttctattgctgatcatgaatatcccgatgattgggttatttacccgtatgttgaatattcccttgtggtttttagtccccgccattgccatcgtgtcagcagtcggggtttatgccgtacacagtacgacattcgatcttatgctgatggttggattgggcgtttttggttatatcctcagaaaaatgaatttcccgatgtcaccgcttattttgggatttgtattaggtgaaatgctggagcaaaacctgagacgcgcactatcaatcagtaacggaaatttcgagatcctctggagcagcaccattgcccaaactttactggtactcggtgcattagtgattattattccacctgttttacggataatgaataaacgccgtaataaaaacacggccgcataa

SEQ ID NO: 3479 - DNA, 1215 bp, Xenorhabdus bovienii
  Coding DNA location: Contig name=SeqID_16889; Position on contig =129022..130236bp; Strand=-
atgaaacgtgcagtaatcactggtctggggattgtttccagtattggtaataaccagaaagaggtgctggagtctctgagagaaggccgttccgggataactttttctgaagaattcaaagagatggggcttcgtagccacgtttggggtaatataaaactggatatatcaggtctcattgatcgtaaaactcagcgttttatgagcgattcatctatttatgcttatcttgcaatggatgaagcgattaaagattctggtttgtctgatgagcaagtttccaatttgcgcactggtctggttgtgggttcaggtggcggttctccacgtaatcaggttaatggatcggatggtatgcgagccaaagggctgcgtggcgttgggccttatatggtgacgcgggcaatggcttctggtgtatcagcctgcctggcaacaccatttaaaatcaaaggggtgaactattccattagttctgcctgttcgacttctgcacattgtattggccacgcagttgaattgatccagcttggtaagcaggatgttatttttgccggcggcggtgaagaactgagctgggaaatggcctgtgaatttgatgcgatgggagcgctttctactaaatataacgaaacaccagaactcgcttcccgcacttatgatcaggggcgtgacggttttgtcattgctggcggtggcggtatcgttgtggttgaagaattagagcacgcattagctcgtggcgcacatatatatgctgaaatcatcggttatggggcaaattctgatggcgcagatatggtcgcaccttctggtgagggagctgttcgctgcatgaagctagctctcgacggtattgaaggtggcgtggattacatcaatacccacggaacatcgaccccgattggtgacttgaaagagttgggagctatccgcgaagtgtttggtgacaacacccctgctatttcggccaccaaagcgatgacggggcactctttgggggcggctggtgcgcacgaagcaatttacagtctattaatgctggaacatggcattattgcgccaagtattaatattgataacttggatgagaatgcgtcaggtatgaatattatcactgaacctaccaaacgcgagctaagaacagtgatgtccaatagcttcgggttcggcggtacaaatgcgtccctggtgatgcgtaaatattcgaactga

SEQ ID NO: 3480 - DNA, 105 bp, Xenorhabdus bovienii
  Coding DNA location: Contig name=SeqID_16889; Position on contig =130217..130321bp; Strand=+
gtgattactgcacgtttcattcattacctcatcatttttacctgcgggatttctgccccgcactttagcgtacacttgtacgccgaacaagtccgatcaggttaa

SEQ ID NO: 3481 - DNA, 2052 bp, Xenorhabdus bovienii
  Coding DNA location: Contig name=SeqID_16889; Position on contig =130436..132487bp; Strand=+
gtgaaaaacagtgctatcagcagcgcaaccctaaactggaatgaacagggtacacccgtttctgagcagtttgatgatgtttatttttcaaatcaagatggcttggaagaaactttatatgtatttttaaaaggtaatcattttccccaacgttttaatacgcactcccgccctgattgtattattgccgaaactggattcggtactggattgaatttcctgacactttgtcgagctttttcaatctttagacaacaacatcctgatgcatctttaaaacggcttcattacatcagttttgaaaaatacccattaacgacagcagacttgaagactgcgcatcagcgctggccagaacttcaaatattttctgaagagttatgtcagcaatggcctttacctcttgggggctgccacaggctaatgctgaataatggcgctgtcacactggatctctggtttggtgacgtaaatgatctattaccgaggataaattcgaatctaactggaaaaattgatgcttggtttttagatggttttgcaccatccaaaaacccgcagatgtggagcgaacaactgttcactgcaatggcaagattttctcgtccagaaggaacatttgcgacatttacgtcagctggagtcgttcgacgtggattgcagggagccggatttgatgtcaagaaaataaaaggctttggacacaaaagagagatgctgacaggggttctagctccatcagcacattcccctctttcctcatcaggtactccatggtttgctcgacaagcagctaccgataccgatgatatcgctatcattggtggcggcatcgccagtgtattaactgcacttgccctattacgccggggcgcgaaagttacactgtattgccaagataaccaacccgcacaaaatgcatcaggcaatcagcagggagccatttacccgttgctgaatggccgtgacgacttactggaacgtttctttatctccgcctttacctttgcccgccgtcaatatgatcagctaattgatgaaaatgtttcctttgattatcaatggtgcggtgtcagccagttggcttacgatgaaaaaagtgacaaaaaaattgccaagatgctgcaaacatcgtggttagaagagattgcaattggaatggatcgccagcaattgagccaagcgagtggattagatgttaattatcatggtatccactatccacagggaggatggttatctccggctcaattgactcaggaggccatcaatctggcagaacagcgtggaatgctcacctatttcaaccacaaaataactcaattagttcaagatgaatacggttggcagttgcatattgagcaccaggggcaatcgctgcacaaaaaccacaaagtcgttatcattgctaatggacactgcctgccgcaatttacacaaactgaaaaacttcccgttactgctgctcgtggacaagtcagccatatcccgacctctacccgtctcagccaactgaacaacgtactgtgttacgatggctatctgactcctgttaatcctcacaatcaacatcattgtatcggtgccagctatcagcgagggaaagttgatactcagtattcttccgcagaacaacaagaaaatcgtgatcgtttattgaaatctttacccgatgtcgattgggtgaaacaggtcaatatttcagaagcgaaatcccgtcaaggtatacgatgtgttactcgggatcatatgccgatggttggcaatgtgcctattttcagtgaaattatggccaaatatgccggtttatctcaacggataaacactgatgagacaattgaagaatctccttgttatcctgatttatttgtcattggtgcattgggttcccgtggattatgttctgctccgttgagcgcagaattactcgcagggcagatttttggtgaagctctgccacttgatgatgaaacattggcgaccttgcatccaaaccgattctgggtcagaaaactattacgaggcaaagaagttaaagctggaaagccataa

SEQ ID NO: 3482 - DNA, 534 bp, Xenorhabdus bovienii
  Coding DNA location: Contig name=SeqID_16889; Position on contig =132578..133111bp; Strand=-
atgttttttattcgtccaacacagatattagatgccggagtattaccagcaatagaacgatcagcgggtcagctatttctctcgacacctgaattggcatggattgctaatggcaatgtccacacggaacagcagcatttagattatatttcgcaacagaatagttggattgccctgaatggcgataatcagcctgttggttttattctggcaaaaccgttggatgatggcttacatattatggaactctcggtgcatggggattggcagaagaaaggtataggaaaagcgttgattgataccgttattcaggttgctgaacagcgcggctttcaggctgtcacgttgacaactttgcgtcatataaactggaacgccccattttatcagcgactggggttttttatcttagaacctcggcaaattactggtgctttgtgtcagatcctgcaacgtgaaattgaatatgggtttgcagaaaatcaacgctgtgcgatgaagcgtttggttgttacaacagattatcacgattga

SEQ ID NO: 3483 - DNA, 552 bp, Xenorhabdus bovienii
  Coding DNA location: Contig name=SeqID_16889; Position on contig =133205..133756bp; Strand=-
atgaagcaggcaactcactccgttaatattgggaagggctatgctgtaggtaaagctgcatttttattatctaaacccgttaatttcagccagtcaacagagatagaaagaagagatatgggtgaacaaattgaaaaaagagtagaaaacctggagtcggatgttgcccagttaaaaacggatgtgtcagtgataaaatccaactatgcaacaaaagccgatattgaatctgttaaggtgttagttcataacgatatttcatcggttaagagtattattcataacgagatttcgtcagttaaaaacattattcatcaagaaataacaactgtaaataaagaaatgtccttgatgcgaaaggaaatatcttctatacacaaagatatatcttctatacataaggaaatagcatcagggcataaaaacactgcggctattcataaagaaatatcattgatatataagaaaatggcggatcaaaccaaatggatggtgacaatgatgtttggtttctctgggatcgttattgcagctatgaaatttatgatttga

SEQ ID NO: 3484 - DNA, 294 bp, Xenorhabdus bovienii
  Coding DNA location: Contig name=SeqID_16889; Position on contig =133856..134149bp; Strand=-
atggatgtaagatttagtaaattcgaaaaaagagtggaaaacctggagtcggatgttgcccagttaaaaacggatgtggcagtgataaaatccaactatgcgacgaaggccgatattgaatctgtcaaggcgttagttcataacgagatttcatcggtgcgcaaagaaatgtcatctattcataaggaggtatcgaagatatataagacaatagcggatcaaactaaatggatgatgacgatgatggttggttttagcgggataattattgcggcaatgaagtatatgctttga

SEQ ID NO: 3485 - DNA, 276 bp, Xenorhabdus bovienii
  Coding DNA location: Contig name=SeqID_16889; Position on contig =134723..134998bp; Strand=-
atgctcgcagagtttgaaacacgcattctggcacatatagatgacagggttgaagatgccagtgatgacgaattatttgctggtggatatctccgtgggcatctgacattggctgttgctgagttggaactagaaggtgctaatactattgaacagctccatcagagtgttgaagagagcatccatagggctatcaaggcaggagagctggctccaccagatcaggttttagttttatcgacatggcaaaggctactggatagtgcgaaagactaa

SEQ ID NO: 3486 - DNA, 552 bp, Xenorhabdus bovienii
  Coding DNA location: Contig name=SeqID_16889; Position on contig =135021..135572bp; Strand=-
atgactgtacatcactaccaacaactcattgaaatttttgacaattgctttagcgatgactgtaatacacgtttgataaaaggtgatgatgagccgatttatctgcccgtagatgatcaagttggctacaaccggatagtgtttgcccatggtttttatgccagtggtttgcatgaaatatcgcattggtgcattgcgggtaaagagcgccgcaaacgggtcgattttggttactggtactgccctgatgggcgtgatgctcaaactcagtctgaatttgagcaagtcgaaatcaaaccacaggcgttggaatggttattctgtatggcagcgggttttcctttcaacgtcagttgtgacaatcttgaaggggattgcgagccggatcgttttgcttttcagtgtaaagtccatgcgcaagttatcacataccttgaaaacggaatacccacacgagcagcgcgctttattcaaggactacactcgttctacaatacgcccccactaacagcagaacactttccttgtccggaagatccttttgctaactga

SEQ ID NO: 3487 - DNA, 801 bp, Xenorhabdus bovienii
  Coding DNA location: Contig name=SeqID_16889; Position on contig =135595..136395bp; Strand=-
atggaatggtcattattaagtccggaaatctacggtttcctgtttttggttgcgatagttgctgggtttatcgattctattgcaggagggggtgggttgttgaccattccagccttactgtcagtcggtgtttctcctgttcaggcgctggcgacgaataaacttcaggcggttggtggctccttctccgccagtctttattttattcgccgtggagcagtagattggcgctcccaacgttttgcgatagcgatgactctgtttggggccatgctgggggcattgctggttcaatttgtatccccagattttctgctttatctcttaccggttctggtcattatcattggtctttattttctgctggtgccgaatattggtgctgaagatcggccgcgccgcttggcgcctttggcatttggctgtcttgccggaggcggaattggcttttacgatggggtatttgggccggggacaggctcctttctggcactgtcttatgtgatgctctgtggttacaatctggcgaaagcgacggcacatgcgaaggtgctgaattttgcatccaatatgggttcactgggcttttttattcttggtgggcaggtcttatggctattgggtcttgtgatgctgatggggcaggtgattggtgctcggttaggggcggggttagtactgagccgagggcaaaaactgatccgtccgatgctggtaacgatttcttttttgatgagtatcaaactactccatgatcatcatggagatactatccgctcttggttggcattttatttttga

SEQ ID NO: 3488 - DNA, 120 bp, Xenorhabdus bovienii
  Coding DNA location: Contig name=SeqID_16889; Position on contig =136394..136513bp; Strand=+
atgatttatttcaccagaaaactgcttatcaataatccagatgcttgtatttcagacgttctcttaccgatttaccagcgtggcagtggagagatgacatcagcacattgcgcccgctga

SEQ ID NO: 3489 - DNA, 1086 bp, Xenorhabdus bovienii
  Coding DNA location: Contig name=SeqID_16889; Position on contig =136465..137550bp; Strand=-
atggctggaaatagtattgggcaatttttccgtgttaccacattcggtgaatctcacgggattgcattgggatgtattgtcgatggcgttcctccaggaattgccatcactgaagctgatctgcaaatcgatttggacaggcgacgtccgggaacctctcgttatacgacacagcgccgcgaacctgatcaagtccgtattctttcaggtgtctttgaaggcgtaacaacgggcaccagcattggcctaatgattgaaaacaccgatcagcgctcacaggattacagtgcgattaaagatgttttccgtccgggacatgctgattatacctacgaacagaaatatgggctgcgcgattatcgtggtggcgggcgttcttctgcccgtgaaacagcgatgcgcgttgcggctggcgcaattgccaaaaaatatctgctcgaaaaacacggtatccgcattcgtgcttgcctgactcagatgggggatattcattgcgaattgaaagattgggatctcgttgaacagaatccttttttctgccctgatgaaagtaaattgacccagcttgatgaattattgcgaaccctgaaaaaagaaggtgactctattggtgccaaagtgacccttgttgccgagaatgtgcctgtcgggttgggtgagcctatttttgaccgtctggatgcagacatcgcccacgccttgatgagcattaatgcagtgaaaggcgttgaaatcggtgacggtttcggtgttgttaacttgcgcggtagtgaaaaccgagacgaaattacctcccagggattcaccagtaatcatgctggcggcattctgggtgggatcagtagcagccagccgattatcgctcatatcgctctgaaaccgacgtctagtattatggtgtctggcaaaaccattaaccgccaaggtgaagaagtcgatatggtgacccgtggtcgccacgatccctgcgtagggatacgtgccgtaccgattgcagaagcgatgatggcgattgtactgatggatcacttactgcgtcagcgggcgcaatgtgctgatgtcatctctccactgccacgctggtaa

SEQ ID NO: 3490 - DNA, 978 bp, Xenorhabdus bovienii
  Coding DNA location: Contig name=SeqID_16889; Position on contig =137701..138678bp; Strand=-
atggcaaaatacgcgctaatacatttttgtggcttggagatgcttgtggataaaatttttgtggatgaggcagtcgcggagctgcataccattctggatatgctgcgctggtcagccagccgttttaatgctgccaatatctattacggtcatggaacagacaattcgtgggatgaggctttgcagttggttctgccaacattgcacctgcctctggacgttcctgaatccatgatggcagctcgtctgacctctaccgagcgccatcgtatcgtagaacgtgttctgcgtcgtattaatgaacgtattccggttgcctacctgactaaccgggcctggttctgcggccatgaattttatgttgatgaacgcgtgctggttcctcgttcaccgattggtgaattagttaacaaccaatttgcaggattgcttccacaggagccatctaccattttggatctgtgtaccggaagtggctgtatcgcgattgcctgcgcacatgaattccctgaagccgaagttgatgccgttgacgtttcaggcgatgcgttggcagtgactgaacagaatattgaaaatcatgggcttttgaatcgcgttattcctatcctgtctgatttattccgtgatatgccaccgatgaaatacgatctgattgtcactaatcctccttatgtggacgaagaagacatgaacgatctgccggatgaattcctccgtgaacctgaattgggactggctgcgggagttgatgggttgacactggctcgtcgtattctcgcgaatgcgccggatttcctgaccgaagaaggggtgctgatctgtgaagtgggtaacagcatggtgcatctaattgatcaatatcttggcgtgccatttacatggctggaattcgaaaacggtggcgatggtgtctttatgctgacacgcgagcaattaatcgaacatcacgaatattttcgcctgttcaaagattaa

SEQ ID NO: 3491 - DNA, 189 bp, Xenorhabdus bovienii
  Coding DNA location: Contig name=SeqID_16889; Position on contig =138754..138942bp; Strand=+
atgttacagccagtttgtacacaaagagtacgcaaaaaagtaaatagaatggcctactgggagagtctaataaagtgcaatttttttctggagagggtaagagaaccaccctgtattcacagggtggtatgtttgggcgttatctcgtttttttcacccacaactttttcacccacaagaaataactaa

SEQ ID NO: 3492 - DNA, 1374 bp, Xenorhabdus bovienii
  Coding DNA location: Contig name=SeqID_16889; Position on contig =138893..140266bp; Strand=-
atgcaaaacacttcacaactcaagcggggcttgagcgttcgccacattcggtttatggcgctggggtcggcaatcgggactgggcttttctatggttcagcggaagccatcaaagcagcggggcctgcggtattattggcatatgccattggtggggcggccgttttcatggtcatgcgggcattgggggaaatggcagttcatcaccctgtggccggttctttctctcattatgccagccactacttagggccattggcaggatttctgaccggatggacttacgtatttgaaatgctggttgtctgtcttgctgatatcaccgcgtttggtctctatatgaaactctggtttccgcatgttgaccaatggatttgggtactcagcatcgtctttttcattggggcgataaatctgtgcaacgtcaaagtctttggagaaatggagttctggctttccatcattaaagtcaccgcaattgttgccatgattgtcggtggctttgtgatcatgatgtatggtttcggccaggaagcgggtcatgtcactggcctgtcaaacttgtgggaacatggcggattcatgccaaatggcatcgcgggagtgattgcttcgtttacggtggtcatgtttgcattcggtggtatcgaggttatcggtattacagccagtgaagcgaaaaatccagaaaaatccattccccaggcaatcaacgctgttccattccgtattttgctgttttatgtactcactctgtttgtcctgatgtgtatctatccgtggaatcaaattggccaaaatggtagcccatttgtccagatattctccagtctggggatcgattctgcggctaatattctgaatgttgtcgtaattactgcggcgatttcagcgatcaacagtgatatcttcggctcaggacggatgatgtatggcatggcacaagagaaacaagcgccctcagccttcacgaaattaaccaaaaacggcgtaccgtgggttactgtgctggtgatgtcgtgtgtactgctaatcggtgtcgttctgaattacctgttgcctgaaaaagtgtttggcattattgcttccatcgcgacatttgcaacggtgtgggtatggctgatgattttgttgtcacaatatatcatgcgccgaaaaatgccggcggaagaggtcaaaaagctaaaattccccgttcccctttggcctacagcacctattctgacgatttcattcatggcatttattatcgtcgtgttgggatatttccccagtacccgtatcgcactgtacgtcgggatagcatggatagcattactcacccttagttatttcttgtgggtgaaaaagttgtgggtgaaaaaaacgagataa

SEQ ID NO: 3493 - DNA, 1533 bp, Xenorhabdus bovienii
  Coding DNA location: Contig name=SeqID_16889; Position on contig =140357..141889bp; Strand=-
atgaaacacattactattcatcccggaaaaatgacgttcgaagagttacgccacatttatcagcatccggttcaaattaccttggatgagcagtgttttcctgccattgaacgcagcgttgattgtgttaaccgtattatcaatgaaaacagaaccgcctatggtatcaacacgggttttggcctgctggcgagtactcggattgccgagcgggatttagaagaactgcaacgttccctcgtgttgtcacatgctgctggtgtcggtgagcctttgccggatgagattgtccggctgatgatggtattaaaaatcaatagtcttgcccgtggttattccggtattcgtttagacgtcattcaaacgttgattactctggttaatgcagaagtttatccctgtattccgagcaaaggttctgtgggcgcttcgggagatttggctccactggcgcatatgagcctgttattgctgggcgagagtaaagcgcgttaccgtggtgaatggctgccagccaaagaagccttggaaaaggcaaatcttaagccgattcggttggcggcaaaagaaggtctggcgttgcttaatggcacacaaacctctaccgcctttgccttgaaaggactctttgcagcagaagacttacttgcctcggctgttgtttgtggcgcgatgtccgttgaagcggcactgggttctcgtaaaccatttgatgcgcgcatccatgaagcgcgaggtcagcaggggcaaatcgacgtagctgccttgtatcgtctggtattggaagaacaaagtggtctctctgaatcccataaaaactgtccgaaagttcaagacccttattcattgcgttgccagccacaagtgatgggcgcttgtctgactcagatccgtcatgctgccgacgtgattataactgaagccaatgcggtctctgataatccgttggtctttaccgaccaagatgaagtgatctctggcggtaacttccatgctgaacctgttgctatggcatcggataatctggctattgcactggcggaaatgggtgcactgtcagaacgccgcatctctttgctgatggatagcaacatgtcccagttaccgccgttcctcgtcaataacagcggggtgaattctggctttatgattgctcaggtgacagcggcagcgttggcgagtgaaaataaagcattggcgcatccttccagcgttgacagcttgccgacatcagcgaatcaggaagaccatgtatctatggctccggcggcaggtcgtcgtttatgggaaatggctgacaacgtgcggggtattttagcgattgagtggctgactgcctgtcagggcatggatttccgtgacggattgaagagcagcccgatactggaaaaagcccgtcatatcctccgtgataaagtcgcttattacgataaagatcgcttttttgcgccagacattgacgcggctatccaactgttgattgcacaacaactttcagcactgctgcctaccggaaagatattgagaaattaa

SEQ ID NO: 3494 - DNA, 1842 bp, Xenorhabdus bovienii
  Coding DNA location: Contig name=SeqID_16889; Position on contig =141904..143745bp; Strand=-
ttgatatttagtataaaagacaccaccctccaaattattgactttatctgtgtcacattttttcctattgaatctacatgtatatacaactatacaattaacaaactttataaagatgaaaaggaaaaaaccgtgacgatgcaaaataataaattcagcaacgaggtcatccgtgcccccagaggaacgcaactcacagcaaaaagttggttaacggaagccccgctccgcatgctcatgaataatctcgatcctgatgtggctgaaaatcctcatgaactggtcgtttatggagggataggccgtgccgccagaaattgggaatgttatgaaaaaatcgtggaaaccctgaaaaatctggaaaatgacgaaacattactggtgcagtcaggcaagccagtaggggtttttaaaacccatgaaaacgccccgcgtgtattgattgcaaactcgaatctggttccacattgggcaacgtgggaacattttaatgaactggatgctaaagggctggcaatgtacggccagatgacggcaggtagttggatttacattggcagtcaaggcattgtgcaaggcacttacgaaacgttcgttgaagcgggacgccagcattttaacggtaatttgaccgggcgctgggtactgactgcgggtttgggagggatgggaggagcacagccgctggcagcaacgttggcaggcgtttcgtcactgactattgagtgccagcaaagtcgcattgattttcgtctgcgtacccaatacgtcgatgaacaggcagccgatctggatgatgcgttggcgcgcattaagcgatatacccaagaaggtaaggcagtatcggtggcattgtgtggcaatgcggcagaaattgtccctgagttggtacgtcgtggcgttcgtcctgatatggtgacggatcaaactagcgcacatgatccactgcatggctacttgccggcaggctggacatgggaagaatattgtcgccgtgccgagactgagccagaagtcgtgattcaggccgcgaaagcatcgatggcagtacacgtggaagcgatgctggccttccagaaacagggtgttcctactttcgattatggcaacaatatccgccagatggcgaaagaaatgggtgttgaacacgcctttgatttcccgggttttgttcctgcttatattcgtcctctgttttgtcggggaatcgggcctttccgttgggctgcgctttccggtgatcctgaagacatttacaaaactgatgccaaagtcaaagaattgctgccggatgacgcaaacctgcatcgctggctgaatatggcgcgggaacgcatcagcttccagggtttacctgctcgtatttgttgggttggcttgggagatcgtgccaaattgggattggcattcaatgagatggtacgcagcggcgaactttcagcaccgctcgtgattggacgtgaccatttggattccggctccgtggcgagtcccaaccgtgaaaccgaatccatgaaggacggttctgatgcagtttcagattggccattgctgaatgccctattaaatacggccagtggtgcgacatgggtttccctgcatcatgggggcggcgttggtatggggttctcacagcattccggtatggtgattgtctgtgatggcacggatgaagccgcagaacgtattgcccgtgtgctgcacaatgatcctgcaactggcgtcatgcgtcatgctgatgcaggttatgaacaggccattcagtgtgccaaagagaagaacctgaacctgccgatgcttgatacaaaatcatcagacacaaaaaccgtcgaaacaaaataa

SEQ ID NO: 3495 - DNA, 96 bp, Xenorhabdus bovienii
  Coding DNA location: Contig name=SeqID_16889; Position on contig =143814..143909bp; Strand=+
atgggatttacattatggtcacaattgtttgtgaaaaaatctccctatactaaaaacaaagggagatttttttatgtaacgatgggcaaatcatga

SEQ ID NO: 3496 - DNA, 732 bp, Xenorhabdus bovienii
  Coding DNA location: Contig name=SeqID_16889; Position on contig =143904..144635bp; Strand=-
gtgacagttgatttatcagatacatttgtcaaacctgtgcctttgtatgcaaaagttaagcaggcgattattgaaaaaatatatacaggagaatggaaaccccatgatcgggttccttcagaatctgaattggtcaaacagtttagctgtagccgcatgacggcaaacagggcgttgcgggagttgatggcagaaggttttctatttcgtttgcaaggagtgggatcatttgtttcagaacccaaagggcagtccgctctgtttgaaattcacagtattgccggtgagattgcggcacgttctaaccagcatagttgtaaagtactgaaacttgctgaagtgaatgccaatataacacaggcggcagaactggggattgtggcgggtacggcaatctaccattcgattattgtgcactatgaaaatgatgtccccgtgcagattgaaaatcgttatgtcaacgctcaggctgtgccggcgtatctgcaacaggatttcaatcagcaaactacccacgattacttatcaatggtggctcccctgacggaaggggagcatattgttgaagcggttgcgggagatgtccgttcttgtcggttgctgcaaattgaggcagatacgccttgtcttctcatcagccgccgaacatggtcgaaagaacatattgtctcaagtgctaaattattatttcctggacatcgatataaattgaaagggcatttcagctcatga

SEQ ID NO: 3497 - DNA, 1071 bp, Xenorhabdus bovienii
  Coding DNA location: Contig name=SeqID_16889; Position on contig =144656..145726bp; Strand=-
atgccgaaaatccggtggatatcttatatgaacttggacgtaatccattggttcatcgtatctatcgtggtgaaattacacataattttcaataatggtgagagaaacaacatgaaattatggcacccgacatcagaaaacatttggcaagggcgtaatgatctcgcagaagcggataatgccctgcgtgtgttccagacaataaaacaacctgccaatttttccccggaagaatttcctcaccatattgcgttattgggatttgagtgtgacgaaggcgttaaactcaatcatggtcggccgggagcgaaattagggccggaatatctgcgtcagtcattggcaaatatggccagttatgatggtcatgagcagctggtggatttgggaaatattcgcgctgatactgagaaattggctgaagcacagaacgcgctgagtgatgctgtctatgagtgccagcatcagaacatgcgaacactcatttttggcggtgggcatgaaacggcatttgctcatggaatgggaatttatcgcgcgtttccgacacaacgcgtaggtatcattaattttgatgcgcatctggatctgcgcaattcgccgcagcctacatcaggaacccctttccggcagcttgccgattattgccagcagcatcagcgtccgttcaattacacttgtattggagccagtttggcatcaaatactcaggctttgttggacgaagccaatcatcttgatgtcactattatttgggatactcaatgtattgagtcgatgctggacaaagtacaggaacaaattcaagatgtgattaatcaagttgatataatttatatgaccatcgatttggatgtactgccaatctggcaaatgccgtcggtttctgctcctgctgctctgggagtgccgttagagcgtttgttgccgttaattcaactcatctgccaaagcaaaaaattacaggctgtcgatttggttgagcttaatcctttgtatgacattcaaggaatgggaggcaaagcggcggctcgccttgcgtggcaattggtgcattggtggaatgggtag

SEQ ID NO: 3498 - DNA, 1254 bp, Xenorhabdus bovienii
  Coding DNA location: Contig name=SeqID_16889; Position on contig =145632..146885bp; Strand=-
atgtctattgagctgaaagatactgacgttatttggcgtaatgccagacttgccacaatgaaccctacaatcaacaacattgatggcaaacatcattatggcatgctggagcagcatgatctgatcgttcggggtgaaaaaatattggcgattgttccgacggatagcgtgccaactcaccattgccacattattgatgtggaacagcggttgatcacccccggattaattgattgtcatactcatttgatttttggtggcaatcgggcatcggagtgggagcagcgtctcaatggcgcttcttatgaggagatcagtgccaaaggaggaggaattaattctacggttaatgcgacccgaaacaattctgcgcaacaattggaagtggctgcccagaagcgactcaatgctctgatcgctgaagggataacgacgattgagatgaaatcaggctatgggctggatctggtaaatgaagaaaaacagttgaatgtcgttcaggcactggcgcagaaaaatgccatcgaaatcagccccacattactctctgctcatgccgttccacctgaatataaacacaaccctgatgcttatatcgatttaatttgtgattccattcttcctacactgtggcaaaaacaattatttgaatccgtggatgttttttgtgaaaccgtcggtttcagtcttgaccaaactaagtgcgtttttgatgcggcacaacgcctgaatattcctgtaaaaggccatgttgagcaattgtccaacatgggaggcagtgaattggttgctgattatcaaggctggtcggttgatcacattgaatatctggatgaaaaaggtattgaagccattagccgcagcggtagtgtggccgtgttactgcccggcgcattttacttcctgaaagagaaaaaactccctcctatttcgctgttgcgtcaataccgagtgccgatggcaatatcaacggatttcaatccgggtaccagtccttttgcttctttgcgtctgattatgaatatggcctgtgtgcaatttgggtttacgccagaagaagcatggcagggtgtaactcttcatgccgcccgtgcattggggagagctgaaagccacggccaattagcggaaggttatatggccgattttattgtctgggatgccgaaaatccggtggatatcttatatgaacttggacgtaatccattggttcatcgtatctatcgtggtgaaattacacataattttcaataa

SEQ ID NO: 3499 - DNA, 264 bp, Xenorhabdus bovienii
  Coding DNA location: Contig name=SeqID_16889; Position on contig =146793..147056bp; Strand=+
atgtttgccatcaatgttgttgattgtagggttcattgtggcaagtctggcattacgccaaataacgtcagtatctttcagctcaatagacattgtatcgtcctgttatttttcttgttggtatcaaccttcatgttgtatatacatttattttataaccagccaagattgtcaaatcattttatggacacggatgaatatcatgaattttctagagactatccgtcacgatgcgaatatattgcaatttacacaatcacctaa

SEQ ID NO: 3500 - DNA, 141 bp, Xenorhabdus bovienii
  Coding DNA location: Contig name=SeqID_16889; Position on contig =146995..147135bp; Strand=+
atgaattttctagagactatccgtcacgatgcgaatatattgcaatttacacaatcacctaaatatacatatcaattctatgcgatagcttctaagcaaaatcacaaaaaatcgggtacaattaccaaaatttgtcagtga

SEQ ID NO: 3501 - DNA, 525 bp, Xenorhabdus bovienii
  Coding DNA location: Contig name=SeqID_16889; Position on contig =147165..147689bp; Strand=+
atgagtgaagaagatatcagtctatttcgaacgtctgtcacgggagcccgccgcatcgttcaagacaccgttttacactcccctcaaagaaaaaaaatcagctatgttgcacctgcacgtatgatgcaagaacaagtcgatgccagttactatttttccgatgagttccaacccaatttggatatggaaggcccaacccgctatattcgagaaggtgcaaatcattatgaattgaagaagctgcgtcgtggtgattattcccctgagctttttctggacttacatggattaacccaactacaggccaaacaagaaattggcgctctgattgcagcctgccgtcgtgaacacatttattgcgcctgcgtcatgcatggccacggtaaacatattcttaaacagcaagctcctttatggcttgcccaacaccctgatattattgccttccatcaagcccccaaagagtggggaggtaacgctgcattgctcattttgatagaaatgaatgaacttatgcagcgttaa

SEQ ID NO: 3502 - DNA, 483 bp, Xenorhabdus bovienii
  Coding DNA location: Contig name=SeqID_16889; Position on contig =147708..148190bp; Strand=-
atgtacgtttttattatgcgccacggtgatgctgccttacattcgatcagtgatgcaacacgggagctgactcctcgtgggcagcaagaatcacaggaaatggcctgctggcttacgcaacaagagcctgatgttgattgtatcttagtcagcccttatatccgggcaaagcagactttaaaggtggttcgtgaaaacttagcgttgcctggcaatgaggaagaactggctgagttaaagccgtcgggagatgtcgcattggtggcgagctacttgcaggttttggcaacgcaagagtacaacgctgtattggtggtttctcatttacccttagtaggttatttagtttctgagctttgccctgagcaaactccgcctatgtttgctacctccagtattgcctgtgtggaattagatcctcaaacagagaaaggccgcctgttatggcaaacctctccggcgcagttagcagcgaaagactaa

SEQ ID NO: 3503 - DNA, 2178 bp, Xenorhabdus bovienii
  Coding DNA location: Contig name=SeqID_16889; Position on contig =148532..150709bp; Strand=-
atggctcagggcgaaaaagaaaccatgatgtcagagacacaaccgaagcaatcggtattcagcttttcggtcagagatgacaaggttggcgtgattaccattgatgtaccaggcgaaaaagtaaacacactgaaagcggaatttgttgagcaatttctgactgtctttgagaaggcacaacaggcctctggcttgaaagggttggtgatcgtgtctggtaagccggatacttttatcgctggtgctgacatcacgatgatagcaggctgccaaaccgaagaagatgcgatggaactggctgaaaaaggtcagaggctatttgctcaaattgccaattatcgtttacctgtagttgccgccattcacggtgcgtgtttggggggagggctggaactggctttggcctgtcatgcgcgtgtctgttctctggatgataaaactcgtcttggtttgccggaagttcagcttggattactgccgggctctggaggaactcagcgattgcctcgcctgataggcgtcagtgcagccctggatatcatattgactggccgacagctcaaggctaagcaggcacagcgtctgggtgtggtggatgatgccgttcctttggatattttgctggatgttgctgttcagtatgtcaagaaaggcatctccaagcgtaagccattggcatggtctcagcgtattttggcgagcactctgggcaggccattgttgttccatatggttcatcaaaaaacgcgtgcgaaaacccatggccactatcctgcaccagagcgtattattaatgtcgttcgcaccggattggaaaaggggcttaaaaaaggctttcaggcagaagccaaggcgtttggtgaactggcaatgtcaccggaatcggaagccttgcgcagcttattttttgcctcaacgtcgctaaaaaatgaaaccggctcgtcggaacagcctgccgagatcaagtatgtgggggttttgggcggcggcttgatgggcggcggtattgccaacgttaccatgacacgcggtaacttgcctgttcgtatcaaagacattaatcagaaaggtatcaatcaggctctgaaatatatctgggatattctttccaggcgggtaaaacaacgtcgtttgaaatcaagcgagcgttctcgccagatggccttgatttcgggaaccactgattacagtggcttcagacaggctgatattgtggttgaagctgtatttgaagatttggcgctgaaacgaaaaatggttgcagaagttgaagaacattcgaaacctgaaacaatttttgcttcgaatacttcatcgttgccaatttgccagatcgctgaaatagcctctcgaccagagcaagtgattggcctccactatttcagtcccgttgataaaatgccattggtggaagttattccacatgcgggaacaagtgaaaaaacgattgcaaccgcagtcgcactagccaaaaaacagggaaaaacggctattgtcgtgggtgataaagccgggttctatgttaaccggattttgtccccttacattaatgaagcgggttattgtctggcggaaggtgaaccgatcgatcatatcgataaggcactggtagattttggtttcccgattgggccaattaatttgctggatgaagtcggcattgatgttggtacaaaaattattcctattctggtggcacaattggggagcagatttaccgcaccaggcttcttggatgcagtattaaaagataaccgaaaaggtaaaaagaatggctgtggtttctattcgtatggcgctaaaaagagcaaattctggccttttggcaacaaaaccaaagaggtggatgcctcgatttattccctgttgaaaattaagccacatgcaaaaatgcaaccatcagacattgctcagcgttgcatgatgctcatgttgaatgaagctgttcgctgtttagatgaaggtattatcagaagcccccgtgatggtgatattggtgcggtatttggcattggtttcccgccattcttgggaggtccattccgttatattgataggcttggcagcgataaggttgtggcaattttacgtcgtctggaacagcagcacggagagagatttacgccttgtgaatatttagttcagatggctgaacagaaaaagaaattctacaaataa

SEQ ID NO: 3504 - DNA, 1311 bp, Xenorhabdus bovienii
  Coding DNA location: Contig name=SeqID_16889; Position on contig =150709..152019bp; Strand=-
atgggtcgttcttcaacaaaagtggcacagcaaaaggagcgtgttgctattgtcagtgggttgcgccttccttttgcgaaacaggcaacgagttaccatggtatcccagctgtcgatttgggaaaagccgttgtcagtgaactggtcatcagaagcggattgtcgccagagaagatcgaccaactggtgtttgggcaagtcgttcaaatgccggaagcaccgaatattgcaagggaaatcgtattaggcgcaggattaagcgtcagcactgatgcttatagtgtttctcgtgcctgtgcaacaagctttcaggcgattgcgaatgtggctgaaagtattatggctggcacagtgaatgtaggcattgccggcggcgctgattcctcatctgtattaccgattggggtaacaaaatcactggctcgcactttggtcgatatgaacaaagccaagagtttgtcacagcgcttaaaattaatcagtcgattgaaattgcgggatttactgccagtatctcctgcggttgctgaatattccaccggattgaggatgggcgatacggcggaacaaatggctaaaacctatcatatcagccgcgaagagcaggatgagttggcacaccgttcccatatactggcagccaaagcttggcagcagggttgtttgaatgaggaagtggtagcggcacattttccgccataccgcgacacattgacagaagataataacatccgaaaaaattcagttctcacatcttactccaaattgcggccagcctttgatcgtaagtacggaaccgtaaccgcggcgaatagtactccgttgactgatggtgccgccgcagtcatgttaatgcgcgaatcggtcgccaaagagcttggtatgaccccgctgggttatttgcgtagttatgcgttttctgcgattgatgtctggcaagatatgctgttggggccatcttatgcgacgccgattgcgttggagcgggcgggtatcaccttgaatgaactctcactcattgatatgcacgaagcgtttgccgctcaaacactggcgaacttgaaaatgtttgccagtgaaaagtttgcgcgtgaaaaactggggcgctctcaggcaatgggtgacgtagatatggataaattcaacgtattaggtggttcaatagcttatggtcatccatttgccgcgacaggtgccagaatggtcacccagacattgaacgaattgcgtcgtcgtggtggcgggtttgggctggcgacagcctgtgccgcaggtggattgggcgtagcgatggtattggaggtagaataa

SEQ ID NO: 3505 - DNA, 297 bp, Xenorhabdus bovienii
  Coding DNA location: Contig name=SeqID_16889; Position on contig =152203..152499bp; Strand=-
atgcctgatacaattaaacgttgtaatgtggaagaaacagccacctgctgttgcgttgatgtcggtaccgtcattgacaatgaagactgcaccgcctcttaccagcgtgtttttgccaatggacaggaagcggaaatgatgcttaatacattgactgtaaaggcaaaatcagtggagtcagagccatgcgtaataagccataaaatcgaagcagttgacgatggggcgcaactgactatagattttacgtttagctgtcaggctgaggccctgatttttcaattaggattacgttaa

SEQ ID NO: 3506 - DNA, 1323 bp, Xenorhabdus bovienii
  Coding DNA location: Contig name=SeqID_16889; Position on contig =152851..154173bp; Strand=+
atgagccaaaaaaacctgtttacgcgttcagcattagcagtggcggttgcagtcatttcatccaacgctagtgctgccggttttcaattaaatgagtattccacatcaggacttggtcgggctttttctggagcaggtgtcgttgcagataacgcgtctgagggtagtcgtaaccccgcagccatgaccctatttgatcgcccatcattttccagcggcttggtttatgtaaagccgaacgttgatatcacgggtagatctccagttcctcaactaggcactggcgttaaaaacagcactgatgctaaaaatattgccccacatgcatggataccaaacttacattttattacaccgatcaatgatcagtggttcctgggtgcatcagcgacgtccaactttggattggcaactgaattcagtaataactatgctgctggcttggttggaggcaaaacctcacttaaaaccgttaacctgaacctgagcggtgcatataaatttaatgatcaatttagctttggtttgggtgtcaatgccgtctatgcggatgctactattgttcgtcacatgggtgaagttggtccttataacccacgagcacctattccagcaacctatgaagcttcccgtttagaaggcaaagattggggctatggctggaatgcaggcattctgtatcagtatgatgagaataaccgttatagcctgacttaccgttcaaaagtcaaagtgaagtttaaagatggcgatttcagtaacgacttaccagagtttttacccaatggcactggcggcaatacaattaagggtacgctggatctgaatttacctgatatgtgggaagtctccggctataaccgtgtcgcacctcaatgggctattcactacagcttcctctatactggctggagtgaattcaaggagctgagaggcaagaataaaggcaacggtaacacgctgttccacaaagatgaaaacttccgtaatgcctaccgcgtctccctgggtacaacttactactatgatgacaactggacattccgtactggtatcgccttcgatcaaagccctgtgcccgcccaaaaccgttctatctctattccagatcaggatcgtttctggttaagtttgggaagcacttacacattcaataaagatgcctctgtggatgtcggtgtttcctacatgcgtggaaagaaagtacgtgttagcgaaaaattaccagaagatgttcaaagaggaccttttagtcaaccctatgagttcgattccaaaggaactgcatggttgtacggtgtgaactttaactacacgttctaa

SEQ ID NO: 3507 - DNA, 783 bp, Xenorhabdus bovienii
  Coding DNA location: Contig name=SeqID_16889; Position on contig =154236..155018bp; Strand=-
atgtctaaaagtgattacgtggagaacaacatgaagtatcgtctgagcggggtggctcttacagcagtattattggtggggtgtgctagttcatcgaattcggtggaacaagggcgttctgacccgctggagggcttcaaccgtgccatgttcaactttaattatgatgttctcgatccttatcttctgagacccgttgctgtagcttggcgtgattatgtaccgatgccagcacgaaatggcattggtaacttcgtgagtaaccttgaagagccagccagtatggtcaacagtattctgcgcggtgatatccatgatggcgcgaagcatttcaaccgattttttttgaatacccttctgggaatgggcgggttgattgatgtcgcttcaatggcgaatccgaagctggcaaaggaagatccaatgcgttttggtagtacgctggggtattacaatgttggttatggcccttatgttgttttgcctggttatggcaatttcactctgcgtgacgaaggagggaatgtcgcggatatgacttaccccgtattgagctatctcacaccttggatgtccgtaggaaaatgggtatttgaaggtattgaaacccgcgcacgtttgctggattccgatggcctattgaaaaactcttccgatccatatttgatgatgcgtgaagcgtacttccagcgtcatgattttatggtcaatggaggcaagctctcgccagaacaaaaccctaatgcaacggtgattcaggacgaattggattccattgattaa

SEQ ID NO: 3508 - DNA, 186 bp, Xenorhabdus bovienii
  Coding DNA location: Contig name=SeqID_16889; Position on contig =155386..155571bp; Strand=+
atgagatatcgaccgctacgactacctgaaagagaagcgggggattgtggagaggtgggaaggaaggctgttgtcactttgatcgaacttcggttgacaaaacagtgtcaaccaaatttaccaaatacagtcatttcgtcaaccagcttcctccgctggaggattcagaaaaaatcaaaaggttaa

SEQ ID NO: 3509 - DNA, 243 bp, Xenorhabdus bovienii
  Coding DNA location: Contig name=SeqID_16889; Position on contig =155796..156038bp; Strand=-
atgcgctgttttcaccgcttttggtgttgctgcactagtttcgttattactgtcagcatcattactcaggatcacaaatcctttatcttgcaatgttgcattggggtgattgcggctttgggcatgttcttcaatagattcttttacataattacgactgggtaccacgaaaagatcacagtcacaagggcatggtgtatcaggattattattttgaatactcatatttactccctcatttaa

SEQ ID NO: 3510 - DNA, 354 bp, Xenorhabdus bovienii; identical to SEQ ID NO: 1124
  Coding DNA location: Contig name=SeqID_16889; Position on contig =156055..156408bp; Strand=-

SEQ ID NO: 3511 - DNA, 477 bp, Xenorhabdus bovienii; identical to SEQ ID NO: 1065
  Coding DNA location: Contig name=SeqID_16889; Position on contig =156345..156821bp; Strand=-

SEQ ID NO: 3512 - DNA, 354 bp, Xenorhabdus bovienii; identical to SEQ ID NO: 1741
  Coding DNA location: Contig name=SeqID_16889; Position on contig =156961..157314bp; Strand=-

SEQ ID NO: 3513 - DNA, 492 bp, Xenorhabdus bovienii; identical to SEQ ID NO: 1438
  Coding DNA location: Contig name=SeqID_16889; Position on contig =157251..157742bp; Strand=-

SEQ ID NO: 3514 - DNA, 492 bp, Xenorhabdus bovienii
  Coding DNA location: Contig name=SeqID_16889; Position on contig =157859..158350bp; Strand=+
gtgagcaattcaactttacctgtcggagtccccgttccttggccagcagaaaccccaccagaaggctggttgatatgtaacggtgactcatttgataaagcaacatatccgaaactggctcttgcctatccctctggaaacctacctgatttgagaggggaatttattcgcggttgggataatgggcgaggagcggacgttggtcgatctctactttctaatcaagtggcagatattgctccacatagtcacaggattggccgcatgtggtccagctcaaacggtggagtcgagggtttgggtacagggaaccgcattttcaatagtgtccaccaagacattaactacggaattgatcctcgcggactaggcattgctataggaatgggatctggtggtgtcggttatatggataatgcagttgctgcttcaacgggaacagaaacacgtccccgcaacatagcatttaactacatagtgaaagcagattaa

SEQ ID NO: 3515 - DNA, 180 bp, Xenorhabdus bovienii
  Coding DNA location: Contig name=SeqID_16889; Position on contig =158347..158526bp; Strand=-
ttgggtggattggggggcggatgttggggtcggtgtgaggctggggatggtagaagaatgaagccagtcttaacccgcggaaagttacgggttaaggattattcgtccgaccattccatcgctgggattagaatattttctaggtatagcgcggtcttccttgcctgtggaatcaattaa

SEQ ID NO: 3516 - DNA, 2946 bp, Xenorhabdus bovienii
  Coding DNA location: Contig name=SeqID_16889; Position on contig =158551..161496bp; Strand=-
atggtgtcgtttacggtgggattggatggaaagatccccttacccggttacattatcggtgtggcggatgaaatgttttccggtcgtgtactgggtggacgtatcagtgcggtggatgggcgtaacattacattagacagggtatcgtctgcgaaggtcggtgagcggttaattctgaacctgccttctggtaaagcggaagggcgaactatccaagccgtcaatgggcagatagttactgtcaccacggaatactcagaaatccccgccactgaaaatgtctgggcgattgatgccacggatttggctgtccagcaattcagggtcacggggattaaagagggtgaggacggggtgtcattcgatatcaccgccgttgagcataaccccgataagtatgaccatatcgacactggcacccgaatagacgagcgccccatttctgtcattccgcccggcgttcaactgccaccgaaaaatgtcggtatcagcagttattccgtggtgaatcaggggattgccgtcacgacattgagagtcacctggaatgcagccgagagtgcgattgcgtatgaagctgaatggcggcgtgataacggcaactggatatctgcaccccgaacctctacacagggctttgaaattcccaatatctacgctggccgctatcaggcgcgggtgagagccattaatgccgctgagatacccagtctctgggcaaacgcccctgaaactcatctgaaagggaaagagggcaaccctccggcaccgttgggcttcaaggccaccccgatcatcttcggtatccagctagattgggggtttgcgccccagacggacgacacgttaaaaactgaaatccagtacagcaagacgaatgacagtgaagggttaatgttactggccgatatcccctatccccagcgaacgcacacaatgcagggactggcggcaggcgttgccttctatttccgtgcgcggctggtggacaagtccggtaatcagtccccgtggacggcattcattcgtggggagtcttcttcggatacgaactggatcatcgatgcggcaggtaaggaatttctttccaacaaagcaggccagcggttgcaggagcagatggactttaactccgaagccatcatggagaacgccgcggtggaaggggcaattgttcagcgacagttgaaagtgaatggtgatcttaaagcagatatattgcacgttcagaccacgcaggttacggaccgagaagcctttgccgaggatatgaagaaagtacaggccgatgtgggggagaatgcggcagcggtgcagacgaaggccacggcggtctttgatattaaaggagatggggctgctctctatgacgtgggtgtcggattaaagtacaaagaccagttccataaagccgggatggtgatgggatctgaggtgaagaacggacaggtcactattgtccggggaacgggcactaaatggaaaagtaatattaacggcattaccgccggccagattatctccattcaatccggtaatacggtgattcagaatgtcatccagtcggtgaattcagacacggaactggtgctggcctttgcgccctcagtcagtcttaacaatgcaaaatatgtcatctcaaccaccgttcccgataccgtttccgatggcgtccggcatatgtgtgccattaacgccgctatcatcctgttcctgcaaaacatggaccgatggatgagtgaaaacggcaaggttgacgtggagatgccgaacggccagaaagtcacgctggactccatccgggcattgcaggctgcggtggagggaaaactggataaattccagaacgcggcggatatccagaataaatcagagtttgtgaaaaacctgggtttatcgggagtaatgaaaattggggattatggctttggtggtggaggccgaattatacaaaaagattctactcagctccttagttggctcagggatgagtatgtcagtgagatataccgaaatgacagcgcatgcgcatacacctatcgatttggttccaacctgaaaataagagcctacgatacatggggcaatatttctattgattatagtggtagtggtgtcaggtttgcgggtggcaatggatatcaagaccatctttatgatgttgtcacaggaaaagattcgaatgttgtgcacccagaccctggagtgggaaaaagagggaaaagcttaaacaatctgccaaataaccaaatatattttgtttattcagacggggttgacggcagctcaggcgtggctggaacaatggttcagtttgctatggatcatgtaaattcgtatccattccagatcatgacagcgtactgggacggacaattacgatatcgcgccaagaatggggataacggtaattggatgaactggcgagtcgcgtgggataatcgcaacgccgtctttgacggcaacggttttctcaagaaaacctcgtctattatccaactccaccccgatggcacctttaccactaacgacgaatccgaaggtgccactgtgaccaaactcggccttggtcactacagaatatccggcatccttggctataacgctgacggtgcatggggtgttcatggcggtatcagtgttccccgtgacgtcaatggtaatgagttagtgtatgtcgaggataaagtgctgccggatggggctattgaaatcaaggtgacgcaccgacagaacgcgcatatgcctgcccgattgcagaaccgacgcatcaagtcacaggatgagcagacgcattacacggttgatgaaccctgtgatttacccgccggcacccggttagacgcccgtgtccagatgccggaggattctatctggaatcagaaacaggcattggcgtctgatcctcagcaggagcatgacatcacgtcagccgtcaataaatag

SEQ ID NO: 3517 - DNA, 708 bp, Xenorhabdus bovienii
  Coding DNA location: Contig name=SeqID_16889; Position on contig =161361..162068bp; Strand=-
atggaaacgctgcgtaaacatattatcgataccattatagatcacgctaaagccgaatatcctaatgaatgctgcggtctggtcatccaaaatagccgcaagcagcaatatatccgttgccgcaataccgcacctttaccgacagaacaattcagtatgcacccagtcgattacgccgaagccgaagacgtaggcacgattgttgccattgttcacagtcaccccgatgccacgacacaacccagtcaactggatatcgcgcaatgtgacctgtcacaaatcccgtgggtgattgtctcatggccggagagtgacattcgtaccattatgccgactgaggggattaagccgttgttgggtcgtccatttgtacatggtatctgggattgttacgccatcgtgcgtgactggtatcggctggagcgtgatattgatattcctgattttgagcgctcagatggctggtgggagcgtggcgaaaacttgtatatgaagaattatgctgatgctgggtttactgaatgcagcagtgaattacagatgggtgatgtcattattatgcaggtaaccgcatggtgtcgtttacggtgggattggatggaaagatccccttacccggttacattatcggtgtggcggatgaaatgttttccggtcgtgtactgggtggacgtatcagtgcggtggatgggcgtaacattacattag

SEQ ID NO: 3518 - DNA, 741 bp, Xenorhabdus bovienii
  Coding DNA location: Contig name=SeqID_16889; Position on contig =162070..162810bp; Strand=-
atgactattaatgcagatctccagcgccttgaagtggggcataagattttattgttttcggtcgatggctcggcctttggtgggccagaattgtactttcataatcacaccattccttacacagaagcggaactggaaaatccggacgacctgccgattaaatcaatctggtggcagggtgtggagtataaaccgtggcctgtgagaattgagggattggaggtaaatagtgatggtagaacagtgtcacccacgctcagtgttgccaatctagacggcactatcagcgccatgtgtctggcatatcagaatatggctcaggcgcgtgtcacccttcgtatgacctttgcgcattatctggatgcccgtaattttcccgagggcaacccagaagctgatcctacgcaagagaaaatagacgtctactatattgacagtaagacgcatgaggacaatacagagattcattttgctttgtcttctcctgccgacctacaagggattcaaattcctacccgtcagatacacagtctttgtacgtggtgtatgcgggggttatatcgcaaatccccatgtaactataccggtgatcggtattttgatgaggacgggaacccaacagatgatccatcaaaagatgcatgttctggattattgtcaacaggatgtgagctgtgcttcgggaaaggaaatcaacttccctttggtggcttccccggttcagcgttattaaggcggtga

SEQ ID NO: 3519 - DNA, 306 bp, Xenorhabdus bovienii
  Coding DNA location: Contig name=SeqID_16889; Position on contig =162807..163112bp; Strand=-
atggctatcgaagaatttaaacaccgagttaaatcaattgagtttggtgatggttacaaacaggtcgtcgctgatggaattaattccgaaacgcaatcatggccttattcttatttaggagcaaaagaagaagtggttccaatctttcagtttattcgtaatcacacggcaaaatcatttatctggagacctccgtttggtgaaaagggattgtatcgagtcaaatctgactcaatcaccatgacccctatggcgggaggcatcatgaaagtatcagcaacttttgaacaggcattcagcgcatga

SEQ ID NO: 3520 - DNA, 114 bp, Xenorhabdus bovienii
  Coding DNA location: Contig name=SeqID_16889; Position on contig =163093..163206bp; Strand=-
ttgcgtagccttttccatatatgccgcctagtgcggttttttacatcaaaatccaagccgcttaactgcggtttttctttttataggtacttatatggctatcgaagaatttaa

SEQ ID NO: 3521 - DNA, 207 bp, Xenorhabdus bovienii
  Coding DNA location: Contig name=SeqID_16889; Position on contig =163247..163453bp; Strand=-
atgaatcaatatattgttacctatagcgcccttggtagtgacaactcagctctggttaactcgcagattgctttagattttgattggagtacgggtggggttagtgattttttaattgcggtcgagaacgaggcgctcactcaagccacgggatttaatagctctgtagcaagaatctctattgttagaatatatactctgcaataa

SEQ ID NO: 3522 - DNA, 252 bp, Xenorhabdus bovienii
  Coding DNA location: Contig name=SeqID_16889; Position on contig =163570..163821bp; Strand=-
atgcggtcgcgcaacaattacgtgggttcatttatgaaagtaagaaatcgtgctgtcagacgacatcacatgtaccgcttaaaggcaaaacgtagtaagtatcataatgctggtggtcaacctgataaaacatcagcaggaatatgttatcggacaccttgcctatgctcttgctggatatgcgcaaaccatcgtgctgtgttcggaatgggtatcaaagagattcgggatagagctaaatatactgattaa

SEQ ID NO: 3523 - DNA, 108 bp, Xenorhabdus bovienii
  Coding DNA location: Contig name=SeqID_16889; Position on contig =163791..163898bp; Strand=+
atgaacccacgtaattgttgcgcgaccgcatggttatgcagccgcttaatcgtgagttctgaacggattgtttttctcatagtgaatattaacggttgtgattactaa

SEQ ID NO: 3524 - DNA, 411 bp, Xenorhabdus bovienii
  Coding DNA location: Contig name=SeqID_16889; Position on contig =163899..164309bp; Strand=-
atggatattcaatttctctcaacagaagaagttattgaaattcagagaaaaacacttccgaatagcggcgagcctgatgttaataaacttgagggtgctttatttcgtgtccagacattgagagattatgaaggatgcgaagatgttttcaaatttgcagctatgtacttgatagcgatagctaaatcacacgctttcaatgatgcaaacaaacgaacagcttttcaggcaacgagtatcttcttaatactcaatggatttgaactcaatgcgtcatttgagctggtaaaattgacaatattggcagctattggtgaggccgattgcgacaataccgctttcgcactaaagattttgtctaattaccggaatgaccttttggaagagaccgttactggctatgggatataa

SEQ ID NO: 3525 - DNA, 174 bp, Xenorhabdus bovienii
  Coding DNA location: Contig name=SeqID_16889; Position on contig =164309..164482bp; Strand=-
atggaaaaagttaacgacatccaaaagataacgagacaggctgataattcaaagcgtgagcctactgatgcaactaactctattgatgatgctcgttccgaagcgttcaggaaagccttgctgcatactcaaactaaatatgcagatattataaaggcattggaagataaataa

SEQ ID NO: 3526 - DNA, 129 bp, Xenorhabdus bovienii
  Coding DNA location: Contig name=SeqID_16889; Position on contig =164463..164591bp; Strand=+
atgtcgttaactttttccatatgcacctctttttctgtatgtgtacagattagcagcaccaataagacagtcaatgtatataatgcaaggctggttacaagccatccgtggcttggggttatgcgttga

SEQ ID NO: 3527 - DNA, 96 bp, Xenorhabdus bovienii
  Coding DNA location: Contig name=SeqID_16889; Position on contig =164581..164676bp; Strand=-
atggaaatagcccaacgtgctggctatctgctgatacataaagaagatatgcagcccatgatgaaggcgttagaaagctacaagttcaacgcataa

SEQ ID NO: 3528 - DNA, 810 bp, Xenorhabdus bovienii
  Coding DNA location: Contig name=SeqID_16889; Position on contig =164681..165490bp; Strand=-
gtgtcgctttatcactgtaaaacggtgaagccaccaactggtggaacagtcagggcttcttatacaacgtctaatatcatctcaaggaaaatagacatgttaagtataccagttaatgaaccaagtaaaactattaacgtcccatttcatggctcagatctatatgtcgttaattataacggcgagccgtatgtaccgatgaagccgattgtcgatggcatggggctagcttggcaatcgcagttagagaagataaaacaaaggtttaaatcaactgtaacggaaatcgttatagttgccgcagatggtaaaaagagggagatgatttgcattgccctccgcaaacttgctggctggttagcaactatcagccccaataaagttaaagcatcgatcagggataaagttatccggtatcaagatgagtgcgacgatgttctttatgaatactggactacgggtgaggttaaggcgaagaccaaaaccacagtccaacaacggaacccactaaagaacgccgttaaccttctggtcagcaagaaaggtatcatgtacccagaggcttattcgttagttcaccaacgcttcaatgtagagcatatagatgaactgacagccgatcagttaccacaggctatcgaatatgttcacaagatggcaatggagggtgaatatcttggcaaagaagaattgccagtcctgcatggttattctggattcagcggaaaattactaatggaactggaaaacggcgaggttgttttattcctcagcactgacaccaaatcaccatgtagcgaccataaatga

SEQ ID NO: 3529 - DNA, 102 bp, Xenorhabdus bovienii
  Coding DNA location: Contig name=SeqID_16889; Position on contig =165501..165602bp; Strand=+
gtgattgtcactttttgtaaagataacctttgtgaatttgggaagtgcttcgtaaatcaaatttatagcgagttaatcgattgcattaataacgtaatgtga

SEQ ID NO: 3530 - DNA, 759 bp, Xenorhabdus bovienii
  Coding DNA location: Contig name=SeqID_16889; Position on contig =165643..166401bp; Strand=-
gtgaatatagcaaataataacctacctgtcattgcgggtgtagaaatcaccaccgactcagaaggtcgtttcaatctaaatgcgcttcataaggcaagtggtggggagaatgcaaaacgcccatcattatggttgaacaataagcaggtacaagagctaatagatgagctaagcaagaattcctgcttaggtcaggaagtaatcaaatcagtgcgtggtggcactacccccggcactttcgcccatgaacttctcgctgtttcatacgcaggatggataagcccatcattccaattgcaggtcaaccagacattcattgattaccgttctggtaagttggttgatcaagttcaggtgcagatccctcaatccttacccgaagcacttcgccttgccgctgacttagcagaacagaaagcggaacttgagcacaaggtcgaagaaatgaaaccggatgtcgcagcactggagcgtatcgcaaaatcagacggttctatgtgtgtaacggatgctgcaaaacagttacaggtaaagccaaagtcattgtttgacctgatgagtcataacaaatggatttaccgtcgcatgggaaccccttgggttggctatcaagaaaaaatccagcagaggttaattgagcataaggttactgttgtgattaagcctgatggtgaagagaaaacagtatctcaagttcgcatcactccgaaaggcatttcgaagctggccaagatattgagtgtggataaagcagcgtaa

SEQ ID NO: 3531 - DNA, 132 bp, Xenorhabdus bovienii
  Coding DNA location: Contig name=SeqID_16889; Position on contig =166398..166529bp; Strand=-
atgagagagcaagaagtgtggctcaataaagacgaaacctcgaaggcagccaccaacgaggcttctaaatcttcaaaccgtgaaaagcaattaaagattacgtcaaccctaacaaagagagtgacaaagtga

SEQ ID NO: 3532 - DNA, 177 bp, Xenorhabdus bovienii
  Coding DNA location: Contig name=SeqID_16889; Position on contig =166501..166677bp; Strand=-
atgaacgccaatgtagatgcaaaaaagaaaagtgaagtaatgcagttaagaacaacgaagttcctgaaagatcaggtttgttcgttatctgaacgggatggtatttcgaagaattcagttatgaatcaggctatagcttggtatgtaaatgagagagcaagaagtgtggctcaataa

SEQ ID NO: 3533 - DNA, 117 bp, Xenorhabdus bovienii
  Coding DNA location: Contig name=SeqID_16889; Position on contig =166667..166783bp; Strand=+
ttggcgttcatcacctttttctccccacaaatgatgtcaatatgctattaccatctatttagagataaattagaaggtgataaaaatgacgaaaaagctcgtggcggctcaagataa

SEQ ID NO: 3534 - DNA, 306 bp, Xenorhabdus bovienii
  Coding DNA location: Contig name=SeqID_16889; Position on contig =166752..167057bp; Strand=+
atgacgaaaaagctcgtggcggctcaagataaattcatgcttcgacttcctgatggcatgagggaggctgttgccaaaagagcagatgagaacggcagatcaatgaactctgagattgttcaaattttgcaagatgcacttgatgttagcgtaagtcctattgattcgagcatgtcaccagaagatgcagctgctacatttcaaagtgaagtagaagaatttaagaggctactttctaaaaaagaagaagacatcatgaaggtagccaaagtttttgctcagtgggctgctcagaaagaaaaataa

SEQ ID NO: 3535 - DNA, 162 bp, Xenorhabdus bovienii
  Coding DNA location: Contig name=SeqID_16889; Position on contig =167094..167255bp; Strand=-
atgttgatgtatattccaggcgctattttgattctttttctgaatttaagacccataattaccccgcattacattgttttatttagaatatttctaatacttatagtgcagtctaacgagatgttcaatgatcaagatttcgaccatcaaggccaaacctaa

SEQ ID NO: 3536 - DNA, 276 bp, Xenorhabdus bovienii
  Coding DNA location: Contig name=SeqID_16889; Position on contig =167200..167475bp; Strand=+
atgggtcttaaattcagaaaaagaatcaaaatagcgcctggaatatacatcaacatcagcaagagcggtgtcagtacctctattgggggtaaaggagccacgataaatattggtaagaaaggcactaaggcaactctcggaataccggggacaggcctttcatactcaacaaaaatgacagatggtaaacgaaaacagaaaacaaaaacccaaaagtttttttctttcgttttgtacgtgatcctgttcttcttcttttataatcttatcaagtaa

SEQ ID NO: 3537 - DNA, 408 bp, Xenorhabdus bovienii
  Coding DNA location: Contig name=SeqID_16889; Position on contig =167517..167924bp; Strand=-
atgaaaaggatactaatagcatgtgcagcgcttaccttaatagggtgcggtgataactacagtgaatataacggaatatacacctgtaaagtaggcaggctaatgaattatgtagcagtagaccgaggaagtgaatattcttttccgctggggacagtgaaagccagaatgatttttaacaatggggttatgatcattaatggaatgaagtcaggtgattatgttggacatgaaatggctttaaccgcactgccagtagcacaggatggcagaaagctaatgtttaaatatgatgatggtgagcttagtgaagatttttctccccatgacggtatagcaacaattacgattggtaacccgcgtaacgacggaataatgctgcggctcattaactgcaaaaaagagtga

SEQ ID NO: 3538 - DNA, 291 bp, Xenorhabdus bovienii
  Coding DNA location: Contig name=SeqID_16889; Position on contig =168007..168297bp; Strand=-
atggacagtaaattattttccagactcactgaaagcatgacacagatgaacgaaatcatgaatggcgaacgtgctgcttctcgtgaaacaactattgaggcagtgaaagtaaaaaacattcgtcaggcaaccggattgagccagacgggttttgctaaattaatctctgttaatgttggaacccttcgtaattgggaacagggaagaagagagccaacaggcccagcaaaagcattgttaaaggcaatagagaaagatccggttcatgtcttaaaggcgttatctatgtag

SEQ ID NO: 3539 - DNA, 312 bp, Xenorhabdus bovienii
  Coding DNA location: Contig name=SeqID_16889; Position on contig =168300..168611bp; Strand=-
atgatattcattgagactcatatattcaccgaagactgtaaagagctgttaagtgatgatgaatatcgcgagtttcagcaatatcttgcagacaatcccgctacgggtgatgttatccagcacactgggggcttacgtaaagttagatgggcatccagaggtaaaggtaaacgtggcggtgtacgcgtcatttattatcacaaggtcgatgtctcacatataagactgcttctgatttataaaaaaggtattaaagatggccttagcgagtcagaaaagaaagtcttgagagcattaaatgaggggtggtaa

SEQ ID NO: 3540 - DNA, 165 bp, Xenorhabdus bovienii
  Coding DNA location: Contig name=SeqID_16889; Position on contig =168591..168755bp; Strand=+
atgagtctcaatgaatatcatgtttcagtacgccattggtgtatgcatagagtgataatagcactcttattgtataagtcaatagcgtatgacggaagagtttggatagtaaaaagccctgtaggggctgtcctgtatacactgaaatctcatgtaagtctttga

SEQ ID NO: 3541 - DNA, 432 bp, Xenorhabdus bovienii
  Coding DNA location: Contig name=SeqID_16889; Position on contig =169144..169575bp; Strand=+
atgcagttcaccccatggaaccccaatcctaaagcagcacagagggtcaatgacccgctccccgttcccacccaatgccgacattgccgcagtcacgtaaagatagcccatcacacggaggtgtttgggaagacccggcatgacgacaaatggccgtggttctatgtctgctggtcatgcgatgctcgtgtcggtatgcatccagaaaccgatattccactgggatatctggctgatgaaccgacacggagagcgaggcggagcggcaaacaggaatttgaggagatgcgaaagagagggaattttgaacgcacggaggcgtaccgatggctggcatggaggctggggattagtatcaataaatgtcatttcggctggtttaatgccgagatgtgcgagaaagcaaccaatatatgcagggggtttaaataa

SEQ ID NO: 3542 - DNA, 564 bp, Xenorhabdus bovienii
  Coding DNA location: Contig name=SeqID_16889; Position on contig =169575..170138bp; Strand=+
atgactgattttacatcactggcagatggcggcgaattatcccgtgaaacatgggctgattttgttaaacgcctcgaatatcaacataaaggcgaaggtgttgatcggcacggcacggcgcatccatcatttacagtcagagaaaaggttagattgactggctctgaggatgacgaggtaggaatatattacgattggggagcgtattattccctagagaacgcattagctcatttagatgatgaacagaaacagaaaatatttaattacgcgacagaggaatttttggatgatttagacaatttggacgatatagataaagctaaatgcatcgtgtctgtattagaggactcatatattttctactggaagtacgattacaaaactataaatactcatttaaccagagaagcggcggaacgattcattgctcgtaaacaacatgattatggagaattatctgtttatgttgaatcgttctattggtgctgggaaatgcgcacgttgattgagggagtgttgactaggaaaataaaatacacaggtgatggtaatgacaaataa

SEQ ID NO: 3543 - DNA, 171 bp, Xenorhabdus bovienii
  Coding DNA location: Contig name=SeqID_16889; Position on contig =170128..170298bp; Strand=+
atgacaaataaacgtcgttttaatttgtggcaatggatttggttgcaggtttggaatttatcagaatggagcggaataggtttaggccgttttgcttcgtgggtatttcatcaaatgattggatgcaattatccagttaagaaaattaaatcaggtgataataatgactga

SEQ ID NO: 3544 - DNA, 195 bp, Xenorhabdus bovienii
  Coding DNA location: Contig name=SeqID_16889; Position on contig =170291..170485bp; Strand=+
atgactgattcagatttatgcagagaagcgtttgagaaattcatggttgatgggttcaattatccaattgactcattaggtaaatatgacgatggaacatattggaatatgccagctcaaaattactgggaaatattccaagcagcatggaacgcaagtcgggagaatataatcaaacaggagagccaaaaatga

SEQ ID NO: 3545 - DNA, 294 bp, Xenorhabdus bovienii
  Coding DNA location: Contig name=SeqID_16889; Position on contig =170482..170775bp; Strand=+
atgagcaaagatgtgattgagaaaataaacacaacattggaatcagccgaggaatttaaatcggaaggtgccagtacaataatattagatttagatgtctatattacaatattaaaacgtctggccaaatatgaaaatatggagcctgtggcgcggggtcgtattactggtatgtttcgtattatggatactacaaccctaccagtaatagtatcagaatggattgggtttaatgaatcgcatcctgatattgctgacgatatattccccctctaccgccaccccaacaaatag

SEQ ID NO: 3546 - DNA, 117 bp, Xenorhabdus bovienii
  Coding DNA location: Contig name=SeqID_16889; Position on contig =170754..170870bp; Strand=-
atgctggttaatggtggtttccggttctggagcgcatgggataccgtcaactcaacggcatcgttagctgtgtcgataatatccatgatggttctctatttgttggggtggcggtag

SEQ ID NO: 3547 - DNA, 717 bp, Xenorhabdus bovienii
  Coding DNA location: Contig name=SeqID_16889; Position on contig =170870..171586bp; Strand=-
atggcattgagcgacactaaactacgtggtattcacgataaaccctacaaagggacgcctgagttaaccgatggtgacggcttaagtgtcaggataacgccgaacggaaccataacatttcagcatagatatcgctggaatggcaagcctgttcgccttactgttggtcgttatcctgaaatgtcgctcaaggacgcacgaatcgcagtaggtgagatgcgctcattgtacgcaaaggggcttgatccaaaaatgtatttctctcattcagaaggagaagcaacattaaaagattgccttgattactggtgggataagtacgcatccactctaaaacctaatactcaaatactttataagtccgtcgtgtacaacacgatgtacacacaattcttgtgtacaccagtagccagcatacccgtgtcatcttgggttaagtttttcgacaagcaggaaaaggaaaacccaaaaaaagcgagggtacttttaactcaaatgcgctcagtagttaactggtgcatagggaggcagtttagtgattgttggctgctccgttgctggctgagttattatatgccatggaggatcagccaatatcaggctgtatttttgttccatctctccgcctatcccgctcataatcctctccgcactcccgactacagaatgcaccgtgtgttgctggctcagtctcacaccatcggcacattccgttga

SEQ ID NO: 3548 - DNA, 1179 bp, Xenorhabdus bovienii
  Coding DNA location: Contig name=SeqID_16889; Position on contig =172018..173196bp; Strand=+
atgttaacgataaagcaaattgagtcagccaaatctcaagataaagcctatcgccttgttgatggtggaggtttatttctttttgtatcgaaaacagggagtaaaatttggcgttttaggtaccgcaaaaacgggaaagagcaaacccatgttattggtacatatccagagatttcactggttacggctcgattaaaacatgccgaagctaaatctattcttgctaacggtggggatttaatacctgtagtaccaaaacagaaagatattgaaactccagacacttttgctgccatatataatgaatggtatcaattcaaacgagctgtttggtctgaaaggtacgcaaaagaattgcagagcatgtttcaagccgacatcctaccaagcattggtcatatgacaataaaagaaatagagccgatggttctactcaaagtgattcgtcagtttgaagaacgtggagctatggaaagagcaagtaaggcaagacacagatgtggtgaagtgtttaaatatgcgatagtgactggcagagctaagtataaccccgctccagatttagctggtgcaatgactggatacaagaagaaacatttcccatttctaacagcagaccaaatcccctcctttaatctggcattatcttcatattccggcagcattatttcgaaggttgccactcaggttttacaatatacagcattgcgtacgaatgaactgcgcagcatgaaatggagcgatgttgattttgataataaattgatcaccattaatgctgacattatgaaaaatagaaaagtacacgtagttcctatgtcaaatcaggtcattgcattactaaaaaccctctaccctattacttccagtatctctaatttcgtattcgctggtagaaatgacaaaaaaaagccaatttgcgagaatgccgtattacaggtgattaggcaaatcggttatgatgggatcgctagtggtcatggattcaggcaccagtttagcaccatactcaatgagcatggatttagccacgacctgattgagcgacaactggcgcatgttgatcgaaatagcattcgcggtatatataatcacgcccaatatctagataaacgtcgaaaaatgatgcaatggttcgctgactacattgatgagatatcgaccgctacgactacctga

SEQ ID NO: 3549 - DNA, 135 bp, Xenorhabdus bovienii
  Coding DNA location: Contig name=SeqID_16889; Position on contig =173168..173302bp; Strand=+
atgagatatcgaccgctacgactacctgaaagagaagcaggagattgtagaacggtgagaagggaagctactgtcactataggtcagaagcctgcccttaagatgggatatcacaccttgcggcaaccgtggtga

SEQ ID NO: 3550 - DNA, 165 bp, Xenorhabdus bovienii
  Coding DNA location: Contig name=SeqID_16889; Position on contig =173350..173514bp; Strand=+
ttgaccacccgagacatctcttccgtaaattcgtctttatttcaactgttgggaaaatcccaatggttactttatgtgctggacaaaaggaataaatgcattgtatttcaatgtgttaattgtgcgcaaggggttgggcaagcagacgccaaatctgtcgtctga

SEQ ID NO: 3551 - DNA, 165 bp, Xenorhabdus bovienii
  Coding DNA location: Contig name=SeqID_16889; Position on contig =173457..173621bp; Strand=-
ttggctcagttccaatcggacaaatttttggctgatcgcgccaattgggatttgaaagcccatttaagtgagaatgcccattttgacgataactcattgatatttaatcagacgacagatttggcgtctgcttgcccaaccccttgcgcacaattaacacattga

SEQ ID NO: 3552 - DNA, 207 bp, Xenorhabdus bovienii
  Coding DNA location: Contig name=SeqID_16889; Position on contig =173962..174168bp; Strand=-
atgaaattaagtagacttgcggactcatcaggtattccctctattctccagaatgttccactaggtcgaagcatacttatacctccccattggaaatctggatttacagttagtccccatttagtcactgtaaatgctcgccgagaattaatgtctacagcatatcccaaagtatcagtgccaccacctcgcactacgcctgtctga

SEQ ID NO: 3553 - DNA, 150 bp, Xenorhabdus bovienii
  Coding DNA location: Contig name=SeqID_16889; Position on contig =174095..174244bp; Strand=+
atgcttcgacctagtggaacattctggagaatagagggaatacctgatgagtccgcaagtctacttaatttcatagacagaaacaacgatggttcaaatagaagtgtccaaaccctgccaaacccacctacttcagtaggtggtagttaa

SEQ ID NO: 3554 - DNA, 384 bp, Xenorhabdus bovienii
  Coding DNA location: Contig name=SeqID_16889; Position on contig =174293..174676bp; Strand=+
ttggctttaattgcctgtaaaattgctgaacactatcctacggctaaattcatcatctctgcattaccaaatgacattcatttggctgaaaatttaactttacgcattagtaaaaatagtcagattgtaatatctaattcacttaatgaatttttaattttattgaataatatgacattaattgtcgtaggtgatggtggtatctgtcatttagctgcggcattacagaaaaaaattgttgctctgtatggtataacaaaacctgaaaattgggcaccacttgcaacggaagagatatgtattaccttatacgatccagaggatgtcaataatattaatttggataaagttaataatgctattttttccttactggaaaagtag

SEQ ID NO: 3555 - DNA, 186 bp, Xenorhabdus bovienii
  Coding DNA location: Contig name=SeqID_16889; Position on contig =174772..174957bp; Strand=-
atgatacaagtgcaacactgttatgaacgaagtaaacaatttagtattccctggaataactcattggctgcttttgatttcctaacttttttaccaaacataggttcattaattgatttttatcaatggcgatattcaccaaatgcgatgattccagagtttataacttgtttgaataaaaaatga

SEQ ID NO: 3556 - DNA, 267 bp, Xenorhabdus bovienii
  Coding DNA location: Contig name=SeqID_16889; Position on contig =175060..175326bp; Strand=-
atgggcaaattttaccaagtaggagatataccaaaatacattatttgttgcaaaatattttataaagaaataaattcagatgaatccttgaaaaaatttaattatactcttcctatctgtgttattggttattttttaggaattaaggtccaagaatgcaaagaattggttaacaagattatcgattttattcaatgtattgtactgaatagtgataaacagagaataactgaatcaattattgcgtcagaatatctatatgtttaa

SEQ ID NO: 3557 - DNA, 93 bp, Xenorhabdus bovienii
  Coding DNA location: Contig name=SeqID_16889; Position on contig =175525..175617bp; Strand=+
atgatccttccagaaaatagacttaattattctattgacaatttcactacttcacttctctgtagaacaaaatattcttttagatacggataa

SEQ ID NO: 3558 - DNA, 903 bp, Xenorhabdus bovienii
  Coding DNA location: Contig name=SeqID_16889; Position on contig =175900..176802bp; Strand=+
atgaatatcaacatattaattacatcgatagcagtcgaaaaatattcgacaaaaaataaatcacctcgagaaaccaatatgcaaacagtaatcctaaatgaaaaaattcaaattttccgtcaactccatgaggaaggtcgcctaatattagccaattcttgggacgtcatgagtagccgtttagctgaacaaagtggtgccaaagcgatagccacaaccagttctgggatatcttggagcttggggtaccctgataatcaattcgccgatcggaaactggtgatgaaagcgctaggtttaattacaggctgcaccaaccttccagtttctgctgacattgaagatggtctgctgggcattgatgaaaatatggatcatcttgtacaagacttatattctgtcgaatgtgtcggtattaatatcgaagatgctcaaaatggtaagtcaatgtctatagaggatggtgccgaacgcatagctgctgtacgtacttccgcgaataaattgaattacaatttgtttatcaatgcgcgtattgattcatggcttcgtggtgaaaataccgaaccagctcacttgatttcccgtgctaatgcttaccttgccgctggcgcagattgtatctttatccccggtctaaccgatttagctatatgccaaacgatcagtactcatattaacggaccgttaaatgtaatggcacactctggtgctcccagcgcagaagaattttttgcggctggagtgaaaaggatctctggcggttctttctttgctgaacaggcctatggcatcactttgtcaagtatggagaattttgtacgaaatggtatgctacagccaaatgataaggcgaaactgaactatatggcgctaaatgctctattggctcagaaagaataa

SEQ ID NO: 3559 - DNA, 159 bp, Xenorhabdus bovienii
  Coding DNA location: Contig name=SeqID_16889; Position on contig =176777..176935bp; Strand=+
atgctctattggctcagaaagaataatcaatacgttgcaggaaatatggcgttctatcctgcaacattaaacaacaatctaaaacacttagaatatagtttcttatattacaatttaagtatgaaattaaaataccaattttactctattaataactaa

SEQ ID NO: 3560 - DNA, 378 bp, Xenorhabdus bovienii
  Coding DNA location: Contig name=SeqID_16889; Position on contig =177114..177491bp; Strand=+
atggcatctggtatgagtcaaacgttaacttctcaatctaatttacaagataatccctgtataagctgtggtgcttgctgtgcatattttcgtgtttcattttactgggcagaagccgaagatggcggaggtactgttcctgtctctatgaccgaaaaattaaacgctttcatgagttgtatgaaaggcacaaatgaacctaatccccgctgtataaatttacgtggtgaaattggtcaatcagtctcttgtgccatttatgataaaagaccttctccttgtagagaatttactcaagcttgggaaactgacgattacaatgaagcctgtgatcgtgccagagccgctcatggccttccgccactgccaaaatcgtag

SEQ ID NO: 3561 - DNA, 132 bp, Xenorhabdus bovienii
  Coding DNA location: Contig name=SeqID_16889; Position on contig =177576..177707bp; Strand=+
ttgccagaaatccttattctaaacttctgctggatatctaaggcttttttgataacagaaaagacaactgattcattaatattgttatggataaatattactatgaggaagtattacgatgagaagagttaa

SEQ ID NO: 3562 - DNA, 330 bp, Xenorhabdus bovienii
  Coding DNA location: Contig name=SeqID_16890; Position on contig =196..525bp; Strand=+
atgcaacccgtcaaggcactgatattgcgctcctatggtgttggtaatgccccacagcacgctgatttattgaagatcttaagggaagcgactgaacggggtattatcgtggtcaatttaacacaatgtatttctgggcgagtcaacatggaaggttatgcaaccggccacgctctggctacatcaggtgtaatcagtggctatgacatgacttttgaagccacgctgaccaaattgcactatttattgagccagtcctatgaatccgaagagatccgccacctcatgcaacagaatctacgtggcgaattgagctattcagatgaataa

SEQ ID NO: 3563 - DNA, 280 bp, Xenorhabdus bovienii
  Coding DNA location: Contig name=SeqID_16890; Position on contig =549..828bp; Strand=+
atgaaaacagcactattacttatcgacctgcaaaatgattatcgtgatagcagcgaaattgaggataagccagatcgagtgtggcgtggggcgaattatcaccatgctccggccaatccactctctaaggaagttgatgccaatctggaaaaattgggtcaggaacttctggagcagtttgatgcacaagcattcatgctgcgtttatacgaattattgccaatcaacaatcctgcttacaaacagctggctaatctattgatgcaaccagaaaaaggcg

SEQ ID NO: 3564 - DNA, 492 bp, Xenorhabdus bovienii; identical to SEQ ID NO: 1438
  Coding DNA location: Contig name=SeqID_16891; Position on contig =162..653bp; Strand=-

SEQ ID NO: 3565 - DNA, 147 bp, Xenorhabdus bovienii
  Coding DNA location: Contig name=SeqID_16892; Position on contig =18..164bp; Strand=-
atggaagaagctaacctattagtcggacaacgtattcaggccaaaaggaaagagttgagtatgacagcaacatcattggcgaaaaaaattggcattagccagcagcagctttcacgttataaacaggaaaaaatcggattaatatag

SEQ ID NO: 3566 - DNA, 201 bp, Xenorhabdus bovienii
  Coding DNA location: Contig name=SeqID_16892; Position on contig =357..557bp; Strand=+
gtgcccttaccaagtaaaggggttttcttctatgacacgaattgcattctttgttttggtgtcaccttgcatctttcaacttcctcacctgtcaccgggttaaacagcatttttattctccttacacgagggataactaacctgcttcctaacttttttcttatggtaatttatgtaattttaaatttattaagatattga

SEQ ID NO: 3567 - DNA, 246 bp, Xenorhabdus bovienii
  Coding DNA location: Contig name=SeqID_16892; Position on contig =1476..1721bp; Strand=+
atggctggatggagggatattttttttggggggggggtaggtaggaacagatcttggaaatggaattattcccttcatctttcaaatggcggctttattggcggctttcactcaccccagtcacatcgttatctatgtaactggggattcactcacttgccactgcgctgcatattgcttaacgtggcatgctggtcggcgatatcgacgtccagttctctcagccgtgttgtcacccacgtctga

SEQ ID NO: 3568 - DNA, 924 bp, Xenorhabdus bovienii
  Coding DNA location: Contig name=SeqID_16892; Position on contig =1735..2658bp; Strand=-
atgaatataaatccagtcatgccgttgattcgcttattccgggaagaagattccaccggagtcagcgcgttgtttcgagtcgtttacggcgaagattacgtctatccggaagtctacctaccaaccatgctgagtcgttataatgcggccagacactggtattctgccgttgcaatacaggatgggcaagtattgggacacgcgacattgtggcggaatgggcgttgcccatcaagtgcagagctcgcgcttatcgcggtacatccacaagcgcgcggacagggtattgcgaccgcgctgggccgatatttgtgtgatcaagccaaagaaatgggattgggtatactcacgattaaacaggtatcgtcgcataatcacagccagcgtctggctcaaaatttgggctttcacaccacgggtttattaccggattatgtgacatctccctttgatcaagcacgtccggaaagcattgtactcggttgcctgcctttgcaacgctggccgtttccagaattacactggccggtaaattggcaaacgtggctgacatcggtcactcaaatatttggtcaagaaccgctaaaacctgcggttccaatagatacgggtattagcatcgccagtcatggtggccgattagaagtctggatagaaacgcagacaacggagcgggtaaaagaagtgacagaactgccggcgcacaagctgatatatgtgaaactgccggtcggagaagagactctccacgcggtacaaattttgcagcaagccggatttgcctgcacaggatttgtgcctggtcaccatcatcgttgggaagtgcttctggttcggggacatagtagaaaagaactggctttaagttgccagtttgcccacaatctacatcagcaaagtctgtttgcctgtgccgaaaggtag

SEQ ID NO: 3569 - DNA, 1272 bp, Xenorhabdus bovienii
  Coding DNA location: Contig name=SeqID_16892; Position on contig =2655..3926bp; Strand=-
atgactttatcattacacgatctagtggaatacgcccgtcaccacgcgcccttttttagggatctttataatgatttgccacaatccggctgggcactaacggatttacctttaatcgatcctgctgcttactggcagcaatcgcagccattggagaattggccggtactcaccggccctatcaacagtggccatatttttaaaaccggcggctctaccagcgaagggaggttgtcggtgttcagtcgcagcgaatggcaagcctttgtgcgttcgttcggccaaggtcttgcacaacaattacaatctggcgaccgtgttgccaatctcttttttgccggagatctgtataccagcctgttgtttattcacggagcgttatctcattcaccggttccggtggtggaatatccgtttacctgttcagtcgatgatcaggcgttggctgacgccattgttagcttagggattaatgtactggcgggagtgccggtacaattgttgcgttttgccagtaccttgcagcgttcaggccagtttatgcccaatattgatcgtctgttgtacggcggagagagcctgtttccggaacaactggctcttttgaatatcgtgtttcccaacgcgcgcattggttcaatcggatgtgccagtgttgacgcaggtctgattggtgccgcctctcctgattgtcaccacggtgaacatcgggtttttgatgaagattcgattgtcgaaattattgacgaatccaatggtcagcccattactgagtctggacgcaatggcatgttagttgttaccaacctacaacgtcgtctaatgccggtgattcgctaccccacaggcgatctggcctgctggtgtgaagagccgggaagactgaaccgcaaatttgctttgcagggtcgggctggaagtgctcaccgtatccgggtttccacgttatccctgtttcccgatcagattgcccgtttactgcaacaacagaaaggaatactggcttggcagctattgttaagccgtcaggacggcatagataagataaaactgctattagccagcgactcaccacagatgccatcaacagcatcaatccatcaggcgttagtcactgcccagcccgctatggcagaactctgtagccaaggggtgttacaggtggaggtagcctcttgcgctctggaaaatatggtcacgcacccacgttccggcaagctgatacgggtcgtggatcatcgttgttataatgctgaagagaagacagcatga

SEQ ID NO: 3570 - DNA, 2406 bp, Xenorhabdus bovienii
  Coding DNA location: Contig name=SeqID_16892; Position on contig =3970..6375bp; Strand=-
atgtatttagttaatggtgaggttatctctaacttggaaccggcggccgcattggccgatcttaaaaaccgtcttgccgatgccttggcttgtcctccaactgtgcaagaggtgttggattgcgccgagcgttttgccagcagtctcaaaactatggcaactgattttgcactggatgcaaccacaatcagcaccttacaccacttttgccgtcgtgacgcactggaagaaaagctgcgccatgaattgggagaacagccgttttccctgcgccgtttcgattatacccagccgcgctttgagacttggcaacctttggggttggtggtgcatatcactccggccaacgcaccattgctaccatttatggctgtattggaaagtttgttagttggcaatatcaactggttgcgccccagtagcagtgataatggcctcaatgcacggatactggctgaatttctgcgccatgatctcagtggcaaattagcgtcttacgtctccgtattaccgctgccgtccgatcaattgtcagaattacttgcctgtgccgatgccgtgtctgcctggggcagcaatgccgcattgacggctatccgcagccagttacgaccgggttgccgctggatcgattgggggcatcgcatcagttttgcctatcttgacccaatggtcgccagcaacgccgactacgatgccctggctgatgatgtttgccgttttgaccaacaagcttgttccagcccacagtgcctgttggtagatagtaccgacgagaatgttttgcgcgaagtggctgatgccgtggcttcggcactggaacgacgcgcaccggtatggccggccttacagccagatatccaagaagcggctgaaatcagcagtcagatggcatttctgcgcttggatcacacgtttgccgacgttgccggttcggtaactgaaggcacaggatggcgggtcgcgtggacgcaacgtcaggaactggcggcatctccactgtaccgtactctgcaaattcgtcctgtgccgcgtgcgcagttgatcaacgtattgctgccgtggcgcccctatttacagagttgtggtttgatcgccggagaacacgaattgccggccttgagccgtcagttgctggcggcgggtgtcagccggatatgtcaggccggcgctatgcatgagggttatgaaggagaacctcatgatggcgtttatgcattgacgcggcttgcacgcagggtctcagtcagtgtgaaagctgagcaactgccaaaccatgtcacgctggataaattatccatcaggccgccggatctggcagggctgccaatcatgggcaaagaacagtttcagcaaagtggcacgacaccgaaagcacaagtgtttttccgcagtggcgggagtacaggagcgccaaaattagcgggattcagtcatagagattatcacatccaaatgcaagcagcggcagatggcctattttctgccggtctcgatccggcacaggatcgcgtcattaatctcctgtacggcggcaatttgtatggtggcctacttagctttttcactgttctggataaattgtccgtgccgcattacccgatgggtggcccgatagacgacgattttagccagatcctacaagttattgtcacgcaaggcgttaatacgttggtaggaatgccaagcacgatatatcagctgtttgaacgtgaagaggccgcattacgcgcttatggtggtgtgcgcaaaattttcgccggtggtgaacatgtcagtgaagaacggcatcaattcttatccagttttggcgtgcaggtgatccgttcagcaatttacggttccgttgatgcgggcccattgggtcatgcttgcacttgttgcaacgagggcgaatttcatctgttatctgatattcagtggctggaaatattagatctggacagtgaacaacctgttcagtcaggcgagacaggtcggctggtgtttacccctctggcacgggaaggacaagtcgttcaacgctatgaggtgggcgatttaggccactggttatcggaaccttgtacctgcggattatcgacaccacgctttagactggaaggccggcatggtggattgatacgggtaggttctatttttgtgaacccaacggcattgtcagccgatctggcgtttccggtgcaatggttagtcggaaatctcgataagggtggcgaatatatccatgtgttggctgatggcgatgttaaccaggtacgtcaacatctactgcaacatgaaatgctgaatcaggttgtcagtggtgaattgttgcaattggaaatcacgtctacgccagccggacagttccgtcgtcattcccaaagtggcaagacgccgttagtgctggattatcgcgtctga

SEQ ID NO: 3571 - DNA, 1041 bp, Xenorhabdus bovienii
  Coding DNA location: Contig name=SeqID_16892; Position on contig =6377..7417bp; Strand=-
atgcgtgaattgacacgataccattgtgaaaacagccccggttaccatcagtggttgaaagtgaatggtttggacgataaaaaactagaaaaattgcatgactggtcgcgtttaccacctattttcgccaattatttcaaacatcagctgctgctaagtcacaccggtatagatgcgctggaattgacttcatctgggacaaccggtcaaaagagccgtatgcggtacgatacgcgcagcatacaggcagcccagagaatggttgaacgtattttcgaatattacggctggaatacaccacaacagccttgtaactacatattattgagctatgaacccgccggagcaattacgctgggaaccgcctataccgatcaatatctgtgtcagtacgcaccggtatcgcaagcttgttatgcactgcgccacaatggaaaaagcaatgaattcgacccatttggtgtgatccgtgccttgcaggaatttgccgcacaagggctgccagtgcgtttcttaggcttcccggccttcctctggttcacgctggaacggatgcgggaaatgaatttacccccactacaattgcatcccgaatctttggtctttttagggggtggctggaaaacccacgccgataaagccattccacgatcgctgctgtaccagcgcttgaatgaacaactgggcattcctgatgaacgctgccgggatggctatggttcagttgagcatcctgtaccttatgttgagtgtcagaatcaccattttcatgtgccgtcctatgcccgtgcttatgtccgtgataccgccaatatggcggtgcaatcctatggtaaaccgggttttctgcatctgacatcaccctatatcacttccagtccagcacacagtatcgtggtgagcgatttggcggtattgcatcccgccgcagagtgtggatgtggattagctaccgattggtttgaactgctgggccgtgctggtacgagtaaaagccgtagttgtgcgattgccgcttctgagttgattaaggaatcctga

SEQ ID NO: 3572 - DNA, 174 bp, Xenorhabdus bovienii
  Coding DNA location: Contig name=SeqID_16892; Position on contig =8565..8738bp; Strand=+
ttggcatgtcatcgcctaattccatatcgggtctttcgtgatgataaagtcattgccactttgttgtatattcttgcaattcattcaatgatgaaaataagtattgccccagccagtcataacgaacggtacggttataacgttcagtatagaccccgctgggcgacagactag

SEQ ID NO: 3573 - DNA, 234 bp, Xenorhabdus bovienii
  Coding DNA location: Contig name=SeqID_16892; Position on contig =8741..8974bp; Strand=-
atgcagtcctggcggttttgcgggtacaggagaaaaaaaacaccggtaggccgggttccgctcagtgtagcggaactccgtaagctgctgtcaaagctgatggaaaaagcgggaaagacaatcgaacagattttacattggtcagactggcgacgacggcatcaataccgggcacaacaatgtcactgtcgccgccggggaaatcatcggcttacagagcaattacggctgtag

SEQ ID NO: 3574 - DNA, 513 bp, Xenorhabdus bovienii
  Coding DNA location: Contig name=SeqID_16892; Position on contig =8892..9404bp; Strand=-
gtgttagccattccctgcaatacccccttatggtggcgagggccagagtatatccgtgttgaccggattgccgataccctgaccgccgctgactggaaaacacggtcagcgggaacggggacaaaaggtgagcgtgagtatgactgggctgtcgtgccgttatggcgtttacagctcagtgaagaggatcgacattatggtcattatttgttagttcggcgcagccgggatagcagacaggaacgggcttactatgtggtgtatgccctgagagaacaggtggatcttaatacgctggttcaggttgcgggttgtcgctgggaaatcgaaagtggctttgaggaaaccaaaggggaatgtgggctggatcactacgaagtgcggcgatggcagagctggcaccggcatattaccttgtcgttactggcccatgcagtcctggcggttttgcgggtacaggagaaaaaaaacaccggtaggccgggttccgctcagtgtagcggaactccgtaa

SEQ ID NO: 3575 - DNA, 651 bp, Xenorhabdus bovienii
  Coding DNA location: Contig name=SeqID_16892; Position on contig =9411..10061bp; Strand=-
atgccatcccctgccaaaatctgggaacaggcgctacaggcattacatacccgtctggctcccttatttcactctaccggctcacgacaacgcagcctcgcctatcttcggggattgctcagtgatgttgaacgtaagaatagctggcaactggctgaatggatgggggaaaatacccccgatgggattcaatatttgctggaacgcgctgattgggatgtcgatatggcccgcgatatcctgcgggattatgtcactgaacatttgggcgatgaacagggtgttctcatcattgatgaaaccggttttatcaaaaaagggacacattctgccggggtacagcgtcagtatagtgggaccgctggacgggtagaaaacagccagataggcgtatttctttgttacgccggcaacggagggcatgcctttgttgaccgggcattatacctgcctcgccagtggacagatgcccgttcccgctgtgaagccgcgggtatccccgccagcgtcacttttgcaacgaaacccccgttagcccggcagatgctggaacgaacatgggatgccggcgttccctgtcgctgggtgaccgcggatgaagtttatggccgtgaccgtcgtctaagagtctggctggagtcccgatactag

SEQ ID NO: 3576 - DNA, 453 bp, Xenorhabdus bovienii
  Coding DNA location: Contig name=SeqID_16892; Position on contig =10199..10651bp; Strand=+
atggcacgctacgacattcctgatgacgcatggatagtggtagaaccttgtttgcccccggtccattcagagcgagcaggacgtccacatgttgaacaccgccgtgtgatgaatgggatgttctgggtcttgtgctccggggcaccgtggcgtgatttacctgaacgctatgatccttggaaaacggtctataaccgatttaatcgcgggtcaaaatcgggcattatcaacaagatatttaatcggttactgtccattctggatgaaaaaggcttgattgactgggctgaaatttgcctggatggcagcaatattcgcgcgagtaaagatgccgcaggcgcgaaaaaaaacatcccgatatcaccgacgatcatgcgctgggtcgctcacgcggtggttatggcaccaaaatccacctggcaaccgacggaaagggttttcccctcaacctga

SEQ ID NO: 3577 - DNA, 390 bp, Xenorhabdus bovienii
  Coding DNA location: Contig name=SeqID_16892; Position on contig =10651..11040bp; Strand=+
atgttgaccgctgggcaagctcatgaaagtcaatccgccatccctttgctcgacggcattggtatacaacgcaaaaatggtttcatgaaacggcgcggcaaagcggtgctggcagataaaggctattcgggcggaaaactccgcggttatctgcgtaagttgcggataaagagcattattccgtataaaatcaatgaaaaaggcagtactgatggtcgcacacaatttgatgagcaggcttatcgtgaccgtaatgttgtcgaacgttgtttcggttttcttaaaggaaatcggcgtattgcaacccgttacgaaaaaaccgcacgaaactttttgtccagggtgaaattaggctgtattcgactcttttacaggcggttatctaattaa

SEQ ID NO: 3578 - DNA, 966 bp, Xenorhabdus bovienii
  Coding DNA location: Contig name=SeqID_16892; Position on contig =11091..12056bp; Strand=-
ttgacggtcgcgcttaaagagatccctttgagcctgcgcacttggcggcgctggcaaaagagcccggaagaccggcggccgttggctgtccggcctaagtcggcaaaccgattaaccccagaagaagagcaacagatattggccgtttgtcaccagccggaatatgccagcctgccaccttcccaaatcgtgccacgattggccgataacggtgtttatctggcgtgtgaatccaccttttaccgggtattacggcgtcagggtgaggttcatcaccgggggcgaaagcgtacagctcacaaacgagggaaaccgaccacatgggaagccaccgcccccaatcagctttgggcgtgggatattacatggctcccgtcaacagtcaaaggtcgctggttttatctgtatatgataatggatattttcagccggaaaatcgtgggttatgaagtccatgaagccgagagtggtgagttagcggcgacgctggtgcagcgcacagtctggaaggagaaatgctggcgtgaacccctgatattgcatgccgacaatggtgccgcgatgaaatcacaaaccctgcaggtcaaactgcaggaactggctatcacgccatcacacagccgcccacgagtaagcaatgataatgcctatgcggaatcgctgttccggacactgaaatatgtgccgacgtggccggaaggtggcttcagagatctgacacaagcgcgtgtctgggggaataattttaccaactggtataacgaagagcaccgtcatagtgggataaattatgtgacacccggtcaacggcacagaggcgaagacaaaatgattttaaaacagcgggatgccgtttatcgtcaagctaagctcatacatccggaacgctggtcgcgaagcacaagaaactggcaatgggtagaaacagtgacgttgaatcccgaacgagaaaaacgcgtggcttaa

SEQ ID NO: 3579 - DNA, 483 bp, Xenorhabdus bovienii
  Coding DNA location: Contig name=SeqID_16892; Position on contig =12122..12604bp; Strand=-
atgactcgtatttcacccgagcgtaaatctgccgcgctggctaaattgttaccgccgtacaacatgactgtcgccgccgttgcacagatggaaggcatatcggaagccaccctgtataattggcgtaatcaggcaaaagcagaaggaaaacccgtgcccggcgcagacaaaactcctaaacaatggcccgcagaagcccggctggcggtcattattgaaacggccacattcagtgccactgaattagccgaatattgtcgtaaaaaagggctctatcctgagcaaattcagcagtggaaacaggcgttcttacaagtgcctgcccgtgacgataaggcggcattaaaacagagccagaaagaaaacaaacaactgaaacgtgaactggcccgtaaggaaaaagccctggcggaggcggcagcgatactggttttgcgaaagatgttgcaggcacacttcgggacggacaacgaggaagactga

SEQ ID NO: 3580 - DNA, 522 bp, Xenorhabdus bovienii
  Coding DNA location: Contig name=SeqID_16892; Position on contig =12507..13028bp; Strand=+
atgccttccatctgtgcaacggcggcgacagtcatgttgtacggcggtaacaatttagccagcgcggcagatttacgctcgggtgaaatacgagtcatttttttctctatcagcgttgttaatggggatgacaactatgctgacagaaagggaccatcagaagatagcaatgaagttaaggaagtaattatttccttaatttgtgtgataattacactgttatccataccttcacggggtatatttgcttgtagttttacatcccccaataatccgcgaattaatgtaatttcatcaagagtaaggcagctttcatcaactagctgcttgataggaaccgtaaggtctcttaaggttagaatatctaacttaagtatttttgcaattaatcttcctaaatcagcccaatcggttaaaaaagaatacactcccccagatttaattgactctgatggagaactagaagtactaaatccagacatggcttgtactcgaatggaccattcaaaaccagtcaattga

SEQ ID NO: 3581 - DNA, 441 bp, Xenorhabdus bovienii; identical to SEQ ID NO: 2208
  Coding DNA location: Contig name=SeqID_16892; Position on contig =13257..13697bp; Strand=+

SEQ ID NO: 3582 - DNA, 537 bp, Xenorhabdus bovienii; identical to SEQ ID NO: 2180
  Coding DNA location: Contig name=SeqID_16892; Position on contig =13723..14259bp; Strand=+

SEQ ID NO: 3583 - DNA, 378 bp, Xenorhabdus bovienii
  Coding DNA location: Contig name=SeqID_16892; Position on contig =14260..14637bp; Strand=-
atgtctgtttggtcccagtcatcatttctaaaaaaattcgaaggcctatatacttttaaagaggctaactccatacaaggaaagccaactttaatcacagctagcttaaaagactgtcctgttatcataaaatattggccacatgaatatcacgaaccatcggatattcttgaagatatctggctatatgaaattcgtcaattacgtcgactaaaaggttatcccggattaggagactatattgcgaatttaatcgatacaggcaaagatgaatatggcttttaccttgttcttgatgcaggtaatcgcctacctttatcatactttcttcagaaacctatacaacaacgaacactatctatacattggcttaagtaa

SEQ ID NO: 3584 - DNA, 132 bp, Xenorhabdus bovienii
  Coding DNA location: Contig name=SeqID_16892; Position on contig =14966..15097bp; Strand=-
atgttcatattggcgatatctgcttccaaaagtgcgcagatgtaccacaattcttgcactccctttcaggctacaggagtttttctagtcgctcgaaagcgcttcctctcagacctatggaagcattggtga

SEQ ID NO: 3585 - DNA, 144 bp, Xenorhabdus bovienii
  Coding DNA location: Contig name=SeqID_16892; Position on contig =15497..15640bp; Strand=-
atgaaatgcagtgtcagattcactgcgctgttaagcaggcatgagcctgtcatagtcatgttgtccttttgctgcggcgtcactttcagcggtaaatctgcaaaaagtgacgccttaagtcccgcaaacagtcagcaaaagtag

SEQ ID NO: 3586 - DNA, 156 bp, Xenorhabdus bovienii
  Coding DNA location: Contig name=SeqID_16892; Position on contig =15714..15869bp; Strand=+
atgcaggcggcagtacaacgtactcaaccgataccccgcaatacctcaacccgcgtttactctggcgcacagatatccgtcaaggacaaagcaggcgtttcctgttttgtcagcattgtcgcgcgccagagattgcatgttgtcaggtataagtag

SEQ ID NO: 3587 - DNA, 882 bp, Xenorhabdus bovienii
  Coding DNA location: Contig name=SeqID_16892; Position on contig =15882..16763bp; Strand=+
atgagccgactgattaaggaattgaagttttttgcccggcagggtggaggcagccataaaacctgtcatgaccgcactcggattgcagggcgtttgggcgcattgttattgagcctgaatattcaggttaaaagtcttagccatttgaaagccaaacatgtggaacattacgttgatgcccgtttatctcaggggattgctaaacgcactgtgcaaaatgaaatgtctgcattgcgtaatattttccgcatggcaggcagggagaaactggaaacctcacctcgtttgagcaatcaggcattgggattaagcggaaccagccgagccggaacgaagcagacgatccctgatgctacgtttcaggttgtttatcagaaagcacttgaacatgatgcaggatttgcagtcacactgaaacttgcccgcttgatgggtttacgttctcaggaagcggtgcaatgcagtgcttcattgaaaagctggcggaaacagttagagcaaccggagccgaaactgcatgttgtttttggtacaaaaggcggaaggccaaggcaaacccgtgtattgaatgtcgctgcggtaaaggaggctgtagagcaggcaattgctattgcagaacaacgaggtgggaggttgattgataaaccagatctccggcaggccatgaactactggcggacacataccaccaggattggtttaacaggccgccattctccccatagtttgcgctatgcctgggcgcaggatgccctagcattttaccaacaaaatggttttagcaggcaggaggcaagggcactggtttcaatggatctaggacatggggatggtcgcgggcgttatgttgagcgggtttatagtcagggaggtctggaatga

SEQ ID NO: 3588 - DNA, 189 bp, Xenorhabdus bovienii
  Coding DNA location: Contig name=SeqID_16892; Position on contig =16763..16951bp; Strand=+
atggaaactctgacttttattcgtctagactatgtaatgcagaagaccggactagaaaaatcacaaatcgaccatttgattaggcagggaaatttcctcaaaccgcgcaaattgggtatccgttctatgttatggatagcagaagaagttgatgagtgggctgccaataaagtcagaaaaacgacttaa

SEQ ID NO: 3589 - DNA, 189 bp, Xenorhabdus bovienii
  Coding DNA location: Contig name=SeqID_16892; Position on contig =17011..17199bp; Strand=-
atggtggcgattcagacagggtttgcaataccgggagctatcgtccggcgaggccgaagcctcccctacctgaaccgccatagaaaaggcgaacgcaggcacactggtagaaacatcctaccagtggatagctctacagggttgcaaatccctgaccattggattttgccaatggagcggttactttaa

SEQ ID NO: 3590 - DNA, 369 bp, Xenorhabdus bovienii
  Coding DNA location: Contig name=SeqID_16892; Position on contig =17119..17487bp; Strand=+
atggcggttcaggtaggggaggcttcggcctcgccggacgatagctcccggtattgcaaaccctgtctgaatcgccaccatcaatcaatggaagaggtagcaggaatgattaatattcaaaacgactggcattccgccgatattattggtgcattgcgtaagcgtggtacaaccttggcggcagtttcccgggaagcgggactaagttcttctacattagcaaatgtattaagtcgtccgtggccgaaaggtgaatggattattgcagattacctaggaatacacccttcagaaatctggcctagtcgatattttgataggaatggacagcttattgaaagaaaagctagaaagcagttagttttgtag

SEQ ID NO: 3591 - DNA, 135 bp, Xenorhabdus bovienii
  Coding DNA location: Contig name=SeqID_16892; Position on contig =17476..17610bp; Strand=-
atgagaaaacagaacgagaggaaacttgaaaacaaagaaaaagccatgagaacaaaaacggtttctttgttatctcagagcttaaaatttcagatagtgactttttttctgattaagaacttcctacaaaactaa

SEQ ID NO: 3592 - DNA, 297 bp, Xenorhabdus bovienii
  Coding DNA location: Contig name=SeqID_16892; Position on contig =17725..18021bp; Strand=-
atgttcgaacaacgcgtaaattctgatgtactaaccgttgctactgtaaattcacaagatcaggtaactcaaaaacctctgcgtgactcagttaaacaagcactgaagaactattttgctcaactgaacggtcaagatgttaatgacctgtatgagctggtactggctgaagtagaacagccactgttggacatggtgatgcaatacacccgtggcaaccagacccgtgcagccctgatgatgggaatcaaccgtggtactctgcgtaagaaactgaaaaaatacggcatgaactga

SEQ ID NO: 3593 - DNA, 984 bp, Xenorhabdus bovienii
  Coding DNA location: Contig name=SeqID_16892; Position on contig =18029..19012bp; Strand=-
atgcgtatcggacaataccagttgaaaaactgtcttattgcagctcctatggctggcataacagatcgcccgtttcgatcgctatgctatgacatgggtgcaggaatgacagtatcagaaatgctttcttccaacccacaggtttggaagacggataaatctcggctgcgtatggttcatcgcgacgaatctggagtgcgttctgtacaaattgccggcagtgatcctgatgagatggcggcggcagcgagaatcaacgttgccaatggcgctcagatcattgatatcaatatggggtgcccagccaaaaaggtgaatcgtaagctggcaggctctgcattactgcgttacccggaattggttcaagcaatcctttctgcggtagtcaacgcggttgatgtacctgtcacactgaaaattcgcactggatggtcaccggaagagcgtaactgtgtagaaattgcccaattggctgagcgttgcggtattcaggctcttacaatacatggcaggacgcgatcctgtctgtttaatggtgaggccgagtacgataacattcggacagttaagcagactgttgccattccaattattgctaatggtgacattactgacccgcttaaagccagagcagtgcttgaatacaccggggctgacgccctgatgataggccgcgctgctcagggaagaccctggatctttcgggaaatccagcattatctggaaacaggagaattgctgccaccgatgcctcttggcgaagtgcagcatttaatgagcgagcatgtacgagaactgcatgacttttacggtcaaggcaaaggagttcgtattgcacgcaagcatgtatcttggtacctcaaggaacatgctcctgatgaccagtttcggcgcacattcaacgccattgaggatgccagcgaacagctggaggcgttggaggcatacttcgaaaatttttgcgtaaataaagaaaagagctga

SEQ ID NO: 3594 - DNA, 882 bp, Xenorhabdus bovienii
  Coding DNA location: Contig name=SeqID_16892; Position on contig =19297..20178bp; Strand=-
atgccttggatacaattaagattaaacaccacgggacaacaggccgaagcactcggtgacgagttgatggaaagcggcgcggtgtcagtaacctttcaggacagccacgatacgccgatttttgagcctctgccgggagaaacccgcttatggggcgataccgatgttatcgggctgtatgatgcagaaatggatatgaaagccgtagtcagccaactggagcaggttccacagcttggcaaagggttccttcataaaatcgagcagctggaagataaagattgggaacgtgaatggatggataacttccaccccatgtgtttcggcaaccgcttgtggatttgcccaagctggcgagaagtgccagaaccggatgccgtcaatgtgatgcttgatcccggtctggcatttggtaccggcactcacccaacgacttccctgtgcctgcaatggctggacggcctcgacctgacagataaaacggttatcgacttcggctgcggctctggcattttggctatcgccgctctgaaactcggcgcaaaacatgccatcggcattgatatcgacccacaggcgattcaggcaagccgggataatgcagaacgcaacggtgtatccgcacaattaacactctatttgtcgaaagatcagccagcagacctcaaatgtgatatcgtcattgccaatatcttggctggtccattacgtgaattggcgccgatcattggctcattacctaaatctggtgggctattgggcttgtccggcgtattggcaagtcaggcagaaggtgttgcccaagcctacagcaatgaatttattatcgatccgattgcagaacaggaagagtggtgccgcattactgggattaaaaaataa

SEQ ID NO: 3595 - DNA, 1452 bp, Xenorhabdus bovienii
  Coding DNA location: Contig name=SeqID_16892; Position on contig =20232..21683bp; Strand=-
atgataatgcaaactgaagtgatcttacctctggtaggatatctggcgttggttttcctgctgtcaatctatgcttaccgccgccgccaaacaggcgaatttttgaatgagtattttctcggcaatcgctcaatgggcggttttgtactggccatgaccatcacggcaacctacatcagcgccagttccttcattggcggccccggcgcagcttataagtacggtatcggctgggttctgctgtcgctgatccaattgcccgcgatatggctctccctcggcgtgctggggaaaaaatttgccatcctcgcccgtcgctacaacgctgtcaccctgaatgacatgctgtatgcccgctatcagagccgttttttggtctggtttgccagcctgagcctgctggtcgcctttatcggggcgatgaccgtacagtttgttggaggcgctcgtttactggaaacagccgcaggtatcccctacgataccggattactgatttttggcatttcaatcgcgctttacacagcatttggcgggttcagagccagtgtcctcaacgatgccttacaggggctggtcatgctgctgggaaccgtaatattgctggcaggtatcatctacaaagccggaggtttgtcaaaagccgtcgacacactgcgcgccatcgatcccaacctggtttcgccctacggtgctgataatatccttacagggccatttatggcgtctttctgggtacttgtctgctttggtgttatcgggctgccacataccgctgttcgctgcatttcctatcgggacagtaaagccgtccatcgcggtattatcattggcactattgtgatggcgctcctgatgttcggtatgcaccttgcgggcgctttgggaagagcgattattcctgatctgaccatcccggaccaagtgatcccaactttgatgatcaccgtactaccgcctgtcgctgccggtatttttctggcggcaccgatggccgcgatcatgtcaacaattaatgcccaactgctgcaatcttcggccactatcgtcaaagatctctatttaaatctgttcccccagcaaatcagccaagagaaaaagctctctcgcatttccagctactccactctatttttggggatgctgctgctgctggccgcatggcgcccacctgaaatgctcatttggctgaatctactggcatttggcgggctgcaagcggtattcctttggccactggtgctggggctatactgggaaaaagccaatgcatatggtgccatcggctcgatgatcatcggtgccacgagctacacactgctggccagtttcaatatccagatttttggcttccatccgatagtgccatcgttgttattcagtttactggccttcgggatagggaatatgattggcagccgtaaatgccagcaaaccgccgcatctcaataa

SEQ ID NO: 3596 - DNA, 270 bp, Xenorhabdus bovienii
  Coding DNA location: Contig name=SeqID_16892; Position on contig =21551..21820bp; Strand=+
ttgagcgattgccgagaaaatactcattcaaaaattcgcctgtttggcggcggcggtaagcatagattgacagcaggaaaaccaacgccagatatcctaccagaggtaagatcacttcagtttgcattatcatcctccaatggaacttccttgaatataaacgccaccatcaaccaacagaggatgataaacagggctggcagtagcaggcaggccaattcgaaccagtatggcaatccggttaagcccgtggcatcactgggtaaatag

SEQ ID NO: 3597 - DNA, 186 bp, Xenorhabdus bovienii
  Coding DNA location: Contig name=SeqID_16892; Position on contig =21938..22123bp; Strand=+
atgtggagggaattgtacggtaacctgcggatttattcaggggaaaatgtgccggaaaaattagcaaaccgtatcgttgagtctaattcgggctttatttgcatattaaaaataatcattttattgttgtattatgatggtgggttttctatattttttgtcttattggcgttgcgtttaatttga

SEQ ID NO: 3598 - DNA, 1350 bp, Xenorhabdus bovienii
  Coding DNA location: Contig name=SeqID_16892; Position on contig =22356..23705bp; Strand=-
atgcttgagaaaattgtcattgctaaccgtggtgaaattgcactgcgtatcctgagagcctgtaaagagcttgggatcaaaaccgttgcggtgcactctacggcagatcgtgacctgaaacacgtcctgctggcggatgaaaccgtctgtatcggtcctgcggcatcagcaaaaagttatctgaacattcctgccattatttctgcggcagaaattacctgtgctcaggcaatccatcccggttatggcttcctgtctgaaaacgccgattttgctgaacaagtagaacgttctggttttattttcatcggccctaaagcagaaaccatccgcctgatgggggataaagtctctgccattaacgcgatgaaaacagccggtgtcccctgtgttcccggttctgacggctcattaggggatgataccgagaaaaataaagccattgcgaaacgcatcggctatccggtgatcatcaaggcatcgggtggcggtggtggtcgcggtatgcgcgttgtacgcagcgacaaagatctggaacaatccatcgccatgacccgcgcagaagcgaaagccgccttcaacaacgacatggtctacatggaaaaattccttgaaaacccacgtcatgttgaaattcagatactggcagatggtcagggtcatgccctctacctagctgaacgtgactgctccatgcagcgccgtcaccagaaagtggtagaggaagcgccagcaccgggtatttcggcagaattgcgccgcactatcggtgagcgctgtgccaatgcctgtatcgaaatcggttatcgcggggcaggtacgtttgaattcctgtatgaaaatggtgagttctactttatcgagatgaacacccgtattcaggttgagcaccccgtcacagaaatgattactggcgttgacctgattaaagagcagttgcgcattgcctccggcctgccactgtccatcaagcaggaagatatcgtgatcgaaggtcatgcgatcgaatgccgtattaatgcagaagatccaaaatccttcctgccaagcccgggcaagattacccatttccactctccgggcgggttcggcgtacgctgggaatcccatatctatgcaggatataccgtaccgccttactatgactccatgattggtaagctgatcacgtacggcgaaacccgtgaaattgccattgcacgcatgaaaaacgcactggctgagttgatcattgatggcatcaaaaccaatatcgacctgcaagtagcgatcatgaatgatgagaatttccagaaaggcggaaccaatatccactatctggagaagaaactgggtttgcaggagaagtaa

SEQ ID NO: 3599 - DNA, 456 bp, Xenorhabdus bovienii
  Coding DNA location: Contig name=SeqID_16892; Position on contig =23717..24172bp; Strand=-
atggatattcgtaaaataaaaaaactgatcgagctggttgaagaatccggtatttctgaactggaaatttctgaaggtgaagagtcagtacgtatcagccgtatagcagcagcccagcacatgccaatgactcagcaatatatttcagcgcctgttcaacaacctgtgcaaaccgccgcaccagccattccagcggctgctgaaaaaccagcggaaattatcggtcataccgtctgctccccaatggttggcacgttctaccgctcaccaagcccagatgcgaaagcttttatcgaaattggccagcgtgttaatcagggcgataccctgtgcatcgttgaagcgatgaaaatgatgaaccagatcgaagctgacaaaaccggcgtggttagagcgattctggcacaagacggtcaacctgttgaatttgacgagccactggtcgtcatcgaataa

SEQ ID NO: 3600 - DNA, 462 bp, Xenorhabdus bovienii
  Coding DNA location: Contig name=SeqID_16892; Position on contig =24191..24652bp; Strand=-
atggcagacaagtttcgcattttactcttgaatggccccaacctgaacctgttgggaacgcgagagccagagacctacggcaagttaacgcttgataacatcgtcagcaaactgtcaaaagaagctcaccaatcgggagtcaaattatctcatctgcaatccaatgcagaatctgaattgattgagagaattcatacggcgcggggcaataccgattttattttgattaaccctgcggcattcacgcataccagtgtggcactacgcgacgcacttctagcggtcgatatcccatttattgagattcacctctccaatgtgcatgcccgcgagccattccgccatcactcatatctttctgatattgccgttggcgtgatctgcggattgggtgcagatggttatagcttcgcattacaggcagcggtcaaccgcttgtcaacattcaactcatttacctaa

SEQ ID NO: 3601 - DNA, 990 bp, Xenorhabdus bovienii
  Coding DNA location: Contig name=SeqID_16892; Position on contig =24792..25781bp; Strand=-
atgaaagccttattacttgagcaacacgagacattatcagcctctattcaaaatattgatacctcgcaactgccctcaggcgatgtcgttgtggatgtccactggtcaacactcaattacaaagacgcccttgctattactgggaaaggcaaaattatccgtcaattcccgatggtgccgggagtcgatttttctggtgttgtccatcattctgaagatccccgctttcatatcggccaacacgttttgctgacgggctggggagtaggtgaaaatcactggggcgggctggcagaacaggccagagtctccggtgaatggctgacaccattgccgcaggggttaagcgccagacaagccatgatcatcggcacagccggtttcaccgccatgttatgtatcatggcgctggagcaggggggagtgacaccggaaagtggagaaattgccgttactggtgccagtggcggggtcggtagcacagcgattactctgctgtcacaactgggatattccgtcgtcgccatcagcagcaaaaccgaaaaccaagattatttactttcactgggcgcaaaaacgatcctgcctgccactgattttaatcagccatcgcgttcgctggaaaaacagcgctgggccggcgtcattgataccatcggtggcacagtactggcaactctgttggcacaggtgcattacaacggcactgtcgccgcttgtggcatggcaagtgacagccaactgcccacgactgtgatgccatttattctgcgtaatgttcgcttacagggcattgcatcagtcaccgtgcctgccataaaacgccctgatatttggaaaagattacaaaaattgttacctgacgccttttatcaacaggccaccactgaaatctcattagatcaagtggtcgaatatgccaataaactgataaacaaccaaatgactggcagaacgttggtaaaggtagctgataagaccagtatttag

SEQ ID NO: 3602 - DNA, 105 bp, Xenorhabdus bovienii
  Coding DNA location: Contig name=SeqID_16892; Position on contig =25748..25852bp; Strand=+
atgtctcgtgttgctcaagtaataaggctttcatcattattctctcttgatgggttttttatatccgacaccatcaccattttgacatcaccacaatatagataa

SEQ ID NO: 3603 - DNA, 141 bp, Xenorhabdus bovienii
  Coding DNA location: Contig name=SeqID_16892; Position on contig =26232..26372bp; Strand=-
atgaagcagcgacaaggcgcatcactaactacttttactacttcaataaaagtggctacgttattattcatatcagacacacaatattctacgttacttttctctaacggagcagaaaaaaactgcataaaaacgggttaa

SEQ ID NO: 3604 - DNA, 1023 bp, Xenorhabdus bovienii
  Coding DNA location: Contig name=SeqID_16892; Position on contig =26453..27475bp; Strand=+
atgttttccaacgatttgtccattgacttgggtactgccaatacccttatttacgtcaaaggccagggaattgtactcgatgaaccttctgtcgttgctatccgtcaggacagagccggttcaccaaaaagtgttgccgctgtagggtcggcagcaaaacagatgctggggcgtactccgggtaatatcgcagccatccgtccgatgaaggatggggttattgccgatttttatgtcacggaaaaaatgttgcagcattttatcaaacaggttcacaacaacagtttcatgcgcccaagcccacgcgtactggtctgcgtacctgttggggcaactcaggttgaacgtcgtgctattcgtgaatctgcccagagcgcgggtgcacgggaagtctttttgattgaagagccaatggcagcggcaatcggtgccggtctgcctgtttctgaagcaactggctcaatggttgtggacattgggggtggtacgactgaagttgcagttatttccctcaatggcgttgtttattcctcttctgtccgtatcggcggggatcgctttgatgaagcgattatcaattatgttcgccgcaattatggctccctgattggagaagcaacagcagaacgtatcaaacatggaattggttctgcttatccaacggatgaagtccatgaaatcgaagtacgtggccgtaaccttgccgaaggcgtaccgcgtggcttcaccctgaattccaatgaaatccttgaagccttgcaggaaccattgaccggtatcgtcagcgcagttatggtcgcactggaacagtgcccgccagaactggcttctgatatttcggaacgcggtatggttctgacgggtggtggtgcgctgctgcgtaatcttgatcgcctgctgatggaagaaacaggcattcctgtcattgtagctgaagatcctctgacttgtgttgcccggggtggcggcaaggcgttggaaatgatcgacatgcatggtggcgatctgttcagcgaagactga

SEQ ID NO: 3605 - DNA, 99 bp, Xenorhabdus bovienii
  Coding DNA location: Contig name=SeqID_16892; Position on contig =27447..27545bp; Strand=+
atggtggcgatctgttcagcgaagactgaacgtaactctgcgagctggggggcgattatgtgttatcagagcctccttgctgtttgttcgggagtttga

SEQ ID NO: 3606 - DNA, 1035 bp, Xenorhabdus bovienii
  Coding DNA location: Contig name=SeqID_16892; Position on contig =27584..28618bp; Strand=+
atgaagccgattttcagcagtggatcttctctgcaattacgactctttttagctgttattattgccattattctggttgtggtagacagccgtttcggtttttttaataaagtccgtagctatatggatacggcagtcagtcctttttattttctggccaatgggccacgccaatttctggatggcatctctgaatctctggctacccgtaagcaccttgagatggagaataataccctacgcaatgagctgcggttacagaacagcaaacttctcttgctggggcaactgaaacatgaaaactcccgtctgcgtgaattactgggatcacccgtgcgtcgtgatgaacacatgatggtatcgcaggtgatttcgggtggcatggatccttatcgagatcagatagtcattgatagaggagctaaagatggcgtgtatgaagggcaggctgtcatcagtgatcggggggttgctggtcaagtcatttcagtgagtcatttgagcagtcgggtattgttgatttgtgatccgactcatgggttgcccgttcaggtcatgcgcaatgatctccgtgtgattgctgctggagcggggtgtacggaagatctgcatctagagccgatggcaagcgataccgacattcgtgttggtgatgtgctggtgacatcgggtctgggcgggcgttttcccgaagggtatccggtcgcggtggtgtcttccgtcaaaatagacaaccagcgggctcatgtggtcattcgtgcacgtccattggctgaattacgacgcctgcgctatctgctgttgttgtggggatcaggtaacgatccgtcggaaccgttgccaccttccgcagtacatcgcgcagcaaatgaacgcttgatgcagatgttacctgaggtactgccaaatccacttgaagaaaaaccgcagcttccgacgcaggattcaggtgaaggaaaagaaggcaataaagaggggaataaagtaccgtctgtaacaaagccctcatcttcagctacaggaaatcgtcaatga

SEQ ID NO: 3607 - DNA, 489 bp, Xenorhabdus bovienii
  Coding DNA location: Contig name=SeqID_16892; Position on contig =28615..29103bp; Strand=+
atgaatcaatatcgtagtcgagggcgctgggttatctggttatctttcctgattgcaatcgtgttgcagattatgccgtggccggagcagttctatatgttccggcctaccttactggtgctgtgcttaatttactggctgcttgcgatccctcatcgcgtcagtgtgggtacgggctttgtattaggcatcattactgacttattacaaggcagtgttctcggtgcgcatgctttggctttcagcatcattagtttcctggtggtgttcaagtttcagttaattcgtaatatggcgctctggcagcaagcactggttgtcgtggcgctttcaacgctgatgaatctctgtgtttttctggctcatgctttgataccaaagacgcttttccatccagaagtgttctggaatggcctggtcaatggtattctctggccttggctattcttattaatgcggaaaatccgtcgtcaattttcagttcgttaa

SEQ ID NO: 3608 - DNA, 588 bp, Xenorhabdus bovienii
  Coding DNA location: Contig name=SeqID_16892; Position on contig =29176..29763bp; Strand=+
atgaaaaccctttacttagcttctggctcaccaaggcggcgtgagttggtgggaatgttagacttcaattttgagattctgacaccacaggttgaagaaaaatggcaagaaggggaatcaccgcagcaatatgtcagccgactggccagagaaaaagcacaggctggcgtggcaatagcaccgaatgactttcccgttctgggtgcggatactattgttgtattgaataaccgtattctggaaaaaccgcgtaatccacaacatgctgctgaaatattgagggctttgtctgggcagagccatcaagttatgacggctgtagctttatcgaacagtcagcacaccctaagtgagatagtcattacagatgtgatattccgccagttatcccaacaggaaatacaggaatatattgtaactggggagccgatggataaagccggcgcttatggcattcaaggtaagggcggttgttttgtcagaaaaattaatggcagttaccatgctgttgtcggcttaccactggtggaaacatatgaattaatcacacgatttttggcattagctgatgggaagcattattcatga

SEQ ID NO: 3609 - DNA, 1470 bp, Xenorhabdus bovienii
  Coding DNA location: Contig name=SeqID_16892; Position on contig =29760..31229bp; Strand=+
atgacagcagagttattagtcaatatcacgccatccgaaacgcgggttgcttatattgatggcggtattttgcaggaaatacatgttgagcgagaagcgagaagaggcattgccggaaatatttacaaaggtcgggtgagccgggttctgcccggaatgcaggcggcttttgttgatatcgggctggagaaagccgcctttcttcatgcttcggatattgtgcctcacaccgaatgtattgcgggtgaagagaagaagaatttccatgtcagagatatagccgagttggttcatcaggggcaggatttgatcgtgcaggtggtgaaagatcccctcggcacaaaaggtgcccgattgacgacagatattaccctgccatcccgttatctggtgtttatgccgggagcctctcatgttggtgtttcacagcggatagagagtgaagaagaacgcgaccgcctgaaatctattgtgatggattactgtaatgagcatggagggtttattatccgcacggccgccgaaggtataggggcagaagagctcgtacaggatgccgcatttttgcagcgcctgtggggtaaagtgattgaacgtaagaaacgtaatatcaccaaaaataaaatctacggtgagctggcactggcacagcgtgttctgcgtgattttgcgggcgctccccttaatcgtattcgggtggattcccgtcagacattccttcaattacaggaattcatcgacgaatatattcctgaaatgaacgccaagctggagcattatcagggaaaccagcctatattcgatctttatgatgttgaaaatgaaattcagcgcgcgctggaacgtaaagtagaattaaagtcgggtggttatctgattattgatcaaacggaagccatgacgacaatagatattaatactggcgcttttgtcgggcatcgtaatctggaagaaacgatctttaataccaatattgaagccactcagtcgattgcccgccaactaaggctgcgtaatttaggtgggatcattattattgattttatcgatatgggtaatgaagaacaccgtcgccgtgtgctggcttctttagaacaggcattgagcaaagaccgggtgaaaacaaccattaatggcttttcccagcttggtctggtggaaatgacccgcaagcggacacgggaaagtatcgagcatattttatgtgataactgtccgacttgtcagggacgtggcacggtaaaatccgttgaaacagtatgttatgaaattctgcgtgagattgtgcgtgttcaccgcctcattgatgcagatcgttttctggtttatgcctctcctgctgtgagcgaagtcctgaaaggggatgaatctcacgccttggctgaggtggaaatttttgtgggcaaacaggttaaggtacagacagaacaactctacagtcaggagcaatttgacgttgtgatgatgtaa

SEQ ID NO: 3610 - DNA, 3837 bp, Xenorhabdus bovienii
  Coding DNA location: Contig name=SeqID_16892; Position on contig =31277..35113bp; Strand=+
gtgaggcgactgccggggatattattagcgacagccgcaatagtcgttatcattgtggctttgcttgtcagcgggttacgttttttcctgccacatatcaatgattatcgtcagcaagtggcggaaaaaattgctgctgtgacggatatacctgtccatatgggttatatcaacggccattgggaatcatttggccccagtttggaaatccgtgatatcagcgccaaaacaaaggatgcgagttttcaggctaaaaaggtgacgctttccctgaatgtctggcgttcgcttttacaatggcgctggcatttccgtgacctgtctttttatcaactggaagtcaattatgataagcccctgtttagtgggaaagatgaaaatctactttctgagccagacagcctctcttcctttgttcttgagcaacttaatcattttgatttgcacgacagccgtttgaccttccagacaccatcgggtgaaaaagcgcaactgatactgccacaactgacatggctgaataaagacgatcgccatcgagcacagggaagcgtcaatctctcttcgattaatggtcaggaaggcgttgttcaggtgaaatttgacctgaaagatatcaatggggttctggataatggtgttatttatttacaggctgatgatattgatatgcggttgtggttaagccgttggttaagagataacacggggctggaaagtagccgtttcagtctggcgagctggattaccctgaaagggggaagaattgacagcgggcgtctgcaactgaagcaaggagaagccaactggtatgttggtagtgaaaaacaccagcttgcggtcagtgacctcattctgcaaatgtgccgacagggtgaaggctggctgtttaatatcccgaatctggcaaatctgaaaaccaatggtcagcagtggccagtgggacgcattgcggcgctgtatgtcatgcaggcggacaaataccaaggaaaagatcactggcgtctccgtgctgaaaatattcaacttgaacgtctgaatggaatattgccattactctcttctgtgacaccgaatgttgtcaaagattggcagcatcggcagccgaaggggatgctcaaccactttgcccttgatatcacgcctgaattaccggatagctcaatgggaattgccatcaaatggcaggatgttagctggttacgctggcaggatctgccgtctgtcaaccatttcagtggaacgttgagtggcaataagcagtggggaagtctgaaatttgagctgaaaaacagtaccgttgattatcgcagcttgtttcaggcgccgttcgacattacgagcagtgaagggcagtttgcctggagaaatgaccatcatgggttgaaggtgtgggggcgggatctggatttacaggccaaatcattatggttcaatggggcttttaactatttgttacccaagaatgagccgccagtgctggaaatgcttgcgggaattcgtgttgatgatgcgggagaggcatggcgttattttcccaagccactgatgggggcatcattgacggactatttgacccactctctgattaaaggaaagatcgagaatgccactctgctctttcaaggcaatccccacgatttcccgttcaagcagaacaatggccaatttcaggtttgggttcctttgcgccatgcgacctttcaatatcaacctgactggcctgccttgtttgattttgatatcgatctgaatttccaaaataacggattgtggatgcaggtaccgaaagcgaagttggggaaagtcgatgccacccggctgactgccgtgatccccgattatggcaaacagaagctattgattgacggcgaattatcggggaatggcaaaaatatccacgattattttaaacacagcccattggcagggtctatcggcagtgcgctggatgagttacaacttgatggcagagttgatggtaagctccatctggatattcccttggaggatggcaaagtcaatgcgagtggagaggtggtattgcaagataccgcactgttcatcaagccattggatagcaaaatggaacatgtgagtgggaaatttcgctttgatgatggcaaactgcaaagtgatacattatccgctcagtggttgggacatcctctgtccctgcggtttaccacgcaggatttaccgaagcattatcaggtggatgttgatctgaatgcgcactgggctgccgggaaattaccggaagtccccgctgaaattcgccgccaactatcaggaacgttggattggcaggggaaagtgaacatcgctatacctgcacaaagcacatcttcacacactaaaccgcaacaaaatggtgtgaaataccgtgtttcgatcaatgcagatttgtcacatatcaacagtaaactggctgcattggacaccgaattgctacgggaatggcagggtatcgatgttcttgctgagggggacatgaaccaaatacagattaaaggttcactgggaaaacaatatgcattcaatacccaatggcaattgggaaaaacacatgcccgactacaacgcggtattatgaatagcgagggtaatggcactccaatactgccggagaagtcgctgctggcgttaaacctgcctgagattgatggcgaaaagtggttgccgctgatagcgccactgatgtctggttcatcagaagatgatggcctgttatggccggaaatgttcgaaatttacatgccgtcactgaagattggcggccagcgctggaatcagctcgtcttcaatattgttcaacaggccgatggcatgaaggtcagcgcggtgggagaaaagctcaaaggcaatctgttgatttaccgtcatgagccgtggcaagcctcaatcgattacctttattatgatccgcagtttcctgaagattcatcggctggctccgatacgttaacttcagacaccacggaagccaaaaaatacggcttgcgccattggccgtcactgaatgttaagtgtgcagagtgctgggttgccgggctgaaactcggcaaagtatccggaacggtgatgccggaaggtgattcactggttttgacaaatggacaactggagaaccgtgcgggcaaattgacattatctgggcgctggggtgaaaacgatattggaaactatactcaggccaaagggcaattatcgggacaaagattcgatgagatggcggcttatctggggtttatcgtcccaatagtcgatgcgccgtttaaatttgatttcgatctgggttggcgggggactccgtggaaccccgatattaaaacgttgaatggtacactgacgggcgagacgaaaaaaggtgctatagccaaattgggtggtggtcgggcggggcaattgttaagactgatcagttttgatgcattgctgcgtaaattacaattggatttcagtgacacattcagtaatgatttcaacttcgattccatgcgtggcgacacaacgatcaaaaatggcgtcatgtataccgaaaacttccgtattgatgggctggcggcggacatcgatgcggaaggtcagacagacttggttcgtcgacagatcaatatggagttggtgattacaccggaaatctcgacaacggttggtgtggcgacagcttttgcggtcaatcctgtggcaggtgctgctgtttttgcggcgacaaaagtgttggggcctctgtggagcaaaatatcggtcattcgttaccggctcacgggtagcctcgaacagcctaaaattgatgaagttttacgtcagcttaaggagaataaagggtcatga

SEQ ID NO: 3611 - DNA, 849 bp, Xenorhabdus bovienii
  Coding DNA location: Contig name=SeqID_16892; Position on contig =35110..35958bp; Strand=+
atgaaaaacgtcaatgttgcacttttacaattatgcagtggtgcgaacgtcaaacataatttagcgcaagttgaacagcagattaaacaactgccggatacggtaaaattagttctgaccccggaaaatgcgttactgtttgcagacgctgatacctatcgcaagtatgcagaagaacagggaagtggcccgttgcagcaggctgtgagtgaaatagcacagcgttatggtgtctggttgctgattggttcaatgccgatgatcagtcgggaagagccgacccgcatcacaagcagtagcctgttgtttgatgatcaaggtgaaatccgtgcgcgctatgacaaaatccacatgtttgatgtcaatatcaacgatgaacatggtgcctacaatgaatccaccgtttatcagcgtggggagcacattaccgttgtcgatacgcctgttggccgtttggggatggctatctgctatgatctgcgttttcccggactgtttcaggcactgcgtgaacagggggcggaattgatatctgttcctgctgctttcacccgcctgacaggtaaggcacactgggaacctctcctgagagcacgggcaatcgagaaccagtgcatcattctggcacccgcacaggttggggtgcatggtactcgcagaacatgggggcattcaatggcggtgagtggctggggggaagttatcaagaaaaatcctctgaccgtcagtgcattacagctcaacatccggcgggatagtctgactcacatgcgtgagcagattaaagtcgtgaaacataatcgattccgtccacaactgacttctttgataaaaaagaatacaaattaa

SEQ ID NO: 3612 - DNA, 1446 bp, Xenorhabdus bovienii
  Coding DNA location: Contig name=SeqID_16892; Position on contig =35977..37422bp; Strand=+
atgagtttaacttttgtcagtgactatttactggctgctaataacctgaatcatcaagatttattttctgtattgggacaattggcagagcgccgtctggattacgccgatctctactttcaatctagctaccacgaagcatggattttggaagaccgcattattaaggatggctcctataatatcgatcaaggtgtgggcgttcgggcgatcagtggagaaaaaaccggctttgcctatgcggatcaaatcacgctgaatgccttgcagcaaagtgctcaggcagcacgcagcatcgtacgggaagcgggtaatggcaccgtgcatacattgggtgcggtcacacataaaggactgtacccagcgatagaccccttgcagagtatgagccgggaagaaaaaattgccttgctgcaccgggttgatcagattgcgcgagctgaagatccccgggtacaggaagtgaatgccagcctgacaggggtttatgaacagatgctggtcgcggcaactgatggcacattggccgcagatattcgcccattggtacgtctctctgtcagcgtactggtcgaagaagatggcaagcgtgaacatggttccagcggagggggcgcgcgttatggctacgaatacttcctgcaaacggctgacggacaggttctggcagaacagtttgtccgtgaagcggtacgtatggcactggtcaacctttctgctgttgcggctcctgcgggcacaatgcccgtcgtactgggcgctggctggccgggtgttttactgcatgaagctgtgggacacggtttggaaggcgattttaaccgccgtggtacttcggtcttctccggccagatcgggcagcaagttgcctctgaactgtgtaccgtggtcgatgatggcacgatcgaagggcgtcgtggttcattatctgttgatgatgaaggtgtaccggggcagtacaatgtgctgattgagaacggcattctgaaaggttacatgcaggacaagcttaatgcgcgcttgatgggtgtggctccgaccggtaacggtcgccgtgaatcctatgcacacctgccgatgccgcgaatgaccaacacttatatgttggcggggaaatccacaccggaagaaattatcgccagtgttgatcgtggtctgtacgcaccgaatttcggtggtggccaggtggatatcacttccggaaaatttgtcttctcgacatcggaagcttatttgattgaaaacggcaaaattaccaaaccggtgaaaggtgccacactgattggttcgggcattgaagctatgcagcaaatatcgatggttgggaatgatctggctcttgataagggtgtcggagtgtgtggtaaagaaggacagagtgtaccagtgggtgtcgggcagccaacattgaaactggataatctgaccgtggggggaaccgcttga

SEQ ID NO: 3613 - DNA, 477 bp, Xenorhabdus bovienii
  Coding DNA location: Contig name=SeqID_16892; Position on contig =37467..37943bp; Strand=+
atgaaaaagagcatactagcaggtatcttattgattttggcttttgtatctatcacttttgcccaaggctctgagtcggttggcgcagaaaaatcacagcaaaatacagaggtattggagagcgcctcttctgaaccgattggcgttctgactaaaccgaaacgtgttgcgcagtatcttcgccaacataacaatagtagacttcccgattattacctcacgaaggcacaggcgcgtaatcttggttgggatgcccgtaaaggcaacttatgccaagtctcgccgaatacggcgatcggtggagatcggttttccaatcgtgaaaataagctaccgaaaaaacgtgatcgccagtggtttgaagcggatgtgaattatagctgtggacaccgaggcagtgatagattgctctattctaatgatggcctgatctatctgacagtggatcattacaacacgtttaaaaaattggagtga

SEQ ID NO: 3614 - DNA, 270 bp, Xenorhabdus bovienii
  Coding DNA location: Contig name=SeqID_16892; Position on contig =37948..38217bp; Strand=+
atgaaaaaagtggaatttgattttgaccgtatccctgacttagaaaccttctattgcgaatttaaggagagtttcgatattggtgatcattttggtgcaaacttggatgccctgtgggatgcggtaacgggtggcattgagttgccggttgagattagttttatccacttttcgtcgcagaaacgagtatattttgcggctttagttttgctgtttgaagaagccgaagaagaattggaaggggaattgcagtttaacatagtagagtga

SEQ ID NO: 3615 - DNA, 210 bp, Xenorhabdus bovienii
  Coding DNA location: Contig name=SeqID_16892; Position on contig =38149..38358bp; Strand=-
atggttttaaatatacatcatgaaaataggttatacgattttctttgctcaataagaagtagaacagagcacctgatgaatacctcaggtgctcacggtcatataacagaaagcccaaattcacgaacaagaaaggaaaactcactctactatgttaaactgcaattccccttccaattcttcttcggcttcttcaaacagcaaaactaa

SEQ ID NO: 3616 - DNA, 540 bp, Xenorhabdus bovienii
  Coding DNA location: Contig name=SeqID_16892; Position on contig =38647..39186bp; Strand=-
atggtaaagcagcctgaagattggcttgacaattatcctgcagaagaggaagacgaagagataatctgggtcagtaaaagtgaaattaagcgggattctgaagcactgaaaaagctgggaatggagctggttgaactgagtaaaaacgcactggaacgcattccgctggatgacgacctgctggcagccattgagctggcacagagaatcaagcgtgaaggccgtcgccgccagttgcagttaattggcaaaatgttgcgttcccgcgatccggaaccgattaccattgcactggataaactgaataaccgtcacaaccagcagatagtgctgtttcacaagctggaagaattacgtgacaaactgcttgaagatgcagatggtgccttgacggaagtggttacgttgtatccgcatgtggatcgccagcaactgaggacgctggttcgcaacgccaaaaaagagaaagagaccaacaagccaccaaaatcctaccgtcagattttccaatatctgaaagagctgtctgaatcagcttaa

SEQ ID NO: 3617 - DNA, 1344 bp, Xenorhabdus bovienii
  Coding DNA location: Contig name=SeqID_16892; Position on contig =39385..40728bp; Strand=+
atgatagtcactaatcaatatatcgcggaacagcgcaagcaattggaagatgcggtctcccacgctctcgaattagcgaagaccggttctgatgctgcggaagtctcggtcaataaaacgacggggattagcgtcagcacccgtttcagtgaagtcgaaaatgttgagtttaacagcgatggtgcgctggggatcacggtttatcaccagcagcgcaaaggcagcgcttcttcaaccgatctcagcccagaggcaatagcccgcaccgtgcaggccgcgattgatatcgcccgctatacgtcacctgatccttatgctggcccggcggataaagatctactggcattcgcagcgccggatctggatctcttccacccggctgatttagatacggataccgccattgaactggctgcccgtgctgaacaagcctcattgcaggcagatcaacgtatcaccaataccgaaggcggcagttttaacagccattatggtatccggatatttggcaatagtcacggtatgctgcaaagctactgctcaagccgccactctctgtctagctgtgtgattgctgaacaagatggcaatatggaacgtgattatgcttataccgtcagccgccgttttgacgaattgcaatcaccggaatgggttgggcaggagtgtgctcgccgtactctttctcgtctgggtgcacgtaagttaccgaccatgaaagcgcctgttatcttctctgcggaagtggctacgggactgttcggtcatttggtcggggcgatcagtggcagcagcatttaccgcaaatcttctttcctgctggatagcttgggcaagcagattttaccttcgtggctgacgattgaagagcagccgcatttactcagaggtctggcttcaacaccttttgacagtgaaggtgtgcgtactgcaccgcgtgatattatcaaagagggtgtgttgcagacgtggctgctgacttcctattcagcccgtaaactgggcatggtgaatacggggcatgcaggtggtattcataactggcgtattgcgggtcaagggctggattttgcagctttgttgcgtgaaatgggaactggcctgattgttactgatctgatggggcaaggtgttagtgcggttaccggcgattattcccgtggtgcatccggtttctgggttgaaaatggcgaaatccagtatccagtcagtgaaatcaccatcgcaggtaatttgaaagatatgtgggcgaatatggtgaccgtcggtgatgatatcgaaacacgcagtaatattcagtgtggttcggtactgctgccggaaatgagtatcgccggtcaatag

SEQ ID NO: 3618 - DNA, 411 bp, Xenorhabdus bovienii
  Coding DNA location: Contig name=SeqID_16892; Position on contig =40780..41190bp; Strand=-
atgaaaaaaccaaaaattattattaacgaacttgatgcggaacgtttagattcgctgttggaacaaccggcctttgccaataccagcattgcagaggcgctgaatgcggagttggatcgagctgaaattgtgcctccggtcgaaattccgccggatgttgtcacaatgaacagtgaaattcgctttattgatttgggcagcaacgaagagcgtgtacgcactcttgtgtatccagcgtctctacaggatagtaccaagcacctgtctgtcatggcacctttaggcgctgctcttttgggtctgagggtgaatgatgagataacctggcaactaccaaacagtgaaaaaacccggatcaaagtattagaaattatttatcaacccgaagccgcaggtgaatatcatcgctaa

SEQ ID NO: 3619 - DNA, 210 bp, Xenorhabdus bovienii
  Coding DNA location: Contig name=SeqID_16892; Position on contig =41102..41311bp; Strand=+
atgctggtattggcaaaggccggttgttccaacagcgaatctaaacgttccgcatcaagttcgttaataataatttttggttttttcataccacgctccaaattaggctcaatacaaaataacaccccgcatcacaaggaggggggtgttattttcaaagtaataaaattgatattaggctgttctgacgtgaaaataaagagatcatga

SEQ ID NO: 3620 - DNA, 1233 bp, Xenorhabdus bovienii
  Coding DNA location: Contig name=SeqID_16892; Position on contig =41396..42628bp; Strand=-
atgcgttttaataaaattacactggcaatccttcttggcctaaccctatgccaaggcactgctcaagccgcccctgcactttctttagacaatattcaggcagaacacgttgcagctactaacaacgcttgggttgaaatcaacacgacgactttcgaaaataatatccacacactgcaaagcaaactgacgaaagacaccaaagtgtgtgtagttctgaaaggtgatgcctacggtcatggtatcgatttactaatgccatctgtcatcaaaacaggcataccttgtgtaggaattaccagcaatgaagaagctcgcatcgtgcgtgaaagcggcttcaaagggcaattgatgcgtatccgtgcggcggctgcgactgaaattgaaagtacgctgggctatgacatggaagaaatggttggcgatctagaacatgctaaaactatcgatgcccttgccaaaaaacacggcaaagcaatccgtgtccatttagttctgaacacggggcgcatgagccgtaacggcctggaaatgaaaactgagcagggtaaacaagaagcgctgaaaatcgcccagttacctaacctaaaactggttggcatgatgagccattatgccctaaaagatctggatgcgatccgcgaaggcgtgaatgatttcaaagaacaaacggcttggttgatcaaaaccgccaatctgaaaagaaacgagatcactctgcatgcttcgagctcttatgcgtcaatcagcgtacctgaagcacaattcgacatggtgcgagtcggcagtgcactgtacggcgttctgacccctgaatatccagaattcaagccactgattcaggtaaaaacccgcgttgcttctgttaaaccctatcctaaaggtaatggtgtcagctacgacaacacctacatcctgaaacgtgattccaaactggctaacctgcctgtgggtttctctgacggtttcagctccagcctgtccaacaaagcgtttgttctgatcaacggtcaccgcgcaccggttgtcggcctcgtttccatgaacaccgtcatggtcgatgtaactgatttgcctgatgtgaagagtggcgatgaagtggtcatcttcggtaaacaaggcaaagaagaaattacccaatctgacattcaaaaatggggcggaatgcatattgttgagttctcttccatctggggagaaaccaacccaaggatcgccattacaggcgcataa

SEQ ID NO: 3621 - DNA, 273 bp, Xenorhabdus bovienii
  Coding DNA location: Contig name=SeqID_16892; Position on contig =43073..43345bp; Strand=-
atgacagtcaaaaagcagcttgaaattaaaaatcggcttggtatgcacgcccgacctgcaatgaaactgcatgaccttgtgcaacagtttcaatcgcaggtcattctgcgcaacagcagcaatattcaagccgaagcccacagtgtgattgccatgcttatgctggattccgaacaaggcagttacattgaagttgaggcgacagggtcggatgagcagcaggcactggccgccattattgagttatttaatgccggatttgatgaagaataa

SEQ ID NO: 3622 - DNA, 852 bp, Xenorhabdus bovienii
  Coding DNA location: Contig name=SeqID_16892; Position on contig =43363..44214bp; Strand=-
atggtgctgatgatagtcagcggtcgttccggctccggtaaatccgttgccctgcgtgcgctggaagatatggggttctattgtgtcgataacctgccagtggtcttactgccggaactggcgggcacactggctgaacgctctatttcagcggcggtcagcatagacgtgagaaatatgccggaatcgccagaaattttcgaagaagctctgacgaaactgccggacacgttctcgccacaattactgtttcttgatgcggatcgcaacaccctgatccgccgctacagtgacacacgtcgcctgcatccactatcaaacaaaaatctgtcgctggaaagcgctattgatcaagaaagtgacctgctggaacccctgcgttcacgggcagacttgatcatcgacacctctgaaatgtccgtgcatgaattggcagaaatgctcagaacgcgtttactgggcaaacgcgaacgcgaactgacgatggtgtttgagtctttcggctttaagcatggcattccgattgatgccgattatgttttcgatgtgcgtttcctgccaaacccacactgggaccctaaactgcggccaatgaccggtttagatcgtcctgtagctgcctttttggatcgccacacagaagtacacaattttatttaccagacccgcagctatcttgaactctggctgccgatgctcgaaaccaataaccgcagctatctcaccgtggcaattggttgtacggggggtaaacaccgttccgtctacgtcgctgaacaattagcggactacttccgttcccgtggcaaaaacgtgcaatcacgtcaccgcacactggaaaaacgtaaataa

SEQ ID NO: 3623 - DNA, 468 bp, Xenorhabdus bovienii
  Coding DNA location: Contig name=SeqID_16892; Position on contig =44296..44763bp; Strand=-
atgaacaacgaaacagatttaccactaagctcggtgctttcgcccgaatgtacacgcaacaacgtaccttgttcgagtaaaaagcgcgccttagagattatcagtgaactggcatcaaaacagcttggattaccggaaaataccgtattcgaggccattctttcccgcgaaaaagtgggcaccacaggtatcggcaacgggattgccattcctcacggcaaactggataaagagtgctcacataatgccgttggcgtgtttctgaatctggaacagcctattgccttcgatgccatcgataatcagcctgttgacttgctatttgctttattggtgccgtctgaccagtgtcagacccatttacattcactatcattgattgcaaagcgtcttgcagataagaatctctgccgccgcctgcgttcagcacaaagtgacgaagagctatataaaatcataactgaataa

SEQ ID NO: 3624 - DNA, 288 bp, Xenorhabdus bovienii
  Coding DNA location: Contig name=SeqID_16892; Position on contig =44911..45198bp; Strand=-
atgcaactcaatgtcacaggccacaatattgaaatcaccgatgcattacgcaacattgtgaatacaaaatgcggcaaactggatcaatatttcgataaaattaacctcattcaggtcatactccgagtggaaaaagtgcagaaaatcgctgaagccacggtgtatgtcaatggaggtgagttgcatgcaagctcagagcatgaagacatgtatgcggcaattgatgcgctggcagataagctggcacgtcaattgaccaaacacaaaagtaaattgagacaacattaa

SEQ ID NO: 3625 - DNA, 1440 bp, Xenorhabdus bovienii
  Coding DNA location: Contig name=SeqID_16892; Position on contig =45222..46661bp; Strand=-
atgaagcaaagtttgcaactcaggctcagtcagcaactggcgatgacgccacaactccagcaagctatccgtttgttgcaactttctacgcttgagcttcaacaagagatccagcaggctttggaagctaacccactgcttgaacaggatgatccgcatgaggaaattgacagtcaggaatcccctgatgcggcaactgaggtgatggatacccgcgaagcgcttgaacagaaggatataccggaagaactgccattggatgccagttgggatgaaatttacacggctggcacttcttcggggacaaacagcgattacagtgctgaggattttcccgtctatcagggtgaaaccactcagacactgcaagactatctgatgtggcaggcagggttgacgccgtttactgaaacggattctgccatcgccacctccatcattgatgcgattgatgattcaggctatctgacagtttcaatcgaagagatccttgccagcattggcgatgatgagctgatgctggaagaagtggaaatcgtactcaaacgcatacagcatttcgatccgattggtatcgccgcccgcgatttgcgtgaatgcctgcttattcaactttcgatgctgtcaacagaaacaccttacctgaacgaagccaaactggttgtcagcaaataccttgaactattgggcaatcgagactttcgtaatttgttacgtcagagcaaattaaaggaaaacgccctgaaagaagccatcgatattattcaatcattggaacccaaacccggattagtggtcaatacaggtgaatccgagtatgttattcctgatgtgcttgctcataaagaaaatgaaagctggcaagtcaaactgaataccgatagcatcccccgtctgcgcatcaatcaacactacgcagcgttggggcaacagtcccatagtgaaagcgacagtctgttcattcgcaataatctgcaagaggccaagtggctgataaaaagcctcgaaagccgtaatgacacgttattgaaagttgccagttgcattgttgaacggcaacaagatttttttgaatatggtgcagagcacatgaaaccgctagtactggcagatatcgcctatcaggttgaaatgcacgaatccaccatttcccgtgtgacaacacagaaatatctgtatagcccacggggcatttttgaattgaaatattttttctccagccatgtcaataccgatagcggaggtgaagcctcttctactgcgatacgggcactggtgaaaaaattggtcgcggcagaaaacccggccaagccactgagtgacagcaaattgaccagcatactggccgaacagggcattcaagtagcgcgtcgaactgtcgcaaaatatagagagtcgttatccatcccgccttcaaaccaacgcaaaaaactggtttga

(The sequence listing continues in the following parts.)

What is claimed is:

1. An isolated nucleotide sequence encoding a *Xenorhabdus nematophila* strain Xs86068 protein, wherein said protein comprises the amino acid sequence set forth in SEQ ID NO:6903.

2. The isolated nucleotide sequence of claim 1, comprising the sequence set forth in SEQ ID NO:795.

3. The isolated nucleotide sequence of claim 2, said *Xenorhabdus nematophila* strain Xs86068 having an NRRL deposit number B-30757.

* * * * *